United States Patent 9,976,191 (RICE WHOLE GENOME BREEDING CHIP AND APPLICATION THEREOF) - sequence listing, part 3

SEQ ID NO: 32988 - DNA, 101 bp, rice(Oryza sativa)
  misc_feature (71): n=t or c
ctgacgatgacactggtggtagccccgagaatgatgatgatggagttttggatgattgggaagctgttgcngatgcactctcagtggatgacaaccataat

SEQ ID NO: 32989 - DNA, 101 bp, rice(Oryza sativa)
  misc_feature (71): n=t or c
taaattgaaccagatgatattctattcaagaaagtgactacttttatgttggtatgttactatcagtttcngaggtgtcctgatcacatcttgttggccta

SEQ ID NO: 32990 - DNA, 101 bp, rice(Oryza sativa)
  misc_feature (71): n=t or g
ccacgcttcccgcccttatcactgcactgtcccttccgccggccaaacttccattcctccgtcgcctcatncggctccttgtcagctccggcgttttcacc

SEQ ID NO: 32991 - DNA, 101 bp, rice(Oryza sativa)
  misc_feature (71): n=a or c
atcgtctgatatcttgtaggtatcagtgatacccgttcagacgaggtatacacatcaaccatctatttcanatcgagcatctatttcaaatcgagccgtat

SEQ ID NO: 32992 - DNA, 101 bp, rice(Oryza sativa)
  misc_feature (71): n=t or c
tggtatggttgtattgaagatacaacgaagaagcatctgtatgtatacctttacagcattttgtgaatgantattttaagggcatatagatattttacagc

SEQ ID NO: 32993 - DNA, 101 bp, rice(Oryza sativa)
  misc_feature (71): n=t or g
taaaattacaatagttgtaaccaatcagcaactatttgcttgagagaaatattcactctacgcatattcangaaaatctcattcctgaaataaaacaacta

SEQ ID NO: 32994 - DNA, 101 bp, rice(Oryza sativa)
  misc_feature (71): n=a or g
ccgtcggtccagccagccaccaaccgcccacttaagaatatctcgtctactttcttcgtcacataaaaacnaatataaacagatataacatattatatata

SEQ ID NO: 32995 - DNA, 101 bp, rice(Oryza sativa)
  misc_feature (71): n=a or g
gatacgcccgaaggcgctctcgctttcttctcgcacatcgacatctgtgtactttcttctcgctctccatnagacgggtactccagtgttcatcacgggcg

SEQ ID NO: 32996 - DNA, 101 bp, rice(Oryza sativa)
  misc_feature (71): n=a or c
tgatctgggatcagaatatcaaatgatgttgagttgcctacttgcctcctaccaatcatcaggtaaaaagnttgtgctacaattaatatgccatttggttg

SEQ ID NO: 32997 - DNA, 101 bp, rice(Oryza sativa)
  misc_feature (71): n=a or g
tctcttctccaaatgattaaagatctaagaaccctagaaagctgggcaaaagagaaaccagagattgagcnaccagctctccaaggtttgaaagtatatgg

SEQ ID NO: 32998 - DNA, 101 bp, rice(Oryza sativa)
  misc_feature (71): n=a or g
ctacgtggtcggcttcgccaaatcgtggaggatcgctctcgccgtcttcgccgtcacgcctgccatgatgncgtgcggcatggcctacaaggccatctatg

SEQ ID NO: 32999 - DNA, 101 bp, rice(Oryza sativa)
  misc_feature (71): n=t or g
cttaggtgttactcgccaggaaacatcgataaagaactggtggaagctgcacgtgatttcctaagaaatgnaggaattgttgttgatcctgaagccaaggt

SEQ ID NO: 33000 - DNA, 101 bp, rice(Oryza sativa)
  misc_feature (71): n=t or c
gcctccctcatatgtcggtcctgatcgaatcgcctagaatcaggtataacgagcctgttcattttgatgtnaaaaaaaaaaaccctactaaattttggtaa

SEQ ID NO: 33001 - DNA, 101 bp, rice(Oryza sativa)
  misc_feature (71): n=a or g
cggcacggcaggggagaagcccgctagtccgccgccatccctgacctcgtcgttgtccccgaccttgtctnccgccgccatccccgaccttgccgtcgccg

SEQ ID NO: 33002 - DNA, 101 bp, rice(Oryza sativa)
  misc_feature (71): n=t or g
gaagaatggggagaggaggagaagcggaggggattttgaattgaatggagacgaagagggaaagtggatgnggaaggacagggggagatttggtggtgggc

SEQ ID NO: 33003 - DNA, 101 bp, rice(Oryza sativa)
  misc_feature (71): n=a or c
gttggtaacaccaaccgggagtaaagaggatgaatctttagtaagaggggaagcgacagtttctcgagatnttttttttattttattgttgatttgctaat

SEQ ID NO: 33004 - DNA, 101 bp, rice(Oryza sativa)
  misc_feature (71): n=a or g
aaactgaataatgtcaagatcagacttgagatggtttttcaagtcattatttaagctctcactcaactgtntgcttctcatccctaatgtgtaaacattcc

SEQ ID NO: 33005 - DNA, 101 bp, rice(Oryza sativa)
  misc_feature (71): n=a or g
cttctctggttgaacctcttcatcagccgaattactagatggtgcttccttggcgataccattagttcctntagggttaggatgttggtatttcttaacga

SEQ ID NO: 33006 - DNA, 101 bp, rice(Oryza sativa)
  misc_feature (71): n=t or g
agaccagaacgaacatgcaaactcaacgatttgatgttgacgttaattctttggtggtaggtatggttctnttattttatatctcaccaatatatctcttt

SEQ ID NO: 33007 - DNA, 101 bp, rice(Oryza sativa)
  misc_feature (71): n=a or c
acggtgaaggggtgccgacagtgagctgctggactatatcgtggaactggttcttgctaatgttttagacntgcgactgtggagactgtggagtggccttg

SEQ ID NO: 33008 - DNA, 101 bp, rice(Oryza sativa)
  misc_feature (71): n=t or c
gggagagatcagtacaagccgcaccatggcgaaacaaagcaacataattcttcgtgcttatcttttcctcnctcgctcgctgtggatagcgaaagaaaacg

SEQ ID NO: 33009 - DNA, 101 bp, rice(Oryza sativa)
  misc_feature (71): n=t or c
acagccagatccggtgctcccgagccgtgaatcttccagatttggtgctcccgcaaggcccgaccatcgtnaccgtgccacagcactggggagggagggtt

SEQ ID NO: 33010 - DNA, 101 bp, rice(Oryza sativa)
  misc_feature (71): n=a or g
ggcggtggcggcggaacacccgagcagagcaaagctgctgcctttttgtgctgtttgcgggagagagaganagtttgggccttttgggctgtatacaggaa

SEQ ID NO: 33011 - DNA, 101 bp, rice(Oryza sativa)
  misc_feature (71): n=t or c
ttgtttctttctgcaaccccgtgtactcttaggaaaagagcacgaatggagggacccatctttaatcggtngatcagatttcacagtaattctggttgtac

SEQ ID NO: 33012 - DNA, 101 bp, rice(Oryza sativa)
  misc_feature (71): n=t or c
tggttatggaaaactggcataacaagtaaaaacacagccaaatctaacaactaacaaggctggtccagctnaaagccagttttagagacaggcatgatttc

SEQ ID NO: 33013 - DNA, 101 bp, rice(Oryza sativa)
  misc_feature (71): n=a or g
tgcgcgcgtgaatcggtcgggcggcgatcgagccgaggtgaggtgtgtccatggtggttaccaagatgcgntgggcagacgacggcggcgaaggcgacgac

SEQ ID NO: 33014 - DNA, 101 bp, rice(Oryza sativa)
  misc_feature (71): n=a or g
acaagtctgtctatttatgtagacgggcctattaagagtgcttgcctgcaaatattgatttatacatacanaccggtattatcacgagcggacgatgttac

SEQ ID NO: 33015 - DNA, 101 bp, rice(Oryza sativa)
  misc_feature (71): n=t or c
tgccatcttcgcgaggagtacggtgcagtactttgggtgttagtttactcaaatattcctggctgatctgnacgccatatgatatgggctctctcgcgagc

SEQ ID NO: 33016 - DNA, 101 bp, rice(Oryza sativa)
  misc_feature (71): n=a or g
catcagggattcattgttggtatttttatctctgagcgtgccttaaaaggttgcactcgcaggtgtgagcntagtgatgtgtagacgtgtgtgacttatat

SEQ ID NO: 33017 - DNA, 101 bp, rice(Oryza sativa)
  misc_feature (71): n=a or c
aaaaacaatatatgcaatacagagaagcagcactcccgtgcatggtgcctacacacgagtatatttgtatngatctcgcagaacatactaccaatagttaa

SEQ ID NO: 33018 - DNA, 101 bp, rice(Oryza sativa)
  misc_feature (71): n=a or g
tccatgatatttttcctttttttttttttcatattactcccgatgatcatcctgtcccaaaccgcaccttnttatcaaatgagtaaattttgtacaacttc

SEQ ID NO: 33019 - DNA, 101 bp, rice(Oryza sativa)
  misc_feature (71): n=a or c
caaggacgtcatcggagacgcaatggcacagcgatcctcaccggaggaggagtatgccggcgtcgtgtccngcctcccgagctatcccaagctgcgcctgc

SEQ ID NO: 33020 - DNA, 101 bp, rice(Oryza sativa)
  misc_feature (71): n=t or c
gttctccgaccaccgccccgtcaactccctcttctccgtgcagctcgccgccggcggtaacaacgccaagnccgaccacctccacctcctgctcctccgcc

SEQ ID NO: 33021 - DNA, 101 bp, rice(Oryza sativa)
  misc_feature (71): n=t or c
gtttagcagcttgttgacaacatctacctcggggagatcgcctccgagagtgcgaatgctgtttgtgattncggtgaggcgcatggagaagtcgtcaatgt

SEQ ID NO: 33022 - DNA, 101 bp, rice(Oryza sativa)
  misc_feature (71): n=t or c
aaatacttcttccgttctaaaatgttgctatctaggatttgatttgacccatcatgtccagattcgttgtnctaggatgggtcaaattctattctaggtag

SEQ ID NO: 33023 - DNA, 101 bp, rice(Oryza sativa)
  misc_feature (71): n=a or g
taacgtcgagttccaaccattgtgcgtccaaaacccacccaccgcatggtgagctagcacctccgtctgcngtgcccaatcgaccactttgcacctaccct

SEQ ID NO: 33024 - DNA, 101 bp, rice(Oryza sativa)
  misc_feature (71): n=a or g
ctaagtactggaaagcaagtttcttcggataagagtggtcacacattgtcaaatagcacacacggccctcnatgatgtaactgtttggttaaatcaaggtg

SEQ ID NO: 33025 - DNA, 101 bp, rice(Oryza sativa)
  misc_feature (71): n=t or c
tcgaagggaaacggcacctaaaatgaatgggacgactgacggctgatgaattgcttctgggttctgatctnctccagcaatcaggaacatgtatttgcaat

SEQ ID NO: 33026 - DNA, 101 bp, rice(Oryza sativa)
  misc_feature (71): n=t or c
ctatgcaagtaacgagatggattctaatatgaataaaaagagcaatggcatggtgattatgtttttttttnctagcagtacaaaattggtgtgcatgttgt

SEQ ID NO: 33027 - DNA, 101 bp, rice(Oryza sativa)
  misc_feature (71): n=t or c
ttaggctcacatgcaacagatattaggatacatcatacgctcatcgtaagagattttatcatatgtatagncgtgttccatgtaaaaactcgatatgaaga

SEQ ID NO: 33028 - DNA, 101 bp, rice(Oryza sativa)
  misc_feature (71): n=a or c
tgtccatatgaacctttctaaaaaatatctatatgaactgagactggaaggaaaatatataggtggtgtantggaactgatatcctcattgacttggtagc

SEQ ID NO: 33029 - DNA, 101 bp, rice(Oryza sativa)
  misc_feature (71): n=a or c
attttcaaacctcactttattttttggagtttgtaatgacatggggtattacactactagtttagattggnatccatattttcaacactttgtctgttttc

SEQ ID NO: 33030 - DNA, 101 bp, rice(Oryza sativa)
  misc_feature (71): n=a or c
gtggccaggggaaacaagagttcagaggtgaagagctctgacaggtactacttagctctattgcttttagnattttagagtttaaggttttgactcagctt

SEQ ID NO: 33031 - DNA, 101 bp, rice(Oryza sativa)
  misc_feature (71): n=a or g
cgccgaccaccgccttccactcgaactctctcaccatgttggccacgaagtactacaggtgcagcatggcngtgttgagccctgcgcacatcctccgcccg

SEQ ID NO: 33032 - DNA, 101 bp, rice(Oryza sativa)
  misc_feature (71): n=t or g
cgaacctgcagctgaatgataatattcttcaacacatcattgatttgcttgctcagaaacggaagaaaaantcaagggggacaacataagagcaatcagac

SEQ ID NO: 33033 - DNA, 101 bp, rice(Oryza sativa)
  misc_feature (71): n=t or c
ttggtgcgcgcggccgtctccctcctcacgccatttttttttcctaaaagaactttttcgatcgagtgggntagctttcgcgctcgattcgtcccgcggct

SEQ ID NO: 33034 - DNA, 101 bp, rice(Oryza sativa)
  misc_feature (71): n=a or c
acaacctggctggctaccaacggcatcgaaccaaacaacccctttgttcttcgacaatccagtcatcttanatagaaacggataaaactacatcgtagcac

SEQ ID NO: 33035 - DNA, 101 bp, rice(Oryza sativa)
  misc_feature (71): n=a or g
aaaaacgtccataatttccttttttattatgtgccagcaactcttgtagaaagtgctaatgaaaccatctnggcctggcgctttttcctttggagagtttt

SEQ ID NO: 33036 - DNA, 101 bp, rice(Oryza sativa)
  misc_feature (71): n=t or g
ctagattcatcgcatgattgttgaatgttgagggaaaaaaagggtctgtttatgctatttctacagatgtntctcggtagggttgattgagtagtgtgttc

SEQ ID NO: 33037 - DNA, 101 bp, rice(Oryza sativa)
  misc_feature (71): n=t or c
caatattagagccaaatttatttatcaaggttcccaaccttcactccctcgttttcagcacgtatatttcncaaactgctaaatgatacgtattttgcaaa

SEQ ID NO: 33038 - DNA, 101 bp, rice(Oryza sativa)
  misc_feature (71): n=t or c
ttgagcaaatagcctttgcctcttctcctccctgagaagtgagaatatactgaaataatgtcaacggtggnaatggcatcacccaccagctttatcagcta

SEQ ID NO: 33039 - DNA, 101 bp, rice(Oryza sativa)
  misc_feature (71): n=t or c
gaggaagaagagaagtatgacaaggtgggtcccactgtcagcctctaagggatgtgggtattttggtctanacgaaaaaatgttacatacgaacctgatct

SEQ ID NO: 33040 - DNA, 101 bp, rice(Oryza sativa)
  misc_feature (71): n=a or g
gttcctggactgctcatgtgtctatatagaagattgcactcagcccctggatcgcagtagaatcttccttnactaagcttaattgtctattctttgggtaa

SEQ ID NO: 33041 - DNA, 101 bp, rice(Oryza sativa)
  misc_feature (71): n=a or g
cttacttagttgacttccccttgacgaaagatatggcatagtcaggcacctatccagagaagcagtaattnatggcatgcaaaagaggaaacattgacatt

SEQ ID NO: 33042 - DNA, 101 bp, rice(Oryza sativa)
  misc_feature (71): n=a or g
atgacatgagtgttgaaatgtttgctagcttgattgttgcaatggcgtttaatcggtgttgtaggatccangggggtgaatggttggtatacccaaaaacc

SEQ ID NO: 33043 - DNA, 101 bp, rice(Oryza sativa)
  misc_feature (71): n=a or g
gagacagaagcacacgctcgcccttacaggataacagtacatgaattcgtctgaaactagaacattctganaagaaatggcaagttcatttagaaagcgga

SEQ ID NO: 33044 - DNA, 101 bp, rice(Oryza sativa)
  misc_feature (71): n=t or c
ccctactccaccgtattcgacatctcttcatcagcatggcacacgtacaaatcggctccaacttctccttntaaaatatttaattaagcaagggtgaatac

SEQ ID NO: 33045 - DNA, 101 bp, rice(Oryza sativa)
  misc_feature (71): n=a or g
atcaccatatccttagcgagattggagaaacgtgtaatattgtagataaaggcggagaagattgaggctanagatgtaatgcatcttccattatctttata

SEQ ID NO: 33046 - DNA, 101 bp, rice(Oryza sativa)
  misc_feature (71): n=t or c
gcagtggtggatccgctcgtcacaggacaaccgccacctgatcaagtgtcggctccctccagctaatgtantgtcggccgctcttgtcatcgcctatcgat

SEQ ID NO: 33047 - DNA, 101 bp, rice(Oryza sativa)
  misc_feature (71): n=t or c
gggctgggctgtctacatatatatgcatacatatcgatctctttttttcttcctcaaactaaaacagggcnaataattatatcgaacaaggaaattaatta

SEQ ID NO: 33048 - DNA, 101 bp, rice(Oryza sativa)
  misc_feature (71): n=t or c
agactaaggggttcgccatcatacctgggcgaagctgtgtaatgaagaccgaagggtttgcctccaagctnatcaaacaatcgaagatctatagttggcga

SEQ ID NO: 33049 - DNA, 101 bp, rice(Oryza sativa)
  misc_feature (71): n=a or g
aaaacataaacatgatctcataggcaatgcttctaagaaggaagtaatgacataaacatcgccaccacctntcctaggaatctagatgttgtttttactta

SEQ ID NO: 33050 - DNA, 101 bp, rice(Oryza sativa)
  misc_feature (71): n=t or g
aaacgtgccttaggtcatgttgagtacatggagaacgttgtagaatctgaagaagtgttctcttactctanatgtcttaagcaaaaaggtattaaggttaa

SEQ ID NO: 33051 - DNA, 101 bp, rice(Oryza sativa)
  misc_feature (71): n=a or g
tcagatggtgatatatgataacgagaaagcacagcttggttggatccgtggatcatgtagtaggagccccnagtctattatgtcttcctttccatgatcat

SEQ ID NO: 33052 - DNA, 101 bp, rice(Oryza sativa)
  misc_feature (71): n=a or g
accgttttgttggatcgggtcattttgtgaagccccgctttgtccccttacaattttttgctatatatttntcgataaaatttcttccaaaaatttaacag

SEQ ID NO: 33053 - DNA, 101 bp, rice(Oryza sativa)
  misc_feature (71): n=a or c
ttcggatttaacactatatattattgaaacttcttccgatgaattacttgcatatatacaagacttgcacnaagctagtcaatttggatacatagtatatt

SEQ ID NO: 33054 - DNA, 101 bp, rice(Oryza sativa)
  misc_feature (71): n=a or g
accgtgcctcgcaagtagtcactattgttacccttttccgaggtgtgtgacttgcgccttagaagcagccntcgttattgccctttcttttaggagcacga

SEQ ID NO: 33055 - DNA, 101 bp, rice(Oryza sativa)
  misc_feature (71): n=a or g
gtactactactacgtacgaactgtccattatccgagatcgtcctgcaagaatggtttgcgtaaactcaatntgctttcgcatcgaacatataaaaggatgt

SEQ ID NO: 33056 - DNA, 101 bp, rice(Oryza sativa)
  misc_feature (71): n=a or g
tgctggatcagttcatataccttgccggaacttggaaccaacctacgaggtaacttttttctccagggatnagatttgatcatatgaatcatgaatggtgt

SEQ ID NO: 33057 - DNA, 101 bp, rice(Oryza sativa)
  misc_feature (71): n=a or g
cgatacctataagatataaatcaccgtttcttagttttagccactgtaaaggttagcgctaaagagtatgncgctgacctcttataacgtggctaatatat

SEQ ID NO: 33058 - DNA, 101 bp, rice(Oryza sativa)
  misc_feature (71): n=a or g
tacatatacatacaattggagagaaaattaccaccactagaatctagtaggattaagagagagagagaganagaaaaacaaggcagtaaaattcaccgggc

SEQ ID NO: 33059 - DNA, 101 bp, rice(Oryza sativa)
  misc_feature (71): n=a or c
aaaatcgtcatctcagcggaaacatggaggatggagccatcaagcaagattccagtaaccgctcatataangtaattgaaacagtagtaaatcagcaagga

SEQ ID NO: 33060 - DNA, 101 bp, rice(Oryza sativa)
  misc_feature (71): n=a or c
ttgaatccatccaattcagtcgtgcaggtttggaccatcgagcaattggtcagttgaatcataaagaggcngcatgtgtcagcagatcagtcagaccgccc

SEQ ID NO: 33061 - DNA, 101 bp, rice(Oryza sativa)
  misc_feature (71): n=a or g
aaggcgctggcaaagaaagaaagtgagagtagtgccaatgatgggggtgagcggcactggcttgggaaagngagagtggctgcgcagaggggagggaatgg

SEQ ID NO: 33062 - DNA, 101 bp, rice(Oryza sativa)
  misc_feature (71): n=a or g
tgacaactgacaacaaataatcaattgttgccacgtggttgctgccgacatggtctctatttttatggccnaaaatgctatacacacgactgtgacgtacg

SEQ ID NO: 33063 - DNA, 101 bp, rice(Oryza sativa)
  misc_feature (71): n=t or c
tgccacagtacaaacgggccagaaggttacctcatgctcatgcccatgaccatgtgagtgatcatcatgancatcccaaggatgacgcatgccctgaaaac

SEQ ID NO: 33064 - DNA, 101 bp, rice(Oryza sativa)
  misc_feature (71): n=t or c
cacagactggtcacatccgattgataggggtcagttaggcgcgttgcacatctgccctcaccgcattacangcagtgagggacagttgggacgccgcgtat

SEQ ID NO: 33065 - DNA, 101 bp, rice(Oryza sativa)
  misc_feature (71): n=a or g
ctgtccatcaccattgactcaagactccacaagttaaagttgctgccagcatagatgataccgaatttccntccgccagtggtgtgttctagaagccggcc

SEQ ID NO: 33066 - DNA, 101 bp, rice(Oryza sativa)
  misc_feature (71): n=a or c
ggaagaatcgcagtttaattaatttcttaattaattctcgcttttgaggcagcagcatgtgattaatcccncatacgcgaggatcacacgctgagcaagag

SEQ ID NO: 33067 - DNA, 101 bp, rice(Oryza sativa)
  misc_feature (71): n=a or g
ttggtaagggtggatatggcactgtttacaaaggcagtctatctgatggtagcacaatagcagttaagatnctggaagactccaacaatgatggggaagat

SEQ ID NO: 33068 - DNA, 101 bp, rice(Oryza sativa)
  misc_feature (71): n=a or g
tcaactttttaagagttggtacaatgcatcttaaaaggtacccaacggtgaagtttttcatagctgccccnctgacttttttatatatagtcaaggcgctg

SEQ ID NO: 33069 - DNA, 101 bp, rice(Oryza sativa)
  misc_feature (71): n=t or g
tccacgtccctgaaattcccaaccgtgccctccaccgctgtcacctgttcacgcgccgacaacttgatctncatatcgtttacaagtttaattaattagca

SEQ ID NO: 33070 - DNA, 101 bp, rice(Oryza sativa)
  misc_feature (71): n=t or c
gacgacgaagtcatcataatcgtcatcgtcgtcggtgtaactgtaatcatcgcaatccgtgaagtatctcngtggtgaaaggagcacaccgcctgcgccgg

SEQ ID NO: 33071 - DNA, 101 bp, rice(Oryza sativa)
  misc_feature (71): n=a or g
aagaggcattgaggcatgcgataggagagaaagaccaacttcaactatatgcctatgtttccgttcagctnacccattctgttgatgggtgtgaggacaag

SEQ ID NO: 33072 - DNA, 101 bp, rice(Oryza sativa)
  misc_feature (71): n=a or g
gagtgcttgatctgccaagcacgagtaaatatgggtgcttgatctgccatggctgtgtttagtttctttcnaagttggaagtttggattgaaattgttaca

SEQ ID NO: 33073 - DNA, 101 bp, rice(Oryza sativa)
  misc_feature (71): n=t or c
ttctagatcatcctcttctcgatctcctttttttatcctcatgtcaaactcagaacaacagaacaagacancgaaatgcctcgcttagggccaatcatttc

SEQ ID NO: 33074 - DNA, 101 bp, rice(Oryza sativa)
  misc_feature (71): n=t or c
cttgtattgcggtgtgtgctcgttaaatggaatcatatgtgcgttcagaaaaacatggagacctatatctngagacaaggaaaactcaataatataattga

SEQ ID NO: 33075 - DNA, 101 bp, rice(Oryza sativa)
  misc_feature (71): n=a or g
ttgggaatggtggtaggtgcttggttggggagaagggtgtgggggatttatgatggatgcgatgtggatgnagattggagaggagatgagaggcagcttca

SEQ ID NO: 33076 - DNA, 101 bp, rice(Oryza sativa)
  misc_feature (71): n=a or g
tctagaaaacaaagtcatagcaatccatttgtgcattgatggcagcttcacgttcggcaacccccttatcncaaagggggacggggacgttgcttgccgtt

SEQ ID NO: 33077 - DNA, 101 bp, rice(Oryza sativa)
  misc_feature (71): n=a or g
cagcagacagggttggcctgttaaaccaaagctggctctaaggtttctattcgataacgatgaagataaanattaagtatatatattttttagtttataat

SEQ ID NO: 33078 - DNA, 101 bp, rice(Oryza sativa)
  misc_feature (71): n=t or c
aaaagttttattttgaggtatattgaatatgtgttgcacattatcactctgctcgtgttcgtaggggcganagactcggcaatggggatgcgcatgggcgg

SEQ ID NO: 33079 - DNA, 101 bp, rice(Oryza sativa)
  misc_feature (71): n=t or c
caatttcgtgccaacgacgagtgattcttctgaaacttctacgtcctccatggaccttaaattctagtacngtccaatgaagcatctgaactgaatggacc

SEQ ID NO: 33080 - DNA, 101 bp, rice(Oryza sativa)
  misc_feature (71): n=a or g
atagtatatgtttagtttgcatcattaccagtcttgattaagtgcatacctggtaaagcaagtcaccgttnctgacagcaactagattcgtgctaactgtg

SEQ ID NO: 33081 - DNA, 101 bp, rice(Oryza sativa)
  misc_feature (71): n=t or g
cgaccacggacacgtattaatttctccttagaaaagtgcgcgttgacctaactccagatggtaatatatgntcccctattgtcacacttgatttttatgca

SEQ ID NO: 33082 - DNA, 101 bp, rice(Oryza sativa)
  misc_feature (71): n=a or g
atcagcttaaaaaataacttgtgagcaaaacttttatacttatcttcttagtgactttaaagccaccactnaaaaataaactacaataaaaaaatcaaaat

SEQ ID NO: 33083 - DNA, 101 bp, rice(Oryza sativa)
  misc_feature (71): n=t or c
aaaaaaaaaacggagtcaaaacgttgtgaattggaaggtgtttagaagtagcataaggctattcccaaccnaaaacactgacatagtttctataaactcca

SEQ ID NO: 33084 - DNA, 101 bp, rice(Oryza sativa)
  misc_feature (71): n=a or c
cttttatttatgctactacatctcatatcattgcatcatcattgcaattgagcaaggtcagtctcatagtnaaaaaaaaaggttataaaatgtaagaagtg

SEQ ID NO: 33085 - DNA, 101 bp, rice(Oryza sativa)
  misc_feature (71): n=a or g
gatactagtataaccgatgacctgaccaccggcatgctttctccatcccaaaataacttaaccaaggatgngatttgatccatcctagaacaacgaatctg

SEQ ID NO: 33086 - DNA, 101 bp, rice(Oryza sativa)
  misc_feature (71): n=t or g
tttcctaataaaaacaatagtgacgcatgcttgacagcatggttattaataatggtaagaaaaaaagagangaaaaattggttatatagcattaaaagttc

SEQ ID NO: 33087 - DNA, 101 bp, rice(Oryza sativa)
  misc_feature (71): n=t or c
acataatccctttcgcatctgacacctccagcatttcccgtcagatctggttgccacgacggcgacggggngagcacagcaacaaccatcgcgaccaccac

SEQ ID NO: 33088 - DNA, 101 bp, rice(Oryza sativa)
  misc_feature (71): n=t or c
gacctaaaaacatttggccaatggtcgaactctggttttgattctttgaatgggattttgttcgtctcggngctgataaatattgtgggatttggatcacc

SEQ ID NO: 33089 - DNA, 101 bp, rice(Oryza sativa)
  misc_feature (71): n=a or g
cgtacaaattgaaatggtgtgcgaacagatctatcggtgggtatcagatttactgaacataaggaaagggnaaatcggtaggtaacctgtgttagatcatt

SEQ ID NO: 33090 - DNA, 101 bp, rice(Oryza sativa)
  misc_feature (71): n=a or g
caaatgttctttgatgtttggaaagcattgtggggatgctctgcagtctgacatcagatcccttttgcaanttcaacacacttcctttgaagataaatatc

SEQ ID NO: 33091 - DNA, 101 bp, rice(Oryza sativa)
  misc_feature (71): n=t or c
taatccacttcacagctagctgtagctagcaaatgccacatcacaaagcacaggaacataaaactgttagntttaatacaagtgaatgttttaaattcatc

SEQ ID NO: 33092 - DNA, 101 bp, rice(Oryza sativa)
  misc_feature (71): n=a or c
aatcttaaatctaaagttgtgctaaagaggtgctaaagaggagcataatctcttccatagaagaaaaagangtcacatttgtgacccagtcttcgtctagg

SEQ ID NO: 33093 - DNA, 101 bp, rice(Oryza sativa)
  misc_feature (71): n=t or c
cttgcagcaagcaaggacagctcttgtctttccatctgccactgatctagtacctgtccttaggagcttcngagttttacgtgtactggatttacaaggtt

SEQ ID NO: 33094 - DNA, 101 bp, rice(Oryza sativa)
  misc_feature (71): n=a or g
acaccatgtttaatttgagattcggtgggcgaatcgatagggaaacagatcctctcacattgtcatatcantgtcacaactgtaaactgcacaaagttagg

SEQ ID NO: 33095 - DNA, 101 bp, rice(Oryza sativa)
  misc_feature (71): n=t or c
taacatatgtaatgtggcaaattatcacattttttagtgtattcggacaaattcactatcttatagtgttnccagtaaagatcgtattttttaagtgtcct

SEQ ID NO: 33096 - DNA, 101 bp, rice(Oryza sativa)
  misc_feature (71): n=a or g
agccgtgtaactacacttaaaaaaaatggaggtagtagaaggtaaagctgatattagagcacccgcaatgntaaagtaaggtgctctctataaaacatgta

SEQ ID NO: 33097 - DNA, 101 bp, rice(Oryza sativa)
  misc_feature (71): n=a or g
cgcaaggcccatatatatttctatctaacaagatccacaacctcaccttgttgcgctcaccatggggccantagtgcccgaggacctctcgcatgagctgc

SEQ ID NO: 33098 - DNA, 101 bp, rice(Oryza sativa)
  misc_feature (71): n=a or g
tggggaattggggagcagtgcaaatggtggcttgagaggatggaagacggcgagaagagcaatggaggagnagacggcggcctgagattctccctccagtt

SEQ ID NO: 33099 - DNA, 101 bp, rice(Oryza sativa)
  misc_feature (71): n=t or c
gattacaagtacgggtgccattttcttattctttgatttttggttgactaattggacaagtactactgtanagtactacctgacatctgaaccggtgctgt

SEQ ID NO: 33100 - DNA, 101 bp, rice(Oryza sativa)
  misc_feature (71): n=t or c
tcgcctagtatagtacctggagtgctcgaccatgccataagttttgccgttggttctcacgtccttgggtngggttgctttgctttgggcgtttcatggtt

SEQ ID NO: 33101 - DNA, 101 bp, rice(Oryza sativa)
  misc_feature (71): n=a or g
gtctcgggactaaaatatatctaaacgaaatcttagttaaattataagattccgacatttacactatggtnggttaattatagattgatttatgatgtata

SEQ ID NO: 33102 - DNA, 101 bp, rice(Oryza sativa)
  misc_feature (71): n=t or c
aaatgaaggagaagtgacagcaaaacatacgatcaatcattcagacgctgtcaagaaacaaacttatgganaaatgggctgagaacaccaaattcacaaga

SEQ ID NO: 33103 - DNA, 101 bp, rice(Oryza sativa)
  misc_feature (71): n=a or g
aacttgtagaacagccactgttgatatatatatggtgaataacgtagataattaaattgatgcagggcaanaggtgatgtgctacgagagcccaaggccaa

SEQ ID NO: 33104 - DNA, 101 bp, rice(Oryza sativa)
  misc_feature (71): n=t or c
gagctctacatggtccgcctgaagacaaccttgggatcccagtcgtcgcctgcatcatcgtcgtcgtcgtngtcgccatcgccattgcaggtgggtgtcta

SEQ ID NO: 33105 - DNA, 101 bp, rice(Oryza sativa)
  misc_feature (71): n=t or c
tgaggtggccattgttttgatggcaacatcatcacttgtcatccatggagtaattaaagccttgatttcangaaagttgtggtaaaataaatttgcagttg

SEQ ID NO: 33106 - DNA, 101 bp, rice(Oryza sativa)
  misc_feature (71): n=a or c
ttctcaaacacacatacagacacagcacacacgcccacgcatttacgtgggctactttttttttatcaaangaccgctaattttttttagaaaaaaatcaa

SEQ ID NO: 33107 - DNA, 101 bp, rice(Oryza sativa)
  misc_feature (71): n=t or c
cagctaaactgcatgcattcttttcacgccatagccaagaacccaagacagctacagcacgcagcaatgtnaaacggttgatttgtgccaaaatgtggttg

SEQ ID NO: 33108 - DNA, 101 bp, rice(Oryza sativa)
  misc_feature (71): n=t or c
tcaatttgtccagagtgatggtcatgacgttgccctcattaacctcagataggtctaattgctggatcttntctttaacagaacctgggctagccgaagac

SEQ ID NO: 33109 - DNA, 101 bp, rice(Oryza sativa)
  misc_feature (71): n=t or c
aaaacttgcctttccaacaactgggtttcttctggaatttatcttctagatccttctaatctttgtttganaatcttttgaaatgcataggaaggcctagg

SEQ ID NO: 33110 - DNA, 101 bp, rice(Oryza sativa)
  misc_feature (71): n=t or c
ttagtgtttggtgggagatattctccctccctctctcaatattgtaataacatctagtttacaagtgcttnatgtaatttgttctccttcttgagcaatgg

SEQ ID NO: 33111 - DNA, 101 bp, rice(Oryza sativa)
  misc_feature (71): n=t or c
taccggcggagggcctgttggtaattggctgctgagacggcaactcgttcctcgagtagattcacatcgangtttcgctgctcctcctgatccttgtcgga

SEQ ID NO: 33112 - DNA, 101 bp, rice(Oryza sativa)
  misc_feature (71): n=a or g
gtttttaatcgaagaaaagaatcgtgatagagatgtgcatagcgtagcagttctggaattgttgtcctacngctaaagattagggaataaacaaaactact

SEQ ID NO: 33113 - DNA, 101 bp, rice(Oryza sativa)
  misc_feature (71): n=a or g
caaaacaagttttactcttagctgactttgggtttttcttaaagattagaaggcagatcaggattcacccnccacctgggagatgggcgtaccccgctcag

SEQ ID NO: 33114 - DNA, 101 bp, rice(Oryza sativa)
  misc_feature (71): n=a or g
tatttttatatttaatttacctatacgattaaatagatcatatgttttttcccagtaatctaaacaaaacnaaaatctagtaggatgtagctactggattc

SEQ ID NO: 33115 - DNA, 101 bp, rice(Oryza sativa)
  misc_feature (71): n=a or g
ttagcaaatcatttgggggatatcgatggaagaccattaattccatcattggctttgtgcccatgtttgtntgcaaatgcaatgcattactgtatcaccat

SEQ ID NO: 33116 - DNA, 101 bp, rice(Oryza sativa)
  misc_feature (71): n=a or g
attggctggtctgaccgggccatttggccggtctgaccacggttctcacgttggtcttgccgggccatctngccggtctgaccgccgacctcatgtcggtc

SEQ ID NO: 33117 - DNA, 101 bp, rice(Oryza sativa)
  misc_feature (71): n=t or g
gaactgaaacgcacacgtagaccttaacactccaaggacatcgacttccgcctctcgtcgccggagctcgncggcggcggcggcggctgctgctgctgccg

SEQ ID NO: 33118 - DNA, 101 bp, rice(Oryza sativa)
  misc_feature (71): n=t or c
accacgcatgtacgcacgctcatgagagtgatggagaacaactgcaagtcactgacccattaaattcttangggactcccgtgtgtgtaatattcatgggc

SEQ ID NO: 33119 - DNA, 101 bp, rice(Oryza sativa)
  misc_feature (71): n=t or c
gatgtgacgacgagggacggcaagtggacttattccttatatattggaggaggcccaataagcctacatgngtctcctcagtctcgcaagaacggaattac

SEQ ID NO: 33120 - DNA, 101 bp, rice(Oryza sativa)
  misc_feature (71): n=t or c
acaccatctttcttaatagcacacagggaaaaacccgatgcttaaattttgtttgcatatgctcacatgcncgagtttttcctcaccgaccaataaaaaga

SEQ ID NO: 33121 - DNA, 101 bp, rice(Oryza sativa)
  misc_feature (71): n=t or c
agaaaataaaaaggaaaaaaaaaggaaacgaagcagagcattcacggtgtgcactgcagagtgcagagcancgcaccgctctcccgccaaaaaaaaaaaag

SEQ ID NO: 33122 - DNA, 101 bp, rice(Oryza sativa)
  misc_feature (71): n=t or g
ggaggcaaggagatcaggcggcagaggaaaggggcagatcatagtgacaacacatgcaaaatagagttagntcgggatcacacgaatctgtaagatttttt

SEQ ID NO: 33123 - DNA, 101 bp, rice(Oryza sativa)
  misc_feature (71): n=a or g
gaacagatcgccttgtccatcgagactttgctcgatctcgataccctgtcactggaggagctgacggggcntctgaggaacgccaaggagcaccgccccaa

SEQ ID NO: 33124 - DNA, 101 bp, rice(Oryza sativa)
  misc_feature (71): n=a or g
aaggatctgtgcaagaacttcgctggctttggcagtgcctactatttaacaagttggtccctctagattgncagcttgtaaggataacaacatattgttca

SEQ ID NO: 33125 - DNA, 101 bp, rice(Oryza sativa)
  misc_feature (71): n=a or g
tgaccggtgacaggacaaatcacggcactagacaccaccatcctcttaccttcccggtttcccggcgtgcntcacacatggaggtggcagccgcggattcc

SEQ ID NO: 33126 - DNA, 101 bp, rice(Oryza sativa)
  misc_feature (71): n=t or g
gtaaacccagtagtagtacacagaaagcaccgatcaatcaaaactgacacgcccaaacaggtagtgagaanagaagacaggccccgaatctcggcagtagc

SEQ ID NO: 33127 - DNA, 101 bp, rice(Oryza sativa)
  misc_feature (71): n=t or c
tttttcccgagaaaaaaaaaatgtgcaaaagaagaatcagaggttcagcgtcaatctacttcgaactcagncctgcgctgcgactcctcccgccgcctagg

SEQ ID NO: 33128 - DNA, 101 bp, rice(Oryza sativa)
  misc_feature (71): n=a or g
gacctctccacggacacagtcatacatcatggtggccgtcgcccttcatacaccatccagcatgctagganaggaagccaaggtgttggagcagatctaga

SEQ ID NO: 33129 - DNA, 101 bp, rice(Oryza sativa)
  misc_feature (71): n=t or c
gttttcgaattgggaatgaaattttggaacagctgtgggattttgtttttttccttgtcgtgtgtgcatcngatttggttttgcccattgtgggaacccta

SEQ ID NO: 33130 - DNA, 101 bp, rice(Oryza sativa)
  misc_feature (71): n=a or g
tccaaaacacatttctgtacatccatcaagtctgaaattctttctcctttttacgactcaagaattaaganaaaagagagagagagagagagaatgtgaca

SEQ ID NO: 33131 - DNA, 101 bp, rice(Oryza sativa)
  misc_feature (71): n=t or c
cgctccagcgccatccgcagagtcctcctgtacggcgcgaagaggccgatgtcgccggtgttcttgagccnggtgacgttgtgcatgccaaccacctcgcc

SEQ ID NO: 33132 - DNA, 101 bp, rice(Oryza sativa)
  misc_feature (71): n=a or g
agcccttattgtaaaaccatggaaagtcagcaactttggccaccctaggaattcatctggggaagagctcngcccctccgatagttaaattttttggttgg

SEQ ID NO: 33133 - DNA, 101 bp, rice(Oryza sativa)
  misc_feature (71): n=a or g
cacaccttttttttacccatgggtaagtggggtactggtggctaaagaaccgaatcatacctatcaacctntagcgcccgttccgtcgtggcgcctagcgg

SEQ ID NO: 33134 - DNA, 101 bp, rice(Oryza sativa)
  misc_feature (71): n=a or g
agtcctaaaaagagcagagcgacagaacctctgcacacatagaccagttttacatgcaagtatcttgaggncataacttgctgctccaaaattcaaattta

SEQ ID NO: 33135 - DNA, 101 bp, rice(Oryza sativa)
  misc_feature (71): n=a or g
ggtgattagctgttgaacactagacgcattattttattatatttagtacaaacgtagagagaaacagtgtngaatgcaccaatttgcccccgtgtccatag

SEQ ID NO: 33136 - DNA, 101 bp, rice(Oryza sativa)
  misc_feature (71): n=t or c
tacctgtacagactgtagtcacagctaaagaatctcatgagaagagaacaggataggccacatgctaatgnacaacttcacatgtttggttctgacattgc

SEQ ID NO: 33137 - DNA, 101 bp, rice(Oryza sativa)
  misc_feature (71): n=a or c
ccgctcccaggtcagccatccactctctccgccattgatatcgctcactcactcactgtgcccgccattgntgctgctgcagtgggacgtcctgtcgcacg

SEQ ID NO: 33138 - DNA, 101 bp, rice(Oryza sativa)
  misc_feature (71): n=t or c
gcggcttcaccccgcgttcgcactgacatggtggcggcggtggcgtcgttgtcctttgtcaccgccattgntggcgccctgggtatcacaatgctggggcc

SEQ ID NO: 33139 - DNA, 101 bp, rice(Oryza sativa)
  misc_feature (71): n=t or c
tactttccttgggccgccagaacatagtgcccttgttattcttccgcataaaatgggttattgtcagcatnaaaatcaaaacctctacagttcatctacat

SEQ ID NO: 33140 - DNA, 101 bp, rice(Oryza sativa)
  misc_feature (71): n=a or g
ggtaacgtaggcgtggatccctgcagtattatccaattccaagcccatatgccagtggcttttaatgcacnttaatactatagagaatcctcatcggtgat

SEQ ID NO: 33141 - DNA, 101 bp, rice(Oryza sativa)
  misc_feature (71): n=t or c
cgattcgatgtagcttaggctcgagcctaatttcctcgtacctgcaaaagtacatatatagacgagttgcnagaaagaaaaaaaaaaaaaacagtgctggc

SEQ ID NO: 33142 - DNA, 101 bp, rice(Oryza sativa)
  misc_feature (71): n=a or g
atcgattcagccacacctcgacagagcatcgattcaactgcttcaagctctaagaagaggaagaaagacancaacaaactgaaaaataccttgtcaagtga

SEQ ID NO: 33143 - DNA, 101 bp, rice(Oryza sativa)
  misc_feature (71): n=t or c
ccggctatctggtcaccccgcgttttcctcgcggagcacacaatatattatgtatgtgttcaaatctcacngatgacggcatgacgcacagagacaggagg

SEQ ID NO: 33144 - DNA, 101 bp, rice(Oryza sativa)
  misc_feature (71): n=a or g
ggcagtgaccgcacgggcacccacgacaggaggttggagccgactcccatggtgagcatacgtgtgatgcngggacaaagagcccaccaccgccgtcgtgg

SEQ ID NO: 33145 - DNA, 101 bp, rice(Oryza sativa)
  misc_feature (71): n=t or c
ttgacatttgtaggggaggtggagctggcaccagaacctaccttaggagcactcctcccgatgctagtggntgtcgcccttccactcctcctgtagtcgcc

SEQ ID NO: 33146 - DNA, 101 bp, rice(Oryza sativa)
  misc_feature (71): n=a or g
ctaatcgtacttcattttttttagcattgacaagtcgctccgaacacatatatagatgtttattatttctntaacactaataaagcgttatggcttataat

SEQ ID NO: 33147 - DNA, 101 bp, rice(Oryza sativa)
  misc_feature (71): n=a or g
atctggtcctgacgctctgggtgaaatatgactgcactcaaagcgaacgggaaaaaggcaaaaggcagatncggttagaggaagcagatcttgcaacggcg

SEQ ID NO: 33148 - DNA, 101 bp, rice(Oryza sativa)
  misc_feature (71): n=a or g
tggggggggggggggggggcgtgggggttggtggtggtttgggacttggtggtagtttggtgcttggagtnaacagggtggggcttgggaagttgggatcc

SEQ ID NO: 33149 - DNA, 101 bp, rice(Oryza sativa)
  misc_feature (71): n=a or g
tgtgaccttccacacttccatcgtccatgattgtaaggagagtgccaagtcactaaagggaggattctctngacagaacctagaatttagcaaagtaaatc

SEQ ID NO: 33150 - DNA, 101 bp, rice(Oryza sativa)
  misc_feature (71): n=t or c
tcctttgtcaatattctaaaaaacaaagtttgaccacactcacgagtagcaacaatggttctttgaatttnagtgaggcaaggaatccaatatccaataag

SEQ ID NO: 33151 - DNA, 101 bp, rice(Oryza sativa)
  misc_feature (71): n=a or g
atccgacggttaatgcgtcattaagcattggtcccagcgggaaagcatcaaagacaagctgctacgggatntcatttggccggaccagagcttacaatttc

SEQ ID NO: 33152 - DNA, 101 bp, rice(Oryza sativa)
  misc_feature (71): n=t or c
atacacgtgtggtccaaatggtatgaagaatcttgatgtggcctcaaatataccatttatgccacaccacncatttgatctaacgctagtttctaagtttc

SEQ ID NO: 33153 - DNA, 101 bp, rice(Oryza sativa)
  misc_feature (71): n=a or g
gcatggcattgttagaaaagagtctggtagtgatactacatttgagcccccttgattccatgaggaagcantataagagcaggtacaatagcaggatacag

SEQ ID NO: 33154 - DNA, 101 bp, rice(Oryza sativa)
  misc_feature (71): n=a or g
gtccaatcatgtgcttgcgattcaacctgctatctcatttcacactaatcgcgcgttatctcatgcgtgantatagactatctagaagaaaagagagaaaa

SEQ ID NO: 33155 - DNA, 101 bp, rice(Oryza sativa)
  misc_feature (71): n=a or c
aaagggtttcgccattcgtggctgtcagcgaacgagattgaccagctggcgtgttcctttgctcctttggntgagagggtcttctcgtccatgaactagca

SEQ ID NO: 33156 - DNA, 101 bp, rice(Oryza sativa)
  misc_feature (71): n=a or g
caatcaaattttcacgcatttggtaccctaccaccagggaaacaaaattctccctccaagacatatttcantgtctggtggcgcggaggaatacaaatttc

SEQ ID NO: 33157 - DNA, 101 bp, rice(Oryza sativa)
  misc_feature (71): n=a or g
tcgttgggtccatagaccacgtgtaagtaaactattggccaatatttgaaggatttattatgtgggccaanaatgccaacctctcctctattttctcgtcc

SEQ ID NO: 33158 - DNA, 101 bp, rice(Oryza sativa)
  misc_feature (71): n=t or c
ggcggcggcagtggtggtggtggtggtggtggtgaaggtgataatggtggtgttttctttgtttctcctgntggggtcgtggaacaagttggggaactagc

SEQ ID NO: 33159 - DNA, 101 bp, rice(Oryza sativa)
  misc_feature (71): n=a or g
tacatcagcaccatgctcaagcagaaccttcgcaacctgatcatggtcatttgcggtagccaagtgcagcngggccccactataattcagaggatccacat

SEQ ID NO: 33160 - DNA, 101 bp, rice(Oryza sativa)
  misc_feature (71): n=a or g
ctcggctgcaatcatacaagtcaccaagagattctccgatcctaattttggaaccaaatttgtgttcttcnttgaggttctaacctcacctctctcgtttt

SEQ ID NO: 33161 - DNA, 101 bp, rice(Oryza sativa)
  misc_feature (71): n=a or g
ttggtagcgctgacagaaaacactctgttttggtctctagctggtgatcccagcatgaagtcgtgttacgnaagtcaatacatgcatagttttattgttgg

SEQ ID NO: 33162 - DNA, 101 bp, rice(Oryza sativa)
  misc_feature (71): n=t or g
acggcgcccaacgtggtcgggtctacacttttgggatcgaggtttacagcagcgtgatgatgcagattganggcgccccggccgtctaatagacattgctt

SEQ ID NO: 33163 - DNA, 101 bp, rice(Oryza sativa)
  misc_feature (71): n=t or g
gaaccgtctttgaattttgagatcagtaaactgtaaacatgcaactgaactgcagctgttccagtacgcangcactgcataatcactcagcgagtgttgtt

SEQ ID NO: 33164 - DNA, 101 bp, rice(Oryza sativa)
  misc_feature (71): n=t or c
cttgcgcactgattttcggactgaacaccaccaagaggaaagatcttctgatggcaccgagcaggaaaggntaagccgatctcgaatccttgtccaaacct

SEQ ID NO: 33165 - DNA, 101 bp, rice(Oryza sativa)
  misc_feature (71): n=t or c
cacaaattaactgcgtcatttgtatggttagccactcctccgtgctgtatttccttgctcatctctttgcnatccactcaccggattcctccacacaacag

SEQ ID NO: 33166 - DNA, 101 bp, rice(Oryza sativa)
  misc_feature (71): n=a or g
actgtgacatataatatgtctatttttgctccctattatttttttgtcgggcctggccgaccggcccaacntgccggtggaggggcccaggcaaagcccgg

SEQ ID NO: 33167 - DNA, 101 bp, rice(Oryza sativa)
  misc_feature (71): n=t or c
accagaccagtcatctccgcgccaccagagttgaacgatatggctgggaagaccctacacaagtttgctantccctctgctgacaacgtgcctattggacc

SEQ ID NO: 33168 - DNA, 101 bp, rice(Oryza sativa)
  misc_feature (71): n=t or c
tagtaactcgcaaatacatgtccttcaactgacatatgtcttgcccaggtctttacaggtacagggttggngatgtgcttcaagtgacaggcttctacaac

SEQ ID NO: 33169 - DNA, 101 bp, rice(Oryza sativa)
  misc_feature (71): n=t or c
ggtttgagtccctttctgtggaatatatttgtaagattgccatggttaagtcagcagggagatgccatgtnggcgaggtcctaggtgatgagccaattgat

SEQ ID NO: 33170 - DNA, 101 bp, rice(Oryza sativa)
  misc_feature (71): n=t or c
gcagcacatgaagacaatacgagaggaggcattggtgagaatgttcatcaagacccatcaaggagtggttngtcagtctgatcctcctctcaaactcgtct

SEQ ID NO: 33171 - DNA, 101 bp, rice(Oryza sativa)
  misc_feature (71): n=a or g
gaagttcttgactggaacttgtactctctccttaccagtataaagtaatctagaactagagtggacatatnacatattctaatataatgaattgtaaattt

SEQ ID NO: 33172 - DNA, 101 bp, rice(Oryza sativa)
  misc_feature (71): n=t or c
tctcaccattttaatatgttatgagatgtgataataagaacgccatttaatttaaccccccccctctcctngcgtaggaggcatcacggttctttcattag

SEQ ID NO: 33173 - DNA, 101 bp, rice(Oryza sativa)
  misc_feature (71): n=a or g
ctccggtctgaccggcaacacctgcctggtctaacccgacacgacaataagcagtccatattcatcacctncaaatccaattatctccaaaaccactttgc

SEQ ID NO: 33174 - DNA, 101 bp, rice(Oryza sativa)
  misc_feature (71): n=a or g
ttttgcttttgctggtttttttttctccctcttgtttttcttccttttttgggactctcagctgttcctgntttaataatccggtagtactagtagtaaat

SEQ ID NO: 33175 - DNA, 101 bp, rice(Oryza sativa)
  misc_feature (71): n=a or g
agagatggtaaaggggataatgctgtggatatcaatcccccgtgggtcaatcggctcggctcagttttgtntgggtatcagcttttttaaaaaacggatac

SEQ ID NO: 33176 - DNA, 101 bp, rice(Oryza sativa)
  misc_feature (71): n=t or c
ttcatgctcttcaatgtggaccgggcggccctttctgaacttcttttctgatacgaaaataggccataaangtggggaaaaagtacaccgaaggtccctca

SEQ ID NO: 33177 - DNA, 101 bp, rice(Oryza sativa)
  misc_feature (71): n=t or c
agcaactgaaaaaataagcacaacacagaacagaaaacacaaactgagctttggattgtgcaaggaacatnctgaatggatatatagagtatctagagatt

SEQ ID NO: 33178 - DNA, 101 bp, rice(Oryza sativa)
  misc_feature (71): n=a or g
ttgaaatatacgacttagtagaactaatacagagcatgtagcgctctatttgagctaagtagcatgtattntaacaactaaaaaaaataccaacttttaaa

SEQ ID NO: 33179 - DNA, 101 bp, rice(Oryza sativa)
  misc_feature (71): n=t or c
gcaggtagatcatcagctggtgtagtcttctttgtcttagctgtcttagccggggctgaaatatttacagncgatgatttgttgtttcttttcttggcagc

SEQ ID NO: 33180 - DNA, 101 bp, rice(Oryza sativa)
  misc_feature (71): n=t or c
catcttttgcttcttcagctcattcacttatccgcaaatcattctcatatggggaaactttatcgccttcnacatgatcaacttaatagtcagtgcggtac

SEQ ID NO: 33181 - DNA, 101 bp, rice(Oryza sativa)
  misc_feature (71): n=a or c
gcttaattaagcttgcacgcaccaaccgtccctctttcgctcacactcttccttccactctcccaatactnactcactctctctaagtttttgtgtataaa

SEQ ID NO: 33182 - DNA, 101 bp, rice(Oryza sativa)
  misc_feature (71): n=t or c
ttaattaatgtccaagaaaaaaccgacctagtaattatcgtcggtgacaagaagtttgcttgtgtcaaaantattgggccaggcatgggttacccgttggt

SEQ ID NO: 33183 - DNA, 101 bp, rice(Oryza sativa)
  misc_feature (71): n=a or g
ggaacaattttcgtaggcatatggtatattttagccgcccgtgaaaatcgattttgatagccggccacccncctacctaaacgcgttaaaaaatatacggt

SEQ ID NO: 33184 - DNA, 101 bp, rice(Oryza sativa)
  misc_feature (71): n=a or g
tgaggaagggaagcataaaatgacaaccactatataataatgatgagagagtggggtgtggttcgaaggcngcaagaagggtaggaggatggaggaatatt

SEQ ID NO: 33185 - DNA, 101 bp, rice(Oryza sativa)
  misc_feature (71): n=t or c
gtaggggtttgaccaagggacaagaagaatatctaaggaagtccatcctatcaggagttcagcaccattgncccctatgttatctttccactcacattgct

SEQ ID NO: 33186 - DNA, 101 bp, rice(Oryza sativa)
  misc_feature (71): n=a or g
accgacattgtcgtagctcccatgccagatccgccatcgctgaggtcatccacgccgccagatccatcctntcattgtggtcccagcgccggatccactgc

SEQ ID NO: 33187 - DNA, 101 bp, rice(Oryza sativa)
  misc_feature (71): n=t or c
gcccgtgtttcggtgtttggggctttgggccatggggcgcgggtgcgtgagagcaagtctaatagtacagnctccaattcatctatagttaatctaatagc

SEQ ID NO: 33188 - DNA, 101 bp, rice(Oryza sativa)
  misc_feature (71): n=t or c
gttacatcatcctcaaatacgtcttcctgccatcctggaccttttttttattatgcagtactacttattgnaaaatctttgcagtgggagaaatcgtccca

SEQ ID NO: 33189 - DNA, 101 bp, rice(Oryza sativa)
  misc_feature (71): n=a or g
agtgagtattactattgtaccgtgtttaattacgtaggagaagtgatattactatgaacactagattttgntttttctatgaaaatattttatatatatat

SEQ ID NO: 33190 - DNA, 101 bp, rice(Oryza sativa)
  misc_feature (71): n=a or g
ttggtaaattttattatagcacatggtgagtggtgacttcgcacgaaaccatttttagggaacacactatnaaaatatggttatttatcaggagacaattg

SEQ ID NO: 33191 - DNA, 101 bp, rice(Oryza sativa)
  misc_feature (71): n=t or c
cttatgcgctggtggcatagactacttcgtgatggaccatctcgaccactcgtcccttgccatgacccgcnttccagacatgccgcctcgcgtgtggggca

SEQ ID NO: 33192 - DNA, 101 bp, rice(Oryza sativa)
  misc_feature (71): n=a or c
tttttatttcggatccagggattgaattttgttgatttagcgagtatgacttatagtacgttttgacctangaattcagtttgaggtgaagatggctgaat

SEQ ID NO: 33193 - DNA, 101 bp, rice(Oryza sativa)
  misc_feature (71): n=t or c
cttgatgcaaatatcaaagtgtccttaaactgataggcttgaaattccctgtatgattctcaaaaggatcncatgatggtaggtaggtagactgctgttac

SEQ ID NO: 33194 - DNA, 101 bp, rice(Oryza sativa)
  misc_feature (71): n=a or c
gatcaaacgcaagctagcttcccatggtattcggtgttgttttgcccgaaaagcaatctatttacacctgnaaactgcatatatgaaacgcatgagtttgt

SEQ ID NO: 33195 - DNA, 101 bp, rice(Oryza sativa)
  misc_feature (71): n=a or g
agaggagagagcgctaaaacgaaagcaagcaaagctagctagctagcgtcgtcgtagatacacacacagantcacagatcctactacaaaagacgatgagg

SEQ ID NO: 33196 - DNA, 101 bp, rice(Oryza sativa)
  misc_feature (71): n=a or c
gagaccgaccgtcgaccgaggaggagtggacggctggtttcgagtccctccttccaaaagtataaaagtancatttcattctttgattcttttaaaagtct

SEQ ID NO: 33197 - DNA, 101 bp, rice(Oryza sativa)
  misc_feature (71): n=a or g
gtaggccatatatttgtcggtgtataatatgaatatgacttgagaagatatagtcgaggtgattcaaagtncaacaaacataaagttatctagtataaaat

SEQ ID NO: 33198 - DNA, 101 bp, rice(Oryza sativa)
  misc_feature (71): n=t or c
tttttgcatttgctgaaatgagcgatgaactgatcgatcattctgctgcccaattgttatttctaacccantatctaacaaaaaaaattgttatttctaac

SEQ ID NO: 33199 - DNA, 101 bp, rice(Oryza sativa)
  misc_feature (71): n=t or c
aatggaattattggggctcattcgtctaccctgtctgacgggaccactgatctaccgaggattcacaattncgacgaaaaccgataaaattctgtgaaatt

SEQ ID NO: 33200 - DNA, 101 bp, rice(Oryza sativa)
  misc_feature (71): n=t or c
gacatcagctttcttcgtttcaaaagaggagcagtttccctcccactggatctggcggaaaggaggacgcngccgctgcgccgctacctcccgggcaggcg

SEQ ID NO: 33201 - DNA, 101 bp, rice(Oryza sativa)
  misc_feature (71): n=t or c
atttcgttgtcttcagaatgaccatcctcaaactcgatagagatttccgaaagctgaatttcttcttcctncggctcccgaggtttagatgagagcttaaa

SEQ ID NO: 33202 - DNA, 101 bp, rice(Oryza sativa)
  misc_feature (71): n=a or c
cagcctccgggcagtcaatctgtccggcaacctcatcggtaaattatcacgttcttttctcgttaagatanatattttatatcgattttcgttagcatact

SEQ ID NO: 33203 - DNA, 101 bp, rice(Oryza sativa)
  misc_feature (71): n=a or g
agaaatcttcctttatttttacaaatcataaaagatgacccttatgtgaatgtacgagatataccatcaangactgcatatgaaaattgatttccacaggc

SEQ ID NO: 33204 - DNA, 101 bp, rice(Oryza sativa)
  misc_feature (71): n=a or g
cttagagtagtaaaaaatagaaaataatgcgatccgtattgcaacagtaaattcacagcaggtggcagaanaggtctacaaatgatcatttgataactaat

SEQ ID NO: 33205 - DNA, 101 bp, rice(Oryza sativa)
  misc_feature (71): n=t or c
catgctgcctcctccatgcacctctactacatgacagccacctcagtcacacctcatccctgtatgagtcngtcaaaactgtgcgccatccacttcggatt

SEQ ID NO: 33206 - DNA, 101 bp, rice(Oryza sativa)
  misc_feature (71): n=a or g
cgggaggactgaaccaaatattctgtgatcggtcggttgcttgcttctagtttctctcaacttgtgtgagngctcgttcgaatgtttgatgtgtgtatatt

SEQ ID NO: 33207 - DNA, 101 bp, rice(Oryza sativa)
  misc_feature (71): n=t or g
ccaccgaattggtactcttgtgcgatctcgtggttcacctccgaaattcgctcaattatacatctatgatncagaaaatgaaatacaaaacaggctaaata

SEQ ID NO: 33208 - DNA, 101 bp, rice(Oryza sativa)
  misc_feature (71): n=a or g
acacgaacactgcaccaaccaaaaaaaaaaaagaaagaaaccgtgagatcatcaccacgcttgcacggccngcgaaatcctcgccggcgatcatctcggcg

SEQ ID NO: 33209 - DNA, 101 bp, rice(Oryza sativa)
  misc_feature (71): n=t or c
tcacctccctctgctggtgtcggcctccacaccggcacgaagatttgacaaggaagtactccctccgtttnacaatataagtcattctagcattttccgca

SEQ ID NO: 33210 - DNA, 101 bp, rice(Oryza sativa)
  misc_feature (71): n=t or c
cttgtttacaactttattagatgtccgaaccaatattttgaagtgatgcagccaagctgattggttgtcantgcataatgcatactgcatgaatttgctga

SEQ ID NO: 33211 - DNA, 101 bp, rice(Oryza sativa)
  misc_feature (71): n=t or c
tgtcacttcaggtgaaaacgaataatgcaaatcaatattgcagtcattttaattgctgctttaaaacttgnaacatcaagagatacttaataataccatat

SEQ ID NO: 33212 - DNA, 101 bp, rice(Oryza sativa)
  misc_feature (71): n=t or c
cttacaacaaatttaagtgctaccattttgaagtcaatttcacagccccatacatgtagattgccattggnactgaggtacagttgtcagtcttgaaactt

SEQ ID NO: 33213 - DNA, 101 bp, rice(Oryza sativa)
  misc_feature (71): n=t or c
gcagaacaaaacctttgagcacgtcctgcggtatgatttttttttccgaacatcaaggatggcacatgatnaatttaagaaatacaacacaaagatataca

SEQ ID NO: 33214 - DNA, 101 bp, rice(Oryza sativa)
  misc_feature (71): n=t or g
caagcagccagtactagatctacaccgaccgaatatagatcttgtcaagtttctctgatcagatcatgcangacccacaggccttcagaagttcatgtccc

SEQ ID NO: 33215 - DNA, 101 bp, rice(Oryza sativa)
  misc_feature (71): n=a or g
agctccactgtatattttcctcggtattcacactgccgaagtagactacctatataggttacgattgtgcntactagcgtgtgggaaaacttggatactca

SEQ ID NO: 33216 - DNA, 101 bp, rice(Oryza sativa)
  misc_feature (71): n=t or c
ttttcatctctatttgattagttctgatggagattaattggaggttgggatttctgatttttggtccgaantgtttttgttgcggagctgttctaattcgt

SEQ ID NO: 33217 - DNA, 101 bp, rice(Oryza sativa)
  misc_feature (71): n=a or g
ctaataattgtcataggtagtggaccgagaggatgaggtcataaggatagggatagagatagagttggttngataagattagactgagtcctcccctctgt

SEQ ID NO: 33218 - DNA, 101 bp, rice(Oryza sativa)
  misc_feature (71): n=a or g
gagtgcttaggaacataacaatatttttatatactgttagtcttttacattgtcagcttctatggcctganagggagagatagagagtgtgagtgagagag

SEQ ID NO: 33219 - DNA, 101 bp, rice(Oryza sativa)
  misc_feature (71): n=t or c
tccaagaaaaagtgataatactaaagaatccagcatctgtgaaagctgatctactgcttgtggccttagangaggaagaagctgcacggtccaaaagtggc

SEQ ID NO: 33220 - DNA, 101 bp, rice(Oryza sativa)
  misc_feature (71): n=t or c
gctaaacctcttaattcgtagcaaaaaccgtctgtttgttccatttctttgagcatttcaatcaaccgtantgcgcttgcgcaggcattcgcgggatctca

SEQ ID NO: 33221 - DNA, 101 bp, rice(Oryza sativa)
  misc_feature (71): n=a or c
cacccaatcgatcagtctttgaagctctgtcatagttttgaaggatcaaaagtcgctatataggggatgantacatggtttcacaagtttggcagctgatc

SEQ ID NO: 33222 - DNA, 101 bp, rice(Oryza sativa)
  misc_feature (71): n=a or g
gcttccatggaggagttgtattggtttgtcctagaaatttgtgcgcctcttcagatgctttcaaattgtcnaaagtgtcttttggatgcttgttttgtgat

SEQ ID NO: 33223 - DNA, 101 bp, rice(Oryza sativa)
  misc_feature (71): n=t or c
ggtgcagtagctataggtacctatcctctgatatagacaaagaaaacatcgatgatgatgatgatgacgangacgtcgtcaatgtcgttgttggtgtactc

SEQ ID NO: 33224 - DNA, 101 bp, rice(Oryza sativa)
  misc_feature (71): n=t or g
atgttatattgaagccgaaaagcaacagtaaagggaagcatatatgtctggtaggattttgcagacttacnagatgacatcatgtgcgttagtacactggt

SEQ ID NO: 33225 - DNA, 101 bp, rice(Oryza sativa)
  misc_feature (71): n=t or c
tatgagctttaagccgccacttctccctctcggtttatgtaagtcatcaccgagcatcacccatgttccangcaatggccccaccaagatgctaatcagtg

SEQ ID NO: 33226 - DNA, 101 bp, rice(Oryza sativa)
  misc_feature (71): n=a or c
gatgtgattatgcacgtatacaattagaaacattagaagagcaattagaaagtttaatatccatgccatgntcaacactattataatgtcaatcacacaac

SEQ ID NO: 33227 - DNA, 101 bp, rice(Oryza sativa)
  misc_feature (71): n=t or c
cactggacaactgagtttggctggtttgtgtaatgtacgatttgagtgatgaaatgaacttgtgttagccntatatcaccactactagttgttggtgtaga

SEQ ID NO: 33228 - DNA, 101 bp, rice(Oryza sativa)
  misc_feature (71): n=a or g
aattaatcttcccttcagaagagcaatggttggatgatttggtacatctcatctttttcctccatgaaganggagtaaaatcaatgcctctacttgagaag

SEQ ID NO: 33229 - DNA, 101 bp, rice(Oryza sativa)
  misc_feature (71): n=a or c
catatttagaaaataatagtagtccttaatattctgcgagattttattcagccatgttagaaaataaagtnttgttatgttacacccatctatgcataaac

SEQ ID NO: 33230 - DNA, 101 bp, rice(Oryza sativa)
  misc_feature (71): n=t or c
tggagttgcatcagtgcaaatgatatgttgggatatgttggatgtacacatggtcttgtccttgccacctncttttgaattcttcaggcatatcctcaaca

SEQ ID NO: 33231 - DNA, 101 bp, rice(Oryza sativa)
  misc_feature (71): n=t or c
aattatttttcttatatgcattgctagtctaaacaatcatgtgttgtacatgtgtgaaaactgaagctttntgtgtctgtgaagaatacttccatagtaat

SEQ ID NO: 33232 - DNA, 101 bp, rice(Oryza sativa)
  misc_feature (71): n=t or c
gtttctcgtccacccacccagcccatgtcatatacgggcaataatcggcactagtaacatcacatcagtgncgatcattaagatgaccaacattaagaata

SEQ ID NO: 33233 - DNA, 101 bp, rice(Oryza sativa)
  misc_feature (71): n=a or g
gtttgttggtcatggaagtctatgtcggtcttccttgttcagggaaacaatgcacaataggccatgtcacngcttccgcccgtatgccatggtggcatgtg

SEQ ID NO: 33234 - DNA, 101 bp, rice(Oryza sativa)
  misc_feature (71): n=t or c
taaaatactgtcccgacttagacattacactcttcactgttccattcacatcacaagttcgatagcgtgtncttcccttcccatcaggaccatgttcagct

SEQ ID NO: 33235 - DNA, 101 bp, rice(Oryza sativa)
  misc_feature (71): n=t or c
acttgcatgtgctcactctagatgtttgtattcttgcggcagcgccctagtcaatacaggctgaccatgtnagtgggccttgtggggaaagtggttccatc

SEQ ID NO: 33236 - DNA, 101 bp, rice(Oryza sativa)
  misc_feature (71): n=a or g
tgctcattcgcatttatatacagcttatttaatcacttatatttggatattagcatgttcactgagacacnagcgaagaatttttaatggtaaattaataa

SEQ ID NO: 33237 - DNA, 101 bp, rice(Oryza sativa)
  misc_feature (71): n=a or g
tactgatcgatcgtgcatatagtgacagctctagttatcatccatgcgtgttctatttattagaacatgcngcttttattagttggtctaatgctgattat

SEQ ID NO: 33238 - DNA, 101 bp, rice(Oryza sativa)
  misc_feature (71): n=a or g
ttcacacaaaccagtgtacctcataatcttcttccaagagagatctagtaagcttagtggatgcatcatcngaaaggataaaactgccaccgggaatagtg

SEQ ID NO: 33239 - DNA, 101 bp, rice(Oryza sativa)
  misc_feature (71): n=t or c
cgatctcccattgccggtgcatatgatgaggcatgtgcagataaagtcacgagtatgctcctcccatttcnaaattttttaagctaatgcttaactaatca

SEQ ID NO: 33240 - DNA, 101 bp, rice(Oryza sativa)
  misc_feature (71): n=t or c
acattttactggagtggaagggaaaagtcagcttcaaagcacacacctttcagagtcttctaaatcccttnaaattaaagccagtcccattaaactcgaaa

SEQ ID NO: 33241 - DNA, 101 bp, rice(Oryza sativa)
  misc_feature (71): n=a or c
aattcgttttggtcgagttttgggggaaagtaagttgttgaatttcaggagatttggtgaaattcgtcatntcgcccgggctcgcatttcaaacaatgact

SEQ ID NO: 33242 - DNA, 101 bp, rice(Oryza sativa)
  misc_feature (71): n=t or g
tgctcagaataaagagaactgcctatcagagaaaacctgctaaagacactactaggtaaacgattttcctntgtagggacccatttaaattgcgaacggac

SEQ ID NO: 33243 - DNA, 101 bp, rice(Oryza sativa)
  misc_feature (71): n=t or c
ttctcgatatgtcattatagttaacctatagcatgctcttatggtctaggactaacctacttcctctgttncacaatgtaagactttctagcattgtccat

SEQ ID NO: 33244 - DNA, 101 bp, rice(Oryza sativa)
  misc_feature (71): n=t or c
aaacttttcgtctcgcaaactaaacaatattttattggacgatgcaccagaagatatataatgtttgttgngctatagaattagtgaaagctactcactct

SEQ ID NO: 33245 - DNA, 101 bp, rice(Oryza sativa)
  misc_feature (71): n=t or g
ttaaaatatgctaatgagttttcttattttgtgtgcgataaaagtttctctctaaagatggatatcgaacncagccttagacttgaccatcatctcttctc

SEQ ID NO: 33246 - DNA, 101 bp, rice(Oryza sativa)
  misc_feature (71): n=t or g
aagtaaacttaaaaaacactcccataattaaagcaaacacaaaggaatgaacatcaacacaagataaaaancacataattattgaaccatatttctatact

SEQ ID NO: 33247 - DNA, 101 bp, rice(Oryza sativa)
  misc_feature (71): n=t or c
aggtgtctgaaattagacatgcctctacctcctttcaacctttgcaaagctgacctatgcatgttatgtgngtgatgtagcctcctttgagcagcccaatg

SEQ ID NO: 33248 - DNA, 101 bp, rice(Oryza sativa)
  misc_feature (71): n=t or c
tatgaggaaggacatcgtacgcaactcttggacaaatccttcggtaccaaacaagtactcgggcttgtagngcggcatctaagaagtgacaggagggagtt

SEQ ID NO: 33249 - DNA, 101 bp, rice(Oryza sativa)
  misc_feature (71): n=t or c
ttcaaggtatggctgtcttgttcttggaaattaatacatacaaatccagctctcgctgtcgctgctgttgntatcaatcgatcggtccaagaactggctgg

SEQ ID NO: 33250 - DNA, 101 bp, rice(Oryza sativa)
  misc_feature (71): n=a or g
atttgctacatctgaaagatgtggaccctggagttgatctttttatcgcagtggtggtgcattcatcagtntgtggtgcattggaggccactctgtccttc

SEQ ID NO: 33251 - DNA, 101 bp, rice(Oryza sativa)
  misc_feature (71): n=a or g
tgacagcaacctgtgaatgcatggtcaagttgatcggcttcttgttgccttgttttcttgcctaggtctcnttttataatctgatcgcaattaacaccgcc

SEQ ID NO: 33252 - DNA, 101 bp, rice(Oryza sativa)
  misc_feature (71): n=a or g
ctatctgtcacagcctcttcatcttcattgtcagaaagcagcttcacttgtgcagttatttccttggtcanttgagcctgattggacagttgagataaggg

SEQ ID NO: 33253 - DNA, 101 bp, rice(Oryza sativa)
  misc_feature (71): n=t or c
atgttcttttggatcatgcggactgtactctctcccggaccgatcgagttcctctcaggctatgtttaganggtagaaaagttgggaagttgggagaaagt

SEQ ID NO: 33254 - DNA, 101 bp, rice(Oryza sativa)
  misc_feature (71): n=a or g
aagaaaaaccgtttttcctcatatacggatctgaggccatgctcccttcagagccctggcaccaaagtacncgagtccaaaagtactctaacgaggaacaa

SEQ ID NO: 33255 - DNA, 101 bp, rice(Oryza sativa)
  misc_feature (71): n=a or c
cccggtactgtaccttccggtacgacatgctggacggaagtaggggctgttggtttcccagggatttattncaagtctctatcacatcggatatttgatac

SEQ ID NO: 33256 - DNA, 101 bp, rice(Oryza sativa)
  misc_feature (71): n=a or g
cgacaccggcaacttcgtcaagctggcggcgccggtgattcccgtcatcgctttcaacaacctcccctacngcgagaccttcttcggccaccccaccggcc

SEQ ID NO: 33257 - DNA, 101 bp, rice(Oryza sativa)
  misc_feature (71): n=a or g
caactataaacaataggaccatttcaacacttatgacaaacacacagatggaatcatcacgagcaagtagnatagcatgctataagccagctacaaacaca

SEQ ID NO: 33258 - DNA, 101 bp, rice(Oryza sativa)
  misc_feature (71): n=t or c
tgctcacaggcataagcataactgacacatggatcagttgttagtgaccagcaaacactgtgcaaaatctngcaacaggaacatagagatagaactgctgc

SEQ ID NO: 33259 - DNA, 101 bp, rice(Oryza sativa)
  misc_feature (71): n=a or g
tccctcgtcacagaaaagtggtccgtgatgactcaacatcatcaatgagcggtaaatacccattagtggtnacatacattttcgatgggttgtatactgtg

SEQ ID NO: 33260 - DNA, 101 bp, rice(Oryza sativa)
  misc_feature (71): n=a or c
agaaagagagcaaagcttactcttctactacctgtgtctagtactactgactatttcacatataataagtngtttgaatttttttaagtcaaactacttta

SEQ ID NO: 33261 - DNA, 101 bp, rice(Oryza sativa)
  misc_feature (71): n=t or c
tatcaggtttagcaaagacatcagtgaattgctgaagtactgcagtgagagctggtaatggagttgttgcngtcacagggcagaacttaagaagtgacaat

SEQ ID NO: 33262 - DNA, 101 bp, rice(Oryza sativa)
  misc_feature (71): n=a or c
aattgattaataagtccaacaattaggtgtcagcagagtaagcattattaactgattattatcacatgccnctattactcatcccacattgtacttgcagg

SEQ ID NO: 33263 - DNA, 101 bp, rice(Oryza sativa)
  misc_feature (71): n=a or g
ggcaggccaattattgaacagaattgatggagcaggacaaaaaatcataagcaagtaggcagtggataaantactagtgccatcaaaacctatcataattt

SEQ ID NO: 33264 - DNA, 101 bp, rice(Oryza sativa)
  misc_feature (71): n=t or c
aaactccttaggcagtgggaaactttcatttttcaccaaaatgatgatatgtataggcacgcctatttcgngggaaggatatgctaaattgctacacgcgc

SEQ ID NO: 33265 - DNA, 101 bp, rice(Oryza sativa)
  misc_feature (71): n=t or c
cgttacgtagtttggcaagagcactgccgcatgcatatgcagcggcaggcagagtgtgtgtggccgatttngctttggactctacggcgcgcgcggtgatc

SEQ ID NO: 33266 - DNA, 101 bp, rice(Oryza sativa)
  misc_feature (71): n=t or g
ttttggaaaatatagaggtgatctagctagagaatagtagagatcattggggagagtataccgagatttcncaaggtcgcatgcacgacgcagcctcgctg

SEQ ID NO: 33267 - DNA, 101 bp, rice(Oryza sativa)
  misc_feature (71): n=t or c
cattgctaaattaaattgttcagcaagtaacgcaacaactcgcattgttggagctagttaaaaaaccatgnactttcagtaataccctccatattttcaca

SEQ ID NO: 33268 - DNA, 101 bp, rice(Oryza sativa)
  misc_feature (71): n=t or g
tagaagatactactagcagtactatgttagagaagtctacagcatctgctatacgaagattaagtaccggnacgcaatacggaaaagccactaatgtatga

SEQ ID NO: 33269 - DNA, 101 bp, rice(Oryza sativa)
  misc_feature (71): n=a or g
gcggatatgaggtcagcaccatgatgtcatgggccaagaagtagtgccttagcttccgagaggccataacnagcgcgtacgcgatcttctccagctctgtg

SEQ ID NO: 33270 - DNA, 101 bp, rice(Oryza sativa)
  misc_feature (71): n=t or c
tgacgatcgattgaccaaatggaaaaaggctagatagtgcgattatatatgcggcgccggcgtcggcttgnttcaccattaattagttagtactccccctg

SEQ ID NO: 33271 - DNA, 101 bp, rice(Oryza sativa)
  misc_feature (71): n=t or c
ttacttcgtaacgatatttctcttttttccctcttctctctacataccgaaatagatgcagtacagcttangtcttaacattttttttatacttttctatc

SEQ ID NO: 33272 - DNA, 101 bp, rice(Oryza sativa)
  misc_feature (71): n=a or g
gctcttaagagactcgtatataaaaatttattttcgcagaagccgcacggaaaaataggctgttttctccnacatgcctcttaagcgacgcacagtaaaat

SEQ ID NO: 33273 - DNA, 101 bp, rice(Oryza sativa)
  misc_feature (71): n=a or g
aaacacgcatccaccagaatcaaccgcaatttccccgcttataacgaatagcgcatccaatcagtaaatcntacacacaggagtaaatcgtacacatcggc

SEQ ID NO: 33274 - DNA, 101 bp, rice(Oryza sativa)
  misc_feature (71): n=a or g
atcatgaaactggagtaaaagaaggcataaacatgagcagcataatccgtactacagaaatcacatgagcntaaaggccatggtaattttcaggaagcaat

SEQ ID NO: 33275 - DNA, 101 bp, rice(Oryza sativa)
  misc_feature (71): n=a or g
aagagcagctatagcctatagggcttgtttgggagtaaactctaactagtttattttatgagagcgtttcncccagctccgctgttatttaggtggaacta

SEQ ID NO: 33276 - DNA, 101 bp, rice(Oryza sativa)
  misc_feature (71): n=a or g
gtgagaggaggagttgagggacgttcattagacttcctttgcgggctgagaaagaaaatggctaatagtgncccagagagaaatgaagatttttatttaga

SEQ ID NO: 33277 - DNA, 101 bp, rice(Oryza sativa)
  misc_feature (71): n=a or g
ggagggcgtcatgggtcccatctgcctcttcgatcgcatcgagcataagtcggttcagtggcagaacacgnccatcttctcatgctggatgtggatgcgga

SEQ ID NO: 33278 - DNA, 101 bp, rice(Oryza sativa)
  misc_feature (71): n=a or g
aacggagggaggggagtatatgaaatacttttatcatgttgatgtcgaaaatggtgtctaagattacgtcnttaggaaacaataatatactccctccgtat

SEQ ID NO: 33279 - DNA, 101 bp, rice(Oryza sativa)
  misc_feature (71): n=a or c
gacggttttttctaagtatcgatctttctaagcactcttggtgtattgtacatgtcctaagcagcttgatnccattgtgttacgacggttggctcattgtc

SEQ ID NO: 33280 - DNA, 101 bp, rice(Oryza sativa)
  misc_feature (71): n=a or g
gagtccttctctccacttccttcgtgttcggcgtcatgtccgaccatgtcggcctgagcgcccatggcatngcgttcgtcgtggccgccagccgggacttc

SEQ ID NO: 33281 - DNA, 101 bp, rice(Oryza sativa)
  misc_feature (71): n=t or c
cctatttcgccaagcgcccacacccatccatcccgtgtccttatcctcattatcatgctttctcttctctngtctctctgcctcccctttcctatctcact

SEQ ID NO: 33282 - DNA, 101 bp, rice(Oryza sativa)
  misc_feature (71): n=t or c
ctcattcagatatttctcctgttatgtttgatcaaaagcagtctatgctgtgctctgatgatagacctggnggttcacctgcaaatgcgggtgaggagatc

SEQ ID NO: 33283 - DNA, 101 bp, rice(Oryza sativa)
  misc_feature (71): n=a or g
tcccaaatcgcaagaccggattgggtcatctctacgtggcgctctcgctcaacggaaaaacgataccgatncggtatcgcttacccaataagtgataccgg

SEQ ID NO: 33284 - DNA, 101 bp, rice(Oryza sativa)
  misc_feature (71): n=a or g
attacaaaaattttctaagtcctattacaaagataatcatctagacaagttacgctggattgccgatacancccgttggctaatttgatctacttcttcaa

SEQ ID NO: 33285 - DNA, 101 bp, rice(Oryza sativa)
  misc_feature (71): n=a or c
actatcactcttcatcatcatcttctttggcttctccctcttcactgccctaattacaacccatttgcttntctctctcctctctctctctctctcgctgc

SEQ ID NO: 33286 - DNA, 101 bp, rice(Oryza sativa)
  misc_feature (71): n=t or c
gattcggcccatctcctccagcacgacatcggacagaacaaagttactcggtcagaatctactctcctgtnctccatccgtcccaaaataagagcgagtac

SEQ ID NO: 33287 - DNA, 101 bp, rice(Oryza sativa)
  misc_feature (71): n=t or c
acttatcctcctactctgcccaaaatctcatcctgatgatgcactaccacacaaataattttcgcagccancgtttaatttatttttacaaggctaaaaaa

SEQ ID NO: 33288 - DNA, 101 bp, rice(Oryza sativa)
  misc_feature (71): n=a or g
gatccttgcgaagaaataatgtccagttcaaagggtatgattcttccaaacttgtgtggatgtatttgtgntattcactaatattattccactctaaccat

SEQ ID NO: 33289 - DNA, 101 bp, rice(Oryza sativa)
  misc_feature (71): n=t or c
aggacgcgaataaaactcggtccataggtgagggatgtcgaagaacatttcccaagctgttatggtgacgntattgcaatctgggccgggctggcacagcc

SEQ ID NO: 33290 - DNA, 101 bp, rice(Oryza sativa)
  misc_feature (71): n=a or g
gggaggtctgtgttatagccacaaattaaggctgtcgtcacgacgacatcctaacacagtgttcgaggcanccgatgcgagcgtcagttcgatgcggagtc

SEQ ID NO: 33291 - DNA, 101 bp, rice(Oryza sativa)
  misc_feature (71): n=a or g
tcttcctctccggcagcgatagcaacggtatggttactgtagtccatcaggttagggtttcagggtttacngagagaatgaggcatgggaggcaacggtgt

SEQ ID NO: 33292 - DNA, 101 bp, rice(Oryza sativa)
  misc_feature (71): n=a or g
acacaaatacctttctcaacttcgtcaaacctccgtaggagtattgcacttgagtgtaatcaaattttacnaagtaaagttattgtataataaaaatgtgt

SEQ ID NO: 33293 - DNA, 101 bp, rice(Oryza sativa)
  misc_feature (71): n=t or g
acaggaggtgagcggataagtttgtttatcgtgacatgcaatcgggaccgaaatctttccaacttctaacntttctccttgattttcagaaaaccgagtgc

SEQ ID NO: 33294 - DNA, 101 bp, rice(Oryza sativa)
  misc_feature (71): n=t or c
gcctaactttctctttgtcacagcgatgaatgctgatagtaatttcttactgtttttagaggtacatggcngacattttatcagtgttagctttgacaatg

SEQ ID NO: 33295 - DNA, 101 bp, rice(Oryza sativa)
  misc_feature (71): n=a or g
gacttcgcttgtgtctcctgaaacatgtatgcacaactgatagactggtgcacgatgcttctcctcctctntatatacgccaacttgcatcttcacttgcc

SEQ ID NO: 33296 - DNA, 101 bp, rice(Oryza sativa)
  misc_feature (71): n=t or c
gatcatctccaagtgagcaacagtatctcagggctaccaaccagctgaaaaattaagtgagagagaatacnagtactactagctagctgctaggagtagta

SEQ ID NO: 33297 - DNA, 101 bp, rice(Oryza sativa)
  misc_feature (71): n=t or c
ggttcttcatccgtcactgcggcataggggttgaggagtcacaactcaagtttgagcttgcagtcgcatgngctagtttactggaggagacgctcaagctt

SEQ ID NO: 33298 - DNA, 101 bp, rice(Oryza sativa)
  misc_feature (71): n=a or g
gattatctgtggtcccccaatttcattctttctgttacatgaacatagtaaaacgtagtcgcagtttcccnattttgagatgttgtatagcatggggtagg

SEQ ID NO: 33299 - DNA, 101 bp, rice(Oryza sativa)
  misc_feature (71): n=a or g
cacccaagcaacatttactcatgggagcagttgcgggatgtcttcgtaatgaaatttcatgggacgtactnttggtatttcttacgttcacagataaaatc

SEQ ID NO: 33300 - DNA, 101 bp, rice(Oryza sativa)
  misc_feature (71): n=t or g
tttagattggttttttaagggagtattcgtcttcattctggtgcttctcatccaacgtagaagctcatgtnctcttcgtgtgtaggtaatggctaaaggat

SEQ ID NO: 33301 - DNA, 101 bp, rice(Oryza sativa)
  misc_feature (71): n=t or c
aggcggcgccatggtaacgtgatttctctttttcttgctggtgttggctcgatcggtttgttcgttgttgnttttttctttcttggctgattgattgatcc

SEQ ID NO: 33302 - DNA, 101 bp, rice(Oryza sativa)
  misc_feature (71): n=t or c
gaagactcttcgcagaaatcccaggttacaaattacctgcttgcttatatgtcatactgttactaagggcntgtttggcacagctccagctccagcttcac

SEQ ID NO: 33303 - DNA, 101 bp, rice(Oryza sativa)
  misc_feature (71): n=a or g
caggacgggccgacccgtcacttttagtgctattgtcactttcacttgggatggaataagttcaccggagntccctcaacttaatagcgagatttttcgat

SEQ ID NO: 33304 - DNA, 101 bp, rice(Oryza sativa)
  misc_feature (71): n=a or g
tcatgacgatgacaggctagtttattcacctgcggtgaaatatgacatgaattccatcctcgtgtcgatanttacaaggtgttcagatttatactcacagc

SEQ ID NO: 33305 - DNA, 101 bp, rice(Oryza sativa)
  misc_feature (71): n=t or g
agccagagctgtctccaaatcctttggacgttgcaagagaactgcatttctgatctcccgacgcaatcccncagtaaaacgatgtgttagataccgtatat

SEQ ID NO: 33306 - DNA, 101 bp, rice(Oryza sativa)
  misc_feature (71): n=a or g
tagtagtggtagatgcaaaaatgtacattgagcataattaggcttaaagaggcatatagccatgaactatnaaaagtggacagctggtcctcaaaagaagt

SEQ ID NO: 33307 - DNA, 101 bp, rice(Oryza sativa)
  misc_feature (71): n=a or g
ttcaggacaacatattgtctcatacaccttaggatcatcattctcttcatcagcatcatcatcctcaggantgtaatctggatcattagcctcatcatctg

SEQ ID NO: 33308 - DNA, 101 bp, rice(Oryza sativa)
  misc_feature (71): n=a or g
tgcaatattacaattgcctaggtcttgcaatcttttttctaatccatttctttcaatgcctaaggtgttcntttttttcaatgcctaagtcgtccattttt

SEQ ID NO: 33309 - DNA, 101 bp, rice(Oryza sativa)
  misc_feature (71): n=a or g
gttatcctatatctatattcgtagagaatgaaaaaaaaaagaaccagagaatgcaaaacaatcagtactantatatgtattttcttataattccccaaatt

SEQ ID NO: 33310 - DNA, 101 bp, rice(Oryza sativa)
  misc_feature (71): n=t or c
atctatcaccaaaacctactggggatctaggtgcactttcagtagtaagttccttgtgtatgtaccaatcnagaaatactcctaggtgaaagtatcttata

SEQ ID NO: 33311 - DNA, 101 bp, rice(Oryza sativa)
  misc_feature (71): n=t or c
ctgatatcaagtatgttaaacctgcacggtgacatctaagaacctataattaaagagcaattttacggtcnttaaggaggtaacatgaggtaccatttttt

SEQ ID NO: 33312 - DNA, 101 bp, rice(Oryza sativa)
  misc_feature (71): n=a or g
cgcatccctagctagacccagccgatgatctccaagaacgactccgcgtgcgacgaatccacgccgtccanctgcccctcctccattgaatatattttgat

SEQ ID NO: 33313 - DNA, 101 bp, rice(Oryza sativa)
  misc_feature (71): n=t or c
tcctcctagaaggtgtcgccttccttgactgcggatctgtagataaggccgccaatgcgggcatccaatcnggcaatccctccgcttcctctccgtcgctg

SEQ ID NO: 33314 - DNA, 101 bp, rice(Oryza sativa)
  misc_feature (71): n=t or c
tgaacaatcccgccgtttcaagagacagagtctcagcatcacccccgtcagctccttgtatcccaaacttngctttcttctcaaccccctcctccctagct

SEQ ID NO: 33315 - DNA, 101 bp, rice(Oryza sativa)
  misc_feature (71): n=t or c
ttgttttactcacatacatgtgggttccatttaggtttggtttttatttagtgccacgtaagcatcacgtnaatgccacatggaatgaagaccaagtcaac

SEQ ID NO: 33316 - DNA, 101 bp, rice(Oryza sativa)
  misc_feature (71): n=t or c
ttgacagtagcattttgatcatgactaatttcaaagagatcaggaaatttgactttcagaggtacattatnacaccaaacatccttccaaaaactcacatc

SEQ ID NO: 33317 - DNA, 101 bp, rice(Oryza sativa)
  misc_feature (71): n=t or c
gtagaaatcttattggtccttcattgctcaatccctgtttaagagctactcccccctatcaaaatataagnatttttagaatagtgccaagtcaaattttt

SEQ ID NO: 33318 - DNA, 101 bp, rice(Oryza sativa)
  misc_feature (71): n=a or c
gatcaaattagatcaattagctaggactagacatagttcactatggagactagatgcttcaacttgtattnatggacttgtccaataagattgtaaccact

SEQ ID NO: 33319 - DNA, 101 bp, rice(Oryza sativa)
  misc_feature (71): n=a or g
tcctctgtgccatatccatggaccatccaaaggtacgcggtagttctgcaaaaagaaatgctactggagtngtagtaaaagtaaaaaccactaagactatt

SEQ ID NO: 33320 - DNA, 101 bp, rice(Oryza sativa)
  misc_feature (71): n=a or g
atttttttaactggtatttgtttttttttcaatttaaccgttcagtcagaggcggatccagtgtgggggcngcaggtctcgagtccccactattagcgtga

SEQ ID NO: 33321 - DNA, 101 bp, rice(Oryza sativa)
  misc_feature (71): n=a or g
acaacatattattgggttgctctttccctgcattatgttgaggctaccccaactccacttatccaactatntcctacatgttttaatatttttattatcat

SEQ ID NO: 33322 - DNA, 101 bp, rice(Oryza sativa)
  misc_feature (71): n=t or c
gttgatggcatgcatgacgtatgcactccagtcgtctcttgcacgggacgtgccagattattacttttcanattttactaatgtacggtatatttatattt

SEQ ID NO: 33323 - DNA, 101 bp, rice(Oryza sativa)
  misc_feature (71): n=t or c
ctgtggtgtgcatgcagcagcaagcatatcgcgcacacgacgagcttccatatatgggaatggacggcgantcttcatactcaccggcattggccgccgtc

SEQ ID NO: 33324 - DNA, 101 bp, rice(Oryza sativa)
  misc_feature (71): n=t or c
tggttttttctttaatcctttgtggatgattttgttgttcggttaattaaacttcactcgtttggagtgcnagtttgtaaaaattggttgtagctctttga

SEQ ID NO: 33325 - DNA, 101 bp, rice(Oryza sativa)
  misc_feature (71): n=t or c
ctatatgatggcatgttaatatcataaaaaaactcgctagcacttaataatcaaaacaaagcatacttggncaagttgttgcactaaaatattaaattatc

SEQ ID NO: 33326 - DNA, 101 bp, rice(Oryza sativa)
  misc_feature (71): n=t or g
tggtacaacacacttgcaactagcagcaagttccctgaaagatgtttgtctaatgctatggtgatctcttncactacagtttggtgtatgtgtgtccatag

SEQ ID NO: 33327 - DNA, 101 bp, rice(Oryza sativa)
  misc_feature (71): n=t or c
ggagtgctgccctcctccatcagtcagctgaaatccttgtctttattagaggtgtctgggttagagctagnaggatccatgccatcatggatctcaaacct

SEQ ID NO: 33328 - DNA, 101 bp, rice(Oryza sativa)
  misc_feature (71): n=t or c
ctctaattctaggagaaaccgtagctgtgaaactcttcaaacataccttcaactttggctgtgtttagttnagtataaagtttgaattttggttgaaattg

SEQ ID NO: 33329 - DNA, 101 bp, rice(Oryza sativa)
  misc_feature (71): n=a or c
aatcaaaccctaacccctgtaggcctcaccattttttaaaacctttgaagcttcttccaacacatccagcncatccagccaatcaatggcattccggcaaa

SEQ ID NO: 33330 - DNA, 101 bp, rice(Oryza sativa)
  misc_feature (71): n=t or c
tagaaaataaaacaaaagactatgacaaaaaagagtcgcatagatagaactgaagccttcgcatcactctngtgcgagtggctcgggagcgaaaccctagc

SEQ ID NO: 33331 - DNA, 101 bp, rice(Oryza sativa)
  misc_feature (71): n=a or c
gtaagtgtggttgccttagaaaacgtttagcatgcctgtgtgctctgtgtcaacatggggatatataggtnataattatatacagaactcaatatcaacgg

SEQ ID NO: 33332 - DNA, 101 bp, rice(Oryza sativa)
  misc_feature (71): n=a or c
gcctacatatttactgcagtagtttgcatcaaggaaaccgaagcaatgccccttgctaacacactattccnttcgtcccataaaaaatcaacctagtaaag

SEQ ID NO: 33333 - DNA, 101 bp, rice(Oryza sativa)
  misc_feature (71): n=t or c
tcttcttcttcgactttagctactactcctgctatatatagagtagctagtgcatatatacgtatgcaatnatgcatgtggcgtatagggttgtgtttagt

SEQ ID NO: 33334 - DNA, 101 bp, rice(Oryza sativa)
  misc_feature (71): n=t or c
tctcaagaagtaatgaagataaagtttgcagtatgtggggtagcactgtagcaggacaatgtaaatgcatnatgcattatcaacatttgatttttaatttc

SEQ ID NO: 33335 - DNA, 101 bp, rice(Oryza sativa)
  misc_feature (71): n=t or c
agttgctgttgcactatgtgtagtttaagaccagagggcattatgatattagataccagtatggagcatgnggacatgtaattgattcacaaattcatatg

SEQ ID NO: 33336 - DNA, 101 bp, rice(Oryza sativa)
  misc_feature (71): n=a or g
atgaattacttccgttggaacttcaaaaggacttacctgatggatctccatctggatcagcttttgagtcncatattactgaggatgaaggttatttccat

SEQ ID NO: 33337 - DNA, 101 bp, rice(Oryza sativa)
  misc_feature (71): n=a or g
tatgaaggtgatcttttaacaggtttagacattacagatgtagcgttggtttccacccttttaaacatgcnttagattcttagagcaggccgcacaatagc

SEQ ID NO: 33338 - DNA, 101 bp, rice(Oryza sativa)
  misc_feature (71): n=a or g
catgaaatatatagttacagttagtcatcactacttttttccaggcagcccaatcatattctcgcaggcgngcaagccttccgcctgcacctcaacacctg

SEQ ID NO: 33339 - DNA, 101 bp, rice(Oryza sativa)
  misc_feature (71): n=a or c
tattcgtcccacatggcattgacatgatgcctacgtgacagtacaatcccccaaaaaaaatatataaaagnatcaaaattgaaaactaaaaatataaaaaa

SEQ ID NO: 33340 - DNA, 101 bp, rice(Oryza sativa)
  misc_feature (71): n=a or c
gttgctataactgaagtcagatagtagaatttgtcgatcgttctctgccagagggatcaattaattgcgangacctcgccgatttgatggggaatttcagc

SEQ ID NO: 33341 - DNA, 101 bp, rice(Oryza sativa)
  misc_feature (71): n=a or g
attcatgaacggacataaactttcgatgctgatgacccttctcattagtgtcggttcttgatccggcacangtggcccttgggagcaccttggtggggtat

SEQ ID NO: 33342 - DNA, 101 bp, rice(Oryza sativa)
  misc_feature (71): n=t or g
atattttatccctaatcttcttatagtcattgctacttatagcccgttacaacgtaggacatgctactaanttttgtgaacaatcgaacctagcttatatc

SEQ ID NO: 33343 - DNA, 101 bp, rice(Oryza sativa)
  misc_feature (71): n=t or g
caaaccgacgatatagcttgagctccacccttgatcaccaaagtgccagacgagcaggagaacttatgaancgagatgggagagcgtgggcgcatggggtg

SEQ ID NO: 33344 - DNA, 101 bp, rice(Oryza sativa)
  misc_feature (71): n=a or g
tgaataccgccacatgggcgccacgtcatcaaaaccacctccaaaaccgtaaggggaattaaattgcaccngttttaagtgtttggggttgaaatatccgg

SEQ ID NO: 33345 - DNA, 101 bp, rice(Oryza sativa)
  misc_feature (71): n=a or g
catagagagtggattctaatccctcgagggaatgtcatttgtgtactttttttcctttaaatttgatacanatagttgtagaaaaattctaaacttttttc

SEQ ID NO: 33346 - DNA, 101 bp, rice(Oryza sativa)
  misc_feature (71): n=a or c
catccgtgtatgctttgttttgtaaagtacctcccatagctgtcactaattgttcaatctttgcctggaanaacaaaaacaaaatagagataaatacattg

SEQ ID NO: 33347 - DNA, 101 bp, rice(Oryza sativa)
  misc_feature (71): n=a or g
aatttggaaattctataccatccaggaaaagccaacgtagttgctgatgccttaagccgaaaagctaattncaatctacaacaagaaataatatcagaaca

SEQ ID NO: 33348 - DNA, 101 bp, rice(Oryza sativa)
  misc_feature (71): n=a or g
gatcacaagaacgccattgaacaatgctccaagtgacccaatcagcgcacaaccaatctgagaaaatactnagaaattaattatgcagatgaaaacttcag

SEQ ID NO: 33349 - DNA, 101 bp, rice(Oryza sativa)
  misc_feature (71): n=t or g
ttgggagacttatagccatactaaaggcaatacagtcgaggaatgacaaccttactcacaaggacaaatantcattaaaaaattatgacagcactaaccat

SEQ ID NO: 33350 - DNA, 101 bp, rice(Oryza sativa)
  misc_feature (71): n=a or g
gcaggaaacacacatgctcttcctcccttctcagatagagaatggtcgtatcctaatcgagtacacacttngaagtttattgagaaataattaactattta

SEQ ID NO: 33351 - DNA, 101 bp, rice(Oryza sativa)
  misc_feature (71): n=t or c
acgcatgaagtctcagtacgatccagaaaagcagaagtaaaggagttctcaaatacactcacgatgatcgnagcctcgcgatcagccttccccttctcaca

SEQ ID NO: 33352 - DNA, 101 bp, rice(Oryza sativa)
  misc_feature (71): n=t or c
gcatgcccatcaaggtgtcgaggctaacatttccccgcatgcctgcattttatttcattggcatttgccanattacttaacaaaaaggtgaaaaaaaatgc

SEQ ID NO: 33353 - DNA, 101 bp, rice(Oryza sativa)
  misc_feature (71): n=a or g
ttcggtttgataggtgcatactgcccagctccattaagccaaaacttgttcatcgtcggaaatactattcnccgcaacccaaccaacctgactggtacatg

SEQ ID NO: 33354 - DNA, 101 bp, rice(Oryza sativa)
  misc_feature (71): n=t or c
ttagatcactccatctcatgccatgacttccagcttcagaagccctaatagcatattggccaagctcatanagtcctcgatacaaagaaaatgcaggtatt

SEQ ID NO: 33355 - DNA, 101 bp, rice(Oryza sativa)
  misc_feature (71): n=t or c
tgcacatcttctgaaaagataagggctcggtatcggctcaatcgaacaagctgaggtatataaggaatagnagaacatattgattatcctattggattggt

SEQ ID NO: 33356 - DNA, 101 bp, rice(Oryza sativa)
  misc_feature (71): n=a or c
atctgctgttttgacacggttcttccataagtcagccgacattgttctacgttcggcacgtagtcgttccncttcttcagctccattacaaacttgtttgg

SEQ ID NO: 33357 - DNA, 101 bp, rice(Oryza sativa)
  misc_feature (71): n=a or g
ggtacttgatcgtccaccaaagtgccatgtctgttataaggaactgaacttctccattgaactcgcttgcngtcgtgaaaagagggacgagcacatcagtg

SEQ ID NO: 33358 - DNA, 101 bp, rice(Oryza sativa)
  misc_feature (71): n=a or g
attatttttttggaggggatgggcggcaaaggaatcgactgatactagttgatatctcacgctttgttgcnggatatgtcgatgaatgtatgttatatatt

SEQ ID NO: 33359 - DNA, 101 bp, rice(Oryza sativa)
  misc_feature (71): n=a or g
cagtaatttgagagcaatttttttaaaaaaattagtgtaaaattgctcgtaatttgatccgacggttgatnatcatcggcacgatgatcgattgctggacc

SEQ ID NO: 33360 - DNA, 101 bp, rice(Oryza sativa)
  misc_feature (71): n=a or g
catcagggcgtgatagtagagtttggtccctgaaaacggttttaaagatttatacgcatacggttctcttnacaatatatctcatcataaaaaggatgtat

SEQ ID NO: 33361 - DNA, 101 bp, rice(Oryza sativa)
  misc_feature (71): n=a or g
atagtacaattttttaatgggcaaggatcgtttaaaatgacatggatagtttgtttaaaccacattacctnccacctggctccctagcatctagattctag

SEQ ID NO: 33362 - DNA, 101 bp, rice(Oryza sativa)
  misc_feature (71): n=a or g
aaataggaagagattgaaaactaaaagcaaaaggaagagggctaaacgtacagaggtaagtaaaaacagcnatcgatgatgatatgccatagagagaaacc

SEQ ID NO: 33363 - DNA, 101 bp, rice(Oryza sativa)
  misc_feature (71): n=a or g
gctgacgacgctatgatccaacggccttcttcttgaaccttccccaagatattttatagggtcagccaacnagttggaggataaaatcgagctagccatgt

SEQ ID NO: 33364 - DNA, 101 bp, rice(Oryza sativa)
  misc_feature (71): n=t or c
cttggagatcgaaatgtacatatatttgtctaccctatctaaggggattcataggatattgtgggacatangtacgagccgtgtcttacggtctcagtcgg

SEQ ID NO: 33365 - DNA, 101 bp, rice(Oryza sativa)
  misc_feature (71): n=a or g
ctatcacccacgtaattcacgttccgatgcagcagatcaaaatatcttgtgaaataggaaagccctagtgntttgctagtcatgtgtgcatgactttactt

SEQ ID NO: 33366 - DNA, 101 bp, rice(Oryza sativa)
  misc_feature (71): n=t or c
gagaatttacatggataccctagtgaatagggacatttataaaggtaattgtagacaatttagccatgggntgcttagtgggccgtagcatgggcctcctt

SEQ ID NO: 33367 - DNA, 101 bp, rice(Oryza sativa)
  misc_feature (71): n=a or g
agaattaactaggattatcacacaattttccatgtacctaaacgttcctaaccatcaaacagctctaggtntcgcatgatacttgagtatcagccgatacc

SEQ ID NO: 33368 - DNA, 101 bp, rice(Oryza sativa)
  misc_feature (71): n=a or g
ttcttccatcaaggaaaaagaggagaaaaggaccttaataaatgagacacttatcagcttgatattcttcntactcctcctttctatgtgtgtgaatgtga

SEQ ID NO: 33369 - DNA, 101 bp, rice(Oryza sativa)
  misc_feature (71): n=a or c
cttctctctcccctgttttggttcaagctcaccactcttctcttcttcttcctctgttttggtcccatccncgtgcttgacctacgttagcgcctgagctt

SEQ ID NO: 33370 - DNA, 101 bp, rice(Oryza sativa)
  misc_feature (71): n=a or g
aaaaagggaaaaaagaaaaaagggaggggaagcgtacataaccatgtacgtaggtgtatacctatgacacnggacgagaggtgagaccttatagtattttg

SEQ ID NO: 33371 - DNA, 101 bp, rice(Oryza sativa)
  misc_feature (71): n=t or c
tctgtgcaatatctttacattgaagttgggctttgcatggtttttaaatttgaatcaatatctgtgtttcngtgctatattttattttataggatgcttgt

SEQ ID NO: 33372 - DNA, 101 bp, rice(Oryza sativa)
  misc_feature (71): n=a or g
gcagagaactctcttttcaggctacgtcagctaccaaaacgttcgagaagcttatgatggttagtctttcntccatctaagtatttccaaggaaactattg

SEQ ID NO: 33373 - DNA, 101 bp, rice(Oryza sativa)
  misc_feature (71): n=a or g
ctgaaacttgtgacaggaagcattcctaagggctgttcaatgcgtgcccctggatcgttccccagctcacnccgtccgcgtagaggtggccaaatgggccg

SEQ ID NO: 33374 - DNA, 101 bp, rice(Oryza sativa)
  misc_feature (71): n=t or c
taattgaatcagacattgttggggggaaattcaaaatttgatggtacaacagctgtacgacagataattanatactaatgatataccctcataaaccaaac

SEQ ID NO: 33375 - DNA, 101 bp, rice(Oryza sativa)
  misc_feature (71): n=a or g
agctgggtcagctgctccagcacctcggtttcttttctgggccaatctatcgtggcgagcaaatcgtccgnggatcccagaagtactggaaggtgaagctc

SEQ ID NO: 33376 - DNA, 101 bp, rice(Oryza sativa)
  misc_feature (71): n=t or c
aagactaatagtaacctttggcacaaacctgacttgagctttgactcttaagtagcggccaaatctgaatnctatatttaattcatataccaggatttttt

SEQ ID NO: 33377 - DNA, 101 bp, rice(Oryza sativa)
  misc_feature (71): n=t or c
gcgcgaaggagaagaagattgaaggccaagttgcttgcttgttttggtctccgtccattcgatggaaaaangttgggccgattttggtctttttaccgtgc

SEQ ID NO: 33378 - DNA, 101 bp, rice(Oryza sativa)
  misc_feature (71): n=a or g
ttcaccactgtagcctgtaggtatgcactggagtgactgaggtactccgtcctaaaaaaaggtaaactatnggttcctgtgtcatcgtttgactgtccatc

SEQ ID NO: 33379 - DNA, 101 bp, rice(Oryza sativa)
  misc_feature (71): n=t or c
ctgctaccgtacctgctctcatatcgcgagtctcgcgactccatgtcgctatggagcgtgtaaaaagaatnggatacgagcccatgtagttcgagcacgaa

SEQ ID NO: 33380 - DNA, 101 bp, rice(Oryza sativa)
  misc_feature (71): n=t or c
actataatgtactgtgaagaataaaatagaccatatgcactgtggaggatgtttcttacaatgttcctagnctagttggcggttttggcttctcaaataag

SEQ ID NO: 33381 - DNA, 101 bp, rice(Oryza sativa)
  misc_feature (71): n=t or c
aatcgatatgattaaactcgatatatcttgtaaagtaattaaccaatatcgggtccacgtacccaccctanagtaaaatatatatttctagcgaattgagc

SEQ ID NO: 33382 - DNA, 101 bp, rice(Oryza sativa)
  misc_feature (71): n=a or g
gataatccaacgataaggaacctaagtagatatccccgcatgaggataaaactatgacgttttgatgatanagatctactccctccgtctaaaaatataga

SEQ ID NO: 33383 - DNA, 101 bp, rice(Oryza sativa)
  misc_feature (71): n=a or g
ataccattgtcgtcaaggttttctcgataatcattctctgtcctgaacgagaacgccttgcaagaaagccngaaacttagttacatcgatcctgttctgtt

SEQ ID NO: 33384 - DNA, 101 bp, rice(Oryza sativa)
  misc_feature (71): n=a or g
atcaacattggaaccgtagtgctatcatataatttcaaaatactccaatagttttcataataaccgcttantatatatattttttagagattgatacggtt

SEQ ID NO: 33385 - DNA, 101 bp, rice(Oryza sativa)
  misc_feature (71): n=a or g
tggaacaggttgagcctaattaacctgctcacatatgatgcgtacaagccccttacagagtgctacccttncaatgctaattcctaatgacttccatacct

SEQ ID NO: 33386 - DNA, 101 bp, rice(Oryza sativa)
  misc_feature (71): n=t or c
ttgggtttagcggcattcaatcaaacagctctggacaaaacaagagaatctgcaatcaggtaagaacttgntgctaatcattcaagttaaaatcaaatagt

SEQ ID NO: 33387 - DNA, 101 bp, rice(Oryza sativa)
  misc_feature (71): n=t or g
ccaaggggatgatttgatcgatgtcattcgggcacgaggtaaacataagagatcggtcttaaacataaganaggtcttgtttatttgtttgcaaatgtatt

SEQ ID NO: 33388 - DNA, 101 bp, rice(Oryza sativa)
  misc_feature (71): n=a or c
ggggatgatcaagaagccgatgaaagatatcaagaattatatggagtatgtgctggagttgttcatgttcnttctctagtggtccaaggcttattttttgt

SEQ ID NO: 33389 - DNA, 101 bp, rice(Oryza sativa)
  misc_feature (71): n=a or g
ttactcagcatgactggtcaaattttcggccgcaaacgcccgtctacgtagttgtggacaagggccacctnggaagatacatttgaagtttcgcctctaaa

SEQ ID NO: 33390 - DNA, 101 bp, rice(Oryza sativa)
  misc_feature (71): n=a or g
aaacaggaagggcgccttaacgtacgagaggacacaggtacaaattgttgtgcttttcaaatttgggcctngtttagtttctaactttttcttcaaacttt

SEQ ID NO: 33391 - DNA, 101 bp, rice(Oryza sativa)
  misc_feature (71): n=a or g
agagcaaagacacatttgttttcttcggactatataaatgcattgcagcctctcataagagtaagacctcntatctcggtttgcatagaagagaacatata

SEQ ID NO: 33392 - DNA, 101 bp, rice(Oryza sativa)
  misc_feature (71): n=a or c
ggaaatctggtttgctacagtgcactaggtgccattttgtggcagctgatctcagatcatgtgatgttganaattttttcagttccgaacgtttacccggt

SEQ ID NO: 33393 - DNA, 101 bp, rice(Oryza sativa)
  misc_feature (71): n=a or g
catttaccatcatgccatgccacatgttaaagtggaccatcatggcaacttttctttactaggattaattntacatgtattgtacgttgaccctttggtca

SEQ ID NO: 33394 - DNA, 101 bp, rice(Oryza sativa)
  misc_feature (71): n=a or c
acttatgccaagaaaggggaagaaaagaccaaattaaaaaaggggatgaacgactactgtgacggctacanacaactccaaattgcgggaagggggcagag

SEQ ID NO: 33395 - DNA, 101 bp, rice(Oryza sativa)
  misc_feature (71): n=a or g
tcggccatggggtcgaccggagcttggtctcagcagcgttgcgtcatgtggcagctgcaactgcaagggcngcgacgccggagccggaggaggtggaggtc

SEQ ID NO: 33396 - DNA, 101 bp, rice(Oryza sativa)
  misc_feature (71): n=a or c
gagacagtatattgagcaacatggccactttaccactagccactggagttggatgggtagtatctcctgtnatcaagcttatgtttgagaaggtccaatca

SEQ ID NO: 33397 - DNA, 101 bp, rice(Oryza sativa)
  misc_feature (71): n=a or g
gtttgcaccgcaaatcgttaggtgattctatgttgaccatgaaaaagtatcaacacactgttagagtgganactttaatggagaggttattggattgaaag

SEQ ID NO: 33398 - DNA, 101 bp, rice(Oryza sativa)
  misc_feature (71): n=t or c
gaacaatcaccgaccaaaaattcagcaaaaatggcaaaacagcacacaataatgattcaagaatcaagatnacttcaaaccctttttttccccctgaggcc

SEQ ID NO: 33399 - DNA, 101 bp, rice(Oryza sativa)
  misc_feature (71): n=t or c
aaagccaatgaaaattttccctaggaagggagggagtaaatgacaagaggcaacacaattagagcaggtanaataacagactattagccagctataaacat

SEQ ID NO: 33400 - DNA, 101 bp, rice(Oryza sativa)
  misc_feature (71): n=t or c
gtattaagatttgaagagagggtttgcagaaacgctaattcgcgcgcacgttgccggtgcgcacttccagnccacgcacgtgcgcgtgtttcttttctctt

SEQ ID NO: 33401 - DNA, 101 bp, rice(Oryza sativa)
  misc_feature (71): n=t or c
ttagttttcactactacataaattttaataggaaacacccttaaatgtgccagtttaactaaaaccggcangcatataaggctttccctgtccttttaatt

SEQ ID NO: 33402 - DNA, 101 bp, rice(Oryza sativa)
  misc_feature (71): n=a or g
aagtcatcacacaatttggtttgcactttgtaactctagagtgagcagtgctgaaactacttccaagtttncccaccgaataatatgatgtcaggcattat

SEQ ID NO: 33403 - DNA, 101 bp, rice(Oryza sativa)
  misc_feature (71): n=t or c
cagcgacatttttggttgcctgcatcagcgggtgagtcaggattcattagtgcaaaagcgaccttcaagcnaggctgagaggaaacacggaagtcggctgt

SEQ ID NO: 33404 - DNA, 101 bp, rice(Oryza sativa)
  misc_feature (71): n=t or c
gtatcgagctgcttagcgatgataagcacctgacgaattcggacaacatgatggagttgtgctgcactagntagaaggggatcaggttttttgaaagcttc

SEQ ID NO: 33405 - DNA, 101 bp, rice(Oryza sativa)
  misc_feature (71): n=a or g
gtttttttttaaccaatggcaatggtgggtaattttttaccatctccatgtgactccaggttttggtggantaccccttgaggagctccagaaaattcctg

SEQ ID NO: 33406 - DNA, 101 bp, rice(Oryza sativa)
  misc_feature (71): n=a or g
tccaactgctgctgcagcgttctcagctatttctcgcttacctgttagtggaccgattctattacagtggnccgaaagcgaggctaggttctctccgctct

SEQ ID NO: 33407 - DNA, 101 bp, rice(Oryza sativa)
  misc_feature (71): n=t or c
aatctgtttacctcatgtatcagctttcattttttttaccattcattctgctgttgcagcaaacgctactnggagcctgtggcgttccattcattgggcca

SEQ ID NO: 33408 - DNA, 101 bp, rice(Oryza sativa)
  misc_feature (71): n=t or c
cggctcttcgtcaagcgcagcaagtgcaccttcggctccccctcggtgtcctacctcggccacgtcatatncgaggcgggcgtcgccatggatccggccaa

SEQ ID NO: 33409 - DNA, 101 bp, rice(Oryza sativa)
  misc_feature (71): n=a or g
caaccaccaagtttgaccattacacgcatcccggtcagatcggccggtccaaagacaaaaccaacacttcnccaattatctccaaatatcaaaccaatcat

SEQ ID NO: 33410 - DNA, 101 bp, rice(Oryza sativa)
  misc_feature (71): n=t or c
gagaacagagctatctctcggatcttgtgcatcaattccagttatgatgttgtcgatcatcatctgtcagntcccttagatgatatgaggaatgtggaggg

SEQ ID NO: 33411 - DNA, 101 bp, rice(Oryza sativa)
  misc_feature (71): n=a or g
ttattgcatttttattttcaagtcacctgttctctgttatgatctaatatgttaatacggcccctgtttgngagagcttaaaattctgagaatctgctggt

SEQ ID NO: 33412 - DNA, 101 bp, rice(Oryza sativa)
  misc_feature (71): n=a or g
tttatctttttatttgtactatgcactcgcaaagtttgagatggacacccctatgtcaacacgagatattncactatataccacacttttaaatatggcaa

SEQ ID NO: 33413 - DNA, 101 bp, rice(Oryza sativa)
  misc_feature (71): n=t or c
tctcgttataaacgttgttgaaaactctatcattctatcgttttgctccagccaaacgcaccatgacgtgnatatgatgatgccatcaaacatcctttgat

SEQ ID NO: 33414 - DNA, 101 bp, rice(Oryza sativa)
  misc_feature (71): n=a or g
tgccagttcaacccaaaagtttaaaccgatgaggaaggacggttaattcactttaccgctacactatgcgntgcagttctttttatgtatagaacatacct

SEQ ID NO: 33415 - DNA, 101 bp, rice(Oryza sativa)
  misc_feature (71): n=a or g
gaaagaaaggaaaagaaaaagaaaagaaaaagaaaagagaaatttagggggaagatttaaaatatttacanatattagaatttaattataggattaataaa

SEQ ID NO: 33416 - DNA, 101 bp, rice(Oryza sativa)
  misc_feature (71): n=t or c
aggagtctatccctgtatacctgtaccattcttagcagagtatttacttttccgtccaatttgattgatcngcgtttcatggtcttacaggcacaaggagt

SEQ ID NO: 33417 - DNA, 101 bp, rice(Oryza sativa)
  misc_feature (71): n=a or g
acgagactatagcggaatgaaacgatgtttgcatacatcatgaccccctaacacgacaactctagtaaagntcactattacgaggagtaaaaagttaggct

SEQ ID NO: 33418 - DNA, 101 bp, rice(Oryza sativa)
  misc_feature (71): n=t or c
cttggcacaacgcacccccctagtcctatcatttattccttctcctccctctcaagcaaaactcacctttnattgcccctctctcttctatgagaaattcc

SEQ ID NO: 33419 - DNA, 101 bp, rice(Oryza sativa)
  misc_feature (71): n=a or g
ttagctaacaatcttaatgacagtacgacagcaatctgttgcttcagcctatgatgcatggatacagaccntaaacatggcatggtactgatacagggaat

SEQ ID NO: 33420 - DNA, 101 bp, rice(Oryza sativa)
  misc_feature (71): n=a or g
cccccttttatgctctggacacctccaaagtcatgcgttgccatgtcagctgtcctggttgtgcaataaanaggagggggacgccacccagcatccatcag

SEQ ID NO: 33421 - DNA, 101 bp, rice(Oryza sativa)
  misc_feature (71): n=a or g
tgcgaaggcttcaacggaatccttggaattccaaagacaattaagctccacttttacactactctaaagtnggcatgcagcctagtggttgtagtgaccta

SEQ ID NO: 33422 - DNA, 101 bp, rice(Oryza sativa)
  misc_feature (71): n=t or g
taagaatcataaaaattcaaaaacctaaaggcaagacggtgtaccggtgtttgaggttcaaactgagatgngggaactttttttttcaattacacaaaaaa

SEQ ID NO: 33423 - DNA, 101 bp, rice(Oryza sativa)
  misc_feature (71): n=a or g
ttggaggacagttttgctaacgtgacatctacatgacagtgtgtgacctaatatgtgatgttgacgtggcnctaggattgaaaacatatatgtgaaaccca

SEQ ID NO: 33424 - DNA, 101 bp, rice(Oryza sativa)
  misc_feature (71): n=a or g
tggttcttgtttagttcatgtgtagattattgaaggtcattaagtaacaacttgaaccgtcaactcctacntaaaagatacaaaatataatatcaaattta

SEQ ID NO: 33425 - DNA, 101 bp, rice(Oryza sativa)
  misc_feature (71): n=a or g
gagtgaagacccacgggtcccaaccgagactcgcgtttattgttagattttactagcattcgtcagaaccnacccacactcgtcgtgccccacgggccgtc

SEQ ID NO: 33426 - DNA, 101 bp, rice(Oryza sativa)
  misc_feature (71): n=a or g
ggtgagcaagagctgctgctatagtacagcagcttagctagctcaaatggggaacaccgagatgaaggccnctactactccatatgtatatagtggcttct

SEQ ID NO: 33427 - DNA, 101 bp, rice(Oryza sativa)
  misc_feature (71): n=a or g
ggaactcatataccaaacaaatgtcttaagcagaccacattctctggtagttagtactacctccgtttcangttataagactttctagcatacgtgtctag

SEQ ID NO: 33428 - DNA, 101 bp, rice(Oryza sativa)
  misc_feature (71): n=t or c
agagaacattttaaaaatatcatcgacaagcgtatcaatcgaagaagaatcattgacaaacccatctttcngataatgatattgtacaagtgtctttgtgc

SEQ ID NO: 33429 - DNA, 101 bp, rice(Oryza sativa)
  misc_feature (71): n=t or c
tttaggttgaaacaaaaaatgtgtcttccacttctcaggtgattgtgtgcatatcataagcatgtgtctanctttgcaaatgttaggtaagtctttcaaat

SEQ ID NO: 33430 - DNA, 101 bp, rice(Oryza sativa)
  misc_feature (71): n=a or g
gttaattatgaagaagctatttgtggagaatatgggtatactccgaaacaatttggaggcttgggtataangacattggcaggcaaaatgaggctttactg

SEQ ID NO: 33431 - DNA, 101 bp, rice(Oryza sativa)
  misc_feature (71): n=a or g
cctcgccgcacgcatccttcgacattcatcgccgtgctgagccacttcaacaaaggttttgtgggaccctnctcacccaccgggtccccagcggagttgga

SEQ ID NO: 33432 - DNA, 101 bp, rice(Oryza sativa)
  misc_feature (71): n=a or g
atgtgtggttttatccttgacatgcacttaataatcttcatgtcagatgcacaaaacgagatgagccatgncaactaagttcctccttcttgttctccttt

SEQ ID NO: 33433 - DNA, 101 bp, rice(Oryza sativa)
  misc_feature (71): n=a or g
tacaagccttgtgctgctaggtaaaacagcagagtaccccatttttcgtatggctaaggctgagtttaatnagaaggtgaaagagatgatcgggaagatac

SEQ ID NO: 33434 - DNA, 101 bp, rice(Oryza sativa)
  misc_feature (71): n=a or c
atcagaaaactggactgtattatgggccacattcctctcccttaacagggcagagaataagtctacattgngtccctcaactcttgtccttggttgaatca

SEQ ID NO: 33435 - DNA, 101 bp, rice(Oryza sativa)
  misc_feature (71): n=t or c
aatggtttgcgtacctactagctactccctttgtccacaatataacagcatagaaaggacaggacatattnaagtagtacaaatctatactactttatcca

SEQ ID NO: 33436 - DNA, 101 bp, rice(Oryza sativa)
  misc_feature (71): n=a or g
tctcttgctctctcgtttcttctcccccatctcatttactcctctcttggttggagggagtttttagttgngattaggagtttagagggatgaggctatta

SEQ ID NO: 33437 - DNA, 101 bp, rice(Oryza sativa)
  misc_feature (71): n=t or c
tgtcaacaaccttcaacacaatctctattttatttggaagttggaactagtagtatacttggtcgttcctnggccgtgtacatattgattatagatctaga

SEQ ID NO: 33438 - DNA, 101 bp, rice(Oryza sativa)
  misc_feature (71): n=t or c
ccgaccggccagaaatgaccattggcttgattgttttgactgcactatagagctagattttacgtgtgacnggccacatgtgaaacataggtttgattgtt

SEQ ID NO: 33439 - DNA, 101 bp, rice(Oryza sativa)
  misc_feature (71): n=a or g
tttgtaactaataatccggtcaaaccattgatacttttgtccatatcagcatgccataaggaaacaatacnggtgcgtttggatccttcgcttactttacc

SEQ ID NO: 33440 - DNA, 101 bp, rice(Oryza sativa)
  misc_feature (71): n=a or g
cttggttcgttaacttcgtattcgaaaggtgtcaacctcaactcgcgcttgatttacccaggccgtggacncgtcttcgccacccccgcggcggaggaagc

SEQ ID NO: 33441 - DNA, 101 bp, rice(Oryza sativa)
  misc_feature (71): n=t or c
ttgccatccccgtgcctcgccatgtcgacgattctgtccagcttgttgttgatgagacgccatgagcgctngcccgtgcgggctatggcgaactccctctc

SEQ ID NO: 33442 - DNA, 101 bp, rice(Oryza sativa)
  misc_feature (71): n=t or g
tgttcgagttcttctgccctctctatcctagaatgtcgacaccttcacgaaaactcctggttctctatccnagtaagagatgacaatcatcaactactggg

SEQ ID NO: 33443 - DNA, 101 bp, rice(Oryza sativa)
  misc_feature (71): n=t or c
gcgtgcacgatcagcgtcgtcgtcgtgtacgtctttgtcgtgtgccactcgtgtatcgcactgtcacctancatgtcgttccaaggtagctggggctcaaa

SEQ ID NO: 33444 - DNA, 101 bp, rice(Oryza sativa)
  misc_feature (71): n=a or g
tctagaaaagatggatctgaacctagatccggccatattatataggagtacgtagctagtactagcgtatncgtccttgccgcttagctcaaagtcgtcgc

SEQ ID NO: 33445 - DNA, 101 bp, rice(Oryza sativa)
  misc_feature (71): n=t or g
tccatcccctacaaagacttcacttttagccattgatgattgacaaattagtggcaagaatgaaagaccanagtgtaccttatcaataagataatgttctg

SEQ ID NO: 33446 - DNA, 101 bp, rice(Oryza sativa)
  misc_feature (71): n=a or g
ggcatcatcggatacaagccggacggcctagatctaacgtatcacaccgcactacagcagcaaatactgtngcatggagtactgttcacatggtcagtgta

SEQ ID NO: 33447 - DNA, 101 bp, rice(Oryza sativa)
  misc_feature (71): n=a or g
agcagatcgcccttacttttaattactccgatttcgtagcgcatatcgactctcctcccctcccctgtggnacgcagctctccgcttgtcattttccctca

SEQ ID NO: 33448 - DNA, 101 bp, rice(Oryza sativa)
  misc_feature (71): n=t or c
ctgctatcgggaaagttcaattgtttccttaacggttagtacttatattatattcaagttctctccaaagnctccacataagaatggaaatttctacagtt

SEQ ID NO: 33449 - DNA, 101 bp, rice(Oryza sativa)
  misc_feature (71): n=a or g
tagtgcaattccattattgtccaccagaaatgcataaatggccagcatgggactttctgtctgcgaaatgncatggttgaacagtacttctgttacttttc

SEQ ID NO: 33450 - DNA, 101 bp, rice(Oryza sativa)
  misc_feature (71): n=t or c
gttagcctccgggcggcccaagcccatcgatgtgctcgtcaagtctctcgacgggacgcggcgcgtccgtngaggagctgaaggagctcggcgaggagatc

SEQ ID NO: 33451 - DNA, 101 bp, rice(Oryza sativa)
  misc_feature (71): n=t or c
cgttagctccattgagggaaatggattgttaaccaaaatttggcttgtggtcaactggtcacggaggtgtnaggataattgcatggcaaatgtatggtagg

SEQ ID NO: 33452 - DNA, 101 bp, rice(Oryza sativa)
  misc_feature (71): n=a or c
acatgcggaccgtttaaatcttccgcctgtaataattcatacattttcataggaggagggtcatcccaccnctcactcaggacaatgcaggtggccattta

SEQ ID NO: 33453 - DNA, 101 bp, rice(Oryza sativa)
  misc_feature (71): n=a or c
tgttcttttgcagccttacatgctgtcgcttaagacgtccgtccgcgaaaataatgctatggtggtaagtngggctagattcacgtctcccttcctctcac

SEQ ID NO: 33454 - DNA, 101 bp, rice(Oryza sativa)
  misc_feature (71): n=a or g
ataattagatgacgttttatacccgatttcatgggtaagggatgcaaatagaatttgactcatagttgagnaatgtaaagtgaacttattacttcttactt

SEQ ID NO: 33455 - DNA, 101 bp, rice(Oryza sativa)
  misc_feature (71): n=t or c
ggatagaatggggagaaatttaaatatggcatgataatctttgcagaataaatttgaatccaagagtaacnatttttttgggaaattagaaataaaaattg

SEQ ID NO: 33456 - DNA, 101 bp, rice(Oryza sativa)
  misc_feature (71): n=a or g
gtaaaatctgaacatgcctccaaactcgtactacgatgtgtccatactccaaactaggttgccatattttnggacggatggagtaaattaccagaagatgg

SEQ ID NO: 33457 - DNA, 101 bp, rice(Oryza sativa)
  misc_feature (71): n=a or g
aaaaaggtgcactataaggtgggcaaagtttggtggtgaaaatacaaaattctttcatgctgcggcaactnaaagatatcgcagaaatttaattatgcagc

SEQ ID NO: 33458 - DNA, 101 bp, rice(Oryza sativa)
  misc_feature (71): n=a or g
catcatgctgtagtataagaagaaagtattgacacttgacagctcatgaaaaattgcaatcgttgtgatgncatccttttttatcgagccaattaatatgc

SEQ ID NO: 33459 - DNA, 101 bp, rice(Oryza sativa)
  misc_feature (71): n=t or c
atccccttgttctaaacgtatcagtttcttgcttaagtctgtatgataagatgatgggacaaatctatcgngcatagctaccttaatttcttcccaagtag

SEQ ID NO: 33460 - DNA, 101 bp, rice(Oryza sativa)
  misc_feature (71): n=t or c
cctggacgcatccctaatattctccaacacgatacatagtccaatgcgtcaaaagacggtgatgtagcacncaggctgattctggatgcccacttgtttcg

SEQ ID NO: 33461 - DNA, 101 bp, rice(Oryza sativa)
  misc_feature (71): n=t or c
ctggacgtgcgaaagaattctcaattgatgagaaggaaacgctatggtataagaagaggatctacgtaccnaaacagggtggactgaggggattaattcta

SEQ ID NO: 33462 - DNA, 101 bp, rice(Oryza sativa)
  misc_feature (71): n=a or c
cccctacaccaaacaacagctcccaaggatgtagacgacaccgtgcatgatccccctctcgtggaggtganaacaaagcagaggagccactcgttattgtt

SEQ ID NO: 33463 - DNA, 101 bp, rice(Oryza sativa)
  misc_feature (71): n=a or c
gtagaggaggagaaagagagaactttttccaaggacagaaccagtatataggcggcttcaccctctctctntatatatatatatgtgtgtgcgcgcgcgcg

SEQ ID NO: 33464 - DNA, 101 bp, rice(Oryza sativa)
  misc_feature (71): n=a or g
ttatagattgagtggttaccataccacaccactgaggctacaagtcttacactgaactcgttatgcaatcnagactccgattacttcatgtactagtgcca

SEQ ID NO: 33465 - DNA, 101 bp, rice(Oryza sativa)
  misc_feature (71): n=t or c
tcacagtactaagcaatcgcgagctgaaactaggactgattaccaagtccgaataggccttacaatagatngagaaacaggaaactatgatatatttgatc

SEQ ID NO: 33466 - DNA, 101 bp, rice(Oryza sativa)
  misc_feature (71): n=t or c
ttgggcccatagtcacaaagttcctgggtcaatgggatcgaggaacgggatcgaggaacgtgatacgctanttgcgagaggtttttacaaggtggggacga

SEQ ID NO: 33467 - DNA, 101 bp, rice(Oryza sativa)
  misc_feature (71): n=a or c
catggatccaaacaatatcttaagcttttgctgaaaccattgcaggaacaaaacaaaaacatcatgcaganatttaccctatgtgatccaactatccaagt

SEQ ID NO: 33468 - DNA, 101 bp, rice(Oryza sativa)
  misc_feature (71): n=t or c
ggtgatgaggacgaggagccagcggccaccgactatgccatttttctatgcagctacgccccgtcgccgcngccgccgccgccgctacgctccaccaccgg

SEQ ID NO: 33469 - DNA, 101 bp, rice(Oryza sativa)
  misc_feature (71): n=a or c
atgtgtatggggatctcatttttcaatgaatgttggtcctaacacaatttgcagtagatgcgcacattccntctttcgagggtgaatcatcttgtctcatg

SEQ ID NO: 33470 - DNA, 101 bp, rice(Oryza sativa)
  misc_feature (71): n=t or c
ttttccacacagcaaaacaacgtaagcatggcaaagaaaactacctccgtagtcgtataacgataccgggnaaacatttgtggacctttcaaaggtaagga

SEQ ID NO: 33471 - DNA, 101 bp, rice(Oryza sativa)
  misc_feature (71): n=t or c
ttggctgctaacatgtagggccccgtgtagctactatgctgattcaacatagctgaccggagtgaaaatgncacgttggatgaaactgggagccatactgc

SEQ ID NO: 33472 - DNA, 101 bp, rice(Oryza sativa)
  misc_feature (71): n=a or g
agttggaagttgggggtgaactaaacacggcctcagttaaaggtccagtgaaggaaatgttgacggctatntttagtgccttaaatcacagcctgcactcc

SEQ ID NO: 33473 - DNA, 101 bp, rice(Oryza sativa)
  misc_feature (71): n=a or g
gtcgccgccatggcgatcatccgtcgatctacaatctgttctagaacaaatgtgaactggctcgctattgngccgaggaaagaaattacatgaagagatat

SEQ ID NO: 33474 - DNA, 101 bp, rice(Oryza sativa)
  misc_feature (71): n=a or g
tttatgactaattattttctcaagttatatgcaatgttttcatcgacaacgagtcgtatatgaacacttcntgaatgttaagatatgcagatctagtattc

SEQ ID NO: 33475 - DNA, 101 bp, rice(Oryza sativa)
  misc_feature (71): n=t or c
ccgatccggcaaaaaaaagagtagagaatcacaggacacgagatagggcaagatgagacggcgtacatggntgccgtggtgctccgcctcagcacgaagag

SEQ ID NO: 33476 - DNA, 101 bp, rice(Oryza sativa)
  misc_feature (71): n=t or c
tgaagttgcagatcaaatatttcagttgatccaaaaaaagttgagcgatcaaatattttagttgatcaatnggtgaaacattaagttatacatggtgaaat

SEQ ID NO: 33477 - DNA, 101 bp, rice(Oryza sativa)
  misc_feature (71): n=t or c
tatcgaaaaagacaatactttgtcagcgcatttttctctataatgtgcaacaacgtttttggcacaactancactcaatcagtgatcaactggaagagtgt

SEQ ID NO: 33478 - DNA, 101 bp, rice(Oryza sativa)
  misc_feature (71): n=a or g
aagatatacatatttgataaattaaaaaaaaagagatagcaggatggtgtgtgtgaacacaattaagaagngcaatacctcactttattgaaacttatttt

SEQ ID NO: 33479 - DNA, 101 bp, rice(Oryza sativa)
  misc_feature (71): n=a or c
atgcatgcccagattgagaattgtacgatatttgtgctcgatcaacatggaaactcaggtttgactatatntgtagacttgatatatcaataataagtcga

SEQ ID NO: 33480 - DNA, 101 bp, rice(Oryza sativa)
  misc_feature (71): n=a or g
atcccctcctcttgagtgctctagatcaagcctgccaagactccaggcgaccaacccgtgtcctcgtctcntcctttgcaccgtgccactggatccacgcc

SEQ ID NO: 33481 - DNA, 101 bp, rice(Oryza sativa)
  misc_feature (71): n=t or c
aaccaaacttctaattttagcgtgaactagacacacccttctttagattggagaaactttatgggactttngaacaaattagactaatttatatgaaattt

SEQ ID NO: 33482 - DNA, 101 bp, rice(Oryza sativa)
  misc_feature (71): n=a or g
agattaagcatatacatggacgaacgacataatccttacaatttttttgttgttgtcacgtaccacgaaancagatcataatacatgatgatgccattttc

SEQ ID NO: 33483 - DNA, 101 bp, rice(Oryza sativa)
  misc_feature (71): n=t or c
atctcctatctgaaccagcagtctacagacctactccctccgtcaaagacaaaccctggaattgcgtgtcnaactttgactgtccgtcttatatgaaactt

SEQ ID NO: 33484 - DNA, 101 bp, rice(Oryza sativa)
  misc_feature (71): n=a or g
cgaagaaaaggttggctaaagctcttagtgggaatatttgaaaaggtattatccttctgcacggtagcaancttgattgtcttataacgaatacatatttg

SEQ ID NO: 33485 - DNA, 101 bp, rice(Oryza sativa)
  misc_feature (71): n=t or g
gcaggagctttttctgctccacccacttacaagggcaaagtcagttctgaacagggaggaagtataaaaangatagcctctaagaaaacctctcttttgaa

SEQ ID NO: 33486 - DNA, 101 bp, rice(Oryza sativa)
  misc_feature (71): n=a or g
cgagcacatcgccgagttccccaagcttacgaagggggattgggaagtcagctctcaggacgtttcgcccnccttacgcgcctggcgcaagcagttctggc

SEQ ID NO: 33487 - DNA, 101 bp, rice(Oryza sativa)
  misc_feature (71): n=a or g
gtctctgaacctccaacgctatgtcactctgaagaacagatctaaattcagttgtggcaatgaatcagacnattgcctaagaagttgacatatctaacctt

SEQ ID NO: 33488 - DNA, 101 bp, rice(Oryza sativa)
  misc_feature (71): n=t or g
tttagaacaataatttgcaagttttcagagacactttagtgaatctgaatttactgtcagctgtaactctntttaaatgtccatgtaaagaaaggaacttg

SEQ ID NO: 33489 - DNA, 101 bp, rice(Oryza sativa)
  misc_feature (71): n=a or c
gggcccacgtatttggcccatccagcttgggaattttttttgggccgaggcgagaggcgagaggcgagagncaccggcctcgtcgtcggcggcgggcggcg

SEQ ID NO: 33490 - DNA, 101 bp, rice(Oryza sativa)
  misc_feature (71): n=a or g
gcaacaagaagaggaaaacagtgaaattcactaaaagaagtttaataatatagtccactgtccactgctanctccaattcatctatagtcaatctaatagc

SEQ ID NO: 33491 - DNA, 101 bp, rice(Oryza sativa)
  misc_feature (71): n=t or c
tagagctgtaaactgcttagggtattcacaatgcgctaaaaagcaagcaataagtaataaatgcacccatngaagataatagcaacatccaggcagtagtt

SEQ ID NO: 33492 - DNA, 101 bp, rice(Oryza sativa)
  misc_feature (71): n=t or c
atgtatgtggtgggctactgggctacacagaaagtgtcgtcgaagtgcagggaaagtttgctttcttcctnctttttctttcgtacaaatagagggccacg

SEQ ID NO: 33493 - DNA, 101 bp, rice(Oryza sativa)
  misc_feature (71): n=a or g
aaccgagtgttccatgatgtcgaagatatagaaatttgtacatgtgtctggttatataaatttggaagtcngttaaagatatatactactacaaagctttg

SEQ ID NO: 33494 - DNA, 101 bp, rice(Oryza sativa)
  misc_feature (71): n=a or c
aggaaaaaggaagcagagttaggaggaggaatgatttcttcagatagaagttttgattcaattccaacgcncgcctctagaagatccttctagtatttata

SEQ ID NO: 33495 - DNA, 101 bp, rice(Oryza sativa)
  misc_feature (71): n=a or g
gtgggtatccaggcgtaggcttcgttggggctcttcacgaagaccaagaagcatttgttgcaggcgcggcngggaaggagatgcttgccaatggacacagt

SEQ ID NO: 33496 - DNA, 101 bp, rice(Oryza sativa)
  misc_feature (71): n=t or c
aatcatttctatgtttccaaatctcccaagcgaccaaaataatcatcaagttgagcccattttttctcaancggcctttcgctgctcttgaccaccaacta

SEQ ID NO: 33497 - DNA, 101 bp, rice(Oryza sativa)
  misc_feature (71): n=t or c
aaccttgaacagaattgtaaggcaatgaagaaaaccatgtaaatgttgtcccggacaaagacaaaggaaanaaccgaacccttaaagcgtcaacagctgat

SEQ ID NO: 33498 - DNA, 101 bp, rice(Oryza sativa)
  misc_feature (71): n=a or g
tctggctcccgcccaccgtcgccgcccctgctcgatgattgcgccatgagagagagaagggagagagggangaggaagaagaagagggagaggatgacatg

SEQ ID NO: 33499 - DNA, 101 bp, rice(Oryza sativa)
  misc_feature (71): n=t or g
tatatttgggacagatgtgtacgtagcatgtcgctagctagaagtactacctgtatcgctatcagccacangccccctataattgtccggtcctacgtact

SEQ ID NO: 33500 - DNA, 101 bp, rice(Oryza sativa)
  misc_feature (71): n=t or c
gcacttaccgcacatgcattacaggagaggatcccaactcatcagagttaggctgtcttggatactccaanaagagttagggtgtgcttagttcacgttaa

SEQ ID NO: 33501 - DNA, 101 bp, rice(Oryza sativa)
  misc_feature (71): n=t or g
ttatctatcgaatatatgttctatgagtagatatataaaggtcaatagataaatacataggttgctacggnaacggtccaatgacctttatatataagttg

SEQ ID NO: 33502 - DNA, 101 bp, rice(Oryza sativa)
  misc_feature (71): n=t or c
ttttattttgcgttggtagttcttctttgaccttctgagaagtgtgactgagaaggggaaaataagttatnagaccttccggcagtccaggctaatttgaa

SEQ ID NO: 33503 - DNA, 101 bp, rice(Oryza sativa)
  misc_feature (71): n=t or g
ggcatccatgtcttgtaaaggagcttcattcattacagattacagacacttacaatctcaccaaacactcncagtgaaaggaaacatcactagcaacgttg

SEQ ID NO: 33504 - DNA, 101 bp, rice(Oryza sativa)
  misc_feature (71): n=t or c
ctagtcagacagtggcagtccagactgcatatatatacaatttgtgagatatgcatcggctcccctagcgngggcggaagaaatgaaacattatattcatg

SEQ ID NO: 33505 - DNA, 101 bp, rice(Oryza sativa)
  misc_feature (71): n=a or g
agatggttcaggcattggtctttgctgtggggatcgtaggtaacacacatgcacacactagctaattcganattacacacttctataacaactaaccacat

SEQ ID NO: 33506 - DNA, 101 bp, rice(Oryza sativa)
  misc_feature (71): n=t or c
ccaaaagttgatatatcttggaataatgaagttatcatagacgtctggttaccgatgagtaacgagtacgncatctatcactagaaaaatattagcataaa

SEQ ID NO: 33507 - DNA, 101 bp, rice(Oryza sativa)
  misc_feature (71): n=t or c
gctctaactcaagatgactgattcgctagaagagagtccatcccgactatcaaaaggaaggacgagacacngccataggtgattgctttgtatgttgttta

SEQ ID NO: 33508 - DNA, 101 bp, rice(Oryza sativa)
  misc_feature (71): n=a or g
tattataggcgctaacatgtgtgacaataaaaagaatgggacccacataccaatgactataataataatgntattatggtagagggtcatcatccgtcttt

SEQ ID NO: 33509 - DNA, 101 bp, rice(Oryza sativa)
  misc_feature (71): n=t or c
actatggctgtttaatggaattgtgtgttctccaattcaattcaaagcagaaactataggggttaggcganggagctcctcctcggactaaggccaccgat

SEQ ID NO: 33510 - DNA, 101 bp, rice(Oryza sativa)
  misc_feature (71): n=a or g
aagaactttagaagaagctcgaaagttagttgagcaaagctttggtaactatgttgggagcaatgtaatgnttgctgctaaagaagagcttgaaagaatac

SEQ ID NO: 33511 - DNA, 101 bp, rice(Oryza sativa)
  misc_feature (71): n=t or g
ttcatccgtagaaaacgaaggtgtagaaaacactttccgatatggatatgtctcttttgggatatgttgantttttatgggacggaggtattatgtcatag

SEQ ID NO: 33512 - DNA, 101 bp, rice(Oryza sativa)
  misc_feature (71): n=t or g
cttgttacactactagataaaaccattttttgcaggcagccaaaattagttttcccaggcaaaaggctggnccaccagtccgcctgagaagatccatcttc

SEQ ID NO: 33513 - DNA, 101 bp, rice(Oryza sativa)
  misc_feature (71): n=t or c
tccctgtgtcccgaagaaaactaaggtcccgtttagcacagttgtaactctaacttcacctcttctggagnttggagtccagccaaacggttttaactcca

SEQ ID NO: 33514 - DNA, 101 bp, rice(Oryza sativa)
  misc_feature (71): n=t or c
acaatcacgaagcagttcatcaaaagagctatgttgttgctcaaatatataccacccttgtgcttgcttgncttttccattctaccacaatcgatcagctt

SEQ ID NO: 33515 - DNA, 101 bp, rice(Oryza sativa)
  misc_feature (71): n=t or c
gataaatcccaagaatttgagagttgcaaggacggacgaccacacatgctattatgctaaattaagcccanttggctgcagttggatcattcacaggtgat

SEQ ID NO: 33516 - DNA, 101 bp, rice(Oryza sativa)
  misc_feature (71): n=t or c
gtacaaaccaaaattgtttctggcgtcttaaaaccacaaacttttcattagcgtgagggttcacaagtatnactacatcgaaattcaaccgcaacaaaaaa

SEQ ID NO: 33517 - DNA, 101 bp, rice(Oryza sativa)
  misc_feature (71): n=t or c
gtcgtcggtgacatagatggttgatggtgtcgtcaactttgaagacaacggctgcggaagctattagcagngatgccctagtggtgacggctagcaagtga

SEQ ID NO: 33518 - DNA, 101 bp, rice(Oryza sativa)
  misc_feature (71): n=a or g
catggttttattgattaagtaggtgctaattagtaactggtgaggccaagctgttgcagctgttgatctcnagatgggtggcctacaggaaagcaacggta

SEQ ID NO: 33519 - DNA, 101 bp, rice(Oryza sativa)
  misc_feature (71): n=t or g
tagacacattttctttcccagggatatttattactacaaagttcactaaatgtgaaatgttaaatgattcnaatttaaagccaacaaaatgtagaaaatta

SEQ ID NO: 33520 - DNA, 101 bp, rice(Oryza sativa)
  misc_feature (71): n=a or g
ctatttatagtgcaatgcttcaagtgatgagattaacacaggcttcgtttctaaagggaaaaaaaaatcancacacgagaacagctagcaatgaccgtgta

SEQ ID NO: 33521 - DNA, 101 bp, rice(Oryza sativa)
  misc_feature (71): n=t or c
cttgcacgctgtttaaaaatgcaacttttgtgtaactttactaaatgtttgctttggtctatgtttttggntggttcacctggatatgtttttttgtggta

SEQ ID NO: 33522 - DNA, 101 bp, rice(Oryza sativa)
  misc_feature (71): n=a or g
gaagtgaccgaacatcatgtagtgatgaaagtcaggtgttgacagaagtccgttgtcaagctaaggccatnggaataagcacaaggcaatggaaataatga

SEQ ID NO: 33523 - DNA, 101 bp, rice(Oryza sativa)
  misc_feature (71): n=a or g
tactagcaaccaatgaagaccaacttagtgcctccagtgctgccacatctaaagcccaggatgcagcacangcagttggagctcgatccccgacaagaagg

SEQ ID NO: 33524 - DNA, 101 bp, rice(Oryza sativa)
  misc_feature (71): n=t or c
tacccgttctaaatctaaccgaaatgggtatcccgataaaatatcagttgtgtagtagtgccattttgtangactgtgcatagtgtggtgcatcttttttg

SEQ ID NO: 33525 - DNA, 101 bp, rice(Oryza sativa)
  misc_feature (71): n=t or c
aagtcctgcatcgatcacactgctgctccggccgatgcatttcatctgaaagaagtgtttcatcttaaaanataaatattttttaaaatagtgctaagtca

SEQ ID NO: 33526 - DNA, 101 bp, rice(Oryza sativa)
  misc_feature (71): n=t or g
ggcagttgtttaaacatgtgcacagccaccctatgaatatacatacgcacaccctacctcctatgagaganaaatatttgtcaaaaaaaacatgaaaaaga

SEQ ID NO: 33527 - DNA, 101 bp, rice(Oryza sativa)
  misc_feature (71): n=a or g
cacgaacacgtaaagaattacacgttaatatattaaaaaaatataataacaccacgcaatcagccagaccngcttatgctaagggaagagagaaaagcaaa

SEQ ID NO: 33528 - DNA, 101 bp, rice(Oryza sativa)
  misc_feature (71): n=a or g
catccccccctcaggctgcagtgccatcgcccgtggtccacctccattggctattggaatgctgagaggcnccctcctcagcatggcctcaccgccagtgg

SEQ ID NO: 33529 - DNA, 101 bp, rice(Oryza sativa)
  misc_feature (71): n=t or c
tctcttttttcaaaggtccttccggagattcttcatatggctatcctggtctgctaacttctactccctcngtcccataataggtgacgtttttgactttt

SEQ ID NO: 33530 - DNA, 101 bp, rice(Oryza sativa)
  misc_feature (71): n=t or c
ctcactgcagctctagataaccactgccgaaccgttcgcaaggatacatcatgccataagacaaaattagntcacctgctgcgtgctcttgacttgtgaaa

SEQ ID NO: 33531 - DNA, 101 bp, rice(Oryza sativa)
  misc_feature (71): n=a or g
cacagtgaagcatatatccttgtgttttgtggacagtggacgtatgcttagtagtgtacgtaactcgatcntgttgcctgttagccaagattaatgcttaa

SEQ ID NO: 33532 - DNA, 101 bp, rice(Oryza sativa)
  misc_feature (71): n=a or c
aacaaaagaagaagaagagatggatcgatggagcgaagaatttgtttttgtcgatccacacacacacacanacaaaaaatctgaatgtgaatgttcgtagc

SEQ ID NO: 33533 - DNA, 101 bp, rice(Oryza sativa)
  misc_feature (71): n=t or c
acgaaaataacagcgagcaaacagttccatgctaccagcatcttccctatattaagagcaacatttcaagncgctctcatcaaacagcaaaacaaaccacc

SEQ ID NO: 33534 - DNA, 101 bp, rice(Oryza sativa)
  misc_feature (71): n=a or c
tccaaaaaggtagatcaatgtctcttctaccaaccccaatcttaactcgagatatcattgtttaaatctanaaccttgagtccacaaaacacctaaatagt

SEQ ID NO: 33535 - DNA, 101 bp, rice(Oryza sativa)
  misc_feature (71): n=t or c
tccaatatactgttggatgtagcactgcacagccatcgaagcagttagtatttatacgaaatttaaaaagnatttcaagtttcgatatacacatatatggg

SEQ ID NO: 33536 - DNA, 101 bp, rice(Oryza sativa)
  misc_feature (71): n=t or c
tatacaagttactcattccgtctgtaaatataagggattttttgttggatatagtagtagtagtatatcanatgaatgaatgtggacaattcaatcaaaat

SEQ ID NO: 33537 - DNA, 101 bp, rice(Oryza sativa)
  misc_feature (71): n=a or g
atgtcacctaaaatccaaaccgcttcggattgagttaggggttttgttgtctggtttgaaaagtttagggncgtagatatgtctggttttgtaatttatgg

SEQ ID NO: 33538 - DNA, 101 bp, rice(Oryza sativa)
  misc_feature (71): n=a or c
tgtttttaggctagcttctcgaagatgtctttgatgaacaaatgtataatatgtagatcttgtatgcatcnacggtcctcttcagaaggaacgtgtagtgt

SEQ ID NO: 33539 - DNA, 101 bp, rice(Oryza sativa)
  misc_feature (71): n=a or g
cacctttggggttcttcgcatctaggtagtaccaggacccttgtgcctcggactgcaccgaccgccttatnacccatgctgcgacgagacgtggacattcc

SEQ ID NO: 33540 - DNA, 101 bp, rice(Oryza sativa)
  misc_feature (71): n=a or g
cttgcaccatcactgttactatcactcagacactcactagtactccatcttctaccgagctagctatagtngcttcactaatccatctatgctctttcatg

SEQ ID NO: 33541 - DNA, 101 bp, rice(Oryza sativa)
  misc_feature (71): n=a or c
ctatcccgatcctgacaaccttggtctcctgtgaatttattattacaatcataagtcatacaagtcccagngaatttattattacaatcataagtcatagt

SEQ ID NO: 33542 - DNA, 101 bp, rice(Oryza sativa)
  misc_feature (71): n=t or g
atcttatacatattgcttttccgttaacttgggaggaaagttagtcttgtttcttcacgcttgtagtattnctgtaatgattgttgaaacttatattccta

SEQ ID NO: 33543 - DNA, 101 bp, rice(Oryza sativa)
  misc_feature (71): n=t or c
tggactccgaagatggattttcctaaatttgatggtactggtgtccgcgtgtggattgataattgtgaaangtattttgccttttatcaaattgcggaggg

SEQ ID NO: 33544 - DNA, 101 bp, rice(Oryza sativa)
  misc_feature (71): n=a or g
tgcataaggttccgctaacgtggtagcggttactataccatgctcgctggcgttgagccattggaactcantgcctttggccctggttctgtcctcgaagt

SEQ ID NO: 33545 - DNA, 101 bp, rice(Oryza sativa)
  misc_feature (71): n=a or g
ctttttttactacagttttcaccttgggagaagctgaaactgcattgctgctatagaagcaaaggacatgnaactaattatcaacatagataacagcatat

SEQ ID NO: 33546 - DNA, 101 bp, rice(Oryza sativa)
  misc_feature (71): n=a or c
tctttttcttgactgcacaaaagaaaatcctacagaccagcacttaaaagatttttcctcattaatctatntaagttttattaaacaaattggattgtcaa

SEQ ID NO: 33547 - DNA, 101 bp, rice(Oryza sativa)
  misc_feature (71): n=t or c
atgcattactagctaacaaaatgaatgaatgaatatatatatatgctgcctgcagcctgcatgtggtgcangctcactcattgctctttgtggaatgttcc

SEQ ID NO: 33548 - DNA, 101 bp, rice(Oryza sativa)
  misc_feature (71): n=t or c
ggagaggagaagcatggctggcgccgtggtatgtgggacgacgtcccccattgccacgttagcccatccangtttgcctttctgccgcggtggcatggtga

SEQ ID NO: 33549 - DNA, 101 bp, rice(Oryza sativa)
  misc_feature (71): n=a or g
attagctaaaacttaattaatcatatgacaatgagccgttctgtttttcatgctaagaggatgagttctcnacttgtaacttcgaacacagcctaaaaaaa

SEQ ID NO: 33550 - DNA, 101 bp, rice(Oryza sativa)
  misc_feature (71): n=t or g
taaaagcccattaggccggcccaggtcaacccgaccgattagggtttagctctgcgtgctcctataaaaanccttctcgcttctctccgccgccgccaccc

SEQ ID NO: 33551 - DNA, 101 bp, rice(Oryza sativa)
  misc_feature (71): n=a or c
gtcagttcagtttgctatttcagttctttacctgttccatgccatgccatattgtcctccgaaacaaattntatgaaacaaattccagtgattggaatatt

SEQ ID NO: 33552 - DNA, 101 bp, rice(Oryza sativa)
  misc_feature (71): n=t or c
ccgacccgatatcattgttttaggtatcggctgtcttaggctaagtatcacaatcacgttattattctcantgataaaattatcaatccattattcggatg

SEQ ID NO: 33553 - DNA, 101 bp, rice(Oryza sativa)
  misc_feature (71): n=a or g
attagttgagttttaatattctaaatcaacttctatatgttacgtccgtcccataatataagcgattctgnaggaatatattttctagtattacgaatctg

SEQ ID NO: 33554 - DNA, 101 bp, rice(Oryza sativa)
  misc_feature (71): n=t or c
atcaaatatgaaaagccgcatacaaaaggagactcgacttctgaataggttcacaatcccattaccggacngataaccgcacaagcggtatctccggtttt

SEQ ID NO: 33555 - DNA, 101 bp, rice(Oryza sativa)
  misc_feature (71): n=a or g
gggacagcaacagtatgtttgttttttctctgccaacgccaaatgtgaaatggatcagtgagatttctatncaaatggtttataatgagcagcaagagaag

SEQ ID NO: 33556 - DNA, 101 bp, rice(Oryza sativa)
  misc_feature (71): n=a or g
accatcagagccccgccagacctcgtgcacctaaaccgagccctagcactggggaagtggtttcgcggcgncgatggaagcgagaaggtcggcaggcggcg

SEQ ID NO: 33557 - DNA, 101 bp, rice(Oryza sativa)
  misc_feature (71): n=a or g
cagacaagcagtgcgtgatcttccaacggttagcacatcaagtgatggccattggagaggtaataatactnaaacaatttattttttttacagttaccgtg

SEQ ID NO: 33558 - DNA, 101 bp, rice(Oryza sativa)
  misc_feature (71): n=t or c
cggatttcatcctgcgtgtagtagcagacacagctttaaaaaaagtgataaggtggagatgcttgctcganaaggacaacggaacccaacacatgccgtat

SEQ ID NO: 33559 - DNA, 101 bp, rice(Oryza sativa)
  misc_feature (71): n=t or c
ctcctcaccaccgtcgctacctcccttggtcgcggcgggtccggtttgcttgccatcaccaacgtgcctcncgcagccgccctccgccgccggcttctccc

SEQ ID NO: 33560 - DNA, 101 bp, rice(Oryza sativa)
  misc_feature (71): n=t or c
ttagaagccagaatatgatttctccatattttcaccgacttcttttcggaacaggaccttaagggcttatncggatcggagggtaaacttaggaaaaatat

SEQ ID NO: 33561 - DNA, 101 bp, rice(Oryza sativa)
  misc_feature (71): n=t or c
ctttgggacaaatttgtcgtcgagaagtacagtgactgttcttatgtttccatgtagtatgggttttgatntactatgcatatatgacaatccttctgcca

SEQ ID NO: 33562 - DNA, 101 bp, rice(Oryza sativa)
  misc_feature (71): n=t or g
tcaaaatatataccaagacgaggaacaagaaagagttaaaaaaaaatgtcgcccctcagtgaagaacatangtaagaacaagtgctagagccatcagcatg

SEQ ID NO: 33563 - DNA, 101 bp, rice(Oryza sativa)
  misc_feature (71): n=a or c
cttcctccccaaaacataggaatcctcatgcaacacctcaatccatggcgatgtccaggcctctcgtgccnccatgctctccactgtctgcgtctcctgct

SEQ ID NO: 33564 - DNA, 101 bp, rice(Oryza sativa)
  misc_feature (71): n=a or c
gcaatgtgaatttcccagtgtaacttaggaagcacagtactattaaccatacaacatcatgcatagagcantatcatctttaacattcagcaggaaaccaa

SEQ ID NO: 33565 - DNA, 101 bp, rice(Oryza sativa)
  misc_feature (71): n=a or g
aagaacaatattgatcgatgagtcgatcggcatccacacgcattccacgtgttaattactttatttttttnggtaatggtttatattaaaccaacccctac

SEQ ID NO: 33566 - DNA, 101 bp, rice(Oryza sativa)
  misc_feature (71): n=a or g
aaaataggccgtggatttagcaccacggaccttggcgctgagatataacttcccaacgccaatagcattgnccctgagctctaatccgaggtggcataaat

SEQ ID NO: 33567 - DNA, 101 bp, rice(Oryza sativa)
  misc_feature (71): n=t or c
agaaaaatcgggcgggctgactctgacacacatcctttcaagcctacacacatgtacctttaacgatattnaaaacattttttctcgtaattatttatcca

SEQ ID NO: 33568 - DNA, 101 bp, rice(Oryza sativa)
  misc_feature (71): n=a or g
gctactcatatcactgcaaccattacgctacatgctccttcacctcaaccagttattgcccccaaggtacnatattttcatttattactcccatcaatcag

SEQ ID NO: 33569 - DNA, 101 bp, rice(Oryza sativa)
  misc_feature (71): n=a or g
gttaatacagctgcttccaagtaaattttaataaaaaggtaataagttgcaacagaacgataaagaaaacnaaataacaggtaacaaaaagaataaccgat

SEQ ID NO: 33570 - DNA, 101 bp, rice(Oryza sativa)
  misc_feature (71): n=a or g
ttttgaagcattagactcaactaggttctacctcctctttgactcaattaggtcttgacatatatccacanttgctctccacacttctgggatgctccctt

SEQ ID NO: 33571 - DNA, 101 bp, rice(Oryza sativa)
  misc_feature (71): n=t or c
tcgtaccacaagagggggcttgaaggagcaatgtttctggcaggacaactcgaaacatgtctaggaatgcngtcgcgaagtagcagcaacaacagttgcaa

SEQ ID NO: 33572 - DNA, 101 bp, rice(Oryza sativa)
  misc_feature (71): n=a or g
tcagcaccagcagcaaccacctcaccgtgatggattcactggctgaatttgttcctgccaatcaacggcanctaatcatagtaagcacttgttgaatttgt

SEQ ID NO: 33573 - DNA, 101 bp, rice(Oryza sativa)
  misc_feature (71): n=a or c
actgtgcgaatttttttttcaatttttatccgactccttgcgcaagaggtgcgaaaaaatagagaagacantgtggcaaccaactgcgtgaaaaagaagtc

SEQ ID NO: 33574 - DNA, 101 bp, rice(Oryza sativa)
  misc_feature (71): n=t or c
gatcgagctagatcagttcagttgcactgcacactagctatagctagcttgtgtcttccttaagctctccnaaacctttcccgcttggtaccggccggcct

SEQ ID NO: 33575 - DNA, 101 bp, rice(Oryza sativa)
  misc_feature (71): n=t or g
tatattgctggatgcatgtatacaccttgtcatggcgatttgagatgcacaaatgcccaccaaaatccatnttcttacttccgatcaacacgatccgaacc

SEQ ID NO: 33576 - DNA, 101 bp, rice(Oryza sativa)
  misc_feature (71): n=t or c
aaacactcccccctccctttcatcctctctccactctctctttcctctctctcttattctctccttttctntttctctcttattctctccttttctttttc

SEQ ID NO: 33577 - DNA, 101 bp, rice(Oryza sativa)
  misc_feature (71): n=a or g
atggagtagtgcaaactatggcgggatgaagagagagcgatgccaacagatgagccagcttgatgattccngcgatggcgacgcgcccgcgtactggcctt

SEQ ID NO: 33578 - DNA, 101 bp, rice(Oryza sativa)
  misc_feature (71): n=t or c
tacaggtgcagctgatgcactgtcgttgctaatccctttgtgacacgtggcatggtgacgtgtacctaacngatcagacagacactcaggaccccatggct

SEQ ID NO: 33579 - DNA, 101 bp, rice(Oryza sativa)
  misc_feature (71): n=t or g
ggccaggttaccttgcaccttacaagggaaccaaatatcatctacaggagtatcgagacagccctgaaccncaaggtaaggaagaaaaattcaactatgca

SEQ ID NO: 33580 - DNA, 101 bp, rice(Oryza sativa)
  misc_feature (71): n=t or c
cttctaatattgttcattctgcccaattacttctactcttattcatcatcctcatcaagcccaattatttnttatcttattcatcatcctcattaagaagc

SEQ ID NO: 33581 - DNA, 101 bp, rice(Oryza sativa)
  misc_feature (71): n=a or g
tgcgggaggaaagaaaaaaaatgagagaaaaaaaggtgtgggctattttttgccggattgatggtgtgggnaacctttccatagtaacttgtttactaatc

SEQ ID NO: 33582 - DNA, 101 bp, rice(Oryza sativa)
  misc_feature (71): n=a or g
tttaaattgcaggaatccacttcaaaaccgaagaacccttcaacttgcacgttttataaatacaggaatgnatcgatggtaagcctataccaaacagaaag

SEQ ID NO: 33583 - DNA, 101 bp, rice(Oryza sativa)
  misc_feature (71): n=a or c
tgatccttcaaggcagtgtccaatatgtggggctcatggtttgttgcagctatcatccggaagcaaagtgngtgtttttggataggaagtgttgggtactt

SEQ ID NO: 33584 - DNA, 101 bp, rice(Oryza sativa)
  misc_feature (71): n=a or g
tcttgcttcctatcaacctggtgcactgaacgtttgtcattttcgcacacttgcggcattttttatttggncgcagcatgtaaggtgctgagcttctctaa

SEQ ID NO: 33585 - DNA, 101 bp, rice(Oryza sativa)
  misc_feature (71): n=t or c
aacgaacgcaagattgtaggtatgcagctgatgtggtcaccatggcatgcgtgtgccacgcctagatactncatcactgaaaaaataattaactgtaaata

SEQ ID NO: 33586 - DNA, 101 bp, rice(Oryza sativa)
  misc_feature (71): n=a or c
gatatcgctatatgtattgcatacatatgcatcacacacagcatttctcagttgcatacacatgccgttcnaaaacgatcggtttctgcatttacatatgc

SEQ ID NO: 33587 - DNA, 101 bp, rice(Oryza sativa)
  misc_feature (71): n=t or c
attgtttgaatataatgctcagatctactttagatatgccattcagagttccctcaattaataatggtggngcttgtgtgtttggatggttatggattatt

SEQ ID NO: 33588 - DNA, 101 bp, rice(Oryza sativa)
  misc_feature (71): n=a or g
cacatgattattggattctatttgtgattttgtgaatcttcatacgaatttgacgaaaagctgcataaccnttgactcaagattacgacatgcaactttta

SEQ ID NO: 33589 - DNA, 101 bp, rice(Oryza sativa)
  misc_feature (71): n=t or c
atgcatgcatggacaaaggcgtaggacactataccagcattgagagagcaagcaaccactgcctgatgcancagcgcaggattacaacacgatggtggtca

SEQ ID NO: 33590 - DNA, 101 bp, rice(Oryza sativa)
  misc_feature (71): n=a or g
ttacctgtgattcatctcgtgaattttggctaagttcctgttagtgattcctgaatttgtctgttgcccgnaagttccggtataagaacaccggaagttcc

SEQ ID NO: 33591 - DNA, 101 bp, rice(Oryza sativa)
  misc_feature (71): n=t or c
atagccaaaacgagtttaacggattataggccgccttcctgggcataggtgtttgtgaaaataataatttntatggataagcatcgtccgtatgtaaaaac

SEQ ID NO: 33592 - DNA, 101 bp, rice(Oryza sativa)
  misc_feature (71): n=t or c
gacactaattttatttttttaagaaatacaatatgtaataaattgatggtcaaaaggccctatttggatcnaagggatattttttagtcctctcttaaata

SEQ ID NO: 33593 - DNA, 101 bp, rice(Oryza sativa)
  misc_feature (71): n=t or c
ccaacacaagacgtctggtagtggtactggtccgtccaagaccattgcgacggcctcctcttactacacancgaccacgccggtgggcagcggccgcgaaa

SEQ ID NO: 33594 - DNA, 101 bp, rice(Oryza sativa)
  misc_feature (71): n=a or g
ctgaatttatggacaagtacagaagatgtggggctctggactctgggtaattaggcaagtttacactaggnctgttcacccgggaattttcattttaaacc

SEQ ID NO: 33595 - DNA, 101 bp, rice(Oryza sativa)
  misc_feature (71): n=t or c
aaaaaacctgtgaacattattatttttatgcttagttcttttttccatggcttatgagccgtaaatcaaanaatgtgtacttcgattttaaaatgagatgg

SEQ ID NO: 33596 - DNA, 101 bp, rice(Oryza sativa)
  misc_feature (71): n=a or g
ttttggcatccttttcccacctattgtggaaaggataatttgttgcttataatagggtatgtagctttcangtttaactacagccatgtgttattttgaat

SEQ ID NO: 33597 - DNA, 101 bp, rice(Oryza sativa)
  misc_feature (71): n=t or c
catgcgttgcaacgggtaaaaaacatttttatcattatatacttttcaattccagcccagcccattgcctncctctgcttggtctgcctctctttgacccg

SEQ ID NO: 33598 - DNA, 101 bp, rice(Oryza sativa)
  misc_feature (71): n=a or g
atggagaggaaattttttttatcaacttgccaaatgtggagatggagagtttgatttgggtatgctgttgnagatgctcttaggtgaagatctcatgttta

SEQ ID NO: 33599 - DNA, 101 bp, rice(Oryza sativa)
  misc_feature (71): n=t or c
aaggtatcatgtcctaaacctatgtgtactatatatatcggcacaatgatcccgcggctctatgcgtttcnaatgagattcgcctcggcgatgttaaattt

SEQ ID NO: 33600 - DNA, 101 bp, rice(Oryza sativa)
  misc_feature (71): n=a or g
agtattggctagccatcgtcccgatccaaaattgtgatcgccatatttcgcacgatggcaacaagtgtaanctaagtgcacatatgccagacaaaagctgg

SEQ ID NO: 33601 - DNA, 101 bp, rice(Oryza sativa)
  misc_feature (71): n=t or c
ctaaaaatatgggacggaggaagtactcatttaggagtaacattcaagttcatagcttttttttttgaganggagctagttgtactcaatatagagaaaat

SEQ ID NO: 33602 - DNA, 101 bp, rice(Oryza sativa)
  misc_feature (71): n=t or c
tttaggatactatctggctatctttgatctttttttttcctttgattgaggtgctagcacctaacagtagnacttaagatatactcgataggacagtaaca

SEQ ID NO: 33603 - DNA, 101 bp, rice(Oryza sativa)
  misc_feature (71): n=t or c
tttctccagagttagtccaaactttgaagccacagtaggaaatctcatctctctaatttatatatgcgggntggatacaactgaattattgcagtttgcgt

SEQ ID NO: 33604 - DNA, 101 bp, rice(Oryza sativa)
  misc_feature (71): n=t or c
tcgaaatcgctaggggcgaaatgaggcgccacaagcgaatactccgaagcagaagtctcgacggctgcccncttccccttcgcctcgattagcggcgatgc

SEQ ID NO: 33605 - DNA, 101 bp, rice(Oryza sativa)
  misc_feature (71): n=t or c
tctctcggttttcacatcgagaacgacgacaacatcagaagtcgcaaccggtctcacgagttcatttaagnagaagtcgggggctactgtcagggttacgg

SEQ ID NO: 33606 - DNA, 101 bp, rice(Oryza sativa)
  misc_feature (71): n=a or c
aatcaactacaaagctgtcaataaaaaaatgacaaagaaacagaagaaaaggtgaagatagagcttactanttattttaagcacatgtcttgattctcttg

SEQ ID NO: 33607 - DNA, 101 bp, rice(Oryza sativa)
  misc_feature (71): n=t or g
aataaacatgcatggaccccatgggaaggattcatcatcttaggttctccccttccttctactttaagcanattccagcccgcactactatgccttggttc

SEQ ID NO: 33608 - DNA, 101 bp, rice(Oryza sativa)
  misc_feature (71): n=a or g
tatcaggccacagatgcgctgagtaattcatgtttcagtccatgtattcagatgttttattagttgaatcnaaatattgcaatgaatttttggtggtgttt

SEQ ID NO: 33609 - DNA, 101 bp, rice(Oryza sativa)
  misc_feature (71): n=t or c
tagccatctttctccacttcaatagtagtctttctccactccggtcacatcctttgcttcctcttaccacnaacaaaattgcacaagggtgtgggtcctag

SEQ ID NO: 33610 - DNA, 101 bp, rice(Oryza sativa)
  misc_feature (71): n=a or g
tttaaccgcacgtacgccccaaagattcttggatcgctgaaagtctcccaagtttgtagccggaaatgcangtggtagaatacgggtcaagcgataacgaa

SEQ ID NO: 33611 - DNA, 101 bp, rice(Oryza sativa)
  misc_feature (71): n=t or c
taaccattaataaagactttgggccatctttaattgtccactatggctcatatatttcctagaagtttacngttgttcattctaagaaaagaataactgca

SEQ ID NO: 33612 - DNA, 101 bp, rice(Oryza sativa)
  misc_feature (71): n=t or c
gggtatctttctcgtattcatcttggcgtgcttgtacttgtgttcctcttgacttatcaaaagccagttcncgtttaacaggtctgagcagcgaagctata

SEQ ID NO: 33613 - DNA, 101 bp, rice(Oryza sativa)
  misc_feature (71): n=a or c
cgatcgatcactttcacctaggcgaacacaaagagaagtattccaacaaccagtcggttccaaatcaggtntggtttagtgtctaaatttttcttcaaact

SEQ ID NO: 33614 - DNA, 101 bp, rice(Oryza sativa)
  misc_feature (71): n=t or c
gctagctagcctactctctccttttagtagtgagagtagtgagttaaccgttcgtgcaaggtccacgtacncctacccctctccggccatggcgtgcgtga

SEQ ID NO: 33615 - DNA, 101 bp, rice(Oryza sativa)
  misc_feature (71): n=a or g
ctccagtgatggctactcaacgacaagctgttccaatatgttcagttgtttttccaactaaccaagagtcngggcctacacaaatacaagactcaaaatcc

SEQ ID NO: 33616 - DNA, 101 bp, rice(Oryza sativa)
  misc_feature (71): n=t or c
ttatctattatcctgatgtgagatacaacaaagatatgccttacatatctcttcaatattcatgacgcaanattagatgaaaaaatattaaacaaagtaaa

SEQ ID NO: 33617 - DNA, 101 bp, rice(Oryza sativa)
  misc_feature (71): n=a or g
gcggcgacatgagccctcgatctctccttctgtcatggtatcaccattcactgacagccgcctgaggctcngacctcatgggtagacgggtcggagcgaat

SEQ ID NO: 33618 - DNA, 101 bp, rice(Oryza sativa)
  misc_feature (71): n=a or c
gattcaactgccaatgacgaagattatgaactactgtatgcatgacttacttgtggcaactaattactccntccgtttcacaatgtaagactttctagcat

SEQ ID NO: 33619 - DNA, 101 bp, rice(Oryza sativa)
  misc_feature (71): n=a or c
gtggggcgttgctttcctgaaagcaagacgtgcaaaccgtctcggcattggcgttggcgattaccgggagnagcagcagcaacgcgatgccccttgtcgct

SEQ ID NO: 33620 - DNA, 101 bp, rice(Oryza sativa)
  misc_feature (71): n=t or c
ctgacccagacaaggaaagagctactcatgtaagtgtgagtgctgaccacacctcatgctgcaagcagcangtgcacatgcacaggaaatatggtgaggcc

SEQ ID NO: 33621 - DNA, 101 bp, rice(Oryza sativa)
  misc_feature (71): n=a or g
attgatttgagaagttcagtctaaggttattttttttattatattccttcactcccgcgtagctctgctcnactccaattagtgtgccgcttcgccaccgc

SEQ ID NO: 33622 - DNA, 101 bp, rice(Oryza sativa)
  misc_feature (71): n=a or g
ggtagttattatacgtatcatctattagtaccatctattacttacgtgtataaattttcagcccatcaacnaacgatactattaaacttgctctcaagata

SEQ ID NO: 33623 - DNA, 101 bp, rice(Oryza sativa)
  misc_feature (71): n=t or c
cagtttccacatattgaactagagttcagaaaaaaaaaaggtgtatatgagaagtgagcagggagctcagncaaagaaagtacaacaaaatgtagcacttg

SEQ ID NO: 33624 - DNA, 101 bp, rice(Oryza sativa)
  misc_feature (71): n=t or c
attgctactttgaactttcagattactgacgctgacagcatttcaatgcatcaaatacgaaactgtaatanattatctggaagggggaatacaccatcttt

SEQ ID NO: 33625 - DNA, 101 bp, rice(Oryza sativa)
  misc_feature (71): n=a or c
tgtatgtgtacaacgtcattttcagttaactttatttgaccaaaggaaaagaaggcttaattggtacttcntccgtttcacaatgtaagtcattctaacat

SEQ ID NO: 33626 - DNA, 101 bp, rice(Oryza sativa)
  misc_feature (71): n=a or g
tttgttctccaagtctgactcaaaccaatcaattccacacaagttcaccattttctactttgatgcaatcnaaccaaaggatagggaaaggcccacgctgc

SEQ ID NO: 33627 - DNA, 101 bp, rice(Oryza sativa)
  misc_feature (71): n=a or c
cagcttctgcttctgctcgcgacacaacgcaaccgagacgcaacgttaggagagcgagacgacgacgacgncgacgacgacgccatggtgttcgatcgatg

SEQ ID NO: 33628 - DNA, 101 bp, rice(Oryza sativa)
  misc_feature (71): n=a or g
atctgctctcaggagtcaggagacacatcaatgcagataacgactcattaacgcaaaactctgcctgttgngcaaaaatcgatcgatacataaggcgctgc

SEQ ID NO: 33629 - DNA, 101 bp, rice(Oryza sativa)
  misc_feature (71): n=t or c
atgataagagacacgcacacataacacaacttattgtggtgaaactagtatacttgggtttaaattaatgnttgtttttatgactaattattctttcagta

SEQ ID NO: 33630 - DNA, 101 bp, rice(Oryza sativa)
  misc_feature (71): n=a or g
ctccatggctgcctcctccctgcagccgccgccgcgctagctagctactagcatacatatacacccctccntccaaaaaaagttcaatcctgtccaggttc

SEQ ID NO: 33631 - DNA, 101 bp, rice(Oryza sativa)
  misc_feature (71): n=a or g
tttgtttggttggcatcctaagaagtagcctgacacaggcgagtgagctcaggctcaggcgtaggaatatngtggcctgagtcaagcaactaggttaagag

SEQ ID NO: 33632 - DNA, 101 bp, rice(Oryza sativa)
  misc_feature (71): n=t or c
aaagtgtagtgtacataatacaacaataggaaggcctaccgatgacctcgtcagcaaagctctgctgctantctgtaaaacttacctgatgatccatgaag

SEQ ID NO: 33633 - DNA, 101 bp, rice(Oryza sativa)
  misc_feature (71): n=a or g
cgtgtggcaatccatatgaagcacattaattcaacctgatgacgtataccgagccatattgttagaatcgnctgtatcggctaaccctgttcgactcgaac

SEQ ID NO: 33634 - DNA, 101 bp, rice(Oryza sativa)
  misc_feature (71): n=a or g
agcataaaaaaagataaaacacatataaaaaataccactctggaagcaatcaattaaaataatgccttgantgcatgcaattatgtagagtgaactaacct

SEQ ID NO: 33635 - DNA, 101 bp, rice(Oryza sativa)
  misc_feature (71): n=t or c
acagccctacatcacctagctatagccctacatctccaagttacagcccgacctcgccaagttatagtccnacttctccgagctacagtccgacatcacca

SEQ ID NO: 33636 - DNA, 101 bp, rice(Oryza sativa)
  misc_feature (71): n=a or c
taaaattagtacggaggaacagagtgaggaaatcttccttgatggagtagtatatcatttcatttgttgantacttgaattgatttgatctttctgaagaa

SEQ ID NO: 33637 - DNA, 101 bp, rice(Oryza sativa)
  misc_feature (71): n=a or g
attgaaaaaaaatacaattgtttgcatgtggtttcaaataaatcggatttatggtggagctaaactgtgcnctagctagcgaaccactgaacatgcccctc

SEQ ID NO: 33638 - DNA, 101 bp, rice(Oryza sativa)
  misc_feature (71): n=t or c
attccctccccctcctctctctctctctctcactcagacacttagaaaaatcctccctcagcgcctccgcnggctccctccttgccctatccgctggccga

SEQ ID NO: 33639 - DNA, 101 bp, rice(Oryza sativa)
  misc_feature (71): n=t or c
gcaatgaaatactctgggatccagttctgtgagggtaaccaatggtttttgccttctttaaaagttctgtntttgtatcgattagattgtgtattgtctgt

SEQ ID NO: 33640 - DNA, 101 bp, rice(Oryza sativa)
  misc_feature (71): n=t or c
atgctgtgccaaacatcaaaagccaagacaaacggtgacctgatcattttgcttcactgtcagattcatgnattataaatggcatgatttttctgctattg

SEQ ID NO: 33641 - DNA, 101 bp, rice(Oryza sativa)
  misc_feature (71): n=a or g
ctccattaatattactattattagtcacatcatgttttaaaacgataatagttccggtacaagtctaaggncatctacaatattgtgctataagaatgact

SEQ ID NO: 33642 - DNA, 101 bp, rice(Oryza sativa)
  misc_feature (71): n=t or c
tcccggctcccgctggcgctcaaggccgcggctcaggccgagacgccaacctttgccgacaactacacgcngccgccgtcaagggtgggctagcgcgctgc

SEQ ID NO: 33643 - DNA, 101 bp, rice(Oryza sativa)
  misc_feature (71): n=t or c
ggcagtcgagtccagagatggtggcggagataaggacgtgcatttcagaatttcagtgagaacatgcaagntcaaaccaaactcaaattactatatgtata

SEQ ID NO: 33644 - DNA, 101 bp, rice(Oryza sativa)
  misc_feature (71): n=t or c
tagctatttcctgttctggaaggaaaggaacctgatagcagtacaagagctggcaatggcacggcatatanggtggtgtttgaaactaatgaagatgaaga

SEQ ID NO: 33645 - DNA, 101 bp, rice(Oryza sativa)
  misc_feature (71): n=t or c
ctttatgttcttgatgtgcttgggtcggcttgattgagctgagttggagttttttatttctcatgttcatncttgtaggtgttggttcttgggtaaaactg

SEQ ID NO: 33646 - DNA, 101 bp, rice(Oryza sativa)
  misc_feature (71): n=a or g
cctggtccagattcactaatttagtgcagtccggacaacccttatccttacctgactatgtgcttttgcancattttcatatgggtctaaataaggagtct

SEQ ID NO: 33647 - DNA, 101 bp, rice(Oryza sativa)
  misc_feature (71): n=t or c
ggctctgcgctgcaagctcaacattagcacgcgtaagaattctaaagccacttctctaccgagtgaatccnctttgtgtgcactttctgctagtgtgtttg

SEQ ID NO: 33648 - DNA, 101 bp, rice(Oryza sativa)
  misc_feature (71): n=t or g
atggtggcgataccgcttgatgtggcgatagcgatgcgtcatgcgtgcgagctttggtggatcgacgattnagatatgctgtgggggatggaaaggatgcg

SEQ ID NO: 33649 - DNA, 101 bp, rice(Oryza sativa)
  misc_feature (71): n=t or c
tgcacgcacgtgtagacaggagaccacctttattagggtatgtacgatggttatcaacagtggtttaattntttgcattgctaattaggaatacctgttgt

SEQ ID NO: 33650 - DNA, 101 bp, rice(Oryza sativa)
  misc_feature (71): n=t or c
gcgatgttacaagtcaatgcttattcaaattatgcttgaggaaaacaggacaggtttttcatattaacaanacattcacctacaatttcttcatgctgttg

SEQ ID NO: 33651 - DNA, 101 bp, rice(Oryza sativa)
  misc_feature (71): n=a or c
ggtttctttcttactttttcggtttggtaggacaccatttgtcattttctttcacagcatctctgtgcttnctccctgggctgcaaagtaacggccaagcc

SEQ ID NO: 33652 - DNA, 101 bp, rice(Oryza sativa)
  misc_feature (71): n=t or g
aagacgcaaactagagaggaggagatgatgcgaggagagcatggagcatgtgcaattacttctagacctanaattcaactaaacaattttcaacttcacca

SEQ ID NO: 33653 - DNA, 101 bp, rice(Oryza sativa)
  misc_feature (71): n=t or c
aatttcatggcagaagctcctcagggccctcctccgccagcttctaaccctccggctccagcagttgatcngagctacggttcatacccaccaccatatgg

SEQ ID NO: 33654 - DNA, 101 bp, rice(Oryza sativa)
  misc_feature (71): n=a or c
ggtgatggtgaatcttgacgcctttgggatggagcttgggtctgaaatccagatccacacatcaaaagtgntgttgttgttgcgacggcgggagtattctt

SEQ ID NO: 33655 - DNA, 101 bp, rice(Oryza sativa)
  misc_feature (71): n=a or g
tttatggagctcatgcaaaacctcatggagaattacacacccatccaaaatatacctcccaggaatgaacncagtctgtgtccagttaataatccccccaa

SEQ ID NO: 33656 - DNA, 101 bp, rice(Oryza sativa)
  misc_feature (71): n=t or c
ggcagctggccgtgtcgacccggcccgtatactgtgtgggatcgcagtagctacagcgcacggtacggaanctcgttaattatcactactttctttgtctc

SEQ ID NO: 33657 - DNA, 101 bp, rice(Oryza sativa)
  misc_feature (71): n=a or g
ggactgggagtggaagcacaggctacaacacatggaggactcctttcccttttttgcttccaatctgaaancattcagtttattggttatgggctgatcaa

SEQ ID NO: 33658 - DNA, 101 bp, rice(Oryza sativa)
  misc_feature (71): n=t or c
gcgtccccttatggggatgaatagagtttcccctttgaagtagccatttcacactagatcgctttaggaancgaattaaaagtagcagaaataatatattt

SEQ ID NO: 33659 - DNA, 101 bp, rice(Oryza sativa)
  misc_feature (71): n=t or c
tggacaatgaagactatctttatttttcctataccatatgagcatttttcagaaggttggattagcatatnttgagattgacgaagttaccatggacgtct

SEQ ID NO: 33660 - DNA, 101 bp, rice(Oryza sativa)
  misc_feature (71): n=t or c
ggtattgtgactacatatatgtacttttacaagtggatttttatgatgccagactgggatacagacatcantgtgtaactgaaactattgtatctaaggca

SEQ ID NO: 33661 - DNA, 101 bp, rice(Oryza sativa)
  misc_feature (71): n=t or c
caaacgtaagcgcaacttggtcttcggtcaagtggcgggcacagatctcgaggcagtagtagtcctaggcngtgtttaggttcaaaattttttcgtcaaac

SEQ ID NO: 33662 - DNA, 101 bp, rice(Oryza sativa)
  misc_feature (71): n=t or c
taaccaggttgagtatattaaatgtttacttgtttaaaccactggcaccgttgagcacaaaacttcctttnctttaattcattctcttaggtaggaggtaa

SEQ ID NO: 33663 - DNA, 101 bp, rice(Oryza sativa)
  misc_feature (71): n=a or g
agttcaatactatatgtgccggaacagttaaaaccaataactacagatctcttcccacctttgcatggtgnaaaaaataaaataaaatcgacaccttttac

SEQ ID NO: 33664 - DNA, 101 bp, rice(Oryza sativa)
  misc_feature (71): n=t or c
tagttgacttgaatgtaagagtaaggcactatactgttctagcaaatacgttacgaacaatacaaagttanaaaatattccacttaacacagtacaaaacg

SEQ ID NO: 33665 - DNA, 101 bp, rice(Oryza sativa)
  misc_feature (71): n=a or g
ttaagtgctaaatgtaatagtgacaaaaaaatttaaaatgcctcccattaaacatgaatttgttttggtantgtgaagatcaattgtaagtgaagtcagta

SEQ ID NO: 33666 - DNA, 101 bp, rice(Oryza sativa)
  misc_feature (71): n=t or c
aagtggaaccgaaaatacagaaaacggaaaaaaaaaaggaacacgaggcgctacggactcggagtgcgcgngagttgctaatctggcgcgtctgcgcggat

SEQ ID NO: 33667 - DNA, 101 bp, rice(Oryza sativa)
  misc_feature (71): n=a or c
gtttctcaccagaaaatcctctctagcctttgcctattttttgtcttgtgttcttcgatgaacctattccntgtggaaattcgatacttggaatactccta

SEQ ID NO: 33668 - DNA, 101 bp, rice(Oryza sativa)
  misc_feature (71): n=a or g
agcgtatggtggctttatatttcttggggtttttttttctctctgtggggttgggaagaatgtttggaganagagagagagagagagtgtgtgtgtgtgtg

SEQ ID NO: 33669 - DNA, 101 bp, rice(Oryza sativa)
  misc_feature (71): n=a or g
attgatcccctttttctaaaaacaaaagaagatgagggatgtggtacattttctgtggtttcccattgctncaataaaacagtaaatcattataccagatg

SEQ ID NO: 33670 - DNA, 101 bp, rice(Oryza sativa)
  misc_feature (71): n=a or g
aatagtagttgacatcaacaactcgatgcattgtggcaaacatgagcaattgtttctttcggatgaaaatntgttgtggtacctttatacagatctgcaca

SEQ ID NO: 33671 - DNA, 101 bp, rice(Oryza sativa)
  misc_feature (71): n=t or c
gttttcatacagcattacaaaattatttggagcacttgagacaagtggtcgtcgcgggcgatggcgcgganggccgcggcggctgcgggtgacggcgtagg

SEQ ID NO: 33672 - DNA, 101 bp, rice(Oryza sativa)
  misc_feature (71): n=t or c
tcgagaaagaatcaaagtagtcagaactacatatcagaggagctgagcagattctatcaaacttcatcaangaaaacagcaagagacctgctgcatcaagc

SEQ ID NO: 33673 - DNA, 101 bp, rice(Oryza sativa)
  misc_feature (71): n=a or g
actaactgtatatggttcggatttcaaggtccattggaccatgaacacatctttggtttcagctggacttnaatcttaagctaaacagatgaatttgcatc

SEQ ID NO: 33674 - DNA, 101 bp, rice(Oryza sativa)
  misc_feature (71): n=a or g
tttttgatgattcctgtctatccaaactcaggcatcaatttggggccctgtttcatttccacatggatttnaattcgaaactgtttattgagttgtttcca

SEQ ID NO: 33675 - DNA, 101 bp, rice(Oryza sativa)
  misc_feature (71): n=t or c
gtctcagtgctccaaccatggggaaaaacagagaagtctcttcgccacatgatgctgacatgctgtttcgnattctactccgtccgtcaaaaaaaaaaaaa

SEQ ID NO: 33676 - DNA, 101 bp, rice(Oryza sativa)
  misc_feature (71): n=a or g
caaacacctctcgcacatttttataagcgggtattttttttcctccttagtaaaagtaaaagggacctacncatgaaaatcctttttaatagtgcttgcca

SEQ ID NO: 33677 - DNA, 101 bp, rice(Oryza sativa)
  misc_feature (71): n=a or g
ccaccacacccgccaacaccgcaaccatcgccaccacaaataaccccacaaacacgccggcggtcacatcnccgcgataccgcccggactctcctcgagag

SEQ ID NO: 33678 - DNA, 101 bp, rice(Oryza sativa)
  misc_feature (71): n=a or g
ctgctccccgcccctcccgaggacagccggggatggatttgaccctcccatggccactggcaatggcaacngattcctccttgtggttgcttgagagaagg

SEQ ID NO: 33679 - DNA, 101 bp, rice(Oryza sativa)
  misc_feature (71): n=a or c
ttgcctatgcaactgcccaactacaagaattatagtacaagcactctctaagaataccacaagttagcttntgaagagcatagatattcatgtcatgacaa

SEQ ID NO: 33680 - DNA, 101 bp, rice(Oryza sativa)
  misc_feature (71): n=a or g
tgcctcaatcccggcccgttggaagtctcctctcagacggagtaaaaaagaagattcctctcaaaaaacanaataaataaaaattaaacagggtatattat

SEQ ID NO: 33681 - DNA, 101 bp, rice(Oryza sativa)
  misc_feature (71): n=t or c
gttagggagtccctttgcaacaatttggctattctagtccatttccactctcaagtaagggtgcaactagngggtcaactcacgattcacaaaccccacct

SEQ ID NO: 33682 - DNA, 101 bp, rice(Oryza sativa)
  misc_feature (71): n=a or c
taatcttatctatatatctagaaatagaagtagtaccgactactacggagtagtacaagtccatgtacacnagtgttatactccctccgtcccataatatg

SEQ ID NO: 33683 - DNA, 101 bp, rice(Oryza sativa)
  misc_feature (71): n=a or g
taaccaggggagctaattacattgtggtagttggagcaagattgctgtctactacttgtttgcagtgcaancttggaactttgtactaattgatgttaatt

SEQ ID NO: 33684 - DNA, 101 bp, rice(Oryza sativa)
  misc_feature (71): n=t or c
ggcggaacgggtgaagatcaggcgagtcgaagctgctttctggggatgaggcggcatttcttgtggatgcngcagcactcggttggaatgcgctcctcgct

SEQ ID NO: 33685 - DNA, 101 bp, rice(Oryza sativa)
  misc_feature (71): n=t or c
acaagaggatttgtgctgcgatgaagctatagcttttcggggtttttcccttcttctgttgacaaaaattnaacatgcaattcccacttaatttcggaaat

SEQ ID NO: 33686 - DNA, 101 bp, rice(Oryza sativa)
  misc_feature (71): n=a or g
aatataccggcgtcgcggtttgaaacagcgatagtgcgatatcgcgtaatgtgcgcacgaaagcggtggcnctcatcggtgtcgcggtcctaaagcgcgag

SEQ ID NO: 33687 - DNA, 101 bp, rice(Oryza sativa)
  misc_feature (71): n=t or c
atagccgattgctcacaaattttatagttgcagaagaagaaaaccccacccaacatccgtccttatcgtgngcctcacaatcgctgtgaagaagaaatcgg

SEQ ID NO: 33688 - DNA, 101 bp, rice(Oryza sativa)
  misc_feature (71): n=t or c
ttgattccaaatgatggcaataagattggaagaatatgtatctctgatttccagaactctgtcttacagcnaggataatatgttgctctcgtacaagagct

SEQ ID NO: 33689 - DNA, 101 bp, rice(Oryza sativa)
  misc_feature (71): n=t or c
cgtttcaaaaattctggcaccatctaatagtacaaattgcgttaagtactgtaaagcagtaacgctatttncaacccaatgactaggatggtgtccatagc

SEQ ID NO: 33690 - DNA, 101 bp, rice(Oryza sativa)
  misc_feature (71): n=t or c
agaaagaaaggctcgcagatcccatttgctccggtccactctgtgcacagccctgtgttgtctaggactanctccgtctcaaaataagtgcggtcatggaa

SEQ ID NO: 33691 - DNA, 101 bp, rice(Oryza sativa)
  misc_feature (71): n=a or c
attcagactactttgcaaatagaaaatcatggtagaatacatgagtaagtgagtaatatacttatctctcnatatataaaatttcttaaaaaaattgggta

SEQ ID NO: 33692 - DNA, 101 bp, rice(Oryza sativa)
  misc_feature (71): n=t or c
ggcttgctgctaagtcaggaaaggtatgcaaatgagatccttaagcaagtcagtatgactggatgcaaacntgtaagtactccactctccactgtagagaa

SEQ ID NO: 33693 - DNA, 101 bp, rice(Oryza sativa)
  misc_feature (71): n=a or g
ggccccaaatttttggggcgcctgtgtggtcgggcatcccacactacttatgtatgagccttatgtaaaanggttaatttgtcatcatcatttcgttcttg

SEQ ID NO: 33694 - DNA, 101 bp, rice(Oryza sativa)
  misc_feature (71): n=a or c
ataattgtatagaaaagctccacttttttttttgagttgctcaaagttttgttgtgcgtttaccgtttatnttttctttttaaagctagaagcactcatat

SEQ ID NO: 33695 - DNA, 101 bp, rice(Oryza sativa)
  misc_feature (71): n=a or g
caaatcccaattgggtcaggatgtcacaccattataatgagaatgtttctgctgtgcttctgtcacgcccngaatttctatccaaaattccaaacgcttac

SEQ ID NO: 33696 - DNA, 101 bp, rice(Oryza sativa)
  misc_feature (71): n=a or g
cgatcttccatcacacgtcatgaacaaactctcaaagctatcaaatgagggcagccattgttccgctgctnccgcaaacctgggcaagacgaggatgccag

SEQ ID NO: 33697 - DNA, 101 bp, rice(Oryza sativa)
  misc_feature (71): n=t or c
tgtcttcattatagtattgtccaactgcaaacttgaaaggttgaatatttgttaccatcaggtaactatantttcaaaaacttataattataactaatatc

SEQ ID NO: 33698 - DNA, 101 bp, rice(Oryza sativa)
  misc_feature (71): n=a or g
catccatttagagcgtagaggccgagttatataatcctttattgaaaaaacaagccacggatggctggcanatgaaaagcatctctcatcccttctttctt

SEQ ID NO: 33699 - DNA, 101 bp, rice(Oryza sativa)
  misc_feature (71): n=t or c
aaatgaagttgtaagatgatgacccactgcaatagtaacttgagatcggtatgacatgacactaaaggganagcattatagttttgtttatagacgacaaa

SEQ ID NO: 33700 - DNA, 101 bp, rice(Oryza sativa)
  misc_feature (71): n=t or c
ccaaataaaacctaatgttgtgattttgcgattttgccaccatacatgctatttaaggtgaatttggtcangtctatcagatcaagcctagattgtttact

SEQ ID NO: 33701 - DNA, 101 bp, rice(Oryza sativa)
  misc_feature (71): n=t or c
gactaaaatccattagtctctcttagaggtacttaagtgacatcctctctcttctctctccctcgatccangtgctttcagtccctagatccaaacagtag

SEQ ID NO: 33702 - DNA, 101 bp, rice(Oryza sativa)
  misc_feature (71): n=t or c
ttttatttgtttggtccaagatggtaccaactactagtccactttttctacaaatagttttacggtctggnaccctatcaaaaaccgaaaaagattcccct

SEQ ID NO: 33703 - DNA, 101 bp, rice(Oryza sativa)
  misc_feature (71): n=a or g
gtagtatagtgtatttttatacaaagatttttttcaatcacatagggatgttaggctcgggacgttggggntcatggaattttttttattaaaagttttac

SEQ ID NO: 33704 - DNA, 101 bp, rice(Oryza sativa)
  misc_feature (71): n=a or g
gtcaccttgcacaacgtcagctgaagcatacgactcaagttcagacatctcgtcaggtgtgagcttcactnacagtgctcccacattctggtcgaagttgt

SEQ ID NO: 33705 - DNA, 101 bp, rice(Oryza sativa)
  misc_feature (71): n=t or c
atttactttgaattcccaagcactcgtggagggttgatttgttgaggctaagatcccaatacctctcaatnctataaactgcactcacagaaggtatcttt

SEQ ID NO: 33706 - DNA, 101 bp, rice(Oryza sativa)
  misc_feature (71): n=a or g
caggtgagcagcagcctcagattcccccagactgcagctgacatgggggcaaaagaactaaatagagaganagagagaggggaaaggagagagaaagagag

SEQ ID NO: 33707 - DNA, 101 bp, rice(Oryza sativa)
  misc_feature (71): n=t or c
ctggcctgctcatggccagtagacaattaatatacgcatttccagcacgattttgctagatatttgtcatnaaatttctccccctaatatttgtcagatgt

SEQ ID NO: 33708 - DNA, 101 bp, rice(Oryza sativa)
  misc_feature (71): n=t or c
tgcaacgtcgcaacggtgtatcagaagtcagtggttcacaagtcgggtttgtggctttgtgatttgtgttnaagtttggtcgcgagtgtacgtgtatatat

SEQ ID NO: 33709 - DNA, 101 bp, rice(Oryza sativa)
  misc_feature (71): n=t or c
tattgccacaatattaatgtgtggcgttatctttttctcatattgccacgaaatatatgatgtgtaacatnccgggttttagctatagttttagtcacgct

SEQ ID NO: 33710 - DNA, 101 bp, rice(Oryza sativa)
  misc_feature (71): n=a or c
cgcccgtgcagcagctcccggatagctttgtcaacttcgaaccgacggacgccgagctgagggagttcgcngccgacatggaagccctactcggacaaggc

SEQ ID NO: 33711 - DNA, 101 bp, rice(Oryza sativa)
  misc_feature (71): n=t or c
tttatttgctgtgtcacggttgctagggtttcataggcgatccaattcatcgaactagttagcatcttggnggcctcgtttagttctaaactttttcttcg

SEQ ID NO: 33712 - DNA, 101 bp, rice(Oryza sativa)
  misc_feature (71): n=t or g
tttgtgttgcacggatagatgggacagatatatatatcgtcagggcacaacaaaaatcacaaattaaaggnagtgaaaagaagtatatatatgcgtgttct

SEQ ID NO: 33713 - DNA, 101 bp, rice(Oryza sativa)
  misc_feature (71): n=t or g
cgggccagcgctctacagactagtacagactacagagatcggcaaggctgcatgctggaaccagagacgcngacgccccactccaccaccgatcgatcgct

SEQ ID NO: 33714 - DNA, 101 bp, rice(Oryza sativa)
  misc_feature (71): n=t or c
ttaactaactgaaccaaagggtggaatttgatggcacagcttttgggctttctgttttgcaatgggcttcntgataagttctttcaagaaaaatgcatggt

SEQ ID NO: 33715 - DNA, 101 bp, rice(Oryza sativa)
  misc_feature (71): n=t or c
ccaacagctacccaagaaccctccagcgcgcgtgagacaaaaaccagatgattgggaatgaaatatcgctncttggaagtggggatcgatatatacggaga

SEQ ID NO: 33716 - DNA, 101 bp, rice(Oryza sativa)
  misc_feature (71): n=t or c
tagattggatttttttttgaccaggggagtatgtatttaagggtattttttaagaaaagcatcagtctaanggcatggcatattgtagaataatttataaa

SEQ ID NO: 33717 - DNA, 101 bp, rice(Oryza sativa)
  misc_feature (71): n=a or g
aaaccggtgtggatgtatggctaccaggaactccacagtgactggtcgatgataagcaggtactccatccntcctaaaatataagcatttttaaatctcgc

SEQ ID NO: 33718 - DNA, 101 bp, rice(Oryza sativa)
  misc_feature (71): n=a or g
cgtctcattttttttactttcggtgctatcaacgaaaccattgtttccttttcttttctctccacctatcntgtcggcgactttttttcggttttagattt

SEQ ID NO: 33719 - DNA, 101 bp, rice(Oryza sativa)
  misc_feature (71): n=a or g
ttaacatcttctcggagttttcactctcaaatagtggctttcatcagaaatgtcaactgcccgcgactgcntacaaaaactcagtgcatttaacttttgaa

SEQ ID NO: 33720 - DNA, 101 bp, rice(Oryza sativa)
  misc_feature (71): n=t or c
aactacgcacttttcacagcatttttcgacccatcgagtatttggtatttcgagtggctcgcgaatggtgncgcccgttctggtggcgtgaatcgactcgt

SEQ ID NO: 33721 - DNA, 101 bp, rice(Oryza sativa)
  misc_feature (71): n=a or g
ttttagctcgatgtgtgggggagaaaggatgggctcgccggtatttataggcttcaaaggtcggttcgcanaggaggagggcgacgaaggcacggctgcag

SEQ ID NO: 33722 - DNA, 101 bp, rice(Oryza sativa)
  misc_feature (71): n=a or c
aattggtattgcaaagcttttttgggggggagggagggggtggttggatgtctggttttattaatttttcntgtttggattagatatgaggattgcatgcc

SEQ ID NO: 33723 - DNA, 101 bp, rice(Oryza sativa)
  misc_feature (71): n=t or c
acgctcatggaggcccacagggagagggagaagagtatcctcaaggggaataggaactacctgccatcacnagcccactccaatatcgctgctggcaccat

SEQ ID NO: 33724 - DNA, 101 bp, rice(Oryza sativa)
  misc_feature (71): n=t or c
ggcaaccaaacaaatcgaacaaactctccatgctcctcgtgatctcgatcgaaaccgctcgctccccccangtgctccctcgccggcgagatctcctccgg

SEQ ID NO: 33725 - DNA, 101 bp, rice(Oryza sativa)
  misc_feature (71): n=t or c
cattgctgcaggcgtgcagtgccatatcatctcttgaacatgtggactttgttagcgagcttggcctggtnggcatctcctctgtcgaggctgttggcaag

SEQ ID NO: 33726 - DNA, 101 bp, rice(Oryza sativa)
  misc_feature (71): n=a or g
acgagctcgtcgtcccgaggcgacggcgcggcaggatcccgcgcggagagaatctgcaaatgatcagaaanggaaaatttaggaaataaattcagagcttg

SEQ ID NO: 33727 - DNA, 101 bp, rice(Oryza sativa)
  misc_feature (71): n=t or c
accaccaaacccaccgccgctgctgcggcctcttctccaaccctctctaaatccaatgtcttcctcacccncctctctctctctgagatccagtcacacca

SEQ ID NO: 33728 - DNA, 101 bp, rice(Oryza sativa)
  misc_feature (71): n=t or c
tgaaatggtagatgggaagcaggatttggggatcatttgcatcgggttgcaaaccctatgcaattggcaangtgaccccttataaagttgtaccaagtatt

SEQ ID NO: 33729 - DNA, 101 bp, rice(Oryza sativa)
  misc_feature (71): n=t or c
tctgtcatcgttcgtcgtagttctttgcttcggtgagttcgtgtcgtcatcctcttcatgttggtgtcttnggaaagcccaaccgagctctgtagcgctgg

SEQ ID NO: 33730 - DNA, 101 bp, rice(Oryza sativa)
  misc_feature (71): n=t or c
ttgagaaaaaggagcacctaaattagggaggaacacagcttgagaaataaaggatggcacaagttaatgcnatgcacaagagagtagggtgcatatgtact

SEQ ID NO: 33731 - DNA, 101 bp, rice(Oryza sativa)
  misc_feature (71): n=a or g
atagggtaccgatgtgctcacaaaaagagttttgatggtctaaatgaaaaaaaaatccacagtaaaaaaanattaagtaaatgatggttcgatgtaaaatt

SEQ ID NO: 33732 - DNA, 101 bp, rice(Oryza sativa)
  misc_feature (71): n=t or c
attcagtagcattttcacccctattaattgttgacatgtagcaatatatatgctaattagttggacaaggnagtgggagtaaatgatactccctccttccc

SEQ ID NO: 33733 - DNA, 101 bp, rice(Oryza sativa)
  misc_feature (71): n=t or c
tcggcgtgtagatttgggagatttgatggagtactgctactagcagtcactgctagttgtttcttccaagnaggacagacgctagagaaagcatttaatgg

SEQ ID NO: 33734 - DNA, 101 bp, rice(Oryza sativa)
  misc_feature (71): n=a or c
aagtaaggatcgaaggaatcgccaaaaagacaaatgcaagaggtgtggcgtcgcctaaccttgaaggaggnggaggaggaggtggtggtggacggcgccac

SEQ ID NO: 33735 - DNA, 101 bp, rice(Oryza sativa)
  misc_feature (71): n=t or c
atttaaaaaatcatttaaatatagttatagtataattatatagtacttatatcatggacttatctaagggnctgtttggtacagctccaactcctagatat

SEQ ID NO: 33736 - DNA, 101 bp, rice(Oryza sativa)
  misc_feature (71): n=t or c
tctagccttttgcccttacaatcatgcatccataccaaaatacttttacaatctctactaggggtgcattnggctggccttgctgccgcaacggctacggc

SEQ ID NO: 33737 - DNA, 101 bp, rice(Oryza sativa)
  misc_feature (71): n=a or c
ttgtgtagttttgtgcgtgcgtgtaacgtacttttgactagttgcgcctctccctctccctccttttaatntctttccacgactttatcatattatatata

SEQ ID NO: 33738 - DNA, 101 bp, rice(Oryza sativa)
  misc_feature (71): n=t or c
gaccgataaatgtttgaagactttagaacaagctaaagagataatacgaagttatagccaaaacccataanaacagaactggagtggaatcgtctcgggat

SEQ ID NO: 33739 - DNA, 101 bp, rice(Oryza sativa)
  misc_feature (71): n=t or c
cttggcaagaacagcactgagctgttcatcatctctgcaagaagcatggatagtttattgggagcaagttnttctttctctgtgatgctctagctctggct

SEQ ID NO: 33740 - DNA, 101 bp, rice(Oryza sativa)
  misc_feature (71): n=a or g
atcctgaagatggagaacccagtgccttacgcgcgcaccttggcactggaagatcggaacactccaactcngtcgttatgggaaatcacgatgagctggag

SEQ ID NO: 33741 - DNA, 101 bp, rice(Oryza sativa)
  misc_feature (71): n=a or g
gtgactgtgtcttcttcctgctccagcacaatactgagcagcaaaggatgggtttgggggccagctttttngccaaacggcgacaacggcggtggcaacag

SEQ ID NO: 33742 - DNA, 101 bp, rice(Oryza sativa)
  misc_feature (71): n=t or c
gagtactactgtgtcatctcactcaacaagctctactgttactacgagtacttactttcacctgcaggatnctccaaggctggcacccatctcctcctgct

SEQ ID NO: 33743 - DNA, 101 bp, rice(Oryza sativa)
  misc_feature (71): n=t or c
ttgaccagtagtcattgcttctgcatcatgcttcagtagctagttggtttccttaggtggtgtttagatcnagggacttaactttagtccctgtctttaga

SEQ ID NO: 33744 - DNA, 101 bp, rice(Oryza sativa)
  misc_feature (71): n=t or c
tctcatggtcatttgcaacaagcagttaagcacacaggctgaggctatgcaagagactttggaatgcactnggcatgaggataccttttggactgtcatac

SEQ ID NO: 33745 - DNA, 101 bp, rice(Oryza sativa)
  misc_feature (71): n=t or c
gtattttcgcgattcccttgattctttttttttttggcttcagaagtacatttctctttcagccttttccntttttttttgagaatattcacttttagctt

SEQ ID NO: 33746 - DNA, 101 bp, rice(Oryza sativa)
  misc_feature (71): n=t or c
ctagaaatactatacttatattagaactcacgttagatagatagagtagagcatatatagggggtttagcncctctctcctaaacacccccatagttgtga

SEQ ID NO: 33747 - DNA, 101 bp, rice(Oryza sativa)
  misc_feature (71): n=t or c
acaggtatttgccctcttgagacctgcttctttgctggtactttgtttccaatctacttacacaatttgtntgtatagctgtataattgatcattctttcg

SEQ ID NO: 33748 - DNA, 101 bp, rice(Oryza sativa)
  misc_feature (71): n=t or c
tggccagagatcgtccgttgttcccttactcctgggaagaagcaattgggatttcactgcttttccaagcngatggtggtagactgagggaggagacattt

SEQ ID NO: 33749 - DNA, 101 bp, rice(Oryza sativa)
  misc_feature (71): n=t or c
agaaaaagaaaaaagaaccacaccacacgtctacaaacagaccatgctactgaagggcaaatggatacaanaaggaccttctagacgacgccttcgagaaa

SEQ ID NO: 33750 - DNA, 101 bp, rice(Oryza sativa)
  misc_feature (71): n=t or c
tcgcagaagaggaaacactacttgcacttgcacgtccggacaaaaaaaaaacaaataataataggggcaantgcatctttacccctacttcatgtttcaat

SEQ ID NO: 33751 - DNA, 101 bp, rice(Oryza sativa)
  misc_feature (71): n=t or c
gagagcagagaaagatgatgtagaggtggccccagtgtggaggccgaggaggaagcggtcgccatgaacgnctagacaaatacctaaatctctctacaagt

SEQ ID NO: 33752 - DNA, 101 bp, rice(Oryza sativa)
  misc_feature (71): n=a or g
ttaaacctctaaaataggcataagggcatatataattaaaaattcaattcataatgctccatgttctaccncaaaggaaattttgtgctgaaaatattatt

SEQ ID NO: 33753 - DNA, 101 bp, rice(Oryza sativa)
  misc_feature (71): n=a or g
ttttctcctctgcatgtggaatctcctgctcgctttatcccgtgcgccaggcacagccctattcgcgtccntgcgtggcgcgcacacgccgtggcatgcca

SEQ ID NO: 33754 - DNA, 101 bp, rice(Oryza sativa)
  misc_feature (71): n=a or c
tattttattcggcattctgtgcaaaagttgggatttggacttgtcatatctgtagcagaaatttaatatcnccctaaatcattctattttgttgttctgca

SEQ ID NO: 33755 - DNA, 101 bp, rice(Oryza sativa)
  misc_feature (71): n=t or c
tacgcgagattgaggtaaagagatgagagacggcgatttttatgcagattcggaccctttaaccctttaantaacaggtaatagccttactcctgttgacc

SEQ ID NO: 33756 - DNA, 101 bp, rice(Oryza sativa)
  misc_feature (71): n=t or g
caagtatgcattcattgacgaaggcacgaagctggacaaagtatgcaagtagagcgagaaacacatagggntatttcggctagctccacaaggtgatagac

SEQ ID NO: 33757 - DNA, 101 bp, rice(Oryza sativa)
  misc_feature (71): n=t or c
atttccagttattaaagtaatcgtagtgttattacatcgttggattgtagttacagatttttgaaaattanataaaagttgtattataattacatacaagc

SEQ ID NO: 33758 - DNA, 101 bp, rice(Oryza sativa)
  misc_feature (71): n=a or g
agcaaggacaagtacatcaccgccaagtacgacgcaaccacggtaagaacgaatgcattcttcacaagatntgcaatctgaattttctttgaaaaagaaat

SEQ ID NO: 33759 - DNA, 101 bp, rice(Oryza sativa)
  misc_feature (71): n=t or g
tcaaccaagccgcgatgccgctgctgacaccgtacaagcaggctggcggcaagatcgatctctcccaccgngtgctgctctcgccgatgacgcggtgccga

SEQ ID NO: 33760 - DNA, 101 bp, rice(Oryza sativa)
  misc_feature (71): n=a or g
tgtcaacaaataaaaaaaaagaacatagtgaatactatttttatggcatgcaacctgcaaagtaatggttnttaattagtttgattccaatagctcttgtt

SEQ ID NO: 33761 - DNA, 101 bp, rice(Oryza sativa)
  misc_feature (71): n=a or c
gctattctctgcatttatgcgaaaaataccttctgcctgcaaagtacaaacaaagacactgattaaaacanaaacagtaaccaatttaaatagttttaaaa

SEQ ID NO: 33762 - DNA, 101 bp, rice(Oryza sativa)
  misc_feature (71): n=t or c
ccccccgagatgttttcgccccttgcccaaaggaatttccttcttattttgtccaactcctctagggttcngtctggtagctttagtgatgttaggtggta

SEQ ID NO: 33763 - DNA, 101 bp, rice(Oryza sativa)
  misc_feature (71): n=a or g
tccggctcatttgcggtgcgcatctggacgctcgcgataaactatttggtaagattctaaatttagatttntaattttgtagtgtaatttatatgagttaa

SEQ ID NO: 33764 - DNA, 101 bp, rice(Oryza sativa)
  misc_feature (71): n=t or c
cttctacttatactaaggtaaaccttccgagcatggtttttcagttttgtccgccagaaagatttctttgntaacgctgatctgatccgtccagccaagac

SEQ ID NO: 33765 - DNA, 101 bp, rice(Oryza sativa)
  misc_feature (71): n=a or g
ctaaaaggacgtggtccacgtggacaagacaacaacgctgagtcattagcgttggtgccgccttggacacntgtcgacaatgcaccgcgccacctgatata

SEQ ID NO: 33766 - DNA, 101 bp, rice(Oryza sativa)
  misc_feature (71): n=t or c
gatgaaaaaaaggtcaccacgtcatctgaaggatggaattgaaggatgacgtgggatgtgggacatgggcnaggatacaatcgatttggggcctgcatgta

SEQ ID NO: 33767 - DNA, 101 bp, rice(Oryza sativa)
  misc_feature (71): n=t or c
aacggtgaagattgataacataaatacatgtaatacaattgcatcttcggtactaaacaatggtacatagngtatagtgacagcgtttgatgagacttcta

SEQ ID NO: 33768 - DNA, 101 bp, rice(Oryza sativa)
  misc_feature (71): n=a or c
cgtcagatcgactctaatcaatgcataggattagttttaggattctttggaggaaacacgcaatcatccancccaaccccccccccccctgcacgcgcgcc

SEQ ID NO: 33769 - DNA, 101 bp, rice(Oryza sativa)
  misc_feature (71): n=t or c
gatactcatgctgagctgctaaccaatctagctagctgcctccccagttcccttaatatgctgcaaatagnagcttttggcatttaacagttccagcggca

SEQ ID NO: 33770 - DNA, 101 bp, rice(Oryza sativa)
  misc_feature (71): n=t or c
gagacaggattgcagtcggactcgcgctgctaggtacaggcccacatatggcccaacaaataaaatcttcntggcccaccgtacattggcataagttcatc

SEQ ID NO: 33771 - DNA, 101 bp, rice(Oryza sativa)
  misc_feature (71): n=t or c
gccctcacatgacagagatctccatacaacgcctctggagattgcatgattccttacgcatgtcaggctanatagaagtaaacgacacgatgtagtagtag

SEQ ID NO: 33772 - DNA, 101 bp, rice(Oryza sativa)
  misc_feature (71): n=a or g
tttacatatgtaattattacttaatagtttattgttttcattgctcatccatctaacattttaaccaaacnaaaaactgaatgaccatatccacttaatca

SEQ ID NO: 33773 - DNA, 101 bp, rice(Oryza sativa)
  misc_feature (71): n=t or g
tttgtctcaaaatataaaagattttaaacagatgagacaactttcaggacatcaatatactatctatctanattcatagtctagaaagtatctcatccgtt

SEQ ID NO: 33774 - DNA, 101 bp, rice(Oryza sativa)
  misc_feature (71): n=a or g
ttttacgggctgaaaatatttttcatgaattttcttcgcctctatgtatatatcatgtagccctatcactnttaaaataccaaccaaataatttcgaaaaa

SEQ ID NO: 33775 - DNA, 101 bp, rice(Oryza sativa)
  misc_feature (71): n=a or g
gtgaaaatgaaaccatatctggcgtaaatgttctatttcttcgaataatggaatttatggaattcaatttnaaaatatactgttcattcaattttttttca

SEQ ID NO: 33776 - DNA, 101 bp, rice(Oryza sativa)
  misc_feature (71): n=t or c
gttctttgagcatgcggatgataagcagtcacacgagatcagaatactggccttgttttaattggatctgnaccattgtaaattgttattactatttatct

SEQ ID NO: 33777 - DNA, 101 bp, rice(Oryza sativa)
  misc_feature (71): n=a or c
taagttattcagagcatagaatttgagccatataatttagagacaaacactttgtcagtcaaaagagcttntgaacatccaaacagtaatgatcaggtaaa

SEQ ID NO: 33778 - DNA, 101 bp, rice(Oryza sativa)
  misc_feature (71): n=a or c
gcttgaaggaggcacactttgaaccttgagcctagaggtatgcaatgttgttaatactcttttttttaccncagggaagtgtgttatcctatcttagtata

SEQ ID NO: 33779 - DNA, 101 bp, rice(Oryza sativa)
  misc_feature (71): n=a or c
acactagaaatactaggttcggtgatccttcgagttctcaaaatcaatccatcaatcatcatcgataacgnggcgacagaacgcattccgaacccgtagtt

SEQ ID NO: 33780 - DNA, 101 bp, rice(Oryza sativa)
  misc_feature (71): n=t or c
cttgaaggggcatgtacgttgttttgaagttagcaagatgaaataatttaacatgttcccaaacctaattntgtattgttagatgacacaacctgatatgt

SEQ ID NO: 33781 - DNA, 101 bp, rice(Oryza sativa)
  misc_feature (71): n=a or g
aacctgccgcaatcctcttcctaccagacgcattacgccgaacactaggcggccaggggcttacttcctanccggaggagcaggcgcctcgtcgccggagg

SEQ ID NO: 33782 - DNA, 101 bp, rice(Oryza sativa)
  misc_feature (71): n=t or c
ctatcttcaagatcatcttggtcgatctactccttttttctctgtctctctctctcacaaaagctgctcanagtgagatgcgatctccataaggtcggtaa

SEQ ID NO: 33783 - DNA, 101 bp, rice(Oryza sativa)
  misc_feature (71): n=a or g
cgacaatacgctgatgtcctttccttcacgcgtgtataaaactcccatcttctttttggctctattgtcanctttctcacctcatatgaacaataagctgg

SEQ ID NO: 33784 - DNA, 101 bp, rice(Oryza sativa)
  misc_feature (71): n=t or c
gtgaaatatcaaaaatgcccttgggcccacatgtcggcacagtggagagatttgtggcgtggttgtgcgcngagatggaggtgctcggcgtgctttgtgtg

SEQ ID NO: 33785 - DNA, 101 bp, rice(Oryza sativa)
  misc_feature (71): n=a or c
gcagttttttcctttctttttatttttccttgtcctcggacaatggctttctgatttaactaaaactctgnttttttctaatatattaataatgtgatatt

SEQ ID NO: 33786 - DNA, 101 bp, rice(Oryza sativa)
  misc_feature (71): n=t or g
gctgaattataataagctgatataaaataagctgtgagagctgtttgtttatatggactataagctgtttngttagctgttagctactcaataatctaaaa

SEQ ID NO: 33787 - DNA, 101 bp, rice(Oryza sativa)
  misc_feature (71): n=a or g
gaagtaaagaccggaatggattctattggtgaattacaaagcatgatccccaatatctgctgctcgggacncccatcaacacgctatcaagattggatggc

SEQ ID NO: 33788 - DNA, 101 bp, rice(Oryza sativa)
  misc_feature (71): n=a or g
aaaaaaaataacttggttataagatttgcagttttgatttggtctgccgttgaggattcttgtgttctatngctcgtctctgttttttatagtgtgcaaga

SEQ ID NO: 33789 - DNA, 101 bp, rice(Oryza sativa)
  misc_feature (71): n=t or g
taggcagatgatgttactaattttttttagtcaggtactcaggtttctcattgactaacatttgttacttnttataacagccagattgtaagggctatgat

SEQ ID NO: 33790 - DNA, 101 bp, rice(Oryza sativa)
  misc_feature (71): n=a or g
agccgcacaacacaaggttgcagccgcagcgctgccgcagatagaacagccgaacagacccattgtacatnctctttgcagtttcggtcgtaggggctata

SEQ ID NO: 33791 - DNA, 101 bp, rice(Oryza sativa)
  misc_feature (71): n=a or g
agaaaacttcagttcccctccatagggtactctttcggctcatttcttcagaaaaaaaatatttaaatctncaatttttatgttgaaatatttaaacgatt

SEQ ID NO: 33792 - DNA, 101 bp, rice(Oryza sativa)
  misc_feature (71): n=a or g
cccccccccccgggcgcgtacggatgtctgccccgtggatgaggctgaggtcggcaaggatcggtacaganccgagggacaccggagcaccatcggggaac

SEQ ID NO: 33793 - DNA, 101 bp, rice(Oryza sativa)
  misc_feature (71): n=t or c
caactcgatcataagccttcgacaaatccaatttataagcacatgcagctttctcctgccttctatttttntggatgaagtgaaaacattcaaaggcagac

SEQ ID NO: 33794 - DNA, 101 bp, rice(Oryza sativa)
  misc_feature (71): n=a or g
caccagaaaaacactgtaaaacagatgcatcatcatttgttcatacgccacgcatactgctgctgctgctnctgctactgcagtgctccagcaaggcatgg

SEQ ID NO: 33795 - DNA, 101 bp, rice(Oryza sativa)
  misc_feature (71): n=t or c
acgtctttgctccgtattgtgtggagtcatgaccgtagaaatgtcaagttttgatctcatgcaagctagtnaacacgatctaagccggaaatttacctttc

SEQ ID NO: 33796 - DNA, 101 bp, rice(Oryza sativa)
  misc_feature (71): n=t or g
ggccaaacggagggaggtagctggcctagggctaaaaaggaaggaggctatcgaccctaaacccaggaaanattttcattaacttttttaattataatcta

SEQ ID NO: 33797 - DNA, 101 bp, rice(Oryza sativa)
  misc_feature (71): n=t or c
ggtgaaggaacgcaacgaaatggcagaggtctttctcaattaaaacaaaattttcatgatgcgtctgtttntttcaaaattgaaaacacatcatcatcgtt

SEQ ID NO: 33798 - DNA, 101 bp, rice(Oryza sativa)
  misc_feature (71): n=a or c
ttgatttctacttttgtactctgtcttagtatattcatgttcctcgtttaaaaaggagctttgaaactttnattaagcatgtcacttttaatttacactat

SEQ ID NO: 33799 - DNA, 101 bp, rice(Oryza sativa)
  misc_feature (71): n=a or g
gcatgcatgtcttgttagtactacgcacacaccaaagatgtccagcttttgcgtgccagacacttcggctntaatagaggtttacatattcttctaaagca

SEQ ID NO: 33800 - DNA, 101 bp, rice(Oryza sativa)
  misc_feature (71): n=t or c
gaggggcggcggcggcggcgagtggaaaccggatagaagacgagtatttaccgactacgccgcgcggctcngatttttatttttactagcaaaagtgcccg

SEQ ID NO: 33801 - DNA, 101 bp, rice(Oryza sativa)
  misc_feature (71): n=t or c
aaaaagaccaattctaactacgaatctggacacatgtagaaatttattatttttttggacggaggagtagnatgtaattagtgatgcaaagattaaaaaaa

SEQ ID NO: 33802 - DNA, 101 bp, rice(Oryza sativa)
  misc_feature (71): n=a or g
acaacatccaataaggaaacacccttcttcctcgtgtacaattctgaagccatgctccccgacgagttacngcatcaaagcacacgagtacagaagcattc

SEQ ID NO: 33803 - DNA, 101 bp, rice(Oryza sativa)
  misc_feature (71): n=t or c
ccaattcttcatatttttgccaaaataacccccagctgcaccatatgggccgttagacagcccattagtanggctaccggtccaactagtgccggtttaat

SEQ ID NO: 33804 - DNA, 101 bp, rice(Oryza sativa)
  misc_feature (71): n=t or g
taaaaaatgttacaatccaaaataagcattacaggcatttagattataaacgaacacccaaacatctgctngtttgtctactgatacattgacaattttga

SEQ ID NO: 33805 - DNA, 101 bp, rice(Oryza sativa)
  misc_feature (71): n=a or g
tgaccgcccttggtcaggccgagcccagtgaaatattgtgtgtgtgcgctatgaagatgtgagcacaagtnaaaatgcaatgacctaatatggcaattaaa

SEQ ID NO: 33806 - DNA, 101 bp, rice(Oryza sativa)
  misc_feature (71): n=a or g
taaaaaaaatttagagaaaacaaaatttacaaatagtaaaaatgatatggtcggaaacattatctcttatntagaaataatgctcggtcgatcgagaattt

SEQ ID NO: 33807 - DNA, 101 bp, rice(Oryza sativa)
  misc_feature (71): n=a or g
catgtataataagaaaaactaatacctcgcaaaatattttaaaatattatagtttaaactgcagagtggtnattcaattattttcagtaccagtgtattga

SEQ ID NO: 33808 - DNA, 101 bp, rice(Oryza sativa)
  misc_feature (71): n=a or c
tcccttgttcggatgagtgacggtacaacagaatgcgctgtttggggacaggattttggacacgaagggcntgttcactttgatgccaaaaaaaaccttat

SEQ ID NO: 33809 - DNA, 101 bp, rice(Oryza sativa)
  misc_feature (71): n=t or c
taatggcgcgacttaaaattggagtaatattctatttagttcggactacatcgtcgaatgataagtacggnatcaagtttatcgaaggtgatgttttagaa

SEQ ID NO: 33810 - DNA, 101 bp, rice(Oryza sativa)
  misc_feature (71): n=a or g
aatcgcctttgcgtcggaagagtcgccggagaaggaaggggaataagttctgcttgagcggtgaaaacggntgtcacggtgtgaggtttctcgggggtgac

SEQ ID NO: 33811 - DNA, 101 bp, rice(Oryza sativa)
  misc_feature (71): n=a or c
tttcccctgtcgagcataaaacacatgttaaatcacttccttccggggtacaaaattttctgtcaagcatntcacgagtattcaatctatcaatgagcaga

SEQ ID NO: 33812 - DNA, 101 bp, rice(Oryza sativa)
  misc_feature (71): n=t or c
cagctcaagttgtacataggcgcatttccagggtaatgacttttgagagtgcagtgactaggggtggacgnaggataaaaaataactggggggcatgtatc

SEQ ID NO: 33813 - DNA, 101 bp, rice(Oryza sativa)
  misc_feature (71): n=t or c
ggcgaagccttgtagagaaaaaaaggggggtcatggtccccaccagctttacaagaacttcaatgaggtcnttcttaacttttactattttactattaacc

SEQ ID NO: 33814 - DNA, 101 bp, rice(Oryza sativa)
  misc_feature (71): n=a or c
acttagttttcaccagcttagcacgtattccacacaacctgttgccttcacaacacaacaattgcacacanaaaaaattatggccacttttttttaaaaca

SEQ ID NO: 33815 - DNA, 101 bp, rice(Oryza sativa)
  misc_feature (71): n=t or c
ggatttcgctgggaattttgaagaaacagttttgcaaactttctaaaggaattttgcaggggactagcacngggaattttttttgtcaaaaacacttttca

SEQ ID NO: 33816 - DNA, 101 bp, rice(Oryza sativa)
  misc_feature (71): n=a or g
cattatttctaatgttttttaattatatacatggttttagaagaattgtgaaaatatactgtaccaggggnaaatgtgggaccaaattaaacaattggcgc

SEQ ID NO: 33817 - DNA, 101 bp, rice(Oryza sativa)
  misc_feature (71): n=a or g
tcattgcgcgatgtgcaacatgtagtgcaacgtaactgcaagatagaggatgttttctagttcatatatancgcacgctctctctgtgtgtgtgtgtgtga

SEQ ID NO: 33818 - DNA, 101 bp, rice(Oryza sativa)
  misc_feature (71): n=a or g
taatttgtgaaaaatcagcaaaaaccctggtattaacaaactgaacctaaacaaagcataaccatccaacnagggaaaagctcctaaaatgaagccttcaa

SEQ ID NO: 33819 - DNA, 101 bp, rice(Oryza sativa)
  misc_feature (71): n=a or g
ccacccagatgacagtggcgccagagcagaggaggcactgtgggccgctttggcgcatctttgtctttttntcttattattattattattattagaattgg

SEQ ID NO: 33820 - DNA, 101 bp, rice(Oryza sativa)
  misc_feature (71): n=t or c
tgagttatgctacaattttttagcaagttggtccacttgtcattgagcgttttttttttgccataacttgncacaattgtggccaacaaatttttagccat

SEQ ID NO: 33821 - DNA, 101 bp, rice(Oryza sativa)
  misc_feature (71): n=a or g
caaaagttgtacaagtactgctacattagaagtcaatatattgctgtttgatgcagtgatgcttaaatatncatgctcttatggattaaatgtatgtaatt

SEQ ID NO: 33822 - DNA, 101 bp, rice(Oryza sativa)
  misc_feature (71): n=t or c
tacatgcggcatcggaggtttcttccagccggccaccactattgtagcaatacaagagatttcgatggcantgtggaggagggtacagctccaacacaacg

SEQ ID NO: 33823 - DNA, 101 bp, rice(Oryza sativa)
  misc_feature (71): n=t or c
ttactgaggcagatattcagcatatcgtgtcctcttggactggaatacctgtggagaaagtctcatctgangagtctgaccgtctccttaagatggaggag

SEQ ID NO: 33824 - DNA, 101 bp, rice(Oryza sativa)
  misc_feature (71): n=t or c
catgacctcgcagcgccgtcctggtgcacggcatttttcctgcacacgcagtgtggaaatccaatccaatncaatccaatccaatccaatctccgctgaca

SEQ ID NO: 33825 - DNA, 101 bp, rice(Oryza sativa)
  misc_feature (71): n=t or g
acattactttcttttttttacaaatttgcagaacttgttaagccataggctctggttccatatgagagaanatccatatgctcttttgagatagtttggaa

SEQ ID NO: 33826 - DNA, 101 bp, rice(Oryza sativa)
  misc_feature (71): n=a or g
ggcagggagccccctctaggggcatgagcacatatgactcaactagatcgatagatcaatacaacacccgncggattcaaatccccaaacaggagtagggt

SEQ ID NO: 33827 - DNA, 101 bp, rice(Oryza sativa)
  misc_feature (71): n=a or g
cacgttactagctccgtcccagaacgtagcaacctaggatatgctaatgggtctaatctgaaatatgctcntgtctagattcgtagtcttaagatagatct

SEQ ID NO: 33828 - DNA, 101 bp, rice(Oryza sativa)
  misc_feature (71): n=t or c
tgcacatgtcaatgcctctgccattttctccctatatattcacatacacatatgcgtacatgccaattgcnaagtagtagtagtatgcactggatgtgtca

SEQ ID NO: 33829 - DNA, 101 bp, rice(Oryza sativa)
  misc_feature (71): n=a or g
atactgtacttttagaacattgagcaacataacgtatttttatgttgctcaattatatactactccctccntcccttaatataagggattttggcattttg

SEQ ID NO: 33830 - DNA, 101 bp, rice(Oryza sativa)
  misc_feature (71): n=t or c
attcgtactgtggcttctttggcttcttccacaccggctgttagttctacagtttcttcctcttaatcatnggcgcgtcctcctgccacagttgtgccatc

SEQ ID NO: 33831 - DNA, 101 bp, rice(Oryza sativa)
  misc_feature (71): n=t or c
aacaaatgtgttaatccataggggcaattgcgcatttaaccttgttttgaaatgtaactagcaatttgacnctactccttttagtttgcttatttgacccc

SEQ ID NO: 33832 - DNA, 101 bp, rice(Oryza sativa)
  misc_feature (71): n=a or g
gctttggactaggtaactttacctttgttgcacaatgggctaccctaactctgttcgcttgtgatgtctancatctctttcgacaaaagtatgtcatgcat

SEQ ID NO: 33833 - DNA, 101 bp, rice(Oryza sativa)
  misc_feature (71): n=t or c
tcactactcatgagcaagatgatgaaaataatttacaaaatgacctggagataaatttgcagacgactganggcatgcgcatgccaaaattttacacaaat

SEQ ID NO: 33834 - DNA, 101 bp, rice(Oryza sativa)
  misc_feature (71): n=t or c
aaaagttctatagtccaaaaaaaacacatgagaaaaaaatacgtctgtaaaaaagcaaaaaaaaagcatangaggaaaaaattgttagaaaaaaacgctaa

SEQ ID NO: 33835 - DNA, 101 bp, rice(Oryza sativa)
  misc_feature (71): n=t or g
cctacggtgatcatgcgcaaacaggtgtagtgcaggcattcagtccacagaaattaattatctccaaacanccaaattcagcaaggcatgcaaatctcatc

SEQ ID NO: 33836 - DNA, 101 bp, rice(Oryza sativa)
  misc_feature (71): n=t or c
ccggcatagtgcgataccaatttttggtgcggaagggatcgacagagctagggggctcagttgcaggtgangaagaagtgtcacacagggtcaacatcgtc

SEQ ID NO: 33837 - DNA, 101 bp, rice(Oryza sativa)
  misc_feature (71): n=t or g
aacacttaattaatcatgtgctaaaggactctcttctctactgagtactaactaactgtctttataataanaatgtacgctggatgtctttaaaggagagc

SEQ ID NO: 33838 - DNA, 101 bp, rice(Oryza sativa)
  misc_feature (71): n=t or c
cacattagtttcacacttatttctgaattcccactccatggtagtacaaagttttgttaaacagtcatggnactttcaaatgcaggacataaattgcacag

SEQ ID NO: 33839 - DNA, 101 bp, rice(Oryza sativa)
  misc_feature (71): n=a or g
gggggcttattgctggttgctacattgtcggttgctgattggtcaccactcgggcgatcttcggtagtcancccggtttcagtcgaaggaccagtctccgt

SEQ ID NO: 33840 - DNA, 101 bp, rice(Oryza sativa)
  misc_feature (71): n=t or c
accatttctctgccgagaccacgtcgttgtcgtccgcgttcctgttgttttggttttcatcattgccaacngtagcgtgttcaagtaaaacggaaccccct

SEQ ID NO: 33841 - DNA, 101 bp, rice(Oryza sativa)
  misc_feature (71): n=a or g
tgcaagtcaggtagagtagaagatgctatgctttattttgagcagatgatcgatgaaggactaagacctgncagcattgtttataactccctaattcatag

SEQ ID NO: 33842 - DNA, 101 bp, rice(Oryza sativa)
  misc_feature (71): n=a or g
cctgggaaaaaaaagaataagttcaccttacgttcctcaatttgtcgtcgattctgaaattcatccctcancagtatagtgaccggtattggctaacgtgg

SEQ ID NO: 33843 - DNA, 101 bp, rice(Oryza sativa)
  misc_feature (71): n=t or c
cagttgccacggtaagaaattaaaaggcaaattttgctactatgcaagacattgtgacttagcggttttanctgtaggacaccgtacaaagtgacttaatt

SEQ ID NO: 33844 - DNA, 101 bp, rice(Oryza sativa)
  misc_feature (71): n=t or c
ttgccgccactggagctcctagatgactggcaaccacctccactaccaccacccttagccaccacaggcancgccgccacctctgttagcatcaccaccac

SEQ ID NO: 33845 - DNA, 101 bp, rice(Oryza sativa)
  misc_feature (71): n=t or g
ggatgcacggcatgctttaccccaaaaacgaactgagaaaaagggtgtggtttggcttcaatgtgaacatnacacggtcctttttattgacttctatttac

SEQ ID NO: 33846 - DNA, 101 bp, rice(Oryza sativa)
  misc_feature (71): n=t or g
tggcgctagaggtatgttggtcgatgctaaaggtcaacaacaatgaaggattctggaggagagagagaagnaattaggaacgaagatgtatggggccacct

SEQ ID NO: 33847 - DNA, 101 bp, rice(Oryza sativa)
  misc_feature (71): n=a or g
gggggagaaatccccgttgtgcccacaaaaattcttctcccgccacaaccattcttcctcccaccaccganccaagaaaagacaagaaaatcttggggatt

SEQ ID NO: 33848 - DNA, 101 bp, rice(Oryza sativa)
  misc_feature (71): n=a or g
cgctttccctgagaacgatttttagctcaagggggccgcctgtaaaagactgggacggactgatatttttncaagcaacccccttgccgctctctgaaagg

SEQ ID NO: 33849 - DNA, 101 bp, rice(Oryza sativa)
  misc_feature (71): n=a or g
tccctcccatctttctggagaaatcgaacgcccatacaccgtagatgctcctgcgcccatcaatttggccngagaccgtcccaatcacccaagccccaaac

SEQ ID NO: 33850 - DNA, 101 bp, rice(Oryza sativa)
  misc_feature (71): n=t or c
gtaaatgcccatgtacacaaattgagtaagccaagaacaaaaccattactacaaaacaatacttatagtgntagtttttccccctcatcaatgttggtttt

SEQ ID NO: 33851 - DNA, 101 bp, rice(Oryza sativa)
  misc_feature (71): n=t or g
aagtatatatgctttcttgtattaccttgcaactttcctgcttgggcattttctggaatacccaaaataantttatttttcatccatcccacacataccaa

SEQ ID NO: 33852 - DNA, 101 bp, rice(Oryza sativa)
  misc_feature (71): n=a or g
cttcgtcaatcttacaagtattcctagagtgcatgcatgatgactgttcattgttacatgagcaattttgngcactaaaccagtaaacctctctgttcaga

SEQ ID NO: 33853 - DNA, 101 bp, rice(Oryza sativa)
  misc_feature (71): n=a or c
ctaaataaatagcaatgtaatgtacttctcattatttcgagctgtacacacaacagtagagcttcaatggntatattgcactacccctagaagtaattacc

SEQ ID NO: 33854 - DNA, 101 bp, rice(Oryza sativa)
  misc_feature (71): n=a or g
tcaatccaaacatacacaattattattaaggttgtcaaaaaattgataagcttaggcctcaaaccaaactngcccttactcctaccgggaaagggagagcc

SEQ ID NO: 33855 - DNA, 101 bp, rice(Oryza sativa)
  misc_feature (71): n=t or c
tatttcatattggaacaccttccaacaagtccttaactttagcacgttgtacaacttaatctcctcctctnctaaaagtatagctaatctattattcataa

SEQ ID NO: 33856 - DNA, 101 bp, rice(Oryza sativa)
  misc_feature (71): n=t or c
aattaaactctctaaatacccatatagtcagctttcagtcgatttagcaagccaaacttattcctcactcnaatattcttttcatctacactcttcattac

SEQ ID NO: 33857 - DNA, 101 bp, rice(Oryza sativa)
  misc_feature (71): n=a or c
ttctctccgttgtctttctctgatctccccctctttttttcctccccccccttttttcgtgggcaaggtcntccttttatcactcaaggggatcccacatg

SEQ ID NO: 33858 - DNA, 101 bp, rice(Oryza sativa)
  misc_feature (71): n=a or g
accatggcattcgatggagcactggacagccaaggagcaggcgtcggattcatcttgacatcctccacagngaaccaattcaagcatgcaatccatctaaa

SEQ ID NO: 33859 - DNA, 101 bp, rice(Oryza sativa)
  misc_feature (71): n=a or g
tgttgtgggactgtagtataactttcgcctctcaattagtacatatcttacgtgctccgtaaagatcagcnctgtactggagctaaggcacgatttccacg

SEQ ID NO: 33860 - DNA, 101 bp, rice(Oryza sativa)
  misc_feature (71): n=t or c
ggtcaaataaaaaaagatataacaagtagggcaaaaggtactatttaccccttacttaaggctgttaactngccttaacggaataggaccagacaattttg

SEQ ID NO: 33861 - DNA, 101 bp, rice(Oryza sativa)
  misc_feature (71): n=a or g
ctccagtgcatacaatcaatgcttcccaacattgctgggaatccacgttcttcatgcctctgtacgaggcnttgaacatcatcatccgtaggcttcctcaa

SEQ ID NO: 33862 - DNA, 101 bp, rice(Oryza sativa)
  misc_feature (71): n=t or c
taggaaggtgtatgatactcacaggtatcaccgatgttagtactcagatcaaacagaagcacaggtgcgangacaaaggccgaccgactcaacgtatccta

SEQ ID NO: 33863 - DNA, 101 bp, rice(Oryza sativa)
  misc_feature (71): n=t or c
agatgaacttattccaaagaaaacaccaactgactatgagcctatgggcctgtttgaggagcttaaaattntaataagcagctggttggtagctagctttt

SEQ ID NO: 33864 - DNA, 101 bp, rice(Oryza sativa)
  misc_feature (71): n=t or c
gaattagcctgagccaggcgatgggctccaggcgcagcagcgctacacattagcaccataatcccctcgtncccgccgtgacaactccacacgaagccgcc

SEQ ID NO: 33865 - DNA, 101 bp, rice(Oryza sativa)
  misc_feature (71): n=t or g
aggatgcagcaataacttcacccttacaaagaaagtctctttcatcagacgtttaagagcaggtataacanactattaggcagctataaatatattttaat

SEQ ID NO: 33866 - DNA, 101 bp, rice(Oryza sativa)
  misc_feature (71): n=t or c
tagttgagtttgtggtagtgtaattagctgatggataaacgatgtgagtgtacaccaaattatactatctnctttttaaatatatgacaccgttaacattt

SEQ ID NO: 33867 - DNA, 101 bp, rice(Oryza sativa)
  misc_feature (71): n=a or g
ccttttcttttgttttccttttcttttgttttccgtagcggtttgggttggaactcttgtgggtatcttcntccccggccccaaagggatgaacggggcaa

SEQ ID NO: 33868 - DNA, 101 bp, rice(Oryza sativa)
  misc_feature (71): n=a or c
ttcgcatgtggtagttctgatccagggggtgttgggaaccttgacggtgtgggtcccacagtagcacaacngcgaatgcaaatatgctatttttatgtaaa

SEQ ID NO: 33869 - DNA, 101 bp, rice(Oryza sativa)
  misc_feature (71): n=a or g
ctcgccacgtccctgcactgtgaagggcctaagatgtttaacttgcaaaatcggagtgcacgaggtcttcngatagtattgaggtcggttttagatgatat

SEQ ID NO: 33870 - DNA, 101 bp, rice(Oryza sativa)
  misc_feature (71): n=t or c
ccacgttagacgaagacatagtaaaaggagccacgtcagccaaaacaggggtaatactaccgagggatctngtttgtattggttttgtaagttgggtgata

SEQ ID NO: 33871 - DNA, 101 bp, rice(Oryza sativa)
  misc_feature (71): n=t or c
attaacaatttacgagtagatgttctttttaaatatttattaaaaaaaccttgactggtaggagaaatacngccaccacgacttcaatataatagaacacc

SEQ ID NO: 33872 - DNA, 101 bp, rice(Oryza sativa)
  misc_feature (71): n=a or c
ggagctggtgagaaattgaaaaagctgaaaaatataacatgtggctcgtagttcatttatggattatacanctacaatttcttaaaatttaggtaaaaatt

SEQ ID NO: 33873 - DNA, 101 bp, rice(Oryza sativa)
  misc_feature (71): n=a or g
cattccctgttcttgcactggcctgcgatgtaagtggtgtttggatcagggctaaactttagttcttatcncatcagatgtttagacgttaatttgaagta

SEQ ID NO: 33874 - DNA, 101 bp, rice(Oryza sativa)
  misc_feature (71): n=a or g
ttcctctgcccctatcatcgcggagggaagtggaaccaagaggaaaacctaggccaggacaagcggcgctnccggatctcggcagaagtccagcggttccg

SEQ ID NO: 33875 - DNA, 101 bp, rice(Oryza sativa)
  misc_feature (71): n=a or g
caagatcagatctgaaactgctcaacttgcctcaggtagggacaagtttcgtttgcatgccccatttacgncatccatccatgataactgatgaaagagaa

SEQ ID NO: 33876 - DNA, 101 bp, rice(Oryza sativa)
  misc_feature (71): n=a or g
cagatttacagcaaacagaaataacccccaccaaaaataagggagaatattttttaaaaaaaaaggaagcnaaattaaggaagggcctaatatcaaataat

SEQ ID NO: 33877 - DNA, 101 bp, rice(Oryza sativa)
  misc_feature (71): n=t or c
gccggcggccaggacggtttccttgtagctctcacctaccgtgtgtacccttgcagtcttgcagatcgacngaggcctggtttagttcccaactttttctt

SEQ ID NO: 33878 - DNA, 101 bp, rice(Oryza sativa)
  misc_feature (71): n=a or g
cggacatccggatatgctataagttgggtatgtgagcaggggcggatctacagtagtatgagcggtgtcangcgacaccgacgactttcggcaaaacctat

SEQ ID NO: 33879 - DNA, 101 bp, rice(Oryza sativa)
  misc_feature (71): n=t or c
ttctcttttactgtttattctaaaatgcaaaaaaaaagaaattttgttgtagcttagattaaggcagcctnagctttgtggtttgccaagccatgtactga

SEQ ID NO: 33880 - DNA, 101 bp, rice(Oryza sativa)
  misc_feature (71): n=t or c
ccaacatctttatcttcgagagctgcgactgcgacagcatatttgtgcaccccatccccatcttgcggagnaagatcaagttgagctccgcctcctccgcc

SEQ ID NO: 33881 - DNA, 101 bp, rice(Oryza sativa)
  misc_feature (71): n=a or c
aagattcgaagagaagttgtagctatggaggctttccaaatagagcatagaaatacttatattctactccntccgtttcaaaatgtttgacaccgttgact

SEQ ID NO: 33882 - DNA, 101 bp, rice(Oryza sativa)
  misc_feature (71): n=t or c
gtcatggccgtcgccgtagccgcccccgttgtcgccgtcaccgttgtaagaatccatcgcacactccggtngatcctggcccacaaaccgccgcggagctg

SEQ ID NO: 33883 - DNA, 101 bp, rice(Oryza sativa)
  misc_feature (71): n=t or c
aagcaaagaacaccgagctgcaatgcattgcaatgcaacgctagctgcatcgcccaagttttggatgccgntgctgcttggccgagctcgtgcttgtgcca

SEQ ID NO: 33884 - DNA, 101 bp, rice(Oryza sativa)
  misc_feature (71): n=a or c
cttgtacactggtactactgcccgttaataacgctatggcaatatgggccattttggtttggtaccaattnttgccctaacaattctttagtagttttgaa

SEQ ID NO: 33885 - DNA, 101 bp, rice(Oryza sativa)
  misc_feature (71): n=a or g
cgttctgcagacacggctgtgtaatgtcattctttctccaaactacttaagacgcattaagcattcatttngaatgcaacaatggcatctctacatttaga

SEQ ID NO: 33886 - DNA, 101 bp, rice(Oryza sativa)
  misc_feature (71): n=a or g
gttgtttaatggagttgggaaccttcctcccacggaaaacaagcaaacttattagcacatgattaatacantatttaaaaatagattaatataattttttt

SEQ ID NO: 33887 - DNA, 101 bp, rice(Oryza sativa)
  misc_feature (71): n=a or g
gtttccaagacaaaattcttatcttacgttttctgtttcagctagtttttattcttggattcaagatatgnttatttcagtttcgtttacaatgcccatta

SEQ ID NO: 33888 - DNA, 101 bp, rice(Oryza sativa)
  misc_feature (71): n=a or g
acaaaaaaaatcaacatggagttgcttaatgttaggccattcacagtgtgtgtgcgtggcgttcggccccnaccatttatgtcggagattccacgtcacgc

SEQ ID NO: 33889 - DNA, 101 bp, rice(Oryza sativa)
  misc_feature (71): n=t or c
ttatggatgtctctttttttggattttactatattagtcacatagaaatttatagttactcaaaattgcangataagctgaaaattccaatgatatataat

SEQ ID NO: 33890 - DNA, 101 bp, rice(Oryza sativa)
  misc_feature (71): n=a or c
agaacacgaagctgatcttgagtaacgtggaagcaaagatcgtgatggtaccattaagaatttagaacagnatttttactcttgtttgcaaccggcagatc

SEQ ID NO: 33891 - DNA, 101 bp, rice(Oryza sativa)
  misc_feature (71): n=a or g
atgttttctacagttaagatgggctgccaaagtccaacaaccttaaggctcactgggatcagctaattacngtaattgctctaactgtttaattaaaccta

SEQ ID NO: 33892 - DNA, 101 bp, rice(Oryza sativa)
  misc_feature (71): n=t or g
gaattatacccagggtgcaaggaggctaccaaggtatctttcattgtcaggctatttcaaataaagtgcangtacggtatcagcaaccatgccatggagca

SEQ ID NO: 33893 - DNA, 101 bp, rice(Oryza sativa)
  misc_feature (71): n=a or c
agaccgagcgataaggctaccaggaagggggaagaagtgccacccagatctaggccacccctagctggacnggcatacagcgatacggagaaaagataggc

SEQ ID NO: 33894 - DNA, 101 bp, rice(Oryza sativa)
  misc_feature (71): n=t or c
cgcgtgaccatttcttttattttctccccctacttttcccgcgctgctttcccctcgcgccatccaagcgnccgcctctatatatgcgcgccgccaccatg

SEQ ID NO: 33895 - DNA, 101 bp, rice(Oryza sativa)
  misc_feature (71): n=t or c
gtacacagcacgatcgatggatctatatatacatacatacatcatatatatccaggggcggatccagaaanaaaaaattggaggactcaattacacagttt

SEQ ID NO: 33896 - DNA, 101 bp, rice(Oryza sativa)
  misc_feature (71): n=t or c
attggatgagaatttgtaatactaagaaccgttttttcaaatatgcactttatcattgatactatatgtangattttttggttaatgaaatcacaacaatt

SEQ ID NO: 33897 - DNA, 101 bp, rice(Oryza sativa)
  misc_feature (71): n=t or c
gtacagggcacctgctacatttacgcaagtagattttacactgcaaaagattgctatctgatgtgttctantgaatctgggcttttttttagataatggaa

SEQ ID NO: 33898 - DNA, 101 bp, rice(Oryza sativa)
  misc_feature (71): n=t or c
ggttgcataataatatcattgtacgactcttctgaccaaatcacgcgcataaacatgaggatttttttaangactcgcacgagatggtgagaagttctatt

SEQ ID NO: 33899 - DNA, 101 bp, rice(Oryza sativa)
  misc_feature (71): n=t or c
aagagaaggtttgcagccggtctccaccaattttttttgagagaatctattctgtgtaccactgagttcgntcgagttctcaatgatttgccatcaacatt

SEQ ID NO: 33900 - DNA, 101 bp, rice(Oryza sativa)
  misc_feature (71): n=a or c
ttctccttcctcttcctcttcctcttcctcccctttccccttctagcagcagtagagagggcggcggcgangacggcgaggtagagtaggagccgggaagg

SEQ ID NO: 33901 - DNA, 101 bp, rice(Oryza sativa)
  misc_feature (71): n=t or c
cagattagcattctaatatcttcagattctgtgtttcgattgagctagaaaagtaacactccagttttganaacaactcggcatccatcatggattcccaa

SEQ ID NO: 33902 - DNA, 101 bp, rice(Oryza sativa)
  misc_feature (71): n=t or c
ttttacaaacgaactaaaagaaaatccgtatgtaaaaagctttgagagatatctgttaaaggcttgcttgnaaaaatcaattttcgtagacgggcctctta

SEQ ID NO: 33903 - DNA, 101 bp, rice(Oryza sativa)
  misc_feature (71): n=a or g
agacatgcgaccttggcgtggcgtccgcatagggccccttagagcatcaccaagaggttagctaaagtccntccccaagattttgcttataggaatactaa

SEQ ID NO: 33904 - DNA, 101 bp, rice(Oryza sativa)
  misc_feature (71): n=a or c
ggaatggcctcacaactaactgaagcagaaactgagactgaaatgatgatgcagaagcagcagctagcagnagcagcagaagataaggattgcatgctgac

SEQ ID NO: 33905 - DNA, 101 bp, rice(Oryza sativa)
  misc_feature (71): n=t or c
aaaaatctccgatgggtaaaacttctctggacttcattctataccaatagatctatgccaccgcatgcatnacaagactttggatccttttggtggaaaga

SEQ ID NO: 33906 - DNA, 101 bp, rice(Oryza sativa)
  misc_feature (71): n=a or g
attctcatagaactcaccatctgaaccaatctctgtctctctctggggtggagaaaaataaagcaagactnagcaccaaccaccatactcaacaagtcata

SEQ ID NO: 33907 - DNA, 101 bp, rice(Oryza sativa)
  misc_feature (71): n=a or g
gctttaaatttagatgtagagtatatattccatgcataatagtttgttatgatcgcttgattggatactgnatatcattacatcacccacttgattgatct

SEQ ID NO: 33908 - DNA, 101 bp, rice(Oryza sativa)
  misc_feature (71): n=t or c
aagtatagtatataactcatattcgtagagtttatcattagtgtaagcttcaataggttagtgtgctcggnaaatttcacaggccctacttctggtatgaa

SEQ ID NO: 33909 - DNA, 101 bp, rice(Oryza sativa)
  misc_feature (71): n=a or g
cccaaggtggcagtctcgagaaggtgactaccaaggtggatctcgccatggatttcgttggcaaggtgcancaagagtgtgctgagttggcccgttcgatg

SEQ ID NO: 33910 - DNA, 101 bp, rice(Oryza sativa)
  misc_feature (71): n=t or c
cacttagacaaatcaaacatgacaaatttagctacaggatatcgcagttgtgtggttttagcttttactanatgacattgcaattgtgtgattttagctca

SEQ ID NO: 33911 - DNA, 101 bp, rice(Oryza sativa)
  misc_feature (71): n=a or c
gagtaatcgaacactctggagttccgctcctttcatagctgcgaggagaggaggactaaagagtcgaagcncttatgacaatgcttaggcaggcaggccct

SEQ ID NO: 33912 - DNA, 101 bp, rice(Oryza sativa)
  misc_feature (71): n=t or g
tgcaaccgcgcgcctaccagcagtctattgtgtccatgaaccaatcatgacagaatatcctcgcgttcccnagggagaaaaatcgaactgaatgaagctag

SEQ ID NO: 33913 - DNA, 101 bp, rice(Oryza sativa)
  misc_feature (71): n=t or c
atggtactccacaatgccagaccgaatagtatccaggctgggagaaacacaaaacgagaacggaattcaancaactcctggaaaggagaatggcactcacc

SEQ ID NO: 33914 - DNA, 101 bp, rice(Oryza sativa)
  misc_feature (71): n=t or c
caacgcattagcagtaacagcaacagcaaaacgtaattaaaccaccaccaattgcaagcttgcactgaccngagtaataatttaaggtcctgagtttaaat

SEQ ID NO: 33915 - DNA, 101 bp, rice(Oryza sativa)
  misc_feature (71): n=t or c
gtcgtttcgtcttccccgccgaaaccttcgccactttcccctttctccgctatagtgcaatccacaccggnaaaaagctagggttcacaaatccactccca

SEQ ID NO: 33916 - DNA, 101 bp, rice(Oryza sativa)
  misc_feature (71): n=a or c
aagagaggcagtgtcttaacattgccaatatgttattagcaataatgcatcattaagaattggctacattngaagattccggtagtaaagcgtatccagca

SEQ ID NO: 33917 - DNA, 101 bp, rice(Oryza sativa)
  misc_feature (71): n=t or g
ctacatgcatattctctgttcagaaaacatgcatgcttgcacctaaaactggatttacgcctaataacatntatatacattactgcatatgctgactgcac

SEQ ID NO: 33918 - DNA, 101 bp, rice(Oryza sativa)
  misc_feature (71): n=a or g
taaatatctaaaattagcttgacttaagccatccattccgcttgatgtggtcctacaaaacaaccaaaatntatattgtcactgtagttatttgtatttac

SEQ ID NO: 33919 - DNA, 101 bp, rice(Oryza sativa)
  misc_feature (71): n=a or g
tgcacatgaagaggaaggcagcccaaagccttccagtcgactactgcataaaaaaaagtcagaagatatanggatctagaattagttagtaagcaaagaaa

SEQ ID NO: 33920 - DNA, 101 bp, rice(Oryza sativa)
  misc_feature (71): n=t or g
tgaagggaacgtactttagctttcctgctacccgttcgcaaaaaatggtgaaactttaaaagtcaaattcncttttaacgctactaacaggatttcaaaag

SEQ ID NO: 33921 - DNA, 101 bp, rice(Oryza sativa)
  misc_feature (71): n=a or c
attaatcaatcctcaattattggtgagagagcaatcacagtaccctggaccgaatgtgattcaactaacanaagaccaggttgtatctatgtttctacctc

SEQ ID NO: 33922 - DNA, 101 bp, rice(Oryza sativa)
  misc_feature (71): n=t or c
ggaaaacacacatgcctatgtgtattctcgttgccgtgacccttcttcctcttcgtctcactatcctatancccatcctccctctattcctcaagaatgaa

SEQ ID NO: 33923 - DNA, 101 bp, rice(Oryza sativa)
  misc_feature (71): n=t or c
ggtcgacctgctcacccgctacgtcacctccctctacctcgccatcgtcaccatggcaactgtcggtacgnaccctccgtcccaaaataactcaacctaga

SEQ ID NO: 33924 - DNA, 101 bp, rice(Oryza sativa)
  misc_feature (71): n=a or g
ttagtacttgcccgctatatgttacactacggttacggttatttgcacgtgtcgttttgttctggcgaaanaaatgaaccgtttaaaaataagaaagttcg

SEQ ID NO: 33925 - DNA, 101 bp, rice(Oryza sativa)
  misc_feature (71): n=t or c
ggacgagtcggtttctggtttgtgatatgttcgatgttgatgctttgcctgtaacattttgggccacgctnggcgcaggcctgcagggtgggggtggggcc

SEQ ID NO: 33926 - DNA, 101 bp, rice(Oryza sativa)
  misc_feature (71): n=a or g
tgtatactggagtaactactgtaatgggtaagcaggttatatattgcgctagtttgcttcaaccgggaacntcaaactactaggcggaacgtacacaaatt

SEQ ID NO: 33927 - DNA, 101 bp, rice(Oryza sativa)
  misc_feature (71): n=t or c
tgtttgtcctgttcaccttcctggagcctgaggcggtactgcaacggttgtgtacacaaattcgaaactantacttccatgtcatcctgcaacagttgtac

SEQ ID NO: 33928 - DNA, 101 bp, rice(Oryza sativa)
  misc_feature (71): n=a or c
tcaaagagatcagaaaagagtacagattgaacaacctgctactctgctagtagtgctgcactctgctctgnaccgtcgccgacgtcgttctccagtccgct

SEQ ID NO: 33929 - DNA, 101 bp, rice(Oryza sativa)
  misc_feature (71): n=a or c
aatatatttaaaactcagccaacctaggagaaaacatgcactcaaattcgcctcgttgagaacttaaactngggtgatctgggcatacattgctcagtaga

SEQ ID NO: 33930 - DNA, 101 bp, rice(Oryza sativa)
  misc_feature (71): n=a or g
taggctgacctctccacttggccgtcaccgcacgatgcctagatctagcagttggttggctaccttcatcnagagccaagggtgtgacgtggcgggtgcgt

SEQ ID NO: 33931 - DNA, 101 bp, rice(Oryza sativa)
  misc_feature (71): n=t or c
tcgaggcaaggaactcgcgtcttacctgagggacgagagcctatgcaaaggtaatagggcccacaccctcnctcctccacggcatcacgcaagtggggtgg

SEQ ID NO: 33932 - DNA, 101 bp, rice(Oryza sativa)
  misc_feature (71): n=t or c
tgagctgtttttctgcacaccatcatctgtctttcagaaaacagctatttagctttatcttcttcttcttnttttttttttttgcaaaacttgcattctgt

SEQ ID NO: 33933 - DNA, 101 bp, rice(Oryza sativa)
  misc_feature (71): n=t or c
atagttgatagtagtatcattttctcaaaaaaaaaaaacatagtgtagtttcatcttgaaaaccagattanttagcccaagttgcacaatcttgattgttg

SEQ ID NO: 33934 - DNA, 101 bp, rice(Oryza sativa)
  misc_feature (71): n=a or g
tggttgtaatagaaacattgtcactgaggtattcgaatggaagagttttaagtatgttgcaccacttctcnaacatgctcttggttcagatatcagaaatt

SEQ ID NO: 33935 - DNA, 101 bp, rice(Oryza sativa)
  misc_feature (71): n=t or c
tttgattaaattacttcctatacattcataatgctacgaggtgactacctattattgttttcagtcaattncgtaatttgtgctgattaatttagtttcta

SEQ ID NO: 33936 - DNA, 101 bp, rice(Oryza sativa)
  misc_feature (71): n=a or g
tctcaaaattaatccaccgaacatgtcatggtgaggtgtcaatcaaggaagcagccaccaaacaacaagtnagtgagtcactggttaagttccaccaagtt

SEQ ID NO: 33937 - DNA, 101 bp, rice(Oryza sativa)
  misc_feature (71): n=a or g
gccatcaaactcctattctagccttctcctcccagctgcatctccacacatcattctccacctctaagccnaagaaaccgagggaagaggctctcaacttc

SEQ ID NO: 33938 - DNA, 101 bp, rice(Oryza sativa)
  misc_feature (71): n=t or c
taaaatcccaccttttggccaacccggaaaaaaataatctagtaaaagcttggctttgtttaattcagcgnaaagtttggattttggttgaaattggagat

SEQ ID NO: 33939 - DNA, 101 bp, rice(Oryza sativa)
  misc_feature (71): n=a or g
cattttgtgatgagggagtaccagaaaccatgcaatagagaactgagatttattttttttaaaaaaaaacntactagtatacttatagggtagggtttgcg

SEQ ID NO: 33940 - DNA, 101 bp, rice(Oryza sativa)
  misc_feature (71): n=t or c
tctcttctctcgcttggcggtggggaccagcagagagacgcgacgctttttttactaagagcaagtttaanagtatagccaactattagctctaaattatc

SEQ ID NO: 33941 - DNA, 101 bp, rice(Oryza sativa)
  misc_feature (71): n=t or g
acctacaggctatagacgcctcctccttatcctccctgccagggactttaatttatttttcataaaatgcnctctctctctctctctctctctctctctct

SEQ ID NO: 33942 - DNA, 101 bp, rice(Oryza sativa)
  misc_feature (71): n=t or c
ttgtccctccgtagaagaagctctccgagcagagaccagccatccaagtgtcacgcctggaatttctatcnaaaattccaaacgcttacatgtgtgttaaa

SEQ ID NO: 33943 - DNA, 101 bp, rice(Oryza sativa)
  misc_feature (71): n=a or c
gttgaaatatcatcgccttttggtttcttatcgattccgtcgttccgattggagttgttcgtcggcgtgantttttttttcctgattcatcgttgcttgtt

SEQ ID NO: 33944 - DNA, 101 bp, rice(Oryza sativa)
  misc_feature (71): n=t or c
agattctttttaaatataggtatcatgagagcgagtctgatgcagaagaagacaatgatgtgtacttcaantatttggtaaacaagttcatcaatgttgct

SEQ ID NO: 33945 - DNA, 101 bp, rice(Oryza sativa)
  misc_feature (71): n=a or g
tacagataatccaccacactgcacgtagggtattacctcaccttgagggcttgaaccaggataatcatctntgtcaccatctctccttgatctagtgcacc

SEQ ID NO: 33946 - DNA, 101 bp, rice(Oryza sativa)
  misc_feature (71): n=a or g
tttttttttggacggagagagtatataataaaggacaatacttgactgttaatccaaatactaccaaaatncaagccaagaatttcacttgaaaaacattg

SEQ ID NO: 33947 - DNA, 101 bp, rice(Oryza sativa)
  misc_feature (71): n=t or c
cactaaaataataattagttatagatgcgagcacccgtgtcagtctacaacttaaaaattcgagtggattngttccaccataaaaactctagccagttgaa

SEQ ID NO: 33948 - DNA, 101 bp, rice(Oryza sativa)
  misc_feature (71): n=t or c
ggggcggcatgccgccgtcgcacaaccacgacgacggctaccggcagcagttcagcgatgtcgccgacgtnggcgcggccgcgctgagggaccagctgtgc

SEQ ID NO: 33949 - DNA, 101 bp, rice(Oryza sativa)
  misc_feature (71): n=t or g
gtacaaaccctgcttgcacgtcctccccgaaacaaaacacagttcggaatggcaattagcaggacatgcgncacagcgactggccgccggccgcccggcaa

SEQ ID NO: 33950 - DNA, 101 bp, rice(Oryza sativa)
  misc_feature (71): n=t or c
tagcatcgggtaggacccacacgcactattatagctgatagtggaaccgatgatttcctctcaatttctcncctcaataataagtgaagtaggtcttatca

SEQ ID NO: 33951 - DNA, 101 bp, rice(Oryza sativa)
  misc_feature (71): n=t or c
accgaatttgatcgtttacgaccgttttcacctgttgccgtcaccagccatggtagctttagctccaggcnatcgcatggccgtccaaggtcccaatcagg

SEQ ID NO: 33952 - DNA, 101 bp, rice(Oryza sativa)
  misc_feature (71): n=t or c
cccttttatatcgcaggtcaactgtctccaagtaggactcggagaggccagtccgaacacgacacaatgangacccagttctgaccgagtaggactccttc

SEQ ID NO: 33953 - DNA, 101 bp, rice(Oryza sativa)
  misc_feature (71): n=a or c
tccccttctcacttgttgctatcaccacgtcacgcacctgcagtaatatatactcccccattaaaaaaagntcaatctaaaaagagattgacctctagtcc

SEQ ID NO: 33954 - DNA, 101 bp, rice(Oryza sativa)
  misc_feature (71): n=a or g
catctgtaattgactatacctaattgggaaaagaataccatgcacttcctcttgttggattggtctcctcnctgcctcgacagttgctaggtgcgctagct

SEQ ID NO: 33955 - DNA, 101 bp, rice(Oryza sativa)
  misc_feature (71): n=a or c
gaggatggtggagattaggtctagaagtgagtttatacagagatgaaggggatcggcttgacggttggatntatatcaaatgactattgaaagatattaaa

SEQ ID NO: 33956 - DNA, 101 bp, rice(Oryza sativa)
  misc_feature (71): n=a or g
ggtaaggtgcgtggttggatttttttttccttttttcgtgcggtcggtttgatggtgcttgctggttagtnattcgcgctgcgcgcggatttgtgcttaat

SEQ ID NO: 33957 - DNA, 101 bp, rice(Oryza sativa)
  misc_feature (71): n=a or g
gtatggcctaatttctacatattattgttgatgttgtcttctgtagcaaccaaaacgtgcttgggagttgngagttgagagttgagactgtttctgatgga

SEQ ID NO: 33958 - DNA, 101 bp, rice(Oryza sativa)
  misc_feature (71): n=t or c
acatgaaggttggggcaatgtatttcggttttgctggtacaatgcattcacgcatattggttagtactttnaatcgttgtactcctcttttgatacgatta

SEQ ID NO: 33959 - DNA, 101 bp, rice(Oryza sativa)
  misc_feature (71): n=a or c
aaaacttggctgcacttaaaatattcattctaaaaacagaaacaaagatcttaagcaaatatgaggcattnctagctagaactaacatcttcttttaaaaa

SEQ ID NO: 33960 - DNA, 101 bp, rice(Oryza sativa)
  misc_feature (71): n=a or g
ggtatgaaagggtgtgcaaatttgatccaggggcatataaggaaagagccagtttcaaatggcatataagnaatacaacaagttttcaatggcgtataagg

SEQ ID NO: 33961 - DNA, 101 bp, rice(Oryza sativa)
  misc_feature (71): n=t or g
tggaacacatgcacctagttaacaagatctagttaaaatggcggaaaatttagtcaacatgtagaaaatanttcttaattttaactacaacaatgtattga

SEQ ID NO: 33962 - DNA, 101 bp, rice(Oryza sativa)
  misc_feature (71): n=a or c
gtgcaccaactggcacgccggccacctgatgaacctgatcgagctctagctactcttatcatcacgtcaancagtccactatacactggaatatatcttat

SEQ ID NO: 33963 - DNA, 101 bp, rice(Oryza sativa)
  misc_feature (71): n=a or g
cctacatggcaacttggcaagtctacggcgtttttgttactcctacctagcaacggaattttacttttacngttttactgtgctcgcttctttttccgttt

SEQ ID NO: 33964 - DNA, 101 bp, rice(Oryza sativa)
  misc_feature (71): n=t or g
cgtaggaggaggatcttgagcttagcaagtagtagcaaattagtagcaattttgtggatatggatgcggcngttgcagcgagaaattgcggagtctgatag

SEQ ID NO: 33965 - DNA, 101 bp, rice(Oryza sativa)
  misc_feature (71): n=t or c
ttatatcttcccttaaaattgagataatcaacacatactcatttatattatattccagttacttgtttggngggatgagtaataatcaataaaaataattt

SEQ ID NO: 33966 - DNA, 101 bp, rice(Oryza sativa)
  misc_feature (71): n=a or g
agggaactttgaagaggttaataaggtggttctaggaaatgctcctatcaattgtcaaatgatagatcacnagattcagaaacaactcattcgctcatgtg

SEQ ID NO: 33967 - DNA, 101 bp, rice(Oryza sativa)
  misc_feature (71): n=a or c
tgggctgagtgccacgaaatttggtcatggagaccgccatggcaatgggaacatatcttttgtactctgtnaagcatggagaaaaaaggagtctcgttgtc

SEQ ID NO: 33968 - DNA, 101 bp, rice(Oryza sativa)
  misc_feature (71): n=a or c
gcaaagcaaaatatccccaagtactatttttgcaaagaaaaattatttccgttgatctggctcaagaccangactagctaaatctcctagcgagatagaat

SEQ ID NO: 33969 - DNA, 101 bp, rice(Oryza sativa)
  misc_feature (71): n=t or c
gtgatgagcccaataagtgtatttgggccaggcccaatgcaagtccctgcatgcaagaacaagtgaaatanatggccattagtcaattatttgatagcaag

SEQ ID NO: 33970 - DNA, 101 bp, rice(Oryza sativa)
  misc_feature (71): n=a or g
aataattaggaaacgaaatcatggagccagccttgcttgcacctaaccacaacatgaaacaccaaaaaacnttcgcgtggatgaggtcacagtgcacgttg

SEQ ID NO: 33971 - DNA, 101 bp, rice(Oryza sativa)
  misc_feature (71): n=t or c
gccctaagcaaacacacgccacattagtacacgagcgcgttttttttatttgtagctttgattttgttttntgtgtacgagaatctatacgataggacatc

SEQ ID NO: 33972 - DNA, 101 bp, rice(Oryza sativa)
  misc_feature (71): n=t or c
aagaaatagatagaagaagtaaatggctactgacaatctgacatgcgtgatgtacatgaatccatcgatanaaagtcaggttgacttggtcatggactcaa

SEQ ID NO: 33973 - DNA, 101 bp, rice(Oryza sativa)
  misc_feature (71): n=a or g
taattatttgattcatttcctataaacaaatcgatcatccatcatcctacatccgcatttcatctagaaanaattggcatcgcgccaccccaatgttgact

SEQ ID NO: 33974 - DNA, 101 bp, rice(Oryza sativa)
  misc_feature (71): n=a or g
gtctacggctacgattggtttcggcgcaaggaagcgcacgaaacatacgctagatgctcgatttttttttntttttatttttgtttgtatgtcttctaagc

SEQ ID NO: 33975 - DNA, 101 bp, rice(Oryza sativa)
  misc_feature (71): n=a or g
ttcatggttttcactggtggatacttagaaaaaccgcctgtaagtttgtgagtattgcttacatagtgccnatatctcatggcctgagaattttgtatttg

SEQ ID NO: 33976 - DNA, 101 bp, rice(Oryza sativa)
  misc_feature (71): n=a or g
tggaagaatcacaacgcatggaagaaatgcaaatcacaaaactcaggcaattagctagccatgaattgagncatcagccatgcatgcgcaatggatgggaa

SEQ ID NO: 33977 - DNA, 101 bp, rice(Oryza sativa)
  misc_feature (71): n=a or g
ttgacaaccctatcatgttaatgatagtattctgtcttaacctctcagcccctaagatgtcttatgttganctagaaagaagtcaggataacatactccgt

SEQ ID NO: 33978 - DNA, 101 bp, rice(Oryza sativa)
  misc_feature (71): n=t or c
cgcccctgacaggcagtgcacaccttacttccatcttgccaagtgccttctaaaattgttgcttatccatnctttgctcctgtttttcagctatgcctccc

SEQ ID NO: 33979 - DNA, 101 bp, rice(Oryza sativa)
  misc_feature (71): n=t or c
attcttttatttgctgatttgttactatttagtatttacaccctttacaaacagcactgcccaactgatangagcaagctgtatatgtttggatacgcgta

SEQ ID NO: 33980 - DNA, 101 bp, rice(Oryza sativa)
  misc_feature (71): n=a or g
tgtgtgcactatgatgcagaaaaaatagttgtaaaacatttttctattataacaactaggaagatagcccncgcttagcgcgggcatgggtcgtatgctaa

SEQ ID NO: 33981 - DNA, 101 bp, rice(Oryza sativa)
  misc_feature (71): n=a or g
accggcgggcggcagcacggcgcagttcggcggcaggtggcgatgcagtctaaggggagagaaagagacanagagagaagggagagagcgaggaggaagga

SEQ ID NO: 33982 - DNA, 101 bp, rice(Oryza sativa)
  misc_feature (71): n=a or g
tgtctttcaaggctggtactttgttagctagagttctgtacagtctagaatatctggctcttgtaccatcngcggttcgtgccagggcaagcaagctgatt

SEQ ID NO: 33983 - DNA, 101 bp, rice(Oryza sativa)
  misc_feature (71): n=t or c
ctccattctcgtaaagggtacatctcacttaggtttttttttgcccccgcaactgcccattggagagcttnctcctttattctcaagaggatgaggaatgg

SEQ ID NO: 33984 - DNA, 101 bp, rice(Oryza sativa)
  misc_feature (71): n=a or g
ataacgaagtatacaagatattatgaaaaatatcctcacgggccggcgattaacagagtcccactaggagnggatagggattattctatatcggcaaggtt

SEQ ID NO: 33985 - DNA, 101 bp, rice(Oryza sativa)
  misc_feature (71): n=a or c
tgagatgctcacgtgtgttgtccgtatttttcttgctctgtacagtttttaaaattatgccgttggagtcntgagataagtatggatggtatgaagagtaa

SEQ ID NO: 33986 - DNA, 101 bp, rice(Oryza sativa)
  misc_feature (71): n=t or c
attcccattccgtccctgccaattataacggggaacaatttttctatcaccatcccgtgcgggaattgatnccgtgatccatcatctccagttctccactt

SEQ ID NO: 33987 - DNA, 101 bp, rice(Oryza sativa)
  misc_feature (71): n=a or g
tgggccgccgaaccagcacgtctgcccgggagggaaagtgaagtcggtgatgcccgaaacgaatcccatcncactagtcggcgaaaaacatggcgcaaccc

SEQ ID NO: 33988 - DNA, 101 bp, rice(Oryza sativa)
  misc_feature (71): n=a or g
taatgacgtggacgaatctcagccattggatttattttggaggaccgaaatctacgctatgtcatctcgtnacatgtttaccctatgtcacttaatctgaa

SEQ ID NO: 33989 - DNA, 101 bp, rice(Oryza sativa)
  misc_feature (71): n=a or g
tacgccgacgatcactggagcagttcgaaggacttcgtcctctacttccactttgactgacggcattgcanagggaacaaggagaagcacatcaatggctt

SEQ ID NO: 33990 - DNA, 101 bp, rice(Oryza sativa)
  misc_feature (71): n=a or g
tccactcatcaaagaagcattaaatgatgtaaagaaacctccaaattaagggtctgtttggcacagctggnctggagctggagctctgccaaacagtttca

SEQ ID NO: 33991 - DNA, 101 bp, rice(Oryza sativa)
  misc_feature (71): n=t or g
aaattctgctccactgtaactttttcttacctgctgcaggggctggtgggggtctttgcaaatgaactccntgaaactttaattcatacttcccaaatacc

SEQ ID NO: 33992 - DNA, 101 bp, rice(Oryza sativa)
  misc_feature (71): n=t or c
gaatgcgtcacctaacacatgctctaagagcggaggttgacgcattaacacatgccctaagagacacctcngcgaaatgaccactacactcacacctccgt

SEQ ID NO: 33993 - DNA, 101 bp, rice(Oryza sativa)
  misc_feature (71): n=t or c
gtggcctgcaaggcttcattgtccagtcctcttcatatttctggctagagttgttggtcctctagagcacncgcaatggtaaaggaatgtgctttttataa

SEQ ID NO: 33994 - DNA, 101 bp, rice(Oryza sativa)
  misc_feature (71): n=a or g
acaatgagagctttcgacggtgataggacgcgtaatcgcgcgatccaacggctgaaagattctgtgtccanggtcggtgactttacgggcaggatggatgc

SEQ ID NO: 33995 - DNA, 101 bp, rice(Oryza sativa)
  misc_feature (71): n=t or c
gggttaaacttatatgggagaaatattatgttggcaaaacccctcatgctgtcatacctatgggatctttntggtggagagatgttctgtaatttgttgat

SEQ ID NO: 33996 - DNA, 101 bp, rice(Oryza sativa)
  misc_feature (71): n=t or c
gcagtcatgcatgcagatgatggatcgatcgatcgagcaaaagactgactagctagctaattactccaatngatggatggatgcatcggagtacctgagaa

SEQ ID NO: 33997 - DNA, 101 bp, rice(Oryza sativa)
  misc_feature (71): n=a or g
gacagttatatttacgagtgtcattatgtgaggtattatcacgacaaaaaattttttagacgataataaantatatttctatttattaaaaagcatatgta

SEQ ID NO: 33998 - DNA, 101 bp, rice(Oryza sativa)
  misc_feature (71): n=t or c
aaatcatcccgaatcaccgccgaaccacaaatccacacccaacccgtcacaggatcaaccggatctagcgnccctggacacacgaaaccctaccgcgacac

SEQ ID NO: 33999 - DNA, 101 bp, rice(Oryza sativa)
  misc_feature (71): n=a or g
acggccctcttgacagaagagtcttatactcaagcaattccttacactgatgagatgaaaccaattcaggnagaaagcttaaaaaataaaatactgatgac

SEQ ID NO: 34000 - DNA, 101 bp, rice(Oryza sativa)
  misc_feature (71): n=t or c
ggaagcgtatcaccctactcttgtgttcttgttatgaatgagggtgataaagtttacaatgtagattgggnggatgttgttctaagtaggagatgatgaac

SEQ ID NO: 34001 - DNA, 101 bp, rice(Oryza sativa)
  misc_feature (71): n=t or c
tttttcagactacaactgctccaaccctttgccaaacttctcctatcgctctagcagtagcagatctccgntactccgatccgtccttcccctcgaattga

SEQ ID NO: 34002 - DNA, 101 bp, rice(Oryza sativa)
  misc_feature (71): n=a or g
cctcttcctgtcggcacacccttgagacaagccttcgctgctgcgccatcgtttgaacggtggcatggtcntcttggtcactcctccaaaccaatcgttct

SEQ ID NO: 34003 - DNA, 101 bp, rice(Oryza sativa)
  misc_feature (71): n=t or c
tgcaattggcccaaaatgtatactacaaaaatccaaaagatacaccacaaagcatgacaagttatagttcnacgatgatcatgctacaaaacatttgcata

SEQ ID NO: 34004 - DNA, 101 bp, rice(Oryza sativa)
  misc_feature (71): n=t or c
tctagcaagtttgatgttttgccattttaaatgtttagagtacttatgaaaagttcagaacattgttaagntgtgtattactcttcacaaccagtgaagat

SEQ ID NO: 34005 - DNA, 101 bp, rice(Oryza sativa)
  misc_feature (71): n=a or g
aagtccaaaactgtttgttagcgcaagcgctgaactccgatacggaactgaagaaaacagagcaagaacanagtatcgaggaatttcagaacttagcgaaa

SEQ ID NO: 34006 - DNA, 101 bp, rice(Oryza sativa)
  misc_feature (71): n=t or c
tcacttattaatatatgtaaccttctatattttaacacatatccaaatcaaggatatattgaggatattgnaagttaattagctagcttttcttcagtggt

SEQ ID NO: 34007 - DNA, 101 bp, rice(Oryza sativa)
  misc_feature (71): n=t or c
ccgctatcgctcggctgaagcgtagtatacgagagaaaaacgcccgcttccagcccgatgagagcaggtanaatagcaggctataagccagctataaatat

SEQ ID NO: 34008 - DNA, 101 bp, rice(Oryza sativa)
  misc_feature (71): n=a or g
gcctgaggacgtgaagcctactcgccggaagatctcatcgaattatctcaacaaggatatcgccagtaacnccggattcatctgttctctttgtattctgt

SEQ ID NO: 34009 - DNA, 101 bp, rice(Oryza sativa)
  misc_feature (71): n=t or c
agtaaaattgttaacaaaaggtaggtgagtatggcggccgagttgacatgcatgacaaagagtggagacgnctttcggtggaggaataacagtagcttgtg

SEQ ID NO: 34010 - DNA, 101 bp, rice(Oryza sativa)
  misc_feature (71): n=a or g
tagctgctcctgttctagtagattttactctcttttactccctcgtcacataaaaaaacaatctagtatcnaatgtgacatatcttaatactacgattcta

SEQ ID NO: 34011 - DNA, 101 bp, rice(Oryza sativa)
  misc_feature (71): n=a or g
gccgtgggctgcgcgcgcggtgtagacgtaggcgctggggaggcaaaaccgcactagcggtgcagcgcacngccaccgggcatgaggcgtcgccgcgtggc

SEQ ID NO: 34012 - DNA, 101 bp, rice(Oryza sativa)
  misc_feature (71): n=t or c
ggcatgagaagagagagagagagagcttggttttgggtggagaaaagtggagctctgtccatggattggtngatgacggcggcgctcacacgtggtggccg

SEQ ID NO: 34013 - DNA, 101 bp, rice(Oryza sativa)
  misc_feature (71): n=a or g
ttatttacatcaccaatatttaataactagttaaaggcttgtttagtttgaaactaatttttactctaccnaaatcttgatagtgccaaaaccgtggcaag

SEQ ID NO: 34014 - DNA, 101 bp, rice(Oryza sativa)
  misc_feature (71): n=a or g
cgatgtcaaatcactaagatcaatttttctaaaacttttcctaataatatctccaatccaatcctccatantttcaggcctttgttgatttggtggtgtat

SEQ ID NO: 34015 - DNA, 101 bp, rice(Oryza sativa)
  misc_feature (71): n=t or c
ctttttaatagaaatctctactggatcaagtggttagagttgcatactatgaaataggaggtcctgagttngaaccataacttctctgtttctattttatt

SEQ ID NO: 34016 - DNA, 101 bp, rice(Oryza sativa)
  misc_feature (71): n=t or c
cggcaattaggcccttcctactgagagatgtaatttttacgttttcaagagtatcgcataagtagcaaggnagtttacgtactccctcagttccaaaataa

SEQ ID NO: 34017 - DNA, 101 bp, rice(Oryza sativa)
  misc_feature (71): n=t or g
ctccacggagtaaattcgttacttttgaaacgtgcggagatataaaaaaaggaaaaatcggaaagaaaaantagatggtaaatattttacaaaaacgtgaa

SEQ ID NO: 34018 - DNA, 101 bp, rice(Oryza sativa)
  misc_feature (71): n=a or g
aaggatacatcttctgacaggctgcattgtgggtttccactcgtcacacaaaataaaataaaggattagcncatgattaattaaatattagttaaaaatta

SEQ ID NO: 34019 - DNA, 101 bp, rice(Oryza sativa)
  misc_feature (71): n=t or c
cagctcagatctgatacccgatgggtattggttgacaccgttaggtatcaggtctggtaccaacgtgtatnggctggtaccaaaaaagtatcggttggaac

SEQ ID NO: 34020 - DNA, 101 bp, rice(Oryza sativa)
  misc_feature (71): n=t or c
gtggaatagctctggctttgcaatggactctttggccgttgatcgtagaaacttattgcctggtggctatncacatgatcaaatcacaggaaaaggataaa

SEQ ID NO: 34021 - DNA, 101 bp, rice(Oryza sativa)
  misc_feature (71): n=a or g
atgggtgtgttagactgttgtacattgtgttgggggtgtatggtgtgttgtgtgtgaacaactgaacatangtaagggagtggggcttaaacaaacgatca

SEQ ID NO: 34022 - DNA, 101 bp, rice(Oryza sativa)
  misc_feature (71): n=t or c
ttgctcaaaatcaaatcacaaagctcgcgaattgagtataattcaactggttaaattatttgtaaaggaangtgtgcttactcgagttcaagttaagactt

SEQ ID NO: 34023 - DNA, 101 bp, rice(Oryza sativa)
  misc_feature (71): n=a or g
cctgccattgatgaatgacgagacaaattcgtcataacaaattgaacccacgcgtatgatgacatgtgatnttgcagatgacaaggcaggtgatgtggcaa

SEQ ID NO: 34024 - DNA, 101 bp, rice(Oryza sativa)
  misc_feature (71): n=a or g
acaaatgtgttatatcatgtattagatttatttattatatgatgataaaagtagtaccaaatttaacacgncttaatattatgaatttgaatgctattata

SEQ ID NO: 34025 - DNA, 101 bp, rice(Oryza sativa)
  misc_feature (71): n=t or g
gcaagagtactcccgtgcaacttaaatccaaacaggcaccgtatattcactagcagtgacgagggctcgcnctctctctctctctctctctctctctctct

SEQ ID NO: 34026 - DNA, 101 bp, rice(Oryza sativa)
  misc_feature (71): n=t or g
agataacttaagattctgaaaaataactgatgagaatcttaaaaaaatggtttcccagcttctagtttttnattcattttttaaactctacaattacatat

SEQ ID NO: 34027 - DNA, 101 bp, rice(Oryza sativa)
  misc_feature (71): n=t or c
cagattagcaagtaggaacaaatacttgctctataagcatgatgcatgtcagccaccttttcattacatanttgtatgcttcttggatggcttgttgctac

SEQ ID NO: 34028 - DNA, 101 bp, rice(Oryza sativa)
  misc_feature (71): n=a or g
catgtggttacttcattgcgtgcatgaatgctgttcctggtatatattgcgttgacacttagatacacagntacacaggtcttaaaaaaagagcacatagg

SEQ ID NO: 34029 - DNA, 101 bp, rice(Oryza sativa)
  misc_feature (71): n=t or g
cccatctgatatgggttctaatataagcctgattgtgagctgacttttttttctgtcttgaggttgaattncattggaatactgagaattgtgtggctcat

SEQ ID NO: 34030 - DNA, 101 bp, rice(Oryza sativa)
  misc_feature (71): n=t or c
cggagttacgtatatgaggatacgtgtattgagaaaaaaaggccgagaagacctgttttcgaagttagaanataggtttagtgatgttagaagttgattta

SEQ ID NO: 34031 - DNA, 101 bp, rice(Oryza sativa)
  misc_feature (71): n=t or c
taaacaatgctgatcaaaatcccttatattttagatcagattcgtattactattatgtatcatattcgacnaaaattctttacattttacaatgatgggag

SEQ ID NO: 34032 - DNA, 101 bp, rice(Oryza sativa)
  misc_feature (71): n=a or c
ttggagtttgacatgttgatttagggttagcttttatatatgcctagtaaatgggcttcaatattatgggncaaaacgtctaaaaagtctaaatttagtcc

SEQ ID NO: 34033 - DNA, 101 bp, rice(Oryza sativa)
  misc_feature (71): n=a or c
cccactttgactcattttaccattggtaatcttatcttactgtcatgcacgatatgggccctgtttggttncatcggctaattattagcccccacctttta

SEQ ID NO: 34034 - DNA, 101 bp, rice(Oryza sativa)
  misc_feature (71): n=a or g
gctcgtcttgcgtttgtcctcgtgcttggtggtacaacgggaattaatctggacgggcgaaccctaaagcntttacgcccgcgggttggcccactcgctta

SEQ ID NO: 34035 - DNA, 101 bp, rice(Oryza sativa)
  misc_feature (71): n=a or g
acgataacataaatctatatccgctgttaacttataatggtaactggagacgtggtaagatgttagatatnattttctaaatgcgctatacatcaggatca

SEQ ID NO: 34036 - DNA, 101 bp, rice(Oryza sativa)
  misc_feature (71): n=t or c
aggtgctttctcgttgtttttagtttgcacgcagccatcggtaacatcggcagaccggctactagcagtgngtcgaatgcccaaacgcgcggcagtatcta

SEQ ID NO: 34037 - DNA, 101 bp, rice(Oryza sativa)
  misc_feature (71): n=t or c
ggaaggaatgaagcgtcgacagcggcgtaagaattctttccataaaaagatctactatgttcctattgagngttaagaggtaacgctttatataaaacgga

SEQ ID NO: 34038 - DNA, 101 bp, rice(Oryza sativa)
  misc_feature (71): n=t or c
tcaaacattttgaaatggagagagtaattaagctacgcaggccatgagattgatcgatcgaaataacaagngaacatgcagtagcagtagcagagtagtgt

SEQ ID NO: 34039 - DNA, 101 bp, rice(Oryza sativa)
  misc_feature (71): n=a or c
tcttgcaaccaagcacaaacagcacaaatatttattatagacaaaacataccggacaatcctctctctctntatatatagagagagagagaggggcaaata

SEQ ID NO: 34040 - DNA, 101 bp, rice(Oryza sativa)
  misc_feature (71): n=t or c
ctaaaatttgtcttatctggatcaccacgtcaattaggatattttatttcgggggttaaaccaattttttnatgcaaaattcaagtccactgttaattagt

SEQ ID NO: 34041 - DNA, 101 bp, rice(Oryza sativa)
  misc_feature (71): n=t or c
atgcttttcctttgcaattccttggaaacgaataagcccttaaggtgttttgcaatcccatgttcccaatncctctctctcgttttccacgcgtacgcttt

SEQ ID NO: 34042 - DNA, 101 bp, rice(Oryza sativa)
  misc_feature (71): n=t or g
atgcaaatacataggccccttcccttctaccgagttgtttagaaggcgctttccgttctacggtccattcnctaggtccgaattcgtcaaagcgaaagatc

SEQ ID NO: 34043 - DNA, 101 bp, rice(Oryza sativa)
  misc_feature (71): n=a or g
gaagattttagggacttggcaacaccaagaggatggagagatatgttggaagcattagaattttccatacngctcgaaacatgtttttgcgtgcggtaggg

SEQ ID NO: 34044 - DNA, 101 bp, rice(Oryza sativa)
  misc_feature (71): n=a or c
gctaaaaatcatgtctcacaaccaaatcgatcgagtgtaagtggtcgttagtgttttgtttgatgataatntttttttttaagggaaagtttgccatgaga

SEQ ID NO: 34045 - DNA, 101 bp, rice(Oryza sativa)
  misc_feature (71): n=a or g
gattgccgccaaagtctttgagcaccatgttcgtcttaatgaggtcatcggcatttgtacccaacttcctnaacgtggcataaggcatcaaatttaccgca

SEQ ID NO: 34046 - DNA, 101 bp, rice(Oryza sativa)
  misc_feature (71): n=t or c
tgaaccaattgaggggatcgtctttgccgtcatatttgggaaattccagtttatagaagcgaggaacgccngtgccagaactgttgtcctggggcgcatga

SEQ ID NO: 34047 - DNA, 101 bp, rice(Oryza sativa)
  misc_feature (71): n=t or c
acctgcgtaggtcgctacgctggatccacaatcgccgaggtcccccatgccggattcgccgccaacaagcnccctgccactagatcagtcaccgtggagca

SEQ ID NO: 34048 - DNA, 101 bp, rice(Oryza sativa)
  misc_feature (71): n=t or c
atctccacttccggggccttcccttcccgatgaggactggccgaagggaccgcctgttgacggtcgttatngatcagttttgaccgtcaatattaccaaaa

SEQ ID NO: 34049 - DNA, 101 bp, rice(Oryza sativa)
  misc_feature (71): n=t or c
acgcgtggtagtatacagatgcaattaatccttctagtagtaatatattgctattgtatcaagacgggaanataagttgtatcatacatgcatacattgtg

SEQ ID NO: 34050 - DNA, 101 bp, rice(Oryza sativa)
  misc_feature (71): n=t or g
tttttcctttcagctaaagttttaaaactccccttctcttaatcctacaaaagatacgcaaggcttttacntattcttttaaaaaaaagctgaaccattag

SEQ ID NO: 34051 - DNA, 101 bp, rice(Oryza sativa)
  misc_feature (71): n=a or g
actatcgacgcccttcagtgctagagagatacaaatagagagatgaaagagctgacttgtgggctcagggntattttagtactttcatgcaatttctccct

SEQ ID NO: 34052 - DNA, 101 bp, rice(Oryza sativa)
  misc_feature (71): n=t or c
agtttacttccatatggttttggtcccacatcaaaatttctatcaatctatcatgaatctgcaaaacaagncatatacctcatccaatccaagtctgattt

SEQ ID NO: 34053 - DNA, 101 bp, rice(Oryza sativa)
  misc_feature (71): n=a or g
gttgatgtctttggatttatctttcaagctgcgaacttcaatcaaatctcaagcactagcagattttgttnccgagtggaccgagtgtcaagaagacacac

SEQ ID NO: 34054 - DNA, 101 bp, rice(Oryza sativa)
  misc_feature (71): n=t or c
aaaccgccctttggaagggcgatttttaaaatcgccctccccaaggggacgcggatcctctgactttactngctaaagtcacggtgtgactttcgaccaat

SEQ ID NO: 34055 - DNA, 101 bp, rice(Oryza sativa)
  misc_feature (71): n=t or c
gaaggtcggggtaatccaccatcctggaagcttttccttctgtggaaaaaccccgcacggatctccatgcnaatctgacggtagcaggggatatcctcctg

SEQ ID NO: 34056 - DNA, 101 bp, rice(Oryza sativa)
  misc_feature (71): n=a or g
ctccaacatatgcatcccctttcttcacccagtgatgccgaccagccggtgcactgatgctgctctctgcncgagccccttcctgcggggcattttcacac

SEQ ID NO: 34057 - DNA, 101 bp, rice(Oryza sativa)
  misc_feature (71): n=a or g
aattgaaaaaactcatcgttccaagagaaaccctaaatttaattcccaaaaattaaaagtgagcctttccnttaaactaccaacagaaatatcccgttttc

SEQ ID NO: 34058 - DNA, 101 bp, rice(Oryza sativa)
  misc_feature (71): n=t or c
gcccctctgcgcctctcttccgcggtgccgcccctgtctcgtctcctcgtctgcttgtccactcctctctngcctcgtccagtcctctcttgcattggccg

SEQ ID NO: 34059 - DNA, 101 bp, rice(Oryza sativa)
  misc_feature (71): n=a or g
ggacctcaaatgaacttattctcctctctactactacactgcctgcagggatgaaaacggtcgggaaaacntatcaaaatagaacagtaaatagtaaagtt

SEQ ID NO: 34060 - DNA, 101 bp, rice(Oryza sativa)
  misc_feature (71): n=a or g
ggcatcaccgcttcaccacctctgcagcaactgccacaggcgaccttttgtcgtcgccaccggatgggacnacgagctcagggcggatctagctcgaactc

SEQ ID NO: 34061 - DNA, 101 bp, rice(Oryza sativa)
  misc_feature (71): n=a or g
acagttgattccatgcagttctgagttttttttttttggttttggttttgaattttgcatatgtttgttcntgtaggatgcagaactgtacaagcttggtc

SEQ ID NO: 34062 - DNA, 101 bp, rice(Oryza sativa)
  misc_feature (71): n=t or c
tgtggtgcctcccttcctgtcctctctctctgtttcttgatggcgtaggaaacaatgttgtgggcccagangcaattctgacgaagaacggggagccaact

SEQ ID NO: 34063 - DNA, 101 bp, rice(Oryza sativa)
  misc_feature (71): n=a or c
ggccacgctcatgtatggacgtccgaacgagaagcgcttgtacgaccacaacatgaccaaaagtggacacnccgtgaaaatcgcctacctttgcccggtct

SEQ ID NO: 34064 - DNA, 101 bp, rice(Oryza sativa)
  misc_feature (71): n=t or g
tgagatacacatatgagatacggtttgaaatatattttgtttgattgattgtatggatttgaatgtactanttaggtgatatcacctctaacaaaaaaaaa

SEQ ID NO: 34065 - DNA, 101 bp, rice(Oryza sativa)
  misc_feature (71): n=a or g
ttatgaaatattctgaagaaaattaacaatgtagagtatataatgatatctatcgatcctcaaaaaatcangtttaaattcgacctacacatcgagaaaaa

SEQ ID NO: 34066 - DNA, 101 bp, rice(Oryza sativa)
  misc_feature (71): n=t or c
atcattacgcttttgtaagtgcaatggattttttaaacattatacatggtattatttggatatatttcaanaagtatttttcacatgttttagcatgtcat

SEQ ID NO: 34067 - DNA, 101 bp, rice(Oryza sativa)
  misc_feature (71): n=a or g
agaaataaatttttggaaaggacgcttttatcaccatggcgtgtagcagcgaagcagcctcatggaggtcnagatcaacattgacattacaatttaaagaa

SEQ ID NO: 34068 - DNA, 101 bp, rice(Oryza sativa)
  misc_feature (71): n=t or c
ggcccactatcccgattccctgggggcgctttattatgccgtggcttttaggaccggatcagatcgtagcnaaaataaactttactaaatttgacaagatg

SEQ ID NO: 34069 - DNA, 101 bp, rice(Oryza sativa)
  misc_feature (71): n=t or c
gtcgcattcgcatatatgtttggtaattggtactagtactagtcatttcaattggtactagtatttaccgnagcttccaggaaacatctcgtccgactgct

SEQ ID NO: 34070 - DNA, 101 bp, rice(Oryza sativa)
  misc_feature (71): n=t or c
ttaattgagcatgcccttaagggcttatttgatatggggactaatgtttttttaacagccaatcaactgangttttattaatagaagggagtttaagtata

SEQ ID NO: 34071 - DNA, 101 bp, rice(Oryza sativa)
  misc_feature (71): n=a or g
tatgatgaaataaattaaaaattagttatgtcttatattatggaaggaatggatggagtatcatttttcanaaagttactaagggcccctttgaatcgcag

SEQ ID NO: 34072 - DNA, 101 bp, rice(Oryza sativa)
  misc_feature (71): n=a or g
ccatagattggataagtagtttaggagaaaattcattttaaaatctactaaatccatgcatggatggatanaatggagagagaagcaggagagagagtaga

SEQ ID NO: 34073 - DNA, 101 bp, rice(Oryza sativa)
  misc_feature (71): n=a or g
cgaggtggacgtgcgacaaatataccgagagggaaactcggtggcccacacactctgccggcatgcttacntaggctagtagttacagtgacctacgtagt

SEQ ID NO: 34074 - DNA, 101 bp, rice(Oryza sativa)
  misc_feature (71): n=a or c
gatataatatgatagaaaattgaaaattggggaaaactaaacacggcctaagggcacccataatggttatntataggctctatataagagatccatgtcag

SEQ ID NO: 34075 - DNA, 101 bp, rice(Oryza sativa)
  misc_feature (71): n=t or g
tttctgtatattattgattgataaaggaggcacgtacgccgcgaggccgtcgcgattcggcgtactttttntgtgtgtgtgtagacaagggatggcgatca

SEQ ID NO: 34076 - DNA, 101 bp, rice(Oryza sativa)
  misc_feature (71): n=t or g
tacactaaatccgttagatagttacattattaatcagccgatcttcgagtgaaaataaaatcttttttttntgtgtgtgtgtgtgtgttggggaggggggg

SEQ ID NO: 34077 - DNA, 101 bp, rice(Oryza sativa)
  misc_feature (71): n=a or g
aacccaaaccctaaattagtgctcctgtactccattaaatcaaaatgacagttttttatctaaaaaagacnccggtatgatctaatatcaaataattagaa

SEQ ID NO: 34078 - DNA, 101 bp, rice(Oryza sativa)
  misc_feature (71): n=t or c
atctatgccttttttccccgacaaatcgtatttttaaaaatgtggcacgaataaaccgatgataacatgtncatgttagcttatttaagcgtttgtactgt

SEQ ID NO: 34079 - DNA, 101 bp, rice(Oryza sativa)
  misc_feature (71): n=a or g
caagaacataatcccttggttcgtactcattggccgaaccgaaggacacagccaaagaatctattaacatnagtagagaaagacgaactgagagatttttc

SEQ ID NO: 34080 - DNA, 101 bp, rice(Oryza sativa)
  misc_feature (71): n=t or g
ggacccgggtttctcctcggggtatttttcttatatttcagattccattccttatgtgcatgttcctcctnttttatcgaattctggttctcgatctacag

SEQ ID NO: 34081 - DNA, 101 bp, rice(Oryza sativa)
  misc_feature (71): n=a or g
atcgtcctcgcgatctcgagactgctctggctattgcgtctttacaggaagaggtgctggaggtggtcccngagtctaatcacagtaaaccctttcggcgc

SEQ ID NO: 34082 - DNA, 101 bp, rice(Oryza sativa)
  misc_feature (71): n=a or g
ctgtttcactatctctccttaatctagcgcgccccataaaatatattgccaatcatagaaatcgacagttnacgccccaggtatgggggtgctagatcgtt

SEQ ID NO: 34083 - DNA, 101 bp, rice(Oryza sativa)
  misc_feature (71): n=t or c
gagtttacagcgacagttgaattaatctaacccatcttaattaattaatttaaggaaaagtctaaataccngctaactttagatagaagtccatccagcac

SEQ ID NO: 34084 - DNA, 101 bp, rice(Oryza sativa)
  misc_feature (71): n=a or g
gaatgggtagagcaattaatcgttcttaccaatactctcgacggttttataattcttgtcgttttaataanatttaggcaacttttataattttgactagt

SEQ ID NO: 34085 - DNA, 101 bp, rice(Oryza sativa)
  misc_feature (71): n=a or g
gcttgattcagaccaaggtctacactgtactccttggattaacacgaaggccatccttcccgcgggggggnggggggggctaatggccgatcgatcgctag

SEQ ID NO: 34086 - DNA, 101 bp, rice(Oryza sativa)
  misc_feature (71): n=t or c
tccgccgccgccgcatcgatgcaatcgatttgggaacgggagagaaacgcgagagaaagagagagaaacgngagacggcgatagacaggcaggcgataaga

SEQ ID NO: 34087 - DNA, 101 bp, rice(Oryza sativa)
  misc_feature (71): n=a or g
atcgagtccatcttgagatcaacttgtttaattccttcaaaaaaccccgtgggaaaaaaataggaataatntgattggtgattactctatcagaaacctgt

SEQ ID NO: 34088 - DNA, 101 bp, rice(Oryza sativa)
  misc_feature (71): n=t or c
cgccctcacttcacccctccttgtgtcaaaggctctcacgagccaagcgctgccacctcctcctcgccccntttccgtctgtctgcctccttcctttccaa

SEQ ID NO: 34089 - DNA, 101 bp, rice(Oryza sativa)
  misc_feature (71): n=a or g
agcctctcggaacttccgggtggttgctggccgcttgcgtagctggcggaaggagagggcgctggatcagncaggtagacctgactcggggcttggttgat

SEQ ID NO: 34090 - DNA, 101 bp, rice(Oryza sativa)
  misc_feature (71): n=t or c
ataactggttggcatgtccgcatctaatcgaccttaggatctgtattggagttaagcaaaactccccgtancttattaactttaggatctgtattagagct

SEQ ID NO: 34091 - DNA, 101 bp, rice(Oryza sativa)
  misc_feature (71): n=t or c
aaccgcctcccttcttcttcgcgcgctccctataaataccttcctccccccaacacctcccccctacccancgccgccatagacgtacggacggccggcta

SEQ ID NO: 34092 - DNA, 101 bp, rice(Oryza sativa)
  misc_feature (71): n=a or c
tctataagctttatcaaagctaaaaaaactctgactaagaaaaagtcaaacgattttttaatcaaacgganggaatataaagtaactatttttttaatgta

SEQ ID NO: 34093 - DNA, 101 bp, rice(Oryza sativa)
  misc_feature (71): n=a or c
ggtcgccaaacaggatttccgggtcacttgtggtggatcccaccactatctttccttcacttttcttcccncccccctcctctctcagcgccttttccctg

SEQ ID NO: 34094 - DNA, 101 bp, rice(Oryza sativa)
  misc_feature (71): n=a or g
atggccagatcgatcagatggaccacacgatctccatccaccactacacacccgcgcgcgcacacgccacnccacaccacccagatcaccagcaggcggcg

SEQ ID NO: 34095 - DNA, 101 bp, rice(Oryza sativa)
  misc_feature (71): n=a or g
cctctctttagggcaagtactataatatctcatatgttgcctctaaaaacgctacattggattgggtgatnaggtggaggagagaagtggagagagataag

SEQ ID NO: 34096 - DNA, 101 bp, rice(Oryza sativa)
  misc_feature (71): n=t or c
caccaaaaatagtcggatcctttttacactataaatcacctacactataccgctaaatttatttgtcattnaaaagtttgaaataataatatactagagtt

SEQ ID NO: 34097 - DNA, 101 bp, rice(Oryza sativa)
  misc_feature (71): n=a or g
gggggccggttggggaggaaaagagaacttgagggagagggagaggggcggctaggccagcccaacagaanggagaacttgggccaaaaagggcccaaagc

SEQ ID NO: 34098 - DNA, 101 bp, rice(Oryza sativa)
  misc_feature (71): n=a or g
tcacctacgcccagggcatggttgcgagcggcaagccgacgtggcggcgtgaggcaaggcattatgtgcangcggcatggtagtgcaggatggctggggtg

SEQ ID NO: 34099 - DNA, 101 bp, rice(Oryza sativa)
  misc_feature (71): n=t or c
gaatacataaaatgattagaagttagaagctgagaaatttagttttttcatgttttcaaaagctggttacngactagctgcttctcagaattttaaacccc

SEQ ID NO: 34100 - DNA, 101 bp, rice(Oryza sativa)
  misc_feature (71): n=a or g
atcaaaccgccgccatgctggagagaaccaccgtcagctccacgtcgaggaggtgaggggtcagttggggngaggggtggagctgctgccaccacaccagg

SEQ ID NO: 34101 - DNA, 101 bp, rice(Oryza sativa)
  misc_feature (71): n=a or g
taaatgattatgaaaaaattcaaaaaaaaatctaaagtaggttaatatgtgatatatttctcacaaacatncaagttcaaattaaacttctacaagttgta

SEQ ID NO: 34102 - DNA, 101 bp, rice(Oryza sativa)
  misc_feature (71): n=t or c
accgccaaagttttgaattcaaatgtttgtcgatgaaattcatacggttttcggcagttaccgtggtaacngccttaccacgtgggtgcgagaacccccct

SEQ ID NO: 34103 - DNA, 101 bp, rice(Oryza sativa)
  misc_feature (71): n=t or c
ggcaaagcaaaggaacagaaaggtcgaatccagccagatcactcgtacagagttcagtcctgtggggcgcnagaactccaaggtcgaatccaatgaggcca

SEQ ID NO: 34104 - DNA, 101 bp, rice(Oryza sativa)
  misc_feature (71): n=t or c
gctgtatgattctttccatatattcattgatcaatctgcaccattataatctggacccactacgatctaanggtgtagatatttctttttttctctaatta

SEQ ID NO: 34105 - DNA, 101 bp, rice(Oryza sativa)
  misc_feature (71): n=t or c
gaaaacctatttgagctaaaaatgacggtcgcaacgaggcaacctattttgctcgacaacctattttgctngacctcgtctctcttttgaaaggtaagggg

SEQ ID NO: 34106 - DNA, 101 bp, rice(Oryza sativa)
  misc_feature (71): n=t or g
cgctagtgccagagctaagcagtgtattaagctaggtccttcccacaaggacatgtggttgcacggtaagnctcagatcaatggtgcacgaagtgaagtcc

SEQ ID NO: 34107 - DNA, 101 bp, rice(Oryza sativa)
  misc_feature (71): n=t or c
tctcacaaccagctcctcccccacggccccacccccgccgctataaatagacgcttcctcttcctcccccnctcttccccaccactccaaagttccaaacc

SEQ ID NO: 34108 - DNA, 101 bp, rice(Oryza sativa)
  misc_feature (71): n=a or g
attcctccctccatctaaaaaagataacctaatacatacactacgataaatctagatataaaatatgtccnaatttattatattagaatatatcacatctt

SEQ ID NO: 34109 - DNA, 101 bp, rice(Oryza sativa)
  misc_feature (71): n=a or g
ttgcagtgaacgtacatacggcggggtgcaagagggcagaaagatatgcctcgagctgccagatcccgccntcctcttcttctaacttagaggtgcttaca

SEQ ID NO: 34110 - DNA, 101 bp, rice(Oryza sativa)
  misc_feature (71): n=a or g
gacccatcgctgcgctagggagatgttgagagggagagagaggagccagatcctgagccaccatgccgccnacctgccggatatggcaacgagcggagcgg

SEQ ID NO: 34111 - DNA, 101 bp, rice(Oryza sativa)
  misc_feature (71): n=a or g
cgctcagagagcacctgtcgtcaggtgatggcgagacgctcgcatcgtgtgaaggccaccggcgatggtcnagtgcatggtgtgcccatgcctggagaaga

SEQ ID NO: 34112 - DNA, 101 bp, rice(Oryza sativa)
  misc_feature (71): n=t or c
agagaaaattccgtttctagcggtagcggctcaagggatgtaagcgggtcgacccacgaacttacttatangttaaataaagggtaatatgtgggttttca

SEQ ID NO: 34113 - DNA, 101 bp, rice(Oryza sativa)
  misc_feature (71): n=t or c
cttcttgggccggcccattagtggtgaaaggcctccatgggctgcagggcctcccaagccataaatatacnaggactatttctggcgccattgctgggaat

SEQ ID NO: 34114 - DNA, 101 bp, rice(Oryza sativa)
  misc_feature (71): n=t or c
tggatcattttggcccggttcacaccaactagccaagttattgtatcaaagtgagcaatttgtaagttgtngtatctatttgcacccaccacacaagttca

SEQ ID NO: 34115 - DNA, 101 bp, rice(Oryza sativa)
  misc_feature (71): n=a or g
gaacacgtagaatatccagattcgttgtattaggatgtgtcacaatttagtatgaggttggtttattttgngacgggtggagtacatggactactcaatag

SEQ ID NO: 34116 - DNA, 101 bp, rice(Oryza sativa)
  misc_feature (71): n=a or c
tctatcctataatataagtgattttgattggatgtgtcacatcctactactatacgaatttgttcatactnttcgtttagattcgtagtaataagatattt

SEQ ID NO: 34117 - DNA, 101 bp, rice(Oryza sativa)
  misc_feature (71): n=t or c
tcaacacttcccggcttcctgtaatgtttgtatagccaccaaagcaagggctgtgtttagatccaaacttnagtccttttctatcacatcaacctgtcata

SEQ ID NO: 34118 - DNA, 101 bp, rice(Oryza sativa)
  misc_feature (71): n=a or t
gccatctcgcggaatgaagcgaagcagacatattggggatacgtacaggatatgtatcggggtgtatccgntacgtatcagtatcccccccatgtatctga

SEQ ID NO: 34119 - DNA, 101 bp, rice(Oryza sativa)
  misc_feature (71): n=c or g
tacgacaataatcaaatctctataacttcgccactttctttactatagtccctcttggtggtgtttggatncagggacttaactttagtctctgtatttag

SEQ ID NO: 34120 - DNA, 101 bp, rice(Oryza sativa)
  misc_feature (71): n=a or t
ctcgaagagggaatataagaagatagaacgtgaagtctgctctacatcacagggggctgctaccaagatgnaatggtcccagcacaagattgagttctctg

SEQ ID NO: 34121 - DNA, 101 bp, rice(Oryza sativa)
  misc_feature (71): n=a or t
gtagtccttgtcgtatatctgttcctctgctccctcctggaacccctgtctacgttgactattgtgccatntccatccatgcatcttaattacattacact

SEQ ID NO: 34122 - DNA, 101 bp, rice(Oryza sativa)
  misc_feature (71): n=c or g
ggacaagaggttgccggacacgtcgaacgtctggagttgtctagttggcgaggaatgactagagaatgggnacggagagggagtgtactggaggtagacgg

SEQ ID NO: 34123 - DNA, 101 bp, rice(Oryza sativa)
  misc_feature (71): n=c or g
tgtactcggtcactcgcccgccgtgcctgcagaagtagtacctgtcctctccatctttgtcaacgtcttcntcttcatcttcatcttcgtcttcatcgtcc

SEQ ID NO: 34124 - DNA, 101 bp, rice(Oryza sativa)
  misc_feature (71): n=a or t
atgatactcccaacatgtagtatggtctaaaaactgcagaaccagctaccaacaaacaaaaagatgaaagnttttttttttgtgatgtcgtctattaacgg

SEQ ID NO: 34125 - DNA, 101 bp, rice(Oryza sativa)
  misc_feature (71): n=a or t
acaaacacaagattgatgtgccgtggcttaatgaatatcacaagaacttaaaaacacaggaatcacacatnattagatagagaaggaaaagggatagagag

SEQ ID NO: 34126 - DNA, 101 bp, rice(Oryza sativa)
  misc_feature (71): n=c or g
aaggttcaaatcaagaaatgatatgcccaaaacgtatgaattaactaatcatgatgtgatgtgatgtgatnactatggacggacctagctagctagctaca

SEQ ID NO: 34127 - DNA, 101 bp, rice(Oryza sativa)
  misc_feature (71): n=c or g
ctgcagtgcagcgcacggtttttttctctccccgtctttcttttctcctttccttcgggagagccgagccnagccgagccgtgcgaggccgcgggctttcg

SEQ ID NO: 34128 - DNA, 101 bp, rice(Oryza sativa)
  misc_feature (71): n=a or t
tcccgtagaaaaacgaaaaagaagtctcccattaaaaaaaagtctgcttgttttttttttggcaccgggtnttttttttttctgatttttgttgcactcgg

SEQ ID NO: 34129 - DNA, 101 bp, rice(Oryza sativa)
  misc_feature (71): n=a or t
tcagatttgatgctttggctttctgcagtgttggtggctgtgctgcactgtcgtggcttacattttttttnaaaaaaaatgaatacatctgaaatgaaaca

SEQ ID NO: 34130 - DNA, 101 bp, rice(Oryza sativa)
  misc_feature (71): n=a or t
cccatcacatcccaggaggccagggagacccatcaaagtatcaaaacagaccaaggcagtgttggttcccntcaaattttcaaaaattccgtaacatcaaa

SEQ ID NO: 34131 - DNA, 101 bp, rice(Oryza sativa)
  misc_feature (71): n=a or t
atttaaagtctagtagtttggaattcaagaattgtgcacaaaacacatgggttgattctctactttttttnaaaaaaaagaaaacatgggttaattctagt

SEQ ID NO: 34132 - DNA, 101 bp, rice(Oryza sativa)
  misc_feature (71): n=a or t
atcagcatatccattggacggtgacgcatttcttgtgggctgttcgtgtcccccgcaagaagatttttttnaaaaaaatacttactcctgatcaaaagagc

SEQ ID NO: 34133 - DNA, 101 bp, rice(Oryza sativa)
  misc_feature (71): n=c or g
atagactgctgaattatgatttatatgatgtctcatttcttttcaggttactgcatatgccatatcagttnctaagcagagatgggagttcccaatccttc

SEQ ID NO: 34134 - DNA, 101 bp, rice(Oryza sativa)
  misc_feature (71): n=a or t
catatagtcctaaaatatatctcatcatgaaaatttcaataatatgtaggtatcccgtagtaaaaaaaaanactaatagacttaatagaagtatttgacaa

SEQ ID NO: 34135 - DNA, 101 bp, rice(Oryza sativa)
  misc_feature (71): n=c or g
tttggggtgtatggatgaagttgaggcagttctcctcctggtgtggactatttgatccctgttctctcctntatttggttggagttgtgctttctcttaat

SEQ ID NO: 34136 - DNA, 101 bp, rice(Oryza sativa)
  misc_feature (71): n=a or t
tcttctccacgccggtttctctacggtcaccggccgaagtgtacacattccttcaggctgcgttcttttcngcaaagtcctcctcgttttccgttagcacg

SEQ ID NO: 34137 - DNA, 101 bp, rice(Oryza sativa)
  misc_feature (71): n=a or t
actttgtattacagaagtataacctagacgtaactaattcagtataaaagcaaaaagtgcatcagcaacgntgagggtggaaactagaaagaaggatttat

SEQ ID NO: 34138 - DNA, 101 bp, rice(Oryza sativa)
  misc_feature (71): n=a or t
attgagttggtagttcatgatatactatattcttctcttgggaaggcttacttgaagcgataactgttttngtgacgctgaaacatttcactcgcaagctg

SEQ ID NO: 34139 - DNA, 101 bp, rice(Oryza sativa)
  misc_feature (71): n=c or g
agatgaagtaccattgccatcaattgcctccgcaataccagtagataaccatgcatcactacgtgtctttntcagccatggttcaggacctctgtcacgat

SEQ ID NO: 34140 - DNA, 101 bp, rice(Oryza sativa)
  misc_feature (71): n=a or t
aaacaaaacatgatgatgttaaagcaatttaaatgttccccaagaattccttactctctgttttttttttnaaaaaaagaaattaaaaaacaaagttcctt

SEQ ID NO: 34141 - DNA, 101 bp, rice(Oryza sativa)
  misc_feature (71): n=a or t
cttctttgtttcttttcacaaatatgcaaaagatttatgggtcctcttattaatctatactcatttttttnaaaaaaaattaatagtagtggtggtgagtg

SEQ ID NO: 34142 - DNA, 101 bp, rice(Oryza sativa)
  misc_feature (71): n=a or t
gtgtttgcataggcatcaaaggtccacatccatcttgttaatggagagatcgaatgcatcacacaagtagngaaattcccttagctattaataattgacat

SEQ ID NO: 34143 - DNA, 101 bp, rice(Oryza sativa)
  misc_feature (71): n=a or t
actttctgaccgttggatgtaatccagatcaatttgattggcttggaagttaacgggtacacccgtttatntgcaagatatggaatgagttatatgcatgc

SEQ ID NO: 34144 - DNA, 101 bp, rice(Oryza sativa)
  misc_feature (71): n=a or t
gctggagctgaagacgacatgctacatcgctgatgtcaggcaatactttgtagggtccgttgaaacgtggngatagcttgccgcggctgaaccctggtaca

SEQ ID NO: 34145 - DNA, 101 bp, rice(Oryza sativa)
  misc_feature (71): n=a or t
tcataaagctgttcatgcacttctgtcctcataaaacgttggcactgagttaggaacgttgcccccctgcngtccatttggccctccaaaagtctgttgtc

SEQ ID NO: 34146 - DNA, 101 bp, rice(Oryza sativa)
  misc_feature (71): n=a or t
taccggccgagccaatcaaagtgaaccaaggcatgtcatgcatttgatacctttgtagctagtattgcttnatactccctccgtttcgaaatgtttgacgc

SEQ ID NO: 34147 - DNA, 101 bp, rice(Oryza sativa)
  misc_feature (71): n=a or t
tgacatgtgggcccgcccaaatgagaacttttcttcttcttcatttgggtcgtttatgacaaacgattttnttcacaaattgtcgcatgagttgagttaat

SEQ ID NO: 34148 - DNA, 101 bp, rice(Oryza sativa)
  misc_feature (71): n=a or t
acggcatgtttttcatgaaatatcaggttttgagttggctcaggctgataattccgctcggtaattttttnaaaaaaaatcatagtaaatcttttctaaat

SEQ ID NO: 34149 - DNA, 101 bp, rice(Oryza sativa)
  misc_feature (71): n=a or t
aagaaatacattatctgcttaaccaccttatgaagatgcagtctatccaattactacccagtttttttttnaaaaaaaagtctacaaactacaagtcagca

SEQ ID NO: 34150 - DNA, 101 bp, rice(Oryza sativa)
  misc_feature (71): n=c or g
caggtaactacagttaaagacactgaaagcattaatacatctcatcaagtgatacgagatcgaggacacgntcacttccagtgtacacaaccattgacttc

SEQ ID NO: 34151 - DNA, 101 bp, rice(Oryza sativa)
  misc_feature (71): n=c or g
catgacattaatttctgcaatcatctgaacgattcatttcatctaatagccctaaattttacatcaggatntatgtacaaatggaaaactgatggctgatt

SEQ ID NO: 34152 - DNA, 101 bp, rice(Oryza sativa)
  misc_feature (71): n=a or t
cggcggcggcgcgcggaatcgcgggtgaatttgctggctccctgaccttgcgagatctcgaggagtggagnggagaggagaggaggaggggatcggggacg

SEQ ID NO: 34153 - DNA, 101 bp, rice(Oryza sativa)
  misc_feature (71): n=a or t
cattatcgatcacgggatgccatatcaagaagctttgatcctgcaacggcaccaaaaaagaacgaagaacncatcagtgtataacgtcactaacattaata

SEQ ID NO: 34154 - DNA, 101 bp, rice(Oryza sativa)
  misc_feature (71): n=a or t
tttgcaagaaagccaagagcaaagaatggccgatgtgccctaattaaccaaagctaaaatttgattttttnaatttaattttaaagttcgttttaaaatat

SEQ ID NO: 34155 - DNA, 101 bp, rice(Oryza sativa)
  misc_feature (71): n=a or t
tttgtgttcaacatagcgaaaccgttggtaaaccggtaaaaactggtaagatttggaaagtttgattattntttttttaaaaaaagttgggtaattgtggg

SEQ ID NO: 34156 - DNA, 101 bp, rice(Oryza sativa)
  misc_feature (71): n=a or t
ctgcaattgtggcatatcctggagagtggagacctgaactcctgaactgaattcgatcatggccatatgtngatctgcttaacttcagtgcaggtctaaaa

SEQ ID NO: 34157 - DNA, 101 bp, rice(Oryza sativa)
  misc_feature (71): n=a or t
tctttgagagagaaatctattcacgcctcaaaatctaattatgaattctaaaataaattttgggatggaantttttttttgtttctccttcacacagtact

SEQ ID NO: 34158 - DNA, 101 bp, rice(Oryza sativa)
  misc_feature (71): n=c or g
agctcgcaaaaattgaaaatatattacaatctaccctgagatgtttgtcacaggatacagaaactaccagnaagtccaacgccaatccatcgactgaaaga

SEQ ID NO: 34159 - DNA, 101 bp, rice(Oryza sativa)
  misc_feature (71): n=c or g
tataatttttttctgctctatcaatataacttcgcacagtttcgtacgggtcgttaaaaagaaagatgatncatatgcagtctcgatgtggttgtagctgt

SEQ ID NO: 34160 - DNA, 101 bp, rice(Oryza sativa)
  misc_feature (71): n=a or c
gcccactggcatgcatagcaagaagtactgcatgttgtgcttcaacaaacttacccagccagatttttccntagaacctgattactccattagtcaaggtg

SEQ ID NO: 34161 - DNA, 101 bp, rice(Oryza sativa)
  misc_feature (71): n=t or g
catccacactgttgatgatgtgcacaattgccagtaagccactgcaggtgcagcttcctggttcacaccanataccagcacgtttcagttggagctgcctg

SEQ ID NO: 34162 - DNA, 101 bp, rice(Oryza sativa)
  misc_feature (71): n=t or c
tttaatttcacttaagtcaaaaagaaaaaaatctatactccgtagtgcttagctcagcaagacgacgaatntagaaagcagagactcctgcgccgctacag

SEQ ID NO: 34163 - DNA, 101 bp, rice(Oryza sativa)
  misc_feature (71): n=t or g
ttctgatgaactattatatgatgagaggagggaagacacggagttagttgggaaaacgagtgaagactcangaagagtagtcaataagtcaaaccaatgca

SEQ ID NO: 34164 - DNA, 101 bp, rice(Oryza sativa)
  misc_feature (71): n=t or c
tggttatctcaacctcctccccaaaacgcccaactaaacaagcatcagctactcgacccacctatctggcntggctcactctttctccgtttattttttat

SEQ ID NO: 34165 - DNA, 101 bp, rice(Oryza sativa)
  misc_feature (71): n=t or c
cttcaatgactatataggagcattagatgtgacacatataccggttgtggtgccaaaaagtaaggtggttnagcatattaacagacacaacgaaacctcac

SEQ ID NO: 34166 - DNA, 101 bp, rice(Oryza sativa)
  misc_feature (71): n=t or c
aaggaaagcaattcatttcttcatccacaaaagcagtgcagatatccacaggatgagcagatatttcccanaaagtatcaaaaaagacttcgatgttctca

SEQ ID NO: 34167 - DNA, 101 bp, rice(Oryza sativa)
  misc_feature (71): n=a or g
tgcatgcgcaaggtgaagtagaaaaggctctaacagcatccctggaggcagcctcgctcaaccatggatcnttcatccacaggaccccttcagcagctgcc

SEQ ID NO: 34168 - DNA, 101 bp, rice(Oryza sativa)
  misc_feature (71): n=a or g
attcttcctgttcttgttttaggtagcattatcccaaagagagggagagattattggagctcatttgattngttgattgattgattggagtggtaatcttc

SEQ ID NO: 34169 - DNA, 101 bp, rice(Oryza sativa)
  misc_feature (71): n=a or g
gacgctctgtcgcgctgtgactctcctgagattcttcagttaagtgctttatctgtgtgtgttccctcctngttggatgaggttcgggacagttatgctag

SEQ ID NO: 34170 - DNA, 101 bp, rice(Oryza sativa)
  misc_feature (71): n=a or g
agtcaaactaaaattgaacaataaccgacctgcaccgtaggtatgagtttagtcaaagtgacaatggcacngcgtctgatatcaactagctccactttaaa

SEQ ID NO: 34171 - DNA, 101 bp, rice(Oryza sativa)
  misc_feature (71): n=a or c
ggcaatggcaagtcggcaaccagctgatcttcaggtgtagctagcaaggtcagtactgtgagaatgggggnaagaagagtaagtggctaagtgctcgctag

SEQ ID NO: 34172 - DNA, 101 bp, rice(Oryza sativa)
  misc_feature (71): n=t or g
tgtttcttcaaaaaaagcgaagaacaggggtggttcttgcagagcctggatgaaaggggcctgtaaaaacnacccttcctggcttgctaaagcttaaaaaa

SEQ ID NO: 34173 - DNA, 101 bp, rice(Oryza sativa)
  misc_feature (71): n=t or c
gagattagaggtggcctatcaggtaaaggcacaacatgcagtgttgtttcccgatggggtactaggacganaggggcaagttggtgaccaactggttagcc

SEQ ID NO: 34174 - DNA, 101 bp, rice(Oryza sativa)
  misc_feature (71): n=a or g
taaccaaactcccgcaccctatccatcaaataagcagccaaggataagaggaggaagaagagccgttggangaggtcgcaagccagcgagcgagcaaagca

SEQ ID NO: 34175 - DNA, 101 bp, rice(Oryza sativa)
  misc_feature (71): n=a or g
ccgtactaaagatttttaaggtcctggtttgcaaccgaaactaaagcggttgaaaacagggattaaagatngattccctaatagtgagtatttaatatatt

SEQ ID NO: 34176 - DNA, 101 bp, rice(Oryza sativa)
  misc_feature (71): n=a or c
cattgtttgagatgagcaacgcaaatcgtgatcacaagggaaaaaaattgctacgtggtgtgattcgctcngccgcggtagtgttgcagcagccggttagc

SEQ ID NO: 34177 - DNA, 101 bp, rice(Oryza sativa)
  misc_feature (71): n=a or g
tttgaaagatgtttgattaaaagaaaactgagaagcaaaataacctcatcctctacgtcctcttcatcctnaacatctgcatgggtctttgaaacacattc

SEQ ID NO: 34178 - DNA, 101 bp, rice(Oryza sativa)
  misc_feature (71): n=a or g
gagccggagataacacagagaaactaaccaatagtgttgccaaatcggcatcaatgcggatctgagtggtngtggtggtggactggtggttgcccccaccc

SEQ ID NO: 34179 - DNA, 101 bp, rice(Oryza sativa)
  misc_feature (71): n=t or c
ttgcaatcccccacccaacccaacccatgaaatgaaatgaattcaatgaacccatatcgatcgattgatangtgcctccgcctccgccgctctgcctcctc

SEQ ID NO: 34180 - DNA, 101 bp, rice(Oryza sativa)
  misc_feature (71): n=a or g
tcttccggcaaatctagcttataagctatagtgcccaccttctgtagaatctggaatggcccaaaatatcnaaatgcaagtttgtgattagctcttttggc

SEQ ID NO: 34181 - DNA, 101 bp, rice(Oryza sativa)
  misc_feature (71): n=a or g
tggcagttgctaaagaactgaactatccggtcatagacatctggacaaagatgcagcaatttcctgactgncaaacttctgcattatggtatggatctatt

SEQ ID NO: 34182 - DNA, 101 bp, rice(Oryza sativa)
  misc_feature (71): n=a or g
tgatgcatgcatcaccttttttgtactgcctgttggacctgtagacatctgctttcttttttctggtacancttgatgttgaaaatgtgttgtttcgagtg

SEQ ID NO: 34183 - DNA, 101 bp, rice(Oryza sativa)
  misc_feature (71): n=a or g
gggacttgcttaataccatatcaggatatgtgtttggacttgtggacaaggtggggataatggtttttcanagtggtgaccaccctgacaaaacactatca

SEQ ID NO: 34184 - DNA, 101 bp, rice(Oryza sativa)
  misc_feature (71): n=a or g
ccatttttttttatcacacatgccttttgtcttaacaaagttagctttgctttatccttgtgcatggcccntatacatctaccttctatcagtgatgacca

SEQ ID NO: 34185 - DNA, 101 bp, rice(Oryza sativa)
  misc_feature (71): n=a or g
cgagccagtttggctgccacactccgcgctttcgttcgatgcggtgtccaagcgctacgtcagaggatctngattctataattcctatccctcaatcgcaa

SEQ ID NO: 34186 - DNA, 101 bp, rice(Oryza sativa)
  misc_feature (71): n=a or c
tgccaccgctcctacacagacacagtacaggccccaaatcgtcatcctcgaggatatctccccgtccgctngccactccgactgagttcgccccgccgccc

SEQ ID NO: 34187 - DNA, 101 bp, rice(Oryza sativa)
  misc_feature (71): n=t or c
atccaaacacaccctaagttcttggggattttcaaccggtagtttccctaatcgcatcgtctctactgctntgatctttcttgctgcgtctcgctctcgat

SEQ ID NO: 34188 - DNA, 101 bp, rice(Oryza sativa)
  misc_feature (71): n=t or c
tgaaccttcggcgacgctgccatcttcttacctgctatcatagacggcgatggcatcatcgcggccatacnaggcaaagctgtctggacactcagcacctg

SEQ ID NO: 34189 - DNA, 101 bp, rice(Oryza sativa)
  misc_feature (71): n=a or c
ataaactttgtaacaaagtaagtgtcatcaaaggccctattgtagatcaaaaccttgtgcatcaattcttnaaacttagtgtaatactcatctacactacc

SEQ ID NO: 34190 - DNA, 101 bp, rice(Oryza sativa)
  misc_feature (71): n=a or c
tccgcgaccgccggtatgcgttttctcagggttccctacccgacagcccaagcgagaagtccgcggaacancatgggcgagctcctccgccgccgccgccg

SEQ ID NO: 34191 - DNA, 101 bp, rice(Oryza sativa)
  misc_feature (71): n=t or c
caaagcataactgaacatgtgttggaaacaaactgatttcacatcaagcaggtttcactttcaccatcacnaatcgtatttgactgcgacaaagtacgcac

SEQ ID NO: 34192 - DNA, 101 bp, rice(Oryza sativa)
  misc_feature (71): n=a or g
cgccacaccgccccctgtatcgctcactcgcttactatatagccagaggggagggagcgggtagggttttncctcctcccccccgcagcgccgccgccgcc

SEQ ID NO: 34193 - DNA, 101 bp, rice(Oryza sativa)
  misc_feature (71): n=a or g
atgggttttttcttatatttctactaatgttttatctgtagaccccaaatcgagagttcctccttcgtgtntcatacttggaaatatataacgaggtttat

SEQ ID NO: 34194 - DNA, 101 bp, rice(Oryza sativa)
  misc_feature (71): n=a or g
gttccctacaacctaattatgttttttttgctacagagtagtttttgtaatgtactgtttcaaacatcatntgccttacacagttacaccttagtttcaga

SEQ ID NO: 34195 - DNA, 101 bp, rice(Oryza sativa)
  misc_feature (71): n=a or g
gcatagggagcaaacatgtcatagtggagagggtacatgcgaagcagttctgcaaaagctggattgagctnagcaagaaactggttgagctggcctgtctg

SEQ ID NO: 34196 - DNA, 101 bp, rice(Oryza sativa)
  misc_feature (71): n=a or g
atcaaaagtagatggaaggagtacctttctagaagaaatgtagggagcaagatgagggagccaactgcctngcgatagaagacgaagatgtagatgttcat

SEQ ID NO: 34197 - DNA, 101 bp, rice(Oryza sativa)
  misc_feature (71): n=a or g
aagcccatcaacgaaaaactacgtgacagcgtgacacagggggtagttaattactagttattcgcagtgcntgcgtgtgtgtgtgtgagcgatcgattgat

SEQ ID NO: 34198 - DNA, 101 bp, rice(Oryza sativa)
  misc_feature (71): n=a or c
gcctcgatgtggtattgcttgatcaaactggccagaagttggttttgggacagaacccccttctgtgttcnaattgcaaaggcttcccaaaaatcaggggc

SEQ ID NO: 34199 - DNA, 101 bp, rice(Oryza sativa)
  misc_feature (71): n=t or c
aattccaacagcctgttcattgttctgtgaaaaaggggcagttcttttgcagtgtgtatccatttattcgntgtttcttttggtggtttttttggaggcgg

SEQ ID NO: 34200 - DNA, 101 bp, rice(Oryza sativa)
  misc_feature (71): n=a or c
aataaactcctattgtacctgctcttagttgatcggctcttgcgaaatccgaatcggatcccacatacctntatcgtgcaagaacgacggaattccagggc

SEQ ID NO: 34201 - DNA, 101 bp, rice(Oryza sativa)
  misc_feature (71): n=a or g
cttgctccggcactccttagcccaatggctgagcttgccgcagttacgacatttgtcatccctgcgtgccngcgaggaggtggacccatccgagccaccgc

SEQ ID NO: 34202 - DNA, 101 bp, rice(Oryza sativa)
  misc_feature (71): n=a or c
gagcaaaaacccaaaccccccacacacaacgaacccgattcagaagcaacacaacacaaccaaaccaagcnaagcagggagaaggacggagctagggaggg

SEQ ID NO: 34203 - DNA, 101 bp, rice(Oryza sativa)
  misc_feature (71): n=t or g
ataggactgcggtcttggttgacataggcatggcgcaggagacgatagcctcaacctcctcatcaatgtgntattcgaacgaatcgagtgagtagatgggg

SEQ ID NO: 34204 - DNA, 101 bp, rice(Oryza sativa)
  misc_feature (71): n=a or g
gagagaagagagaagggaatcaaggagaagagtggaggaggaaaagatggtgtccttttattaggacgcangaacgtgtcctttgcaaaccttatcttgga

SEQ ID NO: 34205 - DNA, 101 bp, rice(Oryza sativa)
  misc_feature (71): n=a or g
ataccgttggttgtgtggataggatcgttgggagaaggggtgagttggcgctcgtctgatttacccaattnctcacttttcactgcattgccgctggccat

SEQ ID NO: 34206 - DNA, 101 bp, rice(Oryza sativa)
  misc_feature (71): n=a or g
ttcccctcctcccgaagatcgcacaaaccctagctcctgatcacagcgagacttggagttggaagcggcangggaagggaagggagaggagggtatcgtgt

SEQ ID NO: 34207 - DNA, 101 bp, rice(Oryza sativa)
  misc_feature (71): n=a or g
tagtaaccttttaaccattcaggccgcgattttatgcaataatcagcatcaaacaaagcttcggtcatttnaagatggcaaaggctcctattggaatacaa

SEQ ID NO: 34208 - DNA, 101 bp, rice(Oryza sativa)
  misc_feature (71): n=a or g
ttcaacttatagaaagctttggaggtgtaagtagtcatgccccatataaaactccaattgtccccatgctnacttgccaaagacagatcatccaactcccc

SEQ ID NO: 34209 - DNA, 101 bp, rice(Oryza sativa)
  misc_feature (71): n=t or c
tctgtgctacaaatgatgttctcagggtaggccaagcgctcaccgttggcgacaagctggtgtcaagaaanggcaagttcacgctcggcttcttccagcca

SEQ ID NO: 34210 - DNA, 101 bp, rice(Oryza sativa)
  misc_feature (71): n=t or c
ttccaagaatcttctggaagactcagttgtcggtgcaggtttcccatgcgtaatatcattgcgaacaaacnagttgcgccacaataccatgagaaacatag

SEQ ID NO: 34211 - DNA, 101 bp, rice(Oryza sativa)
  misc_feature (71): n=t or c
ttgggatcagcaatcaacggcctcgattatccgctgcggtagacatgtcctcctaggccatggccattcanagtgggcttaagtggcattcagcctccaca

SEQ ID NO: 34212 - DNA, 101 bp, rice(Oryza sativa)
  misc_feature (71): n=t or g
cacattggatttccttttgctttaaggaagttatcctattgcatataattttcatatttgttgctcccagngtagatcgacagatacaattgctaattagt

SEQ ID NO: 34213 - DNA, 101 bp, rice(Oryza sativa)
  misc_feature (71): n=a or g
gagaataaaaaacttcatgcccgcataaaaatcctcgaacagtcagtggttgaccaccaagaggtttcttnggaaagagccatttctgcacataaactaaa

SEQ ID NO: 34214 - DNA, 101 bp, rice(Oryza sativa)
  misc_feature (71): n=a or g
ggattcctctccagaaggtcccttagcacatcacactcagcatcaaacaaccactcagcagccttgagcancccattgtgcacatagccgccgtcgaacct

SEQ ID NO: 34215 - DNA, 101 bp, rice(Oryza sativa)
  misc_feature (71): n=a or c
gtccaagggaggccacagaatttctgaatcttctgcagcccttactaatggagtcactgcttattgattgnttcagcataaatttgggagatttcactgtc

SEQ ID NO: 34216 - DNA, 101 bp, rice(Oryza sativa)
  misc_feature (71): n=t or c
gggtagtaattgattgattggggtggttaatgccttccaagattgctcctctgctgctgtgctgctagggntgtgcgattcggcatggggaccaaaccaga

SEQ ID NO: 34217 - DNA, 101 bp, rice(Oryza sativa)
  misc_feature (71): n=t or c
tttagcactgccaacaaattgcgctctgaaattatcagtattgactaggcttggaaatctctctcgtctangaaacttaaaatattttacagttgcaccaa

SEQ ID NO: 34218 - DNA, 101 bp, rice(Oryza sativa)
  misc_feature (71): n=a or c
gatgaggtcgatggctttatgagagatggctttattatgggcaaagggaaaaaaaagtctaaccagttgcntatataccttcaaggcttcaattcaactta

SEQ ID NO: 34219 - DNA, 101 bp, rice(Oryza sativa)
  misc_feature (71): n=a or g
ctcgcctccttgtggagccccatggtgatcgctcgctggggaatgagagaatttgggaagcacacgaccancgccgccgccgcggccgcgcacagccgacg

SEQ ID NO: 34220 - DNA, 101 bp, rice(Oryza sativa)
  misc_feature (71): n=a or g
gagattgggatgaacgaagaggtcgaggaaattcgtgtgtggatcgtcgagcaagagaggtgagcttgganagcagttcagcttgagctggtgcagagtcc

SEQ ID NO: 34221 - DNA, 101 bp, rice(Oryza sativa)
  misc_feature (71): n=a or g
gctctactaaccggtaacaagtctatgcatgccttgatgaatgttgtccaagcactgaacagcaaccaganatttgtaccatatagacaaagcaaagtaac

SEQ ID NO: 34222 - DNA, 101 bp, rice(Oryza sativa)
  misc_feature (71): n=t or g
ggccagcaagtcaatcaaattacagatacccataggcacttggaggccgtcaaaagcaagaactctatcanaagatccctctggaactcttaccacatata

SEQ ID NO: 34223 - DNA, 101 bp, rice(Oryza sativa)
  misc_feature (71): n=a or g
gcagcacaaaactctactaacgggcactctactaatagtaactttgcgtattcattaaggaagctgattcngcctgattgtgcagataaatcgtttccaca

SEQ ID NO: 34224 - DNA, 101 bp, rice(Oryza sativa)
  misc_feature (71): n=t or c
caaatagggagtttcggacttccttttgcttgaggatcccagcaacatcccaggctgtttctgttttctcnttttacctgcacccgataaaaccgtctttt

SEQ ID NO: 34225 - DNA, 101 bp, rice(Oryza sativa)
  misc_feature (71): n=t or g
gcaaagaagctcggcctctgggtgccgagcattaagaggaacatccagcaacaggtcttgatcagaatcantgttggcatactgaggaggaaccagcatgg

SEQ ID NO: 34226 - DNA, 101 bp, rice(Oryza sativa)
  misc_feature (71): n=t or c
tgccgtatgctcttactgactatagcatttgtgatgcaggtcagccgttttaccaagtcagttgaaggccnatatagtggtgaccccattgagggtccaag

SEQ ID NO: 34227 - DNA, 101 bp, rice(Oryza sativa)
  misc_feature (71): n=a or c
tgtaatagtcacgtgtatcagggaataccaccaactatcaaaaatctgaaggtcgatgatggatggataanggcaactgccaagaaattatcagattggtg

SEQ ID NO: 34228 - DNA, 101 bp, rice(Oryza sativa)
  misc_feature (71): n=a or g
tgtgatgtggcttatccccgatgaagtatatattcagaggccattcactaggtatgtggtgtaccttctcntgatcattttgatgattcatatgatcggat

SEQ ID NO: 34229 - DNA, 101 bp, rice(Oryza sativa)
  misc_feature (71): n=t or g
caccgtggggaatggggagttgccgattattttttttccctctcaaacttgatcatgggtgggaggataangtcatgacgtggtgacgagttattgggcct

SEQ ID NO: 34230 - DNA, 101 bp, rice(Oryza sativa)
  misc_feature (71): n=a or g
ggaatcatgtttgtttcggcatttacgaactcagtgggatccttattgccgattgggcctaaaaagtatcngttgggatgcactaagcttggaactgcaat

SEQ ID NO: 34231 - DNA, 101 bp, rice(Oryza sativa)
  misc_feature (71): n=t or c
acttatgaaattggaaccaggtaatgttggctaccatgtggtgttcagcaatacccaagctagtagtgatnagtgggatgaagttgaaagcattagaagct

SEQ ID NO: 34232 - DNA, 101 bp, rice(Oryza sativa)
  misc_feature (71): n=a or g
cccttctgcgcctcgatggaagccgaggttgtgtcccatctcgccaccctcgtctcactcgtcacttgctnctcctctcctcctgcaacgaagacccgctg

SEQ ID NO: 34233 - DNA, 101 bp, rice(Oryza sativa)
  misc_feature (71): n=t or c
cccccgcgcgccgcgactcgttaggctactccacccactcttgtttagggtttccctcagccgccgccgcngcatccacgctcagcagccatggcggtggt

SEQ ID NO: 34234 - DNA, 101 bp, rice(Oryza sativa)
  misc_feature (71): n=t or g
aggtgatgataatctgagatgagggatacaagattatgcgagcgccgaggaggattagagagtgctttgcntgagggtaattaaggttagtgaagataatt

SEQ ID NO: 34235 - DNA, 101 bp, rice(Oryza sativa)
  misc_feature (71): n=t or c
cgggaaagactagattttgaggctgctgctgagacaattgaaaagggcaaggaaaaaaaggctatggatcntttatcattgttgggtttatctggaataaa

SEQ ID NO: 34236 - DNA, 101 bp, rice(Oryza sativa)
  misc_feature (71): n=t or c
cggctatcgacgctccgcacgtcgcttgatgggacccgagatgcgcgaggaggtcttacagcaggcaatcngacagatcactgagttggtcctcctccacg

SEQ ID NO: 34237 - DNA, 101 bp, rice(Oryza sativa)
  misc_feature (71): n=t or g
agttgcacctttgtcttggccatctcgagtgattggactgtcatcaggtggatgttacctgtgcttttggnccttggctcctataccctctttatcagctt

SEQ ID NO: 34238 - DNA, 101 bp, rice(Oryza sativa)
  misc_feature (71): n=t or c
gcctgggcttgaacgttatcagctttgaaaaacaaaagcgtgtcatcagcaaaaagcaggtgtgaaatccncggggcctgcctacaaatcttcactggcga

SEQ ID NO: 34239 - DNA, 101 bp, rice(Oryza sativa)
  misc_feature (71): n=t or c
gcttaattgcatggctaatgatgagaaggaaggagagagagcaataagcactaaactagttaattaatggncgtcatggctctcatccacttggtcgtcat

SEQ ID NO: 34240 - DNA, 101 bp, rice(Oryza sativa)
  misc_feature (71): n=a or g
ccgcaagggagagctgaataaaataattgatccccacatttcagggcaaatccgtcctgattcacttgaantatttgctgaggccgctgagaaatgtcttg

SEQ ID NO: 34241 - DNA, 101 bp, rice(Oryza sativa)
  misc_feature (71): n=a or g
ctggaagaagattcatgtcatctacaacttctttttgatccgcaaaatcatcgcgcacatcgtgacctttncgttctactgcttgattatcccggcaacta

SEQ ID NO: 34242 - DNA, 101 bp, rice(Oryza sativa)
  misc_feature (71): n=t or g
acaagcaactttggtgctatctttttcttgtttgtggcaaacaacaagcgagctagtctcatctgcatctnaagatttgtccttttgtaatcatcctcaga

SEQ ID NO: 34243 - DNA, 101 bp, rice(Oryza sativa)
  misc_feature (71): n=t or c
agagcagacggtggagacgagctcctcgccgtcaccaatgtcctcttctcctcccagtcgctcctccactngagccacgctgacccactcgccatcctcag

SEQ ID NO: 34244 - DNA, 101 bp, rice(Oryza sativa)
  misc_feature (71): n=a or c
taaaaaatactccacgttaaacacctttttattttgcaacaaaataatatcccacgtatggtcaattaacntcgtaaatcgaaaatctagggtttaagtct

SEQ ID NO: 34245 - DNA, 101 bp, rice(Oryza sativa)
  misc_feature (71): n=a or c
tttattctaggtgacggctgaatcagcgtgtgatccatgtgagccctacatataaggatgccatatcggcncacactctctctttcccctcttctctccct

SEQ ID NO: 34246 - DNA, 101 bp, rice(Oryza sativa)
  misc_feature (71): n=a or g
cttaaaataagttttcttaaagggtcgatttgtcaaaatttctcagctcgacgatgacgaagactattatngggtggcaacagggcagggcggggtcgggg

SEQ ID NO: 34247 - DNA, 101 bp, rice(Oryza sativa)
  misc_feature (71): n=a or c
tcaaaggtggtgcaacatctggaagtttgtccctactgtgcatgtaaccaacgaaactattcaacattgtnagaagttactggatcatgtcatcatgcaaa

SEQ ID NO: 34248 - DNA, 101 bp, rice(Oryza sativa)
  misc_feature (71): n=a or g
tcctgtcctctagaggtggtttcccaaccatcaggcttggttttgatctcagcagtgcttggaatctttgnatcgccaaaatctgtatttccagaatcgaa

SEQ ID NO: 34249 - DNA, 101 bp, rice(Oryza sativa)
  misc_feature (71): n=a or g
cgcctccagctcggcccaaaaccccgaaatttcaacatggacagtaggaagcaccaagataccgtgtcganggccttggaaatgtcgagcttcaagagaat

SEQ ID NO: 34250 - DNA, 101 bp, rice(Oryza sativa)
  misc_feature (71): n=t or c
tagtgaaagaaatgaaatcgcattgctgctactactactggcagaagagtggcagtagtactgcaagatgnatgtaccggagagaagcttttggaccaatc

SEQ ID NO: 34251 - DNA, 101 bp, rice(Oryza sativa)
  misc_feature (71): n=a or g
ttgagtaattaccaaagaaagctggttgatgtgcacagagatgctcaaaagcttatgcaatcattggatgnaatacaagcgaatgttggaagcagtcgttt

SEQ ID NO: 34252 - DNA, 101 bp, rice(Oryza sativa)
  misc_feature (71): n=t or c
taaaggttatcaaaatggcaacacctaatcatgtaatgatgcagagaattcagaatgggaacagagaaaancttgccttgaggctgcccttgcagcagcaa

SEQ ID NO: 34253 - DNA, 101 bp, rice(Oryza sativa)
  misc_feature (71): n=t or c
atgaagaagaggggggttaccatctgagtcttcgtcatcggaacgttctggatatagtcgcgcaagtttcnggccaaagcatcggcggagaaatcatgtgt

SEQ ID NO: 34254 - DNA, 101 bp, rice(Oryza sativa)
  misc_feature (71): n=t or c
cctccctagaaccccccccccccccccctcctgatgaatcgagaccaaattggggggtcaaagcaagcagnagattgcacgaaacccacgcattccaagcg

SEQ ID NO: 34255 - DNA, 101 bp, rice(Oryza sativa)
  misc_feature (71): n=a or c
gatacagcgacccaaaaagatgatgcgattgaaaacaccacagagacagaaccagcaacttcgatcattcnaacgcgtccaccaagccctccaagaaaaag

SEQ ID NO: 34256 - DNA, 101 bp, rice(Oryza sativa)
  misc_feature (71): n=a or g
atctatgttgccgagtatccatccagagaaaaggctatggtggtcaaactcattagggcagtataactttntgagctcccgcctggctgatggcaagtcga

SEQ ID NO: 34257 - DNA, 101 bp, rice(Oryza sativa)
  misc_feature (71): n=a or g
ttataaatcaaaacctccgaaatccattctggccattctgaaattgaggtcatcgtggttctattctctgnatgactgcaagccaaaaacagaagatcctg

SEQ ID NO: 34258 - DNA, 101 bp, rice(Oryza sativa)
  misc_feature (71): n=a or g
ggtattcctcagaccattacaaccgatcagggctcgatcttcatgtaccgatgagtttgttcagtttgccnatatcatgggtatcaaattattgaattctt

SEQ ID NO: 34259 - DNA, 101 bp, rice(Oryza sativa)
  misc_feature (71): n=t or c
actaatctaaggcttacactgaacatatcaactgatgaacatctagctgagttgaggagtatggtttcctnggctattacttctagatagcagttgtagtt

SEQ ID NO: 34260 - DNA, 101 bp, rice(Oryza sativa)
  misc_feature (71): n=t or c
gacacatgtgtgccatccacagcaccaactgagtcatagaatggtcggaatttgtttccttcaagcagccnaggatgagtgtacgtgaagttgggatcaac

SEQ ID NO: 34261 - DNA, 101 bp, rice(Oryza sativa)
  misc_feature (71): n=a or g
aaatctagcgggaatgtttgctcgctcaagtagagataaaagacatgaactatttgacaaggaaattgcanccgatgagaatatagactttatagaggaaa

SEQ ID NO: 34262 - DNA, 101 bp, rice(Oryza sativa)
  misc_feature (71): n=a or g
aaagaggtgctctcaggtcgatcaggtgttgcgagtgcatttcagggatctgaggacagcacaatggatangattccacctctcgccttgttccgtgggga

SEQ ID NO: 34263 - DNA, 101 bp, rice(Oryza sativa)
  misc_feature (71): n=t or c
gtcagagtgtgacgtgggcgccccccattaacttcccatacaaacaatttgttagagctacaggcagcaancacaaacttgttgtcattagtcacagcaag

SEQ ID NO: 34264 - DNA, 101 bp, rice(Oryza sativa)
  misc_feature (71): n=t or c
aatattaacgcgaggctgaccttatccacggataatggcattcgccgggttaagagctcaagaagaactanaccaaagctgtaaacatcactcttatcggt

SEQ ID NO: 34265 - DNA, 101 bp, rice(Oryza sativa)
  misc_feature (71): n=t or c
aaatcaagaggagacaagtgaacaaaatggagtcagacacttatgttgatgatggcggacttctcggcgtnggtgaactcgcagacgacactcgtcggctc

SEQ ID NO: 34266 - DNA, 101 bp, rice(Oryza sativa)
  misc_feature (71): n=a or g
tggttcaagtggctcccaaggacataatgtcaatggaggacagaagaaagtgcagcatgctagcccactcnctctgaacaatgggtcaaagcaccgtccat

SEQ ID NO: 34267 - DNA, 101 bp, rice(Oryza sativa)
  misc_feature (71): n=t or c
tgcttcagcggtggctgcgagtgaagcaatggctatgatcaatagattgcaggaagaaaaggcttcaatgnacatggaggcacttcagtacctcaggatga

SEQ ID NO: 34268 - DNA, 101 bp, rice(Oryza sativa)
  misc_feature (71): n=t or c
cagcagcttaggtgcatacttcttatagggagcagattcagattgatcgtagaactccatagcaactcgtncttccacagaacccaaagcaaatcctgtat

SEQ ID NO: 34269 - DNA, 101 bp, rice(Oryza sativa)
  misc_feature (71): n=t or c
tggcgaggccaaaggcctcccggccactaacttgctgaaccaccttcatggacaaacaccctctcctcatntccccaagggctccacgaccatagtctgga

SEQ ID NO: 34270 - DNA, 101 bp, rice(Oryza sativa)
  misc_feature (71): n=a or g
gccaggctctgcgccacatagccggagtacgacatggtgatgcggatcgccatcgcgaagctggactcctnatctccgggatcttactggagatcgtcggt

SEQ ID NO: 34271 - DNA, 101 bp, rice(Oryza sativa)
  misc_feature (71): n=a or g
atcttccgatgttatagtaagggtgaaaacggggcggtatttctcgtcgcccgtccggccacattatttcnggacaaattcgggtacccgagacttttcag

SEQ ID NO: 34272 - DNA, 101 bp, rice(Oryza sativa)
  misc_feature (71): n=a or g
agaagacataggaatcatatatctagctagtttatattaggttgttgtccttgtgtagggtacatggtacncaattatctcatgttgggcctttatgccgg

SEQ ID NO: 34273 - DNA, 101 bp, rice(Oryza sativa)
  misc_feature (71): n=t or c
ggaaaaggaactcagcttgtacttacctcgccagatttaatagcgtgaacgatgatacaccttgagaaatncagatgagatagagggcacaatggaaggta

SEQ ID NO: 34274 - DNA, 101 bp, rice(Oryza sativa)
  misc_feature (71): n=t or c
gaatgcatgttgagagggaagaagagagcatatataccatgggggagcgtagtgaatggagtcagtgatgncctcacaagtggaaacgcaattgttggtgg

SEQ ID NO: 34275 - DNA, 101 bp, rice(Oryza sativa)
  misc_feature (71): n=t or c
tcctttgaagagaagttacaagaggcccagaaagcattggagatagatccacactattatgtcccaatcanttacactactgaagcaaaatggtttgagga

SEQ ID NO: 34276 - DNA, 101 bp, rice(Oryza sativa)
  misc_feature (71): n=a or g
gactggagtattatacggcggctctacatataaatacccagtgatttgcctccggctgcggatccactcgntgacgtgtcactctgccatggcggctctca

SEQ ID NO: 34277 - DNA, 101 bp, rice(Oryza sativa)
  misc_feature (71): n=a or g
cgagggaggcatggggttcgaagaaggattcgattcgcagcaatgggccgccgtaaatggggaagagggcnagagagagggagagcaaggaggggagcggg

SEQ ID NO: 34278 - DNA, 101 bp, rice(Oryza sativa)
  misc_feature (71): n=a or g
ggtatgccaatccctctataccattttatagctctcccttgcaaatgtgctaatgccaaattgacccactnatcaacaggagtcccagttatctcgaaaaa

SEQ ID NO: 34279 - DNA, 101 bp, rice(Oryza sativa)
  misc_feature (71): n=t or c
tctcttattcccttttgctgtgtgttgtaatcgatcctttctccgtgggtgtcggcgaaatagaaatacgncggattaatcagggccaccgtctgttcacg

SEQ ID NO: 34280 - DNA, 101 bp, rice(Oryza sativa)
  misc_feature (71): n=t or c
tctgcaacccagagatttaggtcagcaaactcaccctttagtcccatcaattggatctagcacccagtgtngcccagatggacctccctcagacttgccat

SEQ ID NO: 34281 - DNA, 101 bp, rice(Oryza sativa)
  misc_feature (71): n=t or c
tgaagatgttccaatgctcttgcagcctctcgatgaagacttccatcaaaagtaatagtggctctcatcancgaatcattctcctctggagttaacacctc

SEQ ID NO: 34282 - DNA, 101 bp, rice(Oryza sativa)
  misc_feature (71): n=a or g
gtgaatcgggcttgctaattcgcaggctatcccgacgcacgccatcgccggaattagcgagatcgagggcntggtgatggagattgtgatcacgttcgcgc

SEQ ID NO: 34283 - DNA, 101 bp, rice(Oryza sativa)
  misc_feature (71): n=a or g
ttgctaaatttcagtgggggttcaaaagtggcagcaatctctaaacattggatagaacttttctccttcgnctatagtgtcactgtcctcgccttctccgg

SEQ ID NO: 34284 - DNA, 101 bp, rice(Oryza sativa)
  misc_feature (71): n=t or c
gtagggaacttttggaaactttctaccaaacgaaggcaaagatgtgctattcccttcatgttttctcctcntgagcaacatgatagatatggttgttctat

SEQ ID NO: 34285 - DNA, 101 bp, rice(Oryza sativa)
  misc_feature (71): n=a or g
aataagtggtataacattcaaatgcagccaacgatcacataatatatacatgcacctcaccatcttcgagngccttcgtcccacgcgaggatctcggtgga

SEQ ID NO: 34286 - DNA, 101 bp, rice(Oryza sativa)
  misc_feature (71): n=t or g
aaatttatggctgacttgtgaattagagggggtcttttttaccgaggacttatgcaggtaagaagatggtncagggacattctgtttcaaatggacctcct

SEQ ID NO: 34287 - DNA, 101 bp, rice(Oryza sativa)
  misc_feature (71): n=a or c
taggcatatctttgttttaattttatctcagttcaaggagcttgcacaagcttatgaggtattgagtgacncggagaaacgtgaaatctatgaccaatatg

SEQ ID NO: 34288 - DNA, 101 bp, rice(Oryza sativa)
  misc_feature (71): n=t or c
cagtgtttcaagtgaagaaatagctgcaattctcactgaactgtctgaatcaacctctctgtcaaccaacnctagaatcttaacgcacaactcactgaaac

SEQ ID NO: 34289 - DNA, 101 bp, rice(Oryza sativa)
  misc_feature (71): n=t or c
cccactgcacattttggaccaagcatcactgtgccttacaagccacctgtatgctgttgctcttgctctgnattgctactgctcccacgatgctcctgttg

SEQ ID NO: 34290 - DNA, 101 bp, rice(Oryza sativa)
  misc_feature (71): n=a or g
aaatcagaagctcctccaaacagtccagtttttttccagattcggaaataacctagaaacctgaagctggnaaacccaacttttctagattctaataggct

SEQ ID NO: 34291 - DNA, 101 bp, rice(Oryza sativa)
  misc_feature (71): n=t or c
gggcatacatatatgcagatgatgatgatggacgagcatggaaattacgtgatacaaaagatgttggagangatagcggatgagtgggtggtggacttgat

SEQ ID NO: 34292 - DNA, 101 bp, rice(Oryza sativa)
  misc_feature (71): n=a or g
ggtgttggtgaggttcgtcttgccgttctagctgatcctaacatgcaattctgggagaggaagaagacagngggagatgggagtggtgccgcatacacatg

SEQ ID NO: 34293 - DNA, 101 bp, rice(Oryza sativa)
  misc_feature (71): n=t or c
gcccagtcattcctgttcctaagacaatcgttaacagcatgtaaatagttggggtatgcattgttttccangttgggtttacttaaatccccccaatgctg

SEQ ID NO: 34294 - DNA, 101 bp, rice(Oryza sativa)
  misc_feature (71): n=a or g
tttatttacgaagaagtagaatttacagaagaggagcagcagaggagtcgaagcctgattggcttgggctntcgcggtcgaagcttgaatcgcttgtgccg

SEQ ID NO: 34295 - DNA, 101 bp, rice(Oryza sativa)
  misc_feature (71): n=t or g
gtcccttccctcgccagccgagacgaattagcaacaacgacgccgcctgtggcgaagctgatgatgttgtngtttggcccgtcgctcgccgcgccggcggc

SEQ ID NO: 34296 - DNA, 101 bp, rice(Oryza sativa)
  misc_feature (71): n=t or c
aatgcaacagaaacttccgtttctgctatccagccagaagagtctgacggcacccaattctgatccaacgnagaaaaagctcccattcttgccgatcagcc

SEQ ID NO: 34297 - DNA, 101 bp, rice(Oryza sativa)
  misc_feature (71): n=a or g
gagggtgtgatccaaaagcagcagtggcagcagccaccactttgcacaaaagaagcaaagtaaatggatgnccatcgccgttgaggaagggttggtggcca

SEQ ID NO: 34298 - DNA, 101 bp, rice(Oryza sativa)
  misc_feature (71): n=a or g
cttcacatatgaggatgaattggcaaaagatctgaaagttgtctccatagttggattcggaggactaggcnaaacgactcttgccaaccaagtgtaccgca

SEQ ID NO: 34299 - DNA, 101 bp, rice(Oryza sativa)
  misc_feature (71): n=t or c
tggtaaagataggcacaccaagctttgtcaaaagaagccaactgagatctgaatttcttccgatcagcaanaacggcagaagattcctgataattagaaga

SEQ ID NO: 34300 - DNA, 101 bp, rice(Oryza sativa)
  misc_feature (71): n=t or g
gtggatagtttgcccagcaatgctgataaaatgtgtctcatgcttgcaggtgtggagattccaaccaccgncaaaagcgaggcttaggagcgcaactacgc

SEQ ID NO: 34301 - DNA, 101 bp, rice(Oryza sativa)
  misc_feature (71): n=t or c
ctctcccccagaccggggtgtgaactaccggatccggttgccacaagtttggggtggccatatcctggctngattgtggcctcttcctctcctctacccga

SEQ ID NO: 34302 - DNA, 101 bp, rice(Oryza sativa)
  misc_feature (71): n=a or g
taattatctggaaccacacacttcagtcgtcgatgatgctcataaagcagggttggaaatttatgctgccnactttgccaatgactttatgttcagttaca

SEQ ID NO: 34303 - DNA, 101 bp, rice(Oryza sativa)
  misc_feature (71): n=t or c
gacattggtggagaaaccaagatgaaggccacaatacgatcccatggcactggaaagcacgtaagcacatncatcacacgagttgtgaatatagtagctgg

SEQ ID NO: 34304 - DNA, 101 bp, rice(Oryza sativa)
  misc_feature (71): n=a or g
acagagatcagcacctgcatcctaggtaggaaaattaccttgctcttgtcctgaggaagaagaagccgccnccgaaggagatgcactcatcgccggcagtg

SEQ ID NO: 34305 - DNA, 101 bp, rice(Oryza sativa)
  misc_feature (71): n=t or c
gaggacaatatcggcattgacatgcagagcctgcatatcgaacaagttgaacaaacagaattgccgagcanggtgcaacaacatgcgatgggtgaagccga

SEQ ID NO: 34306 - DNA, 101 bp, rice(Oryza sativa)
  misc_feature (71): n=a or c
ttttggccttgccagggcatttggtggagatcagtcaaaggatattacaagacgacgacctgttggaaccntgtaagtatatgtattataagttcctcttc

SEQ ID NO: 34307 - DNA, 101 bp, rice(Oryza sativa)
  misc_feature (71): n=t or c
agcttggaaaagatatccttaataagacctgggcagctaccaattaagtaccgaaacccatcagtttccangactgccttcagagatcttgatgacctgag

SEQ ID NO: 34308 - DNA, 101 bp, rice(Oryza sativa)
  misc_feature (71): n=t or g
aaaatatgtcttacccttcttcttcttggtaccactcatggttatcgtggagaccaacaaacacacaggcncattgttcgtcgtcttcttgagcatctgga

SEQ ID NO: 34309 - DNA, 101 bp, rice(Oryza sativa)
  misc_feature (71): n=t or c
gcaattacaactccatgaggccattcaggatgacttaagtgcctacaagaagaggaacattgcagaccgcnaacatgcttccaagatgtcgaatgttaagg

SEQ ID NO: 34310 - DNA, 101 bp, rice(Oryza sativa)
  misc_feature (71): n=a or g
agagaacatcaacaatgaaattgcagaatgcagtagtaaagacacacacctcatcttcctgatgacacccnccatctcctctctcttcttctttgctctct

SEQ ID NO: 34311 - DNA, 101 bp, rice(Oryza sativa)
  misc_feature (71): n=t or g
tcgccttcttcggtctttgatagcttggtcgcatgcacttctcattcgtctgccgtggtcgtagccagctngatctcttcgcgagcgagagtgatctcgcg

SEQ ID NO: 34312 - DNA, 101 bp, rice(Oryza sativa)
  misc_feature (71): n=t or c
aaagtacagaagcatgcttgttgtttgggctgcgctatcacctagtgttgtagaatcattctcagttgcanccatgctctctacagatggatctacagaaa

SEQ ID NO: 34313 - DNA, 101 bp, rice(Oryza sativa)
  misc_feature (71): n=a or c
agcgctgggcaagaacatgtagataccaaaggacaggaggaaagctgacatcgaccaatccttctagaatntggacaatctctcccatcgttggtcttgtg

SEQ ID NO: 34314 - DNA, 101 bp, rice(Oryza sativa)
  misc_feature (71): n=a or g
tccacctctccccatcgatccatctccctcttgattatcatcttcgacatgatttccaattgtcggaactncctgactgcttgcctcatgcgccttagttg

SEQ ID NO: 34315 - DNA, 101 bp, rice(Oryza sativa)
  misc_feature (71): n=a or c
ataattaagaccgccctgactgtcaatagtaaacaattcatcctcatcgtcgactcctcatcactccctanaagctcacccagctcatgaaatacttcctc

SEQ ID NO: 34316 - DNA, 101 bp, rice(Oryza sativa)
  misc_feature (71): n=a or c
attgtgcagcactgccccaaggataggaatgcctctgggtgtgatctcccccttccagttacaaagtgganaccaccgccgccaggcatggtactaattaa

SEQ ID NO: 34317 - DNA, 101 bp, rice(Oryza sativa)
  misc_feature (71): n=a or g
gtcatcagtggttgttactgtgaattcattcggaggcagcaagagaatacaaggcttaaggattggtggcnatgaaaattctatgtctgggaacagcttga

SEQ ID NO: 34318 - DNA, 101 bp, rice(Oryza sativa)
  misc_feature (71): n=t or c
ggtgttttaccacttggccttggtaatctcactaacctgcaatacatttcgctgtccaataaccagttctnttcagttataccaccaagcattttccacct

SEQ ID NO: 34319 - DNA, 101 bp, rice(Oryza sativa)
  misc_feature (71): n=a or g
ccagcagatgttccaagcatgctcttctattagtatgttgacaagcacagatggatcttctctattaaatnatttgttatcactaggtatgagctgagtaa

SEQ ID NO: 34320 - DNA, 101 bp, rice(Oryza sativa)
  misc_feature (71): n=a or g
ggcgccgagtccgcctcgcccccatgctgcgcatattgaggaggtctggatgagccgaattgaagacagcnggggcggaatcaacgacgagctaggaaagg

SEQ ID NO: 34321 - DNA, 101 bp, rice(Oryza sativa)
  misc_feature (71): n=a or g
gccaccgaccttccagaatatggctgacaagagtcacaagaccctccatgaatttgttgctccctcagctnacaacgtggccattgggccgcagatcaacc

SEQ ID NO: 34322 - DNA, 101 bp, rice(Oryza sativa)
  misc_feature (71): n=a or g
ctctagaaggcttaatgtttcagcaatttcagcatctaacttttccatatcacttatggaaataacaggtnagtatattttcttaaagaagttactcacac

SEQ ID NO: 34323 - DNA, 101 bp, rice(Oryza sativa)
  misc_feature (71): n=a or g
tatccgtccttttttaccagcactgcttttcagtgccaaagaatctccttgtagtttaggtagtacaatcntatccttttgttctgaagaatttgttgcca

SEQ ID NO: 34324 - DNA, 101 bp, rice(Oryza sativa)
  misc_feature (71): n=t or c
tttgtgaatgatggaacaacagccgatgatttagtcctcttcctcttgccagcttcagaaggaattggctngcgagattgtccgtggagcagtgtagacgt

SEQ ID NO: 34325 - DNA, 101 bp, rice(Oryza sativa)
  misc_feature (71): n=a or g
atgcagactgatagagggaagcctgacaagggaggatttggatccttgagaactccaaacagcttcagtgncatgggcattagaggtggtggtccaggggg

SEQ ID NO: 34326 - DNA, 101 bp, rice(Oryza sativa)
  misc_feature (71): n=t or c
atgaactcatctgctcgatcattatccgacgccttccaggacacattgtattcgatgctatacaagtatcnagcccggtatggaaatggtaactcagagct

SEQ ID NO: 34327 - DNA, 101 bp, rice(Oryza sativa)
  misc_feature (71): n=a or g
aaatattgttatccctcctccgaagaatacaactgatctcagaaacctttggctaaacttcaggtttcacngcataaatccgaataatacaactgatctca

SEQ ID NO: 34328 - DNA, 101 bp, rice(Oryza sativa)
  misc_feature (71): n=a or g
attctgtcaaacaggtcgattgcactcttggcaagtccaagatatgcaaaagaagaaaccattgatgaccntgtaactagatctgggttatggatcatacc

SEQ ID NO: 34329 - DNA, 101 bp, rice(Oryza sativa)
  misc_feature (71): n=t or c
tgttgcaggatagtgttactgcatgactagaatggttgagctttatacaaagactacataccaccgttgangtcacctctaagcagccacgaaggtctgga

SEQ ID NO: 34330 - DNA, 101 bp, rice(Oryza sativa)
  misc_feature (71): n=a or c
ctatgaactgaccatatatgtacgcgaagaacagtattggggttcatctgcaacaaagattcctcacctcnaggtaaccgcatcctttgacgatgtgtgct

SEQ ID NO: 34331 - DNA, 101 bp, rice(Oryza sativa)
  misc_feature (71): n=a or g
catagaccatgactatggcttgcacccataccgcactgatgaagacaatcggtaccacctccgtatggccngattgcccaaaggatgtcggtgcacgctcc

SEQ ID NO: 34332 - DNA, 101 bp, rice(Oryza sativa)
  misc_feature (71): n=a or g
attcgctagctagctagctcatggcgatcgatcaagatcgtcgaagattactactaccttttcttgggggnaaatatctcgtggcgcgacgcgaacggcga

SEQ ID NO: 34333 - DNA, 101 bp, rice(Oryza sativa)
  misc_feature (71): n=a or c
tggtgaggctcgcctgtcgagggagatggaggatatggaagatagtctggtatacaaggcgacaacagatnctgattaccctgattactacaaaaaacttg

SEQ ID NO: 34334 - DNA, 101 bp, rice(Oryza sativa)
  misc_feature (71): n=t or c
aaggattgctttccctgtggtatcaagttttaagcccggtccctttatatcagtttccaagaagaaatgcntccccttaactgactctcttgctgcaatgt

SEQ ID NO: 34335 - DNA, 101 bp, rice(Oryza sativa)
  misc_feature (71): n=t or c
ctacaccttgcagcttcaactttagctcttatttcaagttgcagtcgtctttcctcgtccctagattttgnagttccattgctgcatcctccctagataaa

SEQ ID NO: 34336 - DNA, 101 bp, rice(Oryza sativa)
  misc_feature (71): n=a or g
gcaaagaattaaagcattctgcacttcgcgttctccagagcattggctaaaaaatcagcctccaaaaagantagaacttcagaaagccctcggtaaccatc

SEQ ID NO: 34337 - DNA, 101 bp, rice(Oryza sativa)
  misc_feature (71): n=a or g
ggaacagttaagcacaacatcaatcaagaagaatcatgggattggaatagagacagggtgctcacgtatcnccaatcggcttcattgatcattgatattgc

SEQ ID NO: 34338 - DNA, 101 bp, rice(Oryza sativa)
  misc_feature (71): n=t or c
ccgctggccttgactgcgtcgtagtacgcccgatcccttgtcctcctcggatcgaaccccgccgagcagancagcatcctctcgcacgccagctttgtcag

SEQ ID NO: 34339 - DNA, 101 bp, rice(Oryza sativa)
  misc_feature (71): n=t or g
agttccaaaacgagggaagataatctcggggaacatccggtgggcttgcttggcattgcctcaacccactnggacacatagtcaacggccaccaggatata

SEQ ID NO: 34340 - DNA, 101 bp, rice(Oryza sativa)
  misc_feature (71): n=a or g
gcgttccctattctcctcatcatgccaaacaattattctttcgataccatctcatttcatccactgcagcnatgggaatgtcgccatgccattgtcggctc

SEQ ID NO: 34341 - DNA, 101 bp, rice(Oryza sativa)
  misc_feature (71): n=t or g
cgatggtgttttcttccgaataattttgtgtggtgatcatgttttcttctgtctgcaagaacatggggtgngatgggagaaacgtaacgtacgtagtgacc

SEQ ID NO: 34342 - DNA, 101 bp, rice(Oryza sativa)
  misc_feature (71): n=t or c
gagggtgtccagcagcgcgggcaacctgagtcgccagtgatccctccgattcttgcgtttgagggacacgngttgctggacgatgtgaatgacattgtacc

SEQ ID NO: 34343 - DNA, 101 bp, rice(Oryza sativa)
  misc_feature (71): n=a or g
gatatggattccctttcaatcgggagccatgaatctgaccagactcgtgtaagcgtacgaacactatacancaagccaaggaggaccagggtaaacctgga

SEQ ID NO: 34344 - DNA, 101 bp, rice(Oryza sativa)
  misc_feature (71): n=a or g
gatatctatcatgatacaagtcgtccacataaaattccgccaaatatcaaagctccaaaccacttattggncacaaatctgcagagaaccatttcagctaa

SEQ ID NO: 34345 - DNA, 101 bp, rice(Oryza sativa)
  misc_feature (71): n=a or g
atattactgcaaccagagaaaaaaaaaacctttttcttttttagagtagcagttgtggaggaagttccgcnctttcacatgtttactgccagccaagagcg

SEQ ID NO: 34346 - DNA, 101 bp, rice(Oryza sativa)
  misc_feature (71): n=t or c
gcacaacctgaccttctgaaagctgctgttatttcaaccatgtcaatacttgctgtgcctcttgaggcatnggcatcggcggagacatgtcagccagctaa

SEQ ID NO: 34347 - DNA, 101 bp, rice(Oryza sativa)
  misc_feature (71): n=a or c
tgataagacatattgctagctccatatgtttgctgacaaataaataagctggtttgcggggagaaaaaaanagctggcatcagttcggcccgcgtcggccg

SEQ ID NO: 34348 - DNA, 101 bp, rice(Oryza sativa)
  misc_feature (71): n=t or c
ctggaggattatccaacatagttccgttccttggtcctcatattcctcaggttccaatctagagttccgtngacacttgatcgcaaggtgtttcatggctg

SEQ ID NO: 34349 - DNA, 101 bp, rice(Oryza sativa)
  misc_feature (71): n=t or c
tgcagcagctccgactccgccttaacacgaaagctcaagcaccgtagagaaaagcacaccgctccaaactnggcactaagacagatccacacagtcacagg

SEQ ID NO: 34350 - DNA, 101 bp, rice(Oryza sativa)
  misc_feature (71): n=t or c
cctgcttctcatccatcacagccagctgcttatgtgcatcagcagcaccaaacttcttatattcctccttngactgctcatccgatgccacctgaatctta

SEQ ID NO: 34351 - DNA, 101 bp, rice(Oryza sativa)
  misc_feature (71): n=a or c
atatatatacgcagaactaagcaagggattatgtcgtgatagccactaatttttccgtccatgctgtaaanagcagctacctatactcgcttcactattta

SEQ ID NO: 34352 - DNA, 101 bp, rice(Oryza sativa)
  misc_feature (71): n=t or c
aggagaaatccagtacacgctcgaaggacacatagcacaagcacataagtggcaggaaaatattgatgcangactctccaaatttgatgacatgatgcatc

SEQ ID NO: 34353 - DNA, 101 bp, rice(Oryza sativa)
  misc_feature (71): n=t or c
aacataaatcttctcgatcactgagtttgtatatcatcaacagcaactactccgaacatagaaggtcagtnggaaattgacccaggcagaaaacaagtaca

SEQ ID NO: 34354 - DNA, 101 bp, rice(Oryza sativa)
  misc_feature (71): n=t or g
acctccattttggctccctttagcaagtgcatcagcaaactcatctggattttcatatgccctcattttcntcctgtcaaaaccaagtccttctagtaaat

SEQ ID NO: 34355 - DNA, 101 bp, rice(Oryza sativa)
  misc_feature (71): n=a or g
accacctccaattctaccgctggctgtgatggagttccatgttgttacagttgatgttgttacagttgatntgatcgagagcgagctcgatgccgccgtgg

SEQ ID NO: 34356 - DNA, 101 bp, rice(Oryza sativa)
  misc_feature (71): n=a or c
agaaaactgcaaggcaccacgtttcctttcacaaaactgtgacttcatgccaaagctcatctggtatggcncaatgctctccttgtacatgatggactctt

SEQ ID NO: 34357 - DNA, 101 bp, rice(Oryza sativa)
  misc_feature (71): n=a or g
tcttttgttgttgttgctgctgctgcacattgtttagtaggtgtgggaggcactcaagattcttgatgcanctgatgcacccaaaccagaggcgtcccttg

SEQ ID NO: 34358 - DNA, 101 bp, rice(Oryza sativa)
  misc_feature (71): n=a or g
tgcattgttgaagaggtcctctgcaatggcttccatttgcctccgcttcttctcctctcgcatgaagtcanttaccgttccacgctcgtaatcagattctc

SEQ ID NO: 34359 - DNA, 101 bp, rice(Oryza sativa)
  misc_feature (71): n=a or g
tctgacttttgacatttgcacaattattgggaatactaaagatgcctctgtgtttcgaggttgctgcctcnagcctgcaacaagcccgaatcacattctcc

SEQ ID NO: 34360 - DNA, 101 bp, rice(Oryza sativa)
  misc_feature (71): n=a or g
ggatgattgctaatcatttgactatagtgtaaattgcaagtgctcaaagtgtcacgtgtatcggtacccgncaggtcaatgacagacctaggtcatgagcc

SEQ ID NO: 34361 - DNA, 101 bp, rice(Oryza sativa)
  misc_feature (71): n=t or c
gtgagtggcatgctaaataactgctcaacctgtgcaagccatccaaaagtatctgacttgcccatcaccgngtgtcctcgtatcgggagggccaagatcat

SEQ ID NO: 34362 - DNA, 101 bp, rice(Oryza sativa)
  misc_feature (71): n=a or g
caatgtcaacaggtcccagcgcacaatattgaactgtggctgtcaacaggtccctgcgactgcccctatcnaacaatgggtgttcgactggcggctttaaa

SEQ ID NO: 34363 - DNA, 101 bp, rice(Oryza sativa)
  misc_feature (71): n=t or c
cttctgtaactctgaatttaattagtcaaaatgataaacttacgccgtggtccagtgcgtttcctgtcaanaggtggaggaaaaaatgagaaattttcaca

SEQ ID NO: 34364 - DNA, 101 bp, rice(Oryza sativa)
  misc_feature (71): n=t or c
tctcttagaatttcacatggaagcagctgcatgcacattttatgcaatcgctgcttctgtagatataatcngacatcaatcagtcatcagggaaaataaat

SEQ ID NO: 34365 - DNA, 101 bp, rice(Oryza sativa)
  misc_feature (71): n=a or g
gccgccctcgctcccaatctccaccgcacaatccccacccccaatctcccatgtgccatcctcgtccctancctccttctcaccgttgccgccctcaacca

SEQ ID NO: 34366 - DNA, 101 bp, rice(Oryza sativa)
  misc_feature (71): n=t or c
cgaacgggtcgcgagtgaggaggtgatcgacccaccaggactccactgtcatgagaccacgctgtggctgncccatgggcgacctgggaggggtagtcgat

SEQ ID NO: 34367 - DNA, 101 bp, rice(Oryza sativa)
  misc_feature (71): n=t or g
catgctactgtactaaattaaaaaaaaacgtttgttgcgagcaacaaaacgaaatactgcgtggatagggngcctactgcatagtgttgtgtcgttcgtat

SEQ ID NO: 34368 - DNA, 101 bp, rice(Oryza sativa)
  misc_feature (71): n=a or g
cgtctgatcactgaagctgtatcactcccagttatcggcgatggtgataatggctatggaaatgctatgancattaagagaaccgtaaaagggtatattaa

SEQ ID NO: 34369 - DNA, 101 bp, rice(Oryza sativa)
  misc_feature (71): n=a or c
cacctatcatcaccacctctaagtgtgtccaacacaagacgctcaagtgagactgcggccttgacgatgcnacatgttagctcaaccaagctctttgcgga

SEQ ID NO: 34370 - DNA, 101 bp, rice(Oryza sativa)
  misc_feature (71): n=a or c
ttttagagaggtgagtgcttgttcatcagaagcagagagacaagatgtataacgctccaatggcacagganatgtcctactatgaacatgtgcagaggcgc

SEQ ID NO: 34371 - DNA, 101 bp, rice(Oryza sativa)
  misc_feature (71): n=t or c
acagacagccagtgttgagtacacaggcagcatcatcctcaatgagcgcagaaacaagaactcatagctgntctgactcttttgggcatcgccctccaatt

SEQ ID NO: 34372 - DNA, 101 bp, rice(Oryza sativa)
  misc_feature (71): n=t or c
tttcattcaaaaccacaagctaatcactcatgctaaaagttttgtgtccattcttgaatcactatcacttnagtcttagtagctacatatataaaaccact

SEQ ID NO: 34373 - DNA, 101 bp, rice(Oryza sativa)
  misc_feature (71): n=t or g
catgctcgaggaggggaattcgaagaggcatgagcaccctgtgaaagaagagatcatgagcagtgcacacncagccggggtagtggagcctggcgtggagt

SEQ ID NO: 34374 - DNA, 101 bp, rice(Oryza sativa)
  misc_feature (71): n=a or g
ccaactacgccacaggtgcgtgggagcggtcaaatcgcatacaaactcaacgaccagacccacatcgaccngcgccaagacgaagacgaagaagaagaacc

SEQ ID NO: 34375 - DNA, 101 bp, rice(Oryza sativa)
  misc_feature (71): n=t or c
aggaaaggggcattcctgaacctagagatattgcagctatgttgtaactccctgtcagggccagttccagncttcttattctcacttccacgattggagtt

SEQ ID NO: 34376 - DNA, 101 bp, rice(Oryza sativa)
  misc_feature (71): n=a or c
gatgtaagactaagaactggccaaaaacatcattgggtaatgccactgaaccagaaggaactattaagggnaattatttcaatgaaacaggtaaaagaagt

SEQ ID NO: 34377 - DNA, 101 bp, rice(Oryza sativa)
  misc_feature (71): n=t or c
caatgcctccccgctgctctctgattgcactggtgaagttgttccagttaaggtcgaactcggtccacgcnaggagcgccatgaagttgagcatgtcaaga

SEQ ID NO: 34378 - DNA, 101 bp, rice(Oryza sativa)
  misc_feature (71): n=t or c
ctgggcgctgacatgggcccgcttctggagttagatgttcttggtattaccgatcgattttgctatatctnactcgaaagatttttccttatctctcactc

SEQ ID NO: 34379 - DNA, 101 bp, rice(Oryza sativa)
  misc_feature (71): n=a or c
cttgtaattgctcgtaagtcccacaaagacttgatccagaccaggatcccctgtagtcaattgtaccgcgnctttatcactaatatgtgtgctcggatatc

SEQ ID NO: 34380 - DNA, 101 bp, rice(Oryza sativa)
  misc_feature (71): n=a or g
gagagtgtcctatgatagtgcggtgataagcgaccgcacacccatagaatcaacactaggcgtggcttccncacgagtgaggatcgacaagaagcttctta

SEQ ID NO: 34381 - DNA, 101 bp, rice(Oryza sativa)
  misc_feature (71): n=t or c
tgcaatgccaacgtaattacttggaaaatcgaggtaattaacggcgtgattaattaggaggtgtggtcctngagcacgtcgagggtgagctcgctggggtc

SEQ ID NO: 34382 - DNA, 101 bp, rice(Oryza sativa)
  misc_feature (71): n=a or c
atgtgttaaagctgcaccaaaacccacaatagatgtttcagcaagcagggcactgctggaagaatacaatnagctacacaagccacctattcgaccttcta

SEQ ID NO: 34383 - DNA, 101 bp, rice(Oryza sativa)
  misc_feature (71): n=a or g
aagcgaaaatacgaaaaggtgttgcagattgtgaagaaaaaatagggataaaaataaaagagccaatcttnccagcccgcgagccgccgccatctcccatc

SEQ ID NO: 34384 - DNA, 101 bp, rice(Oryza sativa)
  misc_feature (71): n=t or g
gtcaaatatgtgtatgttcaatctagaaattgagcagacagtgtgattggccttgttaaatttcgttgagngccttaatatatctcccagaaacacttcag

SEQ ID NO: 34385 - DNA, 101 bp, rice(Oryza sativa)
  misc_feature (71): n=t or c
caggaccctgcactaacttatcaagaaaaagtgacttcacttgaagctgcactctcagaaaaggagacggngttacgtttagctaatgaagaaaaccagag

SEQ ID NO: 34386 - DNA, 101 bp, rice(Oryza sativa)
  misc_feature (71): n=t or c
ccaaacttgttcagttcggtgaaaagcccaaggccgtcggacggtgtgataacatggcacaccccacccangaagggggtgatctcaggccgcgtggtgaa

SEQ ID NO: 34387 - DNA, 101 bp, rice(Oryza sativa)
  misc_feature (71): n=a or g
tgtttgattctttgtgcttaacagaaggatctcagagaagcatttgcgatagttgtggcaccttcaaaacngtaattctctattcataactccctttttca

SEQ ID NO: 34388 - DNA, 101 bp, rice(Oryza sativa)
  misc_feature (71): n=a or g
gttgttcttgcaacctggaagcaagcaatttacatctgcacttcttatgcatcttctgccacaagagagantccttcccatgatgtcaccgcgaagggttt

SEQ ID NO: 34389 - DNA, 101 bp, rice(Oryza sativa)
  misc_feature (71): n=t or c
gtgctcctgccgaattcgggcggttttgctgggggcaccgagagttgctgccatctgtggtgatctgatcnggcggcgcgcggcgggagtggtggtggtct

SEQ ID NO: 34390 - DNA, 101 bp, rice(Oryza sativa)
  misc_feature (71): n=t or c
atgatgtgggtaggctgatggcattaggataagatgactcccgtggccggtggactgataggcacatgatnagaagggcgcgtcaaattcaggtgaggatt

SEQ ID NO: 34391 - DNA, 101 bp, rice(Oryza sativa)
  misc_feature (71): n=t or c
gatgcagaagtggttctacgtcgacaacccatactccaccgaggacgacaaggcgaactggctccgctttnggcgccttcctgtttccatcatcgccaagc

SEQ ID NO: 34392 - DNA, 101 bp, rice(Oryza sativa)
  misc_feature (71): n=t or g
tccagatccttcttcaagtcctctactggcaactgggcataaacagcaagacggggctttatcttatcggnttcatcatctccaccgccgcatgaggtctg

SEQ ID NO: 34393 - DNA, 101 bp, rice(Oryza sativa)
  misc_feature (71): n=a or g
cctgtcatctgacgatatgatgatcgacaatatacctctatgttctcgtgagtcaactctcgcagtcaatntttcaagtgccccgagccaactggttggaa

SEQ ID NO: 34394 - DNA, 101 bp, rice(Oryza sativa)
  misc_feature (71): n=t or c
tcctgcccgcagaggcaagaccacctgaatcaatggagaggcaatgacacaacagattggataaggaagangtccaacagcctcgctgtcgtggccgtgct

SEQ ID NO: 34395 - DNA, 101 bp, rice(Oryza sativa)
  misc_feature (71): n=t or c
gtcaagcaaaatcaaggggcatagggtagattgtgctctgtgtatttatacctcgtttagttggagaaaantttcgtgtttaattgtcatatcgaatatac

SEQ ID NO: 34396 - DNA, 101 bp, rice(Oryza sativa)
  misc_feature (71): n=t or c
aacaatcgccattgcacgatatcgaaatggaagttgaagaagcaattgaacctacatttgtgttggtcctngtccatggacaactccagcccggaaaccgc

SEQ ID NO: 34397 - DNA, 101 bp, rice(Oryza sativa)
  misc_feature (71): n=t or c
gaagaaaaaaagaaaaccacggaattaaacattcagaaaaattttcagaaaagagcacccccaaaccgcangcaattgcaaagtaagcgatcgatcgaatc

SEQ ID NO: 34398 - DNA, 101 bp, rice(Oryza sativa)
  misc_feature (71): n=t or c
acaaggactgcatgctgattcatttgtaaattcttcacacctctccatcctattaagagatatgcatgctntttgattcttacttcctgcatatggttggt

SEQ ID NO: 34399 - DNA, 101 bp, rice(Oryza sativa)
  misc_feature (71): n=t or c
catgtaggatgaaaacaaccatctaaagcaccaagggaagtaattgactcgattttgacagttggaaggcntatatatgtgattttgtggttgagggatgt

SEQ ID NO: 34400 - DNA, 101 bp, rice(Oryza sativa)
  misc_feature (71): n=t or c
gcgcgtcatcggcagctccccgagtcagaacctctttgaggtctatctcaggatgtgctagcctcaggcangagaggacgtggcacgccccctgtgtaaat

SEQ ID NO: 34401 - DNA, 101 bp, rice(Oryza sativa)
  misc_feature (71): n=a or c
gtgtcattatctttacctggatcgaatacaagtataaagatattccaatgaaccaccagcttattagtctnaattttcttctttgttgactctagtatcat

SEQ ID NO: 34402 - DNA, 101 bp, rice(Oryza sativa)
  misc_feature (71): n=t or c
cctacgaagattttcctctctttcataaagctaagcgatcaagactccgtgaatgaaaagacttcaaaaangtctacttacttctcgccgatcgtcacaag

SEQ ID NO: 34403 - DNA, 101 bp, rice(Oryza sativa)
  misc_feature (71): n=a or g
agtagctctggaaggaatgatggtctagatgttccagaactgctggccttgcataatggacaaaataacantgaagctgatatatatcacaagtccagtgt

SEQ ID NO: 34404 - DNA, 101 bp, rice(Oryza sativa)
  misc_feature (71): n=a or c
cataaaaaaaatacatcttaggaacttcctaccaaagcagtcaattgcactagagcgattttcttgaatgntacagtccaaattattgtccatgcggtaca

SEQ ID NO: 34405 - DNA, 101 bp, rice(Oryza sativa)
  misc_feature (71): n=a or c
tgtggggccgaacaacacgtgccacatgattgcaggcttaattcgatcggtacttcctaatctagggtttntctctagcttaaatatcatagttgggtttg

SEQ ID NO: 34406 - DNA, 101 bp, rice(Oryza sativa)
  misc_feature (71): n=t or c
tccacacctcttccatcatcctcatgtgtcaccgccaacaaattctcccttcatcgtcccctctccagcantgtcaagctcgtcctctatgtcgatctgca

SEQ ID NO: 34407 - DNA, 101 bp, rice(Oryza sativa)
  misc_feature (71): n=t or c
gaaaggagagttatttttgtgctatatgtatgttgcaggtttatcctgatgggaaaatgagtcagtatttngcaagtctgaaaccaggagatgttgttgag

SEQ ID NO: 34408 - DNA, 101 bp, rice(Oryza sativa)
  misc_feature (71): n=t or c
cttgactcgctatcttccaagtgcaagagcttgcagtcagtggagatcaagtttcggccaattgataatgntcgtcaccacgaccttgtagggttattgaa

SEQ ID NO: 34409 - DNA, 101 bp, rice(Oryza sativa)
  misc_feature (71): n=t or c
ggttagcagctattaattacatatcgaacatcatctatcagcaaaagcccaaaccaactctgagtctaccnccttcaaaccctgcaatcatcttccaggac

SEQ ID NO: 34410 - DNA, 101 bp, rice(Oryza sativa)
  misc_feature (71): n=a or c
ctctcacaaagtcagaagcatatgcagaatgatgcttaaccacataatttgtaacctcttcttcaggtccnaagcagaatattttggagggagttatgtta

SEQ ID NO: 34411 - DNA, 101 bp, rice(Oryza sativa)
  misc_feature (71): n=t or c
ttggacttctcaccgatgccaactcagaagcaagcttctcgttttggttcatgagcttggtgacttcttcngacaacgctttcaattcaactcccgcagcc

SEQ ID NO: 34412 - DNA, 101 bp, rice(Oryza sativa)
  misc_feature (71): n=t or g
gtggcaattgaggaccagcatcaatcaattcagtagaagttgtagctaaaattccgtggctaccttctggnggtggtggtggtagaggaattctagtatat

SEQ ID NO: 34413 - DNA, 101 bp, rice(Oryza sativa)
  misc_feature (71): n=a or c
aagaaatattagggaatgacagtaatataaaatctgttgagtagattacttgaaaattttcaagcttcatnttttcaagaattccctttgtcaatgccctc

SEQ ID NO: 34414 - DNA, 101 bp, rice(Oryza sativa)
  misc_feature (71): n=a or g
ggcttagcgatgatagagatagcaagacgccgaaacctaagccagttcaccttaccatcctcgatggagtnaggattgtcgatgtagaaccacttctgcaa

SEQ ID NO: 34415 - DNA, 101 bp, rice(Oryza sativa)
  misc_feature (71): n=t or c
atagctagttgtgtcagcaactgcagggctcaaaaactatgcaagcatgctggtagcatagtaatgttggngctacaaacctgtgtgcaacagaagatgca

SEQ ID NO: 34416 - DNA, 101 bp, rice(Oryza sativa)
  misc_feature (71): n=a or g
catccttactccagctgtttatcttgagcagcaccaattcaatctggaaaaagccaaattaagattagccnaaagacgagaacgcaaggacattgaggcca

SEQ ID NO: 34417 - DNA, 101 bp, rice(Oryza sativa)
  misc_feature (71): n=t or c
aattttaaaaaccgtgtacgggctaatctttatgttttgtgtttgttaagttggggatgcttgctagtagnataaaatttttaatatgaaatattaaacca

SEQ ID NO: 34418 - DNA, 101 bp, rice(Oryza sativa)
  misc_feature (71): n=a or c
ccgtgcagtgctcggactctcaccatggtttgtaccatacgcagcgcgtgacgtgagacttaattgttgcntgctccctcggtcaaaaaaaaaatcaaact

SEQ ID NO: 34419 - DNA, 101 bp, rice(Oryza sativa)
  misc_feature (71): n=a or c
agcagttggaaaacccagccaaaaggagatggatcaacactgtgatgggacataaatcaataagactgtcngtgattttcttcatcacaacaaactatcag

SEQ ID NO: 34420 - DNA, 101 bp, rice(Oryza sativa)
  misc_feature (71): n=a or g
tacaggcaatggcaacttcaattggtcataactctttacttcaaagagtgttggaagctcatgagcacttnttggaaagggttttgatgtctactttcata

SEQ ID NO: 34421 - DNA, 101 bp, rice(Oryza sativa)
  misc_feature (71): n=a or g
gctctacccgtctggccaaagttgtctagctataaaaatcacggttttctcatacgggcgtcacagccacncgtaaaaaccattttcgcaaacagcttctc

SEQ ID NO: 34422 - DNA, 101 bp, rice(Oryza sativa)
  misc_feature (71): n=t or c
ggcattaattacctgaagttaggttcagcacgtaaagatgaatacactaagggatcgctacaagcagtgancatcttgacattcatctcctccttgacata

SEQ ID NO: 34423 - DNA, 101 bp, rice(Oryza sativa)
  misc_feature (71): n=t or c
atttccacgcgtgccaagtcagtctggacggtgaaaataatatcgcgggcgtggcgctttctctctctctntctctctctatatatatatatatatatata

SEQ ID NO: 34424 - DNA, 101 bp, rice(Oryza sativa)
  misc_feature (71): n=a or c
cgttgctaatggtccaatcatgtctccgttgtagttttgggctgtcagggtacaaaatcagacctgaaagnggtacacacatgatcaaattagggtggtaa

SEQ ID NO: 34425 - DNA, 101 bp, rice(Oryza sativa)
  misc_feature (71): n=t or c
gcaatatctgttgcgcttttgtatgaacatgctcaggggattaaatgtcatgtgatggttatagcagaggngtcgcgtttgtttgatctttcaaggcggaa

SEQ ID NO: 34426 - DNA, 101 bp, rice(Oryza sativa)
  misc_feature (71): n=t or g
ttatcaagcctgaccaaaccatgtggtaccgagcttgcaagacctgcaacaagaaggtgactgaggcaatnggatcaggatactggtgtgaagggtgccag

SEQ ID NO: 34427 - DNA, 101 bp, rice(Oryza sativa)
  misc_feature (71): n=a or g
gtgatgtgctggtagtttggacttacaactcgcgtgataattgattgattcccccaaatatggacaggacnagcaggtggatgggggaatgagatgctgga

SEQ ID NO: 34428 - DNA, 101 bp, rice(Oryza sativa)
  misc_feature (71): n=t or c
ttcccttttgtaactattttatcctcagccgattacttactaatcttgtctttgtagaaaaagagaattgntgtgaagaagaaatcggcaacaacaactct

SEQ ID NO: 34429 - DNA, 101 bp, rice(Oryza sativa)
  misc_feature (71): n=t or c
ttacactatgccatcacgttgttccactcccaaagatgtttgtattcttcacttgtagccaggatgctctntgggtcgaagaaccgtcttttgacatgaca

SEQ ID NO: 34430 - DNA, 101 bp, rice(Oryza sativa)
  misc_feature (71): n=t or c
aaggcgtcagctatgacacatgtaagtagcaaccgaatcgggtctatctttaggctgccgagacgcatcancgtctgcgtctggtgccgtgcctatgtgca

SEQ ID NO: 34431 - DNA, 101 bp, rice(Oryza sativa)
  misc_feature (71): n=a or g
gaatttcactgcaattctcgttttagactcgatcttttgatgatcaacaaagcgagcaagcgagtgagtcngtcggtaccagtcttgagagcggcgggcgg

SEQ ID NO: 34432 - DNA, 101 bp, rice(Oryza sativa)
  misc_feature (71): n=t or c
ccatcatatccatagtggcgtgctcgctctttctagtttctgtctgatgcttaattagctgctgctgctgntgctgctgcctattcagtattcactagtag

SEQ ID NO: 34433 - DNA, 101 bp, rice(Oryza sativa)
  misc_feature (71): n=t or c
aggtggctaagcaagtactccctccgtttaatttgtttattataccagcactcagttaagatacttactcncttcgtcacagaatataaatatttttagaa

SEQ ID NO: 34434 - DNA, 101 bp, rice(Oryza sativa)
  misc_feature (71): n=t or g
caacaccaggtgttgcagagataatcttttgacatgaatacggagtgtaatcctggaggagccatttgtcngagagatgaataagttgattatccaaacaa

SEQ ID NO: 34435 - DNA, 101 bp, rice(Oryza sativa)
  misc_feature (71): n=a or g
attctctctgataagcttttctgcctcggcggtctgctcagcaagtttcttttccaagatctccagagcgntggcagcgcgatccaaaggttggcggccag

SEQ ID NO: 34436 - DNA, 101 bp, rice(Oryza sativa)
  misc_feature (71): n=t or c
caaggcaaaaaattatcctaacggctccctggttgacacatgcttcagtggctgtgcatctccgggttggngttcaatagaatatggactagaactcctga

SEQ ID NO: 34437 - DNA, 101 bp, rice(Oryza sativa)
  misc_feature (71): n=t or c
tctgcccccttccctttcgatcggctgagtcgatagtgacagcaagcaaaaatggatccggcagtgtcggnggcggcgtgagcgacggcgtcggaagcggg

SEQ ID NO: 34438 - DNA, 101 bp, rice(Oryza sativa)
  misc_feature (71): n=a or g
tgggtcaagttaacgtttagtactttagtagtgtcgttggttgcaattctatcgtgcgtagagtggtggcnggtatatacgtgccggatggatcgccgaaa

SEQ ID NO: 34439 - DNA, 101 bp, rice(Oryza sativa)
  misc_feature (71): n=a or g
catccgtttgctgcccaagggcggtcttccgagatcactaaaagtattagatgtcagtgagagcaaaaacnaggagctcaaaagacagtgccgtaagctaa

SEQ ID NO: 34440 - DNA, 101 bp, rice(Oryza sativa)
  misc_feature (71): n=t or c
acctttgtatggcccatgtagtgctcctcttctaggacaatcatgttgttctgatcatcccatagagcccnacttagatctttcagcctagcgatacgcac

SEQ ID NO: 34441 - DNA, 101 bp, rice(Oryza sativa)
  misc_feature (71): n=t or g
ggatgatgattccaccattgacatcttgttcatttggtcatttccctttggtggttgactaactccctttncactgtttcccttttcagaatttttagtta

SEQ ID NO: 34442 - DNA, 101 bp, rice(Oryza sativa)
  misc_feature (71): n=t or c
ggtacataaacacaaacatctcaaatttcacttgccattttcgcagccggatcatgagctgatgatcgagntcgttttttttttctctttttcgtgtgatt

SEQ ID NO: 34443 - DNA, 101 bp, rice(Oryza sativa)
  misc_feature (71): n=t or c
gacgctagatttggccaaagagccagacctagaaactcttgtcacctccacagtgccattgccctgccggnaggtcaccacatccactgagctatcacagc

SEQ ID NO: 34444 - DNA, 101 bp, rice(Oryza sativa)
  misc_feature (71): n=t or c
gccttttctcgtaataggttgatgagctgaacactctcctcgggctgtgagagatcaatatttttccttcnacttattatttccatgagaacaactccaaa

SEQ ID NO: 34445 - DNA, 101 bp, rice(Oryza sativa)
  misc_feature (71): n=t or c
acactctgaggacttggaagctgcaacagaaggtttcagacaagagcattagctgcaagatcccaacatgngtggatctgatcaaagaagtgcactgtcac

SEQ ID NO: 34446 - DNA, 101 bp, rice(Oryza sativa)
  misc_feature (71): n=a or g
ttagtggatgggaaatgatttcccattagccaaacaggaccaaaataaataaaaatcacccccgtggcatntgcccccgcaacacagaattccccaattcc

SEQ ID NO: 34447 - DNA, 101 bp, rice(Oryza sativa)
  misc_feature (71): n=t or g
gatcatatatatatatggatgagctacctacactgatatgatccaccacaattaatgtgctcgagacgacncagcaacaaccgccgcgccattgatgacta

SEQ ID NO: 34448 - DNA, 101 bp, rice(Oryza sativa)
  misc_feature (71): n=a or g
cgatccattgccctaccacaaagaactggcatggaagaaatgaaaggctccgtagacacgaacccaaaaanagaaatttgctcgtacagtactaatgtaca

SEQ ID NO: 34449 - DNA, 101 bp, rice(Oryza sativa)
  misc_feature (71): n=a or g
atagtctcaagacaatattgtaaacacttttagcgttggtcgtaagtcgtgaaaagagatggaagaggggnaaaaaggaagaagaaagctgtggtttcact

SEQ ID NO: 34450 - DNA, 101 bp, rice(Oryza sativa)
  misc_feature (71): n=t or c
ctcctcgtgaagatcgatcgaccatcggcaatttcattcggtaatagttaagctaagatcaaatcaagatnggcgaaacgatggagatggtgctgcagagg

SEQ ID NO: 34451 - DNA, 101 bp, rice(Oryza sativa)
  misc_feature (71): n=t or g
atattcatcaaatggggcaatacctcattcaaatcatccgtgttaagccaacaagctccgtcttggttgtncaaaccatgagatttctgtagtttagtcaa

SEQ ID NO: 34452 - DNA, 101 bp, rice(Oryza sativa)
  misc_feature (71): n=a or g
aaacaacttgtcgcgcctaattatttacatcaacgtgctggttggaccagtagataaaaaacaggggagcngggagaagggctgaaaacgtgtcagcatgg

SEQ ID NO: 34453 - DNA, 101 bp, rice(Oryza sativa)
  misc_feature (71): n=a or c
gcacttggcacaggaattgcttcatctgggaggctacagtttgtccagtcgtcttcgacgagagcagcagnagcagcagcagaagctgcgtctgatacacc

SEQ ID NO: 34454 - DNA, 101 bp, rice(Oryza sativa)
  misc_feature (71): n=t or c
tggtactacgtactaaaatcaactgcatgtaggctttgcatctccttcagagttcatggaaacagtcaagntgctatctttacctcttcagcctcttcaga

SEQ ID NO: 34455 - DNA, 101 bp, rice(Oryza sativa)
  misc_feature (71): n=t or c
tgtgagtgccgttgagtgtcaacagctagtgtggctcttcacagtttttgggtagccctgacataacctcnggtgtcttttctgttcgttttaaccatttt

SEQ ID NO: 34456 - DNA, 101 bp, rice(Oryza sativa)
  misc_feature (71): n=t or g
attagtgtgggcatggtagatcgtacctattatgcaggaagcaaagcaatactgctcgtattgtggccagngtttacgattccaacaaagtccggtcggat

SEQ ID NO: 34457 - DNA, 101 bp, rice(Oryza sativa)
  misc_feature (71): n=a or c
ccaaagcacttatggcagtttcatgcagctattgcaatcttcccctgctccaaagcacttatggcagtttnatgcagctattgcaatctcctattgaatca

SEQ ID NO: 34458 - DNA, 101 bp, rice(Oryza sativa)
  misc_feature (71): n=t or g
aaattggacactgatgtactttggctatacatcatgcccagatattggcccagcagaagttcagaagatgnctgatgttgtcaagttgttaggtacgttac

SEQ ID NO: 34459 - DNA, 101 bp, rice(Oryza sativa)
  misc_feature (71): n=t or g
gaatggagcagtcttgtaatggatctgaatgtgcatcagcctcactatcgtatcctgctgtacttcaaggnttggcggaaccgatgtgtcggatcgaccct

SEQ ID NO: 34460 - DNA, 101 bp, rice(Oryza sativa)
  misc_feature (71): n=a or g
gcttggaatatttggaagcacaggaataatttggttttcaattctatcgtgccctcgacctcaagctgganatctgctcttaaagaggacctaagtctaca

SEQ ID NO: 34461 - DNA, 101 bp, rice(Oryza sativa)
  misc_feature (71): n=t or c
tattcactgttgctactgaacaaaggtgaccaaactactctgaaaagtaggatgccactgattaagctatngcttcagttgaatcataatatgctgatgat

SEQ ID NO: 34462 - DNA, 101 bp, rice(Oryza sativa)
  misc_feature (71): n=a or c
cgccacaccccattatccattcctaacccgaagaaaccgagaaggagagctccatctcccttatccatctnaacctcaccgccgaccgtgaagacgacgac

SEQ ID NO: 34463 - DNA, 101 bp, rice(Oryza sativa)
  misc_feature (71): n=a or g
agcaccacgttgtttccaccaataattgccaggatctcctcatcatcacgccacatttgttgtggcacccngagggagctaagaggaggcagacataggca

SEQ ID NO: 34464 - DNA, 101 bp, rice(Oryza sativa)
  misc_feature (71): n=a or g
agaaagcgagagagagagagagagagagatgaagaacggtgtctaatagattgcgccggagaatctcaccngagagggccgcggaggtggtgaagcggcag

SEQ ID NO: 34465 - DNA, 101 bp, rice(Oryza sativa)
  misc_feature (71): n=a or g
aaactctttgctcggaaaaaaaaaaatctcccaaccgcaatcctgatcacacccttccattgtttcttgtntgatgctgaaaacaatgagataaagaaaaa

SEQ ID NO: 34466 - DNA, 101 bp, rice(Oryza sativa)
  misc_feature (71): n=t or c
gagatataaactatctcatataatcagtcgataaactaaccgtatgggtatatgatacctgtaatctccanagtagtccatgagcccttcacactcgaaaa

SEQ ID NO: 34467 - DNA, 101 bp, rice(Oryza sativa)
  misc_feature (71): n=t or c
aggtatacatgtatttattgtctggcattacatagctatgatatgcttcacctgctctatgccatctatantaagaatttgagttactacagtgctactga

SEQ ID NO: 34468 - DNA, 101 bp, rice(Oryza sativa)
  misc_feature (71): n=a or g
cgctcgcgccggtgctaccagctccggattcctcctacgcaccacgaacgaatcctgcttcatggttgttnttctatgtatgtacgtttggatatataggt

SEQ ID NO: 34469 - DNA, 101 bp, rice(Oryza sativa)
  misc_feature (71): n=a or g
aaaaaaactgccataattgtctctgcagctacaagtatatgcagatacgctgggatggagtgagcataatngaagaacaataggcctttatttgatggctt

SEQ ID NO: 34470 - DNA, 101 bp, rice(Oryza sativa)
  misc_feature (71): n=a or g
gacagatgatgaaagtcgtgtttccaagaaattgctggccctaactagaatggggacttctccagcagctntagaggaaacaaggaattctcattccaacc

SEQ ID NO: 34471 - DNA, 101 bp, rice(Oryza sativa)
  misc_feature (71): n=a or g
catctgagaagtggtgcagcgcaagaggctttgctggatgctaatgattgcataaaactcaagcctgagtngactaaaggttactatcgcaaaggatgtgc

SEQ ID NO: 34472 - DNA, 101 bp, rice(Oryza sativa)
  misc_feature (71): n=t or c
acccacaacatcggatgtgttccataaaccccgaaataatgcttacacctcatgcgccaactctgtggatncgaaccatcaaactgaggaaaatccaactt

SEQ ID NO: 34473 - DNA, 101 bp, rice(Oryza sativa)
  misc_feature (71): n=t or c
cggtggcgcaggcgttctttatcgaggtggtcaggctacattacatccccaattcaatcgtcgttgcccangatccggtgaccaggagcatgttctggcca

SEQ ID NO: 34474 - DNA, 101 bp, rice(Oryza sativa)
  misc_feature (71): n=a or g
gtttggtttggtttgctcggttttgcgcggaatttgaccgaattttggtgaattttttgtaggtcaggtgncggtggtagccagcgacgacgacagggagg

SEQ ID NO: 34475 - DNA, 101 bp, rice(Oryza sativa)
  misc_feature (71): n=a or c
aaggggatcaatgagggaaacaccatttgctcacttgaagatttggaagggatccatatcagaccttatcntgattgtatatctcaaggggtggcaactgt

SEQ ID NO: 34476 - DNA, 101 bp, rice(Oryza sativa)
  misc_feature (71): n=t or c
ggaaagaaacagggataaagagagagggggaaaattgagggcagaagggttggttgtttaatagtagtagntgttgttgttgccgttgctgctgttgttgt

SEQ ID NO: 34477 - DNA, 101 bp, rice(Oryza sativa)
  misc_feature (71): n=a or g
atgcgaagcatttccatatgcgagggaccccactcattttgtttataaccaaaggtgttagcaagatagcnacgccatccaaacataacaactagtagtag

SEQ ID NO: 34478 - DNA, 101 bp, rice(Oryza sativa)
  misc_feature (71): n=a or g
agaacttagtaaaagtgatgattttccttattccgctcgccacttgtttttctcaggtgtcattttcctanagaaagtatatccaggtatccaaacattga

SEQ ID NO: 34479 - DNA, 101 bp, rice(Oryza sativa)
  misc_feature (71): n=t or c
ttgctcaacccgtagagccacaccgccaaatacaccaccaccgtgaacacgatgatcatcggctcgtacanggcgaagccgccgccgccgtcgtcgtcgca

SEQ ID NO: 34480 - DNA, 101 bp, rice(Oryza sativa)
  misc_feature (71): n=t or c
gaagattcatatacctgcgcgatacggcagaggcgaaaggcacaaccgcacaaaccgacgcagaaagtctncggtggccagaaaactctccggtggctcca

SEQ ID NO: 34481 - DNA, 101 bp, rice(Oryza sativa)
  misc_feature (71): n=t or c
tatatatttcagattattacaggtgaagtgaagttatgttagacaagctgcatgtccatgtccatctcgtngtcggagacctcatcctctacgtcgacata

SEQ ID NO: 34482 - DNA, 101 bp, rice(Oryza sativa)
  misc_feature (71): n=t or c
taaattcactgtcaatacaacatttaaaacagtgtaaatttgctcgctaatctattaggacgctgctgggncacgaaggcgggcgttgagccgctggctga

SEQ ID NO: 34483 - DNA, 101 bp, rice(Oryza sativa)
  misc_feature (71): n=t or c
ttatgtgatattgtagactagagttagatttgaaaattttcctgatatctccatataagtcgagccgccgnctccacgcaacacacgcaaaatcaatctag

SEQ ID NO: 34484 - DNA, 101 bp, rice(Oryza sativa)
  misc_feature (71): n=a or c
taggattcaaattggccatgctcaagatatttgaggccattgaggaaacagaggaatcgtaatgcttctgnagaaggctaagctcccataggactgaggca

SEQ ID NO: 34485 - DNA, 101 bp, rice(Oryza sativa)
  misc_feature (71): n=a or g
ataacaacaactatcactagctaattaattaattaaggaccaaatgtacggcgtagatcaagttgcggccnaggaagaactgctgcacgtttgcacttgca

SEQ ID NO: 34486 - DNA, 101 bp, rice(Oryza sativa)
  misc_feature (71): n=t or c
tgaaaacaaaacacacagaaaccacttgatattctcctcaatactcgtcctagtaataattacaggcactnctatagtcctatgtaggattagtactaagt

SEQ ID NO: 34487 - DNA, 101 bp, rice(Oryza sativa)
  misc_feature (71): n=a or g
taaagataaacaaatttgtcaatgcaagtatgcagcatttcaagattgatgtgcttgaagttaggagattngaggtgtgtttagttcacatcaaaattgaa

SEQ ID NO: 34488 - DNA, 101 bp, rice(Oryza sativa)
  misc_feature (71): n=t or c
tcatcttcatatttttgcagatcgataagcgagaaaaatgggagcacgctgcctcgcattgcttctcctcnatggcacgttgctgctgctgttgctgctgc

SEQ ID NO: 34489 - DNA, 101 bp, rice(Oryza sativa)
  misc_feature (71): n=a or g
tagagtaaaaatcatttcaataaaaaggcacatcgaatacgaaaatttcaagcacatcgaataagtgtccncgcatgtgcgcgggctatatttttagttat

SEQ ID NO: 34490 - DNA, 101 bp, rice(Oryza sativa)
  misc_feature (71): n=a or g
ttgcatgtgtgttaaaatcatatcgcaaattcaactatcctgtgcgtttattctcactggtggagaaaacntttgtagtcccagtttgtaaccccccttta

SEQ ID NO: 34491 - DNA, 101 bp, rice(Oryza sativa)
  misc_feature (71): n=t or c
actgctcccgtataatttatttcgtgcgtgcgtgtttaattgtcaacccatacacaacttgatctatgtangtattgtacggtcaagtaaaaggaaattgt

SEQ ID NO: 34492 - DNA, 101 bp, rice(Oryza sativa)
  misc_feature (71): n=a or g
acacttggccatcatgtcagaccagtccagtggttcggatggcggtaccacagccacgggcacgacaacancctcggcggactcagcggcagcaggcgcaa

SEQ ID NO: 34493 - DNA, 101 bp, rice(Oryza sativa)
  misc_feature (71): n=a or c
attcatacaagctttacacacttacacctagtgactactatagaagataaccactctgtactcagatctantgtaatgaaaccattctttattcattctgc

SEQ ID NO: 34494 - DNA, 101 bp, rice(Oryza sativa)
  misc_feature (71): n=a or g
ataattgtgtcgtcatatttttagttagatttcagtcagatttttgtgcgttggatttgtgttaagatccntgcttgaggttggaaggccgttggatctgt

SEQ ID NO: 34495 - DNA, 101 bp, rice(Oryza sativa)
  misc_feature (71): n=a or c
gagtcagatgaccttgaggagcttctcactgagttatacaccagcacctctccagactcagggcttgtaancttttttgtggaccctcgttcaatcgagtc

SEQ ID NO: 34496 - DNA, 101 bp, rice(Oryza sativa)
  misc_feature (71): n=a or g
attatgtaaaaaaaatatgcacatggcacagccaaacatcctacgggtttgcaatcccccaagtatctgantatcctattaataatactgaaagcactagg

SEQ ID NO: 34497 - DNA, 101 bp, rice(Oryza sativa)
  misc_feature (71): n=a or g
gtcaaaatcccttatccgtttggcattggcactggatgtgctattggtgaaggctttgagatcatttgcancaggaatgctgatggaattgaccagccatt

SEQ ID NO: 34498 - DNA, 101 bp, rice(Oryza sativa)
  misc_feature (71): n=t or c
acgtgtagcattgcgtgccttaggctacaaaattccaatcaataccgccggcgaagaggaccatcaggacngcctcgaacaaggccttgatcatctgcccc

SEQ ID NO: 34499 - DNA, 101 bp, rice(Oryza sativa)
  misc_feature (71): n=a or c
gcaacaagaagaagaagaagaagaagaggatgatgcaggacgcttcgtctcctctcccggtgttgagcagngcctatcagcctctcccgtggctgtacctc

SEQ ID NO: 34500 - DNA, 101 bp, rice(Oryza sativa)
  misc_feature (71): n=t or c
ttttagtcatcaactaggcaacgatgtatgaacatacagtatggctctgttcgatactcactgttgggaanggtttcctacagcacggaaaacggagcagc

SEQ ID NO: 34501 - DNA, 101 bp, rice(Oryza sativa)
  misc_feature (71): n=t or c
ctcggtcgcgggctgtatgcggctgatctggcgtcggcttgagcggaggtgttgacctagggtgcaaatcnggcggtgtggatggcaagtcccgtggcacg

SEQ ID NO: 34502 - DNA, 101 bp, rice(Oryza sativa)
  misc_feature (71): n=t or g
aattctgatgaactgatcgatggcctcaccttgtctagttagtcctggtttcatgagcagattaatctgtntacacggtgcctaggaaattacaagtccaa

SEQ ID NO: 34503 - DNA, 101 bp, rice(Oryza sativa)
  misc_feature (71): n=t or c
ggaatgaatgccattcttggtcacggcagtgtttgctcttcactcctttccatgtcgcaggtgcacacaanatgcatgactagttacgcaatgtgtcgctt

SEQ ID NO: 34504 - DNA, 101 bp, rice(Oryza sativa)
  misc_feature (71): n=t or c
actctattgaaggtggatgtgacatgtgctgtacgtgttggacgacgcgtctctctcgatgagatgctatngcgtggtccacgcacggggccctgcggacg

SEQ ID NO: 34505 - DNA, 101 bp, rice(Oryza sativa)
  misc_feature (71): n=a or g
atggggaaggaacatcgttacacatcagttgtaagcaataaagatggcattcctaccgcacatttgaacantctcagcgacgtccaagagagctgcagttg

SEQ ID NO: 34506 - DNA, 101 bp, rice(Oryza sativa)
  misc_feature (71): n=a or g
taggaggaggtcatggtagtgccactgaagatggggaagagaagacatcgatggggatggcgaggaaacgncagtggggatggggaggaggaggctgtggc

SEQ ID NO: 34507 - DNA, 101 bp, rice(Oryza sativa)
  misc_feature (71): n=t or g
atgctacaactagtactaacggctgatcacggtggcaactggaaacatggaggaacaaatttagaacttgntttagaacacaaatatagttttttagttat

SEQ ID NO: 34508 - DNA, 101 bp, rice(Oryza sativa)
  misc_feature (71): n=t or c
tatatcagcatcgtttctcctggcgtcactgcacccataactgccaagaattggagctgtctcttctcccnctctctctctctctctctctctctctctct

SEQ ID NO: 34509 - DNA, 101 bp, rice(Oryza sativa)
  misc_feature (71): n=a or g
cggtcgagaaaacaagctaaaatcgagcgtttttagatgccacatagagttttgagagcgttttaagaaantttaatggacttttagtatataatagatag

SEQ ID NO: 34510 - DNA, 101 bp, rice(Oryza sativa)
  misc_feature (71): n=t or c
gttgccgtggcggacggagctgacgatctccatctccgagacgagctcctccatcaccttgtctgaagatntcagcaccttcactgcaacctccttgccat

SEQ ID NO: 34511 - DNA, 101 bp, rice(Oryza sativa)
  misc_feature (71): n=a or g
tagcgcacctagttcagcccataaggatgaaccccatttgtttatacttcagcatttctccctcacgtacntgaaggctgtcttagaaacctgaggaaaca

SEQ ID NO: 34512 - DNA, 101 bp, rice(Oryza sativa)
  misc_feature (71): n=a or g
tctagcccaatagagcccaactcacccatgtgctgcgacatttgaagtatcgacgtccatgggcttcgctnctccatgagatccaccttgtcgccttcaca

SEQ ID NO: 34513 - DNA, 101 bp, rice(Oryza sativa)
  misc_feature (71): n=a or g
ggtcaatatctattactaaaagtttacaactctaggtcatgcaaaaaaatatcccgcagcaacgcgcgagntattatctagtatatatataggcagtccct

SEQ ID NO: 34514 - DNA, 101 bp, rice(Oryza sativa)
  misc_feature (71): n=a or g
tgtcattaactagtaataattatttcttgatctttaggttgttaagggtggttgtgcctatggatggagtntatgattgattagttagtcctttgctttga

SEQ ID NO: 34515 - DNA, 101 bp, rice(Oryza sativa)
  misc_feature (71): n=a or g
attctagctgatggcataaacataagcgaaaatatgaggaaagatgaggccattagcattgaaaatttacnattacgagtagaatttcgtgaaagaagaac

SEQ ID NO: 34516 - DNA, 101 bp, rice(Oryza sativa)
  misc_feature (71): n=t or c
taataactgtatttaactaactagcataagtatatcatccattagtagctagctccgagctaactaagtantcatccccagcagctggatcgaccgaccgc

SEQ ID NO: 34517 - DNA, 101 bp, rice(Oryza sativa)
  misc_feature (71): n=t or c
ccagttgataagctcacggttctgattggtccgatctttatttgacttgatgataattacccctccttccnaaattgatggaatttaaaatttctcaaatt

SEQ ID NO: 34518 - DNA, 101 bp, rice(Oryza sativa)
  misc_feature (71): n=t or c
gtggcactcatcatgcatatggtgtggctgatgatttggttgctgtttctatggattaattgttaattgcnttggcactcatgcacagggttagaaattcc

SEQ ID NO: 34519 - DNA, 101 bp, rice(Oryza sativa)
  misc_feature (71): n=a or g
ctgcccgagagatggctccgccactaggcctcatactttggcctaccagttgaaggtggttgtcacgtccngaaattcactagtaatttccgaacttattt

SEQ ID NO: 34520 - DNA, 101 bp, rice(Oryza sativa)
  misc_feature (71): n=t or c
cttgcccagctacctttgttagcaagcaatcaacatttgtgctggaggttctatctgaattgaggaatgcnttcatcagcctggttatgagcacctgcatg

SEQ ID NO: 34521 - DNA, 101 bp, rice(Oryza sativa)
  misc_feature (71): n=a or g
tgatgacacatggagactgaactgccagctcgctttatcactgccaacagtccaataatttcaaccatttnttctaattcctggactagaactgagacaca

SEQ ID NO: 34522 - DNA, 101 bp, rice(Oryza sativa)
  misc_feature (71): n=a or g
tgatatagctaacgatacctgtaacaatttatcgtgatgctaagatggatatgtcgtggctgtgaaaattnagcaatatgataatgacaaatggaaatggt

SEQ ID NO: 34523 - DNA, 101 bp, rice(Oryza sativa)
  misc_feature (71): n=t or g
tctaacaagttattttcaagtgcctagtgattaactagctagcgatgtcgtatacacttagggcccctttnatttgggggaaaaacataggaattttagag

SEQ ID NO: 34524 - DNA, 101 bp, rice(Oryza sativa)
  misc_feature (71): n=t or c
catggaagaatattttcaatctctcctcccaaacatagcaagtactactctagtccgaaaaattaaggggnggagtcaagacccagccaccacgggcgagt

SEQ ID NO: 34525 - DNA, 101 bp, rice(Oryza sativa)
  misc_feature (71): n=a or g
ccttccaagcttacggtttcagagttcgggcagattggtgaattggtgacgtccagtttgtctgtgaaganctttatcactgatccttcatcaatgatctt

SEQ ID NO: 34526 - DNA, 101 bp, rice(Oryza sativa)
  misc_feature (71): n=t or c
ctgtttttgaggtcaccggcaaggacaaaagcatgtctgatgacgatgacaacaccgatggtgctgacccngggaggttcaccttcgactcattgccggtg

SEQ ID NO: 34527 - DNA, 101 bp, rice(Oryza sativa)
  misc_feature (71): n=t or c
cacggaccctgagcatctcgcacacttaatatccccataggttggtactgttgggttgcttgtaacactgngtaagaacagtagacacgtcagtaataaga

SEQ ID NO: 34528 - DNA, 101 bp, rice(Oryza sativa)
  misc_feature (71): n=a or c
gtttattcgtttattagaactcactcaagacggagggaataactgaagactgaggccttctttagtttccnaaaaaaaaaaaaatcacccaccacatcaaa

SEQ ID NO: 34529 - DNA, 101 bp, rice(Oryza sativa)
  misc_feature (71): n=a or g
cctactctggatatttgtcaccgcctatttcatcgcaaatcttcaactaaattgttggcttgttctgcgtncaatgatcaaaatgtctatgagttaaggag

SEQ ID NO: 34530 - DNA, 101 bp, rice(Oryza sativa)
  misc_feature (71): n=t or c
acaacagcaagtatcagtacacccgagcgagctgagctatctatgcaaccatttttaccccaagaaaaacnaggtagttgatgatacctctgaatccgagc

SEQ ID NO: 34531 - DNA, 101 bp, rice(Oryza sativa)
  misc_feature (71): n=t or c
aagcaaatcctgcatgcactttggtaagctcgtacggtcactcttgaccatggaatggatcacttgaactnacctcattctttgcaaactgtcacaaatca

SEQ ID NO: 34532 - DNA, 101 bp, rice(Oryza sativa)
  misc_feature (71): n=t or c
tcgtaatcctatctccacctctcttcctctctcttccccatcttcagggccacggatgaagggagaagggnagcacgtggccactggacaggagctggaca

SEQ ID NO: 34533 - DNA, 101 bp, rice(Oryza sativa)
  misc_feature (71): n=t or c
taaggaaatagagggagtctcaccattgggcaaacccttttggactagttatgaacttagttacaccatcnatactctgtgtgtgataacttgattttaga

SEQ ID NO: 34534 - DNA, 101 bp, rice(Oryza sativa)
  misc_feature (71): n=t or c
atatttaattgattttgtctgaacttactcaataaggtgcataaaatgatatatgcaaaaggtggaaaggnagtgacattataaataaaaaagaacagaaa

SEQ ID NO: 34535 - DNA, 101 bp, rice(Oryza sativa)
  misc_feature (71): n=a or g
attggatctagcagtgccgcttccgctgctacctccgaaccgattgtaccccattgagccaatgccccttncaacatccaccagcaatccctccctctgga

SEQ ID NO: 34536 - DNA, 101 bp, rice(Oryza sativa)
  misc_feature (71): n=t or c
tcaccgcggaagtgaaacactgtgcactgttcgtatctttacactgaagctacaacctcttctgctcctcncagttttgatgttcttgcacaggatatgag

SEQ ID NO: 34537 - DNA, 101 bp, rice(Oryza sativa)
  misc_feature (71): n=a or g
catatatatctcactttgattactttccatccttattattttatgctccgcatgcagacaaatggcttcanacgactaccgtctccaatttacttccaacc

SEQ ID NO: 34538 - DNA, 101 bp, rice(Oryza sativa)
  misc_feature (71): n=a or c
tgagtgtaaggaatcccattgggattaccatcggggcaatagcagtaatagccacccctgtccgcattgangcattgagagtttctactgcaagcataggt

SEQ ID NO: 34539 - DNA, 101 bp, rice(Oryza sativa)
  misc_feature (71): n=a or g
gaacccttcagcctgcctcctgcaggggatctgctccggtcccgcatattgtgcccccagttatcccgagnagacactgatcgtcgccgactcctctcaag

SEQ ID NO: 34540 - DNA, 101 bp, rice(Oryza sativa)
  misc_feature (71): n=a or g
tcaacgagatgtttgatgccttccaacacatttgtttgtcaagtagaggtgaattcttccgtgtctgtctntaaaccgacatgtcacctgtcgaagatcac

SEQ ID NO: 34541 - DNA, 101 bp, rice(Oryza sativa)
  misc_feature (71): n=a or c
tgactcgtatcatccggtgccgtagttcgtgcatatgtggttcgaccgtgtcatgatggttacttggttcngtagcttgtttgccggactttttacatgta

SEQ ID NO: 34542 - DNA, 101 bp, rice(Oryza sativa)
  misc_feature (71): n=a or g
acgtaaaacctcatggtttttgccgtatcactttttattcgggtcagttccgcaggttaagtggtgctatnttatctgtatatttgtttactctgaaaaaa

SEQ ID NO: 34543 - DNA, 101 bp, rice(Oryza sativa)
  misc_feature (71): n=a or g
atggacaaatcctcattcctccaggctaatttcgtggggaaaaaagaagtccaacctgaaatttcaaaggnaaaattggaaccatgccattataattttat

SEQ ID NO: 34544 - DNA, 101 bp, rice(Oryza sativa)
  misc_feature (71): n=a or g
tgatgtcaataatggtggtgatcccaatactgaagagacgagcaaacttgagtctaatgaagttccaaacnactctgataaaaagtcaaattctacgtcta

SEQ ID NO: 34545 - DNA, 101 bp, rice(Oryza sativa)
  misc_feature (71): n=t or c
ctgttcctcctcgccgtatggttcaataacgacgacgacgagcacaaggcggtggtggtatggtacgcganggatccgagctctgcgtcggcagtgacagc

SEQ ID NO: 34546 - DNA, 101 bp, rice(Oryza sativa)
  misc_feature (71): n=a or g
gtacacagatcatccacaccaaaaatggacggtgtaggggtgggatccatccaactcttgtctaatccttnaacttgtacatcacgttggtgccaatctgc

SEQ ID NO: 34547 - DNA, 101 bp, rice(Oryza sativa)
  misc_feature (71): n=t or c
ggcgcacgagccaatgatgctatgcacggtgtatgcgtcgggcacaagctcgttgtcccgctgcatctccnggaagaggtcgagcgctcctccaatgagct

SEQ ID NO: 34548 - DNA, 101 bp, rice(Oryza sativa)
  misc_feature (71): n=a or g
atgggctctgctcagctttctgccctagctgtgtgtgtctgcattttcggatgcctagccatggctgatgnccagaacgtcactggaggtgatggttcaag

SEQ ID NO: 34549 - DNA, 101 bp, rice(Oryza sativa)
  misc_feature (71): n=t or c
gatgtcatgcaaacatcaaccgtaaatcgtgagtatttgtctttggtgaggagggcattcaaccttcattngttggttaaggaggcaatcagtgttgtaag

SEQ ID NO: 34550 - DNA, 101 bp, rice(Oryza sativa)
  misc_feature (71): n=a or g
cgaacacattcaatcagttatatacgagctgttcaaatcgtaagattatattgaacagtgaaagggacttnaacacaaagtgtttagtaaaacgtggccaa

SEQ ID NO: 34551 - DNA, 101 bp, rice(Oryza sativa)
  misc_feature (71): n=a or g
tggaaaaccgtccggtatacgtatacgtatacgccgagtatacggccacgagcgcgcgagcccatgagtcncagagcagctcatctctcctgttggccaat

SEQ ID NO: 34552 - DNA, 101 bp, rice(Oryza sativa)
  misc_feature (71): n=a or g
gttggagattttaggaacatttttgtggggttacttctatttctctttcctttcattttctcccttgtacntctgactcttttttgttgttgtttttatgc

SEQ ID NO: 34553 - DNA, 101 bp, rice(Oryza sativa)
  misc_feature (71): n=t or c
attacggctgatctggctcaacagggccatgattaatttacatgcaataagcaatagagactgcatcccantatataaatatacgagtagttagtaaacag

SEQ ID NO: 34554 - DNA, 101 bp, rice(Oryza sativa)
  misc_feature (71): n=a or g
tcggcgacgtggggcagctccatcctctccagggagaggatcttgtcgaccagattcttggacagcgcgancttcccgggcgggacgaggatcatctcctc

SEQ ID NO: 34555 - DNA, 101 bp, rice(Oryza sativa)
  misc_feature (71): n=t or c
cccttcctttgtccgtgtgcccgattgagtatgccttttaaatatccccgttcggctttctagtgtcctgntttagggagctaaagaaacgattgaaatat

SEQ ID NO: 34556 - DNA, 101 bp, rice(Oryza sativa)
  misc_feature (71): n=a or g
gtgttgctcgtggaattgcatttttacatgaggaaattcgccctccgattatccaccgtgacataaaggcnagcaacattcttcttgacaaggacctcacc

SEQ ID NO: 34557 - DNA, 101 bp, rice(Oryza sativa)
  misc_feature (71): n=a or g
tctttgacctgttgactggctgatacatcatgtgggacttacatgtcagccagcctgctgcttgtgttgcnggggcaacaggtggccttctcctcctcgtc

SEQ ID NO: 34558 - DNA, 101 bp, rice(Oryza sativa)
  misc_feature (71): n=t or g
cgcacgacggacgatcaggcgacagtacgcaacaccacgctgaaacgcaaaaccacctgcatgtcagtgtntcacggtcgtgtgcaggtctgggtgcaggc

SEQ ID NO: 34559 - DNA, 101 bp, rice(Oryza sativa)
  misc_feature (71): n=t or c
attgtccaaaacacccttcaaccgtcattgggaagaaatcaggaatgtacacatggaagatggtgatcaangaccttagaacggattcggccgaacccaga

SEQ ID NO: 34560 - DNA, 101 bp, rice(Oryza sativa)
  misc_feature (71): n=t or g
acggtgcactcctactgtcctgagtcaagccagatgctgcacacctgcaccagatttcagaagtactgtanctacatgagctccctgctatttgcaggcag

SEQ ID NO: 34561 - DNA, 101 bp, rice(Oryza sativa)
  misc_feature (71): n=a or g
tggtgtcataaaaatcaactaaggcagtacgcacccttgaaacaatggtaagaacaaaatctctacctacnagcaataaatgaagaactagatatatatac

SEQ ID NO: 34562 - DNA, 101 bp, rice(Oryza sativa)
  misc_feature (71): n=a or g
ccaacacacgtgttacctaatacatattcagggagatggagatgaggtgtccctaactatgctaaaaaggntaaaggcaagcaacaaatttgtgtgtgtaa

SEQ ID NO: 34563 - DNA, 101 bp, rice(Oryza sativa)
  misc_feature (71): n=a or g
ttgactggctattggagatgggatcgatggggtaggctactacggagagatatgatacagtgcgttacatntaccgcaaggtggaagggctttaacgtggg

SEQ ID NO: 34564 - DNA, 101 bp, rice(Oryza sativa)
  misc_feature (71): n=a or g
ggtgaacttgtcgccgttgccagcggtgaacggcggcgaactaggcttcgcagccaaaagagaaaagtaanagggaacgacggcgaagccatcggtggtga

SEQ ID NO: 34565 - DNA, 101 bp, rice(Oryza sativa)
  misc_feature (71): n=a or g
agatggaacattttttaacattacatcaaaaaccaagatatttcaaataacaaggatacgatcgcagtcgncatttgcataagccactcgtcgtctaaatg

SEQ ID NO: 34566 - DNA, 101 bp, rice(Oryza sativa)
  misc_feature (71): n=a or g
gtgacctctccactgcattgttctccgggaaactgacggaaaaactgaaggcatacactcttgagcagatngctgagatgctcggcattctcatgagcggc

SEQ ID NO: 34567 - DNA, 101 bp, rice(Oryza sativa)
  misc_feature (71): n=a or c
gggatgctagcaagatagcactttatcagtgcagccacatcaatggggtttacaccatcagggaaaggtgnacctgaatctgcaaaacaacaataaactta

SEQ ID NO: 34568 - DNA, 101 bp, rice(Oryza sativa)
  misc_feature (71): n=a or c
atcccaggacaaattggtaccccaaaaggaatggtcgcattatctctcagtggcaacaatctttctagttncatccctaacggtgttggcaatctaagcac

SEQ ID NO: 34569 - DNA, 101 bp, rice(Oryza sativa)
  misc_feature (71): n=t or c
ggtcacattagccttgtatatttcactaattcccctcaagtggctaccgcacaagacctgttgtttagacnttcacatagcagaaatttaaataaacataa

SEQ ID NO: 34570 - DNA, 101 bp, rice(Oryza sativa)
  misc_feature (71): n=t or c
cttacacacctccccagagcatagtcaagagctggcaggcattcttcagtgcaaactagaaacttttcctnagacatacctgggtctaccactgtcggcaa

SEQ ID NO: 34571 - DNA, 101 bp, rice(Oryza sativa)
  misc_feature (71): n=a or g
gaggatacgatgcatcagcaacaaaaaatggtcaagaaataattccagcatcaacgagctagatactagtngtagtagtaaagcgaaagcgaacaaaaagg

SEQ ID NO: 34572 - DNA, 101 bp, rice(Oryza sativa)
  misc_feature (71): n=t or c
atctagtttcaatgcagtttgtgttagttcacctgtatagctggatggtagtctggaatctactgtctgcntcagctgattttacactcgaaaatatactt

SEQ ID NO: 34573 - DNA, 101 bp, rice(Oryza sativa)
  misc_feature (71): n=a or g
tctcatagagctcccaacgcagttcttcaattcaaaaggactgcccaaacagaccaagggtatcatcatangtcatagcagcaaagttttttaacacaaca

SEQ ID NO: 34574 - DNA, 101 bp, rice(Oryza sativa)
  misc_feature (71): n=a or g
tactcactaccttaaaaaaatgtttcccatacaaatgactttagtaaatgatttactgataagtctacctntcaaacaaaaggtgcggacggataaactat

SEQ ID NO: 34575 - DNA, 101 bp, rice(Oryza sativa)
  misc_feature (71): n=t or c
agattaacccatcgatatatggatgatgctcgattcgatcaggatgtgagaatcggacaaggacgacgtangccttggcatgcaccactgcaaacggagtc

SEQ ID NO: 34576 - DNA, 101 bp, rice(Oryza sativa)
  misc_feature (71): n=a or g
ggcgccgtgcagcgcagggcaacgcaacgcaaagcgcaactcttcctcctcctgacacaattcacgcactnctcctctactctactcgtagctcagtttag

SEQ ID NO: 34577 - DNA, 101 bp, rice(Oryza sativa)
  misc_feature (71): n=a or g
catggaacacaaagactttatgtcagcaaagatatcacaatgtcaatggagggaagcacgtatcctgacgngaaagggatcttgaaggatgccttccagag

SEQ ID NO: 34578 - DNA, 101 bp, rice(Oryza sativa)
  misc_feature (71): n=a or g
acttagtgtatcgatccatacaagggttattcttgtcatagcttataacaagctcacccggtactgaatcntcaacaggaattgctgcaccctcgatgccg

SEQ ID NO: 34579 - DNA, 101 bp, rice(Oryza sativa)
  misc_feature (71): n=t or c
tgagaggatcatttcagaaggtgctcacgcctttctttatctgtgacatttagacatgcacaagtcagaanggacagtgcgaaatgttacagctgcagcct

SEQ ID NO: 34580 - DNA, 101 bp, rice(Oryza sativa)
  misc_feature (71): n=a or g
taaactaagaacagtacacaccaccatcctggagatctggtagtagcgataggccgccacggctgccttgnctagacatatatgaaaacaaatcacaacta

SEQ ID NO: 34581 - DNA, 101 bp, rice(Oryza sativa)
  misc_feature (71): n=a or g
gatatctatggggtcaagagcttgttacaaatgtagggttctgtgctagtatgacctctagaatggaaagnaaattgattttagaatatgagaactctttg

SEQ ID NO: 34582 - DNA, 101 bp, rice(Oryza sativa)
  misc_feature (71): n=t or g
cggatctcgatgttcttcagatgctctaatgggatcatctggtcctcccaatcctccggttggccacatanacagagaggatctgagcacactaagcactg

SEQ ID NO: 34583 - DNA, 101 bp, rice(Oryza sativa)
  misc_feature (71): n=a or g
ggaggccgagcggcgggcaatgaagaaggaagctgaggaggccacgacctaggtcatgtcgtctactaccngagcacaccaccctccctaaggcaccggtg

SEQ ID NO: 34584 - DNA, 101 bp, rice(Oryza sativa)
  misc_feature (71): n=t or c
ccatgcagctcttgttaagtactccctatgtcccccgcaaaaaaaaaagtactccctatgtcacaaaaaanaaatctaaaaccagatatgacatataccaa

SEQ ID NO: 34585 - DNA, 101 bp, rice(Oryza sativa)
  misc_feature (71): n=t or c
tagaaacaagggtttttatgggtggtggaagtagtaaaaagcatggtggacgttttctgacgagttaaganagcgagttattaactactccctccatctaa

SEQ ID NO: 34586 - DNA, 101 bp, rice(Oryza sativa)
  misc_feature (71): n=a or g
ctagcccaaagcccagctagagagaaaattaagacgagcctggtcttatgggaaattttgtttagttaccnattgttttaattattttctgataaaataga

SEQ ID NO: 34587 - DNA, 101 bp, rice(Oryza sativa)
  misc_feature (71): n=t or c
tcttgttggggttgagtggaaattccagctcgcggatgacccggtgggctccgaagatatgaggtagaacnttgaagcctatttggcctttttaaatagag

SEQ ID NO: 34588 - DNA, 101 bp, rice(Oryza sativa)
  misc_feature (71): n=a or g
gtgcgtacacggtggaggtcgctttcccgtgtgctgtgcggtgcgtgcaatccatcactcatcgcgatccntcgatgggtctagagatatgctagctaagc

SEQ ID NO: 34589 - DNA, 101 bp, rice(Oryza sativa)
  misc_feature (71): n=a or c
gatttcatcaatgcatattcctgagtaagatgttttctacggttagtcaactcaacatggagacaagattntgttttggtcatgggttgaagatttcagat

SEQ ID NO: 34590 - DNA, 101 bp, rice(Oryza sativa)
  misc_feature (71): n=a or g
cggcgcgcaagggtgacaacgatactaccagtactgatcgatcggcttgaccagctggagagaaacgaganacaatgcttacagccttcctacgtgacaat

SEQ ID NO: 34591 - DNA, 101 bp, rice(Oryza sativa)
  misc_feature (71): n=a or g
accctgtgaagccactttcagtttatcctgatcactgttgttgcaacagacatgcatgtgagcgtgatgcntcagcaaattcaacaatataatgtccatgt

SEQ ID NO: 34592 - DNA, 101 bp, rice(Oryza sativa)
  misc_feature (71): n=t or c
tcgacgccctcctcgtgttttctttgctttttcttctcccgttccggtgcccccctatctatccgtctctnattttttttcccatggaataaaccttcatt

SEQ ID NO: 34593 - DNA, 101 bp, rice(Oryza sativa)
  misc_feature (71): n=t or g
tttgaggtctggtagtatgtccgtgaagttcatggtctgttgtaatactgcagctattttatagagggtcngagacaaattcctcaaagagtgggatggat

SEQ ID NO: 34594 - DNA, 101 bp, rice(Oryza sativa)
  misc_feature (71): n=a or g
ccaagacttaggggggagaatgatggaataagtcttgtggctgaatagtttagtctttgcattcctttttnccttttcagcttttagatgctctagctttt

SEQ ID NO: 34595 - DNA, 101 bp, rice(Oryza sativa)
  misc_feature (71): n=a or g
aactaactacagggtactttgtcccaagagaatgtcaggtacacggagagacgtaccaaaaaaaacacccnaaaagaagaaaacatccgacctgccgggat

SEQ ID NO: 34596 - DNA, 101 bp, rice(Oryza sativa)
  misc_feature (71): n=t or c
ctttttctggctttgctcctctcttgaagcaaggcgaatgtaaagggtccctccattagtatcagttatgncatcacactgctgctgttttacatcgaaca

SEQ ID NO: 34597 - DNA, 101 bp, rice(Oryza sativa)
  misc_feature (71): n=a or c
aaggaccttgaggaatctgagcacatacatgcatacatgagcactgttttgatcaaacaaagtctgccgtngatggatagcatctttggttttcagccagc

SEQ ID NO: 34598 - DNA, 101 bp, rice(Oryza sativa)
  misc_feature (71): n=t or g
taacacctgggctccccaaggagaggaactaggacgtacataccctttgtcttgtaactcctttatctgcnttttaagttcctccaactcattagctggca

SEQ ID NO: 34599 - DNA, 101 bp, rice(Oryza sativa)
  misc_feature (71): n=a or g
cggttgcttcaaaatgttgtgttgatgacataactaccacttctgtgcaaaggttcgtgcttatgctgtcngcgtgtttgaaagggccagcgacgaagaac

SEQ ID NO: 34600 - DNA, 101 bp, rice(Oryza sativa)
  misc_feature (71): n=a or g
attatataagtttctaatttcgattgtttgtatttgtaggattccttgtatgatttgctggccctgattcnacattgctccgccccctttacctctttctg

SEQ ID NO: 34601 - DNA, 101 bp, rice(Oryza sativa)
  misc_feature (71): n=t or c
tgtgctttgagatatcagagctacataccagtgaactttgataaaggatcctcacgatttcttacggaatngttggcgctttgtgcctcctgaattgttat

SEQ ID NO: 34602 - DNA, 101 bp, rice(Oryza sativa)
  misc_feature (71): n=a or g
catacaaatacaactatcacatcactggtgcttccgcaactgtgatagggtttttaaacttgatatcaatntttttttcagggaattgtttcaacaccgga

SEQ ID NO: 34603 - DNA, 101 bp, rice(Oryza sativa)
  misc_feature (71): n=a or g
tgggaaaaggacgacatggatgggtctagcatcttaattagagcatctccaacaggggagcgtatcttatncacacaggccctcgcgtgtacacatcgtgt

SEQ ID NO: 34604 - DNA, 101 bp, rice(Oryza sativa)
  misc_feature (71): n=a or c
acgctccgttgaactggaataagagacgggttgggtgtgtgcgacaccacatggctactagcagatggggnaggtccgcaggtgatgagtgagcttattcc

SEQ ID NO: 34605 - DNA, 101 bp, rice(Oryza sativa)
  misc_feature (71): n=t or c
atcactatatcagatgctccgtctcaatgtatcgggtggtttgtgcagcatttcagttaagtcagtgttgnaaatggttatcaggtgacaaagataaaagg

SEQ ID NO: 34606 - DNA, 101 bp, rice(Oryza sativa)
  misc_feature (71): n=t or c
caagggtgcatagtctaccatgcctagaaacgttttatataaacgattttgataacttaccagggtttcgngatctcccgtcatcgctccagtcattggca

SEQ ID NO: 34607 - DNA, 101 bp, rice(Oryza sativa)
  misc_feature (71): n=a or g
tcctccatccatccgccacggattgtccgcttcctccttctcgcgcgatgaacttgcgctgaccatgctgnactcgcgctcctcctcgccccgattctcct

SEQ ID NO: 34608 - DNA, 101 bp, rice(Oryza sativa)
  misc_feature (71): n=t or g
tagtgaaaaaaagaatgatagtattgcaacagaaagagtcttggaggcatctcctcttccaaatcaaggcnttttcagacccgttcaacggacagaatatt

SEQ ID NO: 34609 - DNA, 101 bp, rice(Oryza sativa)
  misc_feature (71): n=t or g
tcccgtgcaagtacgtatccatgttcccttgcttcccataggcaactgctccttctccctcttacttttantggaagctactcccgctactaaccatgggt

SEQ ID NO: 34610 - DNA, 101 bp, rice(Oryza sativa)
  misc_feature (71): n=t or c
gtttctgctattagcaaatccgtagttcttggaatttgctgaccgttcttgaggtttttatatgacattgnattgtttgtcgaaaagcgaacatattattc

SEQ ID NO: 34611 - DNA, 101 bp, rice(Oryza sativa)
  misc_feature (71): n=a or g
aagctcgaggagatacggttgttggacagtgctggtagtctaatatccaccgtttttatattccaatactntattagtattatattacatccatgtgaaag

SEQ ID NO: 34612 - DNA, 101 bp, rice(Oryza sativa)
  misc_feature (71): n=a or c
aacacctggtacttgtaggtattagccgtgatatctctaggtatgaggcctgatactacaagtgccagccnaaaataacgtgttgcacgacttacctggac

SEQ ID NO: 34613 - DNA, 101 bp, rice(Oryza sativa)
  misc_feature (71): n=a or c
gtagcagtagtcgggtttccgaaaccgtcgggaccaggttatcacgtatcatgcggtaacggtaaaaaacngtatgaaacaatgtaaaatttaataaaaaa

SEQ ID NO: 34614 - DNA, 101 bp, rice(Oryza sativa)
  misc_feature (71): n=a or g
aacaatcaaggccttcccaatagatgagaaggttgtatgcaagcataatgtgaacagagctgtcagaaatnctttacgtgactggtcaatgtatgcagcag

SEQ ID NO: 34615 - DNA, 101 bp, rice(Oryza sativa)
  misc_feature (71): n=t or c
atgtacttctcagatagccatttagcagtacacctttttagcacccattacttcttacatttatgctcccnaagatatgtcttcaccatcattgacttgga

SEQ ID NO: 34616 - DNA, 101 bp, rice(Oryza sativa)
  misc_feature (71): n=t or g
ctatcatctctcttgaaaaagcaccattcacctgaacaaataatctcatccaatgcggtattttacgattncagtccatgacaagatttgaaatatcatca

SEQ ID NO: 34617 - DNA, 101 bp, rice(Oryza sativa)
  misc_feature (71): n=a or g
tgtgtcatgccacataaagtgaggctagcaattagttagccacaagtgtggctaagtttggcaagaatttnagtctatgacgtgtaggtccaatgactagc

SEQ ID NO: 34618 - DNA, 101 bp, rice(Oryza sativa)
  misc_feature (71): n=a or c
aggctcgccggggatggcggcctcaggctgatccagctctccaaatggtcggctgtcaatggctcgtgggngatgctggtcggggatggcgtccagctcct

SEQ ID NO: 34619 - DNA, 101 bp, rice(Oryza sativa)
  misc_feature (71): n=a or g
attaaatggcgaatgacacgagcgtccctcgtgttaggcgacatgatttgatagtccccatgaccaaggcnctcgtgggggaacttccaagacatgcattt

SEQ ID NO: 34620 - DNA, 101 bp, rice(Oryza sativa)
  misc_feature (71): n=a or g
ggagcatcatcgacttgttcttcttccacttgttctgtcaagaactcttcaacttctggatcaatgggagnaagattatcatcggcagatgttttggattt

SEQ ID NO: 34621 - DNA, 101 bp, rice(Oryza sativa)
  misc_feature (71): n=t or c
accagatagaatcattcaagggaacacccttctcaataatcagtatcttctcattgtttacgagaaccgcngagtgtgagctggttggatttggaggtgcc

SEQ ID NO: 34622 - DNA, 101 bp, rice(Oryza sativa)
  misc_feature (71): n=a or g
atatggtccagcatctattccaatttaccagtaaacttgactacatcatgagttctggtattttgtgttcnttgttctagaaccccgctttctttattatg

SEQ ID NO: 34623 - DNA, 101 bp, rice(Oryza sativa)
  misc_feature (71): n=t or c
tgtggtttggaatctttctttgagctttggtgaaatgttggtcacggccagaaattcatagaactcttccnattttgttgacaaggtgctttatgctgctt

SEQ ID NO: 34624 - DNA, 101 bp, rice(Oryza sativa)
  misc_feature (71): n=t or c
aacaaaaagaacaagatgaaaggaaggacgaagctgcttgagcagattaatgattgctggagacatacttngctgtgccgccaccctcgaggtccagtcga

SEQ ID NO: 34625 - DNA, 101 bp, rice(Oryza sativa)
  misc_feature (71): n=t or c
acaagattttagttaactggaacacatgcgatattacttcctccgcctaaaaaaacgtaacctcttactanaatatatcacatcttaatttttttataagg

SEQ ID NO: 34626 - DNA, 101 bp, rice(Oryza sativa)
  misc_feature (71): n=a or g
gggcttatctgtgcaacaaaagatcacactaaggaagaaatttcagaggcctgttttggtgagcttgtcantagtaaaatgatccaaccagtacatattga

SEQ ID NO: 34627 - DNA, 101 bp, rice(Oryza sativa)
  misc_feature (71): n=t or c
tcccttggttctgctggttttggagttgttgcatcatcaaattcatcaactgtgcctgttgggccaaaacntgagcgagcgtgggattctctgcgttgttg

SEQ ID NO: 34628 - DNA, 101 bp, rice(Oryza sativa)
  misc_feature (71): n=t or c
tatctagatttatagcactaacatgcgtattattccataccatattgttatattttagaatgagtagcttnagagttactggctccggcgttttctgcctc

SEQ ID NO: 34629 - DNA, 101 bp, rice(Oryza sativa)
  misc_feature (71): n=a or g
atatatatcagactactacgaccaggcctaattaatctacctaccaggtccaggtgatgagtgtacgtatncgcatgtacctatatatattagtttgtacc

SEQ ID NO: 34630 - DNA, 101 bp, rice(Oryza sativa)
  misc_feature (71): n=a or g
attcagcaaccgttccatcacttgaagaatattattccccatttgcaacacctcagcccatgtggcaggtncatctggttcgtcatgattttcaccatggc

SEQ ID NO: 34631 - DNA, 101 bp, rice(Oryza sativa)
  misc_feature (71): n=a or g
tcttgtcttatcctagcttaagctctgaattggggaagaacctgttatccgaacaaggtcttcaaaaaatnggaccaatctagaaaggattaaattgattt

SEQ ID NO: 34632 - DNA, 101 bp, rice(Oryza sativa)
  misc_feature (71): n=t or g
atgactcatatatcagagagacatccgttcttttaacttaagttagaggatcttcatccgtatttgactgntgtgagaaaaatattcatctacaagttgtt

SEQ ID NO: 34633 - DNA, 101 bp, rice(Oryza sativa)
  misc_feature (71): n=t or c
ataatttggtaccatatctatcgcatggtttatcacggacgaggttaacacgaaaaccacgtggttatcgngaaatataccgtggtcttaaaaactataaa

SEQ ID NO: 34634 - DNA, 101 bp, rice(Oryza sativa)
  misc_feature (71): n=t or c
caaagacaagaagacaagaacaaagcaagcatggagagatcagcactaacaatggcgctgcttctgcttcngctgctcgccgtgacggcgagcgcccaggt

SEQ ID NO: 34635 - DNA, 101 bp, rice(Oryza sativa)
  misc_feature (71): n=t or c
aatcatgtcgtctcctcctattgccggtccaaccaaggtagtgccaccagtctgaccgccgtgcactcacnggtgtaaccgttgaaaccagagcaaacaca

SEQ ID NO: 34636 - DNA, 101 bp, rice(Oryza sativa)
  misc_feature (71): n=t or c
atttggtgggtgtgcaaatctcacattgcttgattggtcatacaacagactacgtagcacagggttgccgnggagtcttgtcgattgccgtcgattggagg

SEQ ID NO: 34637 - DNA, 101 bp, rice(Oryza sativa)
  misc_feature (71): n=a or c
atcggctcttgctgcgtggagaagaaatcgtctccgggcaagtatttatagtagtgcggggatagacggcngggatgctcctggttttctggattggctcg

SEQ ID NO: 34638 - DNA, 101 bp, rice(Oryza sativa)
  misc_feature (71): n=a or g
gattcttctgagcaacagcaacagtttgagtatggtcccagaccaagttgttgaatttcttatgtcggcanatcagtttgtctgctatttgttgaatttga

SEQ ID NO: 34639 - DNA, 101 bp, rice(Oryza sativa)
  misc_feature (71): n=t or c
actgaatgcgccacaccatgcgcctccagtgcgcccttccagatgagatagcattctctatgtccaaatgntctcaccatcctaaaatatattgagaaatt

SEQ ID NO: 34640 - DNA, 101 bp, rice(Oryza sativa)
  misc_feature (71): n=a or c
tctcttccatgggtggatatgttaacagatagcagacgtggccctgattttgtagagcttctacatgaaangttgtctagtattcctggcaatgttggttc

SEQ ID NO: 34641 - DNA, 101 bp, rice(Oryza sativa)
  misc_feature (71): n=t or c
atcatctcctccgtgatcatcgtcatggctaccatcgtctgaaaaaagaatataaggagctagtactaaangagacacattctagcactaccaatttctca

SEQ ID NO: 34642 - DNA, 101 bp, rice(Oryza sativa)
  misc_feature (71): n=a or g
ttcaattgtactttttagagaacatgctaccggtagtatactattgaccctcactcccgtttagcaatttnaaaaacgtgcgcgtggaaaacaagagatgt

SEQ ID NO: 34643 - DNA, 101 bp, rice(Oryza sativa)
  misc_feature (71): n=a or c
acatttaaaataagatagattgagaagaaaaatctctaaactacaagggtggtccatcttctattgccctnttcttcaggaatctcatttccttcctcaag

SEQ ID NO: 34644 - DNA, 101 bp, rice(Oryza sativa)
  misc_feature (71): n=t or c
atacaagttctacgtacgtaatgcagtggtcaaagaccacgacaatcaagaaagtcccatttttaagacantgtactaccgaatgagtactagtacaagta

SEQ ID NO: 34645 - DNA, 101 bp, rice(Oryza sativa)
  misc_feature (71): n=t or g
atttagttttaaacacaactttcgtgagctaactgtaaagtgtgtatactttacgtcgctctcatacaatncatttatctaggtcttagtagtagacattt

SEQ ID NO: 34646 - DNA, 101 bp, rice(Oryza sativa)
  misc_feature (71): n=t or g
aacttctccatcatcccactcctatttttagactttttgggtaagagttttctcatgtaagtatttggtcngtagtactccatccgttttataagtcgttt

SEQ ID NO: 34647 - DNA, 101 bp, rice(Oryza sativa)
  misc_feature (71): n=a or g
tgaccaagagaaaacgaaacctccaaaaagaaaaagatagaaacgtgtttgatgatggcgtggcacgctcntggccccagcggccggccactacgtacaaa

SEQ ID NO: 34648 - DNA, 101 bp, rice(Oryza sativa)
  misc_feature (71): n=t or c
agtagggactggagtagagttgtcgagctgcttaaacctaactccacctctagttcattttgtaagagagnttcatacagctccaatcttattttaagtgg

SEQ ID NO: 34649 - DNA, 101 bp, rice(Oryza sativa)
  misc_feature (71): n=a or c
aaattttgaaccctgtccttctccaccttccccaagctgcaacgcaccccgaccacctcctccacgaagcncgtggccgccggagcgccatcctcgccatc

SEQ ID NO: 34650 - DNA, 101 bp, rice(Oryza sativa)
  misc_feature (71): n=t or c
ttccaaatcgacccgcgtaaacttaacgcttactccatccatctgtcgccgaagttggagtcggagtgcantcggccaccgtccgatgcagcccacttcca

SEQ ID NO: 34651 - DNA, 101 bp, rice(Oryza sativa)
  misc_feature (71): n=a or c
aacacgtacgtcgagtccttagaaaaggtttccaaatctaggccctcttttgtaatatctaactaatgagngtgcacgtgtaaagcacgtcgatactattg

SEQ ID NO: 34652 - DNA, 101 bp, rice(Oryza sativa)
  misc_feature (71): n=a or g
taactgatatatcttctctatcatccagtcaaaatgcttgactggggggaggatggccatagatcagaacnagaaatttcttcactaagagcagcatttgc

SEQ ID NO: 34653 - DNA, 101 bp, rice(Oryza sativa)
  misc_feature (71): n=a or g
cccgtacataaaggcttggacagctggacgcctggacatgaagctcgcaaattccttcgcaattcaaaccngagggcgcccatccaaatattttccaatgt

SEQ ID NO: 34654 - DNA, 101 bp, rice(Oryza sativa)
  misc_feature (71): n=a or c
tcttgccccttgctcttgttgttggacttgttatcttcttgatagaacttggtgcaagctacggttgatcncttctcaagcttcttcagcatgctttcacg

SEQ ID NO: 34655 - DNA, 101 bp, rice(Oryza sativa)
  misc_feature (71): n=t or c
ctataactaagataatagaccacaatgcgttggaggaatggaagaattaaaacatggatatcaataatatngtgataacacaggctttttgtgtaatgggt

SEQ ID NO: 34656 - DNA, 101 bp, rice(Oryza sativa)
  misc_feature (71): n=a or c
tgacggctatgcaaaacctggaggaagtatcgacgatcgatgtcagtgagagaagctcactcgacatggtntcagagctgctagttaagtcgaactaggaa

SEQ ID NO: 34657 - DNA, 101 bp, rice(Oryza sativa)
  misc_feature (71): n=a or g
ataataaatacatatatgtggcagcaagcttgttacgtaatctatgcatgcatgctcaacccgagctcatngaatcagacctaaagggactatctcacatc

SEQ ID NO: 34658 - DNA, 101 bp, rice(Oryza sativa)
  misc_feature (71): n=t or c
ccacatgtcgagagaggcccatcacaaccattggtagtgatctatctaggcccaatttacttcctccgcgnataaggtttccacatattcctctcacacat

SEQ ID NO: 34659 - DNA, 101 bp, rice(Oryza sativa)
  misc_feature (71): n=t or c
ttttgccaacaaacaagcaaagcaaggacaaaatcattacgtttgtaaccatgaggccaaagcaaagagtngcagccctatagtctaactcactgacgata

SEQ ID NO: 34660 - DNA, 101 bp, rice(Oryza sativa)
  misc_feature (71): n=t or c
cacagaaagaggactgtagcaaaacacgatcttcccagaagcaagggatgcattaattttctccccatccntaattagacagctgcgaccataatatgcag

SEQ ID NO: 34661 - DNA, 101 bp, rice(Oryza sativa)
  misc_feature (71): n=t or c
aactattcaaatacgctaccatgttctggatcctgctactcttggcaatattaggatggatttcatcatancctgtaaatttgatgtgcttatttgcttag

SEQ ID NO: 34662 - DNA, 101 bp, rice(Oryza sativa)
  misc_feature (71): n=a or g
ggtgaaattcgtagtcgatggagagaagaaagacaacaagatcaggccgcgcagacgtacgatcagtgagnaatgatggcagtgcgacggcagccaccatt

SEQ ID NO: 34663 - DNA, 101 bp, rice(Oryza sativa)
  misc_feature (71): n=a or g
acactcatatatgtgtgcaggtctgcacatgaacaaatcactgtacagcctgagctacacctgtgtcaccnctggcactgctggtttattcttcgtggcta

SEQ ID NO: 34664 - DNA, 101 bp, rice(Oryza sativa)
  misc_feature (71): n=t or c
agctatcggatggccctatcgattgattctggtgacgtcaaggcactgtacaattggggactagcacttanctttcgtgcccagctacttgctgatatcgg

SEQ ID NO: 34665 - DNA, 101 bp, rice(Oryza sativa)
  misc_feature (71): n=a or g
ctcacttttggtgaaatgatcagtagtgaccgaagccaaaagcatctatctgcgacccaagaaaaaggtgntcagctaccccgtccattggagtggagtgg

SEQ ID NO: 34666 - DNA, 101 bp, rice(Oryza sativa)
  misc_feature (71): n=t or c
tcatgtgtcatatgccatgtgtaaaaaaggatgagcggaaaaaaatacccttattataattaacataatgnattaaatgatcatacaaattaaccagtaga

SEQ ID NO: 34667 - DNA, 101 bp, rice(Oryza sativa)
  misc_feature (71): n=t or c
attctttttatcttattcattggattattgctgccgtgtgtgtctgcattcatatgggtgagtgtgcatgnatcacgtgttttaaagaaaatcagctttct

SEQ ID NO: 34668 - DNA, 101 bp, rice(Oryza sativa)
  misc_feature (71): n=a or g
ggaagaaatcattagccttttgtggatcaggcaaagattgtgatcaatatcgttgacacaaaaatactccnttatatgttgcttctgaccatcttctagtc

SEQ ID NO: 34669 - DNA, 101 bp, rice(Oryza sativa)
  misc_feature (71): n=t or c
tggcgaaaaatataaatcgacttggaatagtcagatcgcgatcttgataacctcgacaccaagctgtgtgncttgatgaatgcctgcgctttgtagaaaaa

SEQ ID NO: 34670 - DNA, 101 bp, rice(Oryza sativa)
  misc_feature (71): n=a or g
tcatttctccctaggaattgactggctgatggagctccctcatcgtcacgatcacatccgtcgcgtatatnctgaaagggaactctaacagctctctccta

SEQ ID NO: 34671 - DNA, 101 bp, rice(Oryza sativa)
  misc_feature (71): n=t or c
aatgtgtttggcctgatgttgaataaatatcttggtgagaagtcggccatgggctggatggatgctagaanaatcctcgacacacccatcatggtctggaa

SEQ ID NO: 34672 - DNA, 101 bp, rice(Oryza sativa)
  misc_feature (71): n=t or c
gacaagggggagggatggcgacatacttggagatgacaatgatgaatcttgtggagaaggaggggggaagnggcaatcggctggcattgggttgacagaga

SEQ ID NO: 34673 - DNA, 101 bp, rice(Oryza sativa)
  misc_feature (71): n=t or c
tacacttactctgaagttcgaaagatgactaaatcttttgcccacaccctcggaaagggtggatatggtanagtttataaaggcagcttgtctgatggcag

SEQ ID NO: 34674 - DNA, 101 bp, rice(Oryza sativa)
  misc_feature (71): n=a or c
atgctgataatgatacagctgagttagatgaggagaagcaaaagcttggtttcttctcctaaggactctantgtctgaagtctgaactacaatctttccat

SEQ ID NO: 34675 - DNA, 101 bp, rice(Oryza sativa)
  misc_feature (71): n=t or c
agctataatacaagtaaatcagatgtaacgatatgtaaattaaaatcgcgccatagtatagtgtggtatgngtcgcgagtttgacatgcgagtgacccgtg

SEQ ID NO: 34676 - DNA, 101 bp, rice(Oryza sativa)
  misc_feature (71): n=a or g
aaaatgactcagagtaactccgctctattttatcacattattcacgtgtaaggcagcgatggagagagtgnactatagtaaagttactcagtcgcacactc

SEQ ID NO: 34677 - DNA, 101 bp, rice(Oryza sativa)
  misc_feature (71): n=t or c
aacaagcgagggaacgacctccacagtgcaagaaacggcaacacgcgccctcgatttcgacgagataactngtcgcccagttggggggcgagcaaccaaac

SEQ ID NO: 34678 - DNA, 101 bp, rice(Oryza sativa)
  misc_feature (71): n=a or g
aactatgtatccctagtttgatctgtctgtcgctggctcgtcattctcacacctgatcgaacattgtctcntgagactggacgagatcgatgtgcattgcc

SEQ ID NO: 34679 - DNA, 101 bp, rice(Oryza sativa)
  misc_feature (71): n=a or g
catgctaacttgggacgagattcggataactaattgtttcataattcttgccagaccattagaaagcaacntacaggatatggcaagcgtcctaataagaa

SEQ ID NO: 34680 - DNA, 101 bp, rice(Oryza sativa)
  misc_feature (71): n=a or g
caatatcaacaggacaaacaagataccgatggatgagggcatcaaatctttgcctgatgcacagaactggnccaatcttccttgagtgtcaaaccttctgc

SEQ ID NO: 34681 - DNA, 101 bp, rice(Oryza sativa)
  misc_feature (71): n=a or c
tgttgactgcgttagtttaataaaagcctgccgcttgtccttaagaaaacaatgtgccatgaatccaaacntgtggcctgcactgatatgtacgtagtata

SEQ ID NO: 34682 - DNA, 101 bp, rice(Oryza sativa)
  misc_feature (71): n=a or g
tgacatcacatttttgttctctcccctcgtaagtgcgtacaactcggcggtgcattaatacagtactactngtacgtaactaccactttgttcatagatca

SEQ ID NO: 34683 - DNA, 101 bp, rice(Oryza sativa)
  misc_feature (71): n=t or c
attccaagatggtcattcaaaccagacaatgtatggcatttccgaggattcaatggatcatctctttgagnaggcagctaaacagtggcagcgggggcaaa

SEQ ID NO: 34684 - DNA, 101 bp, rice(Oryza sativa)
  misc_feature (71): n=a or g
gccctacgtacaaactaaacgtactccagattccagaagatcctcagtcctcactggcagactggcaggcncgctgctactcagattgcgatgggtttcac

SEQ ID NO: 34685 - DNA, 101 bp, rice(Oryza sativa)
  misc_feature (71): n=t or c
tacgtactctgcatctgatcgatcattctgtacataccaaattagagtactaatttgctctgaaaaagttnattcagaacatgtagtggtgcttgtggtcg

SEQ ID NO: 34686 - DNA, 101 bp, rice(Oryza sativa)
  misc_feature (71): n=a or g
aggagtagaacacccaggtgtctcctcaatcatgttgtcttcgtctttgctgatggatggttcagcattancatccttgctaggcatgttctctacagccg

SEQ ID NO: 34687 - DNA, 101 bp, rice(Oryza sativa)
  misc_feature (71): n=t or c
aaaggttgtattagcatctccttgtaaaatcaagtttcccctcctcttctctgccactcttctctgccacnagatctcctcctgaatgtaaatattttcca

SEQ ID NO: 34688 - DNA, 101 bp, rice(Oryza sativa)
  misc_feature (71): n=t or c
ttcgatctagctcgtttagctcgtaagctattggggcaagagagaagggagtttttttagctggcaaccangggaaggagctcaacctcatcggcaccatg

SEQ ID NO: 34689 - DNA, 101 bp, rice(Oryza sativa)
  misc_feature (71): n=t or c
ttatttcaaaaactcagctcaaaatggcttctaggtctcctgtgctgctgtttgcgttgatggtttgtctngtcatcgtctcgcagggtgtcctcgctgca

SEQ ID NO: 34690 - DNA, 101 bp, rice(Oryza sativa)
  misc_feature (71): n=a or c
acgaagagcagagtgggtatgcttccaagaacgcagagatcgtcctgcttaatgttgcgaacccctatttnaagatgcctgaggttaacaagcaaccccag

SEQ ID NO: 34691 - DNA, 101 bp, rice(Oryza sativa)
  misc_feature (71): n=t or c
gatgtggaccttgtagaaatactcatcccaatcaatcgacttggggtcaaaatcaaaacaatatcctccancgtttttgtcctcctgcttcctcatcgtaa

SEQ ID NO: 34692 - DNA, 101 bp, rice(Oryza sativa)
  misc_feature (71): n=a or g
tctgtttgtttgatcagacttcgcttttgaattccatgcccacaaatcaaaacagatgattctaatgcaantgcaaaacagatgactacaaaataaaagaa

SEQ ID NO: 34693 - DNA, 101 bp, rice(Oryza sativa)
  misc_feature (71): n=t or c
caacaataacgaagctttgtgctttcatgaacgcaattttacaaaaagtcatcgatccagaaagtttagcngcccttcagcatggcgtggtgcaatgcctt

SEQ ID NO: 34694 - DNA, 101 bp, rice(Oryza sativa)
  misc_feature (71): n=a or c
gctcttgtcaaacggattttacgttacatcaagggcacactacatattggtcttcacattggaatttcgcntcttgactcactgactgcttattctgatgc

SEQ ID NO: 34695 - DNA, 101 bp, rice(Oryza sativa)
  misc_feature (71): n=a or g
gatttctctaacatatgctgctgctgttgctgttgtttagacggaggaatcagatggggatgaggtattgngatggagaggggaattcttggttttttttt

SEQ ID NO: 34696 - DNA, 101 bp, rice(Oryza sativa)
  misc_feature (71): n=t or c
caggaaagatatcaatataccaggtcattagaatacttggcacttatgcccgattgagattagtactcatntgtgatgggctctagttagggtccgattga

SEQ ID NO: 34697 - DNA, 101 bp, rice(Oryza sativa)
  misc_feature (71): n=a or g
ttgtggtaggttcttggatcaatatatgggttcaacttcaaggccagttgatgatgaagttcttgatgccnccaccggggtacactactctgcgctccgtt

SEQ ID NO: 34698 - DNA, 101 bp, rice(Oryza sativa)
  misc_feature (71): n=a or g
atagatagatggtactcccccactaggatgatacttatttaagaggctagctacttgctccctccgtcccnaatataaacacaatattatatatatagtac

SEQ ID NO: 34699 - DNA, 101 bp, rice(Oryza sativa)
  misc_feature (71): n=a or c
attaattaatcagtgggacttttataattggtgctgtcatctcgccagcattgccccactagatccctacnagaataaattttggtttattaatcaaatac

SEQ ID NO: 34700 - DNA, 101 bp, rice(Oryza sativa)
  misc_feature (71): n=a or g
catcaatgtattgtaatatcatagctaggaaacacattagctaggcatgcaagaaaaattctggtccagcnacagtgctaaaataaaaagcatagaaaggg

SEQ ID NO: 34701 - DNA, 101 bp, rice(Oryza sativa)
  misc_feature (71): n=a or g
caggtttagcagtccagcaccaggaatgcggaggttgctcttcagggacgacaaggcatggagaggtatcngcatcatgaaggtaaaaccagttgtccctc

SEQ ID NO: 34702 - DNA, 101 bp, rice(Oryza sativa)
  misc_feature (71): n=a or g
aacattgtgataggaatagacaaaggtaaaattgctcaagacttcaaacctactcccaaaataagcaaacntaaaataagatggaaaataacctagtataa

SEQ ID NO: 34703 - DNA, 101 bp, rice(Oryza sativa)
  misc_feature (71): n=t or c
agtccactgaagagccaagctaataccttccctgcaggcaagaagctctgcttccaacgggctgctacacngattaacaaaaccacaagcagagaaaatta

SEQ ID NO: 34704 - DNA, 101 bp, rice(Oryza sativa)
  misc_feature (71): n=a or c
acattgcagcttgtatctacgctcctggatgctgatggaaagccgaaaagaggacacccactcctagttgnagatgatgatcaagatcattttgttgatat

SEQ ID NO: 34705 - DNA, 101 bp, rice(Oryza sativa)
  misc_feature (71): n=a or g
gggataaggcgcgatgatcgggagcgtatctctgcttagactttaactactagatcgctcgcgaatctgcntgagagatgaggaattatacaggttcgggc

SEQ ID NO: 34706 - DNA, 101 bp, rice(Oryza sativa)
  misc_feature (71): n=t or c
ttttgacttgaagacggattatacctaccatgagacggctatgtatagcccggaagtatgatcccctatanataataataataataataataataataata

SEQ ID NO: 34707 - DNA, 101 bp, rice(Oryza sativa)
  misc_feature (71): n=t or c
gaatatactgcagcatttaatatgatgtgtgcgtttcaaattagagtctattcagttcaatctttcactcnggacttgcaggctgcagtatacctaaattt

SEQ ID NO: 34708 - DNA, 101 bp, rice(Oryza sativa)
  misc_feature (71): n=t or g
tgtcatgtttgagttgggagccaccagatatgtggtctaaagtacatggcaccggcactagtcctgagatnaaaaacgtgaaggctattgattgtttatct

SEQ ID NO: 34709 - DNA, 101 bp, rice(Oryza sativa)
  misc_feature (71): n=a or c
aatgtacttgtaatgttttgttttccttgctatgtatatgcaggcctgatgacaaactggacgaccagaancaagagctggccaagagcaaggatacacca

SEQ ID NO: 34710 - DNA, 101 bp, rice(Oryza sativa)
  misc_feature (71): n=a or g
ctggtcatgttattagagcctagagggaataagagttcgttcaagctgttataggtgtcagttctttcatnctggtaagatcagtcagctcaacatgctgg

SEQ ID NO: 34711 - DNA, 101 bp, rice(Oryza sativa)
  misc_feature (71): n=a or g
atcattaatttctactatatctttcgacgtaaaagttacgattctttcttgggtgtgatatgcacggaaantattttctacatctagtacttgaataggga

SEQ ID NO: 34712 - DNA, 101 bp, rice(Oryza sativa)
  misc_feature (71): n=a or g
tcatattggacgaaaccactgagagatccgatttactctggtttaatagatgggggatactctctatccgnttttgtggttgggaggctctgcactcagat

SEQ ID NO: 34713 - DNA, 101 bp, rice(Oryza sativa)
  misc_feature (71): n=a or g
cccacacatgcctaatcttaattgggtcaggatgtcacaccaaccataccattttttttttggcaaagttnccaaaggtgtgcatacatttagtttttttt

SEQ ID NO: 34714 - DNA, 101 bp, rice(Oryza sativa)
  misc_feature (71): n=t or c
aggcttcttaagtggttgtagacctatcatttttcttgatggatgccacatcaaaaccaagtttggggganatttattgactgcagtaggcattgacccca

SEQ ID NO: 34715 - DNA, 101 bp, rice(Oryza sativa)
  misc_feature (71): n=a or c
gtgtgattgcatgctagaatcaggaaatttatagacgtgtttgcgttttgaatgtgttatttgactatatnaaatattttttaggctctaaccgcatcggc

SEQ ID NO: 34716 - DNA, 101 bp, rice(Oryza sativa)
  misc_feature (71): n=t or c
gctgttgttggtcatgcataatttctactcgttcagtagcagtgcatggctaaagagagaagatggctagntctcatattttaagatagagagccaaccat

SEQ ID NO: 34717 - DNA, 101 bp, rice(Oryza sativa)
  misc_feature (71): n=t or c
taatacaccattaatgtatgatcctacatctcatacacacacaatgcattggattctgtgctgcagctggntataaatcctgctttccttctctctcttat

SEQ ID NO: 34718 - DNA, 101 bp, rice(Oryza sativa)
  misc_feature (71): n=a or g
cctcctgttgttccaagactgcctttatcttgggtatgctgtagcccctatgccatcatcgggcctagccncgcacttgttagatcgatagtacggaagct

SEQ ID NO: 34719 - DNA, 101 bp, rice(Oryza sativa)
  misc_feature (71): n=t or c
acatatatatttccagcacccaaattaaactaaaatgcacttaattaaagacgtcagctatagcctatagnagcgagcatataactataattactaattaa

SEQ ID NO: 34720 - DNA, 101 bp, rice(Oryza sativa)
  misc_feature (71): n=a or g
gttgcggctgaaatcatcatcttttgtggtgctttcggacggattagttgattgaaatggtgagtttccancttttttttcctaaaaggaaaaggttccca

SEQ ID NO: 34721 - DNA, 101 bp, rice(Oryza sativa)
  misc_feature (71): n=t or c
gatccttcttccatggcggctagctgatcatatctaatagtagttcaggaggttgccactgatgatgttgntgctgccattgcaggggaagcagccgcagg

SEQ ID NO: 34722 - DNA, 101 bp, rice(Oryza sativa)
  misc_feature (71): n=a or c
tagggccatggagatggagtcacgcgttctcagtgggaaggattgagaattagtgaattcaccgtatgatnacaaacactaggaaatggccaaaagacaaa

SEQ ID NO: 34723 - DNA, 101 bp, rice(Oryza sativa)
  misc_feature (71): n=a or g
aacgggctggcatcggcggtgctcgatagcggcagcgccgacgacacgtcttccttcgatcaataatgtgnttgtgcgtcctattgatcaatcgatggcag

SEQ ID NO: 34724 - DNA, 101 bp, rice(Oryza sativa)
  misc_feature (71): n=t or c
tgcctcgtaggtggacaccatgtactcaagatcaacgatcttagcctctatattcctcttgctcctcatcncactccaatacgtgtggatgtcctctttga

SEQ ID NO: 34725 - DNA, 101 bp, rice(Oryza sativa)
  misc_feature (71): n=t or g
gcggaagtgattttattgtaatgaaatttcgcaaaacaatttgcgcggcatttgagttggtatggaaaatncatagggaattatatttaaaattaattttg

SEQ ID NO: 34726 - DNA, 101 bp, rice(Oryza sativa)
  misc_feature (71): n=a or c
atcattatttttgctggagagtatgcatgctagaaagctcttccgcatgtccatcgtttcctaacaagacnatgtgtacaaattaaatgtatgataatagt

SEQ ID NO: 34727 - DNA, 101 bp, rice(Oryza sativa)
  misc_feature (71): n=a or g
aaactaaaaatccccagaaccaaaaccctagctcccatccgccatcaacaatgtcgacgccgcaaacagcncctctactggggccgtgggtgatagatcca

SEQ ID NO: 34728 - DNA, 101 bp, rice(Oryza sativa)
  misc_feature (71): n=t or c
acgggcatgaattttactacgaagatgggaacccttattacgctgctgatagggaggagaaatgggagaangaaatcctaggaaagatggagtttccagtg

SEQ ID NO: 34729 - DNA, 101 bp, rice(Oryza sativa)
  misc_feature (71): n=t or c
tagtcaattatgtgcaactatcattcaatcctttctttgtacacgtcaaggtcaagctaatcaaatccatntttttcttttagtttacctttacaacccac

SEQ ID NO: 34730 - DNA, 101 bp, rice(Oryza sativa)
  misc_feature (71): n=t or c
cagcaagttgttgttatgaaattggtgcttgctgtttaatcggactttgcagaatcggctgaacaactggntgattagggccaaacatagctgaaacatgc

SEQ ID NO: 34731 - DNA, 101 bp, rice(Oryza sativa)
  misc_feature (71): n=t or c
ttgtgttgagatccagccatggactcgtggaaaaaaagatcgcgttctacatggctaatatattttacttntgctcgaattgggggagaggatcggtcggt

SEQ ID NO: 34732 - DNA, 101 bp, rice(Oryza sativa)
  misc_feature (71): n=a or c
gctcccgtgttattctggtctggcacatcgcaacaagcctatgtgagatcaagcttgccaatgaccataanatcaacttaacaacaatgtcaagattatca

SEQ ID NO: 34733 - DNA, 101 bp, rice(Oryza sativa)
  misc_feature (71): n=a or g
ttaggcgaagcaaacgtaccaaattataatgggtgacgcccagcggcggcagcttctcctcgtcgccctcntgctcgccgccgccgcagaccactcgctgg

SEQ ID NO: 34734 - DNA, 101 bp, rice(Oryza sativa)
  misc_feature (71): n=a or g
gattggcatactataaattaaagttgcatttccatttagaaaacctaagggactgtttagttggtgaaatnaaaatttttgagtgtcacatcgaacatttg

SEQ ID NO: 34735 - DNA, 101 bp, rice(Oryza sativa)
  misc_feature (71): n=a or g
gagcccgatgtgatagagacaaagtacatacccttctacaaactacctctataagcacgctcgttcctatnaacgtacacacgcatactctgtttctataa

SEQ ID NO: 34736 - DNA, 101 bp, rice(Oryza sativa)
  misc_feature (71): n=t or c
gattgtagaaagcctcctgtcatgtgctaactaagaaatacggagaattggaataattggatcatgactcncgtgtcgcctctctggtgacccgggaggcg

SEQ ID NO: 34737 - DNA, 101 bp, rice(Oryza sativa)
  misc_feature (71): n=a or g
aacctatctgaaatctattttctccttgttcttttggattttgagaggcaggacacaacagaactcaggcngtggaggcatgacatccagggccgagaggt

SEQ ID NO: 34738 - DNA, 101 bp, rice(Oryza sativa)
  misc_feature (71): n=a or c
tatattcagctatctattcgggagtcttgtctttcagctgctccgaccttggtgatagcctcacggtatgntgtgtttgacagatcctagttggatgcagg

SEQ ID NO: 34739 - DNA, 101 bp, rice(Oryza sativa)
  misc_feature (71): n=t or c
gctttgtggtgtgatgacatagtagtgtctggaagcaatattttggagcagaagcccaaaatactccctcnatcccaaaatgtttgacgccgttgactttt

SEQ ID NO: 34740 - DNA, 101 bp, rice(Oryza sativa)
  misc_feature (71): n=t or c
ccaccgaccaccgtaccacgtttgtatctgatcaacgctgatgcaaagacgacggtcactcgttcttcgcngtcgccgttttgtcagccatcaatattttc

SEQ ID NO: 34741 - DNA, 101 bp, rice(Oryza sativa)
  misc_feature (71): n=t or c
ctagtataagagtaatttcgacgatttccatagtactgtacttaattagtactacacagttgtcagctttnaagacgttttaactttgatcaaaactgttt

SEQ ID NO: 34742 - DNA, 101 bp, rice(Oryza sativa)
  misc_feature (71): n=t or c
acaagaagaagtttttcaaaagaagaaaacacacacctaagctagaagaagatggttagtcatgcaatatnaaatgatcaggttgttagttgaagcaaata

SEQ ID NO: 34743 - DNA, 101 bp, rice(Oryza sativa)
  misc_feature (71): n=t or g
ggacggcatcttcctgcgcaagaggaagaagctgagcgacgcgatctgggacatgatggagaaggttcgancctccttcttgcaggatggatgctggcaag

SEQ ID NO: 34744 - DNA, 101 bp, rice(Oryza sativa)
  misc_feature (71): n=t or c
tcaatccctgacagtacacggagtgacttcattgtgcctttagctttttcttgggacaagaatcctttctntgcaggctcctttgttttaccttgaggtga

SEQ ID NO: 34745 - DNA, 101 bp, rice(Oryza sativa)
  misc_feature (71): n=a or g
ctcattatcatgcccaaacccaagttgaactcccaaagtcctaacagacttgcaagattgcccttcactcnatagtggcacatgggagttcaggtcaatgt

SEQ ID NO: 34746 - DNA, 101 bp, rice(Oryza sativa)
  misc_feature (71): n=a or g
gagaagggacgttgcagcattgtttgcataagtgtacaacctactatcctatcaaatcaaatatcatcatnagtgctgacttacataacgaatcgagagct

SEQ ID NO: 34747 - DNA, 101 bp, rice(Oryza sativa)
  misc_feature (71): n=a or g
tctcctttgttcagtaaacctagaaaatgacccagcaggtgatttcgcctcagtttcatcagcatgctgcnctccaactcggacaccggtttctttctttg

SEQ ID NO: 34748 - DNA, 101 bp, rice(Oryza sativa)
  misc_feature (71): n=a or c
tatacggtccaatcccggcagagctgcaggggctgtacagtcttgacagcatgaatctctgtcacaattanctcactggatcgattccggacgatctgttc

SEQ ID NO: 34749 - DNA, 101 bp, rice(Oryza sativa)
  misc_feature (71): n=a or g
tgcaacaaccgcgcacatgtttagtttagccacttctcgttggccgtgcgttgcatctgggacaagctggngcttcttgcttcttgctcgctcgctgctgt

SEQ ID NO: 34750 - DNA, 101 bp, rice(Oryza sativa)
  misc_feature (71): n=a or g
cgatggtgggagggtataactgtactttcgcatatcaaattggaggggaaacgccacctccatccaccgtnctaggcgctgtccccgctgcaaatcaagca

SEQ ID NO: 34751 - DNA, 101 bp, rice(Oryza sativa)
  misc_feature (71): n=a or g
tatgtcacaactcacaacaaaatttaaaatctaccggcacccatattgatttctaccacgatgaagatganctgtaaaacaaacaacattggtatgttcca

SEQ ID NO: 34752 - DNA, 101 bp, rice(Oryza sativa)
  misc_feature (71): n=t or c
gatggtgttgacggcagggaaaaaacaaagctactacctaggagttggtagctggtggtagtggatccaanagcaggaagccaccgaagactggcgaggcc

SEQ ID NO: 34753 - DNA, 101 bp, rice(Oryza sativa)
  misc_feature (71): n=a or g
tattataccgttaaattatgtgtattgaaatatcgctcgaggaaagaaagggtcgagcggctggcagccgngactaccacgtgagctacacacgtgggcaa

SEQ ID NO: 34754 - DNA, 101 bp, rice(Oryza sativa)
  misc_feature (71): n=a or g
agcaaccactttaaaatggtttcttcttcatatttacagtctcgcccagataaggttattaaaaatgcgcngaggtatgagtgacctgctacatccaatag

SEQ ID NO: 34755 - DNA, 101 bp, rice(Oryza sativa)
  misc_feature (71): n=t or c
ggcctgtcctcatcagatgcctccatttgagcctctggcttcttcagcaattttgttggaagaaaaccgangactctaagctacttgcaattaattcagta

SEQ ID NO: 34756 - DNA, 101 bp, rice(Oryza sativa)
  misc_feature (71): n=t or g
attcaaggcttttgatggataaatctgaaatttttagctaggcaagaaatgcataattgataaaaagcaangagaaacaaaagacaatggaaactaaggag

SEQ ID NO: 34757 - DNA, 101 bp, rice(Oryza sativa)
  misc_feature (71): n=t or g
tatgttaaatagagatgaagcgttacaccttttatgtcaactttcttgaaaaagaaaacaaccaccttttntataagcatgtaagaccgatgtaggttttc

SEQ ID NO: 34758 - DNA, 101 bp, rice(Oryza sativa)
  misc_feature (71): n=t or c
tttgaaactaaaacaaggccttggttaaaatgaccaaaatacccaggagtacacctcaacaccatctcctngactccttcccattctctgtctgccccatt

SEQ ID NO: 34759 - DNA, 101 bp, rice(Oryza sativa)
  misc_feature (71): n=a or g
gacgaactatgggccaagatcgactgggatctctacaactttggggactgggactacgatgacccagaatncgttgtgtacctgtgatgatggtgatttct

SEQ ID NO: 34760 - DNA, 101 bp, rice(Oryza sativa)
  misc_feature (71): n=t or g
tgttagatgggttgtagaggtagacaacatgtgataacagccctatccatcctttataatcctccacattnttggtatttgttacacacacagataaattt

SEQ ID NO: 34761 - DNA, 101 bp, rice(Oryza sativa)
  misc_feature (71): n=a or c
gttttctcaaaaacatttttctagtgaactgtttagaccactcattttaagctatctgttaatcctgtttnttaaaatatttatttttcatttaatcaaat

SEQ ID NO: 34762 - DNA, 101 bp, rice(Oryza sativa)
  misc_feature (71): n=t or c
gtaaagctactgaaaaagaagttctgaagccaacaaataagatttttcttttctggccggctcataataanatgtatagagccttttatgtcaattttata

SEQ ID NO: 34763 - DNA, 101 bp, rice(Oryza sativa)
  misc_feature (71): n=t or g
tatttctcaatataaatgaaactgcaattgaagggaatgaaggcttgtgtgggggtatacctgatttgaanctgcctctttgctccactcactccaccaaa

SEQ ID NO: 34764 - DNA, 101 bp, rice(Oryza sativa)
  misc_feature (71): n=t or c
gtttgcagttatgtcactaacatgtgagccacagatcctctaactttatgtgcagtctgcagttgtgccantaaaatgtgggcgcagactgcacaaagtgg

SEQ ID NO: 34765 - DNA, 101 bp, rice(Oryza sativa)
  misc_feature (71): n=t or g
acattttgaggaaaaaaaaagagaaaatcattctgctaatgtaatactctcccgggctataatatactcanatactagtttcaaagttttttttcaaactt

SEQ ID NO: 34766 - DNA, 101 bp, rice(Oryza sativa)
  misc_feature (71): n=a or g
tttgcactctgtttagtgttaggttattagttccctaatttttgcactcttcttagtggtagccatgcctngtaggtggagataatttcatttacggcgtt

SEQ ID NO: 34767 - DNA, 101 bp, rice(Oryza sativa)
  misc_feature (71): n=t or g
attaagaaattggagagatttggaactgtcaggcccattactcttgacagaatggtgcatgaggagtacanatacctattgaagacgctcacatttggaag

SEQ ID NO: 34768 - DNA, 101 bp, rice(Oryza sativa)
  misc_feature (71): n=a or g
gattgcggcatggcggtggacataacgctagcacacttcatccttgcaattgaggcaacgttgcaagttcnaatatatgaactaaaggatggctgtggcag

SEQ ID NO: 34769 - DNA, 101 bp, rice(Oryza sativa)
  misc_feature (71): n=t or c
acgaggcaggaattcatttcaagttgagtgatagaaagggatttgtagggggggtcagctttgaaggaggngtactcagtattcctcgggtcctcttctgg

SEQ ID NO: 34770 - DNA, 101 bp, rice(Oryza sativa)
  misc_feature (71): n=t or c
atgcttacgtcgtaaagtacgttcattcaggggggacgtttcatcgatcattcgttgtcgaaaataaaggngagcggaaaccaccacgcagcagctgtttc

SEQ ID NO: 34771 - DNA, 101 bp, rice(Oryza sativa)
  misc_feature (71): n=a or g
catgttgtgttcttgatgttcatgttttgttcatgtgttcttgaagtgaaattgctcgatgcatcgggtcnaatcgagctgatgcatcgagccggtttttt

SEQ ID NO: 34772 - DNA, 101 bp, rice(Oryza sativa)
  misc_feature (71): n=a or g
tatcatgcataccttcgtgcggttctgtgagcttttatcatcctttgtaggcaaaggttgatgcggaagantgtctaatgcagctctttcaagcaaaagta

SEQ ID NO: 34773 - DNA, 101 bp, rice(Oryza sativa)
  misc_feature (71): n=t or c
taagtttgtaatcattaaaactcaattagttacacgttattattacctcacttggcgtgaaacatttaatntttatcttcatatataggagattcaaacac

SEQ ID NO: 34774 - DNA, 101 bp, rice(Oryza sativa)
  misc_feature (71): n=t or c
ccgtcagagcagtgaatgggtgagaaagaggtataaatttggcaaatttagagaaattttcaattaccacnaggattgtgtcaaacttgcctgacttagga

SEQ ID NO: 34775 - DNA, 101 bp, rice(Oryza sativa)
  misc_feature (71): n=a or g
attctcaacactacaagaggcatttttttttttgccggtggagtatatgaacggcaagcggaagagatcgngtggaaccatggagactcgtgccatcaagt

SEQ ID NO: 34776 - DNA, 101 bp, rice(Oryza sativa)
  misc_feature (71): n=t or c
aacccagcttagcaagccaatcgccatagaaacatggaccgaaatggaagagagaaccgactgactagaancgagcgacccgccagagtggttagatggct

SEQ ID NO: 34777 - DNA, 101 bp, rice(Oryza sativa)
  misc_feature (71): n=t or c
gggcatcctactactgctaattaacatggatagcgaaacatctctatattgtcaatgggcaactctgcgcngcaacctcgaatcgtatggggcgtatggct

SEQ ID NO: 34778 - DNA, 101 bp, rice(Oryza sativa)
  misc_feature (71): n=a or g
ctctcccatgctgctagcttcagctgccatggcaagcagcacttcaccagagatcgcagcagtcgacaccnacatggacacggataggcagcacgcagaag

SEQ ID NO: 34779 - DNA, 101 bp, rice(Oryza sativa)
  misc_feature (71): n=t or c
tggtaaggttcacatggttcatgaccagatgcttcagtgaggataggtgtgacagccatgaaagggcaacngagtatagctggttgtatgaataagaggtc

SEQ ID NO: 34780 - DNA, 101 bp, rice(Oryza sativa)
  misc_feature (71): n=a or g
aggtgctatgttgattgggaaggagcgtccgcaatcagagccccaaagatataggcttcgactgaactttnttaataaatacatgtgttttcgtgccgtca

SEQ ID NO: 34781 - DNA, 101 bp, rice(Oryza sativa)
  misc_feature (71): n=a or g
atgcaagggcgtcggatctgactggatatattacgccaagctagtgtactgttgtgctcggaagaaaatanatatgtaaaaacagggtgaaagtttattgt

SEQ ID NO: 34782 - DNA, 101 bp, rice(Oryza sativa)
  misc_feature (71): n=t or c
ctaaacacatgtggccgacatgatgtgactacaaaatagtaaaatgataagagagtgcacagaggtattcngcccatttccagaaaggaaagggagatggc

SEQ ID NO: 34783 - DNA, 101 bp, rice(Oryza sativa)
  misc_feature (71): n=a or g
tgaacatgttcgccatgaaccaggcatacttcttctacgcgttccagcaggggatgctcaagatggggcanctcgacctcaaggagggcgacgccggcgag

SEQ ID NO: 34784 - DNA, 101 bp, rice(Oryza sativa)
  misc_feature (71): n=t or g
tcgttgaaataaggatagtacctagggttcctcagtctcgagtgcaatgttgcaaactgtgggtcacgtgntttaattatatcagcagctagcttcaaaat

SEQ ID NO: 34785 - DNA, 101 bp, rice(Oryza sativa)
  misc_feature (71): n=a or g
caaaagtctattggttcagatagacagagcgcaagcacatagcatgagcgtagctacctacaaaacccagncttattataagagtaagagaatagatgagt

SEQ ID NO: 34786 - DNA, 101 bp, rice(Oryza sativa)
  misc_feature (71): n=a or g
tgtctccaatgttgctgtcgtctccggtgttcgacatgttggcaaagacgatgtagaggaagacgaacagnagcaattgcgcatagcgctcccaaaaactt

SEQ ID NO: 34787 - DNA, 101 bp, rice(Oryza sativa)
  misc_feature (71): n=a or g
atggcgcccgaactcatccgcttctcctagccctataaataagacctcagccccttccttgtccatcatcnatcatcaccaaccataaccccacaaccccg

SEQ ID NO: 34788 - DNA, 101 bp, rice(Oryza sativa)
  misc_feature (71): n=a or c
ttttaaaaaaacattctcagtgtgttgtaagtagagagtcataccatgcctgcataaggtagagcttctgntgtcacctgcattaatgcggccagtcctga

SEQ ID NO: 34789 - DNA, 101 bp, rice(Oryza sativa)
  misc_feature (71): n=t or c
tggtttttttagatttattggttacttcagttcatgtattgctgatactcagtagcacccatccgacacanaagtcacaactatgctacttttgttttgag

SEQ ID NO: 34790 - DNA, 101 bp, rice(Oryza sativa)
  misc_feature (71): n=t or c
tttattcactcgttgttccttttcttcactatgaaagtattgccattcaaccctgtaacgccccgattttngtttgggattaaaaatcatttaataatgca

SEQ ID NO: 34791 - DNA, 101 bp, rice(Oryza sativa)
  misc_feature (71): n=t or c
tcacttcatgcctaccactttaccctttgacaccatctcatttcatccattgcagcgacggaaacgccgcngtggcccccggagctctgcgcaccgccgca

SEQ ID NO: 34792 - DNA, 101 bp, rice(Oryza sativa)
  misc_feature (71): n=a or g
tttatggtttaggggcgtaattaggatgactgcgatagtacgggggcaattgcacgttgcagaaataagantagaaatagaagttagttatttgcatgcgt

SEQ ID NO: 34793 - DNA, 101 bp, rice(Oryza sativa)
  misc_feature (71): n=t or c
cggcggaggtgttcgccaccaaggacgccgccttcatcctctgctactccctcatcatgctcaacaccganctccacaacccacaagtaggggtgcaagtg

SEQ ID NO: 34794 - DNA, 101 bp, rice(Oryza sativa)
  misc_feature (71): n=a or g
acaatccaataacgacatggtccctcatcatccagaattgctggaggtcaatctacgccgccttagctctngaggaggaggggtagagcggccagtggagt

SEQ ID NO: 34795 - DNA, 101 bp, rice(Oryza sativa)
  misc_feature (71): n=t or c
gagcgggcgtacttccacttcctgcacttcgccagcttcgagcagcagcagcgtcagttcgaaatatactncggcaaggtcaagtggaaaaaacagaacaa

SEQ ID NO: 34796 - DNA, 101 bp, rice(Oryza sativa)
  misc_feature (71): n=t or c
gcgctcatgcgaagcttctaatctcattgagaagcacagttgggcactgttcagagaaagcatgaaagatntcctagagcctgatgaggcagtgatactcg

SEQ ID NO: 34797 - DNA, 101 bp, rice(Oryza sativa)
  misc_feature (71): n=a or g
ccgccgttgttgattaatttctcgttgctgtgtgattgatgctgttttggcaatggcgcgcggcagcggangcgctagggctcccactcgtgccgccgttc

SEQ ID NO: 34798 - DNA, 101 bp, rice(Oryza sativa)
  misc_feature (71): n=t or c
aggctcttgtttggttgcccggaaagcatagaacttgaactgaagatgtttcaacaccggcatggcttcantctggaagctcagtcgtggcacacggcaat

SEQ ID NO: 34799 - DNA, 101 bp, rice(Oryza sativa)
  misc_feature (71): n=a or g
tcgtatcgaaccttttacgtaggatcaggataacataaaaatttaagatacatgattttttttagataatnaaatataatatcccggcttttactcaaaag

SEQ ID NO: 34800 - DNA, 101 bp, rice(Oryza sativa)
  misc_feature (71): n=t or c
gcttactttccacaggagtacacataatttattagagctagctaattatgcctatgctacttgttgccatnttggtaaactaccttgtcggccttggggta

SEQ ID NO: 34801 - DNA, 101 bp, rice(Oryza sativa)
  misc_feature (71): n=a or g
gtgcctaattccagggagcaaacgttttctttttcctctcaacagtacataactattgcagacaatcagtncacaactaaaagcctacattcgtgatgata

SEQ ID NO: 34802 - DNA, 101 bp, rice(Oryza sativa)
  misc_feature (71): n=a or c
tgtgcacaaccacatgcgctagctcgttccccatataaattgatgagcactattttttctggtgtagtatntgcttgcacgagaacatgtacagccacacg

SEQ ID NO: 34803 - DNA, 101 bp, rice(Oryza sativa)
  misc_feature (71): n=t or c
ccaaatgaaaattattttctagtggtgctatagtggtatatattttcaagagtgaggtacatgggcggtcnctaaacttgtgccggtgtgtcatctagatc

SEQ ID NO: 34804 - DNA, 101 bp, rice(Oryza sativa)
  misc_feature (71): n=a or g
ggcggctcttgagtccatcgtatacagctataggtacagtttctctggctttgctgcaaggctcacaaaancacaagcgagcatcatccgaggtaattaat

SEQ ID NO: 34805 - DNA, 101 bp, rice(Oryza sativa)
  misc_feature (71): n=t or c
aggtatgcttaggataaggcaatcaggaaaaacttatgtcagtataatgccataaatcactacctgagctngatgcttaaagcgcaaacattggtaaagct

SEQ ID NO: 34806 - DNA, 101 bp, rice(Oryza sativa)
  misc_feature (71): n=a or g
aattcgcaaaaaaatagccaaaaaaaagcgcatgagggcgccgcgtaagctttccttcccgttcactcccnggctctcggcgcatggtcgcccattcccga

SEQ ID NO: 34807 - DNA, 101 bp, rice(Oryza sativa)
  misc_feature (71): n=a or g
ctctacgcctcaaacagcacgatcctcatttgaacggggatacccctaaccgctgttctacgacatcaacntacacttctcgtttaatgagggtattatag

SEQ ID NO: 34808 - DNA, 101 bp, rice(Oryza sativa)
  misc_feature (71): n=a or g
tcttagaccaccgtatacttagaccaccgtatagttaatcatgtgcttgtctatacctataccatcagtgncggatttagaaagaaatagcagtgggatct

SEQ ID NO: 34809 - DNA, 101 bp, rice(Oryza sativa)
  misc_feature (71): n=a or g
gtgtgcagagtgcagactgttcttctccttctccagctgaagtgtcccaaaaccaaaaaaagaaaaaaaangataattataaaatgagcaattttatggtt

SEQ ID NO: 34810 - DNA, 101 bp, rice(Oryza sativa)
  misc_feature (71): n=a or g
gatggccaacggcatctccagctcaatgcttacagctccctctgatgattctccatccacaaaacatgcancattgccatcagggatcaagaatttatcat

SEQ ID NO: 34811 - DNA, 101 bp, rice(Oryza sativa)
  misc_feature (71): n=a or g
tatgagacatagctacgagctgagccaggatcagctagcaaaattgattatcaagcaccgaaagatccacnccttaagggctcatttagtttaaagaattt

SEQ ID NO: 34812 - DNA, 101 bp, rice(Oryza sativa)
  misc_feature (71): n=a or g
cccagacaataggttattttctagtgtcaagtactgcagtgtttcaagccttcctatgctgtcaggtatcngaccactgaaacgattgttagagagaccca

SEQ ID NO: 34813 - DNA, 101 bp, rice(Oryza sativa)
  misc_feature (71): n=a or c
gtattaattaactttatattctactccctctatcttttttttaagatgttcaactaaccagcgtcaaaaanacaacaacatggagtataatatttagtaaa

SEQ ID NO: 34814 - DNA, 101 bp, rice(Oryza sativa)
  misc_feature (71): n=a or g
tattttggcgaatttagggtgcgggagaagtgcaaaaatacaggtaaatactccatgaacgacaacattangagtaattggatatcataaacaggaaatta

SEQ ID NO: 34815 - DNA, 101 bp, rice(Oryza sativa)
  misc_feature (71): n=a or c
ccttaaaatgtaaggggtggttttttttgggtggatgataatgggccggatactccctccctccattcacnaatataaatatttttagcgtttaaatttca

SEQ ID NO: 34816 - DNA, 101 bp, rice(Oryza sativa)
  misc_feature (71): n=t or c
caccttggtactttcctgttccgcccttagaaaccgggtaagtaatctcatatgtttgaactgagagagcntcattttccaatagtgccaggacctgtgtt

SEQ ID NO: 34817 - DNA, 101 bp, rice(Oryza sativa)
  misc_feature (71): n=t or c
gtgattttaaaaactgaaaaagtaaccgtgcatgataattattgtaaccattataaccgtgtggtaatcgnacggttttgtaaatcctgtactgaaatgtt

SEQ ID NO: 34818 - DNA, 101 bp, rice(Oryza sativa)
  misc_feature (71): n=t or c
acacgacaaaacattgtaatgttggaattagttgtaccaaaatttggacttgataaatataagttgtactncctccgtcccaaaataaatgtagttttgca

SEQ ID NO: 34819 - DNA, 101 bp, rice(Oryza sativa)
  misc_feature (71): n=a or g
tttaccaatatcaggattatttgaaccgtgttgggtgtgaattatgcactccccacttcaccggttcaccntcgcattaatactgcttctccaaagacttt

SEQ ID NO: 34820 - DNA, 101 bp, rice(Oryza sativa)
  misc_feature (71): n=a or g
aaatagtttgggaataagagagaaaattcatggtattaaacatgtggagattaaaaaaaacgataatctgncgtcgcccggactcgaaccggagaccttca

SEQ ID NO: 34821 - DNA, 101 bp, rice(Oryza sativa)
  misc_feature (71): n=a or g
ccccaccccctctgtcacgaaagaaaccgtcacccccttccccaccacctctgccacaaaaggtaccatcnccccctccaccaccacctctcgctcctcca

SEQ ID NO: 34822 - DNA, 101 bp, rice(Oryza sativa)
  misc_feature (71): n=a or g
tctttattttttggaattttagtaagaaaaaaccgctccaacagtacccatactattcattccaaaaatcnccattcccttcttcattctcgctcttcaca

SEQ ID NO: 34823 - DNA, 101 bp, rice(Oryza sativa)
  misc_feature (71): n=a or g
gcagataatggagacaatacttgtttcatctctcgtcgagtgcttagtgtgcaagttgcacaggaagaacntggtcagcgacacaatatttctcacactcg

SEQ ID NO: 34824 - DNA, 101 bp, rice(Oryza sativa)
  misc_feature (71): n=a or c
ccaagctgagctcacgagcccgaggttttttttttccacacctatttctgatgcaaggttaggatgcgttnaggaggaggggttgggaacccttcatccct

SEQ ID NO: 34825 - DNA, 101 bp, rice(Oryza sativa)
  misc_feature (71): n=t or c
tttttcgaaatgggtaaagcaataatggcatggatccactaaccgaaaattcgattgggttgcatgcagcntgttcggactagaagcaggaacacttgttt

SEQ ID NO: 34826 - DNA, 101 bp, rice(Oryza sativa)
  misc_feature (71): n=a or g
gcttactgcctatgttggattctttgagatgtccaagcctaagaaaggtgagtatgtcttcgtctcttcancatgtggtgccataggtcaaattgttgggc

SEQ ID NO: 34827 - DNA, 101 bp, rice(Oryza sativa)
  misc_feature (71): n=a or g
gaaaataccagaagggcaccattgattttttatgtcttcatcaccaccttggtcacaatcttgattcaccnggcccaacctttgatgaacaggaacccttg

SEQ ID NO: 34828 - DNA, 101 bp, rice(Oryza sativa)
  misc_feature (71): n=t or c
ggcgaagtcgtcgaggttgtggtcgtcgtaacaatagccgaattcatcatactctacgatctctgttggtngtgagtcgacaccgggggagctgaagtagc

SEQ ID NO: 34829 - DNA, 101 bp, rice(Oryza sativa)
  misc_feature (71): n=a or g
ttccactcgtgcgatgcctcagggaagataatcgccatatgctgttcataacgatttttcagagatgtccntaaaactcgtgggtcctcctctaacatgta

SEQ ID NO: 34830 - DNA, 101 bp, rice(Oryza sativa)
  misc_feature (71): n=t or c
gaattttcttccgcctattaagaaaatgcattgcatcatattttgtggtctcctcctccctagtccctaangctgtatgcgtgtggattgtgattagtgtt

SEQ ID NO: 34831 - DNA, 101 bp, rice(Oryza sativa)
  misc_feature (71): n=t or c
acgctagtaggggactagcggtgcaagcaggtagacccgtaaattcacttataggccatgtttagtctttntcctattcttaactttccattatattatat

SEQ ID NO: 34832 - DNA, 101 bp, rice(Oryza sativa)
  misc_feature (71): n=a or c
ggcggcggcggcgctactacggggttcgcttagaaatagctggagtacttgtaggtgtccaagaaatcggngtccagcgagaacatgaactccatgtcgtc

SEQ ID NO: 34833 - DNA, 101 bp, rice(Oryza sativa)
  misc_feature (71): n=t or c
aattgatctaccaagcacctacctttcgtaatcaagcctagatttccagaatctgatagggcaagcccaantccaaccctctctccagcagatagattaag

SEQ ID NO: 34834 - DNA, 101 bp, rice(Oryza sativa)
  misc_feature (71): n=t or c
gagggaggcggtaccaaatccaagccgtcaattgggacagattaaacggttgagatttattggtaccgtgnggtaccattttagcccatatggtgataccg

SEQ ID NO: 34835 - DNA, 101 bp, rice(Oryza sativa)
  misc_feature (71): n=a or c
gaggaggccaatgtgcgcatcgtgcatcgggacatcaaggctagtaacatcctactcgaccctgatttaanacccaagatatctgattttgggcttgccaa

SEQ ID NO: 34836 - DNA, 101 bp, rice(Oryza sativa)
  misc_feature (71): n=t or c
atatgatgactgaataccttctcatgtctgcattgtgatcctactattctttcatatgaatacttttgccnatattgtccatatatgtgaaactgaaaaca

SEQ ID NO: 34837 - DNA, 101 bp, rice(Oryza sativa)
  misc_feature (71): n=t or c
agcatcacaacgctgcttccttcccacataagctcctccttgaggttatcgaacacctcgttcgatattanggccttcttgtcgtaataaaaggcctaaag

SEQ ID NO: 34838 - DNA, 101 bp, rice(Oryza sativa)
  misc_feature (71): n=a or g
tctaaatcccatcgagcttgttgactgttgtatcaatgaggtcccatcaacaagtattcttgcaagcccanaatctccaacatgcgctaccatatcagaat

SEQ ID NO: 34839 - DNA, 101 bp, rice(Oryza sativa)
  misc_feature (71): n=t or c
tttttgatgcaggcggcaacagccatcaaatcaattctgctctcggatatatatcaaattgctaccgtgtntctgattttgaacatgatggtttcttttat

SEQ ID NO: 34840 - DNA, 101 bp, rice(Oryza sativa)
  misc_feature (71): n=t or c
gttcaatgggttgctaatcactgcacaacctcgacgacgcattgctctcaccgtcaagttgtcacttgcanctaacaccgccatcgtgatttgtgagctgg

SEQ ID NO: 34841 - DNA, 101 bp, rice(Oryza sativa)
  misc_feature (71): n=a or g
ttacaatttcctcggaaataaagttacgattccccgctcctcctcgtcgcagatcgatctcgaaccttcanggagaagaaaaagatctccccctccggaaa

SEQ ID NO: 34842 - DNA, 101 bp, rice(Oryza sativa)
  misc_feature (71): n=a or g
agaaactcaagaacatggcactgcggggaggaatgagtaattaatctcgcagtactaagaattggaggtgncaataaataattgcagtagagcaagcagcc

SEQ ID NO: 34843 - DNA, 101 bp, rice(Oryza sativa)
  misc_feature (71): n=t or c
catcggagaagttcactttcaaatgggcatatggatgagctgcaagagcctgaattactgagccgtgtctnagctgaagcaaatattaaatctgctatgca

SEQ ID NO: 34844 - DNA, 101 bp, rice(Oryza sativa)
  misc_feature (71): n=t or c
gaaatcaagccagaagaatccttcaccggcaaaagcatttgccggtgattgaatagttaaattaggtaggnctttcttgctggcttccatgtaccatgtat

SEQ ID NO: 34845 - DNA, 101 bp, rice(Oryza sativa)
  misc_feature (71): n=t or c
agttcggatgtaccaactaccaagtaaaactaattcctgattagacaaacttggtacctatttatgcttcnaatcattcttcttgctccagtacatgatat

SEQ ID NO: 34846 - DNA, 101 bp, rice(Oryza sativa)
  misc_feature (71): n=t or g
cggcaacagaggcggggatggatgggaatggcgtcgatactgataaattacataatacccctacgcgaatnatgatccttggacgaatatacccctccaca

SEQ ID NO: 34847 - DNA, 101 bp, rice(Oryza sativa)
  misc_feature (71): n=t or g
tttgctgaagttttccagctctctttatatcacaaccctaactgggatcttcaggaaagcaaaaattttanttaactgcagaatattttattggattcttg

SEQ ID NO: 34848 - DNA, 101 bp, rice(Oryza sativa)
  misc_feature (71): n=t or c
ggtgatgtatgtagttttagtttgttccccagtttcaatttataggcaattttcatctagacattgttgtnaaaatattttttcacaagattttgctttca

SEQ ID NO: 34849 - DNA, 101 bp, rice(Oryza sativa)
  misc_feature (71): n=t or c
tgatgatagatacacaaatcaaactttggaaaaagcaactctgaggaatgcagatctcgacaatggaaggnttaaagaaaaaatacaacacgaagctgtca

SEQ ID NO: 34850 - DNA, 101 bp, rice(Oryza sativa)
  misc_feature (71): n=a or g
acgtgttaaagagatgtcgcaatgtttcattgtttcaaaaaaaatgtttcaccatattttgcaaaacgtcngacgttattgcacgaaatgtttcacatgtt

SEQ ID NO: 34851 - DNA, 101 bp, rice(Oryza sativa)
  misc_feature (71): n=t or c
tctaaggcggacttcttggcacttaggtgcacggcaaggccctggtaaaaaaaaaacaacacacattacgncagggaactagcgaaagagcaaaattcagc

SEQ ID NO: 34852 - DNA, 101 bp, rice(Oryza sativa)
  misc_feature (71): n=t or c
ggatcaacactgacaatgaggggaaatgagatcccgtctttgctttaacttaagtcagttttagggttttnattttttttattataaaagtttaggttttg

SEQ ID NO: 34853 - DNA, 101 bp, rice(Oryza sativa)
  misc_feature (71): n=t or g
aaatggacaccaagcagcatagaagagaacggagtacgtaacacctctgtggcgaaggttcaactctttancaatagcctctcctctcaccttcagtaaga

SEQ ID NO: 34854 - DNA, 101 bp, rice(Oryza sativa)
  misc_feature (71): n=a or g
acggttgctcaaactctcgcagatggtggtatagatttttcatggtcaagtctggagaaggattggtcccnaaccatggctataaagctagggaggagttc

SEQ ID NO: 34855 - DNA, 101 bp, rice(Oryza sativa)
  misc_feature (71): n=a or g
gtttaaggacatgattcaaactacaatagccacgtcatgctgaaaacataggccgtccaatttttcctccnagcattgtgagcggttggatcctacaattg

SEQ ID NO: 34856 - DNA, 101 bp, rice(Oryza sativa)
  misc_feature (71): n=a or c
catccactggattgtgaacttgtgattgctgctgcaggaacgagctttgttctggtccagaagttggtacntccaggtactggtaccacaggtaccaaacg

SEQ ID NO: 34857 - DNA, 101 bp, rice(Oryza sativa)
  misc_feature (71): n=a or g
ggcgtgcacatgatagcgagggcgtccatgaccatcgatccatccattaattgcattgcttgaattgctangctgcaccgtgcattgcctcttccctgcaa

SEQ ID NO: 34858 - DNA, 101 bp, rice(Oryza sativa)
  misc_feature (71): n=a or g
tggttctcatctttttaatggtatcacaagtggattttctggaaatgatcttttaatgcgacataaccctnctattgcaaatgctatggcagtaaaaatat

SEQ ID NO: 34859 - DNA, 101 bp, rice(Oryza sativa)
  misc_feature (71): n=a or g
tacaagttttgtcgtgaagaatgtctaggttgaaacttagtgatatctcaccttggaagtgtagccatcanctccgtagattatagaagaatgtgggcaat

SEQ ID NO: 34860 - DNA, 101 bp, rice(Oryza sativa)
  misc_feature (71): n=t or c
tttttaagcctcaaaacgtcaactcatttggcacaggagggagtagtacgtgatattctgtccaaaacatncataaattttaaaccaaagggagtaccata

SEQ ID NO: 34861 - DNA, 101 bp, rice(Oryza sativa)
  misc_feature (71): n=t or c
ccgctgccacccaactcctctcttgtcggccgctcaaggagttatgagggccaagctcactcgaccgccgntgcctaactccactgttgtcgaatattgac

SEQ ID NO: 34862 - DNA, 101 bp, rice(Oryza sativa)
  misc_feature (71): n=a or g
ttcgccggaggtgttgaagaaagaagctgcagaagagaggaagaaaaggaggctaagggcaattttgtccnaaatagtattctagcatggatgctattatg

SEQ ID NO: 34863 - DNA, 101 bp, rice(Oryza sativa)
  misc_feature (71): n=a or g
tggagccatgaacatcacattctattcggtgtcatgcttctcgagctacatatgaaattcttaaaatattnttttaaatccattttaaattttataatagt

SEQ ID NO: 34864 - DNA, 101 bp, rice(Oryza sativa)
  misc_feature (71): n=t or c
ctacgttttatatctctttgtatggctgacttgtaatattatcttggtttttagttgggggtatgtgttantaggtttattttttagggacgaagagagtg

SEQ ID NO: 34865 - DNA, 101 bp, rice(Oryza sativa)
  misc_feature (71): n=t or c
tttttttttctcttcttcttttacgtattcactccctcccattataaatgtaagtatcactttctacgtcnaactttaattgtccgtcttatttaaaattt

SEQ ID NO: 34866 - DNA, 101 bp, rice(Oryza sativa)
  misc_feature (71): n=t or c
taataatacttgttaactactgcagaatagttaatataagtcagctctataggtcgtggaagtggtaaaancaccacctacagtgcctccccctggcccgc

SEQ ID NO: 34867 - DNA, 101 bp, rice(Oryza sativa)
  misc_feature (71): n=a or g
ctttcttcagcagtgacatgagcaaaaatacgatgtgacaacatgtatagcccacttatatcatcctattntacgcgctcttaatttactagtaataaaga

SEQ ID NO: 34868 - DNA, 101 bp, rice(Oryza sativa)
  misc_feature (71): n=a or g
gccgcctctggcttcgccgccccacgccacgtacaacccgtccaccaccctacttccccaatccattgtcnaaacgccatcttccctgcaaacccgagctc

SEQ ID NO: 34869 - DNA, 101 bp, rice(Oryza sativa)
  misc_feature (71): n=a or c
gtgagaatgacatgtggggctcacgtgggccccaccggtcttaattatttttttctaactaacatgtaggntaacagtttttattattttccaaattaaat

SEQ ID NO: 34870 - DNA, 101 bp, rice(Oryza sativa)
  misc_feature (71): n=a or g
gctgcctgcaagtaatagccagtgaaaatatagttttttcactggcgaatgaccagccgcatgcgaaaatnctcttcacaagctcacaagctatggcatta

SEQ ID NO: 34871 - DNA, 101 bp, rice(Oryza sativa)
  misc_feature (71): n=t or c
tcaatgtatagttgattttttagaacaaatcaatgtatagttgtgtactagtgtcactcacgccacccgtntcatatccattcgcatggttgaacttttag

SEQ ID NO: 34872 - DNA, 101 bp, rice(Oryza sativa)
  misc_feature (71): n=a or c
ataccgactttcccattccacattctcttcggctgcttttgatagagcatttatcgaacattttgctaggntaatcagccatagccaaaatgaaacatgta

SEQ ID NO: 34873 - DNA, 101 bp, rice(Oryza sativa)
  misc_feature (71): n=a or g
aaccaatcatccttctatttacacacaaggggaatgacattgctttcaaggtactcaatttgctcaggctntggcgtcttcaccgagtcagttcactattt

SEQ ID NO: 34874 - DNA, 101 bp, rice(Oryza sativa)
  misc_feature (71): n=t or c
ataattccctagcctccctgtgctaaaaggcataatgctactgtcctccccgtgatgacaggtgtctcccnagccactctggcatccctacaacaaaacac

SEQ ID NO: 34875 - DNA, 101 bp, rice(Oryza sativa)
  misc_feature (71): n=a or g
ctggctggtgatgctcgtgcaagatcaatcacaccacacgaccactactactgtgggagatctagctgcancctgctatgacatatgatcgatcctagctt

SEQ ID NO: 34876 - DNA, 101 bp, rice(Oryza sativa)
  misc_feature (71): n=a or g
tgcggcagacgaaaggcgacattaaattgcatacgagctggtaatatagctgccagaactatataactctngcattatatatatgcaggcgaacaagcgac

SEQ ID NO: 34877 - DNA, 101 bp, rice(Oryza sativa)
  misc_feature (71): n=a or g
acatgcttggccatgctcttgttttgggttatgttgttttttctgaagtacgccttgtgatgtgtcttgtntgcacttcatggtctgtaagcattacttct

SEQ ID NO: 34878 - DNA, 101 bp, rice(Oryza sativa)
  misc_feature (71): n=a or g
aaggacctagagaatattgagaatgaagaagaagccaagaatgcgaagctggaggaaaaacggcatctcgnctcattatctctagaatggtcagaggatga

SEQ ID NO: 34879 - DNA, 101 bp, rice(Oryza sativa)
  misc_feature (71): n=t or c
agctatacacatcagatttgcttgatatggtaccaaagctccgagagatcatctcaggagctatgtaaccnactgttcctcgtgcagcgctcactgggaca

SEQ ID NO: 34880 - DNA, 101 bp, rice(Oryza sativa)
  misc_feature (71): n=t or c
tatggactttttgcctcttccaaccattgaacagaggaatagatgggaatgccatcttttacacgtttgtnatacaactaaccagatgcccatgcattgta

SEQ ID NO: 34881 - DNA, 101 bp, rice(Oryza sativa)
  misc_feature (71): n=a or g
aagcttctgacgaaaaaaatgcatacctaaatcttgcggatcctggatctccggatatgcttcgtaattcntactctaggtgcttcttttctaactccggc

SEQ ID NO: 34882 - DNA, 101 bp, rice(Oryza sativa)
  misc_feature (71): n=t or g
gtgtaattgaactgttggtccatggacttgcccaccccaaaaacaagcacttgctttttcattcatgtagntgaaaattgaaggaggccaatatccaagtg

SEQ ID NO: 34883 - DNA, 101 bp, rice(Oryza sativa)
  misc_feature (71): n=t or c
attgcaaaactgtctcatacactatgtgaattcaagccacaaagctagtcaagacaaacgtatgcatttcnatgccacaaataaaccaaagcactactaac

SEQ ID NO: 34884 - DNA, 101 bp, rice(Oryza sativa)
  misc_feature (71): n=t or c
atctgggcctgtggtagggctagatccttgtccattatagccagagccgaaccaaacactaatagatcctnggttttttaaaagtgaagtgcgtggatctg

SEQ ID NO: 34885 - DNA, 101 bp, rice(Oryza sativa)
  misc_feature (71): n=t or c
aggagagggggagagccaccctcgaagtttgatgtggtgaatggggaggaggagaatggtggtgggaaagngcgacatggcagtggaatgggaggaggaga

SEQ ID NO: 34886 - DNA, 101 bp, rice(Oryza sativa)
  misc_feature (71): n=a or g
cctggtctacctcgacctctccaccagtttctatatcgtcgaatacaacgatgacgagcaggtgacattcnactcagactcagtttggcagctctcagcgc

SEQ ID NO: 34887 - DNA, 101 bp, rice(Oryza sativa)
  misc_feature (71): n=a or c
cttctcctttccatggcggcaagcaacgaagtgcattgaggagagaggagaattccagggaagagagatgnacactgcatttataatgtagctcatccaaa

SEQ ID NO: 34888 - DNA, 101 bp, rice(Oryza sativa)
  misc_feature (71): n=a or c
gggcagggccaaattttgtttgaattgtagcaagtcaattctggagaatcatatacagtggtttcagcaancccccccccccccccaaacaataaaaggaa

SEQ ID NO: 34889 - DNA, 101 bp, rice(Oryza sativa)
  misc_feature (71): n=a or c
tctttctccacgccatgaaaacgacgcttcctaaggtccagcaggtaggaacctctcgtaagggcacaaanaaggaacaaggagcgacgttgacctcggat

SEQ ID NO: 34890 - DNA, 101 bp, rice(Oryza sativa)
  misc_feature (71): n=a or g
ggtagaactgccatgacttcctcagcgcaatcttcttcaggcagggagttagttagggcgaacctagactnctcgaaggagattgaaaattcagacccgcc

SEQ ID NO: 34891 - DNA, 101 bp, rice(Oryza sativa)
  misc_feature (71): n=a or g
agaagtacaaaatcagaaatcggctttaaaagtatagaagcaatgggtaaaaatagacataccctgggctngtaagtagggcgaaccggaggtgatggtgt

SEQ ID NO: 34892 - DNA, 101 bp, rice(Oryza sativa)
  misc_feature (71): n=t or g
gagtaatcaatctccatcgactcttcttcatcgctccccctcggcctataatacttggtgttgtcttttanaagtatggcaagaagggcaggatcctttct

SEQ ID NO: 34893 - DNA, 101 bp, rice(Oryza sativa)
  misc_feature (71): n=t or g
aaaaggagtacaaggtaaaaaaaaaagtctcaattgaatgattatttgtgttgtacagataaaaaaaccangcaaatatctaaccatgcaaatatgcagaa

SEQ ID NO: 34894 - DNA, 101 bp, rice(Oryza sativa)
  misc_feature (71): n=a or c
tttggtcatttgtatgatgtgggaaaacaagccatagttgcaaatttgtgctgacttcttcatagctgctnctgtattttgtgtacactaggcaaaaactc

SEQ ID NO: 34895 - DNA, 101 bp, rice(Oryza sativa)
  misc_feature (71): n=t or c
ttaaaactctcagtgctgcacatcaactttcccatcttggttaaagccatctataaatggccataaggccnaaggcccgacggcgcagcccaagcacggca

SEQ ID NO: 34896 - DNA, 101 bp, rice(Oryza sativa)
  misc_feature (71): n=a or g
tcgaccgaagtctgggaggttgagaaggtaagagcagtcatcacaattgttctcacgtttttaagtccacntaaacttttgtacggaatttctccacttca

SEQ ID NO: 34897 - DNA, 101 bp, rice(Oryza sativa)
  misc_feature (71): n=t or g
catcttccacttgagctgcccacatttctgcaccaattgcggctcaacttccccagattgtacgacatccntgttcttgggcagctggtgcagcatggctt

SEQ ID NO: 34898 - DNA, 101 bp, rice(Oryza sativa)
  misc_feature (71): n=a or g
cctttttgaaaacttatttcgagactaaagcacgaaaaaacttcaaacaaaaaggatgtagtctcgacgcnccaaccgccttggagtttttttttcttttt

SEQ ID NO: 34899 - DNA, 101 bp, rice(Oryza sativa)
  misc_feature (71): n=a or g
acctctgtagtttaaatatgaacattgccgcaatctgtagggagtagtatttttctacttacctgccgctntcgaaaatggtagggcggcttttgttattc

SEQ ID NO: 34900 - DNA, 101 bp, rice(Oryza sativa)
  misc_feature (71): n=a or g
aacaacaaacatggtgaagtctttatctactgtaagaagcttggatgtcccaaagtctgagatcttagggncgaacttgtctgttaaaagtatattggcag

SEQ ID NO: 34901 - DNA, 101 bp, rice(Oryza sativa)
  misc_feature (71): n=a or g
ggtgttcctattgctattcttgcactagccagtttattggctggtaaaataggagacaagaaggaatggtntaaggtccacaactctatcggttcaacact

SEQ ID NO: 34902 - DNA, 101 bp, rice(Oryza sativa)
  misc_feature (71): n=t or c
tcccttttctgttttcttccacctttttcctttggccatggagccaaagctacctctctccctttccagcncgtcccggggaggccaagccccgagcccgg

SEQ ID NO: 34903 - DNA, 101 bp, rice(Oryza sativa)
  misc_feature (71): n=a or c
tggaaatcttacaaatttgaataggatatacgcattctactgcaatttggaaggcccaatcccaccaagcnttggggatctaaaaaaactgtttgttctag

SEQ ID NO: 34904 - DNA, 101 bp, rice(Oryza sativa)
  misc_feature (71): n=t or c
aattcggtagtagttgacactgtcatagtgggcaggaggttccatgaaaacatagaattgcaagaaggtgngagcattactcttctccgagatcctcagaa

SEQ ID NO: 34905 - DNA, 101 bp, rice(Oryza sativa)
  misc_feature (71): n=a or g
atgcaaagcagatgattaaaaacacacggaaaaaaataatcgttcgaagaaaaccgtagaaatcgaatganacgggaaattcaaatgaaatttgccaacac

SEQ ID NO: 34906 - DNA, 101 bp, rice(Oryza sativa)
  misc_feature (71): n=t or g
tttgtgcactatattatagcgtagctcaactgactatgttccttggggtttaaccagccctccagacacangtgtgttcgtatttataactaattattctt

SEQ ID NO: 34907 - DNA, 101 bp, rice(Oryza sativa)
  misc_feature (71): n=t or c
cccactaaatcctaaaactcaaactcatccactaacaactataaagttttaactcactgaatactaatgcncaacatacaaagatactatatcatcatcca

SEQ ID NO: 34908 - DNA, 101 bp, rice(Oryza sativa)
  misc_feature (71): n=t or c
cagaccgaacgcccaccctgatgtgcatggcaaggattgaggtccaatggattcgtaatcatcaaagtctnaaggttgcgttaagtttcaaaaaaatttcg

SEQ ID NO: 34909 - DNA, 101 bp, rice(Oryza sativa)
  misc_feature (71): n=t or c
acacttccacttgtataattcaaatcggttttgctatgtttttaccgtaccaacgttgcacaaaacttccnagctgctagctatcgagaggggattacacg

SEQ ID NO: 34910 - DNA, 101 bp, rice(Oryza sativa)
  misc_feature (71): n=t or c
agccaaacattgaccagccccccgtgctcctccacggttatggtgaggcttaatccgccgcagccatcggnggtgttgccccgagtgctcctacaactgct

SEQ ID NO: 34911 - DNA, 101 bp, rice(Oryza sativa)
  misc_feature (71): n=t or c
ctgctaggcattgtgctagttgtgacacaagaatttacactactgtcaggagaataaaagttgatttcagnatcagtgctgctccagaacatggactttag

SEQ ID NO: 34912 - DNA, 101 bp, rice(Oryza sativa)
  misc_feature (71): n=t or c
gacgcggtctggcatgataaaggtgattggcacggtgatctgtgttgtgggcaccatggtggtgagcctgnacaggggcaagctgctgcatttgtggccta

SEQ ID NO: 34913 - DNA, 101 bp, rice(Oryza sativa)
  misc_feature (71): n=a or c
tagtcatgacttcgcccttcgccacgccatatccacaaccaaacgggccttcgcagcaaggtaccgtgagnaaggcggggggcgaaaaggggctaccattg

SEQ ID NO: 34914 - DNA, 101 bp, rice(Oryza sativa)
  misc_feature (71): n=t or c
cagattgcacatattattacatcccttccttgtatcacttcgttgtggaatcccagctggccgaaaaacgngaaaggcaccggcaaagcccgctggactgg

SEQ ID NO: 34915 - DNA, 101 bp, rice(Oryza sativa)
  misc_feature (71): n=a or g
tcatattaagtacttttttttgcactaatcttgataaaaaaaataacaaattttggtttcgaaaggttttnaaacagataccgacaaaaaagcacagggat

SEQ ID NO: 34916 - DNA, 101 bp, rice(Oryza sativa)
  misc_feature (71): n=a or g
ctggctttcaaagctttgtctctcttccaccatggatgtgaactagatggtatgatttggtccggaatgtngttgggaatggatgggagattgatgtggtg

SEQ ID NO: 34917 - DNA, 101 bp, rice(Oryza sativa)
  misc_feature (71): n=t or g
aaaaacatccccactttactgtacaccatctgtataaactttttccttccttacaccactttgcagtcttntctttggtcgagtagcaccagttggagcag

SEQ ID NO: 34918 - DNA, 101 bp, rice(Oryza sativa)
  misc_feature (71): n=t or c
cggcagggggaggtgcctcaacaatgccctcatcaggtaacaagacactcaaaagtgtcggtgttactgangcaacaaaccactaggataggtttacacat

SEQ ID NO: 34919 - DNA, 101 bp, rice(Oryza sativa)
  misc_feature (71): n=a or g
ggtatcgtcagttcgtcactatctctgaagcggtgatactgtgtacgaatagattgtgttcgatcagcatntcaacgtggtcgggtgctgcatcaatgcct

SEQ ID NO: 34920 - DNA, 101 bp, rice(Oryza sativa)
  misc_feature (71): n=t or c
gcaagctaagaatggtactccctgtttcagcttgtaagaagtttagactttagtcaaacttaatctatttnaaatttaactaaatttatagaaaaatatag

SEQ ID NO: 34921 - DNA, 101 bp, rice(Oryza sativa)
  misc_feature (71): n=t or c
tgctgctgttcgccaagcctcggatcacatgaacgaactactttatcgtgaagagatgttgtggttacagngctcacggattaactggctaaaggagggcg

SEQ ID NO: 34922 - DNA, 101 bp, rice(Oryza sativa)
  misc_feature (71): n=t or c
ggccaaatttaatagtgggcctaatcattgatgtaaattcagtggccattcactagtgggctaaatttgtngcttcctccgtttcacaatgtaagtcacgc

SEQ ID NO: 34923 - DNA, 101 bp, rice(Oryza sativa)
  misc_feature (71): n=t or c
gacataccttgtggagtcccaactattccccaattgagccaaaatcaatttcatatttcgccatccacaanagatttgggaggaacacaccattgctgaca

SEQ ID NO: 34924 - DNA, 101 bp, rice(Oryza sativa)
  misc_feature (71): n=a or g
tcttagtgcttaaggagtaggcagattaataggtgctgcagcaatatgtcctgtctgatctgcatgccatnccattttcagaacataagtggactcagaca

SEQ ID NO: 34925 - DNA, 101 bp, rice(Oryza sativa)
  misc_feature (71): n=t or c
cctgttgcctgtaatctcatttttgatgtgttcatgctatgaatcatgtgcagccaggagaagcatgcagnctaatcgatcatcaggtcagcaggctttgc

SEQ ID NO: 34926 - DNA, 101 bp, rice(Oryza sativa)
  misc_feature (71): n=t or c
caggtcttaattttgactatggatcaatcagttccttttcagctattcaagacattttttgtctcaccttntggcagtaactcatgtagatcataatcttc

SEQ ID NO: 34927 - DNA, 101 bp, rice(Oryza sativa)
  misc_feature (71): n=a or c
tggccgtgatgaagaacaagcttcagggagcaagatcatgaagggagagagaggtgcaaggctaagggtgntgaggtccatcaggaacagcggcggcgacg

SEQ ID NO: 34928 - DNA, 101 bp, rice(Oryza sativa)
  misc_feature (71): n=t or c
aagttgagggaccttcagtgtactttttccaacctagctcgagagtactacggggctgttcagattgatgncatttttaaccataccattttttggcatgg

SEQ ID NO: 34929 - DNA, 101 bp, rice(Oryza sativa)
  misc_feature (71): n=a or g
tgtcccatgcactcgtgataggatatttgtgcttggtcctcgattcagtaatttcaccaatccaaaatccncaatctttggctcaaaatctttatctaaca

SEQ ID NO: 34930 - DNA, 101 bp, rice(Oryza sativa)
  misc_feature (71): n=t or c
tttctttctatcgctctcacccattacatgtctctcgacacgagaccgaacactgaattcactagttgcgngcatcctgtttctgaattccacaagtccgg

SEQ ID NO: 34931 - DNA, 101 bp, rice(Oryza sativa)
  misc_feature (71): n=t or c
acatcctccaagtcttgcccaggagagctcctcacgaagccttcagctatccactgtctaaccacatcatncctaccgatcttgtagtcctctggataatt

SEQ ID NO: 34932 - DNA, 101 bp, rice(Oryza sativa)
  misc_feature (71): n=a or g
gcagccagggcggaggcggaggcggtggaagatgaggcacgtgcagcggaggtagagattgagaccttgcncagcagcatcaacggctccatcgccggcga

SEQ ID NO: 34933 - DNA, 101 bp, rice(Oryza sativa)
  misc_feature (71): n=a or g
gatttcctcgtagccttcttctttttcttctttttcttgcccgagtcaagaacaatctcaggatgaactcnagcagggatctcgagtccaagggcagacat

SEQ ID NO: 34934 - DNA, 101 bp, rice(Oryza sativa)
  misc_feature (71): n=a or g
gctgcattctttggccaagtgatttgcatcttcgaaagcgtttgtacacagactgcatatccaattacatngccagtgacgtctcagcaagttttccgccg

SEQ ID NO: 34935 - DNA, 101 bp, rice(Oryza sativa)
  misc_feature (71): n=t or c
ccggccgccaacaaactgctgcgagaagtctccgtgcgcctccaaaaatcggaacttttttccttttcttnaatcattatcgctttcttttctcgagtttt

SEQ ID NO: 34936 - DNA, 101 bp, rice(Oryza sativa)
  misc_feature (71): n=a or c
gtcaatattacagtcctgtctaaaaatgcattttgaaaatttggtctactacacatgagggcacgtaaaanttggtctctgaaaattaacctatccatatc

SEQ ID NO: 34937 - DNA, 101 bp, rice(Oryza sativa)
  misc_feature (71): n=a or g
gtgagcatgctgcctttgaagatgtaccctgttttctcccagttgttcctaagacaacttcatgaaaaccngatttgttccagcatatcgagtacctagta

SEQ ID NO: 34938 - DNA, 101 bp, rice(Oryza sativa)
  misc_feature (71): n=a or g
tgcttactttggagaatgtgcttgtattgggcgatttgcagttcttactgaaatgccctgcccttgaatgnttgactatccgaatgtgctcccagttacat

SEQ ID NO: 34939 - DNA, 101 bp, rice(Oryza sativa)
  misc_feature (71): n=t or c
ctaaatcaacgaaggaaaaaaaaagaatattaaggcgtcttggcgggtaagcttttattggcgagaagtgngcgggtgatctggacgcagagggcggcgtt

SEQ ID NO: 34940 - DNA, 101 bp, rice(Oryza sativa)
  misc_feature (71): n=t or c
atataatggatgttccattcagtaatgaaaaatatccggccgttgcactactaggatgtaaaaacacacangttcatgggtgtatatttgtatcacctcgt

SEQ ID NO: 34941 - DNA, 101 bp, rice(Oryza sativa)
  misc_feature (71): n=a or g
gaattggcatttcacggactgagactaccgaacgtttagcaatcggttgctaacggccattgttgtctccntatacgccttcatcttatctgctagctgcg

SEQ ID NO: 34942 - DNA, 101 bp, rice(Oryza sativa)
  misc_feature (71): n=a or c
agttcagagccgacttgtttcatcttcgcttcttctgattgctatggatcggacaagcacagatccttggngattttggagcgtttacatatgcgacttga

SEQ ID NO: 34943 - DNA, 101 bp, rice(Oryza sativa)
  misc_feature (71): n=a or c
tatcaaagtaaattccagatctagctcccaacaacaagaatatgctacagcaactagacctatagcggcanaatcaagcaaagctagaggagaggtaggaa

SEQ ID NO: 34944 - DNA, 101 bp, rice(Oryza sativa)
  misc_feature (71): n=t or g
agaaaacaattcattcttaatcaaaagaaacataaggcacatgggatatgttgtcccattcaggaccatantcgccatacttctccttcagaatggggcaa

SEQ ID NO: 34945 - DNA, 101 bp, rice(Oryza sativa)
  misc_feature (71): n=a or g
gccctattgtaatctccgaaagtaagtgggatcccccatctcctagtcctacttcttggaaccttctttanttataatctgctgctagcggatcataaaac

SEQ ID NO: 34946 - DNA, 101 bp, rice(Oryza sativa)
  misc_feature (71): n=a or g
aatcgagagaaggaggagttcttcgcgatcttcgggtgatactaaagtcgccgagcacgagcaaatcgagngagtcaacaaaaaatgctcagcggcgaaac

SEQ ID NO: 34947 - DNA, 101 bp, rice(Oryza sativa)
  misc_feature (71): n=a or c
agggacttaaaagttttagtcccgtctaaacagtgacaaaggatcttgaaaagttcaaatctagcttatcncattacataacgccttctctaaacggttac

SEQ ID NO: 34948 - DNA, 101 bp, rice(Oryza sativa)
  misc_feature (71): n=t or c
cattacgctgggaggcccatttacatagctcagtaagggaggatcgtttacgaatgaaataagttcatccnaggtctcttaactttataccgaatccgatt

SEQ ID NO: 34949 - DNA, 101 bp, rice(Oryza sativa)
  misc_feature (71): n=a or c
ttccccatcagcctctccaccgactgcaacaagtatatcatctctctatgactcctctctctctctctatntatatatatacacgcatatatctctttatt

SEQ ID NO: 34950 - DNA, 101 bp, rice(Oryza sativa)
  misc_feature (71): n=a or g
taatagtagagatatcgttgtgacttttagacacactgtttattatcactagatgggtaccccacacgttnctgcggaagaaatatgtgataatatagtag

SEQ ID NO: 34951 - DNA, 101 bp, rice(Oryza sativa)
  misc_feature (71): n=t or c
cgaaaatcggaccctatactaccatggtcttactcctacatctatcatcttcctccttgatttgttctttnagagttctaatttaaagaagaaatttgagt

SEQ ID NO: 34952 - DNA, 101 bp, rice(Oryza sativa)
  misc_feature (71): n=t or c
tcagaatgtaagtggatttttttgtgtggcagaatgtttggcgtcgtcgataactcgtagcctttcgaatnatgcagaacatgcaggcatgcagcaccggc

SEQ ID NO: 34953 - DNA, 101 bp, rice(Oryza sativa)
  misc_feature (71): n=t or c
tgtctttcagaattaacagttataacagatgtgatattgtatatgttaccagatggtggctccccaactcnatcatatggatcagatggtggttacaaacc

SEQ ID NO: 34954 - DNA, 101 bp, rice(Oryza sativa)
  misc_feature (71): n=a or g
aagtagaggttaagagcctcaagaatgaattggaagcattcgaggaggagaaggaggttactgcaaaggcntttaatgttgagaagacagaaatcctaaag

SEQ ID NO: 34955 - DNA, 101 bp, rice(Oryza sativa)
  misc_feature (71): n=a or c
ccttcaccgggagccaagaaacgcataaagatgagagacgaactgaaagcgaacaagagcagcaaatcgcngcaaaaagggaaacaagaagatactcatac

SEQ ID NO: 34956 - DNA, 101 bp, rice(Oryza sativa)
  misc_feature (71): n=a or g
gcttaagctaagctaaattgtgtgtgtttgtgagtgggagtgagggtgctgagctgtataaatagggggangaagagacgccaagagaggttaaggggaag

SEQ ID NO: 34957 - DNA, 101 bp, rice(Oryza sativa)
  misc_feature (71): n=a or g
gaataaaaggcttgtcaggtaaacgctgcgcttgaaagtgcatgtccatattctagtcctaggatgggacnaagggagtatgagtgtagttcctccgtttc

SEQ ID NO: 34958 - DNA, 101 bp, rice(Oryza sativa)
  misc_feature (71): n=t or c
tatatatataactatatcccattagagagctctccaatccagcaaggcgtatacacgaacgaccgattaangccttcgacgtgccaatggtcgaaaaaatt

SEQ ID NO: 34959 - DNA, 101 bp, rice(Oryza sativa)
  misc_feature (71): n=t or c
gaaatcagtgctgctgttagtaccgctgtttagtttttgcattaacccgagtctacgcttatggtcgtgtntaattcacgttaaaattaaaagtttagttg

SEQ ID NO: 34960 - DNA, 101 bp, rice(Oryza sativa)
  misc_feature (71): n=t or c
ccccacctcatccctcgacagcggccctcctccaagcctactttctctgcaaccgccacctccccttctcntgtgtcgtcgccgccgcattgctcgtcgcc

SEQ ID NO: 34961 - DNA, 101 bp, rice(Oryza sativa)
  misc_feature (71): n=a or g
tgattttcctttttctgcttgtagggtgcagtggaagtgtaaacagtttctgtggaaggacagaaaaggcnttcatttgctaaatggcatcaaagcttcaa

SEQ ID NO: 34962 - DNA, 101 bp, rice(Oryza sativa)
  misc_feature (71): n=t or c
ggtctccttcacgaccttcctaaggtagctgagcttcgtaatgtcatcaggttgcaccctcccgtttacanccaccgcagccctgatctccgcctgcacct

SEQ ID NO: 34963 - DNA, 101 bp, rice(Oryza sativa)
  misc_feature (71): n=a or g
tctctaaaacccagtcctccacagaacttggatgtcaacaatttatcccatgacctccaatgagtcttccntttgccattgtctgcaccccaccagaagtt

SEQ ID NO: 34964 - DNA, 101 bp, rice(Oryza sativa)
  misc_feature (71): n=t or c
tgaggagtccggatattcggaagaaatatatcgatcggtagctgaccgccgggaacccaacagcatcttgngttttatcacatcattcatccaatcttacg

SEQ ID NO: 34965 - DNA, 101 bp, rice(Oryza sativa)
  misc_feature (71): n=a or g
tgcccttcgtacggcccaagaaatgaatgatcgaatcccagcttggaatgaatgttggttgcaatgccagntataaactagaatagagcacacaagcttcg

SEQ ID NO: 34966 - DNA, 101 bp, rice(Oryza sativa)
  misc_feature (71): n=t or c
aaaggagctatctatagcttagcctaattagccctatcactaaattacatgtgtgagtaacatgcaccagncatgaatgctagtaaatgaggttggctttg

SEQ ID NO: 34967 - DNA, 101 bp, rice(Oryza sativa)
  misc_feature (71): n=t or c
gcggcgcagcgggaggccggatgtttcctacggcaattcggatggaatcgcccacaaccgatccgtgattntgggcaccatccacggctactacaaggagg

SEQ ID NO: 34968 - DNA, 101 bp, rice(Oryza sativa)
  misc_feature (71): n=a or g
tttggtggacataatcaaaacttgctccctccatgttttttttaaataatagtcggtcttgacttcaaaanttttgattcggttttgatttatagttgctc

SEQ ID NO: 34969 - DNA, 101 bp, rice(Oryza sativa)
  misc_feature (71): n=a or g
atcgcatagcttgacatctctataaggatagtcataaagtgccaaacgtgtcgtatggtttgcttgcaccntgttgttgaatgtcgctcttccgcgaggtc

SEQ ID NO: 34970 - DNA, 101 bp, rice(Oryza sativa)
  misc_feature (71): n=t or c
aaaacaaacggttttgctacttatctgtcgacagttttcagcgctaaacactgtcgatttgttggctgttngatccggctccaagattcgtgctgggatgt

SEQ ID NO: 34971 - DNA, 101 bp, rice(Oryza sativa)
  misc_feature (71): n=t or c
agaagcctggtatatatgaagtgctgaatgctaatcacatcaatttccactatattggaggaaatgagaanatatttttatagctgagtggttctttcacg

SEQ ID NO: 34972 - DNA, 101 bp, rice(Oryza sativa)
  misc_feature (71): n=t or g
aagtataccattccatggaatcgagtaccatttttcgaccaacaaatgctttactaacttgctcaatcttnattgcagagtatggcttggggtgcaaggtc

SEQ ID NO: 34973 - DNA, 101 bp, rice(Oryza sativa)
  misc_feature (71): n=a or g
gagggcagaatacagttcttcagcaagcgtttgttcataatggaataccgttcgtgtcagacataccgacnatcatttttggtgctgatgttagccatccc

SEQ ID NO: 34974 - DNA, 101 bp, rice(Oryza sativa)
  misc_feature (71): n=t or c
attgaacattgaggggcaaacactgataggaaatatatcaaaaatagtactacctgcgagcgggtcaacanctgacaacttatataaacgagcagtttcaa

SEQ ID NO: 34975 - DNA, 101 bp, rice(Oryza sativa)
  misc_feature (71): n=a or g
tagttgcccttacaagatcggacgccggtgctgctcggtggctcatgctctatgtaatccaacacgacctngttctccttggtgagcccacgggagcgatt

SEQ ID NO: 34976 - DNA, 101 bp, rice(Oryza sativa)
  misc_feature (71): n=t or c
tggggacccgaggcattcagatgacaggctggtgatcatcacaacctgtggggggagaaaggaggacaatngaaggggtgtggggggttttccggtttgaa

SEQ ID NO: 34977 - DNA, 101 bp, rice(Oryza sativa)
  misc_feature (71): n=a or g
ccaagctcagatcttgggatgattgatgaggcaagctaaagaaaccagcaaaaagggggattttgggatcnatgaacacaagagcaaagctccaagaaacg

SEQ ID NO: 34978 - DNA, 101 bp, rice(Oryza sativa)
  misc_feature (71): n=a or g
gccggctgctgtcctgtctcctctagatttggtcatcctcgtcgtcatcatcattgtctcctacccaaccngtcgtcggcacaccccatctcctccagatc

SEQ ID NO: 34979 - DNA, 101 bp, rice(Oryza sativa)
  misc_feature (71): n=t or g
tggatcttctatgaccatccgatcataaataggcggtctagattggacaagggtgaaagatgcatagcatntttcataaagacttaaatctttttccgtac

SEQ ID NO: 34980 - DNA, 101 bp, rice(Oryza sativa)
  misc_feature (71): n=t or g
cctttctatgtcgtccatggggtctgtccatgtttgcatgcacaggtcttcactaatgggaggtacaagancgtcgagcaccgggttgttgtggatgggaa

SEQ ID NO: 34981 - DNA, 101 bp, rice(Oryza sativa)
  misc_feature (71): n=a or g
ctacttttgctactcattttggttacacactcgttacttcgttagtattcatatacgaataccccgctgcnttgctgcaaaaaattaagatgcatatacta

SEQ ID NO: 34982 - DNA, 101 bp, rice(Oryza sativa)
  misc_feature (71): n=t or c
gttaggaatagaagcgttccatgcacagaaagagctccaggaaattgctgtaaaatctctcctcaacgtgnagataccaggattcaggtaatatatctaat

SEQ ID NO: 34983 - DNA, 101 bp, rice(Oryza sativa)
  misc_feature (71): n=a or g
gggatcgatcatccaataaatcaagtcatggtcatcataatgcaatgtctcaacattgaccacaatttcantatatatacttctctcttggttgatattac

SEQ ID NO: 34984 - DNA, 101 bp, rice(Oryza sativa)
  misc_feature (71): n=a or g
accatctccggaagggaattcagaaacctccagtttcttttgatcgagaactcagacattgtcagcatcangttcgatgagggagcagctcctaggctcga

SEQ ID NO: 34985 - DNA, 101 bp, rice(Oryza sativa)
  misc_feature (71): n=t or g
aaggccgctggcctcccaagcaactcgcttggttttgctctgctttgagaacaagtgggcagaaaaatggngaagaacattggaagaagaagatataataa

SEQ ID NO: 34986 - DNA, 101 bp, rice(Oryza sativa)
  misc_feature (71): n=a or g
ggggtgatgagagcattggcatcgagagatagaatatatagctaggataggtatattttttttagataatngaatataatattccggtctttgctcaaaaa

SEQ ID NO: 34987 - DNA, 101 bp, rice(Oryza sativa)
  misc_feature (71): n=a or g
gaacgtctggtcgatcgttaaagtgggccggatcttttcttctccgatcgatctcatgatcttccctttantagcgcatgtacctattctcggctttatct

SEQ ID NO: 34988 - DNA, 101 bp, rice(Oryza sativa)
  misc_feature (71): n=t or c
aaggagtgtcttgctatggttgatagatggctttctggggaacctctttgatcaatccagtaattaggagnctgttctcttaactaagattctcttattta

SEQ ID NO: 34989 - DNA, 101 bp, rice(Oryza sativa)
  misc_feature (71): n=t or c
aacaaaaagaacttgttgtctgtttcacaaacagtggcgtataaccagacatacccttcagaaattcgagncgtaccatgtaaagcacgccatgcagtcaa

SEQ ID NO: 34990 - DNA, 101 bp, rice(Oryza sativa)
  misc_feature (71): n=t or c
tgctgtcgcaacactagatgggtcaagcgcggcaaatcaatgatgcctgatattgatgggatgctgcattntgatacccagggtaactccaaggtttccaa

SEQ ID NO: 34991 - DNA, 101 bp, rice(Oryza sativa)
  misc_feature (71): n=a or g
agttgtcggcttatccgaaagtaactggtaatgtgattttacccaatggcttagatgatgattctggagtnatcccatcgaagggttgataggcatcaact

SEQ ID NO: 34992 - DNA, 101 bp, rice(Oryza sativa)
  misc_feature (71): n=t or c
cctcagccccacgcatccagcagaagagatcctccaagaattttctaccacctccctgtaatcctccgccngcaaccaagccgcctcaaacctgaatccct

SEQ ID NO: 34993 - DNA, 101 bp, rice(Oryza sativa)
  misc_feature (71): n=a or c
aacatttgattcgacccctacagcgttaaaatcgattttgggtgggacccatgaaaaaaatcttaatcccnaatttcccttccccctcacaacctgtagca

SEQ ID NO: 34994 - DNA, 101 bp, rice(Oryza sativa)
  misc_feature (71): n=t or g
aaaaaatatatactccacaacggattggggggaggaatgccgcggttttccactgcagaacgcggtatcancggcgagcgagctcgagtcaccgccggaga

SEQ ID NO: 34995 - DNA, 101 bp, rice(Oryza sativa)
  misc_feature (71): n=a or g
accaacgtttgactgactcttacattctagcttttctttctgtgatgccacaacagttgcattcttactgntaccatattttagaaaaggagagcactaac

SEQ ID NO: 34996 - DNA, 101 bp, rice(Oryza sativa)
  misc_feature (71): n=t or c
tgactatttaacgtggctaacatatatgcatgcatgatcattgcaggaatccaagaactgggtgatatgcngagtgttcgaatcgagttatgattcacaag

SEQ ID NO: 34997 - DNA, 101 bp, rice(Oryza sativa)
  misc_feature (71): n=a or g
ttacgaaactcaccgacacgcggggtcatgatggaggtttgtgtatattcaatttaaagatctccttactntggtgtattgactactacctctatcccaaa

SEQ ID NO: 34998 - DNA, 101 bp, rice(Oryza sativa)
  misc_feature (71): n=a or g
tgtgcaaatgtggaggaaaggaggaagaagaagtgttctggtgtgatccgaacgttctacctccacacgcncatctaaacagactagggacgagcggggga

SEQ ID NO: 34999 - DNA, 101 bp, rice(Oryza sativa)
  misc_feature (71): n=t or c
gctccagatgccagtgaggttctgagttcttcccagccattggtgttctcatcacaaacatcatctaagangagcaaaaaccttctttcatgtaaaatgtt

SEQ ID NO: 35000 - DNA, 101 bp, rice(Oryza sativa)
  misc_feature (71): n=t or c
aacaaaaataaaatattttgaaccgtacttctaactttcaagtcaaatagataaaaggttcgtattcacgncatcaaatttgtatcccatagttgagttgt

SEQ ID NO: 35001 - DNA, 101 bp, rice(Oryza sativa)
  misc_feature (71): n=t or c
aagtagaaactataaatattatgatataaatagagagggtggttatgctcaaccacctaaaaatctcttgngcccaactgctgcatcaggaatgttatcag

SEQ ID NO: 35002 - DNA, 101 bp, rice(Oryza sativa)
  misc_feature (71): n=a or g
aggtttttctccacattggttgtgcggaacagaaatccattgatggagcacctgttagctacacgaactcnatgatctggaccacgagatagacaatatat

SEQ ID NO: 35003 - DNA, 101 bp, rice(Oryza sativa)
  misc_feature (71): n=t or c
gcagcgaacttaaccttctttccagtttttgaatgttcttacggacattgccgacaatttactccatctcnggagagagtcggccatccgttggagattag

SEQ ID NO: 35004 - DNA, 101 bp, rice(Oryza sativa)
  misc_feature (71): n=t or c
ctaaagctccttcccttgtgagttgtgagccaatttcttgatgctccccagctcccaaatggccatacaantcacactcctactcatttcatgtagccttt

SEQ ID NO: 35005 - DNA, 101 bp, rice(Oryza sativa)
  misc_feature (71): n=t or c
tgacacatttatagcaaatcccatcataatattgagctccagctcttaatagggatggaaagactcggtgnacaagtcgactgcaatacatagacaacaaa

SEQ ID NO: 35006 - DNA, 101 bp, rice(Oryza sativa)
  misc_feature (71): n=t or g
cgtgatgtaactcggcttcgtgacaacctcagctacttcaacttctccggtgagcattgccacgaccttcnacattggtggtcgctggtgcggcgagccct

SEQ ID NO: 35007 - DNA, 101 bp, rice(Oryza sativa)
  misc_feature (71): n=a or g
tggacgctgacagccttccagttgtaataccctttgtccatacaggaatgcaggatataatgcctgtcggnaaacgtattccaagagcaggcaaaagggtg

SEQ ID NO: 35008 - DNA, 101 bp, rice(Oryza sativa)
  misc_feature (71): n=t or c
tagaggaacctgatgtggttgatctcggcacgatatttgaagaagaacaaaccaaagctcctgtgctaacnggaagccaagaagatggagacgacgaagat

SEQ ID NO: 35009 - DNA, 101 bp, rice(Oryza sativa)
  misc_feature (71): n=a or c
aaggaactaactttgttgattcccgcggccgaaggttccaaaagtccaaagtgaatatataaccaatggcncaataattgctatataattaatcaccgata

SEQ ID NO: 35010 - DNA, 101 bp, rice(Oryza sativa)
  misc_feature (71): n=a or g
ggatatatatggacctagtcaaggtttatatgctagtcttgttggggattccaacgagtttttattgatcngtgggtgcaccggctcgatggatcttgagg

SEQ ID NO: 35011 - DNA, 101 bp, rice(Oryza sativa)
  misc_feature (71): n=t or g
agctcagctctcaactcgatcggagcgcaagaagtcaagaacaaagaagaaggaagaaatctttcgaaccnaccgtagcgactcggccgcgacctcctgcc

SEQ ID NO: 35012 - DNA, 101 bp, rice(Oryza sativa)
  misc_feature (71): n=t or c
gagaaaaatagcgtgaaatttcaaaaatacccttgggcccacttaccagctctcctatctcttttatcccnctctctctctcctccttccagcgtcgccgc

SEQ ID NO: 35013 - DNA, 101 bp, rice(Oryza sativa)
  misc_feature (71): n=a or g
acaaggatattaatcaagtaatttcaagtgaatgccgccttcgatctttcatcgcattggataaagccatnccatcatccactctgctacctctgctatcc

SEQ ID NO: 35014 - DNA, 101 bp, rice(Oryza sativa)
  misc_feature (71): n=a or g
ttcttttgatgctgtcatgtttatccaaaaaaggtgtttaaggtatatgagggaggaacaaggctgcaganggcttgcagtggttgcttaacttggggaac

SEQ ID NO: 35015 - DNA, 101 bp, rice(Oryza sativa)
  misc_feature (71): n=a or g
tcttgccgtatgcatttagcagaacatcagctcgacacagctcaccagcacaagctataaatgttcttctntcaatctggatggatcaacatgaacatgat

SEQ ID NO: 35016 - DNA, 101 bp, rice(Oryza sativa)
  misc_feature (71): n=t or c
agcgccacgcccctgcacaggccggcgaatcccttagcgacgtcctcgtcgcaccccatgaagtgcacgangacgcctttgctcgccaggagcgcgacgtc

SEQ ID NO: 35017 - DNA, 101 bp, rice(Oryza sativa)
  misc_feature (71): n=t or c
tactacgtaagcgctacattaatgccacgtgggacaaagtcctcgtcaatcaaaatcagggagcaagaaanctcgtttgactggttttgtaagttgagaga

SEQ ID NO: 35018 - DNA, 101 bp, rice(Oryza sativa)
  misc_feature (71): n=a or g
tgctccccgttccacccaagctaatgtcaccgctaccgcttcacggatggtttccgttcgtgttatgctcnctctcgcgcgcgcgatgtagccgcgatgcg

SEQ ID NO: 35019 - DNA, 101 bp, rice(Oryza sativa)
  misc_feature (71): n=a or g
agcgaagacatatttaagctcaacccattgtctgggtgggctgagtttagcccattctctatcctaccaangtggatcaattcatcactcaccaatctctc

SEQ ID NO: 35020 - DNA, 101 bp, rice(Oryza sativa)
  misc_feature (71): n=a or g
aaactgctgttggagactcttttagttcccatggtggatgttgcattatgttgcgttcgggagtcccctgnctcacgcatcagtatgcacgatgcactgtc

SEQ ID NO: 35021 - DNA, 101 bp, rice(Oryza sativa)
  misc_feature (71): n=a or c
atcaaatcaaatcaaatcaaagctgtggttaagtagtaaaactaaactgccacctgtacattaatctggcnatgcatacttattatgaacccattttctgc

SEQ ID NO: 35022 - DNA, 101 bp, rice(Oryza sativa)
  misc_feature (71): n=a or g
ctctttccacatcgattctgactttcaatctgatctgattgttctattgcaggccattatttataaattcntgtcaccacatttgcttgccaaccgaattg

SEQ ID NO: 35023 - DNA, 101 bp, rice(Oryza sativa)
  misc_feature (71): n=a or g
taatgattataagaaaagcccccgctactttgaagttgatgatagaaatcgtgaggatagatctggaaaancaactccagttcaacggtttgaggaccgca

SEQ ID NO: 35024 - DNA, 101 bp, rice(Oryza sativa)
  misc_feature (71): n=t or g
gctgctttgatgagtacttaattactctgtggatgtctgtgtttttctcaatatttgtagcggtgttcaancacttcgagaaggacggggagtacttctgc

SEQ ID NO: 35025 - DNA, 101 bp, rice(Oryza sativa)
  misc_feature (71): n=t or c
aaaagcaaaacttgatgaattggaggctggtccaagctccacacaagccaacatagatcggctgaatgctnggaagatagaactcctagccgagttggagc

SEQ ID NO: 35026 - DNA, 101 bp, rice(Oryza sativa)
  misc_feature (71): n=a or g
attaacaccagctgctttattaaagcggagctagcaccaaaacaagagtggtgcactatttttttcggacncgcaaaaagattacatgttaatatattaga

SEQ ID NO: 35027 - DNA, 101 bp, rice(Oryza sativa)
  misc_feature (71): n=t or g
gccgcggttgatggtggcagcgtgggctgtgaatacgggggtgctagtcgtagatggggtaggggttgccngcgaggggcgcgggtggggggcaaccactt

SEQ ID NO: 35028 - DNA, 101 bp, rice(Oryza sativa)
  misc_feature (71): n=a or g
atattgtatttttacgtacgcagaatgtatagtacaattttccaattgcatcctgattggttcagatgagntaccctcaccgatggatcaccataagttat

SEQ ID NO: 35029 - DNA, 101 bp, rice(Oryza sativa)
  misc_feature (71): n=t or c
agttacttacaagtggagtttggcaaggaactagaaggaagagccttcttgagcaaaagcgagtcaaaganggatcaagcttttctaaaagaaatagctct

SEQ ID NO: 35030 - DNA, 101 bp, rice(Oryza sativa)
  misc_feature (71): n=t or c
aacggtggaagctggacccatcgatgcgtcgcggggttgcagacaaatagcttatattgttctgagatttngccgtggtacaggatgaggccattgcagtg

SEQ ID NO: 35031 - DNA, 101 bp, rice(Oryza sativa)
  misc_feature (71): n=t or c
gccctcttattcttttcttgtcgacgcaggaacgcgaaaggaaagagcgggaggagctagagaaaaagctngaggaagagcggaagaaagccgaggaggct

SEQ ID NO: 35032 - DNA, 101 bp, rice(Oryza sativa)
  misc_feature (71): n=a or g
tagaggacgctttcacggctacacgagtgtggtaggtttctatgagtatacggttggcagttgtgccattnacatgtgggttatagtaaagtagagttcac

SEQ ID NO: 35033 - DNA, 101 bp, rice(Oryza sativa)
  misc_feature (71): n=t or c
gcatccacaattattacaaatcaagtcccttagtagtattatattaggacggctttcagctgacacgatgnttgtttgattagtctttgtcccatgtggtg

SEQ ID NO: 35034 - DNA, 101 bp, rice(Oryza sativa)
  misc_feature (71): n=t or c
gttctcaggcggataaaataaaaaacgctagtaaaaacgtaaccggaggtccctgtttaataattgtttgnggaaatcaatttttacaagtggttgcgtta

SEQ ID NO: 35035 - DNA, 101 bp, rice(Oryza sativa)
  misc_feature (71): n=t or c
tccgccttcgccataccttcttcgccatatagacttcgcccaaaatgccttcaaccttgtgggataccagngcgattcttcgcccttcgccatctttgctt

SEQ ID NO: 35036 - DNA, 101 bp, rice(Oryza sativa)
  misc_feature (71): n=a or g
ggtgctttgtgtggttggcatgggaggattgggtaagactactctggtaaggaagatctttgaaagtaagnaagacatcataaataattttccacatcgtg

SEQ ID NO: 35037 - DNA, 101 bp, rice(Oryza sativa)
  misc_feature (71): n=t or c
ggtctcactaatgcccctgccacatttcaatcacttatgaaccaagtgttagcaccattctttaggaaatncgtattggttttctttgatgatatacttat

SEQ ID NO: 35038 - DNA, 101 bp, rice(Oryza sativa)
  misc_feature (71): n=a or g
ctctttgtcgtggtcaaagaatgccatgttgcagaaacagaaactgacccgggtaggggtaaattcttttnacttggggtcgtattcagttaactgatagc

SEQ ID NO: 35039 - DNA, 101 bp, rice(Oryza sativa)
  misc_feature (71): n=t or c
ctccaatggccaccaaggctgcctcctgacaagcatgactatacttttttcccccagcttcaaactttatngacggaaggtcttcacgatcactagtcaac

SEQ ID NO: 35040 - DNA, 101 bp, rice(Oryza sativa)
  misc_feature (71): n=a or g
ccacctatgcataatatttataatgctcctaatcatgcttatggagggtatccacaagatgctcgatatgnccaatataatcatattgtgccaccgcaacc

SEQ ID NO: 35041 - DNA, 101 bp, rice(Oryza sativa)
  misc_feature (71): n=t or c
acgtttgcctcttaattccttcttcagcttattttgtagttctctacgatcagtaatactggaatgccggntttctgtgatctcctcaagcatatcatgaa

SEQ ID NO: 35042 - DNA, 101 bp, rice(Oryza sativa)
  misc_feature (71): n=t or c
tcttccgtgatttctctgatcgattcttgggctgtttgtttctgtggatgcagggtactcgcagccatacncgccgccaccgtccggcgggcagtacccac

SEQ ID NO: 35043 - DNA, 101 bp, rice(Oryza sativa)
  misc_feature (71): n=t or g
cggtagaaaatccggataagattacaccgcagcttgcagatcgcaacgggagagagaggagaggagaagangagagaacccctgcacgcaagtgcggagga

SEQ ID NO: 35044 - DNA, 101 bp, rice(Oryza sativa)
  misc_feature (71): n=t or c
ccatcattggcataggaacagtctatcagatcccctccaatccgctgctcccttccaaatccgaaatcccntcttttccccaaacatatttcgccccaaat

SEQ ID NO: 35045 - DNA, 101 bp, rice(Oryza sativa)
  misc_feature (71): n=t or g
gcggtgcgttcttcttacagcatttttcatgtcaaagcaatgctcctcctggagatggtcacaaaggaaangaacctccacctcaatgtagcagaaggggc

SEQ ID NO: 35046 - DNA, 101 bp, rice(Oryza sativa)
  misc_feature (71): n=t or c
gattccaagcggtcaatcacatgtttcttgcaatcccttttccactggttcgacctgacatgcagcccctntctacgacagtgatagggtccgatggaaat

SEQ ID NO: 35047 - DNA, 101 bp, rice(Oryza sativa)
  misc_feature (71): n=t or c
ttggaggctggatttagtgactacaaaatcataccggtgctgggtgttcgatcaatcattgaggtttaccnttgatgctcctagaggtgtacatgtgcatc

SEQ ID NO: 35048 - DNA, 101 bp, rice(Oryza sativa)
  misc_feature (71): n=a or g
cggcgatttcaattcaaggacatcagaattcagagaagttcaaagaaggcttcttgacgacgacgacgacnacaacaacaacaaaaaacttatgttcctta

SEQ ID NO: 35049 - DNA, 101 bp, rice(Oryza sativa)
  misc_feature (71): n=t or c
gagtgagtggagtggagttgaccatcccttttttgttttccatggacctgacacgtagtactaccaccttnccttctttctgagcaaaatgtgttcctgtg

SEQ ID NO: 35050 - DNA, 101 bp, rice(Oryza sativa)
  misc_feature (71): n=a or g
tcgttctgttattttagtcgggttgtttcgagaagagagggcagttgttgttgctattcagctgggtgcangtcagatggtcagtctggttgattcccgtt

SEQ ID NO: 35051 - DNA, 101 bp, rice(Oryza sativa)
  misc_feature (71): n=a or g
cttatttgttaaacagttttgtaaaaatatgtttatattttgaagtgtgtagcgtcgataataagtggcgnatctcgaatataaattgaggtggggctaca

SEQ ID NO: 35052 - DNA, 101 bp, rice(Oryza sativa)
  misc_feature (71): n=a or g
aacgcaatgatggtaaatgctaaaagagggatagggtaacgagctagcaagtagtgtgatagcggttgatnaaacaataaaaactatgaataaacctctct

SEQ ID NO: 35053 - DNA, 101 bp, rice(Oryza sativa)
  misc_feature (71): n=a or g
tgacttcaaaggtggcaatgtgcatgtgattagtaacaaagagaattgggaccacaaaattgcagaggcanacaaggatgggaaaattgtaagtaacttgt

SEQ ID NO: 35054 - DNA, 101 bp, rice(Oryza sativa)
  misc_feature (71): n=t or c
tttccccctacctatcttgcaattcgttagaatgagaaatgcaattaagttctttcttgttgatctccgtnagaaacatgtgttggagttctaattacagg

SEQ ID NO: 35055 - DNA, 101 bp, rice(Oryza sativa)
  misc_feature (71): n=a or g
tagtgcagataattcctcagctgaaaaagatgtgcatataagaaaagttaggaacagaagtatgcagcgcncgctaggaaataacagaagcatctcaatct

SEQ ID NO: 35056 - DNA, 101 bp, rice(Oryza sativa)
  misc_feature (71): n=a or g
tgtaaataaataaatgcatttgggatttgtgtactctcttataggagcactacgggtgttccaacaatatntaatttctgaaagataaaagcatacagtga

SEQ ID NO: 35057 - DNA, 101 bp, rice(Oryza sativa)
  misc_feature (71): n=t or c
tgacaatggcactgttatgaattgcttgccaacaatgattcccaacaatttgatatgctgcaaacagtganaacctcgtttgatcaactgcagagtccacc

SEQ ID NO: 35058 - DNA, 101 bp, rice(Oryza sativa)
  misc_feature (71): n=t or c
ccacatatatttcttcacctcctcgtttcatcagaaacagctgcagaagttcaagaatagcctgttagtgntcgtatgagaggcatccaagaattgtgcaa

SEQ ID NO: 35059 - DNA, 101 bp, rice(Oryza sativa)
  misc_feature (71): n=a or g
gctagactgatagtagtagacaaaggtaccttaaattaaaactacgttaacttaaataagagggacatggntccctgataagtgggacccaccctcatgga

SEQ ID NO: 35060 - DNA, 101 bp, rice(Oryza sativa)
  misc_feature (71): n=t or c
cttttcaaggacaggagcgtgatgtgattattatgtcatgtgtccgtgcctcaaatcatggtgtgggtttngtggcagatatacgccgtatgaatgttgct

SEQ ID NO: 35061 - DNA, 101 bp, rice(Oryza sativa)
  misc_feature (71): n=a or g
gaactgtgaagggcaacaagtctcagaaacagtcaggcatctagtatgggaccttaaggatttcacacacnagcaagaatttcccaggcatttaatcaaag

SEQ ID NO: 35062 - DNA, 101 bp, rice(Oryza sativa)
  misc_feature (71): n=t or c
ccatacaacgaactgcaaatgatttggactgcactgcacaccataagcagcaactgaaacagtccaattanagtgatcttcatggccagctctttggtcga

SEQ ID NO: 35063 - DNA, 101 bp, rice(Oryza sativa)
  misc_feature (71): n=t or c
cgatggctggctgcaaccgagtgcgatgtcattcaatcgacacctaatctgcaatatatacaacaataggncacactttatttcacgtccctattcatttt

SEQ ID NO: 35064 - DNA, 101 bp, rice(Oryza sativa)
  misc_feature (71): n=t or c
ccggcgatacctggttgggtgtctttgttggagatggatagcacccttgtcttctccgcggttgaatgtangacgaggatcgatctttgggtgctgcagga

SEQ ID NO: 35065 - DNA, 101 bp, rice(Oryza sativa)
  misc_feature (71): n=t or c
ctgacgttgcatccacatgtcgcaatggcccggtcttcatttgaacatgtcatctacgtgccgatacaatngtaacaaataaacgttgaacccataggtca

SEQ ID NO: 35066 - DNA, 101 bp, rice(Oryza sativa)
  misc_feature (71): n=a or g
tctcataacaaacccaactgtgcgctggatgggcatgctaatttgctgacagcctttgtccaccgatgacnggtacttttcctaggaccccacgagcacct

SEQ ID NO: 35067 - DNA, 101 bp, rice(Oryza sativa)
  misc_feature (71): n=a or c
cgcggataacatggagcctgaggagaaccacgctctgacaccatactcacccatgctgtgtcatacaaggncagtgataattcaactccctgcagcttctt

SEQ ID NO: 35068 - DNA, 101 bp, rice(Oryza sativa)
  misc_feature (71): n=a or g
ttgtaaaaaaaaaaaattatgtgtccttaacgactcaaaaatcaaatgatataaaataaactagctgggtngcccgcgcaattgcgcggctagcacccaaa

SEQ ID NO: 35069 - DNA, 101 bp, rice(Oryza sativa)
  misc_feature (71): n=a or g
ggggcaacagttcagtacactcaggatgatgggcttggtgaaggtgtcaccaaacaaggtgagggatctcnggccgtgaaagcttcctggctctcatcatc

SEQ ID NO: 35070 - DNA, 101 bp, rice(Oryza sativa)
  misc_feature (71): n=t or c
tgacagaggcggcttacggtcacattgccagaggttgggtatatggtcctttcgctgaccaaccgatcttncaatcttcatgagaaagtcacttcttccgt

SEQ ID NO: 35071 - DNA, 101 bp, rice(Oryza sativa)
  misc_feature (71): n=t or c
ctgtaaccgattaaatctcgcattccagtattgattgcttgacttatgggtatcatcttgaacggtagtancaggagctacaggaggctcatttttcttgt

SEQ ID NO: 35072 - DNA, 101 bp, rice(Oryza sativa)
  misc_feature (71): n=a or g
tgtagagctgtaggctagagtggggcctagtggatccaaatcacgtgcgagttagtttgctcgtgcgtctntgtgagataggattcctcgctccgcttgac

SEQ ID NO: 35073 - DNA, 101 bp, rice(Oryza sativa)
  misc_feature (71): n=a or g
gagcactcatcttcattgataagtctattttcctccctccaaaaatgtctctagttgaatggcatccctcnaccgcaaaaccgggtataacctgtccccca

SEQ ID NO: 35074 - DNA, 101 bp, rice(Oryza sativa)
  misc_feature (71): n=a or g
gtcatatgtcaaaagaattggtctatatattgctgtgggagttcattgataaataggagccgacgtactcnaaatctttcatatacgttaaaagagagtcg

SEQ ID NO: 35075 - DNA, 101 bp, rice(Oryza sativa)
  misc_feature (71): n=t or c
ctgttttgtctatttctcatgcatactcccttcgtaaaaaaacttctgattataaggataaatttagacanagtgtatctacagattcatatttaagatta

SEQ ID NO: 35076 - DNA, 101 bp, rice(Oryza sativa)
  misc_feature (71): n=a or c
gaccacctctcctcgaaggattgttagtactgaagctacaacatgcccactcactgtgagtcccagtgcanttgtatttcaatcccttacactcgagctga

SEQ ID NO: 35077 - DNA, 101 bp, rice(Oryza sativa)
  misc_feature (71): n=a or g
tcacctccacggcttccttatactattcaacaggaagaaggcagtggcacggacacggacggaggggattngggaggtggcatgggcacggataagggtgt

SEQ ID NO: 35078 - DNA, 101 bp, rice(Oryza sativa)
  misc_feature (71): n=a or c
tgcaaaaaacatccacagcatccatacatctaattcgtccatacactgcatccacaatgcatccacaatgnataaaaaaaacgagggagaggaagtgtacc

SEQ ID NO: 35079 - DNA, 101 bp, rice(Oryza sativa)
  misc_feature (71): n=t or c
gcgtccctctcaagaagctaaacgtcgctctcgtcgactgattcatcctacaccaacacgtcaaagtgaangacagaaggcaatggcaaacggggatgcac

SEQ ID NO: 35080 - DNA, 101 bp, rice(Oryza sativa)
  misc_feature (71): n=a or c
gccaaggagaagctccctcacaactccagcttcgcaaagttatcagacttgagtgccaacaaatggagccnattccttgagaagttccaggatttgctcca

SEQ ID NO: 35081 - DNA, 101 bp, rice(Oryza sativa)
  misc_feature (71): n=a or g
aatcattgacagtgcccgagatagtgagaccttgctccttgattatggcgtgatgaaacaattttctatanccatgccagctcaagcaagtacacagccaa

SEQ ID NO: 35082 - DNA, 101 bp, rice(Oryza sativa)
  misc_feature (71): n=a or g
ataaagctatgagtgctgccggaatctacaggcatcaagacttcatggcgctgaattaacccttgcaaccncattgtcttaggagactcaatgcccagaac

SEQ ID NO: 35083 - DNA, 101 bp, rice(Oryza sativa)
  misc_feature (71): n=a or g
ttaaaggttatccttttgtccaccaaaaagacaaagaggacagaagatcttagacagatgaaccagggacnaatggaactatattgtattgctaatagatg

SEQ ID NO: 35084 - DNA, 101 bp, rice(Oryza sativa)
  misc_feature (71): n=t or c
actggataattaattatcgatatttgctagtagcatctatcatgtttggatgctgctttctccgtgaatgngatgataataataatcagaagaaataaata

SEQ ID NO: 35085 - DNA, 101 bp, rice(Oryza sativa)
  misc_feature (71): n=t or g
tatagttgttacatttccatcgccaacaatggcgcatgtcagcttctccgatctgccacctgaagctctcnacgacatcgcccgccgcgctggcgccctca

SEQ ID NO: 35086 - DNA, 101 bp, rice(Oryza sativa)
  misc_feature (71): n=t or c
cagcagagacaccgatgtacgtacgtacgtatacgtaccgtatgccaacatatatgtacgtacgccatcgnctctataaatagccgagtgatctccaagct

SEQ ID NO: 35087 - DNA, 101 bp, rice(Oryza sativa)
  misc_feature (71): n=a or g
atccgttcgatattcatctatatacccaggtaattcgtaattcggataaaatcccaggctgacccagcatnatttaggtcgcattcatagtaacaacattt

SEQ ID NO: 35088 - DNA, 101 bp, rice(Oryza sativa)
  misc_feature (71): n=t or g
agtggctttgatcaaagataaacgagaaatagcaaatacttctgtggactatggaagtgctatgcacattnatgttaattatattggtcagcacattctgt

SEQ ID NO: 35089 - DNA, 101 bp, rice(Oryza sativa)
  misc_feature (71): n=a or g
actgagtagtaaaccgcatcccattttgtgccaatcaccaaaatctcagagttgcattctaccagacggtnggaatacaatcgaaagctttcatcgcttgt

SEQ ID NO: 35090 - DNA, 101 bp, rice(Oryza sativa)
  misc_feature (71): n=a or g
agcatgcagggattgttgtgatggttgcctggcagcttgaagagcatactgaatttgtatattgttagctnaagtctgctgatccaaagaggagtagattt

SEQ ID NO: 35091 - DNA, 101 bp, rice(Oryza sativa)
  misc_feature (71): n=t or c
cctgcaatggaaaaatcgggaggttcgccaattattttcttagcgggtggaatgctatttccgtttccccntgggtttgttcggatggggaaaggagctcg

SEQ ID NO: 35092 - DNA, 101 bp, rice(Oryza sativa)
  misc_feature (71): n=t or c
tttcattctcaaggctggcaaagcactgaacaataggaaagcagagatacgtgtgcagttcaaggatgctnctggtgacatttttaaatgtatgcgctaaa

SEQ ID NO: 35093 - DNA, 101 bp, rice(Oryza sativa)
  misc_feature (71): n=a or c
cagtgagtaaaatgagactttttttctacaatgatgactcaagcaatgagcgtcgcatggctaccgccttntttagttggggaaaaaattttaggtttagt

SEQ ID NO: 35094 - DNA, 101 bp, rice(Oryza sativa)
  misc_feature (71): n=a or g
ttttagtaccaggagaattacccccctcaactcaatttagagctgttttcttctacattgcgtccgcgtgncaatccagtcagcatttttcattaaaaaaa

SEQ ID NO: 35095 - DNA, 101 bp, rice(Oryza sativa)
  misc_feature (71): n=a or g
agaccaactactagctctagcatctctccctccgtcactttaaaaatcctatcaacgcttctaaatcactncgtggtgctattaaattggagaaagtacta

SEQ ID NO: 35096 - DNA, 101 bp, rice(Oryza sativa)
  misc_feature (71): n=a or c
gatgatatttcgttgtctatcttagaaagagttgatataaaaacggccgtaaggacaattgtcctctcaanacgctggaaacgtctcccctggatgcttcc

SEQ ID NO: 35097 - DNA, 101 bp, rice(Oryza sativa)
  misc_feature (71): n=a or g
tttctgcattactgaggacctccttgaagttctgctgtctgctggaaacttcatatggcttgcgtctaccnacatatcttacgtgcattcatcacataggt

SEQ ID NO: 35098 - DNA, 101 bp, rice(Oryza sativa)
  misc_feature (71): n=t or c
tctttgtcagcagtgtgggatcaaacaacatgttctagtgcaatgagaacacttccgatggattctttctnaacagtgaacggacaaaacctttccacaaa

SEQ ID NO: 35099 - DNA, 101 bp, rice(Oryza sativa)
  misc_feature (71): n=t or c
ccaaatcgctctcaaccgcgccatggccggctagactgcatgctaatgctacacatttatattgtacaacnccgccggtggggaggaagagagagcgagag

SEQ ID NO: 35100 - DNA, 101 bp, rice(Oryza sativa)
  misc_feature (71): n=t or c
tagactgctgacttgccagatttaccaactgtccaagggacttatttagctgctgctgattctgttgttgntgctgctgctgctgctgtaactgttgtttt

SEQ ID NO: 35101 - DNA, 101 bp, rice(Oryza sativa)
  misc_feature (71): n=t or c
gaatgtgacttcgagaagcccttgaataaaggatggacatgacagccaagttccaaggtttggatcttctngcaaatttgaacatgctctggcaacttctt

SEQ ID NO: 35102 - DNA, 101 bp, rice(Oryza sativa)
  misc_feature (71): n=t or c
tctgtgatgacaagttcctgcccaaatatgttcgtcggctttctctccatggtgacactgttgtgaatggngataacttcaacggtattgatttatcactt

SEQ ID NO: 35103 - DNA, 101 bp, rice(Oryza sativa)
  misc_feature (71): n=t or c
gcaaactctgattcgggatcatctcctgcgtgcacagactcggatgaaatttcaggctgacaatcgtcgtnccgaacgagtttttgttgtgggcgattggg

SEQ ID NO: 35104 - DNA, 101 bp, rice(Oryza sativa)
  misc_feature (71): n=a or g
ggggcccacaccttctcctcctctctctctttaattccctgcacactctttgatccgtcggagcccacccnttgtgtcgctgcctcttccaccagcggacg

SEQ ID NO: 35105 - DNA, 101 bp, rice(Oryza sativa)
  misc_feature (71): n=a or g
ccgcttgctcttgtccaggaaacaatccactctttcccgctcgcaccgcctccaatcaatcaatcaatcantcaatcagtcaatccatcgagattaaaggc

SEQ ID NO: 35106 - DNA, 101 bp, rice(Oryza sativa)
  misc_feature (71): n=t or c
attcgaggacgaacagggcgattccagatgaatcttgtccaagaagctcagcgagccgtagacgaaggtgnagccgttcaggtcgtctcccaccagcgcgc

SEQ ID NO: 35107 - DNA, 101 bp, rice(Oryza sativa)
  misc_feature (71): n=t or c
atggtgagccccttcctccacttcgccactgctgcatcaacgttacacctcctcctccaccaccacgccgncgttgtcggatcgaactgcgagcgccacca

SEQ ID NO: 35108 - DNA, 101 bp, rice(Oryza sativa)
  misc_feature (71): n=t or c
ggattctttcatggagtcgcgaccttccgtattcttctctttgatctccccgcttgcggattcataatatncggaacttcatgttggctctgcttaatctg

SEQ ID NO: 35109 - DNA, 101 bp, rice(Oryza sativa)
  misc_feature (71): n=a or g
gatccctccctcccttgcagtaataactcaggtattaaatgcccataagaaaaggctgcatcagtgctcancagcagcaagcacaccaaccatcgttcaga

SEQ ID NO: 35110 - DNA, 101 bp, rice(Oryza sativa)
  misc_feature (71): n=t or c
ggtgggggggggggggtttacgtttcgttcttgtgctctgggttaatcacggaatcgtactgggaggtctngctagatgcgttcggcgccccgcctggatg

SEQ ID NO: 35111 - DNA, 101 bp, rice(Oryza sativa)
  misc_feature (71): n=a or g
aaaatcaaatttatagttgtgcgtatatcattatttatttttgacaaatacagtaacaacgcatgctctcntaacgcacactcatttatccatatgaacgt

SEQ ID NO: 35112 - DNA, 101 bp, rice(Oryza sativa)
  misc_feature (71): n=a or g
cttgactatagcatatccgaaaacagtatcaaaacttcgagccagatggtcactgatccgcccaccaacancttcagctcagagcaaacaccgacctctca

SEQ ID NO: 35113 - DNA, 101 bp, rice(Oryza sativa)
  misc_feature (71): n=a or g
gtatgccgctggtagcttgactcatgcattactcgttgtacatgcatgttttttcacctagctagtggtanctcctccattcatatatttgagccttgtcc

SEQ ID NO: 35114 - DNA, 101 bp, rice(Oryza sativa)
  misc_feature (71): n=t or c
ccaccaaaatttttctctcctcttgattcttgcggtaattcctgggcgaggtgggggttgattgcttcggngatcggatcccacaaaagcttttgctccct

SEQ ID NO: 35115 - DNA, 101 bp, rice(Oryza sativa)
  misc_feature (71): n=t or c
gcatggcaataaaggtcgacctattaccacgtttgaggtctgtggcaatacacattagcacttattaccangctttggtgcgatgcgactagttcctacga

SEQ ID NO: 35116 - DNA, 101 bp, rice(Oryza sativa)
  misc_feature (71): n=a or g
tttcttcaccgtgatttatttactaatttttcataataccccttcttgatcaattctactaccgttaagtnagaagatagtaaaaataaatctaaaccctt

SEQ ID NO: 35117 - DNA, 101 bp, rice(Oryza sativa)
  misc_feature (71): n=t or c
tgtttatgaagtagggctaccttcttctgataatcaattttcataagttcccctgcctggtttggcatatncaaacaataaattagtatacagaaaacagt

SEQ ID NO: 35118 - DNA, 101 bp, rice(Oryza sativa)
  misc_feature (71): n=t or g
ttgagatggaggagaaatcgacaatcatatgtgaccataccaccagagattttaacatacacatcatgctngcggtaagtgcactcaggtatacgaaaggc

SEQ ID NO: 35119 - DNA, 101 bp, rice(Oryza sativa)
  misc_feature (71): n=a or c
cgaagaaacagcaccttgttgtttggccttctctcactctcctcccagtattcgacgacatgacgccaatncgggccagtgatacaccggcctttgcagaa

SEQ ID NO: 35120 - DNA, 101 bp, rice(Oryza sativa)
  misc_feature (71): n=a or c
tccagtagctttcactgacaaatactgttcgttagtagctttcactgatagatgcatggatggtacttccnccttcatgagggctctgaagaaagcaacca

SEQ ID NO: 35121 - DNA, 101 bp, rice(Oryza sativa)
  misc_feature (71): n=a or g
tgatgtgaacaatagttatatccatagtaggcataataacatcacacacaccactccacctcgcagcccgnttagggcgcacaagactgccacgttcttct

SEQ ID NO: 35122 - DNA, 101 bp, rice(Oryza sativa)
  misc_feature (71): n=t or c
aaagtatcatatatttagtcttgttttgtgttacctctatggtgaagaggggcatatgtgcgctggtgcangtgtttatcttaggccccgtttagttctct

SEQ ID NO: 35123 - DNA, 101 bp, rice(Oryza sativa)
  misc_feature (71): n=t or c
caattgttctatcaaggaatctctctggcatgaacttctcaggttctgtccaaatgtttttatctctaccnatggcccacacatttatcaatatttttgta

SEQ ID NO: 35124 - DNA, 101 bp, rice(Oryza sativa)
  misc_feature (71): n=a or g
ttctagttatcctgtaattgactaaagaagctgcgtcttgcatgacagcttcaagttacacatgctgtctngtgctataaatacccacgaactcttcactc

SEQ ID NO: 35125 - DNA, 101 bp, rice(Oryza sativa)
  misc_feature (71): n=t or c
tggcgagcgcctccagtggtgcgatcaactccctcctatccaagctcgccgcgctgatgggggaagagtanggcaagctgagaggcgtccggaaggaggtg

SEQ ID NO: 35126 - DNA, 101 bp, rice(Oryza sativa)
  misc_feature (71): n=t or c
acatacaagctaaactagctcacaagtgatgtgcaattcactgaaacttgtgtcgagattcctacctgaancatgggcaactcgaaacaaacatatttcca

SEQ ID NO: 35127 - DNA, 101 bp, rice(Oryza sativa)
  misc_feature (71): n=t or c
atatattgttccaattgtgacttcagcatgatacctaggtaccaaatctgatgcctacggagtatcatgtntggtgccggagacaccatattcggtatcat

SEQ ID NO: 35128 - DNA, 101 bp, rice(Oryza sativa)
  misc_feature (71): n=a or g
atagtgcaataatggtactctattatcttgtgtcacagcttaagcctaaatttggttttactagcatgaancttttggtgtagctgtacattggtaaaagt

SEQ ID NO: 35129 - DNA, 101 bp, rice(Oryza sativa)
  misc_feature (71): n=a or g
acgagtgaccaaggtagcaaacatcttatctcatatatttaggcttcgttcgtaacggccagagtttggcntgtaaaacgagacaaatattagtgtattaa

SEQ ID NO: 35130 - DNA, 101 bp, rice(Oryza sativa)
  misc_feature (71): n=a or c
agtcaagggataattcttatgtgactgcactggatgaagtttttaataagcatatggctgcagcaaaggancttcttgatggagaagacctagcaagattc

SEQ ID NO: 35131 - DNA, 101 bp, rice(Oryza sativa)
  misc_feature (71): n=t or c
cgaaggtgaacgtaggagcagtcccctcgaagttccccatgatctcctccgcagcttcgtggacctccgtntcctttgtcctggggggaggagagggggga

SEQ ID NO: 35132 - DNA, 101 bp, rice(Oryza sativa)
  misc_feature (71): n=t or g
gttaacagttgtcatgttctggggtgtttttggtccatgccctctaaaatcttggtaccgtcttttttatnctggaaaattttgcttgtgtcatctttttt

SEQ ID NO: 35133 - DNA, 101 bp, rice(Oryza sativa)
  misc_feature (71): n=t or c
acagtctcataagtgattggcactccgatgtcttggaaagttataacttctcttcttcgagatgagcgacntgacattcggggagcacacttccttgtgta

SEQ ID NO: 35134 - DNA, 101 bp, rice(Oryza sativa)
  misc_feature (71): n=a or g
gaggatgagtagtaatgcttgtgtgtcactctacccttgccatagagtaattgctactagagccatacccnaactcttccgaaggcttccgaactcctgat

SEQ ID NO: 35135 - DNA, 101 bp, rice(Oryza sativa)
  misc_feature (71): n=a or g
tggaccaacttgcaccttgcaaatttagagacttatggggcaatttactaaatagttggaaattttggccnccttgaaacacagttcttcatgttttacca

SEQ ID NO: 35136 - DNA, 101 bp, rice(Oryza sativa)
  misc_feature (71): n=a or c
actttggactaccatgttcattacttctagtcttttcttcctgcaaaatgttaattgggaataaggaaatnaaacctaaacatcaaatagatcaagtggct

SEQ ID NO: 35137 - DNA, 101 bp, rice(Oryza sativa)
  misc_feature (71): n=t or c
tgtctgcccgtcaaagatgattaaaaaaatcgccgtcataacctcctccctgctccgaacccacgcccatnggtcttatccttttttcttctgcctccctt

SEQ ID NO: 35138 - DNA, 101 bp, rice(Oryza sativa)
  misc_feature (71): n=t or c
gtagttgcttcgcgcctttatatacctacatgtcacagatacacccgtatatacatacaatatgtagtctngtagagccagaacgattgggcatacttcat

SEQ ID NO: 35139 - DNA, 101 bp, rice(Oryza sativa)
  misc_feature (71): n=t or c
ggtcggcagagaggagaaggatggtgccggagaggatgaagaggacaccataaactccaaatcaacgcganagaggcttgttgcgccgatgatccctccga

SEQ ID NO: 35140 - DNA, 101 bp, rice(Oryza sativa)
  misc_feature (71): n=a or g
gcccaggaatatcaacggaagatgaactcaagaagaacaacaccattccgtaccgagagggagacaaaacngagatcaccatggggttgcgggtgctcgtt

SEQ ID NO: 35141 - DNA, 101 bp, rice(Oryza sativa)
  misc_feature (71): n=t or c
aagcgtgccaaaactaactccgcatgcatgcactgcctggaccgcttcttgctccaaacgtgccgctaatnaccgtgcatggctaatcaattccacctaca

SEQ ID NO: 35142 - DNA, 101 bp, rice(Oryza sativa)
  misc_feature (71): n=a or g
ttgtacgtactagaattgtacgggaacaatttagagggaagcttgccagctcaaaagggacgattgggaantctttataaccttcgtatcagtgataacaa

SEQ ID NO: 35143 - DNA, 101 bp, rice(Oryza sativa)
  misc_feature (71): n=t or c
atcaaaacggcagccgaagaaaaaagttccttcaaaagacgaggacgtaccggcaaacacaaccggcacanagaaaagcgaacggtcagcaaaggcgaaga

SEQ ID NO: 35144 - DNA, 101 bp, rice(Oryza sativa)
  misc_feature (71): n=a or g
acctcgggctactactactcccctcccttactcatgcagatcgctacacactagtgagaacgagtggaatntgctcggcctccaccgcccgcacggcacaa

SEQ ID NO: 35145 - DNA, 101 bp, rice(Oryza sativa)
  misc_feature (71): n=a or g
tgatgttatctagcagcgaccataccggaaagaagactgaaagcttcggttctctcgtgaaagaagcaganggccttatgaagaataagaaggaaaaaaat

SEQ ID NO: 35146 - DNA, 101 bp, rice(Oryza sativa)
  misc_feature (71): n=a or c
ccagttatttgctgtaactcctagttcaataaccttgtttagcttgcatgatcatccaccgaggaggcaancgcttgatcagattggttgtgagaccaatg

SEQ ID NO: 35147 - DNA, 101 bp, rice(Oryza sativa)
  misc_feature (71): n=a or g
gagaatgaattccacgttgagtgggccaatcatgatgcgcacataaatctcaatgtatttgagtctgtgcntaaaaataacaaaatcaattaccgaatcat

SEQ ID NO: 35148 - DNA, 101 bp, rice(Oryza sativa)
  misc_feature (71): n=t or g
taaaagaaaaaggaaagaaaaacacaaagtgagcattagatcaagactgtgcacctgtcaagaagatcctntgccatggatttgcatccaccagggataga

SEQ ID NO: 35149 - DNA, 101 bp, rice(Oryza sativa)
  misc_feature (71): n=t or c
tcacgatcatcatcaacatcattgtacagtgcaaccggcatgatctctcgacccatggaaatatcaaagcncaaataccctgttggccggaaagtcagggc

SEQ ID NO: 35150 - DNA, 101 bp, rice(Oryza sativa)
  misc_feature (71): n=a or c
ctgatgatgaccactttccccacaattgaaacatttgatctcttccttctgcatcgctcctgctctccccncttctccaaccttctcctttcctctgaaaa

SEQ ID NO: 35151 - DNA, 101 bp, rice(Oryza sativa)
  misc_feature (71): n=a or g
agagtccatatggatgccgccaacaggaatctctgcagttcctatgaggcactgatcactgttatcgatcnaataaacctacagaaacacaatagaaggtt

SEQ ID NO: 35152 - DNA, 101 bp, rice(Oryza sativa)
  misc_feature (71): n=t or c
ccatcaaatgttgtcactgtactcctctacgacccatccgttgcctgggattttaaaaatcaaacatgatnatcgtttagattcattttttactttctaga

SEQ ID NO: 35153 - DNA, 101 bp, rice(Oryza sativa)
  misc_feature (71): n=t or g
cagaaattatgataattgatgtttcagtagtaattcagatgtttgctgacctcgctccatatttctaaganatcaagaaagtaaggcttttctctgaaata

SEQ ID NO: 35154 - DNA, 101 bp, rice(Oryza sativa)
  misc_feature (71): n=t or c
ggcttgtctggcgctgtgcgaagcgaccaaagccattttgtactaagtgcaacacctaagaggtcaaggtnatggatgccaaggccaccaagttgctttgg

SEQ ID NO: 35155 - DNA, 101 bp, rice(Oryza sativa)
  misc_feature (71): n=a or c
tgatccttaaattaatctagaaattgtcaaattgacttgctcatggttttaaaggcttaggttagatttcncaatcaatataaaaaaaatcaactgtaata

SEQ ID NO: 35156 - DNA, 101 bp, rice(Oryza sativa)
  misc_feature (71): n=t or g
ccagagtatgctccattggactgaccaccatgatgattttgcaccactgctttgctttgcatttctcttanaaaactgccgctaatggtggcgcacgtttg

SEQ ID NO: 35157 - DNA, 101 bp, rice(Oryza sativa)
  misc_feature (71): n=a or c
taaaaaaaagcaaaaaaaaatgtcaattttaacactataagtccatcagaataatagtttctctctctctntatatgatgataaatttgaagataaaactt

SEQ ID NO: 35158 - DNA, 101 bp, rice(Oryza sativa)
  misc_feature (71): n=a or c
aataatttcaaacttcatgaacttggagccaactgctactaggttaacgcaatttgtcaatactactgggnaaaccctatcaaatgagtttttggccacag

SEQ ID NO: 35159 - DNA, 101 bp, rice(Oryza sativa)
  misc_feature (71): n=a or c
gaaggaggcagcatgcgagggagtgggaggaggagaggaagaagatgaggtggttcatggtcagggactangcccacgcgcggcgccacgagccgaggaac

SEQ ID NO: 35160 - DNA, 101 bp, rice(Oryza sativa)
  misc_feature (71): n=t or c
tgcttgagtaggttgatgaccaggcctcatttgagcatgcagctgattgggttgaggagtgcttggaagangccctggtggatcaatattgtaatcagaaa

SEQ ID NO: 35161 - DNA, 101 bp, rice(Oryza sativa)
  misc_feature (71): n=t or g
caacattgacctttgatggtgtatcaaaagcaatcccatacaccgttctcttcacatactcccttgatttntatgtagatgaggaagttcttagtgtttgt

SEQ ID NO: 35162 - DNA, 101 bp, rice(Oryza sativa)
  misc_feature (71): n=t or c
caccacactcattccacatccgcgcacacacatagatcctttcacacacaagcgaggaggcattgcatttnagggtgcacgcgacacatgcaacactaacc

SEQ ID NO: 35163 - DNA, 101 bp, rice(Oryza sativa)
  misc_feature (71): n=a or g
atcaatggaggacaacaattagcacagtacaaaaagaaacactcacctttcccatctcaaggtaaacggcngctcggttggtgaggtaggagacgtcctca

SEQ ID NO: 35164 - DNA, 101 bp, rice(Oryza sativa)
  misc_feature (71): n=a or g
tgagtccttttggagcaacaaaagtacccatccgtcccaaaaaaaaaaatcgaactctaggtctaaatctngacacacaaacccagggtttgattttttct

SEQ ID NO: 35165 - DNA, 101 bp, rice(Oryza sativa)
  misc_feature (71): n=a or g
tgtatgtatactttcttgatcataattaccttcttgttagcagttgctgcagcgatggaaagctgtgatgngctggtgccgccatgggcaggagctctgaa

SEQ ID NO: 35166 - DNA, 101 bp, rice(Oryza sativa)
  misc_feature (71): n=a or g
atatatgactatatttccaacaatgagaacctactggctgctggcatactgcttgccatgccgatggatgncctaacgctgatgacgttgctgcttgcctg

SEQ ID NO: 35167 - DNA, 101 bp, rice(Oryza sativa)
  misc_feature (71): n=a or g
atttattttcctttagcattacggcatctgcatgcacgcgtgcaagtgcacatgacataaaaaaaaagcanttttacagtccttgaaatgataccatgagg

SEQ ID NO: 35168 - DNA, 101 bp, rice(Oryza sativa)
  misc_feature (71): n=a or g
ttacacataaaattcgcacgacacttattgtagtggagatccatgaaaccagccttgaagtacataaggcnatatattgggttaaaatttttaaacccact

SEQ ID NO: 35169 - DNA, 101 bp, rice(Oryza sativa)
  misc_feature (71): n=a or g
ccatcaaaggtgaaggtttgaactcgtcagaggtgatctgatcaggcgtaatgatagattaagctgaaatnaaaaaaaaaagaagatagcatgcctaaaca

SEQ ID NO: 35170 - DNA, 101 bp, rice(Oryza sativa)
  misc_feature (71): n=a or g
tagtatgaacatgtttaaccgcattagcctgttatgcaccgatgtagagctatcataggctaagctagccntgtcaatcttatccaagtgcttgcattagg

SEQ ID NO: 35171 - DNA, 101 bp, rice(Oryza sativa)
  misc_feature (71): n=a or g
gaaaaaggtgggcttggaatcaaatgcctaaaatcacaaaatgaggctcttcttctgaaaagattattcancctgttctcgaatgagtcgacctgggctaa

SEQ ID NO: 35172 - DNA, 101 bp, rice(Oryza sativa)
  misc_feature (71): n=a or g
attctcgaagtggttggtgaaaaccaatatgaattcatcaaagggaggactatccaggaatgtttggcacnggcttttgagtatattcatcaatgtcagca

SEQ ID NO: 35173 - DNA, 101 bp, rice(Oryza sativa)
  misc_feature (71): n=t or c
aacaacaattactttacaagcattacaggaagcaatattcaactcttctagctatgatgaccacttcatangaagatttattcttttctcaattggatcat

SEQ ID NO: 35174 - DNA, 101 bp, rice(Oryza sativa)
  misc_feature (71): n=a or g
tgcaaaggcagcattgggaaaatttctttgctactgatgtatccttcgttgccgttgatccaagattccancagttgcgattccattttggcaccagccct

SEQ ID NO: 35175 - DNA, 101 bp, rice(Oryza sativa)
  misc_feature (71): n=a or g
ataatatttgcggttggatttattttttttcgacatgaacgggcagccaaggtttcacgatatgataggcngtggtggcaagggaatgcaagataatgaga

SEQ ID NO: 35176 - DNA, 101 bp, rice(Oryza sativa)
  misc_feature (71): n=a or g
gcagcgagattggcgacagcacggcacctgttaggtgttcgtgattttgggccgtagcagaattaaggggnagtttgttgactgttatttcagctatggcc

SEQ ID NO: 35177 - DNA, 101 bp, rice(Oryza sativa)
  misc_feature (71): n=a or g
gccttgcactggtggacagctctgacgcaagggaagctccgcacaacagtcctgaaatttttacattttgntcctttttgaaaacttattttacaaataga

SEQ ID NO: 35178 - DNA, 101 bp, rice(Oryza sativa)
  misc_feature (71): n=a or g
agatttattcactctatttggtcttgtagtagatccaacggctaatatttaccaaataatgtggctgattntcattccactttggatttcacttttcacta

SEQ ID NO: 35179 - DNA, 101 bp, rice(Oryza sativa)
  misc_feature (71): n=t or c
tctcttaactgtgggagtcgttccacatgcatcctccaatccagctgatctggattgaataggtttctttntcacagtatctctctttgaaccaggttctc

SEQ ID NO: 35180 - DNA, 101 bp, rice(Oryza sativa)
  misc_feature (71): n=a or g
tcgggaacccgtcgctctcgctgaagaactcctcctcctatgtacatagttatacattgttatattttagnacggtgagagtaacgattttaatttatgct

SEQ ID NO: 35181 - DNA, 101 bp, rice(Oryza sativa)
  misc_feature (71): n=a or g
attatctatgtaggatttactgttattaccaatttacacaacaagatccgtcaagctgtttctatcatcgngggtcagtcagtgatgaaggagagattccg

SEQ ID NO: 35182 - DNA, 101 bp, rice(Oryza sativa)
  misc_feature (71): n=t or c
aggaataaagattgaagttaataaaatgtcctgatatcactattgttctctctgcagcctgatggagttcncaaactatcacaagcaaaaaataatacaga

SEQ ID NO: 35183 - DNA, 101 bp, rice(Oryza sativa)
  misc_feature (71): n=t or c
cctctacaccttcgccacagcatgcagtgtcatatcataattcatacataacccaacacctcctctcctcncctcccttcgtcttcatttgctgcgtcgcc

SEQ ID NO: 35184 - DNA, 101 bp, rice(Oryza sativa)
  misc_feature (71): n=a or c
cgcgttcgggaatctttcctcgttttctcccctttaactagcacgatttgcatacggagtactccctatanactcatgactggatcatcagagccaaactt

SEQ ID NO: 35185 - DNA, 101 bp, rice(Oryza sativa)
  misc_feature (71): n=t or c
agtagaagaagaaaaacaaaaaggaaaaaagcgatgtatgcagcgttgtttaggttgctctaccttttgcnttttacttttgggggcgctgatcgcgatgg

SEQ ID NO: 35186 - DNA, 101 bp, rice(Oryza sativa)
  misc_feature (71): n=t or c
aggtgcttattaccagatccaatcccttccccatggcccgaagaattatcattcagatcagactcattccnctcgacatggtccgaagacttattagtcag

SEQ ID NO: 35187 - DNA, 101 bp, rice(Oryza sativa)
  misc_feature (71): n=t or g
ccctaccattcacccccttctggtaggtttgtttggccttgttgcatgctacaaaggttttgatactcacnatttttttactaaacatcaaactatctttt

SEQ ID NO: 35188 - DNA, 101 bp, rice(Oryza sativa)
  misc_feature (71): n=a or g
ttaaaaaattgtactcaaccatcttttctttttttccttttcttgctacgtaccccacgtatactttctcnacgacaaggcctaataattgaaaaataata

SEQ ID NO: 35189 - DNA, 101 bp, rice(Oryza sativa)
  misc_feature (71): n=t or c
tttaactgttctttttttttttttacttttctctgtctgctgcatgcactgcagtcctgagcattctacangttacctaagaaagcatcattaggtaacag

SEQ ID NO: 35190 - DNA, 101 bp, rice(Oryza sativa)
  misc_feature (71): n=a or c
gagaagagttaggagagaggagagggtgaagagagaaaggataaggaggatgaaggtgaggtggccacttnctgtggaacccacaatgtgttttattatta

SEQ ID NO: 35191 - DNA, 101 bp, rice(Oryza sativa)
  misc_feature (71): n=t or c
tgtaaacacttccgcaaaagcatgcaaaaagccaagacacattcagttgcaaacactttcacaaagtaaancaaagaaagccatgttcattgtactgtagt

SEQ ID NO: 35192 - DNA, 101 bp, rice(Oryza sativa)
  misc_feature (71): n=a or g
tttgccttttcaaaagctctagtaagctaacaaataactgtgagaccaaccatacctgacctttaatctcntaagttcaagcattgaacgtaatgtttaga

SEQ ID NO: 35193 - DNA, 101 bp, rice(Oryza sativa)
  misc_feature (71): n=t or c
gcggcatggggcgcgcgagacatgccgaggaaggctgcattgagggtgttgagaaagccggctgtggcgcngcgggtgctggcggacacggtagggccagc

SEQ ID NO: 35194 - DNA, 101 bp, rice(Oryza sativa)
  misc_feature (71): n=a or c
atttcaagttggttttgctgatatcttgattttcattggcatagtggtcctggaatgactgctggtacagnaagtaaatcaggaaatgacagtgatggaat

SEQ ID NO: 35195 - DNA, 101 bp, rice(Oryza sativa)
  misc_feature (71): n=a or g
tccatttcaaagtataaaaagtctggacataaatgagatatttcgtaggacttcgaatttggacataaatnttccatccgattgtagatccttatatttta

SEQ ID NO: 35196 - DNA, 101 bp, rice(Oryza sativa)
  misc_feature (71): n=t or c
gtcataatcaccacattcccgcaacggattgcacgaactaatcatatccttagtttccgtaatccactacnaacatcccgatgaatctcagcgcagctagc

SEQ ID NO: 35197 - DNA, 101 bp, rice(Oryza sativa)
  misc_feature (71): n=a or g
taggtagttttgaacttttgattacttgggaatctgaagctggctttgcaagcatcaagatgctgattaantgattcgtgtctgtaaatgttccacgatga

SEQ ID NO: 35198 - DNA, 101 bp, rice(Oryza sativa)
  misc_feature (71): n=a or g
tttcggataagctcaaggagtaaaaaataaacctgtttatggagaggctaaggctgtatttgcaacccctnttcccaacccctcttatttgttttccacgc

SEQ ID NO: 35199 - DNA, 101 bp, rice(Oryza sativa)
  misc_feature (71): n=t or c
aactatggattagttggcgtgatgaaaattctgaactgtacttaacctaaaagggaaaattgaaaccatgncattataattttgcaaaattaaaaccatgc

SEQ ID NO: 35200 - DNA, 101 bp, rice(Oryza sativa)
  misc_feature (71): n=t or g
atgggtagctccaaaatgaaaagcaaatcctatcaaatgcatgggccatttattccatgatagaacttgangaattatttttaatgtaattcctcaaaatg

SEQ ID NO: 35201 - DNA, 101 bp, rice(Oryza sativa)
  misc_feature (71): n=a or g
gccagacctctcccttacccgcaaccatatcctcccttcctctatcgacgtcattgtgctcggtaagatcnggtgctccttaggtcggcgacaaccggatc

SEQ ID NO: 35202 - DNA, 101 bp, rice(Oryza sativa)
  misc_feature (71): n=a or g
ggggtagctggagaggaagaaggccatgccgtctcccctggccacgttgtccggggtgacgatcttgaagncgaactcggtggcgaagctggccacctcgt

SEQ ID NO: 35203 - DNA, 101 bp, rice(Oryza sativa)
  misc_feature (71): n=a or g
ccagacaatcaaaaaccgaatgccttaccgtgtgcgcaccaaaaattaagaacccttccatgtgtgtaaangattattgataaaaaaaaaggcgatgaaaa

SEQ ID NO: 35204 - DNA, 101 bp, rice(Oryza sativa)
  misc_feature (71): n=t or c
cagaaatttaaaggaaaaaaataaattgatagatctactatttttaagcattagatcttctccggaaatcngaatccatcacatcatgttttaaatattag

SEQ ID NO: 35205 - DNA, 101 bp, rice(Oryza sativa)
  misc_feature (71): n=t or g
aggatccaaaggggagaggatttccgccggttggattcagattacaggacagcaccaacatcggacggtcntcacaatttcatgcgatttcggcgtgcaag

SEQ ID NO: 35206 - DNA, 101 bp, rice(Oryza sativa)
  misc_feature (71): n=a or c
gcggtgcgcgtgccggccattgatgtcacaattatcgggccccaaaagcgtcgtcctcgtactccacgcgngcatcggaatcccacgcctctgcctgcctt

SEQ ID NO: 35207 - DNA, 101 bp, rice(Oryza sativa)
  misc_feature (71): n=a or g
accaatatttcaatgtagtgccatgggttctgtaaccctgctgactggccaaccaaaagagggagtatttnttgaagcaagatctgaatcaagaggttatt

SEQ ID NO: 35208 - DNA, 101 bp, rice(Oryza sativa)
  misc_feature (71): n=a or g
aggttttcccaacataatcatcctctaacaagcgcatcttatcctctaacaagcgcatctttgtttatctntgctaagagtaaatgaacatcattaaatgt

SEQ ID NO: 35209 - DNA, 101 bp, rice(Oryza sativa)
  misc_feature (71): n=t or g
caggctttgtttttttgtcctgtggagcagctttaccatgttttgcacataaaggaagttgtcgtgaattncccttttgcggacaaaagcgctttgatttt

SEQ ID NO: 35210 - DNA, 101 bp, rice(Oryza sativa)
  misc_feature (71): n=a or g
ttatatcaagtttaagctaataccagtgcctaaatttatattcaggtataggtacaattttttcttgaacnggttcctagccgtcctccccccctccccca

SEQ ID NO: 35211 - DNA, 101 bp, rice(Oryza sativa)
  misc_feature (71): n=t or c
tatatccgatgtgacacgcaaaaacttttcacccaagccatagcatgagatatgacctaagcagcgtacangccaagcccgatgtagataggcaaaagtag

SEQ ID NO: 35212 - DNA, 101 bp, rice(Oryza sativa)
  misc_feature (71): n=a or g
tttgctctcgcttgcctgattggctcgacggacggaggagagcaagaaacggaaatgcttgggggttgcangtgtttgtgttgtggaatcttgggtgccat

SEQ ID NO: 35213 - DNA, 101 bp, rice(Oryza sativa)
  misc_feature (71): n=t or c
ctgttgtcaggcctcaaaacaaaagtcttaggccttgcggtgctcaataaattgaggctaagacagtgctngagattaacttggcttaaagaaggtgatgt

SEQ ID NO: 35214 - DNA, 101 bp, rice(Oryza sativa)
  misc_feature (71): n=a or g
agagttttgccggatttccaacagtgtgtggatatagctttggatgaacctcttggacacctcaactggangggctgctttgccatgggttatctcgttgc

SEQ ID NO: 35215 - DNA, 101 bp, rice(Oryza sativa)
  misc_feature (71): n=t or c
agcttaacataattttctcttttcaataatgtgaagggtgagggaactgtgagaagaactcctgaacagcnggtgaacattccatttgatcaacctgaagg

SEQ ID NO: 35216 - DNA, 101 bp, rice(Oryza sativa)
  misc_feature (71): n=a or g
ggtagacaaacaccagttagacactttaatttgctgactatcaggtttaacttcatgttaatgtatccatntagtgtgccaatctggcacaggtggacata

SEQ ID NO: 35217 - DNA, 101 bp, rice(Oryza sativa)
  misc_feature (71): n=a or g
tgttgatgctgaagcatattataagttggtaaatgatggaagtcaagagttatatccaggttgcaaaaacnctatttctgttgatggccaggcactaaatg

SEQ ID NO: 35218 - DNA, 101 bp, rice(Oryza sativa)
  misc_feature (71): n=a or g
gccatgtatatttcttttttatataactaatatttttaaactgtatattatttcagtaaatttcgggcatntttactttgctaccattttcaaccttaaca

SEQ ID NO: 35219 - DNA, 101 bp, rice(Oryza sativa)
  misc_feature (71): n=t or c
ttcttgacgcgcttggccaaggacttgatcgtgcgacagtcagcaaggctgtgggtggaggtattgtggangatgcaccacttatctagtgagcggctctc

SEQ ID NO: 35220 - DNA, 101 bp, rice(Oryza sativa)
  misc_feature (71): n=t or c
aggtgacgcagccggcgtagtagaggcttgtgtagaggccttttccctcgctgtccccgtgcttgttccangccacggtgttgcatcccaggacgacgaac

SEQ ID NO: 35221 - DNA, 101 bp, rice(Oryza sativa)
  misc_feature (71): n=t or c
tatatgctgttctccatttccaggatcggttttctttccacggcagttgtcactggtatatttggtttgcncagtgccttctcccccaactacgcatcctt

SEQ ID NO: 35222 - DNA, 101 bp, rice(Oryza sativa)
  misc_feature (71): n=t or c
catggcctttttaagggattggaatgtttgctcagctgcagtgttccaaacaagtcatattcttccttaanagttgtgttaaaggtttgctgattacacca

SEQ ID NO: 35223 - DNA, 101 bp, rice(Oryza sativa)
  misc_feature (71): n=a or g
gcaactgctaatgagatttggaaagctttcaacgattttcacactggatcttcaaacattaaggagttgcnaaaagatgttttcaaaaaggaatacatcaa

SEQ ID NO: 35224 - DNA, 101 bp, rice(Oryza sativa)
  misc_feature (71): n=t or c
tagatggactcatagaatgagtgctttcgtcactttgttccatttccacccaagtacgggaaatgagaggncatgctaactctcagttttaattccttgtt

SEQ ID NO: 35225 - DNA, 101 bp, rice(Oryza sativa)
  misc_feature (71): n=t or c
gcacattcagatctcccaactttataaaagaaattgcatcttaattcaaagatagtttcttgcacctcttngatgcttcatatctggagatttgggtagcg

SEQ ID NO: 35226 - DNA, 101 bp, rice(Oryza sativa)
  misc_feature (71): n=a or g
tcttgaatatagttccccactcatattagctttgcttatggacttcctgtgtacttcagtgctgtcttcancagttgtggataactttgttaagaactcaa

SEQ ID NO: 35227 - DNA, 101 bp, rice(Oryza sativa)
  misc_feature (71): n=a or g
ttcactggccttgtcaacaccaacaagattggtgaccttctcgtacagtcccaagatacgagggtcaatanatattggaggcttagcatcaatactatcaa

SEQ ID NO: 35228 - DNA, 101 bp, rice(Oryza sativa)
  misc_feature (71): n=a or g
gtagacttagagtcatttcttcggtaaagctttcctcattccatctttccctctgaatgttgttttctctntttagagtcctagatggactcttgggtaaa

SEQ ID NO: 35229 - DNA, 101 bp, rice(Oryza sativa)
  misc_feature (71): n=t or g
ggtaattaagtagtagctagttgtagcgtccaaattcaaggggttctgactgcaccctgacattctgatanaggagtactactctattactcctagtgatt

SEQ ID NO: 35230 - DNA, 101 bp, rice(Oryza sativa)
  misc_feature (71): n=a or c
ccaactgtagcatttttttttacagcgataacagttacggtaacaaacccactgggtagagcaaagcctcnacaggaacaaacccaccccccaccagtgct

SEQ ID NO: 35231 - DNA, 101 bp, rice(Oryza sativa)
  misc_feature (71): n=t or c
ggaagagagcgaagaagcttgtggttatattcagtaaagcctctgcagcgaactatgtgaaggacctcgancaccttctcttcccatgtcagcttccactc

SEQ ID NO: 35232 - DNA, 101 bp, rice(Oryza sativa)
  misc_feature (71): n=a or g
acgagttgtgatatcatcgtcgaaaaatgcccttccactgttatctgccttgtaagctgcaaggaattgcnagacaaggtgttcgtgatccgcataaaacg

SEQ ID NO: 35233 - DNA, 101 bp, rice(Oryza sativa)
  misc_feature (71): n=a or g
tcaatcaacagtggctactccgacgcaagcctttctcttgtggaatacttgacataactttacatcgacanctgagatttgatcataaattgatgcaagca

SEQ ID NO: 35234 - DNA, 101 bp, rice(Oryza sativa)
  misc_feature (71): n=t or c
ctatatggccaagtcttggtcaccaagatgatgtgaggtatgcagacatagcaagcagaagtacagttaanatgactatatgatctattcactaatgtgtt

SEQ ID NO: 35235 - DNA, 101 bp, rice(Oryza sativa)
  misc_feature (71): n=t or g
ttgctccagcactctttaatccaaagggaatggtgatatagcaataagccccaaaaggtgtgataaatgangtcttcaagcaatcggattcctttaagctg

SEQ ID NO: 35236 - DNA, 101 bp, rice(Oryza sativa)
  misc_feature (71): n=a or g
gtcaccgacttattttgtcagataacttccagtcaaagtgatataagagactcgctagtacgagctctaanttcactagaccaaatgccatcccagggcac

SEQ ID NO: 35237 - DNA, 101 bp, rice(Oryza sativa)
  misc_feature (71): n=a or g
ttctgaactttcaacatgtgattctttcttttgcagctctaagcggctacacacattaattaaaggcctangttaactgaaactgaaacaagatgtgtagt

SEQ ID NO: 35238 - DNA, 101 bp, rice(Oryza sativa)
  misc_feature (71): n=t or c
aggccaagcttcacggccgacctgtgaacatgcgcctctccacggagctaaacccatcatttttttcccanttttttaaacaaagattttcttttttgaaa

SEQ ID NO: 35239 - DNA, 101 bp, rice(Oryza sativa)
  misc_feature (71): n=a or g
gagcacctcatttatcagccagggtcagaggcacttagcaggaattttgcacttcaaacaatttcccatcnctggcgacagtggaagttggacatgaacac

SEQ ID NO: 35240 - DNA, 101 bp, rice(Oryza sativa)
  misc_feature (71): n=a or g
gtatctatattgatttctatctcgatgatgtggtagggagggaggagagcaaggtgtggctgtgctcgtgnccaccgggagcttcaatcctcccacctaca

SEQ ID NO: 35241 - DNA, 101 bp, rice(Oryza sativa)
  misc_feature (71): n=a or g
tttagatcttgttgttttgatgatgaaaaccaatgttgcacctgatctcatcacctatggtgctttagtcnctggcatttgccgaaatatagctcgccgag

SEQ ID NO: 35242 - DNA, 101 bp, rice(Oryza sativa)
  misc_feature (71): n=t or c
aggatggcaagtgtcatcaggtactctttctttttggactcctcttcagtgttggaagcaatgttatgttntgaatcagatgatgacccatttgttgtgtt

SEQ ID NO: 35243 - DNA, 101 bp, rice(Oryza sativa)
  misc_feature (71): n=a or g
ccatgcaatcagaatgttgcatcaaaaccccccaactttctgttaaaaacgtgtaggtcctcgctcatgtngttcctcggatcacacaaagatccagtaat

SEQ ID NO: 35244 - DNA, 101 bp, rice(Oryza sativa)
  misc_feature (71): n=t or c
gaccccaagaaggccgcttcactagctaggaaaaaaaatacttgccaactgatgattgtccagaaaaatangaacatgggaaagcaatcttgccggattgg

SEQ ID NO: 35245 - DNA, 101 bp, rice(Oryza sativa)
  misc_feature (71): n=a or g
cctcccttgtaggtgttccaaggacctgcgatgtgtgatcagttttaatgttacaaacttctgcacctccnaacaactcgcaaggccaactaaacaccaga

SEQ ID NO: 35246 - DNA, 101 bp, rice(Oryza sativa)
  misc_feature (71): n=t or g
atcgatttgtttcaatcgttaaccatgtttccatctcatttattcgctcattttaaatacccgagctttcnctctgaacgcattgactattccacaccgat

SEQ ID NO: 35247 - DNA, 101 bp, rice(Oryza sativa)
  misc_feature (71): n=t or c
ttaatagaacactagtaagacaaaatgatggggtagaagaggcatgtacaactctaaaagtagtagactanttgtcaaaacgttgtgcaactatgaagtta

SEQ ID NO: 35248 - DNA, 101 bp, rice(Oryza sativa)
  misc_feature (71): n=t or c
gcagcaatctgtcatgactcgtgctaatcagaagttggctttcaagttctacgggcccttccagatccttnagcgcgtgggttctgttgcctataagttac

SEQ ID NO: 35249 - DNA, 101 bp, rice(Oryza sativa)
  misc_feature (71): n=t or c
tacactaccgatttcagtgctgcgagaatttttaaaactaattgcttggaagaaaggtttctcccaggctnatggggacatggccactgctcagagagccc

SEQ ID NO: 35250 - DNA, 101 bp, rice(Oryza sativa)
  misc_feature (71): n=t or c
tcgaactaccacataagcaccatgtcactgtcacatcagatgaaacatagtcaaattagccacgtaggcgncacgtcaaccaaaaccgccgtccaaactgt

SEQ ID NO: 35251 - DNA, 101 bp, rice(Oryza sativa)
  misc_feature (71): n=a or g
ttaaaacataagatcatcaaaacaggatgatgctaaaacactccgtgagaagctcacataattcctggtgnctaatgatcatcatgaaaagcacaacccta

SEQ ID NO: 35252 - DNA, 101 bp, rice(Oryza sativa)
  misc_feature (71): n=a or g
caggtatgcacggccacacaccccgtttcagagctaaaactgtaccgcagtaaaattctcatcgttttttnccactgtcatgttgtagtacgctcttgaaa

SEQ ID NO: 35253 - DNA, 101 bp, rice(Oryza sativa)
  misc_feature (71): n=t or c
ctctaacgggtgaaaccgaccgtagccacaaatgctttcttttcttatggcttaaaattaacatgggtctnagactgacataattgggtctcttaatatca

SEQ ID NO: 35254 - DNA, 101 bp, rice(Oryza sativa)
  misc_feature (71): n=a or g
aaaacatcccgtgccacctggtccaaatgtcgagatatcaccgcaatagtatcccgtaatcccggtttgtngaggatagcccaggtacgtaaccaccgggt

SEQ ID NO: 35255 - DNA, 101 bp, rice(Oryza sativa)
  misc_feature (71): n=a or g
tgaatgtattgcctgaaaactctagtggagacactgatattatccttttctgttcgtgtggcagaggcccncctcgctttgagggtgacaggcccaggttt

SEQ ID NO: 35256 - DNA, 101 bp, rice(Oryza sativa)
  misc_feature (71): n=t or c
ggtccattctgtcattttctagtttgactccattgctagtgtgagcaaccgtcaaactatgaccattttantgttatatatattgcctcatggcctctctg

SEQ ID NO: 35257 - DNA, 101 bp, rice(Oryza sativa)
  misc_feature (71): n=a or g
attcaactgtttgtataattcaacaaaatgatgaaggccagtctcaagttcttcggtagggggagttttangggacatcttttcttttgtatagagtagat

SEQ ID NO: 35258 - DNA, 101 bp, rice(Oryza sativa)
  misc_feature (71): n=t or g
cgcaccacaaatcctctgaatacacattctggacagcatggccaggcatataacgcatctttatcttgccnttctaggctaagccagcttatcactgacaa

SEQ ID NO: 35259 - DNA, 101 bp, rice(Oryza sativa)
  misc_feature (71): n=a or g
ttgccttcatggatatatggacagcagatggattaatttgtttaggtgaagtgggattccatcaccttgcngttgttgtcttcgaaattcgtatggtcttt

SEQ ID NO: 35260 - DNA, 101 bp, rice(Oryza sativa)
  misc_feature (71): n=a or c
tgcatgattggagtgacaatgactgtgtgaagatacttcggaactgcaaaaaagccatcccatctagagangccggtggaaaggtgataatcatggatata

SEQ ID NO: 35261 - DNA, 101 bp, rice(Oryza sativa)
  misc_feature (71): n=t or c
acttttctttcaggaggcaatgtggtcatccattcatctcttttaggtgcctgtgcctgttttggaactgncagaagttcatcatcaccctcaagagatac

SEQ ID NO: 35262 - DNA, 101 bp, rice(Oryza sativa)
  misc_feature (71): n=a or c
aatcgatcgaccgggccgttgatgcgttgagaattataccctactacacgaacaaagggaaaatacccccntattgtggtcgttttcccttgctttccgtt

SEQ ID NO: 35263 - DNA, 101 bp, rice(Oryza sativa)
  misc_feature (71): n=a or c
ctcttattaccaacccatgcatgtatacatactacttgtggcatcaagatttaaactctggaggtggagtnatatatgcacgcatgacttcgcaatcacac

SEQ ID NO: 35264 - DNA, 101 bp, rice(Oryza sativa)
  misc_feature (71): n=a or g
taagtgccaaagatctcaaaatctctctttgagacccaaaatttctttccaaactcaaatcttgggattcnaattttgaaatttgaatttccctttgttct

SEQ ID NO: 35265 - DNA, 101 bp, rice(Oryza sativa)
  misc_feature (71): n=a or g
ataaatttgactaacaaaaaattacaccgattttaataattttgggggtcaagatatctgtattgtggttnagggatacaaatcagacttggccactagtt

SEQ ID NO: 35266 - DNA, 101 bp, rice(Oryza sativa)
  misc_feature (71): n=a or g
aggccaacatagattgttcaattctcatccaaatcactactccctcggaaaaaaacccaacctaatctaancagggatgtgagaacaacaaatctgaacat

SEQ ID NO: 35267 - DNA, 101 bp, rice(Oryza sativa)
  misc_feature (71): n=t or c
gatgatttttaacaaaccggtacagatagagcagcactgctaatctgttttagtaatacttcctccgttcnaaaatgattggcgtattccaccatggcagt

SEQ ID NO: 35268 - DNA, 101 bp, rice(Oryza sativa)
  misc_feature (71): n=a or g
tataggggaatgaactacaaccttcgatgtgtgcagtcgtatacacaaactacagaggttaattttgatanaagagttagtagtaatagtgttgaacctat

SEQ ID NO: 35269 - DNA, 101 bp, rice(Oryza sativa)
  misc_feature (71): n=a or g
ggccttatctgcctttctgccgactttactctatcatttgcctggattcttctttgctcggagtactggcngccttgtactgaactaggcctctgcccttg

SEQ ID NO: 35270 - DNA, 101 bp, rice(Oryza sativa)
  misc_feature (71): n=t or c
agataaaaagtgcagtttcagagaattttctaatgtagattgggtctacttgaaattgcaaccttatattnagtcctctgtggcaaaaagagcaaatcata

SEQ ID NO: 35271 - DNA, 101 bp, rice(Oryza sativa)
  misc_feature (71): n=a or c
cgaagcaactgtttcgatctccataaatctcgcaactattacctgcatgcgcacaagatcgtgagcgtctncacatatggacaacgcggcgccgccgccgt

SEQ ID NO: 35272 - DNA, 101 bp, rice(Oryza sativa)
  misc_feature (71): n=a or c
tcacatgtttgtacagttcatctaccatcggcttagtttgtttcttgtagccttgtagctgatgtagagcnctataacaatcagttgcaataacaaaatca

SEQ ID NO: 35273 - DNA, 101 bp, rice(Oryza sativa)
  misc_feature (71): n=t or c
tgggcatggcctaactcttgagagtgtcttcacctaaaaatcactttgcgcgatatcctactgctaaaacngcgaagtcacgatgtcatgtaacatcattt

SEQ ID NO: 35274 - DNA, 101 bp, rice(Oryza sativa)
  misc_feature (71): n=t or c
atggaaactgcacctgttccaccaatcggcctccatgtatatgacggacctattccctgataccattcctnaggtaagtcttcactttatcactcttactt

SEQ ID NO: 35275 - DNA, 101 bp, rice(Oryza sativa)
  misc_feature (71): n=t or c
atctagaagttcggccgaaccactattctggctctcgggctcaactttggcaaggagattcccaccaaccntaggagtccattcaggcccgcgcggctgaa

SEQ ID NO: 35276 - DNA, 101 bp, rice(Oryza sativa)
  misc_feature (71): n=a or g
aacaaattaggcaaggagcaaccacaaatcggcgcgcatcaaggagaattgcaaatggcgggtaccttccnatgatagcttgcgcttgcccttgcggtcgg

SEQ ID NO: 35277 - DNA, 101 bp, rice(Oryza sativa)
  misc_feature (71): n=t or c
aactgttaggaagcggagatttggaaaaagctatggctagaaactccttcaaacaagacctaaagctctgnccatcgaggtgatgccggagggagtttcct

SEQ ID NO: 35278 - DNA, 101 bp, rice(Oryza sativa)
  misc_feature (71): n=t or c
gcttcgtcctccgagagccaaccatccctgaggtacttcacgaatggagttcgccaatcttctgggtcttngcctagtttgtcagggttatggataccaca

SEQ ID NO: 35279 - DNA, 101 bp, rice(Oryza sativa)
  misc_feature (71): n=a or g
gtctgttagttgagggaacgggaaattgcaatatttcataccttctatggagacagaaccttctgcaccancctacattacaaaaaccataaattaaatca

SEQ ID NO: 35280 - DNA, 101 bp, rice(Oryza sativa)
  misc_feature (71): n=t or c
tgagaaaatgaccagccatggcgatgtcacaccgatcagaggatagacttggcgagaaatttcgtgcgttnagaccggttcaacgacatctcctgactcct

SEQ ID NO: 35281 - DNA, 101 bp, rice(Oryza sativa)
  misc_feature (71): n=t or c
tagtgttgttgcctcgagtttcatctcttcctttattgagttccattgccatcttcacacatggtgtcggngagcttcacctccacgtatattctgcctac

SEQ ID NO: 35282 - DNA, 101 bp, rice(Oryza sativa)
  misc_feature (71): n=a or g
tggccgctcttgatatcctgcaccgaccagaccatgcctactcactgtcgctggtgccatcgccatcttcnctgttgtgatgaccctatcaccacgacaag

SEQ ID NO: 35283 - DNA, 101 bp, rice(Oryza sativa)
  misc_feature (71): n=a or g
caccagggttttgactctggagccaactcggttcaggatcgaaccctggtcaagggtaagccgatttttcncaactcgccagttaattttgatttgtggga

SEQ ID NO: 35284 - DNA, 101 bp, rice(Oryza sativa)
  misc_feature (71): n=a or g
aataaacttaggaaaaagtacgaattacccccataactatcatagtcgattgaattacacccctaaacttnaatgccagatatttcacactctaaacttgc

SEQ ID NO: 35285 - DNA, 101 bp, rice(Oryza sativa)
  misc_feature (71): n=a or c
agaaaagaatgtgaagtaaagcatggcaacaacacccgatgtcaccttttcgaatgtttttatgtgatganatgctcaatagtgatgcaaacaatgaagac

SEQ ID NO: 35286 - DNA, 101 bp, rice(Oryza sativa)
  misc_feature (71): n=a or g
aattaattaagctaatacaggcccatgctatccctgcatgcacactgggttgatgttgagaggcgaggtcntcttctgtgtcatcacggcttcattactac

SEQ ID NO: 35287 - DNA, 101 bp, rice(Oryza sativa)
  misc_feature (71): n=a or c
ctctttgtcctgcacggtgagaatcttgatgtttgttttagacggttgctctagacaacgcgatgtagagntgaccattttttttctccttctctttgtcc

SEQ ID NO: 35288 - DNA, 101 bp, rice(Oryza sativa)
  misc_feature (71): n=a or g
aatgtctagtgttggcatccatgagattgatagggaaaatgagccttatagcctcttgaatgtgggaaggngttttcttactgaacattatactggattta

SEQ ID NO: 35289 - DNA, 101 bp, rice(Oryza sativa)
  misc_feature (71): n=t or g
cagaaatggtagcatcctgagccatggttgtgatcagaaatcagaaatcaaatttcgcgagtaatcgccangactgtccgcggggtttagccctgctttca

SEQ ID NO: 35290 - DNA, 101 bp, rice(Oryza sativa)
  misc_feature (71): n=a or g
acgcatgtagtcccatttttctgatctgtcgtcgtagagtactgttcaccatacgcacggaggaaaaatgnggctcgtcgcgtcgttctgtttggattctt

SEQ ID NO: 35291 - DNA, 101 bp, rice(Oryza sativa)
  misc_feature (71): n=t or c
tgaaccaactcttttaggtagccttctgccacttcctctagtgtgctttcacccttttccacaatgaaccnttctgccaccatagccgtacaagttccttt

SEQ ID NO: 35292 - DNA, 101 bp, rice(Oryza sativa)
  misc_feature (71): n=a or g
tgaatttggccggatggggaattctgaatttggggtagggaattttttacagggtgggttgattttcgctngcggttctctttaggcaactgtcagagaaa

SEQ ID NO: 35293 - DNA, 101 bp, rice(Oryza sativa)
  misc_feature (71): n=t or c
ccattgagctcattgtgccccaagttaaggacctgaagatacatcatgtttccaagacttcctgggattgngccggtgaggccattgtatgagagatcaag

SEQ ID NO: 35294 - DNA, 101 bp, rice(Oryza sativa)
  misc_feature (71): n=t or c
tcactttccaattatgcctcctttgtcaagcgatggcacattatatggtgtcgctttttgaggtctttgcntgtattatcatcttaggctgagtttggaag

SEQ ID NO: 35295 - DNA, 101 bp, rice(Oryza sativa)
  misc_feature (71): n=t or g
agttttgctgccagttcaattcgtagttgctttcagctgaccaatcaattatccgtgttctctaggatctncaaatgtgcgcattgggttcgcaagtcagg

SEQ ID NO: 35296 - DNA, 101 bp, rice(Oryza sativa)
  misc_feature (71): n=a or g
tctacggatgtaacagcaaataaaattgtctcagtgaacttggatgaagctggatgtagtgcggaacacgnaaactcaaatgggtcaaataaagaaattcc

SEQ ID NO: 35297 - DNA, 101 bp, rice(Oryza sativa)
  misc_feature (71): n=t or c
ttatcaagttgcatcaacagataataggcatttgcgcattgaggaaatcccatgaccatgaattctgagcnacatagtattgacttcgcaatcttcagagt

SEQ ID NO: 35298 - DNA, 101 bp, rice(Oryza sativa)
  misc_feature (71): n=a or g
ggagttgcagccgacgccgccacaaggagccatctccatccgtcgattcttccactgatcttcggatctcncacctccaccgccaccaaccatcgctgccg

SEQ ID NO: 35299 - DNA, 101 bp, rice(Oryza sativa)
  misc_feature (71): n=t or c
caaaaccatctagaatccactagtgttttgggaggtcgctgttgcgggagcagccgccgccttttgtgtgngtggagtggagatggtgaccgagatggcga

SEQ ID NO: 35300 - DNA, 101 bp, rice(Oryza sativa)
  misc_feature (71): n=a or c
tacatccgtaaaaaagatatcattttttgggatgaaggtcgtagtactgctacgtaagagagattaatgtngagtagtactattttgtgcgcattgaatta

SEQ ID NO: 35301 - DNA, 101 bp, rice(Oryza sativa)
  misc_feature (71): n=t or g
atgggttcgggatctcaggatcttacacaactcagaggtcccaagtttttttcattcccggtccatcgaanttaagggtgaaaaaggggcggcgttagact

SEQ ID NO: 35302 - DNA, 101 bp, rice(Oryza sativa)
  misc_feature (71): n=t or c
gaatcgacaagaaaagatatagagtgtgcatttggtgttttgcaatctcgttttgccattatacgtatccnagcacatatgtggaaaaaacgaactcttgg

SEQ ID NO: 35303 - DNA, 101 bp, rice(Oryza sativa)
  misc_feature (71): n=a or c
aacctttacattttttggttgaaaatcagtggtaatttagtttgatgtttttttttcgcttacaagtgttnatggtgctgcacacagacgaagtacatccc

SEQ ID NO: 35304 - DNA, 101 bp, rice(Oryza sativa)
  misc_feature (71): n=a or g
agtcacaatgcttaaaaaagacgagaaccctaattggttgacgatgacaaacatggatgatgataaagtcnatgcatggatggcaaagaagacaatgagca

SEQ ID NO: 35305 - DNA, 101 bp, rice(Oryza sativa)
  misc_feature (71): n=t or g
aagggaagatggctacacaaggctggattgctgacataattggtgactgggtgaagaaaaatccacagaanaaggcaaaggatgccaaggagaagttggaa

SEQ ID NO: 35306 - DNA, 101 bp, rice(Oryza sativa)
  misc_feature (71): n=a or g
tcttggacagtctcggttttcatgctacaggtggattttataaatttcccccctgaagaggatctcccccntgccggtccgcagccaggacctgatgatgc

SEQ ID NO: 35307 - DNA, 101 bp, rice(Oryza sativa)
  misc_feature (71): n=t or g
gctggacctgatgtatgtttgagagcaacgacgcaataagttcaggccattgcttctgtggaatctcaatnccagcaacctttgcgataacttgagaagag

SEQ ID NO: 35308 - DNA, 101 bp, rice(Oryza sativa)
  misc_feature (71): n=t or c
ttgctgcggcgcaccactcgctcaagcttcgcacttatgaggagaaagattagagcagtgagccttggaantactagatcttgcggcgatggacctcatct

SEQ ID NO: 35309 - DNA, 101 bp, rice(Oryza sativa)
  misc_feature (71): n=t or c
caacaatagatgggtgcgagacctgcgaggtgcactctcaaatgaagctatagcgcagttctttcagctangggacgagattcaggaggtggttctcaatc

SEQ ID NO: 35310 - DNA, 101 bp, rice(Oryza sativa)
  misc_feature (71): n=t or c
ctgctttctagtacatcccaccgagatgactctctgtaatatccataacagaagccttgtaataataatanatatatatattgcacgtatcacttcaacat

SEQ ID NO: 35311 - DNA, 101 bp, rice(Oryza sativa)
  misc_feature (71): n=a or g
gtcccacctttttttaatttttaagtaccacctcaaacgccatgtaggcgtcacgtcaaccgcaatcgccntgcaaactgccttggaccttatttgtaccg

SEQ ID NO: 35312 - DNA, 101 bp, rice(Oryza sativa)
  misc_feature (71): n=t or c
aatcatattacaaacccatgaatgtagtgtagcctcatgttgtacccaatactcaataaacaatgggcganctagctaacatcagtaatccaattaaaaga

SEQ ID NO: 35313 - DNA, 101 bp, rice(Oryza sativa)
  misc_feature (71): n=t or c
cggatttcgtcggaatcataaaccctgattccacatacccatgctatttgtgccaacagttgctatgagcnagtccaaaatcatcaagtggatggattggc

SEQ ID NO: 35314 - DNA, 101 bp, rice(Oryza sativa)
  misc_feature (71): n=t or c
ccaagttttcatcaggaagtgtcacagcgagaagtccagcacctctcccaacaccagtaatacggaaagcntttcaggaaataacataggatagatctata

SEQ ID NO: 35315 - DNA, 101 bp, rice(Oryza sativa)
  misc_feature (71): n=a or c
ccagtcattcttctgaatgacataataccaaactacatactgctgcgagtcaacacaaattatggataggnaagaaatatctgcatagtagaaaatattta

SEQ ID NO: 35316 - DNA, 101 bp, rice(Oryza sativa)
  misc_feature (71): n=a or g
cactgcccgccgtcggttcgctccgcttgctccaccgttctcctcgtgaccacctacctgtccgctacctnggaaaagacgatgaagaaatgggagaggga

SEQ ID NO: 35317 - DNA, 101 bp, rice(Oryza sativa)
  misc_feature (71): n=a or g
ttaatttgctcgaacgcagcatgcagtacagtagcgctagctgaataaattcagaggcatttatgcaaaangctgtcgttaaaggccacacactcgctcga

SEQ ID NO: 35318 - DNA, 101 bp, rice(Oryza sativa)
  misc_feature (71): n=t or g
ccaatctctcccgtcacatcaaccacctcgaaaacttgttctagggtaggtcgaacaatctctctcatcanatcaactatgtgatcctagagacttgtttt

SEQ ID NO: 35319 - DNA, 101 bp, rice(Oryza sativa)
  misc_feature (71): n=t or g
aataccttaatctgagaagaacacatattacggaactccctgcacaaataggaaacctgaagaagttgganactctggatataagggacacagccataaag

SEQ ID NO: 35320 - DNA, 101 bp, rice(Oryza sativa)
  misc_feature (71): n=t or c
ttaatctgttctgccccttccgatgtgaatcattggctatcgacagagaatttgttcgaatttggctcttngagttcccaactataaaggatgatgttttt

SEQ ID NO: 35321 - DNA, 101 bp, rice(Oryza sativa)
  misc_feature (71): n=a or g
ggcaaagttaaaaagaaattcaaagaactaaaatgcccataattagttgaaaagttatattgatggatagntatgtaaagggtatttaaaggataaaattt

SEQ ID NO: 35322 - DNA, 101 bp, rice(Oryza sativa)
  misc_feature (71): n=t or c
ccaattacaggttgatgaagggtaagttccttttatttaacgaaaggatgcaaaatagacggaaagctatntgaaatgtatcaaagtgaactaactcccaa

SEQ ID NO: 35323 - DNA, 101 bp, rice(Oryza sativa)
  misc_feature (71): n=a or c
gaaacaatgctccatttgctgtttggcaccactttatcttgttaatcttctcttcaatttccaagctcttnagataatcaaactaatcgcatgacaagaca

SEQ ID NO: 35324 - DNA, 101 bp, rice(Oryza sativa)
  misc_feature (71): n=a or g
atatctgcttggaagatcatctgtggtctttagcgtgcattgctacttttggagatttattgaaaatgtancgtggctctaccccttcccaccaatcggag

SEQ ID NO: 35325 - DNA, 101 bp, rice(Oryza sativa)
  misc_feature (71): n=t or c
tagcagttcttttttcaaaacacgcacagtacaaacggatacgctctgaacacataattatccctacaaangtgcacgcatatacaccatacttctatgag

SEQ ID NO: 35326 - DNA, 101 bp, rice(Oryza sativa)
  misc_feature (71): n=a or g
ttctagatgctatacacacagaaacactagggacctgatttaagcaagcgtctgacaactatagtttctcntaaaatctctagaagcttctcactagaagc

SEQ ID NO: 35327 - DNA, 101 bp, rice(Oryza sativa)
  misc_feature (71): n=t or c
gagagcaaggtgtccagtaatacaacaagttgaagaggataatcaggtagaggaagatgtaagtcatgagnaagggtctttggagtcagggggagaagatg

SEQ ID NO: 35328 - DNA, 101 bp, rice(Oryza sativa)
  misc_feature (71): n=t or g
tagtagctattgtgttggtggggactaaaccaacatatttttatggtggagatcaatgcatagccatctgntaaaatatgagcatcttaaaattgacagat

SEQ ID NO: 35329 - DNA, 101 bp, rice(Oryza sativa)
  misc_feature (71): n=t or c
gtaacattggaatgtaacctgccatgtaccagcacgcagggcctttagttttgattaacatagtacaatgntttattttcgcctatttctattaaaattat

SEQ ID NO: 35330 - DNA, 101 bp, rice(Oryza sativa)
  misc_feature (71): n=a or g
atggtccctcccatttgggggaaagcttgttcttccctgcttgggattgaactcgtcgtaggacataatcnctgacggcaagtgtgcgggctcgaacacgt

SEQ ID NO: 35331 - DNA, 101 bp, rice(Oryza sativa)
  misc_feature (71): n=t or c
ccccacgattaatgaagaagtacaggaagctaagtccaagaaaagctgtaaaaataagccttctaggacanttgacctcacggcttcgttgccttgacaaa

SEQ ID NO: 35332 - DNA, 101 bp, rice(Oryza sativa)
  misc_feature (71): n=t or c
tccagaagccgctaagtccgacaatctctttcttgataaaattcacaagaacttcagggcatcaccagcanatgtttttgggaaacgacaaattgaaaagg

SEQ ID NO: 35333 - DNA, 101 bp, rice(Oryza sativa)
  misc_feature (71): n=t or c
cttttcctcggaatgttcatatggatgggacctgatattccgatttaagtgcagaaactccttaacagtcnggccgtatctccggcgccaaagccatttcc

SEQ ID NO: 35334 - DNA, 101 bp, rice(Oryza sativa)
  misc_feature (71): n=a or g
gtttagtacaagtcacttcttggtaagagctggctttgctgtgacaccatcaatcaaaaatcctagctccnccccgaccaagaaggtcaccttgaacagcc

SEQ ID NO: 35335 - DNA, 101 bp, rice(Oryza sativa)
  misc_feature (71): n=a or c
aaagatcttatcacaacacatctcccattgcagacaatccttagaatcacgagaacctgagaaagaagacntggagattttcatcttacaaagccctttat

SEQ ID NO: 35336 - DNA, 101 bp, rice(Oryza sativa)
  misc_feature (71): n=t or c
gaggaagatgaggttgatgttcacctgcctcactctctctcgggaaaagatgattttgatgaagaagtgcntcttgatgattatagtgatgaagaaggttt

SEQ ID NO: 35337 - DNA, 101 bp, rice(Oryza sativa)
  misc_feature (71): n=a or g
acagagaggttgtacaggaggaagaaggaaaggaaaaggcagagcaacgttgcggaatttcagcgatttcncaaattagggaaatttgtcgcaaggtagtg

SEQ ID NO: 35338 - DNA, 101 bp, rice(Oryza sativa)
  misc_feature (71): n=t or c
ataaaagatcgatagaagcagcagagatgacaatgatatagtatgcttgtgtgcacgatgaccagcttggngcggtctccccgcgaagaatagtatgctca

SEQ ID NO: 35339 - DNA, 101 bp, rice(Oryza sativa)
  misc_feature (71): n=a or g
atgtgtaaaatatcttgttgggtcgagaggcgtagtgtgtatctgaaactaggatggcaatggttgtatcnattgtgtctgaatagctgtatgctgtaaag

SEQ ID NO: 35340 - DNA, 101 bp, rice(Oryza sativa)
  misc_feature (71): n=t or c
cgaatccccatctccggtttataaaaaaaacgcccggattaaccggtttcatctggtctgactgcatgccngatttgttaaggggaccggaccggtggggg

SEQ ID NO: 35341 - DNA, 101 bp, rice(Oryza sativa)
  misc_feature (71): n=t or c
cctgacagctgataagtgccggtttaagtggaaccggtacctatttcatttggggcgttttatagtgtctnctactgctatgtacatgtaatagtgtagta

SEQ ID NO: 35342 - DNA, 101 bp, rice(Oryza sativa)
  misc_feature (71): n=t or g
ccgccaagcgccctccgcctcttccgttccactcttccactccgtcgtccgtccaacgcagtaacagtgtntatcacctaggcagtgtttggctaatgggt

SEQ ID NO: 35343 - DNA, 101 bp, rice(Oryza sativa)
  misc_feature (71): n=a or g
aacgatattttatcacgttcatagacgatttctcaagatatggcaactcacaaccatggctacagtttctngtacgctttcgcatcttaagttataatatg

SEQ ID NO: 35344 - DNA, 101 bp, rice(Oryza sativa)
  misc_feature (71): n=a or g
tgccttttgaccggccgggcccccattgcgtagacgatctctagcaaaggctctatcccctcatctcatcnatgttattttttgttctgatgaaaacgcca

SEQ ID NO: 35345 - DNA, 101 bp, rice(Oryza sativa)
  misc_feature (71): n=t or c
ccggtggtggcagcgaagcactgggaagccattgccaggattacaacgacagcgacatgggacacgtaggngttagacattttcgtctctttcttgtctgc

SEQ ID NO: 35346 - DNA, 101 bp, rice(Oryza sativa)
  misc_feature (71): n=a or c
cccgtaccgacgtagcctatccacgtactgcgtgattggttatcgctagatagcctattgatatggggacnacctatacatttgtcgacaaattttgtact

SEQ ID NO: 35347 - DNA, 101 bp, rice(Oryza sativa)
  misc_feature (71): n=t or g
ggatcggagagctcacctttgaaagccagcagcgcagcgagatcgctgtcgctgccattgctcttgctcgnccctggaggagaagcagcagcagcagcaac

SEQ ID NO: 35348 - DNA, 101 bp, rice(Oryza sativa)
  misc_feature (71): n=t or c
acctgccgaggctagccgggtcctagctccaccactgtctaaattcgttattttaaaatgggtcaaatctnatcctgaatagcaatattttagaatgatag

SEQ ID NO: 35349 - DNA, 101 bp, rice(Oryza sativa)
  misc_feature (71): n=a or g
caccagtttcaacgactacatgaccaaggcatcgagggttcctggtgccgtcgtttacatctggatttctntctacctcgtcttcactattggcctctttc

SEQ ID NO: 35350 - DNA, 101 bp, rice(Oryza sativa)
  misc_feature (71): n=t or c
gattgttgcctcttgtcagcaattttcctctttctgcttcttatgggtttctcatcgccactatctccacngccatcttcctcatcatcagagtcctccga

SEQ ID NO: 35351 - DNA, 101 bp, rice(Oryza sativa)
  misc_feature (71): n=a or g
ttatgctaaactacccacataattctcggcttttctccgtgtgcacggagaatagatcacgctccttctancgggaatagatcgcgcaagggtgggaatag

SEQ ID NO: 35352 - DNA, 101 bp, rice(Oryza sativa)
  misc_feature (71): n=a or c
agtcgatcgcttgactcgttcagatcgacctgacgaccacacagtaattcgactagtcatgtggtcgtgtngtatttagggcggttggttttggctgatta

SEQ ID NO: 35353 - DNA, 101 bp, rice(Oryza sativa)
  misc_feature (71): n=t or c
acaagtccatcatcaccgacatttagtcttgtgtcatcaaatccatttagtgtctttaaagacgcgattcnggtgggcaacaattcatcgaggatgtgcac

SEQ ID NO: 35354 - DNA, 101 bp, rice(Oryza sativa)
  misc_feature (71): n=t or c
ggagtcctttcgtacatatggaattctttttccgacccacatgaaggtattaattttttaaatagtatatntaatctaatgatctaaaatatagagtccac

SEQ ID NO: 35355 - DNA, 101 bp, rice(Oryza sativa)
  misc_feature (71): n=t or c
tacctttgatccgttttaaaatacttgacacttttgactttgatgttaattgtgcacgtgggtctcgatgntgaccttgtttgttggttttctgatccata

SEQ ID NO: 35356 - DNA, 101 bp, rice(Oryza sativa)
  misc_feature (71): n=t or c
taaaacattttgggaattttgaatgacgaggagttgtatgtccaattccaacatatgtcgcaaattacgtngcgccgacgaggtccagggccacgcccatc

SEQ ID NO: 35357 - DNA, 101 bp, rice(Oryza sativa)
  misc_feature (71): n=a or c
tactttgtaattatatacaataccacgttttgatattatctttttaggttaaatgaaatgaggaacatttnatcaatgatagctaatttcctgggatgtgc

SEQ ID NO: 35358 - DNA, 101 bp, rice(Oryza sativa)
  misc_feature (71): n=a or g
ggcgattgatcgcccctagcggtccggttacccctctctcctccacgcagtttttttttttttttgcaccncattactttactattttagtaaatttatat

SEQ ID NO: 35359 - DNA, 101 bp, rice(Oryza sativa)
  misc_feature (71): n=t or c
gatttgcatgccctcaacataaaaaggggatcaagtcattgtacttggcttcacaagcacagcgttcatantgaaagtgcaacgttcttttctcaaccaat

SEQ ID NO: 35360 - DNA, 101 bp, rice(Oryza sativa)
  misc_feature (71): n=a or g
tctccgccatgggaaccaacatttggttgccatccaccattgatgttccaacctcttccaccttgcccctnccggcctccagcaaaattccgagctccaaa

SEQ ID NO: 35361 - DNA, 101 bp, rice(Oryza sativa)
  misc_feature (71): n=a or g
gcaaggcgcctatatacatagaaagactaccaaaaagcctaaaagggcaaagagaaaaagtcacacgaggncgaagggcctcacacctcagggtggtcttg

SEQ ID NO: 35362 - DNA, 101 bp, rice(Oryza sativa)
  misc_feature (71): n=a or g
ttcatgtgtgtacacatgatcatatcaatgctgactcaactcaggttagatacatgggagcgtatcctatncacacaggccctcgtggagcgtatcctatg

SEQ ID NO: 35363 - DNA, 101 bp, rice(Oryza sativa)
  misc_feature (71): n=a or g
acctttgggtactactcaggtcactgtaacccctacatgtcttttagttaatcaccgctgaggctttgtancagtagtagtcgaagtatatatgaacaact

SEQ ID NO: 35364 - DNA, 101 bp, rice(Oryza sativa)
  misc_feature (71): n=a or g
aaaatgctgtgagagagtatactatacactctcaaattctgagtgaatgaaatcttactccgaaacaaagnctgtgtttagatacaaactttggatccaaa

SEQ ID NO: 35365 - DNA, 101 bp, rice(Oryza sativa)
  misc_feature (71): n=t or c
tttgcgggtatttgggctgtttctaccaatttatgctagatgggctgagaaatgatatgtagtactgggcnaagaatcagttgggctgagttaagatcagt

SEQ ID NO: 35366 - DNA, 101 bp, rice(Oryza sativa)
  misc_feature (71): n=t or g
agcaattttggactggtagaatctattatgatttctttcccatttctatggccacaggcatacgtagatangatcaattctggcagagaggatgaagtgaa

SEQ ID NO: 35367 - DNA, 101 bp, rice(Oryza sativa)
  misc_feature (71): n=a or g
catgtcaaaagcacattcttgatttcagctccaaacatagtttgcagataaaatctaattgaaatctgggnaaggaacattttcagttcatactatccaaa

SEQ ID NO: 35368 - DNA, 101 bp, rice(Oryza sativa)
  misc_feature (71): n=t or c
taaagatgtgggagattacatgtgcagcaattaagtaatgagagaggagggttaccagaaatatcgtaganatggcacttgcccttgtgggagccaacgag

SEQ ID NO: 35369 - DNA, 101 bp, rice(Oryza sativa)
  misc_feature (71): n=a or c
gataacaacccccacaaggccataacaccattcttcaaaacagaacgccccacaagaccacaaaatacaanaaccagtgcttgagaaggacgaaatggcct

SEQ ID NO: 35370 - DNA, 101 bp, rice(Oryza sativa)
  misc_feature (71): n=a or c
ccttcgatttctccctctccggtgagtcacagctcaattcctcgggcatgaagctttccagagacctattntacaccgtgtgtatgcatgcatggtagatc

SEQ ID NO: 35371 - DNA, 101 bp, rice(Oryza sativa)
  misc_feature (71): n=t or c
taaataacttgcaccctctgtttttgtcggcaaggaactttttactactcttgtctctatcaaaatataantattactttaagtagctagaatgaatatag

SEQ ID NO: 35372 - DNA, 101 bp, rice(Oryza sativa)
  misc_feature (71): n=a or c
ttagcaaagaataaaaaataaatacatgtaagtgggaagaaataaaatgtggagggtcaacaatcctagtntgggatgatgtatggataggaaagacaccc

SEQ ID NO: 35373 - DNA, 101 bp, rice(Oryza sativa)
  misc_feature (71): n=a or g
gaaggcatgagcttggcggagttggctcgatgatggtagtatagttaggaattcagggccaacacgcttgnttgcaggggcatgggtgagctgaaagtaat

SEQ ID NO: 35374 - DNA, 101 bp, rice(Oryza sativa)
  misc_feature (71): n=a or g
tcgagaagatggctatccatttcattacttccctacaatcaaatacctgggactagcatcttgcaaccttncaaaaattccaggcgcattgagagatataa

SEQ ID NO: 35375 - DNA, 101 bp, rice(Oryza sativa)
  misc_feature (71): n=a or g
catctttgccaaggagatgatcatcaacctcaaggaggggatgatgatcaatagcgacaagacaatcgacnggcggggagcgcatgtgcggatcaccaatg

SEQ ID NO: 35376 - DNA, 101 bp, rice(Oryza sativa)
  misc_feature (71): n=t or c
gcagcaaaaagaccttgatacaatgatgcagcaagcatggaataagttcttgagctcattcacggagaccngcaaggggacattggttcagaaatacaaag

SEQ ID NO: 35377 - DNA, 101 bp, rice(Oryza sativa)
  misc_feature (71): n=a or g
cttcttccactcttgctcgtctcgctccacaccattgataagcatgatgtatgcatcaaacaaggtctgcntctctaaatgcttttgatcaggtggcccta

SEQ ID NO: 35378 - DNA, 101 bp, rice(Oryza sativa)
  misc_feature (71): n=t or c
atcgacttatgaggtagtgtggatcatttatcatagcacacaagagcatctgttcagtttcctaagacgtngcttatatttccgaaatcaaatatgcctca

SEQ ID NO: 35379 - DNA, 101 bp, rice(Oryza sativa)
  misc_feature (71): n=t or c
ggttgtctgtgattctttgttatgtgttgtgattctttatactacgtgtgtgtgtatatatgcacttgttntcctggtgatgctaaccgaataggacttgg

SEQ ID NO: 35380 - DNA, 101 bp, rice(Oryza sativa)
  misc_feature (71): n=a or g
gaaaaattaatatatcaacatctgatgagcatgtgtattactcagaaaatctctcaaggaaaataagctgncattgcacacaaagttacaacttctaccaa

SEQ ID NO: 35381 - DNA, 101 bp, rice(Oryza sativa)
  misc_feature (71): n=a or g
catggatcagaggcatgctactctttgctttctcctagcacttgtgttgattggcaatgcttcttttgctnctggttttgtgcacaacttctctctctttt

SEQ ID NO: 35382 - DNA, 101 bp, rice(Oryza sativa)
  misc_feature (71): n=t or c
ttaaagcatgtaatcaaaccctctggattacgttttccagcaacgaaagcgactgttatcaatcaatcctngcatcgtcgtcttcctcgagcgacgtcgac

SEQ ID NO: 35383 - DNA, 101 bp, rice(Oryza sativa)
  misc_feature (71): n=a or c
agatacttatatttctagagttagaaatactcagatttagagtggtcacaagatacggagatcgcccgtgnagcattatgataccgtggctctcttgagcc

SEQ ID NO: 35384 - DNA, 101 bp, rice(Oryza sativa)
  misc_feature (71): n=t or g
ataaataaatattagtagcgttatggataaaggtgtcctgttcggatcgtattctacatagaatggacaangtgttgcacccaccatgcataatctagaag

SEQ ID NO: 35385 - DNA, 101 bp, rice(Oryza sativa)
  misc_feature (71): n=t or c
ttattggggggagcatgatgttctgaggagcggctgatgagaatctggaatgagtagttctacaagcttanggcttcttttgtattcggattctgataatc

SEQ ID NO: 35386 - DNA, 101 bp, rice(Oryza sativa)
  misc_feature (71): n=a or c
cttcgtcctcaagctctccagaaacctcaggcactacccgagccgaatcaccatgaagcaattctccgttnttggatgctctagcgacgtctccaccctcc

SEQ ID NO: 35387 - DNA, 101 bp, rice(Oryza sativa)
  misc_feature (71): n=a or c
gggccttcgggggcttggggctggcggccggggctttcaagttttaacacgacacagggtctcatcaactngcgagagctaattcgcgcgtgcgtgatagc

SEQ ID NO: 35388 - DNA, 101 bp, rice(Oryza sativa)
  misc_feature (71): n=t or c
actacagttaaaacaatgtggaacccactcttgctaaccgaaaacccaccaaccgattaatcaaatcaganactaattgaggcttgagaaacatgcattat

SEQ ID NO: 35389 - DNA, 101 bp, rice(Oryza sativa)
  misc_feature (71): n=a or c
gaagcgtaggccatacatggaggaaggagaggaatctaacatggataacaaaaaaactagacgataatggnattgttatcgatttgacaaaatttcagtgg

SEQ ID NO: 35390 - DNA, 101 bp, rice(Oryza sativa)
  misc_feature (71): n=t or c
atttctcttgaacagatctgccaactttagcagtatcaacttgttctcgccagaattttgctacgtcatcngtatttgaatcggttttaatctctactatt

SEQ ID NO: 35391 - DNA, 101 bp, rice(Oryza sativa)
  misc_feature (71): n=a or g
cgccgcgacgagccggctgcctcgctttgcgccatcaccacgccggtgtttgactggctacaggatctgcncaccgccaacgacacggaccccgcgctggt

SEQ ID NO: 35392 - DNA, 101 bp, rice(Oryza sativa)
  misc_feature (71): n=a or g
gaagcgcatgcattaaaatagaccctacattccgcgatcatttgcttgatgtgtgaacaccaacaaaattnttgaaatttgcgtagaaagaaaagacatat

SEQ ID NO: 35393 - DNA, 101 bp, rice(Oryza sativa)
  misc_feature (71): n=t or c
tctcaagatacaaagaaaagagacaacacttaccatagtccatcaaaacaaaagaatgcgttgattggcgngaatgatcccagggacatggctgcaatcag

SEQ ID NO: 35394 - DNA, 101 bp, rice(Oryza sativa)
  misc_feature (71): n=t or c
cgacgcgcgcctgcagactctgaaaggagaattcgccagcatggtgatggaggccggggagtcgcttgacnagtacgctggccggatcaccatgatggggg

SEQ ID NO: 35395 - DNA, 101 bp, rice(Oryza sativa)
  misc_feature (71): n=t or c
tctaatagtttattaagtatgctcatcccagcactaccttagtgcagtctcaatcctctacctcagttagnttccatagtattaaaatactaccatataag

SEQ ID NO: 35396 - DNA, 101 bp, rice(Oryza sativa)
  misc_feature (71): n=t or c
aggccgtcctcgctgcccttttgcaggcggtaaggggactgcctgcaaaaatgctaggctgccctcgccgnccttttgcacgtggcccccgcatagtgaaa

SEQ ID NO: 35397 - DNA, 101 bp, rice(Oryza sativa)
  misc_feature (71): n=t or c
aattcatattggttagaaatcttcatatcttttggggaaacatagcaacttcatggttttagcttctgganacgataaaagttgatctttagggaaaacaa

SEQ ID NO: 35398 - DNA, 101 bp, rice(Oryza sativa)
  misc_feature (71): n=a or c
agcagctgcagactccaagaacattcttgtgatggggggaaccaggttcattggtgtcttcttgtccaggntccttgtcaaggaggggcaccaggtatgtc

SEQ ID NO: 35399 - DNA, 101 bp, rice(Oryza sativa)
  misc_feature (71): n=t or g
aaattgggaagaggcgataaagaacacatccttataaatggcgtgggttttaaggaaagaaatagaacttnttttcattggctttttcaaaaatacctttt

SEQ ID NO: 35400 - DNA, 101 bp, rice(Oryza sativa)
  misc_feature (71): n=a or g
atgaaatcacttcaaaggaaaaggagagccaatctctcggcatcatgccctgtagatgaaagggatttgtngttttatcatctcagtttgtatttcgatat

SEQ ID NO: 35401 - DNA, 101 bp, rice(Oryza sativa)
  misc_feature (71): n=t or g
gcagcagctgtctctgtgttggtgacctcttggagttctgtaaatgatagggacacaagtgggcaatccanttaagccgcttaaaacttcattttagactt

SEQ ID NO: 35402 - DNA, 101 bp, rice(Oryza sativa)
  misc_feature (71): n=a or c
caaagtttgagatggcattattttgactcaggataagtatgcaactgacctcttgaggaaatctgggatgntggactgcaagcctacaaatacccctatgt

SEQ ID NO: 35403 - DNA, 101 bp, rice(Oryza sativa)
  misc_feature (71): n=t or c
tcggggaactaaactccagatcctgatggtttcattagagggaagcttccacaaggtgtgcttgttgatgnaaaaaaacacacacacacacactggcttag

SEQ ID NO: 35404 - DNA, 101 bp, rice(Oryza sativa)
  misc_feature (71): n=t or g
gggacaatttttaccaatatgttacccatgttgcttctatattgcttgttggtttgcttgttgccggtttncctctcacttgatgttttgcattgttcatc

SEQ ID NO: 35405 - DNA, 101 bp, rice(Oryza sativa)
  misc_feature (71): n=t or c
tgttgcgcatttgcatcaggaattttgctatgcttcttgcctcctttcccaccaccgttaccagttggatncaagacacataagcgataagcagtaataat

SEQ ID NO: 35406 - DNA, 101 bp, rice(Oryza sativa)
  misc_feature (71): n=t or g
agttcgagctcaccgtcccacagcgagaacttccttgccaaacacttttcacacacacagtcctcatgtgnactcaagataagttctatttcagttgaata

SEQ ID NO: 35407 - DNA, 101 bp, rice(Oryza sativa)
  misc_feature (71): n=a or g
atttggttggtgggcagggaactacaaacattgtttattactccctctatcctattttaagcgcgatcatnagtttccgcatcaaatcttgatcgttcgtc

SEQ ID NO: 35408 - DNA, 101 bp, rice(Oryza sativa)
  misc_feature (71): n=t or c
tagggagtgtctagatttcatatatgtctcatcccttggatgatatccagtggttttcaacttttcatcantccccctattactcatccaaaggtagtcat

SEQ ID NO: 35409 - DNA, 101 bp, rice(Oryza sativa)
  misc_feature (71): n=a or g
gggatgtgttagtttggaataggatgtggactatcaacaatgcactttgaagagcttggagaatgaccttncaacaagggtaacatggggcaagtgccaac

SEQ ID NO: 35410 - DNA, 101 bp, rice(Oryza sativa)
  misc_feature (71): n=t or c
ctttacaatcatggtattactatctaggattatatcctacaagccataacacttgtggttttctacagttntgacataaaacattaggttttctaaagctt

SEQ ID NO: 35411 - DNA, 101 bp, rice(Oryza sativa)
  misc_feature (71): n=a or g
aactggaagcactgaaccatccttttccaaatgaaaggctaagggaactaagggagtgtttgaggagaagnggattgaggagattgggaagatacgcaaaa

SEQ ID NO: 35412 - DNA, 101 bp, rice(Oryza sativa)
  misc_feature (71): n=a or g
cctgagttttcacttgctcattaattcgtgttttgaggtcttttgccgaatggagtgtccaaagaagcgangaaccctaatgcgttgctctccttctctag

SEQ ID NO: 35413 - DNA, 101 bp, rice(Oryza sativa)
  misc_feature (71): n=a or g
caaagagcacatcttgttcagataatggtatgccgttgtcagctattgctgttatctgaccgactgacccnttggcaacattcaacttgtatagatacaat

SEQ ID NO: 35414 - DNA, 101 bp, rice(Oryza sativa)
  misc_feature (71): n=a or g
acgccattgtcgaagaagcggcgatcgaatctgcaacgcagaatgagccagatgaaccagaatccaccacngttgaagagatggccgtcgaggaggagatc

SEQ ID NO: 35415 - DNA, 101 bp, rice(Oryza sativa)
  misc_feature (71): n=a or c
aggtagcagatgatgcatcaagttgatcagaaactggatgtcggttatgtatagggactgtttctttgctntgtatgtcattcttaattcgattatctggc

SEQ ID NO: 35416 - DNA, 101 bp, rice(Oryza sativa)
  misc_feature (71): n=t or c
tacattcaagtcatagaaaactagcatatattaagtactatctcagcctctcagggaacattagaaaggancacattcttagatgaataatattgttatac

SEQ ID NO: 35417 - DNA, 101 bp, rice(Oryza sativa)
  misc_feature (71): n=t or g
ttacccggttgggttcatgaagttttactgtgacaatggtacagagtatagtctgaacctgcatccttacngtgttcactgcatcgaaattaaaaattaat

SEQ ID NO: 35418 - DNA, 101 bp, rice(Oryza sativa)
  misc_feature (71): n=t or c
tttcttttcactgtcaatgtacagattgcagaagagcgcttagaggatagctgggtccctatggatgaaanggtggctcctgaagaacttgaggagatgat

SEQ ID NO: 35419 - DNA, 101 bp, rice(Oryza sativa)
  misc_feature (71): n=a or g
agcgtcagttcggctcaaccagaccaacgaactcgctaaaatcttactcgagaaatataatcctacagaanaatttgaccgctcagttcctcgcctgacgt

SEQ ID NO: 35420 - DNA, 101 bp, rice(Oryza sativa)
  misc_feature (71): n=t or c
ccattctcttcacacctccgccgaaagattcaatactactaattatgttagagatccaccactaccacgancgatgttgcccactgcctttctctgtcata

SEQ ID NO: 35421 - DNA, 101 bp, rice(Oryza sativa)
  misc_feature (71): n=t or c
cttacaagtgctcagaggattggcctgaagttctttgacgatatcaaacaaagaataccccgacatgaggnatgtattctgtaagcccattgaattgtttt

SEQ ID NO: 35422 - DNA, 101 bp, rice(Oryza sativa)
  misc_feature (71): n=t or c
aagaaagtagcccgcgtattcgcgaggacatgtaccatatcgtaggatgcattttagaaacccatagggtnggtataccaaaattgtgatttttttcatga

SEQ ID NO: 35423 - DNA, 101 bp, rice(Oryza sativa)
  misc_feature (71): n=t or c
cgtcggagagaagagtgtgtgagagagagaaacagcagaaaagggagaggagggaaaagatatactgacangtgggacccacgtgggtcccacgctaactc

SEQ ID NO: 35424 - DNA, 101 bp, rice(Oryza sativa)
  misc_feature (71): n=t or c
tgttcgacactggagaccgtatttgtgggggcgccaatttctcgtgaagacggaccattacagcctcaaanacctgcttgatcagcggctttccacgattc

SEQ ID NO: 35425 - DNA, 101 bp, rice(Oryza sativa)
  misc_feature (71): n=t or c
ttctgagagcagtggtacggtttgatgctgtcatgcaactaaacctacaccctcaattactccctccatancaaaataagtacaccgtacaggtcaaatct

SEQ ID NO: 35426 - DNA, 101 bp, rice(Oryza sativa)
  misc_feature (71): n=a or c
ccgatctatgtttaacacgatgtcaaggccgcacacgtggcaaccaaccaagcaatagagtcataagcaangtattatttaacggtgcaagtacttaaata

SEQ ID NO: 35427 - DNA, 101 bp, rice(Oryza sativa)
  misc_feature (71): n=t or c
gtagttaagcagatctcccagaccattgctcttgtcgatttagttcacgctaacacagatctggctctgtnggctgagcgcggatttttcgtcaacaatat

SEQ ID NO: 35428 - DNA, 101 bp, rice(Oryza sativa)
  misc_feature (71): n=t or c
gaggtcataatgatgatggtgttcttgaaatctactgtccttcctttgccatcagtcaacatgccatcatngaggagctgaaggaacacgttgaacaccga

SEQ ID NO: 35429 - DNA, 101 bp, rice(Oryza sativa)
  misc_feature (71): n=t or g
atgcatgaatggatggctcctgattaattaaattaaacaatttattaataggatggtagaattagagctanaaatttaagtaagttattcagaggagaatt

SEQ ID NO: 35430 - DNA, 101 bp, rice(Oryza sativa)
  misc_feature (71): n=t or c
cgcacgcaacgccatcacacaaatgatgcgttctagcacggactggtccggtttgcaacccctatagtccngttgcgcttataaaacgagatactttttag

SEQ ID NO: 35431 - DNA, 101 bp, rice(Oryza sativa)
  misc_feature (71): n=t or c
tcgcgttggtcggctcgtatacgtacgtacacacagggacacggtcaccaatttggtactccatccgtttnacaatgtaagtcattttaacatgggactag

SEQ ID NO: 35432 - DNA, 101 bp, rice(Oryza sativa)
  misc_feature (71): n=a or g
cgcatgcagattaacaaattaccagctgcaggtgttgctgtttttgtaggaatgacccgtgtcattcacanccacccgaatgcacacgagctcttgttttg

SEQ ID NO: 35433 - DNA, 101 bp, rice(Oryza sativa)
  misc_feature (71): n=t or c
tacagcacacgctgtggagccataccatgaatgtaccaatgcgcgcacaacctggatccaaaataattttntactactccctccattccaaaatataaaca

SEQ ID NO: 35434 - DNA, 101 bp, rice(Oryza sativa)
  misc_feature (71): n=a or g
ttaacaccctaatgtatgggaactgattcaaataatcctggggtggttttcccagtatggtagttgatgtncaatgactcgagcaaatggcgctgacatgg

SEQ ID NO: 35435 - DNA, 101 bp, rice(Oryza sativa)
  misc_feature (71): n=a or g
aggcttcttgctgctgcaaacaacagcagcagcatcactactaccacctgcaacaacagcaacatcagcancaacaacaacaacaacaacattaacagcat

SEQ ID NO: 35436 - DNA, 101 bp, rice(Oryza sativa)
  misc_feature (71): n=t or c
ggaagacttcttcttcatctggtgccaacaagaagaaaaagggatcatctaccattactacaactacaacnacaaccacaacctcagaaccaatcagtgtg

SEQ ID NO: 35437 - DNA, 101 bp, rice(Oryza sativa)
  misc_feature (71): n=a or g
ggaagggcatctatacacatgctgttgtactaactccgatcgattctgtgaccttgacgggaatcatcagnttttcagttgagcaaccttttctgagacct

SEQ ID NO: 35438 - DNA, 101 bp, rice(Oryza sativa)
  misc_feature (71): n=t or c
attcggccttgcgcactttggtcggtaaagccatttggcagggcttttactggccaaccatgctctaggangcccaggactgggtccgacgatgcaaagct

SEQ ID NO: 35439 - DNA, 101 bp, rice(Oryza sativa)
  misc_feature (71): n=a or g
aaccacattcttccggaaggctgattctcttgggactgatatttaccatgagaaatctcctccccactgancttgtcaactgtcatgcttttgaccttttc

SEQ ID NO: 35440 - DNA, 101 bp, rice(Oryza sativa)
  misc_feature (71): n=a or g
tactttgtccagcttttctagcatgccacgccaccaaatttacaatcagcaaactctgttacaaaaacttntgtaccatccgttcttgcttggctggttta

SEQ ID NO: 35441 - DNA, 101 bp, rice(Oryza sativa)
  misc_feature (71): n=a or g
ggccaagaagttgtcggtgccctaccattttcatgcccagccatatctctgtcccgatcagttgacactcntcgtcgcccttctcttcgccacctgcgtcc

SEQ ID NO: 35442 - DNA, 101 bp, rice(Oryza sativa)
  misc_feature (71): n=t or c
caaatatgttgtgctctgtgccgttggaaggctggctgacttttccaactatatatgggaaggagaaatgntgatttggggcactcaaaatcgtagaaatt

SEQ ID NO: 35443 - DNA, 101 bp, rice(Oryza sativa)
  misc_feature (71): n=a or c
gaggtctacaattacttcggaagttttgagtatgccggtgcacacctggaacccctgggtccggcagtgancttggataagcctgacccatgactgatcca

SEQ ID NO: 35444 - DNA, 101 bp, rice(Oryza sativa)
  misc_feature (71): n=t or c
ggcgtccaggggcgtcaacgtgcatggagacgaccaacaagaagaagatcgatgtcgtcttcaattgcctnaaatcgagtaggcaccaagcacactgggcg

SEQ ID NO: 35445 - DNA, 101 bp, rice(Oryza sativa)
  misc_feature (71): n=t or g
gaagaatgattacctgtgtgttcaccacctgtagaatctgaaaagttattttgctcagaagggaggaacgntgacttgccataattgtctaatatttctgc

SEQ ID NO: 35446 - DNA, 101 bp, rice(Oryza sativa)
  misc_feature (71): n=t or g
agattcctttgcagtttctagtgtgaccgaaactatgcagtctaaccaaggatctgtaatgcaagaccaanattttattgaagttgctaatgtgactgatg

SEQ ID NO: 35447 - DNA, 101 bp, rice(Oryza sativa)
  misc_feature (71): n=a or c
caggcttgtatcatgcataagtcatccaaacagtaatccattcgtaacagggtagattaaactgtactccntccgtactcgtaaaagaagtcgtttaggac

SEQ ID NO: 35448 - DNA, 101 bp, rice(Oryza sativa)
  misc_feature (71): n=a or g
tataaatgtaaccaagattgacttcagcagaaatgaagtgtttattgattacaactgccgcagccacaacngcttcggcagcaagacgagcaagcaaatgg

SEQ ID NO: 35449 - DNA, 101 bp, rice(Oryza sativa)
  misc_feature (71): n=a or g
atccaatacagcagcagccgattcaacagacactcccaactcagcaagttgtacaactagtccggcaacangtcatgcaaccaggtcagcaagcaccgcca

SEQ ID NO: 35450 - DNA, 101 bp, rice(Oryza sativa)
  misc_feature (71): n=t or c
acgaggctgctcgcccgtgccaacggcggcaccatcagcagtgatgacaacgtgtggagcttcgtgcaatngacggcgctaccgccaccatcggcccctgt

SEQ ID NO: 35451 - DNA, 101 bp, rice(Oryza sativa)
  misc_feature (71): n=a or g
ctcaacgttaaagctatctgattccacaacccattaccgagttgacccttttgtgtaagttttcctaccancagcatctattgtcacatagccttgaaccc

SEQ ID NO: 35452 - DNA, 101 bp, rice(Oryza sativa)
  misc_feature (71): n=a or g
gagcactcccaaggtctataacggcaaatccacacctgactctgccgctgctaccgttggatctatgatgnaggggcgctctcgtggctggctacggcgga

SEQ ID NO: 35453 - DNA, 101 bp, rice(Oryza sativa)
  misc_feature (71): n=a or c
tgggatagccatatccatatagcactccatgatctgaaagatgctctaagcagctactactcctatcaacntttgaatttaaggacaaataacgtttgctc

SEQ ID NO: 35454 - DNA, 101 bp, rice(Oryza sativa)
  misc_feature (71): n=t or c
atactttctattctctttaatataactccagcttagcctggctacggtttcaaaaaaaaagtagtactccntccgtcctataatataagtgattagtatca

SEQ ID NO: 35455 - DNA, 101 bp, rice(Oryza sativa)
  misc_feature (71): n=t or c
tctggtaaatcaccataggaagtgcctatgtcatccttcattatgtcgtaaccctgagatagcatgctagngaatgttaagacattgtataatttattcaa

SEQ ID NO: 35456 - DNA, 101 bp, rice(Oryza sativa)
  misc_feature (71): n=a or g
aatgatgagctcaaaccttccaaggataatatgtctcacctgtaatgtctcctctgctgccatgtcatctnttaggagcatatcttttgtaattctagaaa

SEQ ID NO: 35457 - DNA, 101 bp, rice(Oryza sativa)
  misc_feature (71): n=a or g
aatatataggtaacttttagggagattcattgggcgcagttttggtctatgttgcttaaattggaggatgncattgtgttaaagaaaaagtgtttcttcaa

SEQ ID NO: 35458 - DNA, 101 bp, rice(Oryza sativa)
  misc_feature (71): n=t or c
tgccggttttaaatgaatcggcatctataagccgtcacttattaaggtttttgtagtagtcgaaggagatntggagattaaggagagaataaaggagggag

SEQ ID NO: 35459 - DNA, 101 bp, rice(Oryza sativa)
  misc_feature (71): n=a or g
aaaaaaatatttttgaaacagaattatagatgaaatcaagatcaacaccaggctccaaagacaactctctnaacgatcaaatagagtccaagagagcataa

SEQ ID NO: 35460 - DNA, 101 bp, rice(Oryza sativa)
  misc_feature (71): n=t or g
gggacagagagtatgctcctacttgtaagtcttggatggtgcaatgaaaggtgcgctctcactcaaaatcnttgataagtagtactaccttcatcacaaaa

SEQ ID NO: 35461 - DNA, 101 bp, rice(Oryza sativa)
  misc_feature (71): n=t or g
gtgtcatagggatgcatatgggcaatcatgctaccacataaaaactcatctccatagtttgttttctacanttaacagtataaacaaaacagacgagaatt

SEQ ID NO: 35462 - DNA, 101 bp, rice(Oryza sativa)
  misc_feature (71): n=a or c
tccggcgttagcttttgttattgctggatgaccgtgtaaggcctcctatttgtagggaagtagcttactcnctccgttgaaaaaaagacaaactctgagtt

SEQ ID NO: 35463 - DNA, 101 bp, rice(Oryza sativa)
  misc_feature (71): n=t or c
ttttctcttttttaaccattgacccaataaaactccctcctaattattttctcaccccttctcgttttttncctgtattaataaaaggacataataatctt

SEQ ID NO: 35464 - DNA, 101 bp, rice(Oryza sativa)
  misc_feature (71): n=t or c
caaaatccatctgaagtagtcgatgatgaagatcaaaggagcccaccacctaaaagtgaccattcattaantgagaaggaaagttctgaagtcaaagagaa

SEQ ID NO: 35465 - DNA, 101 bp, rice(Oryza sativa)
  misc_feature (71): n=a or g
atgaagtcaggccttagcatttggcaagcatgaaattccagattgtagaatttccagctcaaaagcattcnaagaaggtaaaaccataaaatttcttcttt

SEQ ID NO: 35466 - DNA, 101 bp, rice(Oryza sativa)
  misc_feature (71): n=t or g
caagagatatcttgattgttaataaatactagttgacaaatgatttcagttcacttgtatccgggactggnagcaatgcttattttgtgaacatgaagggg

SEQ ID NO: 35467 - DNA, 101 bp, rice(Oryza sativa)
  misc_feature (71): n=a or c
ccaatagtatagtcctcatgctatttctttccctgatcttccaaacatgcaagtacttgctttcatccttnatatgttactcccttcgtcccctaatataa

SEQ ID NO: 35468 - DNA, 101 bp, rice(Oryza sativa)
  misc_feature (71): n=t or c
gcgaggttgacgacgacgacttcgaggacgtgacggtggcgagctcctccgtcgtcttggtgttaggaaangataagccaacaaacgataaaaaacaatag

SEQ ID NO: 35469 - DNA, 101 bp, rice(Oryza sativa)
  misc_feature (71): n=a or g
acctgaattcaaatcctaatcttgatataggtgctcgatttacgggctaatattattttaatggtaggccngtgatgcatccgtcgacagcgagatatcca

SEQ ID NO: 35470 - DNA, 101 bp, rice(Oryza sativa)
  misc_feature (71): n=t or c
caagtggcacatccggtgccggtgctaattttgcaatcacctgcaccgccaccaccatcgttggccggtcngacgggttcgggttgctgcacgccaagcct

SEQ ID NO: 35471 - DNA, 101 bp, rice(Oryza sativa)
  misc_feature (71): n=a or g
agtgaagtctgtacttggtatcccaatgggcgacaaggatgtctcatatgagatggaatctgaagctacanaatttgtgctgaatttgcttggaatcaatg

SEQ ID NO: 35472 - DNA, 101 bp, rice(Oryza sativa)
  misc_feature (71): n=t or c
catctctactggtggcccacatgcttgctggcttgctgcagatcgcaacttgactcccaccacttcctccncctcctcgtagttgtgcggagcggagagga

SEQ ID NO: 35473 - DNA, 101 bp, rice(Oryza sativa)
  misc_feature (71): n=t or c
aagtggaaagaagttcattctatcaaagtatggtctcagtgatctaccttcagttcggttctttggtgatnagtttattaaaaaggaatagatttctgatg

SEQ ID NO: 35474 - DNA, 101 bp, rice(Oryza sativa)
  misc_feature (71): n=t or g
gtaggattgagtatctatctgtgtttgtgtgagtcgtcgtgcactcgaacgacttgagctacagtttcagncacgtgctggaatagaatatatattttgat

SEQ ID NO: 35475 - DNA, 101 bp, rice(Oryza sativa)
  misc_feature (71): n=t or c
caggaagtatagaagatcctcaaaaaagttgggacttacatttttgttgaagttcttgattcctgatattngtgtggcttttaggaggactccatccagtc

SEQ ID NO: 35476 - DNA, 101 bp, rice(Oryza sativa)
  misc_feature (71): n=a or g
gcagaagtaagcaaacctatggcaaatatcaccatgaaaataacctttgccaaccagttgtggatttaacntgggggccgaccatggagacccccctaagc

SEQ ID NO: 35477 - DNA, 101 bp, rice(Oryza sativa)
  misc_feature (71): n=a or c
gtcattaatgtaaagcagggatatctgaatatttttgttgacttggaggcaactacatggtggctggtggntgggcaggcacggaaaccgaatccaatcaa

SEQ ID NO: 35478 - DNA, 101 bp, rice(Oryza sativa)
  misc_feature (71): n=a or g
gtacctattttctactacatacttagagagaggatcccaatatacaagcgttgggtgtaagaagagaaggntacactaattggatatgagatctctaatgg

SEQ ID NO: 35479 - DNA, 101 bp, rice(Oryza sativa)
  misc_feature (71): n=a or g
aaaacacattgtttatgatgtttatatagatcctgatgggcctgataaggtctggaaaaaaaagaactggnagtaaaaatgatctttaagatcacttaaga

SEQ ID NO: 35480 - DNA, 101 bp, rice(Oryza sativa)
  misc_feature (71): n=a or g
tgcatcgcgaagcgatggacaaagagggcaaagactgggccagaattaattgggcataatcttgagaatgnaaattgctacatggattcttcaacttcaag

SEQ ID NO: 35481 - DNA, 101 bp, rice(Oryza sativa)
  misc_feature (71): n=t or c
gcatggtccaatacttcatcttctccacgggcatgttgtcaaaccgtgaagtttcccccccttttcttgcnttaaaaaaattggttaaataaattgcccga

SEQ ID NO: 35482 - DNA, 101 bp, rice(Oryza sativa)
  misc_feature (71): n=a or g
tgttactaattttagtagttccaaacctgatttctttggtttattgaagcaaggggtgcatctctcacatnctcctccatagcttgcaggaatgaggtcgg

SEQ ID NO: 35483 - DNA, 101 bp, rice(Oryza sativa)
  misc_feature (71): n=t or c
tattctggacatttgaatgatatgctttgcattatcaggttccagaaccccattgaaaatgggcagcacangaattctacatcagatgatgtcaagatcat

SEQ ID NO: 35484 - DNA, 101 bp, rice(Oryza sativa)
  misc_feature (71): n=a or g
caaatgaccgcagccacaatgctaactaattcccgcatgtccatacggatatggataagtacctgtcatcnttttcattcctttgatagattagcaactga

SEQ ID NO: 35485 - DNA, 101 bp, rice(Oryza sativa)
  misc_feature (71): n=a or g
aacaagacaatggtcatagtcatagattcagcttcgttttcttcagaaatagaaattcaggttcagcttcntatttcaggggcccttgactacatgaggcc

SEQ ID NO: 35486 - DNA, 101 bp, rice(Oryza sativa)
  misc_feature (71): n=a or c
aaatactagtgcgagttttgcttttatgatatttgagaatgtaaactaaaccaaaactaagccttgcaaanaaaggcatgaatggtaggaacttcaaaaac

SEQ ID NO: 35487 - DNA, 101 bp, rice(Oryza sativa)
  misc_feature (71): n=t or g
ggcagtatttagccgattaaaggtatgcggattggcatagtacacggccatcatgtagttgttcagaatgntgaatatcattcaaagaagtatgaaggtgg

SEQ ID NO: 35488 - DNA, 101 bp, rice(Oryza sativa)
  misc_feature (71): n=a or g
agagaccgaacaaaagaagaaataaaaagaagagaaaaccaaagaccaaacaaaccgctacttcggctcgnttcagtccgatctttggttgtcggtatttt

SEQ ID NO: 35489 - DNA, 101 bp, rice(Oryza sativa)
  misc_feature (71): n=a or g
gacaatctcagaagtggagttgtatggcatgcaaacagagaagaccagtcccttgttttcagcagtgctanccatcagtttctcagctgctaccctcaccg

SEQ ID NO: 35490 - DNA, 101 bp, rice(Oryza sativa)
  misc_feature (71): n=a or g
acaagaattgtgattctacaaaagtcctagtatgaaaaaggagcactacttcattggagagagaacaaatncatgtatttcattgtgacgaaatgttgttg

SEQ ID NO: 35491 - DNA, 101 bp, rice(Oryza sativa)
  misc_feature (71): n=t or c
taattaattttaacatcatatcatctcatagagagcacggtagcagtagtaccttaatactacatccgtcncaaaataagtgcagccatggatattcgtgt

SEQ ID NO: 35492 - DNA, 101 bp, rice(Oryza sativa)
  misc_feature (71): n=a or g
tgggacgaaatagaatctcatccaatgatgattaattgcagtccaggtcatataccacttcttccatcctnaccaggcaggtggccatgggtttttcttgg

SEQ ID NO: 35493 - DNA, 101 bp, rice(Oryza sativa)
  misc_feature (71): n=a or g
catatcttgtttcttgaatgagagcatgttacccacaaccacaattgctaatggcaaaccatcacacttgnccatgatctctctccccaatgactctagtt

SEQ ID NO: 35494 - DNA, 101 bp, rice(Oryza sativa)
  misc_feature (71): n=a or g
ttacgatgtttcagtagttcatttgcaaatgttgtattgtgttctttcgatgtttcaataaatactttgcnctgtttcaatagttataaattgatgtttca

SEQ ID NO: 35495 - DNA, 101 bp, rice(Oryza sativa)
  misc_feature (71): n=a or g
caaattcagtgttgaaaggaagttgagtgatgctaactcctcggggatctccccagagaactcattcgagnagaggtccagtgactcaagttgattcaatc

SEQ ID NO: 35496 - DNA, 101 bp, rice(Oryza sativa)
  misc_feature (71): n=a or g
ttttcctatccccactctaactgaactatagaagggcaggcaaaaatcttaaagatactttgcaaaatgtngtagagaaaatgagtggaggagaggatttc

SEQ ID NO: 35497 - DNA, 101 bp, rice(Oryza sativa)
  misc_feature (71): n=t or c
aaacgaacgctcggaatgcttggtatccgcctgatgcttcatgcgcatttgtgctcttagtaaatgctcangaataagagtctgcatcttgtctctctcat

SEQ ID NO: 35498 - DNA, 101 bp, rice(Oryza sativa)
  misc_feature (71): n=a or g
gccaataattttataataaattaggtgaataccctgccacgttgttacatgaaatcaagttacatagtacntacaaataagatgcaaaataattattaaaa

SEQ ID NO: 35499 - DNA, 101 bp, rice(Oryza sativa)
  misc_feature (71): n=t or c
gatcgactcatcgatctacacaagctcagccactgactcgatgatcccttcgaaagagacgctctggttgntagccaggatggccgccatgccgtcgccac

SEQ ID NO: 35500 - DNA, 101 bp, rice(Oryza sativa)
  misc_feature (71): n=t or c
agctacaatattttagatcctaagggcatagatggccataaggcccatcccacggcacgatattttggtcnggcccaaacacggcacggcccgataggggt

SEQ ID NO: 35501 - DNA, 101 bp, rice(Oryza sativa)
  misc_feature (71): n=a or g
cgctcctgttccagtcacatcgctaggaaaatgttcgcggttttactggacttggaaggtaagaaatactngcaaggagcatgaccgtggatgtggacgtg

SEQ ID NO: 35502 - DNA, 101 bp, rice(Oryza sativa)
  misc_feature (71): n=t or c
ccaccggcggccaagaggcctcctgaaccgccaccgaagacgacgcagaggcaacaaccaccaggtcctcngccaaagccgcaaccgagcgcaccgaagcg

SEQ ID NO: 35503 - DNA, 101 bp, rice(Oryza sativa)
  misc_feature (71): n=t or c
cttttgtggttgtcgcatgactggatgccgtgccccttgccgcagaagatcctgacagcggggacgactcnaggtgcagagccgcgcgggctcttctgtac

SEQ ID NO: 35504 - DNA, 101 bp, rice(Oryza sativa)
  misc_feature (71): n=a or g
aagagtatttattatctgctcttccaatttccctggtaaaaggagtttgagaaacatccagatatccaagnctatgacaagttaaaaacacaacaatatga

SEQ ID NO: 35505 - DNA, 101 bp, rice(Oryza sativa)
  misc_feature (71): n=t or c
atgtttttttatgaaaataacactgtttatggggcttagaaaacatgcgcattcatccacggatctactcnctccatcctaaaaaacgaatctaaaactat

SEQ ID NO: 35506 - DNA, 101 bp, rice(Oryza sativa)
  misc_feature (71): n=a or g
tttattttcatatttttgccgtacattttaaagatgtttccgtagtactactatctgagaccaaaatactntactatctggtcagccagagagactttcta

SEQ ID NO: 35507 - DNA, 101 bp, rice(Oryza sativa)
  misc_feature (71): n=t or c
aggttttgcactacaaatttcccctggatatattgtctgagacttagcatcagccatactttgaccatgcnattgctaatgtgtaaggataatgagatgat

SEQ ID NO: 35508 - DNA, 101 bp, rice(Oryza sativa)
  misc_feature (71): n=a or g
gcagtgctgctactgtcgcctctctttctcaccgtcctcttctttggaaagataagtggcgtacggcgacncagcggtgttgccacaactggcgccctgga

SEQ ID NO: 35509 - DNA, 101 bp, rice(Oryza sativa)
  misc_feature (71): n=t or g
tgccgcttgaaacaaaccaaagacggtcacatacagcgctaccgtactagtttccttctatttgtctcctnaattccaaagtttttttttttcatatgaca

SEQ ID NO: 35510 - DNA, 101 bp, rice(Oryza sativa)
  misc_feature (71): n=a or g
tgtagtatagtggagtacctagccagcagctgctcgacttgctcggctaaagtttcggcgaaagagaaaanggggggagatgccgagatcgtaggcggaat

SEQ ID NO: 35511 - DNA, 101 bp, rice(Oryza sativa)
  misc_feature (71): n=a or g
tagctaactggactttttctattttcttcagagcctgaaatcgttggcatcttactccaaaagggcagtgnaaaagagaaaagaacaagaccggtaaagta

SEQ ID NO: 35512 - DNA, 101 bp, rice(Oryza sativa)
  misc_feature (71): n=t or c
atcctctgccctgttctgaggctgaggacattttggccaccagaagctgatgaattttctgtgctgatgtnctcatccttgctcttcagtttgacgaattc

SEQ ID NO: 35513 - DNA, 101 bp, rice(Oryza sativa)
  misc_feature (71): n=a or c
gtatacgtgatttgcattacatattttctcactcaagtgcaacctgccctacaatttacgtcagcatcagnaattagcaccaaacgcatcaagcactttga

SEQ ID NO: 35514 - DNA, 101 bp, rice(Oryza sativa)
  misc_feature (71): n=t or c
atggctgtagtgataaaccgcatggagttttctgcaagtgaaaatgatacagcatgttctgcactgtcttnaaatttgttatatgtagcacaaccgtaaaa

SEQ ID NO: 35515 - DNA, 101 bp, rice(Oryza sativa)
  misc_feature (71): n=a or g
aggtggagggatggaggtggtgctaccggaagtggcgatgcgggtcagaggtgtcggatttattggcaacnaggctggcggcctaacgatggcaagcgaga

SEQ ID NO: 35516 - DNA, 101 bp, rice(Oryza sativa)
  misc_feature (71): n=a or g
cataagattatgtactcgacaatattcaatattgccaacattgtgagctggtactggttctgatggttgantgatgcttctattgataagctctgcaaaat

SEQ ID NO: 35517 - DNA, 101 bp, rice(Oryza sativa)
  misc_feature (71): n=t or g
ttcgtgcctgtgaggctgtgagcactgtccagaatagggcacatgtgatcttaccatttcctgcaactccnccaggagagggtcccattcgctgacgccac

SEQ ID NO: 35518 - DNA, 101 bp, rice(Oryza sativa)
  misc_feature (71): n=t or c
acacatgttaaatcatgattttgactttgatggagtacttgacagtgtgctgtttcatttgcagcttccancagactgtagcttagctgctgtatttgttg

SEQ ID NO: 35519 - DNA, 101 bp, rice(Oryza sativa)
  misc_feature (71): n=t or c
taatggttttacaggggaaaagaaatacaaatttcccaagcaaggctcttagtattaagcagtaaccatgngctgtcacaccatcctattacctccatccc

SEQ ID NO: 35520 - DNA, 101 bp, rice(Oryza sativa)
  misc_feature (71): n=a or g
ggttcatttttaaaatgaaatagataaccttttttttaatatgaagttagatgaacttacagagctggacnaggttaataattaacattgttactaaagat

SEQ ID NO: 35521 - DNA, 101 bp, rice(Oryza sativa)
  misc_feature (71): n=t or c
ctgggaatcaagccagagagaatactgcagcggcgtgagcttgttacgctgcaatggagactgtaactcancaggtcctcgagaatataggtggtggagga

SEQ ID NO: 35522 - DNA, 101 bp, rice(Oryza sativa)
  misc_feature (71): n=a or c
gagccttgcaatcgcacaagagaagaaaaacttttggatccccatgcttccactgcgggtggccatggtgntggatctgcttggccttgtgggggcctatg

SEQ ID NO: 35523 - DNA, 101 bp, rice(Oryza sativa)
  misc_feature (71): n=t or c
cataaagaagagactaatctctgggcgagccgcccagtcttttcaaattatgcaatcaatcaacattgttnccatgatgtacgcatatgtttcatttggtc

SEQ ID NO: 35524 - DNA, 101 bp, rice(Oryza sativa)
  misc_feature (71): n=t or g
tgggaaaaactacactagctcagcatgtctacaatgatgaaagggtggctcagtattttgatgccaggatntgggtctgcatctcgcgcaaacttgatgtg

SEQ ID NO: 35525 - DNA, 101 bp, rice(Oryza sativa)
  misc_feature (71): n=a or g
acatttgtatttccatagtctattagatggaacgactttttggtgtttcttgttctgtggccagttggccncttccatttttgtatgaatactatatctat

SEQ ID NO: 35526 - DNA, 101 bp, rice(Oryza sativa)
  misc_feature (71): n=t or c
agtgccgcggctagtgaagcacaactgggatccgggtaagctgcgtaggtgtagttggatcgatctttttnttttctttttaagaaggatattttttaccc

SEQ ID NO: 35527 - DNA, 101 bp, rice(Oryza sativa)
  misc_feature (71): n=a or c
agcgccatttgtgctcttccatagcttggagatgcttctcttttcgatgatatggaccgatagataccatncttggctcataataagccttgtccaactca

SEQ ID NO: 35528 - DNA, 101 bp, rice(Oryza sativa)
  misc_feature (71): n=a or c
cttgtcatatccaattagatttgataagacctaaactgtagtaaaaaaaatgtaccacatgctttctcatntgtcatcaatgtttccacctattcagacaa

SEQ ID NO: 35529 - DNA, 101 bp, rice(Oryza sativa)
  misc_feature (71): n=t or g
ttgagagagactttcttccatgacaacccattacgccagtacaaggaccaatctggatcggcaaagttcangatggcgctgcagttcctgttcccaatctt

SEQ ID NO: 35530 - DNA, 101 bp, rice(Oryza sativa)
  misc_feature (71): n=a or g
gacttaaatttaaatccaaagtttattcctaaatcattttgaactgtactaatttttttcaggtgtcacanaagacagaattaaagagaggaacattacaa

SEQ ID NO: 35531 - DNA, 101 bp, rice(Oryza sativa)
  misc_feature (71): n=a or c
cacaggccaagaatcaccagcacacacactgtcacacacaaagaaagaaaaggagctagcaatggcagcantcgccgccgtcgccgttctcgtcgtcgcca

SEQ ID NO: 35532 - DNA, 101 bp, rice(Oryza sativa)
  misc_feature (71): n=a or c
gacacgttgcacaataaggctctcatattggtctgcaacatcagccccgatgtgttcctcatcctcactanctttgttgttagctgcaagcaatgcaagtg

SEQ ID NO: 35533 - DNA, 101 bp, rice(Oryza sativa)
  misc_feature (71): n=a or c
actgcaacacacaaccataacaatgcacaaacaaacctaaaatgtcatatttttccttgcttaaggttctnatcacaagcaaaacatccacaaacaaacct

SEQ ID NO: 35534 - DNA, 101 bp, rice(Oryza sativa)
  misc_feature (71): n=a or g
tctgttctcattctctttaggacaattgatgacttctgaaataaagcacggtggaaagctatcctgtagcngcatggattctgatggcccccatacttcac

SEQ ID NO: 35535 - DNA, 101 bp, rice(Oryza sativa)
  misc_feature (71): n=a or g
aggtccatcaagttgcgatgttgcagttagtcattctaattaaccatatccttacacacaggttgacggcngtggcactgtggaattagacaaggaaaagg

SEQ ID NO: 35536 - DNA, 101 bp, rice(Oryza sativa)
  misc_feature (71): n=a or c
atatgggaagctcttgttttgactcggatgaaatcttagggacactggctgttcttttatcagatatcaanactgtgcctgctggctgttatgctgaagtg

SEQ ID NO: 35537 - DNA, 101 bp, rice(Oryza sativa)
  misc_feature (71): n=t or c
gtttactaataggaacggacctttgtagggtaagtgtgcgtgtagatataagtgctcgcgtccatactacntcctctgtcttaaaaatataagtatttttt

SEQ ID NO: 35538 - DNA, 101 bp, rice(Oryza sativa)
  misc_feature (71): n=a or g
cagaaactgtaagttgcactatcttcctcctggtctttcctaccaggcaaaggcacttagaaggttatccntagctaatgttcagcacctaaattgtcttg

SEQ ID NO: 35539 - DNA, 101 bp, rice(Oryza sativa)
  misc_feature (71): n=t or c
gggatggagaaggagaaggagggacatgcagaaagaaagattgaataatcgcaccttttcttctccaaggnctcacatcccattaatggcaaggggcatga

SEQ ID NO: 35540 - DNA, 101 bp, rice(Oryza sativa)
  misc_feature (71): n=a or g
atgtatagtgatcgaaaatgtttttatctattgttaaagacgacagtcggctatgcgagccgggcctacanctttactcgtgggctaggtcaaagagacgc

SEQ ID NO: 35541 - DNA, 101 bp, rice(Oryza sativa)
  misc_feature (71): n=a or g
aaatatttgactcatggggcttcaccagggtgaatcctttgctttcactttcctttttgtcttgtctttgnagcacccccaggtacggggtgatcttgtgc

SEQ ID NO: 35542 - DNA, 101 bp, rice(Oryza sativa)
  misc_feature (71): n=t or g
agactggcagcacagttgttatcagttttcacagtatactccactcatcatgttctctttggtctacagcnagtatgggaacctagagcacccgtaatagt

SEQ ID NO: 35543 - DNA, 101 bp, rice(Oryza sativa)
  misc_feature (71): n=t or c
aggcccatttgatggataatagtttggaggaaaacgttcacattatgtcctccaatttatgggttgagttncatttgcatccctcaaccgtaaaatcaggt

SEQ ID NO: 35544 - DNA, 101 bp, rice(Oryza sativa)
  misc_feature (71): n=a or g
ggtgtccggcgcccagtatccgagtaacagcagcttattcatgtatcaaacactcatcgactcagggaacnagctctactactcatacactgtctccgaca

SEQ ID NO: 35545 - DNA, 101 bp, rice(Oryza sativa)
  misc_feature (71): n=a or g
actcctacgccatgaccatgatcaagcaaagcaatgtacacctgctgctgtgagagttgcaattctccacngtgcatcatcgatcatcaattactgctgct

SEQ ID NO: 35546 - DNA, 101 bp, rice(Oryza sativa)
  misc_feature (71): n=a or g
tcgatcgccattgattgatagctgtctcgagaggatctctgattgtgccatatagttaatggtgtaattgngaggtttaaaactggcattattggctgtaa

SEQ ID NO: 35547 - DNA, 101 bp, rice(Oryza sativa)
  misc_feature (71): n=a or g
ttaatttagatccatggcacgtggactagaattatacaatacatagtatatatactgtatgtgctaggggncccctgattttgggggcctcgggcggccgc

SEQ ID NO: 35548 - DNA, 101 bp, rice(Oryza sativa)
  misc_feature (71): n=a or g
agcgagcgcctcttgataggctccagcttgcttccaaagttctgggagaagctcgacagatttactaacgntttcctgaagcttttgttcaaccatgacat

SEQ ID NO: 35549 - DNA, 101 bp, rice(Oryza sativa)
  misc_feature (71): n=t or g
atattgtattaaagagcaataaccagttgccctactttggatccaagcatgagccttttgtccatttccgncatggctagtatagcattatattggaaatt

SEQ ID NO: 35550 - DNA, 101 bp, rice(Oryza sativa)
  misc_feature (71): n=a or c
ctggccctgctgacgtcaacgcagcagatacggtgcttgttatctagtagttggtgctaattaaccttagnacaagcaaatctttttgaccaaccggctta

SEQ ID NO: 35551 - DNA, 101 bp, rice(Oryza sativa)
  misc_feature (71): n=t or c
gagttatgggctttttagtcttttcccctttcggtatacaacatatatgctcttaggcttcattcattccntcagtttggttggtaatttttaacacacct

SEQ ID NO: 35552 - DNA, 101 bp, rice(Oryza sativa)
  misc_feature (71): n=t or g
aagaggaccctaaaatctaatctcccagctagctttggaggcagtaattaacatccattggaagagcatanaatgggattagagcacagtaacagcaggta

SEQ ID NO: 35553 - DNA, 101 bp, rice(Oryza sativa)
  misc_feature (71): n=a or g
ggccaccgaaatcgtactcagcccagtctttccacccagctgccaaacaacttcaccatgcactggtggcntgcccatttccgcaaatcgcaatgtagcgt

SEQ ID NO: 35554 - DNA, 101 bp, rice(Oryza sativa)
  misc_feature (71): n=t or c
tgccacctgataaggagttcatgacttgattgcctcatttacctgacataagacgtgaaactttcttcttntttttttctacggggagacgtgaaacttac

SEQ ID NO: 35555 - DNA, 101 bp, rice(Oryza sativa)
  misc_feature (71): n=a or g
catgtacttgacatccaggaagcaacagccattgtaaatgcagcacccatggagtgcttctctagctcgtnttgcatcttggcacagccggaacagaatga

SEQ ID NO: 35556 - DNA, 101 bp, rice(Oryza sativa)
  misc_feature (71): n=t or c
ctcgacatcaatgagggatctaaagtgaacctagagacaaaggggttttcctttgtcttagtctaggctancagctttttctctttcttactaacatattt

SEQ ID NO: 35557 - DNA, 101 bp, rice(Oryza sativa)
  misc_feature (71): n=t or c
tattacactttgttgaatgctttgattgaggatggacgagtggaggaagcagaagagctgtatggaaaaanattctcacgatatttggagggtttgcctca

SEQ ID NO: 35558 - DNA, 101 bp, rice(Oryza sativa)
  misc_feature (71): n=t or c
cttgctcttcccactccattagtcactatcactacacaaactattttttacagtttgatttggaaaggagncttacaggcaagtattaaaacatatagatc

SEQ ID NO: 35559 - DNA, 101 bp, rice(Oryza sativa)
  misc_feature (71): n=t or c
tggatagtgtttgtcactttgtaaaaacgtatgacatacatattgtatgtgtataatccaagaggccaacngcttaggatgtgttcgttttctagtttttt

SEQ ID NO: 35560 - DNA, 101 bp, rice(Oryza sativa)
  misc_feature (71): n=a or g
gacataccagcacgatcgagaatatccagaatgtactgacgctgactgagatacatactagcagaagtgcngcaaacactgatccccagaaagtgatccag

SEQ ID NO: 35561 - DNA, 101 bp, rice(Oryza sativa)
  misc_feature (71): n=t or c
attctcaatgctgtgtccttcaccagctcgggaattgtgatgtcccacgaataacaaccggtgtccccctngtcgccataccccagcttcttaaagagcct

SEQ ID NO: 35562 - DNA, 101 bp, rice(Oryza sativa)
  misc_feature (71): n=a or c
cctgctgtctgctgcggtggtgcctgcgtggctgcgtcccttgtatcgcctctgtttgaagggagcgtatntatgcacacaggttctcgcgtgtacaccgt

SEQ ID NO: 35563 - DNA, 101 bp, rice(Oryza sativa)
  misc_feature (71): n=t or c
attcggttaggtgctctttcatttctcctgatctcattggccagcaagtcgatgatggcatcttcctcctngctgctggtatggccatcagcccagccgta

SEQ ID NO: 35564 - DNA, 101 bp, rice(Oryza sativa)
  misc_feature (71): n=t or c
gataacggtagctatggacggagatttaaaaccctgataggttctgcacagatggagctcaccgagttgtnatcgtatctacatcacaggaagagaaaaaa

SEQ ID NO: 35565 - DNA, 101 bp, rice(Oryza sativa)
  misc_feature (71): n=t or g
catccaatagtctatcgccataagtgaataatacggtatgagatgatttggcaccatcatggatacccttntaagacttaaaaatacactagggatgacat

SEQ ID NO: 35566 - DNA, 101 bp, rice(Oryza sativa)
  misc_feature (71): n=a or g
ctgccgaggtgagctacccatgcaacactgcaacgtgatctgaggctctgagttgcacaacggtccgcacnagatcccgaggggttcggagttttcttctc

SEQ ID NO: 35567 - DNA, 101 bp, rice(Oryza sativa)
  misc_feature (71): n=t or c
ttgtaggatttttttttctttagattctttttgctcattcatttttcggcttgccggtatagaggaagtantgacaaaatgagaataattgaaagtttatg

SEQ ID NO: 35568 - DNA, 101 bp, rice(Oryza sativa)
  misc_feature (71): n=t or c
tagacgtgagcggcttgcctgaagaattaatcgtcttgccgcgctggctttgattccttttccatgtctcnctattgacgcccaaggtgttgcatgcttcg

SEQ ID NO: 35569 - DNA, 101 bp, rice(Oryza sativa)
  misc_feature (71): n=a or g
ggttgtcggtacgtaatttggcatggcatcatgaagttcaataaattcttagaggtagcagaagacagctnctactgtggcgacgaagacgactattgtga

SEQ ID NO: 35570 - DNA, 101 bp, rice(Oryza sativa)
  misc_feature (71): n=a or c
ccttggtctcctccaggacgcgcacctcctccatcaggaacatggcgtcgtcgtcgctgctcttcgggcantccgcgggaagcctcctcttgtagccgtcc

SEQ ID NO: 35571 - DNA, 101 bp, rice(Oryza sativa)
  misc_feature (71): n=t or c
ttgtttgcgtgattcttttgatataagcaggctagcccttcagctggtgctttccctcagctgattggttnacaacagaatatccatgataataatgaatt

SEQ ID NO: 35572 - DNA, 101 bp, rice(Oryza sativa)
  misc_feature (71): n=a or g
atatgcctgacctggtaaatgccaggattttttttctgagatattcttcatttgtttcagctaaaaatggngctattcagtggtggtccttttttctttct

SEQ ID NO: 35573 - DNA, 101 bp, rice(Oryza sativa)
  misc_feature (71): n=a or g
tgagacacatgattgccacggctagaaaaatcgttttcccagacagctaaaaatcattttctcagacgggngaaggctcgcctgtacgcataagcctgtga

SEQ ID NO: 35574 - DNA, 101 bp, rice(Oryza sativa)
  misc_feature (71): n=a or g
taatttaatgcacgaacaaattccatacattctctagccaatcggatacttaagaagtctaagcaaatcantatttaaaatttgaccaataaggtgactgc

SEQ ID NO: 35575 - DNA, 101 bp, rice(Oryza sativa)
  misc_feature (71): n=t or c
tgcaattttcggtattgccgcactaattggagcttgtactcctccagtgataaagtcaacctttccactcnttttcttctccagttcctttctctcaactt

SEQ ID NO: 35576 - DNA, 101 bp, rice(Oryza sativa)
  misc_feature (71): n=t or c
atcatcgtctgtctccgtttttagaacaaatggtcaaccttttaaatgttgaccaataattagtcaaactngagcgtgagtttcaaaacttcaaattttgg

SEQ ID NO: 35577 - DNA, 101 bp, rice(Oryza sativa)
  misc_feature (71): n=t or c
cgctgcagaccgccgcgtggtacagccaaccccgcagcggcatgcggatcaagaaggcgtacgcccaggtngacccggctgccatgagcagccaccatgtg

SEQ ID NO: 35578 - DNA, 101 bp, rice(Oryza sativa)
  misc_feature (71): n=t or g
atgtttctggctaagagagctaaatgtgcccgatgcaatggttttatccctcaggaatctcattgatgcanctaacattgccgcgctggcagctctgtcta

SEQ ID NO: 35579 - DNA, 101 bp, rice(Oryza sativa)
  misc_feature (71): n=t or c
tctcttcaaccaatcattgaagtgtatttggagcgtcaaatcacacaatttagatgcaacagtcagagggnagctatacaaggaaaaaacaataaacagag

SEQ ID NO: 35580 - DNA, 101 bp, rice(Oryza sativa)
  misc_feature (71): n=t or g
acaagactccagttcttccatccgtgactcttcaagagacccaagcttcaaactgccatgtgaatcgatcngtctgtcaacaagcggaggcgtccatcaac

SEQ ID NO: 35581 - DNA, 101 bp, rice(Oryza sativa)
  misc_feature (71): n=a or g
gtctcccaatcgggagacaatccgttctatagtcagtacagtcctctcccaccttgcttcgtatgacagantggatgccgaagcgactgagctcagagccc

SEQ ID NO: 35582 - DNA, 101 bp, rice(Oryza sativa)
  misc_feature (71): n=t or c
ctttcgagtgaaaaaatttaagcaaatacattacaatcttgtgccctaatagtgtttcctactccggacantcttatcagcccattgcggtttcccacggg

SEQ ID NO: 35583 - DNA, 101 bp, rice(Oryza sativa)
  misc_feature (71): n=a or g
gttccttgccatgtatgtagtggtagagtgttccatttgagacaaactcatagatcagcatgggcacttcnacttcgaggcaacaaccgagcaatttgatg

SEQ ID NO: 35584 - DNA, 101 bp, rice(Oryza sativa)
  misc_feature (71): n=t or c
agaattagggcaagtgagatcacgattagttggttggatgtttgttaatttgggctgtgtcatggctgtcntggcttaaaatggatagcttccgtgggtaa

SEQ ID NO: 35585 - DNA, 101 bp, rice(Oryza sativa)
  misc_feature (71): n=t or g
catagaacttcagaatattcacttctcaacttcagtcactaaattgaatcggcagcatgtgttacctgttntgcatcataagtaactccagctcagagaca

SEQ ID NO: 35586 - DNA, 101 bp, rice(Oryza sativa)
  misc_feature (71): n=t or c
ggactgtgcctctgctctctaggagcttatgaagatgcaagctaatgggaagttgtccgagcccgcattgnctagcagctgtcattggggtgtaaaactca

SEQ ID NO: 35587 - DNA, 101 bp, rice(Oryza sativa)
  misc_feature (71): n=a or g
aaatgtttcgtttagaagagcgctagtgggagacaacttggtagcttggtatgacttaggggctaaagtgntggcttttgatctttcagaccaaaacaatg

SEQ ID NO: 35588 - DNA, 101 bp, rice(Oryza sativa)
  misc_feature (71): n=a or g
aatgttcagtgacgatgaggatttacttcggattgatgaccctatggagcttgaaatggggtttgctaacnttgttgtcgtggacaacctgcccgttgttc

SEQ ID NO: 35589 - DNA, 101 bp, rice(Oryza sativa)
  misc_feature (71): n=a or g
tcttcctggcaagctccctggtttcgtggagttgggctctggtccctgcttccagggttccaagatgtggnaccagtttttcaagggttgcagtctttgct

SEQ ID NO: 35590 - DNA, 101 bp, rice(Oryza sativa)
  misc_feature (71): n=a or g
aagtggagaaatagtagattttatctcctttggttctcacccaagatctctcaaaccacacaggcaaattncatgaaacttggcaaaaatgatggtctatg

SEQ ID NO: 35591 - DNA, 101 bp, rice(Oryza sativa)
  misc_feature (71): n=a or c
gtagtaaatgggaaggcctgtggccatgagctgtctgaaaatcgatttcgacgtacgttacctaaaacggncatatctaaaaatagggtttgagacacgga

SEQ ID NO: 35592 - DNA, 101 bp, rice(Oryza sativa)
  misc_feature (71): n=a or g
acgaactctttcctgatcttgagggcaatcaaaaagtggaaacacactgctccttacctcgacattgaacnaacccatgtggaatccggtcacgccctcct

SEQ ID NO: 35593 - DNA, 101 bp, rice(Oryza sativa)
  misc_feature (71): n=t or c
atgtgattagttaggtgcatgaggctggatgagtttggtttgtgggaaataagagttcgatgattggattnggcggatttaaccggatatagccattcaca

SEQ ID NO: 35594 - DNA, 101 bp, rice(Oryza sativa)
  misc_feature (71): n=t or c
atagttatttaaaaatataacatgtctaatgcccttgtcagtgtgcgcgcagcatcctaatcagcacccanctcagcaagattacccatgttgtaccgttt

SEQ ID NO: 35595 - DNA, 101 bp, rice(Oryza sativa)
  misc_feature (71): n=a or c
tatgcagtcatcgtctctcaagtagaatctcatggataggaggctgatagtgtgctcatttgacttcctgnatgccaatatgctcttcgttgccttaacca

SEQ ID NO: 35596 - DNA, 101 bp, rice(Oryza sativa)
  misc_feature (71): n=a or g
acaacgcattcccaaccttgcaaaactagtgtaaacgaggtccttaatagtagtgctattggttttgaccnacatgacgactatgtggatcctttgactat

SEQ ID NO: 35597 - DNA, 101 bp, rice(Oryza sativa)
  misc_feature (71): n=t or c
cacacataagtggtgatgtgatcccgtatctatcacaggtcgtaattgccacacgtcacagattgtaacangccaggtaaacatgtacttagaatgccaca

SEQ ID NO: 35598 - DNA, 101 bp, rice(Oryza sativa)
  misc_feature (71): n=t or g
attgcctttgacatggtctcgctgagaagctggaactgaccatattccagttttcccccagaaccaagatngcaaaatgtggaattttttgtctgtctcac

SEQ ID NO: 35599 - DNA, 101 bp, rice(Oryza sativa)
  misc_feature (71): n=t or c
gctactgcttgcaattggaaaaagaaacaatggttcttgtaatagatagacctattcaacaagttcacggngtcaatagcactaaagatttgagtcgcaac

SEQ ID NO: 35600 - DNA, 101 bp, rice(Oryza sativa)
  misc_feature (71): n=t or g
ccatatatataatagctactacttaattaattagcacttgacggtggaggagacgggagtgaacttgaacngcgagctccacgcgtagctgaaggtgatgt

SEQ ID NO: 35601 - DNA, 101 bp, rice(Oryza sativa)
  misc_feature (71): n=a or g
tggtagagacaattattaaaaacgttgtctgtagtgcttactctagttgagttggagatttttatagtagncaatcggctatattattgtcgttgccctta

SEQ ID NO: 35602 - DNA, 101 bp, rice(Oryza sativa)
  misc_feature (71): n=a or g
ctcttagagagtcttgtatttttaccctcgagtgtcctcttgtttaaggagaattagagagtcaagtatgnatacaattcgagtagacattgtggtgtcca

SEQ ID NO: 35603 - DNA, 101 bp, rice(Oryza sativa)
  misc_feature (71): n=t or c
aaagataaagataaagcatgtatggacttttttaaccgaaacaacaaaattggttgagcgtaaatcatggntagaactgtcattgtgtacagataatgatg

SEQ ID NO: 35604 - DNA, 101 bp, rice(Oryza sativa)
  misc_feature (71): n=t or g
tctatgacaggaatgggaaacttgtttttaacagtttgggcattgagctgtctataatcgatgcataagcnccaagacccatctttctttttgactaaaat

SEQ ID NO: 35605 - DNA, 101 bp, rice(Oryza sativa)
  misc_feature (71): n=t or c
tgattttgctactacctccaatccgtcccaaaatgtacgacaaatctagaccctccgttatgtactccctntgtcttagaatatagcaatttaagatacga

SEQ ID NO: 35606 - DNA, 101 bp, rice(Oryza sativa)
  misc_feature (71): n=a or g
acaagagggaagcatctgtgggctcgacaatttgtgccaaagaaaaagaagtcaaagaatgatgaggcaancctgattgactaagtactggagtacttatg

SEQ ID NO: 35607 - DNA, 101 bp, rice(Oryza sativa)
  misc_feature (71): n=t or c
aaatgagcctatttttgcatgcagtcctcttaaggagtctcgtgcgaaaatatatttttgcttgagggctntaaagtggtccacatgcaaaaatatctcct

SEQ ID NO: 35608 - DNA, 101 bp, rice(Oryza sativa)
  misc_feature (71): n=t or c
ataagaaacaagtttgcaaaggctggcagagaattttgttaccttcccaggaatgttgacacgttgagctnggctaccagttgctatcaatatgtgctttg

SEQ ID NO: 35609 - DNA, 101 bp, rice(Oryza sativa)
  misc_feature (71): n=t or c
catgaccaaaaggcaagtcttttcttccaaagctttaagaacagaatggggatctcttcttctccctcaanggcctttaatcccttatccaattaatttgg

SEQ ID NO: 35610 - DNA, 101 bp, rice(Oryza sativa)
  misc_feature (71): n=t or c
gtttcttctagaggagattccttcaaacttgctaggttttgttcgaaaggatggagagattcgacagtaanggaagaggtatctgttggagggggtggaga

SEQ ID NO: 35611 - DNA, 101 bp, rice(Oryza sativa)
  misc_feature (71): n=a or g
caaggttctcttcgctgcgtcaacaaagataaccgttggagacggaaacacaacacgcttttggtattccncgtggatagatgggcgcagaccaaaggacc

SEQ ID NO: 35612 - DNA, 101 bp, rice(Oryza sativa)
  misc_feature (71): n=t or c
gccacaatggaggtctcattgctcttgttggcataggatgatgtcaggttttggacatagttggcgaagancatatctatgcacgtatcatagtcaccacc

SEQ ID NO: 35613 - DNA, 101 bp, rice(Oryza sativa)
  misc_feature (71): n=a or c
aattaacttctttttagctaagtaaccgtaaagaaatcagcatccaattaatcgaagggtcaccaatctantgtaggatcgaatcataataactaagccaa

SEQ ID NO: 35614 - DNA, 101 bp, rice(Oryza sativa)
  misc_feature (71): n=a or g
taaaccagtactttcaaaaaatgaatatataccaacctgaagagatcgaatgaaggggagaagggagcacnaaggcagaaacatttcaaaagctctaagca

SEQ ID NO: 35615 - DNA, 101 bp, rice(Oryza sativa)
  misc_feature (71): n=t or c
caagatctcatctaactcggtgaaacgtctgagcatcacttgctgtagtttcaatgcgaccttgcgagtangtgtagatgtcccaagtcttgtttctctgc

SEQ ID NO: 35616 - DNA, 101 bp, rice(Oryza sativa)
  misc_feature (71): n=a or g
agctccagatccggcaccaccgacgccacctttgctcccatggccaacctcccccactatttgtacctccnccttggggaacgtcgcattcacctctggga

SEQ ID NO: 35617 - DNA, 101 bp, rice(Oryza sativa)
  misc_feature (71): n=a or g
tccttctttactttgcagacaacaaaatcttcccctcctcgcacaagcaacaggggcaaggacatagaatntgctccaggccttctaccaaatggaggtga

SEQ ID NO: 35618 - DNA, 101 bp, rice(Oryza sativa)
  misc_feature (71): n=t or c
ctcgattgcatcatgtcgttgctgctgatgctgaagaattaatcagagagctggagaagagtaacattgantgatggtggaattaattggcaattgacaca

SEQ ID NO: 35619 - DNA, 101 bp, rice(Oryza sativa)
  misc_feature (71): n=t or c
gaagtgaagttttacatgggagatggattgagtccaatgtggcttcgccatgatgagctgagcagcttggnatcactctctatcaactcctgccctaacac

SEQ ID NO: 35620 - DNA, 101 bp, rice(Oryza sativa)
  misc_feature (71): n=a or g
tgtagccagctgcagcacggcctctaaacacaaagtatgtataacatgtaggatcatgttttaatagtctngtatatttttttaggtaactattgtatgaa

SEQ ID NO: 35621 - DNA, 101 bp, rice(Oryza sativa)
  misc_feature (71): n=a or c
ggggggatatgacattatacttgggatggactggttgcagcagcatagccccatgaaaatagattggaatnaaaaatggctggagtttaattataatcagc

SEQ ID NO: 35622 - DNA, 101 bp, rice(Oryza sativa)
  misc_feature (71): n=t or c
ctattataggcagtgacacgtaaagcagtagaagagtagaattcacgtagaggattctcaaccggacgaantggcgagatgcatggcacaagctggtgaaa

SEQ ID NO: 35623 - DNA, 101 bp, rice(Oryza sativa)
  misc_feature (71): n=a or g
aagataggcctgctagagtatagaaaattcatgggatcaaaatttagctagccatactttggcgagtgtgngccgttagcatcggtcgggtgcatggctat

SEQ ID NO: 35624 - DNA, 101 bp, rice(Oryza sativa)
  misc_feature (71): n=t or c
tcgcgctgatggtttccgtttgtgagagtgatccctaacccaccatccctctgaaacctcagtaggatgcnaaggagctcttcatccctatcggcgccgtc

SEQ ID NO: 35625 - DNA, 101 bp, rice(Oryza sativa)
  misc_feature (71): n=a or c
cagtcttgcaattgaagttgcatgttactagcttgtcttcttggcacaacgcatttgcagagagtgagganatcagggcgatcatgtacgacgacaaggcc

SEQ ID NO: 35626 - DNA, 101 bp, rice(Oryza sativa)
  misc_feature (71): n=t or g
gttagcgacatgacaaatgttggtcgatcagttatgttgcagctagcaatagatgttcggagcatatcatntatacatcattggccataatagatgttcgg

SEQ ID NO: 35627 - DNA, 101 bp, rice(Oryza sativa)
  misc_feature (71): n=t or c
tcaaattgttttttacagagttccagctttgtgatgctctgtaaccgctcaagatggagatgtccaaattncacactggagaatttcagctctttgaggtt

SEQ ID NO: 35628 - DNA, 101 bp, rice(Oryza sativa)
  misc_feature (71): n=t or c
gtccgagtttccacaaaatattcgtacaaatgatttagtatcagaaatgccattgccgttaaggtttcgtncatcctacgccgttaaatgcattgtttatt

SEQ ID NO: 35629 - DNA, 101 bp, rice(Oryza sativa)
  misc_feature (71): n=a or g
ctcagatttatcttttccttccttgaattttgatgtgctagctctgaaaaaagggaattgggtagaccccnggagtctcctcaatgtgctagttctgaata

SEQ ID NO: 35630 - DNA, 101 bp, rice(Oryza sativa)
  misc_feature (71): n=a or g
gctggctcggctgcctgttgcctgttggctgtgttgctagcgagctagggtttgcataacacacatagttnggctgggttgggctctttgggctgattctg

SEQ ID NO: 35631 - DNA, 101 bp, rice(Oryza sativa)
  misc_feature (71): n=a or c
gaattcgaccgataagataattagaggacagaattagtgctagaaggtttggagacccaatatctatgggnaaaggccctgacaacaagtttatggagata

SEQ ID NO: 35632 - DNA, 101 bp, rice(Oryza sativa)
  misc_feature (71): n=a or g
gcgtacaaatggtccatacttcatagaattacagaaggtcagaagctctccttttcttatagggctgtcanctctctgcctagactcaagcttgagctaag

SEQ ID NO: 35633 - DNA, 101 bp, rice(Oryza sativa)
  misc_feature (71): n=t or c
ctagtagcaatagataaaagtatggatgttgaacccgattcatggcgctgtgtagtgtatatgagcaaaanttgcaaattattaatacgaatgggcatgaa

SEQ ID NO: 35634 - DNA, 101 bp, rice(Oryza sativa)
  misc_feature (71): n=a or c
atatgattattagtggtgagttaattagtaaacatcatccatgaatgcagcggtggccctgaacacgatcntgaggagatggggcaaggaggcatcatcgg

SEQ ID NO: 35635 - DNA, 101 bp, rice(Oryza sativa)
  misc_feature (71): n=a or g
aactgaccatcgtagtctggtctacttaggggagcaacaacttaccacctctattcaacacaaagcttttnttaagctgatgggattacagtacaaaatcc

SEQ ID NO: 35636 - DNA, 101 bp, rice(Oryza sativa)
  misc_feature (71): n=a or g
tcacatcagaattctgtaggggactattgtttgtctcagagcttcagaaactcaaccgaagctgacaaaantgctggtaagggcctaattgactgggaaat

SEQ ID NO: 35637 - DNA, 101 bp, rice(Oryza sativa)
  misc_feature (71): n=t or c
tttcttgtactatttgcatggacgcctgcaaagctgtcgacacgatggttaattattgaaacgaacagatnaattacttaactaagcagtgtaattaatta

SEQ ID NO: 35638 - DNA, 101 bp, rice(Oryza sativa)
  misc_feature (71): n=t or c
aggtcatcctcccattcgcgctagctccagaaatactttactgctccccttaaaaaatattccctccgtcncataatataagggattttgagtttttggtt

SEQ ID NO: 35639 - DNA, 101 bp, rice(Oryza sativa)
  misc_feature (71): n=a or g
taatttatttgtgtttgacatcatgcatgtacaccccggccgcgagcaggaatgcatttttttagcacgtnctaatagagacttacttatataggatagtg

SEQ ID NO: 35640 - DNA, 101 bp, rice(Oryza sativa)
  misc_feature (71): n=a or c
attcagctgcatgttgtacaggaattgatggatgtcttgcaagtcactttgttgtctgatcatgaagcatntgaattccaggaaaacgatacacttatggc

SEQ ID NO: 35641 - DNA, 101 bp, rice(Oryza sativa)
  misc_feature (71): n=t or c
gaaatgtaattgcctgttgctcttgagtcatcatctgatcatattcaattctttattgatatttccgcaanagaagcaatatttgtttttttttttgcccg

SEQ ID NO: 35642 - DNA, 101 bp, rice(Oryza sativa)
  misc_feature (71): n=a or g
attttcctagcactattgttgagtggatccccaccagatacgagctttcaattgtccagttagttgacatnataagatgcaagctcatggagatgatgtac

SEQ ID NO: 35643 - DNA, 101 bp, rice(Oryza sativa)
  misc_feature (71): n=t or c
atttggaagagtggcaaacatgattagtgcctctgccaacttcaagaatcagatttaacaccgctaaatantttgcatcaaacatacgcagctggaccact

SEQ ID NO: 35644 - DNA, 101 bp, rice(Oryza sativa)
  misc_feature (71): n=t or c
ctgtgacttgcaaagatgaatgttgtcaaggaacaagctctatgggaagaagctgaagagctcgtatgcanttccaagaagatcttcgattccactaatct

SEQ ID NO: 35645 - DNA, 101 bp, rice(Oryza sativa)
  misc_feature (71): n=t or c
agtgggtaacatgtgggtcctaccacatgatattcaaacttgagccttagatgatgaatataaagtgcacnttttcctaacctagattgacttaaagccca

SEQ ID NO: 35646 - DNA, 101 bp, rice(Oryza sativa)
  misc_feature (71): n=a or g
cctaggacaagccaacaggttcggtgacctcgacttcatctccgactacttcagtaagatcgctctcctcnagtcagattcgaaccaattagggagaaact

SEQ ID NO: 35647 - DNA, 101 bp, rice(Oryza sativa)
  misc_feature (71): n=t or c
gaagaaaaggaactgataagtcaaaggaactgataagtcatcgccccctacaagcccaaacaggcaaaggngtacgatgtgggtcggagtgacatggtcgt

SEQ ID NO: 35648 - DNA, 101 bp, rice(Oryza sativa)
  misc_feature (71): n=a or g
ttgttggatgtgcatcctatggtagataaaatctacatgattggaccttcagaaatcattcgattcctatntagacagccccaattaaaaaacggttcggt

SEQ ID NO: 35649 - DNA, 101 bp, rice(Oryza sativa)
  misc_feature (71): n=t or g
atacctagccctatcatccatccatccagccagccaaacagtagcaacatgagtacttcagctcgccgccncctcctcctcgccggcgccgctgccgccat

SEQ ID NO: 35650 - DNA, 101 bp, rice(Oryza sativa)
  misc_feature (71): n=t or c
tataatactaattggcttcattaaattcaatgttggatactttgtctgtttcatacgtaagtcattctaanatttcccacattcatatatatgtatatata

SEQ ID NO: 35651 - DNA, 101 bp, rice(Oryza sativa)
  misc_feature (71): n=t or c
gatatagagtgtagctgtggagaatcataaactcatttccatatctttagcgttttgttggagcgctgcanccagtttcactcctattttagttggagttg

SEQ ID NO: 35652 - DNA, 101 bp, rice(Oryza sativa)
  misc_feature (71): n=t or c
gcatgtagcaagtcttttagtgcattgaccatggagctatctacaggtaagttgtttcgacattacagtangtcgttaatagttaagctaatcataataag

SEQ ID NO: 35653 - DNA, 101 bp, rice(Oryza sativa)
  misc_feature (71): n=t or c
catgttttttcctctccagcttgctacccttctggaaattttgtcaaagacaggttgcaagtccaccttcngcagtcttcccagagctagggggaggccca

SEQ ID NO: 35654 - DNA, 101 bp, rice(Oryza sativa)
  misc_feature (71): n=t or c
aatatagcataggaaatatttcgttctggtcaaatcctgtagttgtagttcttaaacacaagttacgtcangagtacagccatatcaaccacccatatcaa

SEQ ID NO: 35655 - DNA, 101 bp, rice(Oryza sativa)
  misc_feature (71): n=a or g
aaccatgcgccgttattttgcaccatgggatctaagatgtgttgtctaggtcaagccgctcttccccactntgtttttttttttgaaaaaatgtccttctc

SEQ ID NO: 35656 - DNA, 101 bp, rice(Oryza sativa)
  misc_feature (71): n=a or g
gaagctcactcagatgatggctgtgccactccaatgttcaaaactggatcaggaaggtctatcacagcaantgaaaattctagaaagaaagcccacgttgt

SEQ ID NO: 35657 - DNA, 101 bp, rice(Oryza sativa)
  misc_feature (71): n=t or c
attttcattccgagatacatacgagggccaacagcccaatattaaccaaataaaaaggaggtgtcactgangtggtgataaagttgtatgtaggtgattat

SEQ ID NO: 35658 - DNA, 101 bp, rice(Oryza sativa)
  misc_feature (71): n=a or c
tattactgctatccagtgtagtttcacgtgatttccccggtcatctcatgcaccatagaacaacagcagtntgatgataatcctgaaatattacaaggggt

SEQ ID NO: 35659 - DNA, 101 bp, rice(Oryza sativa)
  misc_feature (71): n=t or c
gcaggctggagctcgagaacgtctcctcgagggatatctcgatcttgctgctgctcccgatgttgttcctnacgatctgcatcagctccttggcgacgccg

SEQ ID NO: 35660 - DNA, 101 bp, rice(Oryza sativa)
  misc_feature (71): n=t or c
aggaatgtgaccgtacgagtactttgagattcatgctggacaacaaaacccaaagagagttgctacaaaanaggatcccgttgcaacgggatagacatatt

SEQ ID NO: 35661 - DNA, 101 bp, rice(Oryza sativa)
  misc_feature (71): n=t or c
ttggcgtagaacgcgacgagcgagttgcaggtgtagacgtcgtgctccaggccaagcttgatcaccatgcngtgcgccgcgcggccctcgtcgagaccccc

SEQ ID NO: 35662 - DNA, 101 bp, rice(Oryza sativa)
  misc_feature (71): n=a or g
tgagcaaagacttagagcagtacaaagacataaccctctacaaaggcggaagagtggcaagaggagtattntttacggctgcactgctttccttgtggtaa

SEQ ID NO: 35663 - DNA, 101 bp, rice(Oryza sativa)
  misc_feature (71): n=t or c
agatcgccagccttccattgatgctgccgctcctcctccggcacctcaagtatgaccagaataccaagccngacccaaacctcacctgcatcgcggtggcg

SEQ ID NO: 35664 - DNA, 101 bp, rice(Oryza sativa)
  misc_feature (71): n=t or c
gtgacacttggcgagaagtaagttgacgagtttgaggtcgtttgattcatcgaattcaggcggctcgtctngatggccattacgggaatttttcatagggc

SEQ ID NO: 35665 - DNA, 101 bp, rice(Oryza sativa)
  misc_feature (71): n=t or c
gagtgacatgcaattaacgaggggatatcgcacgagatataatctagaaagaggtgacttacgttgcctcngcatccatcgcagcgaacgtcgtcctgcac

SEQ ID NO: 35666 - DNA, 101 bp, rice(Oryza sativa)
  misc_feature (71): n=t or c
tctctagctaatcagtatagacagtagtgagaacagttcagagaggaagcatgtgacacttccctctgtcnctctctctctctctagcctccaaccatcgc

SEQ ID NO: 35667 - DNA, 101 bp, rice(Oryza sativa)
  misc_feature (71): n=a or g
catgccggcggggtctctatcctctacctgccggaacatccttgaaacaagcctttgctgtggcgccatcntttgaacagtggcatagtcgccttggtcat

SEQ ID NO: 35668 - DNA, 101 bp, rice(Oryza sativa)
  misc_feature (71): n=t or c
gccatcttcccttcctccatcctgctcgccttaatgtcggacaaaaacaccttgcccatggcgcaaccgcngccgcccccgccgccgccgccggagttcag

SEQ ID NO: 35669 - DNA, 101 bp, rice(Oryza sativa)
  misc_feature (71): n=t or c
tatcatgtaactatagatttaagatagagttataggaaaactacagacattttaagtagcaaatttatccnaaaactacaaatttagtggcaatttaatca

SEQ ID NO: 35670 - DNA, 101 bp, rice(Oryza sativa)
  misc_feature (71): n=t or g
aaatgaagaattgatgacaagtttgttttccttggggctttggtccataaatcagtactctcaattgagcntgtccgcagtttattgatgacaagtttatt

SEQ ID NO: 35671 - DNA, 101 bp, rice(Oryza sativa)
  misc_feature (71): n=a or g
ggcaaatggtgacaaagtgtggctagaacaaaactgacccagtgtcttggataaactgaaacccaaccaancagctcagatcgattcaaccaaaacttgag

SEQ ID NO: 35672 - DNA, 101 bp, rice(Oryza sativa)
  misc_feature (71): n=t or c
ctttgtaaaatttctatcttccaaccgtcctatgggtgtcttaaaaaatagagcaattttcacaaaacccnatatcttagggcatccgtaacgcacaaccc

SEQ ID NO: 35673 - DNA, 101 bp, rice(Oryza sativa)
  misc_feature (71): n=t or g
cgtcacgcatctcagaaccagacccggtatccatctccatgatagggattcccttcgttttcttggccatnctgggggctcgatattctgggcgatcaagg

SEQ ID NO: 35674 - DNA, 101 bp, rice(Oryza sativa)
  misc_feature (71): n=t or c
accggcggttttgtgaaccctggtcagcagtcagcactcagcatgatcagcacgcaaaagctgaacagaanataatactacctccgtcccaaaataagtgc

SEQ ID NO: 35675 - DNA, 101 bp, rice(Oryza sativa)
  misc_feature (71): n=a or g
aagatctacatataaatcatcatctgtctactatgtgttgtgatagtttgaatggtttgttcaagtccgcncaccatcttcaaaggctctttctttcagac

SEQ ID NO: 35676 - DNA, 101 bp, rice(Oryza sativa)
  misc_feature (71): n=t or c
tttggttaacttttaccaaatacccttgttttggtttaacttttaccaaataccaggaaaaagtaggtggngaaggttttgtagtaataaatctaatccct

SEQ ID NO: 35677 - DNA, 101 bp, rice(Oryza sativa)
  misc_feature (71): n=t or c
atatatggaaaacagctcaaccgtcattatttccagtttgtagattgttgaatcagtgctacttcccacantcgtgaaatcaaatctcgatttatcatcat

SEQ ID NO: 35678 - DNA, 101 bp, rice(Oryza sativa)
  misc_feature (71): n=a or g
ccattaacacatgctctaataaaaaaaatcagcagcacattcctgaactttagatggccttatggcccgcngcctagcccatggcacgccgctttggtacg

SEQ ID NO: 35679 - DNA, 101 bp, rice(Oryza sativa)
  misc_feature (71): n=t or c
ggcttataagttggcttataagcctaaacaaaaagggcctaataagaagagccaggtatttttttataganggcctaggtggcactggcaaaacgtttctg

SEQ ID NO: 35680 - DNA, 101 bp, rice(Oryza sativa)
  misc_feature (71): n=a or c
ttgttccatactagtttgctaggtcatggaaaagagcgagattttcgtaggagcacactcatatgcagctntatgtgcttttacactcatcataggatggt

SEQ ID NO: 35681 - DNA, 101 bp, rice(Oryza sativa)
  misc_feature (71): n=a or g
aatataaatatttttagattagtacgatactaataaagtagatggaaatgtttgataaatgttgtgattgnttgataaaagatagtatgtgaaaaaatgag

SEQ ID NO: 35682 - DNA, 101 bp, rice(Oryza sativa)
  misc_feature (71): n=t or g
gaccagctcccctcgaacatgtcataactgatcccaacgctcgtgctggtggcgctgccgctgccgcattnctcgctggaccaatctgccgctgcggtggt

SEQ ID NO: 35683 - DNA, 101 bp, rice(Oryza sativa)
  misc_feature (71): n=t or c
attcactaatactaagcttgccactaaaatttcattatttttccccatcggcctataatttcatgaagccntcggtcgaaattcatgagtattaacccttt

SEQ ID NO: 35684 - DNA, 101 bp, rice(Oryza sativa)
  misc_feature (71): n=t or c
agtccatccttgaaagaaggtgtaagaagaaagtagtggattgaaagtagtccaaccgggactaaagtccnggttatttcacccgggggtatctttagtcc

SEQ ID NO: 35685 - DNA, 101 bp, rice(Oryza sativa)
  misc_feature (71): n=t or c
tttaacaaatagcttagagaaaagttatctaagggctttggtttgaagaaaaacaagggatttgaatttcnaagaattaattcctgccagtgtcatttggt

SEQ ID NO: 35686 - DNA, 101 bp, rice(Oryza sativa)
  misc_feature (71): n=t or c
aattcatctcaaaatatagcggcttgcttgtcttaatccaattatataattatttcttattgaatttcttnatatattttcgcatctgaactagctagtaa

SEQ ID NO: 35687 - DNA, 101 bp, rice(Oryza sativa)
  misc_feature (71): n=t or g
gtgtgggccacctgtgtctgtgatggagcacatcatgggcccctgtcgcagtgatctctgctgaatactgntgcagtgagaggtacgtacgtgcatgctca

SEQ ID NO: 35688 - DNA, 101 bp, rice(Oryza sativa)
  misc_feature (71): n=t or c
gaaatatgacaatgtagctattctcgtgaagctaagtatccccaccagtgacaagggtaccagaatcaaantacagttttgcattcatgtcatatagttcc

SEQ ID NO: 35689 - DNA, 101 bp, rice(Oryza sativa)
  misc_feature (71): n=a or g
cggtgcatcaggtaagaacgttgctggcccaaagagctatgataataactcggagatccatggtgagaacnggaatcatgggataaacccaggctggcaga

SEQ ID NO: 35690 - DNA, 101 bp, rice(Oryza sativa)
  misc_feature (71): n=a or g
cccgaagaccgtcctccaggtgccggccagggtgaccaccgtcttcgagttgacaataacataaaagatcnccccaaaaagctcagcggtcggctcgaaac

SEQ ID NO: 35691 - DNA, 101 bp, rice(Oryza sativa)
  misc_feature (71): n=a or g
cacaccccaaaactctctatgttcatccttcactctgattctattgtttctgctcatgagctgcgcctctntttccccagttctaagcatctgcatgcatg

SEQ ID NO: 35692 - DNA, 101 bp, rice(Oryza sativa)
  misc_feature (71): n=a or g
taataagtatttggggcagtaaacttttcttttttggaagatgtaatttctgttttcgatgggcgaatgtntgcgtgatctcaccagcaagtccccgcctt

SEQ ID NO: 35693 - DNA, 101 bp, rice(Oryza sativa)
  misc_feature (71): n=a or g
cttctctttgaacaacacttgccttgcagcctcttcctataatatttccttactttacaaaaagatggtgnacaaatgaaaatactccttaatattttttt

SEQ ID NO: 35694 - DNA, 101 bp, rice(Oryza sativa)
  misc_feature (71): n=a or g
tgcagctacctaggtaggtaccattaatttaggagtaggttatcatgctgcctttttgtaatggttgtagncaagtgcttggctcaaatgttcaacagatc

SEQ ID NO: 35695 - DNA, 101 bp, rice(Oryza sativa)
  misc_feature (71): n=t or c
cctagacgatgaagatggatcgctatcgttaggtgtgcgatctcaatatcgtatgtcatggacttgatctngccttggagctggagatcgtgaaccgcttc

SEQ ID NO: 35696 - DNA, 101 bp, rice(Oryza sativa)
  misc_feature (71): n=a or g
aaatatgtttgtcaaaattatgacaagtttctacattatattcaaataattggagatgttttgctgaaacncaccaaggttcaaatctcagtaccataaat

SEQ ID NO: 35697 - DNA, 101 bp, rice(Oryza sativa)
  misc_feature (71): n=a or g
taagtccaatgtcaactctttattttggatccatacatgcagtttttcacattaactagaaaggtagcccncgcacatgcgcgtgcacctaatttaatatg

SEQ ID NO: 35698 - DNA, 101 bp, rice(Oryza sativa)
  misc_feature (71): n=t or c
caaacaagagctagctaattttgcactactggtaggatagagtcatagagaaccaaacgagtctaaaagantcgagtaaaaattggtcaatgataatccca

SEQ ID NO: 35699 - DNA, 101 bp, rice(Oryza sativa)
  misc_feature (71): n=t or g
aagtgtgaggggacttgttgggttctgcagggcatattgtatttttggctaggccgtatctgtaaatttgnactgattctaatcacctttagttttatatt

SEQ ID NO: 35700 - DNA, 101 bp, rice(Oryza sativa)
  misc_feature (71): n=a or g
acctcgcgatgctgatttggttccttcgattcgcagatcagaaagtgaggcgatcgatccatggcttccancggcggcggcggcctgcgtcacagcaacag

SEQ ID NO: 35701 - DNA, 101 bp, rice(Oryza sativa)
  misc_feature (71): n=a or g
catctgttcaagcaaatttactaaatcatcaccaccctggccttttccccatggatgagtcggaattttgnactaaattccctgcccaacccttggaagtc

SEQ ID NO: 35702 - DNA, 101 bp, rice(Oryza sativa)
  misc_feature (71): n=t or c
atatcccattcaaaaatcgatgcttccaatatatgctcacgttatcgatattaatttggtagggtgtcgtngacgtgatcaattctggagagacaaggggt

SEQ ID NO: 35703 - DNA, 101 bp, rice(Oryza sativa)
  misc_feature (71): n=a or c
tcttgttatgttctcctccttcttgaacatgaacatgatatcagtaagacacttctctcttgtcatagagntacagctgagagatcttttctcgctccata

SEQ ID NO: 35704 - DNA, 101 bp, rice(Oryza sativa)
  misc_feature (71): n=a or g
ataatagacgcccagggtagcaacaaaatgggccgatgagcagcaactatatatgtaccaacaaagtgcanggcaaattcagctgcaagaaggaccaatgg

SEQ ID NO: 35705 - DNA, 101 bp, rice(Oryza sativa)
  misc_feature (71): n=a or g
tgctgtcgtcgccgaagtattgcttccctttgctgcactcgacgaatgcctcctctaaatacagcagagcngttgtcatttcgtcggacgcttcgtccttg

SEQ ID NO: 35706 - DNA, 101 bp, rice(Oryza sativa)
  misc_feature (71): n=t or g
tccaatcctctccattatccgtgacccatcgcttgcgcaaattgctgatggccatactgtaagtatgcaangatcttcaagcttatttcaaataggctatt

SEQ ID NO: 35707 - DNA, 101 bp, rice(Oryza sativa)
  misc_feature (71): n=t or c
tacacaaacaaatgttcagaaaattcagcaacacgcatatcaaactaagctgctatgcttacctggggtgntgggcctgataagaacaatgcacagtgtct

SEQ ID NO: 35708 - DNA, 101 bp, rice(Oryza sativa)
  misc_feature (71): n=a or g
tgactttattttggaatgacagtaggagttgtggcatggagttgacttgattattgcgttgattcttgcanaagattgtcgatcgctctagtgccaagaga

SEQ ID NO: 35709 - DNA, 101 bp, rice(Oryza sativa)
  misc_feature (71): n=t or c
cgaattatctaagtactagtactatctcagactatctctgtcctagaaagactgcagtttaacatttgacngtccgtattatttgaaaaaaaattataatt

SEQ ID NO: 35710 - DNA, 101 bp, rice(Oryza sativa)
  misc_feature (71): n=t or g
acatttagggaaggagggagtatataaaataattaggcttctgctgaatcctcattaccttgatagttttnttttatttaactttcttcaaatataatgga

SEQ ID NO: 35711 - DNA, 101 bp, rice(Oryza sativa)
  misc_feature (71): n=t or c
ggaatcttgggcttctcttgaatcttggatgcttcagctcttgcataatcatcttccacaccatttgccangctcgaattggtggtggcgccacgtttatt

SEQ ID NO: 35712 - DNA, 101 bp, rice(Oryza sativa)
  misc_feature (71): n=t or c
cttatggttcacatttcacaatctttcaatcaagtaaacaaacggttgacatggcagggtttaagaccagntattcccaaggccacagatcctaaactcgc

SEQ ID NO: 35713 - DNA, 101 bp, rice(Oryza sativa)
  misc_feature (71): n=a or g
gtactatcattagtaaaaggagaaatccaaatatcccctatatacaagtcactagtcttttcaatgttgcncgtgcgccttacaaattaatttcgtacaaa

SEQ ID NO: 35714 - DNA, 101 bp, rice(Oryza sativa)
  misc_feature (71): n=t or g
agacagatatttcaaaacttcaagaagataacaactgactttggattacagacaccattgcttcaggaaanaaaggttcacagtattggtaaactggaaag

SEQ ID NO: 35715 - DNA, 101 bp, rice(Oryza sativa)
  misc_feature (71): n=a or g
tatgtaaattacactaagtgtgttcttgagcctgtcgaaatcatagtaaatgaacagagatagagaggacnaagaagaggaggtaatatatgaatgcacca

SEQ ID NO: 35716 - DNA, 101 bp, rice(Oryza sativa)
  misc_feature (71): n=t or g
ttgagctgaactatttcagggatctatcctttaacaacctgagtggtccagcaccagtttttagcgcgaanagtgtattgtaagtgatttagaatgagttt

SEQ ID NO: 35717 - DNA, 101 bp, rice(Oryza sativa)
  misc_feature (71): n=a or g
agaaataacatctgtgtgagagtcagttatccttatacaacttggttgtcttgcctttccattgcccttcncttttcctccagctctgaaaccaaagctgc

SEQ ID NO: 35718 - DNA, 101 bp, rice(Oryza sativa)
  misc_feature (71): n=t or c
gtagcgtcttcatcggtggaactgaatcagtcagcatcagctactgatgaggaaaatgtctcacagaaaanagtagtaacaatcacaaatgaaaaaagtac

SEQ ID NO: 35719 - DNA, 101 bp, rice(Oryza sativa)
  misc_feature (71): n=a or g
tcaattagtggattagtcgtcgtactactactaattaatttggtttggctgctcacatgacccaatatatntgcatatatatgcatcatggtcccatgtgg

SEQ ID NO: 35720 - DNA, 101 bp, rice(Oryza sativa)
  misc_feature (71): n=t or c
agttagtatcattatttatgaacatggaactcctattcccgtttaagctgctcgcgtagtacaagccctgntaattcatgttattttatgagatcactgaa

SEQ ID NO: 35721 - DNA, 101 bp, rice(Oryza sativa)
  misc_feature (71): n=a or g
caggctgggtggcttcttctccgccatctccagcagccatagcagcagtaatccagcaacaacgacgcccnccctgcgatgccgcaccaaaccaaagccac

SEQ ID NO: 35722 - DNA, 101 bp, rice(Oryza sativa)
  misc_feature (71): n=t or c
ggtagtctcaatgaaacgatatgcattcttcaataggattggtgcgtagatgagttggtaaaagagagcangcgtgaaggataggtcatgggttcgaatcc

SEQ ID NO: 35723 - DNA, 101 bp, rice(Oryza sativa)
  misc_feature (71): n=t or c
tgcattcgatgcgactcaatgtgtgtgttttgtgcgatctattcagtataggcatgctgtgccacgtaggngcgccatgtcagcgagctccaaatccagga

SEQ ID NO: 35724 - DNA, 101 bp, rice(Oryza sativa)
  misc_feature (71): n=a or c
tccttgttaacgtccttaaaactagcaactttcattctttcagcaattaacctcttgacatgagaaacaanctcaacattgggtgcttgcagctcctcccc

SEQ ID NO: 35725 - DNA, 101 bp, rice(Oryza sativa)
  misc_feature (71): n=a or g
taattaaggccggtctcctttggacctactccttgtttttctatgaattctactatgcattcgacatcgcnatgttgctgtccagtttttatggcacaggg

SEQ ID NO: 35726 - DNA, 101 bp, rice(Oryza sativa)
  misc_feature (71): n=t or c
catgaaaaaacaaaaagatttgaagcattatcagtagtatgcgatgcaagactgtactgcctctgtagaanctatttattgtattgttcagacttcagagt

SEQ ID NO: 35727 - DNA, 101 bp, rice(Oryza sativa)
  misc_feature (71): n=a or g
tcttcattaaacaagattgcatctttgggagctttggatccaattgatgtggacagccatttctcggtgcncatgcagttgaaaagctcaacaggcattgg

SEQ ID NO: 35728 - DNA, 101 bp, rice(Oryza sativa)
  misc_feature (71): n=a or g
cagtttcaggtttcagctagaataatttcaggattatctcaccagcgcaataccatcaaactctctatcanccactcgatcagcctcattgtgcacatgat

SEQ ID NO: 35729 - DNA, 101 bp, rice(Oryza sativa)
  misc_feature (71): n=a or c
accaaagaatcactcggatcttcacgaacacattcacatcttccgctaagttggcagcaccgtttgacacnaaaatatactccatctgtccctaaatattt

SEQ ID NO: 35730 - DNA, 101 bp, rice(Oryza sativa)
  misc_feature (71): n=t or c
ttatttgttgggtcagtgagacaccgacctaatttatggtgaacaaaattggttaagttttcatttttcangtagcgttgaaagtttacgtccactttaat

SEQ ID NO: 35731 - DNA, 101 bp, rice(Oryza sativa)
  misc_feature (71): n=a or g
tatcggtccaaatttaagaaccgaccgtatattttactcaattgattatatatcgcgcacgtgcacctccntacattttttgcaatgttgtatttcttata

SEQ ID NO: 35732 - DNA, 101 bp, rice(Oryza sativa)
  misc_feature (71): n=t or g
cctgttgtgaatttaattttacaggtgaaaattcttgatcaatgtgagccattttcgctgttactcccaancctgaaggtgactgaaacttgacaagaaag

SEQ ID NO: 35733 - DNA, 101 bp, rice(Oryza sativa)
  misc_feature (71): n=a or c
atttattccatacagtttttagctggcagggctaatccagttactggtactgggagaaaagacgatgttgnaattctacgaggtgaccgatcgaatttcat

SEQ ID NO: 35734 - DNA, 101 bp, rice(Oryza sativa)
  misc_feature (71): n=t or g
atacaaaaacgatgagatgtaccctggaggagagtttcctaatcagaacccacgaattaatgaaggtttancaacatgggtaaaacaggatagatccctag

SEQ ID NO: 35735 - DNA, 101 bp, rice(Oryza sativa)
  misc_feature (71): n=a or g
tatgcaatatttttcatgttcttggatagccttcaatctcagggtttgatgaatgtgcttgtggatggggnagctgctgatggggaacacgctcaatgcat

SEQ ID NO: 35736 - DNA, 101 bp, rice(Oryza sativa)
  misc_feature (71): n=t or c
ttgatcctctcgcacgccacgtaggatcaaaactaccgcgcacgtaggattaaaaccaccatggattgagncgggggggttatttgtccagtttgcatagt

SEQ ID NO: 35737 - DNA, 101 bp, rice(Oryza sativa)
  misc_feature (71): n=t or c
ttggcaaatgaaaaatgggtcgatcacatcaggcatgatctgaacttgacattggttcaggaattctttgnggtctaccagcttgtttggagcagcgaact

SEQ ID NO: 35738 - DNA, 101 bp, rice(Oryza sativa)
  misc_feature (71): n=a or c
ctacacaaaataaaaagaactcactaaccgtcggggccagggttacacgccccgacggtaagcacggtaancatggtaaccgtggcaaactgtacgaaacc

SEQ ID NO: 35739 - DNA, 101 bp, rice(Oryza sativa)
  misc_feature (71): n=a or g
cattatgattagtagatccattaccatggcaactgatttatcgaacgatccgcttagaagaacttcaggcnattgtcggctccaagcaacagattgaacct

SEQ ID NO: 35740 - DNA, 101 bp, rice(Oryza sativa)
  misc_feature (71): n=a or g
tgaacccattgaagcatcttccattggctcgatggtaggaattgaggataaaggaagggcaattgcatcancagaacacggctccaacattgagatttcga

SEQ ID NO: 35741 - DNA, 101 bp, rice(Oryza sativa)
  misc_feature (71): n=t or c
tttagattgttttttgcagatagatctcttaagaaacccgtatgtaaaaatattgcactgaccagccacangttgtgtctgtctcctttaattaattattc

SEQ ID NO: 35742 - DNA, 101 bp, rice(Oryza sativa)
  misc_feature (71): n=t or c
cgggagtggtgtctctcaagaagaaggaattcaggtcactcacacaaggttcccgcactgtcaccgagtanctgcacgagttcaatcgtctggctcgttat

SEQ ID NO: 35743 - DNA, 101 bp, rice(Oryza sativa)
  misc_feature (71): n=a or g
agagtggcatataagggattctatctttggggaattcattccttccttccttcttgtcgtctgtagatctngacacggacgccaatcctcggcccacgggc

SEQ ID NO: 35744 - DNA, 101 bp, rice(Oryza sativa)
  misc_feature (71): n=t or g
atacacacatacatctgcatgatcctggcaaatataaaaacgtaagtacgtggcctcatggaaaggaacanagccacacggaataacataatgaggagcat

SEQ ID NO: 35745 - DNA, 101 bp, rice(Oryza sativa)
  misc_feature (71): n=t or c
gagttattattcgtccaataataattttctttcttggtacatactgaaaataatgtgttaatatgcgagtngtccttttaatatcttaaaagaattccaat

SEQ ID NO: 35746 - DNA, 101 bp, rice(Oryza sativa)
  misc_feature (71): n=a or c
agggagtaagcggtaaaactaaacaataccatgcatgaatccagtgggttcctgatgactccagagtgtgnttgcctttttttcatgttagtcctataata

SEQ ID NO: 35747 - DNA, 101 bp, rice(Oryza sativa)
  misc_feature (71): n=t or c
aaagcagtagtgtaagcagagcgcccgtaaacatatcctcacttttggttcatctcatatttttgtaaganggaggaaacatgagtgaaattagagcaccc

SEQ ID NO: 35748 - DNA, 101 bp, rice(Oryza sativa)
  misc_feature (71): n=a or g
tttgatcttctcaagtctcgtgcaagcaacgatgaaattttctcctcagttttgacagtatccttgccgtncatcagggtagtcaccacatgttcatatga

SEQ ID NO: 35749 - DNA, 101 bp, rice(Oryza sativa)
  misc_feature (71): n=t or c
gactaaccagctgtaatcacgaacatcgatcacgactagataatgaacgtacgtcgacaaggaactttttncaaggcgagtgatgcatatgtatgacatgt

SEQ ID NO: 35750 - DNA, 101 bp, rice(Oryza sativa)
  misc_feature (71): n=t or g
tcgtgcatatacaataggccagacgcgacacctttgatgatgtagatcctctgagcccaatcgaggatcgncttctcgtcgcacccgtgcaggtacttgtc

SEQ ID NO: 35751 - DNA, 101 bp, rice(Oryza sativa)
  misc_feature (71): n=t or c
aaaatgaagcttaaagcttcaagttgctcttcagaagtgcccaggagaggctgttacgcagaattttttantttattttgttttacaaatatagaatcata

SEQ ID NO: 35752 - DNA, 101 bp, rice(Oryza sativa)
  misc_feature (71): n=a or g
gtctgaaccctagctggctcatttggcccccgaccttctcctggagttggatcccctttagtatttctctngagttggcccatttaaatatgatcttattg

SEQ ID NO: 35753 - DNA, 101 bp, rice(Oryza sativa)
  misc_feature (71): n=a or g
attagtgccattggcgcttgccaggaagttagcatggtagcttctccagtgataggatttgggttcctccngtccacagatgacatcaagcttgtaccttg

SEQ ID NO: 35754 - DNA, 101 bp, rice(Oryza sativa)
  misc_feature (71): n=t or c
tactccaatatgcgtatggcttgacacattgagagcagcgctgatagtgcacatagtgaactagtgaagcngcagcagccactactagaaaaaaggttttc

SEQ ID NO: 35755 - DNA, 101 bp, rice(Oryza sativa)
  misc_feature (71): n=t or c
tcgcggagggaaggcgaggtgcgcggacttgagctgccagatggcaacaagtgcatacccattgggtttcnttgccccatactcacacccatgatggttaa

SEQ ID NO: 35756 - DNA, 101 bp, rice(Oryza sativa)
  misc_feature (71): n=a or g
cgtctttggacatggcagagtgttagtacacgatgcacaacgccacaagctatatatctacagagtacagngactactgttagctgtagctagagtactgc

SEQ ID NO: 35757 - DNA, 101 bp, rice(Oryza sativa)
  misc_feature (71): n=t or c
aggatgccaaagggagtccaaagaaaaaggaacctgctaaggatgcagatagcaaaggaaggattgtcagnaagactcaatctgccccccagttgttaaaa

SEQ ID NO: 35758 - DNA, 101 bp, rice(Oryza sativa)
  misc_feature (71): n=t or c
gaataggcaatagattcacctgagtgagttgaagcagcatttgggacaatgttcctgtgctttgaagtcgngttcttgttattgacattgtaaagcgatat

SEQ ID NO: 35759 - DNA, 101 bp, rice(Oryza sativa)
  misc_feature (71): n=t or c
tggcgatgggacctgcccttcttgaacaagttcaccatcttcctcgcgaacccttgggtgcaccccaggtnagcttgctgagagccctgctcgatgtgcac

SEQ ID NO: 35760 - DNA, 101 bp, rice(Oryza sativa)
  misc_feature (71): n=a or c
tgtggtagaaaatatgttctgacagactcattagtgttaatttggtctgcttgttaagttcattcccaacntgccaaatgcaacagtttattctccaaatg

SEQ ID NO: 35761 - DNA, 101 bp, rice(Oryza sativa)
  misc_feature (71): n=a or g
tataggccgccccatttgagatggattattgaccaaattatcatacaggtccatccctcttcttttctgcntaagatttagattttatctcgatttccatt

SEQ ID NO: 35762 - DNA, 101 bp, rice(Oryza sativa)
  misc_feature (71): n=a or g
cactcccgttagcaatatcgtaactttttggcacacttttcccatatatcaaacccgagaattacaatggncaacaccatgaggccggagggagggggttg

SEQ ID NO: 35763 - DNA, 101 bp, rice(Oryza sativa)
  misc_feature (71): n=a or g
gttagataaaattcaagtgaagacaagtaccgaaaagaacagtatccaagctcttgttgggcatgtactcntaaacaagcaccttctctccttcttccaag

SEQ ID NO: 35764 - DNA, 101 bp, rice(Oryza sativa)
  misc_feature (71): n=a or g
atgtgctatcttagccgtccaaagcgccctgatatgcgtgcaaaggctaaggatggtgatctgaaatttgnaagtttgcaactagctcaaggcatatttga

SEQ ID NO: 35765 - DNA, 101 bp, rice(Oryza sativa)
  misc_feature (71): n=a or g
tacatacacactccgttcccagttcatgtacaagcctaccctgatagctgttatccagatctgggctgtanttctgtgattaagttcaggtttgggctgtt

SEQ ID NO: 35766 - DNA, 101 bp, rice(Oryza sativa)
  misc_feature (71): n=a or g
ttcctcctcgccgcgctcctgctccttcccgtgttcaccttgctgagcttctcgtcggcgaagaagccagncgatggcggcggctggcggctgccgcttcc

SEQ ID NO: 35767 - DNA, 101 bp, rice(Oryza sativa)
  misc_feature (71): n=a or g
gctatacgctactacataaatgcactttggtatcggttgggaaaacccataggtaccggattttctagccnacaccaatcgggtggcagcgatggggggaa

SEQ ID NO: 35768 - DNA, 101 bp, rice(Oryza sativa)
  misc_feature (71): n=a or g
attgttcagcactcaaatacctctgagcatgcatcgtcatcggcactgtcatcaccgggcgaaggggatgncagggagtactttgtgccattcaggatttt

SEQ ID NO: 35769 - DNA, 101 bp, rice(Oryza sativa)
  misc_feature (71): n=a or g
tgccgtgtattcgccgtagctggttaatttccacgtggtcttgtcttctttgctctctatcaaatgcaagnttcgtacaacaccccacacgttgacaagtt

SEQ ID NO: 35770 - DNA, 101 bp, rice(Oryza sativa)
  misc_feature (71): n=a or g
acaagtcccccttttgaaagtgaaaaatactgctgaaaatatgaatgcataatcatggcagactgcggccntataacagtgcttagaaagagtcctgaaag

SEQ ID NO: 35771 - DNA, 101 bp, rice(Oryza sativa)
  misc_feature (71): n=a or g
gttggagctgcttggctgggtgtggcaagctgggcaaagaaaacccccttgctccttttttggtagtttcnttggggttactgtgcagttggcttcctggc

SEQ ID NO: 35772 - DNA, 101 bp, rice(Oryza sativa)
  misc_feature (71): n=a or g
tacttgatggaagtgtgaattgatgtacaggatcacctttgccactggagccatctctgctgctatatggncaatgtgcaagccagaactgcattgactga

SEQ ID NO: 35773 - DNA, 101 bp, rice(Oryza sativa)
  misc_feature (71): n=a or g
ggcgtgctccgaggatggattggggttttgggaatgggatattgggatcgcttgctggatttgtaatactnctactactactaaatatcgtgatcgatcga

SEQ ID NO: 35774 - DNA, 101 bp, rice(Oryza sativa)
  misc_feature (71): n=t or c
tgaagaaacttggatagttccatagttcaagtgcaccacaagcttgatatcccattgataatgcttgtttntcaaaccctatttttgatagctgttcttcc

SEQ ID NO: 35775 - DNA, 101 bp, rice(Oryza sativa)
  misc_feature (71): n=t or c
ttacattgtgaaacggaggaagtactaagatattgacctggagtcctggaaaccatatacctcgaaaaaanattgacctgaaaaccatagatctcgaaaaa

SEQ ID NO: 35776 - DNA, 101 bp, rice(Oryza sativa)
  misc_feature (71): n=a or c
agatggcttcctcagcattgactgcgggctggagggagacaaaaatggctacacggacaacagcaatggcntcgtttacacccccgacggcgccccgtacg

SEQ ID NO: 35777 - DNA, 101 bp, rice(Oryza sativa)
  misc_feature (71): n=t or c
agtacaccacacacacactgctcaatgctgtagtgtagtacacacacatgcatgcaatagatcacaacaanatagtgagagaaaaaggtaggcagagagac

SEQ ID NO: 35778 - DNA, 101 bp, rice(Oryza sativa)
  misc_feature (71): n=t or g
agcgtatcagggtatcaaggattctcgaccagtaatgctgccgaccggttgttctctcgcatatactaagnctgtgtttgtttgggtgatagggagtaaga

SEQ ID NO: 35779 - DNA, 101 bp, rice(Oryza sativa)
  misc_feature (71): n=a or g
actttgcacagatgaaggacaagtatgggattatgccatctgcagatcattatgcctgcatggttgatttncttggccgggctggattggtggatgaagcc

SEQ ID NO: 35780 - DNA, 101 bp, rice(Oryza sativa)
  misc_feature (71): n=t or c
taagcatgagcttcttgggtgtgctatcactgattaagactaggttaatacgatagtacaacctccgtccnaaaatataacaacttttaaccattaggatt

SEQ ID NO: 35781 - DNA, 101 bp, rice(Oryza sativa)
  misc_feature (71): n=t or c
ggatttcgacggacaacgtggcaagctcggatttgtcaagaggagaaggcacggattgataccttcggatnagtgtggagacttcggatcgatgacgtgga

SEQ ID NO: 35782 - DNA, 101 bp, rice(Oryza sativa)
  misc_feature (71): n=a or g
tttctatattgtagatgagtcctaaaataagatatacatgctatgaatttatcggcgtgccactaggcgcncagattttttctagtatatttactctttct

SEQ ID NO: 35783 - DNA, 101 bp, rice(Oryza sativa)
  misc_feature (71): n=t or g
tctgaccattgattgttgggggtactttagtccttctcatctttattttggtggaaaggagaggtgactantgatcggtcgcccgatcgaaatctttaaaa

SEQ ID NO: 35784 - DNA, 101 bp, rice(Oryza sativa)
  misc_feature (71): n=t or g
aggagaaggaccgagcgagcgccgagtgaatttcttctccccatcctacccatacaggaatgaacggccanatgtgtactggcaccgagcagtaccagtac

SEQ ID NO: 35785 - DNA, 101 bp, rice(Oryza sativa)
  misc_feature (71): n=t or c
tagggtacattcctagcccctccatacaattccgacatcaatttcataattctaccagctgagagattcantccgtgcagcattgtgatgaaatctttttc

SEQ ID NO: 35786 - DNA, 101 bp, rice(Oryza sativa)
  misc_feature (71): n=a or c
attgatcttcacgtatctttactctttctttccctctctcgagctgcctaattctggagctgctctagatntaatggtttcttaacttgtattaccttttt

SEQ ID NO: 35787 - DNA, 101 bp, rice(Oryza sativa)
  misc_feature (71): n=t or c
ccgtaatgtccagccagtcgaacatcgatattgtgttctggcgccccagcatggactactgaacggtgaangccaccgacggagaattggggcgcgaagtt

SEQ ID NO: 35788 - DNA, 101 bp, rice(Oryza sativa)
  misc_feature (71): n=t or c
ttgatttattcaccagtgcactggaaaggtgtagtatagtatccccaaaactagccctttcaatttcatangacttaattaaaagcacacgccatattaaa

SEQ ID NO: 35789 - DNA, 101 bp, rice(Oryza sativa)
  misc_feature (71): n=t or c
tgcagagtatcactgattgagatggtgtttggatatagagactagacttaaactttagtccctgtcgcatnagatgtttgaacattaatttgaaatattaa

SEQ ID NO: 35790 - DNA, 101 bp, rice(Oryza sativa)
  misc_feature (71): n=a or g
acccaccgcttcgcaggttgctgccatctggttagagggggatgatccgatgaaaacttttgatagacatntcttggtacatgcaaaaagtgataagccct

SEQ ID NO: 35791 - DNA, 101 bp, rice(Oryza sativa)
  misc_feature (71): n=a or c
agaaattaataaaaggaaagggagagatgggagatgaagatgaccaagattacaaagaaccaaagaagtgntatagcgatgtgattatatatatggaggat

SEQ ID NO: 35792 - DNA, 101 bp, rice(Oryza sativa)
  misc_feature (71): n=t or g
gtggcgacgtggagctcgagggaggtcaaactggcgtgatttttggggaaaagtggaggaaaatgaggagnaatgggtggcgaccatgtccgcacggttgg

SEQ ID NO: 35793 - DNA, 101 bp, rice(Oryza sativa)
  misc_feature (71): n=t or c
agctggcacagaggatcctacaaaggcgaagaaagcaaaggaattgcattcttgtgccaccatctccaccnagagatgaagtctgagtatatgaccgagga

SEQ ID NO: 35794 - DNA, 101 bp, rice(Oryza sativa)
  misc_feature (71): n=a or g
caagaagaatttcaagaaggtcaatcatatatatccttatattgctgagtccgaagaagatgatgatcctnaggtagcagcagctgaatgggcaaggaaca

SEQ ID NO: 35795 - DNA, 101 bp, rice(Oryza sativa)
  misc_feature (71): n=t or c
aggttccgcgcgattcgattcgatttgattttcttttgtgtgtgttcattgacggtaacaacgacgatagngttttcttgcagtggcgtcgatgaaagccg

SEQ ID NO: 35796 - DNA, 101 bp, rice(Oryza sativa)
  misc_feature (71): n=a or g
atccataatcctaccttgaggctgttgcataagtggcttggtttaatgctgtttcttagagctgatatccngatagttcgtgaagatgtactagtcctatt

SEQ ID NO: 35797 - DNA, 101 bp, rice(Oryza sativa)
  misc_feature (71): n=t or g
tcctcatttttggtttgaaggaatcctacgctttaacgacaacaacatggtagggttgaatacctacctancaatctagcatctacgtacagctttcagaa

SEQ ID NO: 35798 - DNA, 101 bp, rice(Oryza sativa)
  misc_feature (71): n=t or c
aagcctcatttcgatggaccttaatctgggtccatcaaattcctggcctataggtgtgctaacatggaaanttctcatgtatatgtggcctagtccccttt

SEQ ID NO: 35799 - DNA, 101 bp, rice(Oryza sativa)
  misc_feature (71): n=a or c
tagcttcaacttggcaggcagcagcatttggataatgtgcaaaaagcagtaaaaggtgtacttgcagttancagtgtttctgtgctggcagttcattttga

SEQ ID NO: 35800 - DNA, 101 bp, rice(Oryza sativa)
  misc_feature (71): n=t or c
atgtcaccgaagctgaatccagccatgtgagcgctccgtatgacaaaaatgcagtggaactcgatttgcantggttttgatacttcgggatgctctatacc

SEQ ID NO: 35801 - DNA, 101 bp, rice(Oryza sativa)
  misc_feature (71): n=t or c
gattggataataaagaaacagagatgactggattgccagtgatgataccagtgctaattcatgctaggagnatcttgatatataatatctcaatggagatg

SEQ ID NO: 35802 - DNA, 101 bp, rice(Oryza sativa)
  misc_feature (71): n=t or g
gagagggcgcgacggcgtcggaggtggtggagaagatggtgtcgcaggcggttgtggagaaggcgttgtgngaggcgttcgagaaggtggtgtcggaggcg

SEQ ID NO: 35803 - DNA, 101 bp, rice(Oryza sativa)
  misc_feature (71): n=t or c
accgcctgcaaaatggcaggccccctatagccgaccgttaggcataagccaacggtcgtctgccacgtcangaaaaggcggcaggcgactagttttgtaaa

SEQ ID NO: 35804 - DNA, 101 bp, rice(Oryza sativa)
  misc_feature (71): n=t or c
caatgtaatggatgtatacactgatagatctaacagatacctaatggtagggacatgggagagaacacaanaaaatctcgagggtacacaggggattggtt

SEQ ID NO: 35805 - DNA, 101 bp, rice(Oryza sativa)
  misc_feature (71): n=a or g
taaaactcctcccaaaatcaaaccttcagctcaatatgcgctgaagcaaacaagcaccaaaaacaagacangacgctaaaatcactcaaaatatccaatct

SEQ ID NO: 35806 - DNA, 101 bp, rice(Oryza sativa)
  misc_feature (71): n=t or g
tgaaccggcggcggcaacggtcaaaaatggcgggaaggctgtagtgttgggggtggggcccagtggaggtngggcccacgagtcagtagggttcatgggct

SEQ ID NO: 35807 - DNA, 101 bp, rice(Oryza sativa)
  misc_feature (71): n=a or g
ttctgaaagtgtagctagatgtcactctagtaaatatccaacacatggatttaatactgcataacactgcntatatacacatacaagattaaacgaactga

SEQ ID NO: 35808 - DNA, 101 bp, rice(Oryza sativa)
  misc_feature (71): n=t or c
atgggtcgtggtgttagcagcgggggtggtcagagttccctgggctacctgtttggtggtggtgaagctcngaagtcagctgagaagcctgctccagttca

SEQ ID NO: 35809 - DNA, 101 bp, rice(Oryza sativa)
  misc_feature (71): n=a or g
ataggcgataggaacagcatgagacgacaaagaaattaaagggaaggaacataaggccgtggagaaaaaanaagagccacaacaggatgcgatgatgtcga

SEQ ID NO: 35810 - DNA, 101 bp, rice(Oryza sativa)
  misc_feature (71): n=t or c
cacaaacagagcatcattcagagcaatggaatccaatccatggtaattaacaataactagtcttttttttnccaagcagaactctattgcatggcttgtct

SEQ ID NO: 35811 - DNA, 101 bp, rice(Oryza sativa)
  misc_feature (71): n=t or c
ggtaacggtgcgcttacaccaaagtatccatagcggttgtatcgaccgacgtagccctgatgaattacacnaaactcaaggctctccagtgagagtgcagt

SEQ ID NO: 35812 - DNA, 101 bp, rice(Oryza sativa)
  misc_feature (71): n=t or c
ttctctctctagatctctctcccaattcatcatcatgtctaagactaagatcgagaaggtggaataagggnaatcccaaccccctacctcagttagtgtcc

SEQ ID NO: 35813 - DNA, 101 bp, rice(Oryza sativa)
  misc_feature (71): n=t or c
gtatcggtcgatgggaatttcggagttagccgtggtttcttaaacctgtcccgtatctccgtcagcacgtncgggtagctctgcaccacctcgtagcactc

SEQ ID NO: 35814 - DNA, 101 bp, rice(Oryza sativa)
  misc_feature (71): n=a or g
ctatgcaaaatcgaaggctgtttaggtagattctgcaggagttgtttttcaaagaaaaggtactccctccntttgaaaatattttacataacggaaatgga

SEQ ID NO: 35815 - DNA, 101 bp, rice(Oryza sativa)
  misc_feature (71): n=a or g
actaactccaaagcttaacatgcaaccatgccatcatcacccactagcaataatacatatttaacctcatncaagcatgcaacattatctacaatatattt

SEQ ID NO: 35816 - DNA, 101 bp, rice(Oryza sativa)
  misc_feature (71): n=a or g
attagtgaataagtaactcttagctgtatgacagctctgtgatcttctgggtctggagaaatcaaacaagnaagcatcgaatacatgtgcctactgtacag

SEQ ID NO: 35817 - DNA, 101 bp, rice(Oryza sativa)
  misc_feature (71): n=t or g
tcgtcagctgcctcctcctgcgggctctgctgctcctgctcctgcagcaacatcatctgctgttgctgttnctgttgctgttgctgaagctgctgctgctg

SEQ ID NO: 35818 - DNA, 101 bp, rice(Oryza sativa)
  misc_feature (71): n=a or g
cttggatgcaaagggacgatccaaatggagtatgatgaagagctggagtcggagaagcaatggcagcactngcaatggcaatggcaacggcaatggcagta

SEQ ID NO: 35819 - DNA, 101 bp, rice(Oryza sativa)
  misc_feature (71): n=a or c
atctttctcttggcaactgctgatccgtggaggtgaagtcctggtgcagttttcctcttcctacttgcacntgagtcacctgacattgcttttcgcccaac

SEQ ID NO: 35820 - DNA, 101 bp, rice(Oryza sativa)
  misc_feature (71): n=t or g
actgttgcagcctccgcctagtcgggttttttcatggcagatcggtggcttgagagctggaagtgatgcanacaaagtcattcccagcatcccctgttatt

SEQ ID NO: 35821 - DNA, 101 bp, rice(Oryza sativa)
  misc_feature (71): n=t or c
acggcttccgcctcgccgtgcgacgtcctccccctctgcgtcgcgaatttgctgatctcgcgcgatttttncaactgttgcgtgcagttgcagctccatta

SEQ ID NO: 35822 - DNA, 101 bp, rice(Oryza sativa)
  misc_feature (71): n=t or c
aatattttcccttgctttgacaaacttgctgtatcagatattcagatatcagcatggagaattcctcaggntcggggaaggtggctctccagctcttagtg

SEQ ID NO: 35823 - DNA, 101 bp, rice(Oryza sativa)
  misc_feature (71): n=t or c
catcatgtttgtctcatcgtccaaagccccagtgatctaaatctagattcctattggtcatcggagtgttntagacttctgtgtttgcaatcccatgttgc

SEQ ID NO: 35824 - DNA, 101 bp, rice(Oryza sativa)
  misc_feature (71): n=a or g
gtctctgccgttctcatggcagtagttttttcagtaactgtatgttgctgccttagtttcagtagagttgnttcttcatttcttttcagtgatcaaattat

SEQ ID NO: 35825 - DNA, 101 bp, rice(Oryza sativa)
  misc_feature (71): n=t or c
tgcaagcacaaaaaagactgaaatttttatgggcaaatcccagatcagaaggaccagcagcaaggacatgncctccatagaaaggagtaccagccgaattt

SEQ ID NO: 35826 - DNA, 101 bp, rice(Oryza sativa)
  misc_feature (71): n=t or c
aaagcactgccaagcgattctacacgtctgattctgcatgtccttcgattatctcaatgcgttcatctcgngtcgttcgactgatgatctccatgtttatc

SEQ ID NO: 35827 - DNA, 101 bp, rice(Oryza sativa)
  misc_feature (71): n=t or g
taaaatgctgcctacgtggaatgctacgtatgcggtcagatatggttaaacgttttttggaccgaccatgnttcattaaaacaagatcatgaaccttattg

SEQ ID NO: 35828 - DNA, 101 bp, rice(Oryza sativa)
  misc_feature (71): n=a or g
gcccaggattgcgtggaaactgatgacgcttccattctatgtggtctctggtggggttgggctcatcgtcngttcgatctgtctcgttgcctgggttgccg

SEQ ID NO: 35829 - DNA, 101 bp, rice(Oryza sativa)
  misc_feature (71): n=a or g
acaattgctactggcagttctcaaaatgtagaagtggatgctaaacatgtggatgggagaaaatcagagcnaagtgttgaacttgaagctgtcaaggagac

SEQ ID NO: 35830 - DNA, 101 bp, rice(Oryza sativa)
  misc_feature (71): n=a or g
gctggatgaagcaacatcagcacatgttaagtcaaaaaaggattccaagaaaaatgaccaaccagccccgnaggccttagaaccaatggacggtcttatta

SEQ ID NO: 35831 - DNA, 101 bp, rice(Oryza sativa)
  misc_feature (71): n=t or c
tgagaaagatggaccgttggttcatttggattggagaacaatcaagaggcttccaaagcaaatgtcgctangcagattacttcacatgtctagtcaaaata

SEQ ID NO: 35832 - DNA, 101 bp, rice(Oryza sativa)
  misc_feature (71): n=t or c
tacaatagatgaacaatagggaagtttacatgaatagtgtgctacgagggaaagggctagtagcaacatgnagaatagcttcatcatcctatgcacagaat

SEQ ID NO: 35833 - DNA, 101 bp, rice(Oryza sativa)
  misc_feature (71): n=t or g
gacaaatgtttttctataagagaccaaccgggacaaatatttttttataagagaccaaccggcaaatgtcntaagttcatgattgaaagcaccatggcctg

SEQ ID NO: 35834 - DNA, 101 bp, rice(Oryza sativa)
  misc_feature (71): n=t or c
gcgatcacggaggggaggtcgcgctggaagctcagatcgcgctggacgttgtcaagttcagtgttgtttgnaatttgcaaaagcttggatgcagcacacag

SEQ ID NO: 35835 - DNA, 101 bp, rice(Oryza sativa)
  misc_feature (71): n=a or g
ttacgcaactatcccttaacagtgatagggacatctgaggggcattcttgtcatatttcttggcatgtctnttttaggtggtcttcatgggctgaccttag

SEQ ID NO: 35836 - DNA, 101 bp, rice(Oryza sativa)
  misc_feature (71): n=t or c
ggccgtgtgaatcccggtcgttttcatcacggagaagacgagtcgctagctacaagactttcctctgcttnctgcatcggtttcgccggggagaaaattgg

SEQ ID NO: 35837 - DNA, 101 bp, rice(Oryza sativa)
  misc_feature (71): n=t or c
gccatctcgtcgcatttccatgtgcttgagtatgtggaagaggatgaggattcatacgtcacactggtcanaggggtggagatctattcgtctgaaactgg

SEQ ID NO: 35838 - DNA, 101 bp, rice(Oryza sativa)
  misc_feature (71): n=a or g
tttgaattttcatgtgtcattcacaaattgctcgcgtgtttgtgatcatacctttgctagtagttgccgcngaatgcaaagctgtccgtccgtccggacca

SEQ ID NO: 35839 - DNA, 101 bp, rice(Oryza sativa)
  misc_feature (71): n=a or g
ctgaagagaacattatgtggccttgtttgtggcaggtgtttttacacgccagctgccacacaaacaaaacnaaagaaattgaattaatacccagaaataaa

SEQ ID NO: 35840 - DNA, 101 bp, rice(Oryza sativa)
  misc_feature (71): n=t or c
cccacttggcgcgttcttttcggattagtgtacgccgtttggcttattcaagattgagccggaacaagcanaacatatttgcaaataaaaaataatttatt

SEQ ID NO: 35841 - DNA, 101 bp, rice(Oryza sativa)
  misc_feature (71): n=a or g
caattccaaaagcaatggatggttcttgcaaatttcatcaactgcaaactgaagggagtagcaatacattncaatactgcactacatcaccattttgtaaa

SEQ ID NO: 35842 - DNA, 101 bp, rice(Oryza sativa)
  misc_feature (71): n=a or g
attgcaacgttgatggctacatgatcccagcaggaacacgtgtacttattaacttgtgggcacttagtagngatgctaattactgggacaagccagatgag

SEQ ID NO: 35843 - DNA, 101 bp, rice(Oryza sativa)
  misc_feature (71): n=a or c
ccggcacgcgcgcacatcacacacacattctcctctttacgatctggtcgtgtggatcccgggatcctccnacgatgccccgggcgatcgatcgatcgatc

SEQ ID NO: 35844 - DNA, 101 bp, rice(Oryza sativa)
  misc_feature (71): n=a or g
atcacaaccgtagataataaaatataacctcatgggccaactttaaaacccatctgaccatggtacatttnatgcccatccgactattgtatgtacgtgct

SEQ ID NO: 35845 - DNA, 101 bp, rice(Oryza sativa)
  misc_feature (71): n=a or g
gagagcgtggactcgccgataggaatgtgggaggttcctcttgccgatactgatgtgttttctctttgtcnatattgatgtgatcgccctccatagtactc

SEQ ID NO: 35846 - DNA, 101 bp, rice(Oryza sativa)
  misc_feature (71): n=t or c
tgcacctatcaccccactattgccatacctgctgatgtcaaatggtgcgggcggtggcggtacagtttcantgggaagcatgtgctggcagctacggatgt

SEQ ID NO: 35847 - DNA, 101 bp, rice(Oryza sativa)
  misc_feature (71): n=a or g
gatttgattgtcctgcgtttcagggagtgatgggtgtgattgtggagttgggaatgggggtgatgtgggtnacactgagttgtgcttcatcggagcaacgc

SEQ ID NO: 35848 - DNA, 101 bp, rice(Oryza sativa)
  misc_feature (71): n=t or c
aagtgaaatcagtagacctatagaactggacagttggataggctttggaattcctcagacatgcttactgngaatggacgaaacctaacatggtacgaaac

SEQ ID NO: 35849 - DNA, 101 bp, rice(Oryza sativa)
  misc_feature (71): n=t or g
gaacttctgttctgaaatgaaatgctggcacggcatgttagtttataggctttacctgagcttagctctgnggctatggctgtggctgtactccgagagac

SEQ ID NO: 35850 - DNA, 101 bp, rice(Oryza sativa)
  misc_feature (71): n=a or g
gggaaacttctccggtgccgaagtggtgatgatcgtcgccatcaccatctgcttatacaacttcgccttcntctccggcatcatcctcggctgtggactgg

SEQ ID NO: 35851 - DNA, 101 bp, rice(Oryza sativa)
  misc_feature (71): n=t or c
tgagctcctctttgagtttctccccactgaaaaactggagcagatcgaaactagattagttttaagagaanagcaagctgctttgatgtgttcagtccacc

SEQ ID NO: 35852 - DNA, 101 bp, rice(Oryza sativa)
  misc_feature (71): n=t or g
taattcagtgaagtcctcgtctgaaaacattcagcatcaatcatgtgaaaacgcatttgttgtacgcggcntcggtaatccgagtgcaaaattcttatatc

SEQ ID NO: 35853 - DNA, 101 bp, rice(Oryza sativa)
  misc_feature (71): n=t or c
ccgtccgacgtcgccgacgatgaagctccggacatcgcagcagtctccaccactgccggcttcttcagcanatccgccagctgctccagcggcaccgccgg

SEQ ID NO: 35854 - DNA, 101 bp, rice(Oryza sativa)
  misc_feature (71): n=t or c
gaaagcgagcggacatcgttcatattggtgcccctctggatgaaaacttgaatggcctttgaaaggtgaanagtgttgctgctagaattggaaggggtctc

SEQ ID NO: 35855 - DNA, 101 bp, rice(Oryza sativa)
  misc_feature (71): n=a or g
tagttcaattttattttgaaaaataaaactcaccctagcctttcaagaccaggtgagttataccctaacantccgtttggttggagagagtttttaggaag

SEQ ID NO: 35856 - DNA, 101 bp, rice(Oryza sativa)
  misc_feature (71): n=t or c
tccgatccgggttttatatgtgtttaactcggatgacggacgaaagctaaggtgagtatggaatcatcctnaatttttataataggtaaagattattatta

SEQ ID NO: 35857 - DNA, 101 bp, rice(Oryza sativa)
  misc_feature (71): n=a or c
ctggcccatctgccatggacaatcctgcacaaaaactgggattcttctcctctcctctacacaaacgcacnaacacagacactgacagactgcagcgctga

SEQ ID NO: 35858 - DNA, 101 bp, rice(Oryza sativa)
  misc_feature (71): n=a or g
cacaacgtatgcaaaccccaacctataagcacctccggactccccaccctataaacacaccttcagactgnaagaataattagccgtaaacacgagcaccc

SEQ ID NO: 35859 - DNA, 101 bp, rice(Oryza sativa)
  misc_feature (71): n=t or c
ctgcttacagaaggaaaagtctattacttacactcatacactgtcaagtatggaaataggttatacaggcnagttcccaatgaaatgatgatcctatttac

SEQ ID NO: 35860 - DNA, 101 bp, rice(Oryza sativa)
  misc_feature (71): n=a or g
attgacacgcctccttcgtggggtcgcatgggggagggcccgtaatagtcgttaagtaccaatttcatccnccaactagcacaattaataaagggaaaatt

SEQ ID NO: 35861 - DNA, 101 bp, rice(Oryza sativa)
  misc_feature (71): n=t or c
agggaaactaacgcaacctaagtcgctaagaacacagtagtactttcgtgtcatagagggtgtttagatcnagaggtgtaaagttttggcgtgtcacatcg

SEQ ID NO: 35862 - DNA, 101 bp, rice(Oryza sativa)
  misc_feature (71): n=t or c
ttgaaatgtatgtataaatacttccaggaaaatgatcgatgagtaatcgatctcttggctggatctgttgngagctacgagccaaagaaaatgagattaat

SEQ ID NO: 35863 - DNA, 101 bp, rice(Oryza sativa)
  misc_feature (71): n=a or g
tagtattagtagtagagaacaatttagtactaagtacgtttctctcgccagccggacacacaccgcggcgncttctcgtgcgcacgcaagcaaaacagccg

SEQ ID NO: 35864 - DNA, 101 bp, rice(Oryza sativa)
  misc_feature (71): n=t or c
cttttcctgtttgcagaaaccctgccgctggtttccctgctttggctcgtgagcatcgtgtgcctactccnggtgcccggtctacccaaccgaaacccggt

SEQ ID NO: 35865 - DNA, 101 bp, rice(Oryza sativa)
  misc_feature (71): n=t or c
atcccaaagcggaatgaaaggatgtattgtaccagtattctgctaaggcgagccatttactccaatgaganggacaagcgtgcacaaaacaacgaagaaaa

SEQ ID NO: 35866 - DNA, 101 bp, rice(Oryza sativa)
  misc_feature (71): n=t or c
gatgattgtagctgccgtgttgtcttggtatccacggatccacttaggccgtgttcttttctcctcttttncaacccaaatttcttttttttcgtgtgcac

SEQ ID NO: 35867 - DNA, 101 bp, rice(Oryza sativa)
  misc_feature (71): n=t or g
catcgtcgcccgccgtgttcttgtcggacagatggagagacagggaaaagatgtgtgtgctaattgcatgnggagaggtagtatatatatagcccgggaag

SEQ ID NO: 35868 - DNA, 101 bp, rice(Oryza sativa)
  misc_feature (71): n=a or g
ttggctgatctgattggtcctgtgttgcccagtgcatgtgcagtgaatgtgcaaaaactctaaggtttcanacagataaatgccccatatgcagacaacct

SEQ ID NO: 35869 - DNA, 101 bp, rice(Oryza sativa)
  misc_feature (71): n=t or c
aggtgatggggtgcaccgtcgtgtcatgctgcttatcgtttgtcgtggtggagcttgttgtcgttcgcggngccaccgctaggagaaaggagatggacgag

SEQ ID NO: 35870 - DNA, 101 bp, rice(Oryza sativa)
  misc_feature (71): n=t or c
ggtacgaattaactctgaacattgtggtaattgtgcgatggaaacagtggttcaatgacagttcagagganatcagaagctgctgcgacaaatctcttcag

SEQ ID NO: 35871 - DNA, 101 bp, rice(Oryza sativa)
  misc_feature (71): n=t or c
catttttcaagagtaagcagctctctttgatcctttttgtaatcacttcattttttcggccgattactcanagactttatagttgcagaagaagaaaattg

SEQ ID NO: 35872 - DNA, 101 bp, rice(Oryza sativa)
  misc_feature (71): n=a or g
gtcctatgactcggtttactttgatgattacatattttcctcggattttgattcatctgaagaggacgacnaagacgacgacgacgatgatgatgatgatg

SEQ ID NO: 35873 - DNA, 101 bp, rice(Oryza sativa)
  misc_feature (71): n=a or g
cttggagccaaggaccgcagttcgaccccaacactgccattcaagcaccgaccgtccaaccacaggcgacngcaccaagcttcggaaccaatcaagcgccg

SEQ ID NO: 35874 - DNA, 101 bp, rice(Oryza sativa)
  misc_feature (71): n=a or g
ctgctttcaaaatcaaaaactcctccaaagagtctacctttttattctgattctgagaactatagttatanaatgtagaaaataaactagaatcgagatgc

SEQ ID NO: 35875 - DNA, 101 bp, rice(Oryza sativa)
  misc_feature (71): n=a or g
tggcaaatatcttgttccttgattcaccagttggtgttggttattcgtactcaaacgcctctgatgatatnttaaataatggggatgccaggactggtact

SEQ ID NO: 35876 - DNA, 101 bp, rice(Oryza sativa)
  misc_feature (71): n=a or g
aacctggcacttatagaacacctctggatacccatccatcgtccgattcttaaccctaaatcctgaacccnaaaccataaaagcgtcacacccctacataa

SEQ ID NO: 35877 - DNA, 101 bp, rice(Oryza sativa)
  misc_feature (71): n=a or g
cgctacctggtgtaacccgcgcgcgcagcaaacagaccatatataaaaatcacttcattcgtactaaaatntaagtatttttaagattaacacgggtatta

SEQ ID NO: 35878 - DNA, 101 bp, rice(Oryza sativa)
  misc_feature (71): n=a or c
aggatgctgtgaagtgtacagtaatggcgttgttaattgcggtagctagtgctattctagtacttgtagtnctgtttctaggcggaggtgaatcacggcgc

SEQ ID NO: 35879 - DNA, 101 bp, rice(Oryza sativa)
  misc_feature (71): n=t or c
ccattaaaacaataattttcaggtgaggaagagagagtaatcacgtgaaacgtcaaaaattctcatgggcncacatgtcagctctcctatcactcttccta

SEQ ID NO: 35880 - DNA, 101 bp, rice(Oryza sativa)
  misc_feature (71): n=t or c
atagaggcggaaagctaggagtaggcatccgacttcgccaccttgccggttccatgccactcaacgtcgtngtcgccgctattgagaactgtcgcacccaa

SEQ ID NO: 35881 - DNA, 101 bp, rice(Oryza sativa)
  misc_feature (71): n=t or c
gacagagaggagagctaggaagtgttgtaaagaagcttgcaggttgtgataaggcctatcttggcatgtantgccatcttgaccaatgttacaggcttaca

SEQ ID NO: 35882 - DNA, 101 bp, rice(Oryza sativa)
  misc_feature (71): n=a or g
caagtcgccacgtgtaaatattagtcaatactcgttattgaaaccggacatattatattaaatgacacggnagattacaactctgccatcataataaacag

SEQ ID NO: 35883 - DNA, 101 bp, rice(Oryza sativa)
  misc_feature (71): n=a or c
cctgtcccagttaccaccttgctgaagccggaaggataataacagtggtgtgcggtgctaaaattgcctangtaaaacgaaatatgaacgtggggttattg

SEQ ID NO: 35884 - DNA, 101 bp, rice(Oryza sativa)
  misc_feature (71): n=a or c
tttaaagacacttgtgtgcctaccacagacttttccaaactgtgcagcaaattgaatgtctagcggcacancccttgctctcagttttgcaagtgttccat

SEQ ID NO: 35885 - DNA, 101 bp, rice(Oryza sativa)
  misc_feature (71): n=t or c
caagatcatgaggcgaattcccaatcatattgcaatacgcggaacaaaatatgcaattgttgccagaaaanctagacaacgatattatgttagaatgggat

SEQ ID NO: 35886 - DNA, 101 bp, rice(Oryza sativa)
  misc_feature (71): n=a or g
aatatctagtacaatgcagatgcatcatgctagtaggctagtactcctactagctaagcttgagttcagantagaaagcatccctacttagtgtaattgta

SEQ ID NO: 35887 - DNA, 101 bp, rice(Oryza sativa)
  misc_feature (71): n=t or c
gaccctttttttttaccgaccttaaaacccctcccctttcgtctcaacttttttctacttttcttacaccntttccgatgattgatgtggatataatcaga

SEQ ID NO: 35888 - DNA, 101 bp, rice(Oryza sativa)
  misc_feature (71): n=a or g
cccaatatcagcaaggggggctaactcaacctcagttcactcctcagtgtaatcagttcgagccaatgcancaacaatcgcaaggagcagctcagcaacga

SEQ ID NO: 35889 - DNA, 101 bp, rice(Oryza sativa)
  misc_feature (71): n=t or g
gctgggtcgaccggttcaactgcagaaccggagcagtcatattacgtgtatattctccattcaacagcatntacaagtggtctagctggcttatttgttga

SEQ ID NO: 35890 - DNA, 101 bp, rice(Oryza sativa)
  misc_feature (71): n=t or c
tcgtgacttcctgcaccacaccagggaggcagccctcctgacgacctgctataaattactgtaccccctcntgggctaaaaaacaaaagaagataaacaaa

SEQ ID NO: 35891 - DNA, 101 bp, rice(Oryza sativa)
  misc_feature (71): n=t or c
ggcggcgagggccttgctcattctcattcttgctctcctcctttttctttctatctgtgagcatctatttntttgtttttttttgggttttaaacaagaca

SEQ ID NO: 35892 - DNA, 101 bp, rice(Oryza sativa)
  misc_feature (71): n=t or c
taaacaataaagaaatgaatctttgagatgtgttataagaagagagaatattcggtggtggggccataaanaataaacaaataaatctttaagatgtgcta

SEQ ID NO: 35893 - DNA, 101 bp, rice(Oryza sativa)
  misc_feature (71): n=t or c
tactcctactcattttttattcaacatctagagatctgacttgggtttgaaactgaatacctttcctattngtcaggcaaaagaggaggctgagagagaaa

SEQ ID NO: 35894 - DNA, 101 bp, rice(Oryza sativa)
  misc_feature (71): n=a or g
ctagaagctacaatgagaaaagtataatattttgtttcctattcttggggtgtccagtgtagcttgagttntagtattaactaatagtcctggagttataa

SEQ ID NO: 35895 - DNA, 101 bp, rice(Oryza sativa)
  misc_feature (71): n=t or c
cactccgtagatattgatactcttaatatgtcacctgtcatgctagtcacatgcctctactagcttctggnagagtaaagatgtgtgtgatgaagaatagt

SEQ ID NO: 35896 - DNA, 101 bp, rice(Oryza sativa)
  misc_feature (71): n=t or c
tcactagccgaaactcattcatcaacttctggcattttctatggtaaattatcaatgtatcatccttgcanttatactcccctgccaattgactaattacc

SEQ ID NO: 35897 - DNA, 101 bp, rice(Oryza sativa)
  misc_feature (71): n=t or c
gttagacagccaatatgtcagagtgccagagagttggttggctagggtttactccctcggccctaaaatantttaacctagaatgatttatcctaaaccaa

SEQ ID NO: 35898 - DNA, 101 bp, rice(Oryza sativa)
  misc_feature (71): n=a or g
gtgcaagtcctcaggagaggtcctcgccactgagcaaaaggaatcacctaggcgccctaacccccagaacnacgactcacgcaagacttggtgtccaatcc

SEQ ID NO: 35899 - DNA, 101 bp, rice(Oryza sativa)
  misc_feature (71): n=a or g
aacgggcataatgggagcagtcccatcctctgtcccctagaactttacctaattactgtgggacccacctnttggtccctagcaggagagtagaggctgag

SEQ ID NO: 35900 - DNA, 101 bp, rice(Oryza sativa)
  misc_feature (71): n=a or g
acggatccgccggtggtgacatcagcagctcccgcgggtggatccgttgaaggggatgatgttgttgtttntgttgctgttgttgatgtgatgatgttgtt

SEQ ID NO: 35901 - DNA, 101 bp, rice(Oryza sativa)
  misc_feature (71): n=a or g
aggtaattcccaatattttgcgtcttttttgataaacgcctagggaatttccgaatagctccacaaggtgnttggctaaacgacttggattcgaagtctca

SEQ ID NO: 35902 - DNA, 101 bp, rice(Oryza sativa)
  misc_feature (71): n=t or g
tttgggaatatacgataagccatttgcctgataagccaaaattatcaacgtatgtaaccattctatctatnacatataacataagttgatccctccaatag

SEQ ID NO: 35903 - DNA, 101 bp, rice(Oryza sativa)
  misc_feature (71): n=t or c
cttgcaaggaaatgtgaacttaggcaggtagcctacacatgatagtcttaaattgcagctttttccccgcngaatgtgcaggtcaaaggagagccaaatat

SEQ ID NO: 35904 - DNA, 101 bp, rice(Oryza sativa)
  misc_feature (71): n=t or c
aatagataccacataatagtcagcctggcataaatgtattgcacaaaacaccaccagttcgaaaggtgtanataccattcgaaatttggtatataactttt

SEQ ID NO: 35905 - DNA, 101 bp, rice(Oryza sativa)
  misc_feature (71): n=a or g
cgggatgatggtgggttgtttggttgacccggatgagtgatgatgattcacaatcttgcatccatgaaccntgggatgggtgtccatgtctttctccggga

SEQ ID NO: 35906 - DNA, 101 bp, rice(Oryza sativa)
  misc_feature (71): n=a or c
tcaagaacagtgaagtctaacacgaattttgtctttgacccgtggtcggcaggctacgtattagttgccangtctctctaatttcacgtcaaaatatttca

SEQ ID NO: 35907 - DNA, 101 bp, rice(Oryza sativa)
  misc_feature (71): n=a or g
aggattaagtgtaattaacaagtgttcactcgaagcgcgatttcaatagttggataggtactcacgtgtcngtatcattcgtgggtcccattgctgggtca

SEQ ID NO: 35908 - DNA, 101 bp, rice(Oryza sativa)
  misc_feature (71): n=a or g
acgatttagggcttttcgtaactgcccacatacttggcaaagaatgatataaggtttctcgcgtctgatgncttcccaaccagtgtccaaatctctaaatt

SEQ ID NO: 35909 - DNA, 101 bp, rice(Oryza sativa)
  misc_feature (71): n=a or g
aaatgcagtgtagtgaaacattgtaccggtttgagttcattttgcaaagaagtggcccaaaagttcaggtngtttttcttgacacctctaccatggaattg

SEQ ID NO: 35910 - DNA, 101 bp, rice(Oryza sativa)
  misc_feature (71): n=t or c
tcattaccagtcctgactgctgctttctccaagcacctgcaagcaatgaaagattccaaccgttactcatnataagttacatgtgccaactggtttgactt

SEQ ID NO: 35911 - DNA, 101 bp, rice(Oryza sativa)
  misc_feature (71): n=a or g
gccaattgaatcatttttttcgatattgcatctacttttcgcctagtttagcttagttttgtccatctttntctatttgcgttatgaatcgtccgcattcg

SEQ ID NO: 35912 - DNA, 101 bp, rice(Oryza sativa)
  misc_feature (71): n=t or c
ctttgactgccaatatatatgtcagtctatcttactgcctttgttaagtgccctacgtgtattagaaatgnacctgatctgtctgacagctctagctattg

SEQ ID NO: 35913 - DNA, 101 bp, rice(Oryza sativa)
  misc_feature (71): n=a or c
acatataaacgtacacaacctgagccgtaaatctcatgatgtatggccaacagaatttcagcctaacaganctacagaagcacacattgtatggcatcaag

SEQ ID NO: 35914 - DNA, 101 bp, rice(Oryza sativa)
  misc_feature (71): n=t or g
catcgatcgatctgtacgttcaatgcatatatcaggcatatactgctgcctatccattatgtaaaaaaaangtatatatacactgctgcctgtctcatgca

SEQ ID NO: 35915 - DNA, 101 bp, rice(Oryza sativa)
  misc_feature (71): n=t or c
ttgttaccctcctaaaataatccaaaatgaacctacataagttcaccaaaaggagtcttcgtatctcatcntttcgtttatacttatacttatcagtcaaa

SEQ ID NO: 35916 - DNA, 101 bp, rice(Oryza sativa)
  misc_feature (71): n=a or c
gatgccatggataattgcatatggcatttctagatcttttggcaaaagcatttgcaccttatctttccggncaaagcgaccacatctctaaatcagctaca

SEQ ID NO: 35917 - DNA, 101 bp, rice(Oryza sativa)
  misc_feature (71): n=a or g
agtggcctcgggggatggtgtgttcttgctactagatggtggcggctcctccccgagctccacgggtatcncagattcaaaacttcttctgcctagatttt

SEQ ID NO: 35918 - DNA, 101 bp, rice(Oryza sativa)
  misc_feature (71): n=t or g
tccgccacaccatcaggatggccgacaagctgcaggtggtcatggacatgtactacgccaaggcgcccgangtcacctacggcacggggaccttcctcttc

SEQ ID NO: 35919 - DNA, 101 bp, rice(Oryza sativa)
  misc_feature (71): n=t or c
cttcgccgtggaggcttcgccccaacgaacttgatgtctcgggcttgagccctcactggttacatggtttnggcaggtttggtcgaagggcctcatgtcgt

SEQ ID NO: 35920 - DNA, 101 bp, rice(Oryza sativa)
  misc_feature (71): n=a or g
tctcaacgcctaggtatggccttggcatgttcacactcatcttaaatacttactattgtttaatggtatgnctctaatttcgcaagttgtaatgataactt

SEQ ID NO: 35921 - DNA, 101 bp, rice(Oryza sativa)
  misc_feature (71): n=a or g
ttgactatttttccatttttcatatgagatgtttatatttgttacttcacctgtagcaaaataattcactncagtataataattcatcatattagtcaaaa

SEQ ID NO: 35922 - DNA, 101 bp, rice(Oryza sativa)
  misc_feature (71): n=t or c
aacaggattgtggtatcgccccccctgtatagttgtattcaaccgatacgaatggcaccaaacacagtganggcttgtgtattttgatgagaaaatcagca

SEQ ID NO: 35923 - DNA, 101 bp, rice(Oryza sativa)
  misc_feature (71): n=a or g
ccccacccatccagctagttgttcttgtctagcccatcaactgcaagagcatggccatccattcgacatcnatcgacatcttgggctcgttcttggcatgc

SEQ ID NO: 35924 - DNA, 101 bp, rice(Oryza sativa)
  misc_feature (71): n=a or g
ttgttatgttttaggatgtcggattttgaaccagctgtgatttgatcttatatgtactagtggcaccgccngttaccggtgattaccaattactctcatgt

SEQ ID NO: 35925 - DNA, 101 bp, rice(Oryza sativa)
  misc_feature (71): n=a or c
gaactttcttgcacatttcggataccggatgaacatatcatctctgaattgctgatgaaagaagacgcagnatctgatgaaaacgacgacgaggatgcggt

SEQ ID NO: 35926 - DNA, 101 bp, rice(Oryza sativa)
  misc_feature (71): n=a or g
aagaggaagtatctgtaccttgtgatggacgactgggagaaggggtacggcatctacagggtggacgtganctcgttcgaccctgacgccgagttcggctc

SEQ ID NO: 35927 - DNA, 101 bp, rice(Oryza sativa)
  misc_feature (71): n=t or c
ccactggattcccaccatccgtttctcagaatcaacagcctcatttttttttatgcttatacttatccgtnaagatttgaattttcaaccttaaatttgga

SEQ ID NO: 35928 - DNA, 101 bp, rice(Oryza sativa)
  misc_feature (71): n=t or c
gctccattaattatgaaaggcaaaataaactgatcatgcatatgtaggaaaatcgggttgtatatacatgnatttaaacaacaaaatataatataacaact

SEQ ID NO: 35929 - DNA, 101 bp, rice(Oryza sativa)
  misc_feature (71): n=a or g
tgccattccatttgttacatgctttagaatttgccacttgatgcctcagtgacacatggtacttgtgagcnaggtaataagttgactgagtggcaaatcct

SEQ ID NO: 35930 - DNA, 101 bp, rice(Oryza sativa)
  misc_feature (71): n=a or c
agagaactttgcataagaaatccaaagacacaaacctcttagaacgcttgtgcctttctgaagaaccgaangacttaattgccttagcaaaggctctgtgt

SEQ ID NO: 35931 - DNA, 101 bp, rice(Oryza sativa)
  misc_feature (71): n=t or c
gcactgtggactgagctttttcatctggccgacacacaacttcagatgagttctgcctatcaccctcaaantgatgggcaaacggagcgggtaaatcaatg

SEQ ID NO: 35932 - DNA, 101 bp, rice(Oryza sativa)
  misc_feature (71): n=t or g
cgagcgctcataaaacaaatataccgcgtgaaaactactctttgggtatgtttaggggaagcttctagctnctgtagcttctcctaggattagaagctcct

SEQ ID NO: 35933 - DNA, 101 bp, rice(Oryza sativa)
  misc_feature (71): n=t or c
gcatggtgccatgtgatatatcttaatataataaatctggtttaaccggatttttttatctgtccaaattnattttatcacatctacacaaaatctcttat

SEQ ID NO: 35934 - DNA, 101 bp, rice(Oryza sativa)
  misc_feature (71): n=a or g
aggctggtgtaattccatttgccacaaattctttttcccccaagacgcgggaaattcttcccatgataatnacagcagcaaagccgcaaagcaagccaacg

SEQ ID NO: 35935 - DNA, 101 bp, rice(Oryza sativa)
  misc_feature (71): n=t or c
cgttcggcccaaccggtggggaacaaaagtcagggtgcacccggttggctgttgtcaaaccagcttggtcngggggcttcgccaaggagtcaaggaccaca

SEQ ID NO: 35936 - DNA, 101 bp, rice(Oryza sativa)
  misc_feature (71): n=a or g
aattacactataacttgtactatataatataacttgtatacacatgaagggtggcatgttgtctagcagcnaatgcggtgatacaccaagttgacagttta

SEQ ID NO: 35937 - DNA, 101 bp, rice(Oryza sativa)
  misc_feature (71): n=t or c
tgatttaatgggatctccttcatgcactgtcttagaatttagtctagcacatgactgtaggtacatggacntgtaagcataatgaactaattgaggtctaa

SEQ ID NO: 35938 - DNA, 101 bp, rice(Oryza sativa)
  misc_feature (71): n=t or c
actaccaggcacgggtctgcttctgcatagaagtgatctttatcacctctttcttgggccccgacacaagntgctccacgatctgatgctccttgatggga

SEQ ID NO: 35939 - DNA, 101 bp, rice(Oryza sativa)
  misc_feature (71): n=t or c
tgggctcagcccaccaaggctcacacgctccttgactttgaagagtgagactcatgcacgagtgacaactnatgtactctaaaccattcccaaaaccatca

SEQ ID NO: 35940 - DNA, 101 bp, rice(Oryza sativa)
  misc_feature (71): n=a or c
cactctaaataaaaacttcatttattcaatgcactggtccattgctgttgcgtttcattgttcatgcaatnagaacaagatactgtttcagaacaaatcct

SEQ ID NO: 35941 - DNA, 101 bp, rice(Oryza sativa)
  misc_feature (71): n=a or c
tatgtatatttatgaagttagaatagggccttagatctacaaaacaaatattgttggatggcttgtttctnaaacaattagaaaacaactcagatacgtat

SEQ ID NO: 35942 - DNA, 101 bp, rice(Oryza sativa)
  misc_feature (71): n=t or g
gatgtaatgtgtgcatgcaagcatacatccaaaacacaaatatatggttcatctatgatatactttcttcntctcataaaaactaatttactagtactaga

SEQ ID NO: 35943 - DNA, 101 bp, rice(Oryza sativa)
  misc_feature (71): n=t or c
accaaatcatcaagaagaaaagggcaagaaaccggggggaaggaaattcatcacatgatcaaattccacanaaacattccttaggcttggcaccgactgct

SEQ ID NO: 35944 - DNA, 101 bp, rice(Oryza sativa)
  misc_feature (71): n=t or c
cagagagtacagccatattggtacaaagcctcactacctagcttcttctctctagtcaagatcagctagtntgctccttacatcctgcattgcagctgtag

SEQ ID NO: 35945 - DNA, 101 bp, rice(Oryza sativa)
  misc_feature (71): n=t or c
agacataccggccggcctcagctaactaacacacccactaatttgtactcatctcccctctctctccgttngatctctccctctcttctctcttcatggta

SEQ ID NO: 35946 - DNA, 101 bp, rice(Oryza sativa)
  misc_feature (71): n=t or c
ttcgtccacaacatgacggcttcctacgccgacaagagcaacgagtcctccgtggtgtccacctccgtcgncatgttcatcctcgccgccgtcttcttcaa

SEQ ID NO: 35947 - DNA, 101 bp, rice(Oryza sativa)
  misc_feature (71): n=t or g
ggggagggagaggggagagccggagaggtgggatggcagcactccaacttagcaatttttggtgggtaggnagtgtttttaagatgcttaacctttttgca

SEQ ID NO: 35948 - DNA, 101 bp, rice(Oryza sativa)
  misc_feature (71): n=t or g
accactattttcgcaaatttgcatttgaattgtaatggttgaaagaacgagatctagcaatgcttaccttntccacagcgtggtggagagagttctggtgg

SEQ ID NO: 35949 - DNA, 101 bp, rice(Oryza sativa)
  misc_feature (71): n=a or c
acgacatgagctatttcttttgggattagcattccgacaaaaatttggggatgaaatcaccagattttggnctcgacacatcatcgtgctgggcatgacct

SEQ ID NO: 35950 - DNA, 101 bp, rice(Oryza sativa)
  misc_feature (71): n=a or c
tgacaaaaattatatgccgtaatttcttttcttgtactcatactgtatgtttccttttttagatggatggngaaagaaatcctaatattctgggcacaccg

SEQ ID NO: 35951 - DNA, 101 bp, rice(Oryza sativa)
  misc_feature (71): n=t or c
aactataatgcatatgagacacatgtgccaactattatcatctgggtatttcaacagccatcgttctcatngttagatatgctagcacatcacaagttgct

SEQ ID NO: 35952 - DNA, 101 bp, rice(Oryza sativa)
  misc_feature (71): n=a or g
gtgcaactcctcggcaccacagccaccaactttaataacctaatttggaagacctgggcgccacgaaaacncaaaaccttcgcatggctaatcatccaaac

SEQ ID NO: 35953 - DNA, 101 bp, rice(Oryza sativa)
  misc_feature (71): n=t or g
gcgatggaacaaaaacagggtcgcgatatgatctttggtgtccaccgcatctaatatgatatcggccgcanggcatggaatcaatcgggcgaacgcgtgcg

SEQ ID NO: 35954 - DNA, 101 bp, rice(Oryza sativa)
  misc_feature (71): n=a or c
atatgcctatattttcaacagttcttcggttaatttccgcacaagtgcacaacctgccagctgaatttggnagacaattaacgaacacgacatacggatta

SEQ ID NO: 35955 - DNA, 101 bp, rice(Oryza sativa)
  misc_feature (71): n=t or c
aatctgacggaatcgaagatgcgtcgatccaaatccaatcaggctgccggtgaatcgactgcccttgatcnagatgccgctagtgttgtgggagccgacgg

SEQ ID NO: 35956 - DNA, 101 bp, rice(Oryza sativa)
  misc_feature (71): n=t or c
caccaattatatgccctagatactccaattgttgtttggcaaaggaacacttgctagccttcacaaacagntgatggtgctgtagtatctgaaacacctgt

SEQ ID NO: 35957 - DNA, 101 bp, rice(Oryza sativa)
  misc_feature (71): n=t or c
aagggactaaagtttagtccctgaatacaccactataataagaatagccattatattctaaggaaagttanaacataactagttctatatgcataacactt

SEQ ID NO: 35958 - DNA, 101 bp, rice(Oryza sativa)
  misc_feature (71): n=t or g
cggaacacccttcatcgaactcgttcaactcggtgaataggctcgaagtgctggcaggtaagacaagattncttactcccttgacgaagggaacaagatcc

SEQ ID NO: 35959 - DNA, 101 bp, rice(Oryza sativa)
  misc_feature (71): n=t or g
ttcctgtctctgagaaactgagctactgcatgattggctctactatactcctatgctctagctttggatgntaacaaattatcgtttgatttttgaatcaa

SEQ ID NO: 35960 - DNA, 101 bp, rice(Oryza sativa)
  misc_feature (71): n=t or g
gtacctctatcgttgcgatcattcgggctctctccaaccatctctttgacatatgtatccctgtttttttnggaagagaatggtgtaattttaaaccaaga

SEQ ID NO: 35961 - DNA, 101 bp, rice(Oryza sativa)
  misc_feature (71): n=t or c
catgagcacagagtgatcatttgtgacatgtgagagttgagagcaagaagaagaagagattataagaatgngggttgagcttacgggcggaggaagttctc

SEQ ID NO: 35962 - DNA, 101 bp, rice(Oryza sativa)
  misc_feature (71): n=t or c
cttaacagcgcgttttgagctaactaggaattgacgtgttcgcagccgaatttagcgaaaacgaccacaanaatttcttaaactgattggtaattgtatca

SEQ ID NO: 35963 - DNA, 101 bp, rice(Oryza sativa)
  misc_feature (71): n=t or c
tggagaaaatttaaaagataccatcgtggagatacatgagttgcaaaataccatcgtactccctctgtccnataaaaaatgaatctaggataggatgtgac

SEQ ID NO: 35964 - DNA, 101 bp, rice(Oryza sativa)
  misc_feature (71): n=t or c
cgtatgaagagttgttaggtctgctagcagcagtacgctattacttcaagttaatcactgcatgaatttcngtttatgggaatcttgagatttacaataca

SEQ ID NO: 35965 - DNA, 101 bp, rice(Oryza sativa)
  misc_feature (71): n=t or c
tattttcgcaagtggatgagttatatggtccgcctagaaagacatttttttccgtatgaatgatttagaangcctacatgctataacagttttcgctcaaa

SEQ ID NO: 35966 - DNA, 101 bp, rice(Oryza sativa)
  misc_feature (71): n=a or g
gctatgatttaaattatttttggatgaagagatgtcgatttctattagcaagtttttcagactgttaattngtgttttttctataaaaaatttttatatag

SEQ ID NO: 35967 - DNA, 101 bp, rice(Oryza sativa)
  misc_feature (71): n=t or c
atcaaccacgggcataggcacaaccacttggctatgcatctaaaagaagaaaggcaattactacttccttngtttcacaatataagtcattctagcatttc

SEQ ID NO: 35968 - DNA, 101 bp, rice(Oryza sativa)
  misc_feature (71): n=a or c
ctaaaagaggccattgctgtcgattacaaccgtctgagaagagatcttctgtgcgaatggttgttcaaaantggtactgttaattgttagtccaatatatg

SEQ ID NO: 35969 - DNA, 101 bp, rice(Oryza sativa)
  misc_feature (71): n=t or c
cacatagagctaacgatttgttcgtccacggaagctcctttattggggttgtacttgtgagtctaacgaangagacaatcgtgtggcggcacaaagggcaa

SEQ ID NO: 35970 - DNA, 101 bp, rice(Oryza sativa)
  misc_feature (71): n=t or g
ttatcattgatctgctgctccaagcagcacacgtggtggcacatgatttttaaagaatacgaaatacacanaaattccatatacaagacatcgcatctagt

SEQ ID NO: 35971 - DNA, 101 bp, rice(Oryza sativa)
  misc_feature (71): n=t or c
caaccacgtgtatgtgacgtgaacgctttctgataagcgacatcatacaataagtactgggttagggtttngagggtgagtaagtggaggttggaactggg

SEQ ID NO: 35972 - DNA, 101 bp, rice(Oryza sativa)
  misc_feature (71): n=t or g
cacatccggcgtaattaccttagctaaacatcttgaccaaccacgtaatcactagcttttccctaccacanaaaaaaaaactcataatcctgattgtacga

SEQ ID NO: 35973 - DNA, 101 bp, rice(Oryza sativa)
  misc_feature (71): n=a or g
cctggaccgtcttcagcaaataatcatgggccaaatcaaggaaagccacttgcaaatactaataccacacnaggaatgcggtcgaataattcacaaggtgg

SEQ ID NO: 35974 - DNA, 101 bp, rice(Oryza sativa)
  misc_feature (71): n=a or c
ttggatgcggtgccggattggcacattacaattttattacaacggtgccgtccgtaatagtggagcattangctccccagtatcgtccaagcgaaaagaca

SEQ ID NO: 35975 - DNA, 101 bp, rice(Oryza sativa)
  misc_feature (71): n=t or c
ctatgcagtcgggtacctcgcacccacccatgcctaaacaaaccgatgcaaccaaacaaagtctataaccngaacaccaaatccgacaccaccaatttgat

SEQ ID NO: 35976 - DNA, 101 bp, rice(Oryza sativa)
  misc_feature (71): n=t or c
cgataccctgttctgttatttcaagctggcatccccagctcttttatgcctgttgttttccttttctcgtnttgtaagaacctttgttatgctttattagt

SEQ ID NO: 35977 - DNA, 101 bp, rice(Oryza sativa)
  misc_feature (71): n=a or g
gaggagttgggggaggcaaattagacttgatttgcgggctgagatagtaaatcgactgaaaatggcccatngagaaattgggatttttatttaaataaatg

SEQ ID NO: 35978 - DNA, 101 bp, rice(Oryza sativa)
  misc_feature (71): n=a or g
aaaactaacttgatttgatacatgcacgcgtattacgcgtactctcctttgattctttgacccatatctanctctgcttgcaacctatcaatgcaatgtgc

SEQ ID NO: 35979 - DNA, 101 bp, rice(Oryza sativa)
  misc_feature (71): n=t or g
cgtgtactcactggcggtggtgtagtatgaaaatgaaggcttagctagtccagtaatgttaatctttcttngcatgcaggatgtgccaaaatttctctggt

SEQ ID NO: 35980 - DNA, 101 bp, rice(Oryza sativa)
  misc_feature (71): n=t or c
gggacccatttaaattgcgaacggaccttacctggtcacggtggcgaaaatcattctctatttttatgtgngataccttaagaaaaccacacgcaaaaatc

SEQ ID NO: 35981 - DNA, 101 bp, rice(Oryza sativa)
  misc_feature (71): n=a or g
tcatcaagaattatgttgctcttacaaattgagagctgtagttagtaacatctggaatctcctgaaacgcnccaacacttgcgatgccagcgttgcacaca

SEQ ID NO: 35982 - DNA, 101 bp, rice(Oryza sativa)
  misc_feature (71): n=t or c
atccgttccatctggcccaattagcataggccacatgaacacatgcacaatccatttctccccctggcccncgccactattggttgaaaggaataagtcca

SEQ ID NO: 35983 - DNA, 101 bp, rice(Oryza sativa)
  misc_feature (71): n=a or g
tctacaccgattaattcccttaatctcctcccatctcttcaatctttgagcgatgctctggttctctctantactaccggtattattaggggtaaattagt

SEQ ID NO: 35984 - DNA, 101 bp, rice(Oryza sativa)
  misc_feature (71): n=a or c
tagtgtgtattcatacatatctccaatcaaatgttatttagtttgcctcatcagtgcgctctctctctctntatatatatagagggctgctacaaaacggg

SEQ ID NO: 35985 - DNA, 101 bp, rice(Oryza sativa)
  misc_feature (71): n=a or g
aaatgcatgaagcattgagaattggtaaagcaaacaacaagatgttactagaaggtaaaacctgcgaccgnatactaactcgatctaagggtagaaaaact

SEQ ID NO: 35986 - DNA, 101 bp, rice(Oryza sativa)
  misc_feature (71): n=t or c
tgaggtccacctatcagggatccacgtttttttttactttacttcagaggaatttcgtctgttggcgtccncatgttgcctaatcttagtttcagtccact

SEQ ID NO: 35987 - DNA, 101 bp, rice(Oryza sativa)
  misc_feature (71): n=t or c
tacctttatgatagtagggtggttccccctctcaacatccagaaactctgcgaactcaccaccgccgtgcngcagaagggaaggctcatcggcgtcctcga

SEQ ID NO: 35988 - DNA, 101 bp, rice(Oryza sativa)
  misc_feature (71): n=t or c
tgctcggtttggggcagtgatgctcgctagtcctaccgccgccaacaggtggttccttctccgacctgctngccttcctcttcctcttgccttgcctgcag

SEQ ID NO: 35989 - DNA, 101 bp, rice(Oryza sativa)
  misc_feature (71): n=t or c
tgtaatgatgcgaggaatatatgcttttgtaccttttgcctttcctgtgattatctctccctcgatgacangatttgttagctgtgtgacaatcagcctag

SEQ ID NO: 35990 - DNA, 101 bp, rice(Oryza sativa)
  misc_feature (71): n=t or c
catgccccgaggaaccttctgcttgccatggtttgctctcgatcttcttgtttgcttttcttttttgaaanttttttgtttgctatcactggaattgctaa

SEQ ID NO: 35991 - DNA, 101 bp, rice(Oryza sativa)
  misc_feature (71): n=a or g
tgttcgtggaaattctggctctaaggagaaccttttcctgaattgttagcccctggctataaaccagctancgcaagtatctgtttttgaccaatttcaac

SEQ ID NO: 35992 - DNA, 101 bp, rice(Oryza sativa)
  misc_feature (71): n=a or g
ttctccctcaaatgaagagagcgaaggatgcggggaagggatttcaaaaaaaaaaatcagatatgagaccngttggagcctttttttaccaaaatcctaaa

SEQ ID NO: 35993 - DNA, 101 bp, rice(Oryza sativa)
  misc_feature (71): n=a or g
gtggtgatgttgactgcatagagtggtggcgatgaccttgcaacggggacggctagaggtgcagcggtgangattgcgcaatggggcggcatggcggaggc

SEQ ID NO: 35994 - DNA, 101 bp, rice(Oryza sativa)
  misc_feature (71): n=t or c
ccagagagagattcctcttcctaccttgaaacagtagcgaatgctcagctcaacagatgagaaattccttntctcgatgcgagctttgacccttcgtcctt

SEQ ID NO: 35995 - DNA, 101 bp, rice(Oryza sativa)
  misc_feature (71): n=a or g
agtgggagactttgttgtagatgaataggagcattaatgggcagtacaatgatgtggtggagggatggatnctgatgtaatatacttgcatgttaaacttt

SEQ ID NO: 35996 - DNA, 101 bp, rice(Oryza sativa)
  misc_feature (71): n=t or g
agaaggacggcagcaatcgtcgtcgagccgcggtcatctcctcccttcatgcgttcccttgtctactcagnatgccggcttcattcctctaagtttcatcc

SEQ ID NO: 35997 - DNA, 101 bp, rice(Oryza sativa)
  misc_feature (71): n=t or c
tatgggtattgatgttggtttttctatagaaccgacatatgtagtcgcttaaaggtgccgtatttttgcanttttagtccacgatggtggaaaaagtctat

SEQ ID NO: 35998 - DNA, 101 bp, rice(Oryza sativa)
  misc_feature (71): n=t or c
cactaatgtccgaaatgattcacttacagacgaatgcagtatatttgagtaacggaatgttgtacatacanaaggatttgctttaaagatatgcaaacatt

SEQ ID NO: 35999 - DNA, 101 bp, rice(Oryza sativa)
  misc_feature (71): n=t or c
catctaaaaaaattcctcaccttaacatatgcctacgctcaaaaaaaaaatcctaactgaaacccgcctangctcactttttgattcatctcaacatattt

SEQ ID NO: 36000 - DNA, 101 bp, rice(Oryza sativa)
  misc_feature (71): n=t or c
cggttacagtggaagtcaaatcagctccgctgattttttttttccgtatatttatcctcatttttgcatgncacttagataggtatcaaaaatttgaaaaa

SEQ ID NO: 36001 - DNA, 101 bp, rice(Oryza sativa)
  misc_feature (71): n=a or c
atgccgctttccagaagacccaagtgtggccaccaaacgtagcacacaaaaagttggcatctttgcacatnttccaatagctaagcacttgattagcaact

SEQ ID NO: 36002 - DNA, 101 bp, rice(Oryza sativa)
  misc_feature (71): n=t or c
cttcactacattcgtctccattatcctctgtgtgggaaatctcgtgtcctccatcattatcattttgctcngactctactttaggagagtcaggatctgga

SEQ ID NO: 36003 - DNA, 101 bp, rice(Oryza sativa)
  misc_feature (71): n=a or g
tgacttaatatccccttggatttaattcattgttttatgaatctgtacatgttgagttttgctccattttntccaaactggtttcatgcaacacgtacgta

SEQ ID NO: 36004 - DNA, 101 bp, rice(Oryza sativa)
  misc_feature (71): n=a or c
cttttgcttgtaagtttgttattagcttagctattgtcgggaaaggaatggagacgagacatgaatcttgncgttctgtggaaattctgccacatcccaac

SEQ ID NO: 36005 - DNA, 101 bp, rice(Oryza sativa)
  misc_feature (71): n=t or c
aggtttggtttctttagaaggaggaagtaactctctatttggtatcaagatcgtgaacccgcaactgagtnggtcgattgcttggtgagttgatcttatcg

SEQ ID NO: 36006 - DNA, 101 bp, rice(Oryza sativa)
  misc_feature (71): n=a or c
caagacacttgccaacacgaaaaatccgatccaactccaacgggtaaaggtaaaaagatcaatctccctanacaattaagaagcattgaggtgattgcatg

SEQ ID NO: 36007 - DNA, 101 bp, rice(Oryza sativa)
  misc_feature (71): n=a or g
tatcaggaggctaggagaagtcgagaagagctcagatctctgaaaaaaatctggatctccccagtctaatnttgcattgcacatccaaaattttaaaaatt

SEQ ID NO: 36008 - DNA, 101 bp, rice(Oryza sativa)
  misc_feature (71): n=a or g
tttcgcctgagacatttaacctggataacaaagctaggaattttgtgccgagttttgggtctattttcgcnaaaggtttttcttaattgtatttgtaaagt

SEQ ID NO: 36009 - DNA, 101 bp, rice(Oryza sativa)
  misc_feature (71): n=t or c
ggttcagcaactgtagacttgcatgcaaattgtgccatactcacaggcttcttccagtgctggttaaattntggcaaagcagttgtcaatgtttcagctca

SEQ ID NO: 36010 - DNA, 101 bp, rice(Oryza sativa)
  misc_feature (71): n=t or g
aataggcggttgagacactcctcgacatggcaaagcttttgacacaagtggcatggggcggcggtgagcantggacagaggatggcaacaagcgacggagc

SEQ ID NO: 36011 - DNA, 101 bp, rice(Oryza sativa)
  misc_feature (71): n=t or c
cttgtatgcattgcatttgcaacaaatagttctggtcatagtgaacctcgttgttctagccttgattaganaacaacgcaagagatgcatttttaaattgt

SEQ ID NO: 36012 - DNA, 101 bp, rice(Oryza sativa)
  misc_feature (71): n=a or g
aaaaaataaaaatccataatagtatgtgcaatggaacttcatctgttgatattgttgatcacatttacgcncgcacacacacacacacacactggtgtgct

SEQ ID NO: 36013 - DNA, 101 bp, rice(Oryza sativa)
  misc_feature (71): n=a or g
gcctccccggcacaaccttctgcgacaattccaaggaggccttcatcatcaagacctggatactcaggatngacgacgacgacgacatggtttggacgatg

SEQ ID NO: 36014 - DNA, 101 bp, rice(Oryza sativa)
  misc_feature (71): n=a or c
acgaatatgatgagttgtagtagcggcaatccataatgaaggaggaaaccgcaagggaagcagaggagganggaaacctttgagcacgtaggcctggagca

SEQ ID NO: 36015 - DNA, 101 bp, rice(Oryza sativa)
  misc_feature (71): n=a or g
gggccagtgccacatattaacttcttggaagaagctccgattgagtggttcatgcacaataaaaagttgtntggtacagtcaaagctttacccccttgcga

SEQ ID NO: 36016 - DNA, 101 bp, rice(Oryza sativa)
  misc_feature (71): n=a or g
atcggcaggtcgcggtcgcagccatttatgatcgagtagctgcgaaaacgtgaggcagggacacacgtacntacaggcgcgcgcgccaaccacctcccaaa

SEQ ID NO: 36017 - DNA, 101 bp, rice(Oryza sativa)
  misc_feature (71): n=a or c
tttataggacaagagcatgtggtgatgtacagagagccatcatagagatggagggatttttgtttctgaancttatgcatgaattgatctagtcaacatct

SEQ ID NO: 36018 - DNA, 101 bp, rice(Oryza sativa)
  misc_feature (71): n=t or g
attagattttgattgatcatgcaagaagaggctatacaacgctatagctggatagtactgggtgttggctnatggccttcaggtggtggcctggcaatgcc

SEQ ID NO: 36019 - DNA, 101 bp, rice(Oryza sativa)
  misc_feature (71): n=t or c
tttagattttgaaatattcaaataaagtcttaaggatgtcaattgctacctggattatacttgaaatgctntctccctggagagagagagaataatatccc

SEQ ID NO: 36020 - DNA, 101 bp, rice(Oryza sativa)
  misc_feature (71): n=a or g
aacaggtactaataaaaattgagatggtagccattcaaaaggggattatttgtttttgcctaatgagcacngaaatccaagtgtagaaagttttctccaac

SEQ ID NO: 36021 - DNA, 101 bp, rice(Oryza sativa)
  misc_feature (71): n=a or c
tatattcgtgattagttttgctaaacatataactccacattgcttccactctttccctatgtaattagctntctctcttatatgtgggtatgcttctatat

SEQ ID NO: 36022 - DNA, 101 bp, rice(Oryza sativa)
  misc_feature (71): n=a or c
caggagctcaatgccgtacaatgagagatattgaacatcattttctagattcaagggaaaaagggggaccngatggaattagaatgctgagtgtgctagaa

SEQ ID NO: 36023 - DNA, 101 bp, rice(Oryza sativa)
  misc_feature (71): n=t or c
cactaggcatctaacttattccacaggcacgacattgtgctaagttcgtatccctaaaagtcttcatagtnggcttgcttggcttaacaatgagggtatgg

SEQ ID NO: 36024 - DNA, 101 bp, rice(Oryza sativa)
  misc_feature (71): n=a or g
gtggtctaggataaccgttgtaggctggagtatctcttccaacttactctagattttgaggagtccatctngagtgtccgccattaagagatgagttttcc

SEQ ID NO: 36025 - DNA, 101 bp, rice(Oryza sativa)
  misc_feature (71): n=t or c
gctgcgttgtccctattcgattggtgcgattagatcagggaggagattgggtcatcttttagtcaaactancgcactaatatgttggaagcttagtgatgc

SEQ ID NO: 36026 - DNA, 101 bp, rice(Oryza sativa)
  misc_feature (71): n=a or c
gagtacatctgtcagaagtagatcgagttaattaaaggagcttaatggtagtctacgtggcacagttggcngcgccagcaagtgcacgaagatgaaagtga

SEQ ID NO: 36027 - DNA, 101 bp, rice(Oryza sativa)
  misc_feature (71): n=t or c
ggattggcggaattttccagaaggcgttttaagacgaggcgggcggaggatggtactggagggtaactggngggagggggagggatgacggatgatgagtt

SEQ ID NO: 36028 - DNA, 101 bp, rice(Oryza sativa)
  misc_feature (71): n=a or c
acacgtacatgcccatatgcatatgtttatacgcagtgactgggcctaccaccagtactagaatagattanaggaatcggcaatcatccaggttataggcc

SEQ ID NO: 36029 - DNA, 101 bp, rice(Oryza sativa)
  misc_feature (71): n=a or g
ggatacaaggtgacatatgtggacctatctagcccctgtcgggacagtttaggtattttatggttcatatntatgcttcttctaggtggagccatgtggtc

SEQ ID NO: 36030 - DNA, 101 bp, rice(Oryza sativa)
  misc_feature (71): n=t or c
atactgatggcttgtggccagcaatgcgaaacctatcttcctctttccagtcagaatctgtggttaccccnggtaataaaaaggataaggtagtccccagt

SEQ ID NO: 36031 - DNA, 101 bp, rice(Oryza sativa)
  misc_feature (71): n=t or c
ggtggctttgcgtgagttttcatgaaatttggtattcgatctttgctatcaatgaagtgtacttctcttanggaaaattattttaaactctcgaggggaca

SEQ ID NO: 36032 - DNA, 101 bp, rice(Oryza sativa)
  misc_feature (71): n=a or g
tgtacgcgttgtcatattatatttttttttcttatatggaggagtaaggaggggagagagaagcaaaacanactacagatttataaccagctatatttgag

SEQ ID NO: 36033 - DNA, 101 bp, rice(Oryza sativa)
  misc_feature (71): n=t or c
tgctagctagctgctactgctttgccttgctgttgctgctgtgggctgtgcatgcatgcatgggctggctngctgctgcttgctacttgctgggctgcatg

SEQ ID NO: 36034 - DNA, 101 bp, rice(Oryza sativa)
  misc_feature (71): n=t or c
atcaaggacgtgggttttgtttttccgaagaacacatcattaatggtaaaatccatcagagctaagctcangacctgtgacgggttagaactggtttgtga

SEQ ID NO: 36035 - DNA, 101 bp, rice(Oryza sativa)
  misc_feature (71): n=t or c
cggccatgtgcacacttgtaaatcagttagatgattttcacagcgagctacatgtcgtctactctgaattngttttgttatgttttttggtaaaatgttac

SEQ ID NO: 36036 - DNA, 101 bp, rice(Oryza sativa)
  misc_feature (71): n=t or c
acataatgaaaacagcatacatttatcagtttgcgggctttggagacaactggaaatataaagtcctcaantttgttaacatgatatatacagaattatta

SEQ ID NO: 36037 - DNA, 101 bp, rice(Oryza sativa)
  misc_feature (71): n=t or g
gttcgatctatccatcacgtcatcattgcatcatctttatcttcagacttcactagtgtgctgtagctagngctgtgtttagttccttccaaaattagaag

SEQ ID NO: 36038 - DNA, 101 bp, rice(Oryza sativa)
  misc_feature (71): n=t or c
gtctctgatgttgtctcccaagatatctgcgaggtttcttaacaagaagggatgcttcgatatcttgtacngcagtgctttgccgatttccccttcaatgc

SEQ ID NO: 36039 - DNA, 101 bp, rice(Oryza sativa)
  misc_feature (71): n=t or g
ccgtcatgcaagcatccaccggctcgaaccactcgataagctgacagccaattttgttaagaaattgcttnactgcgtctgcctccaccgcatgcgccgga

SEQ ID NO: 36040 - DNA, 101 bp, rice(Oryza sativa)
  misc_feature (71): n=a or g
taatggcggctcgcttctctacctttcttcatggctactactggtagtagtaggcagtattagtccctccntccaaaaaaaaaaaaagtaaatctagaact

SEQ ID NO: 36041 - DNA, 101 bp, rice(Oryza sativa)
  misc_feature (71): n=t or c
taatgtcgtgaagaaataccaacagtagccgatgttcaacaaccgatcgctatgtcctggcatttcataanactcccaagcaaagcaatctctgaattcct

SEQ ID NO: 36042 - DNA, 101 bp, rice(Oryza sativa)
  misc_feature (71): n=t or c
tccaacatattcacaatcttaatgaagctatggacgaaagtacaatacctgtgacaattcgacgtgggccnagttcctttacaccatccaaaagcctcgaa

SEQ ID NO: 36043 - DNA, 101 bp, rice(Oryza sativa)
  misc_feature (71): n=a or g
tatcaaccggtcaatcaccaaggacaaatgcacgatccaggtgttacgcaccgatggggacaacgggagcnactcctcaggccgcaacgccactgctgcct

SEQ ID NO: 36044 - DNA, 101 bp, rice(Oryza sativa)
  misc_feature (71): n=a or g
cagcaccacgccaccaagtcttgtttccgccgagatgagtggcataactcctggcagacgaccgcgagggntggccgcctttggctgtggcaggcaactca

SEQ ID NO: 36045 - DNA, 101 bp, rice(Oryza sativa)
  misc_feature (71): n=a or g
gaaagcctaaccaattactacaccacgtaggagtactcaccaactaacaccaataattagcacccaattantaatcgtcccttcttttcacaaaactttat

SEQ ID NO: 36046 - DNA, 101 bp, rice(Oryza sativa)
  misc_feature (71): n=a or c
caagtaaccacagtaggatacagtattttttttttctcaatccacccacctatctaattcctactccctcnggttccatattaattaacgttttagagaaa

SEQ ID NO: 36047 - DNA, 101 bp, rice(Oryza sativa)
  misc_feature (71): n=a or g
cttgttttatttgtgatcaaaatatactggtatttatgaactgcatatgctccggttcgaagtatttttcnccggttcaattcaaccggtccaaaactatt

SEQ ID NO: 36048 - DNA, 101 bp, rice(Oryza sativa)
  misc_feature (71): n=a or c
tatcgatcagcctccaccaaatgtcagcaaaagcggtcagctgattgtatatgcagctgtcaaaacccttntggataatgagttgattctggctccataaa

SEQ ID NO: 36049 - DNA, 101 bp, rice(Oryza sativa)
  misc_feature (71): n=a or g
gagttcaacgttgacgatgaacctgccgcagcggtatctgtagaagtaggagcaggagctgctgctgatgntgggcacggcgatggcgagcttggaggctt

SEQ ID NO: 36050 - DNA, 101 bp, rice(Oryza sativa)
  misc_feature (71): n=a or c
gtggtggggtgtgttggtggtggtcgatgagcgccagtgttggtgggcctcagcaattgcatgacgacaangtccgctatggcggttgcgatggagggtgc

SEQ ID NO: 36051 - DNA, 101 bp, rice(Oryza sativa)
  misc_feature (71): n=t or g
tacgtggacacgcacgttcgtacgtatgatgaggacatgcgtacgcaacgcagtcgagttccagtaagtanacttgagttgagagctagctagcttaatta

SEQ ID NO: 36052 - DNA, 101 bp, rice(Oryza sativa)
  misc_feature (71): n=a or g
tgtacaagccctgcctaccatatgtatgcatgcatatcgaagtcccaatgcctcctaagccctaaaaagcncacgcataatttgcgacatatgtatcggtg

SEQ ID NO: 36053 - DNA, 101 bp, rice(Oryza sativa)
  misc_feature (71): n=a or g
aaatggcatacagagtatacacgcgatctcacctttgattgttgaacgagaacaagctctgtagcaacggnttgattttccgagaaagaaattgccataac

SEQ ID NO: 36054 - DNA, 101 bp, rice(Oryza sativa)
  misc_feature (71): n=a or g
tcaggccgttagatattcctgattttccaagtgaaactccaccaaacctaaggactaagctaccacaacgnccactatctgctggtagagcacgcccagga

SEQ ID NO: 36055 - DNA, 101 bp, rice(Oryza sativa)
  misc_feature (71): n=a or g
ccaaagcagcagtcgaaagcgagaaaaaaagcttaagaaagaaagaaagctagcttcagtgagagtgagantgtggggggagatagagagagagagagaga

SEQ ID NO: 36056 - DNA, 101 bp, rice(Oryza sativa)
  misc_feature (71): n=t or c
aatccccaagtaatctcatgcacagaggaggtgatacattattaaactgtgtgaaatcagaagatcaaaantaatttcattaatgagatatgaaattgaga

SEQ ID NO: 36057 - DNA, 101 bp, rice(Oryza sativa)
  misc_feature (71): n=a or g
atgtaagaacatacgaacaagtagaccaaggatttttgcaacgtttctttgagagtttatttagggacctnaaacaatttactgttatgtggattgaatat

SEQ ID NO: 36058 - DNA, 101 bp, rice(Oryza sativa)
  misc_feature (71): n=t or c
tgtcccattaaaacttgtctttttctcaatttctacatccaaacaaaacccctaaaatctgtgctctattngcatcaacaaaaaaaaaaacaaaaccccac

SEQ ID NO: 36059 - DNA, 101 bp, rice(Oryza sativa)
  misc_feature (71): n=t or c
gtagttggtatagtactgttattacatctgaacaccgtaaaattttggcaaggtttctgcaggctaatggnttggcggctgggctcgcagcttctaatctt

SEQ ID NO: 36060 - DNA, 101 bp, rice(Oryza sativa)
  misc_feature (71): n=a or g
aaatgaatcaaaagggagatggatggttagagagagaaagtgtgtaactcaagagcttgaattcggattcnagaaccgaattttgggacgtttatttggta

SEQ ID NO: 36061 - DNA, 101 bp, rice(Oryza sativa)
  misc_feature (71): n=a or g
aatatgaaaaggaggtagtacccctttaaaaatggtaaatttgtaagcacagaactaagcagagtactgtnataattgccaaatgcaatataaattccctg

SEQ ID NO: 36062 - DNA, 101 bp, rice(Oryza sativa)
  misc_feature (71): n=a or g
actagtcactgggctcaaactttatcaggcctttcctttcggccttccaagggttaataggctcaaaccanaactgttgggccgtgtaaactaataacaac

SEQ ID NO: 36063 - DNA, 101 bp, rice(Oryza sativa)
  misc_feature (71): n=a or g
atttgatcacgtgggcttgaagagtgattaaggataaagtactgaacgtgctagcgtatggatacccggtncgaggatggaattgaaggaggacgattgcg

SEQ ID NO: 36064 - DNA, 101 bp, rice(Oryza sativa)
  misc_feature (71): n=t or c
tgcttgtggccagagctcacagcttttgtctcttagttgtcagctcagctcgggttatggctttctttctntctctttcttggcgccgccattgatgatgg

SEQ ID NO: 36065 - DNA, 101 bp, rice(Oryza sativa)
  misc_feature (71): n=t or c
ttgattgatctctcctgcattgcttcctttattttcttgctcatactcgctgcttctgttctctcgaggancaggcttttggcttttatgtggctaatgac

SEQ ID NO: 36066 - DNA, 101 bp, rice(Oryza sativa)
  misc_feature (71): n=a or g
ggttttgatcgttatttccattgccggacacttcgttgctaagaagctacctggtaaataatgtaaaaatnattattttaaaaattcaaacttcaaaatct

SEQ ID NO: 36067 - DNA, 101 bp, rice(Oryza sativa)
  misc_feature (71): n=t or c
tgaggcatgcgacgtggtggtggggtgctcggcaccaacaaggtctacttcctcattgaggagcaacatgnaggtggctacatcttcggcatggagcggca

SEQ ID NO: 36068 - DNA, 101 bp, rice(Oryza sativa)
  misc_feature (71): n=t or c
ttgttgtagttgccaccgttggtgttgatgttctccgctccatcggtgccacctttctcgccattggttgntattgtggatgcagtccttgctctcactga

SEQ ID NO: 36069 - DNA, 101 bp, rice(Oryza sativa)
  misc_feature (71): n=t or c
tatatggtgaatcttcgaccatgcctactcctttgatccaaggcggatatacaaatcttttatttgaagtncaacaagattgcacattttcctcgtctgct

SEQ ID NO: 36070 - DNA, 101 bp, rice(Oryza sativa)
  misc_feature (71): n=a or g
cgatagagccgtattttttttaagataatgagcagcttcgggcatgtgcattacaaggtgaatgcacaccncaagtggggccttatatgtctgcatatgca

SEQ ID NO: 36071 - DNA, 101 bp, rice(Oryza sativa)
  misc_feature (71): n=a or g
cgacgtacttaagatcatttatatttatagtttgagaagagagtttgggtggttcaaggtagtccaaagtnaaacaaatgcaagtttacccaatcaaaagc

SEQ ID NO: 36072 - DNA, 101 bp, rice(Oryza sativa)
  misc_feature (71): n=t or c
agagactcttctgtaatggcctgcaacaacaacagacatcaaaagttaatcagtacagtacatctggattnatccacaggattttattttttatgggacgg

SEQ ID NO: 36073 - DNA, 101 bp, rice(Oryza sativa)
  misc_feature (71): n=t or c
gatcaggtcgtcgatcaggacatggagaaaacgataagcagtttactgattcttataactaaagagtgaantgatgtttggccacatttcattatcaatgt

SEQ ID NO: 36074 - DNA, 101 bp, rice(Oryza sativa)
  misc_feature (71): n=a or g
agtccacattgagtcccttaatataggctgaattcgattcgtaccactaaatcacaaaaccgggtataatnactctcctaattattaaaaccagtgcaaag

SEQ ID NO: 36075 - DNA, 101 bp, rice(Oryza sativa)
  misc_feature (71): n=a or g
acttcactagccatatcatatcccgaccagactagatagcgaggactagacaagtatcttcaagccagccntttgtcaattctatgatttgtcattatttt

SEQ ID NO: 36076 - DNA, 101 bp, rice(Oryza sativa)
  misc_feature (71): n=a or c
gtcaaatcccgtacccccaatccccaggggaaaaaaatagagtacagtcaaattccacattcatttcctcntttttcccttccagtattcctaattacaaa

SEQ ID NO: 36077 - DNA, 101 bp, rice(Oryza sativa)
  misc_feature (71): n=a or g
ccgttagccaccactcttctatccacctgttgctggatgccttggaggattgtgttgcgtgtccaggttcntagctaggattgggtttttttttggacgga

SEQ ID NO: 36078 - DNA, 101 bp, rice(Oryza sativa)
  misc_feature (71): n=t or c
cagatggataagaaagcgaatgtttcaggtaggctagcaaagtagcaacaactccataacgatgaacttantggaatggtcaatggacttgacaaatgcag

SEQ ID NO: 36079 - DNA, 101 bp, rice(Oryza sativa)
  misc_feature (71): n=a or g
agactctggagatttcttatgtgagcatgaatcctgaggaatttcgaaaaagaaactttcatgctcatttntggagtgctttctctcgtcctccagagttg

SEQ ID NO: 36080 - DNA, 101 bp, rice(Oryza sativa)
  misc_feature (71): n=t or c
tgctaagtccatgcggcctgcaggatgttagagacagtaaaaggaattcaagtgggctgacccgcaaattnatttatatgtcaaataagtaaccgatgagt

SEQ ID NO: 36081 - DNA, 101 bp, rice(Oryza sativa)
  misc_feature (71): n=t or c
aatacgataccttggaaatacttccgggtgaaatgctatagcgttatattcgtgtgcttgcggattatatntgtaaccgtaaagaataccgagtaatattt

SEQ ID NO: 36082 - DNA, 101 bp, rice(Oryza sativa)
  misc_feature (71): n=a or c
ggaatgtgtacagctcaagatatataaaattgcatcctagtttgctggacatggcagtggccatgagcctntcctaagataagatatcaaccaaatctcct

SEQ ID NO: 36083 - DNA, 101 bp, rice(Oryza sativa)
  misc_feature (71): n=t or c
atattcgtgcttcggccacttagctttttctctttcaacttcggcgatcagttctcctcaagctcgatagngactggcggtggctcgaggggtaggggtgg

SEQ ID NO: 36084 - DNA, 101 bp, rice(Oryza sativa)
  misc_feature (71): n=a or g
agaacttcagttaaacggctgcttcaatagagtacagcattctgtagttgctttcaggtagtactagtagntagtagagtgctcaatagtggtggccgcga

SEQ ID NO: 36085 - DNA, 101 bp, rice(Oryza sativa)
  misc_feature (71): n=t or g
aagtacaaatttcttgtattgcgcaggaaataataaatcatatgtaacataattggacctgtcgtgtgtcntaaacaaagaatgaatgttaaggcacagtg

SEQ ID NO: 36086 - DNA, 101 bp, rice(Oryza sativa)
  misc_feature (71): n=a or c
tggcatgcaccttaatgatgtggcttgcaattcgctgcaattggaagtttatttagtctctgaagcacatnaatgagctggacaaagaataatgcgtcata

SEQ ID NO: 36087 - DNA, 101 bp, rice(Oryza sativa)
  misc_feature (71): n=t or c
cccctgtttgtggagatcttgctgtatcactatcccaagcaggccctcagtttacccaagtaagcttaatntgtgctcataatcatccttttgttctcttt

SEQ ID NO: 36088 - DNA, 101 bp, rice(Oryza sativa)
  misc_feature (71): n=a or g
gaacggtttaaatttgaaactgtttataagcaagtgaattaaggttccgtcgatcgcttagagctgttttngattggaagattcttataagttctttttaa

SEQ ID NO: 36089 - DNA, 101 bp, rice(Oryza sativa)
  misc_feature (71): n=a or g
ccaatttgagttaagttgggaagtactccctttgtcacaattttatttaagtgcagttctggattttcgtntccaacgtttgaccgttcgttttatttaat

SEQ ID NO: 36090 - DNA, 101 bp, rice(Oryza sativa)
  misc_feature (71): n=t or g
caattgggaggaggtgcttcgggcgacatgatctacatgcaccatggaggagaactagatgagatgaaatntattagagtttgtgtcgaatatgtatgcgt

SEQ ID NO: 36091 - DNA, 101 bp, rice(Oryza sativa)
  misc_feature (71): n=t or c
ttgttcttcacgttgctcatcatctgttcaagctcatccctttgctcagctgtcagcctatccaatgtaantggaacaatgttggaagggtccacttcagc

SEQ ID NO: 36092 - DNA, 101 bp, rice(Oryza sativa)
  misc_feature (71): n=a or g
gctttcgagagagatgctaccattgccagtgttcctttttccgtagaatgctgcgccttttgtgtttactntaaggggtagtatataatttcttgttggaa

SEQ ID NO: 36093 - DNA, 101 bp, rice(Oryza sativa)
  misc_feature (71): n=a or g
cctttgctgtaagaagtctgcgacccgtcatcttccacaaggaacctaatggatttgtgccagaagaggcnccctttgaccgcttcttctttgaggacgtt

SEQ ID NO: 36094 - DNA, 101 bp, rice(Oryza sativa)
  misc_feature (71): n=a or g
ggtcgatgctgatgagtgccttgcagaggaagcggaagatgcactactggagcgggataaggtagctggtngaggccggctgggtcagtcgccttgtcttc

SEQ ID NO: 36095 - DNA, 101 bp, rice(Oryza sativa)
  misc_feature (71): n=a or g
tgtgactcctaaatctcaccgctggctgtgactcctaaatccttcttaccatttcaatcaatctcatgccnccgtccggccgtgaccctctttcatacagt

SEQ ID NO: 36096 - DNA, 101 bp, rice(Oryza sativa)
  misc_feature (71): n=t or c
aacaaggtagttgccaaaatatttatgaattagtactatcaatgtatgtcctggattggaccaatatggcngtgtttagttcgtgtaccaaatttttttta

SEQ ID NO: 36097 - DNA, 101 bp, rice(Oryza sativa)
  misc_feature (71): n=t or c
gccacggtcaacgcagtcaaccggacgccccatctctccccccactgtacggccggtcacatatcataacnagttctccatccgtttcgaaatgtttgacg

SEQ ID NO: 36098 - DNA, 101 bp, rice(Oryza sativa)
  misc_feature (71): n=t or g
tctctgttattagtatcatctcagggagccctggtttagagtgtgcacaaccacaatatcaataaaaaaanatttgttatccttcaaagtcaacagataat

SEQ ID NO: 36099 - DNA, 101 bp, rice(Oryza sativa)
  misc_feature (71): n=a or c
ctgttctatctttagatgttttccttgttcaggtatgacatccagccccaagccccttatttatttaactnctaggcattctattcctagtttccattaat

SEQ ID NO: 36100 - DNA, 101 bp, rice(Oryza sativa)
  misc_feature (71): n=a or c
tccatcgattctacatccccgccgattgctatcgatggaagagaggaaaaataaagaattaaagtacaatntggacgaacctcaaagacaaagaatccgat

SEQ ID NO: 36101 - DNA, 101 bp, rice(Oryza sativa)
  misc_feature (71): n=t or g
caatgccagcagtagagggcgacggcggctgcagggacatattatcaaatctcccgtgtagtttataactngagaggtgtcgaaacatgatttcggcaata

SEQ ID NO: 36102 - DNA, 101 bp, rice(Oryza sativa)
  misc_feature (71): n=a or g
acgttcctaaatcaccacgtggcattttttaatcacaccgtcaattttacgaaggtaaaaaaaaaaaaacncagtacgtactccttccaccctccgaatct

SEQ ID NO: 36103 - DNA, 101 bp, rice(Oryza sativa)
  misc_feature (71): n=a or g
tcgtcaggaagatgcatcgtccatgaagtatcgattttgttgatcaacatggcaacatcttaacggccgcntgtgcatgatcatgatgaaaagcgactgga

SEQ ID NO: 36104 - DNA, 101 bp, rice(Oryza sativa)
  misc_feature (71): n=a or g
catggaagctgtaagcacagaagggtggagatatccggtggctggacttactatggcgtgcggcaagcggngcacttgtacttggacggcgcctccttgca

SEQ ID NO: 36105 - DNA, 101 bp, rice(Oryza sativa)
  misc_feature (71): n=t or c
tctccgtgcatgtgcagcgatagtaacgtttctcttgccagatttttccattcactaggcatgtcttgtgnacatagttgttaggtcgagatgctctacag

SEQ ID NO: 36106 - DNA, 101 bp, rice(Oryza sativa)
  misc_feature (71): n=a or g
acaaggcaaggacggagttcaaagccagatgggttttgaaaaggtagtggctcaaagaattcgccctttgnagcggaatgattttgaatatatatgttgct

SEQ ID NO: 36107 - DNA, 101 bp, rice(Oryza sativa)
  misc_feature (71): n=a or g
tcaaaaaaggaggctacaatgtattcgagccaaagattaaatgaagacaaaagccgaagacgtgaggaacnaaacgtacaacaattaaagcctcaaaaaat

SEQ ID NO: 36108 - DNA, 101 bp, rice(Oryza sativa)
  misc_feature (71): n=a or g
ggttagtagattgcacatggcggcaatgccatttgccgccattgaaggtccacagcaagataaggttactntcttttcagaaatagtttttcactaacact

SEQ ID NO: 36109 - DNA, 101 bp, rice(Oryza sativa)
  misc_feature (71): n=t or c
agtaacggccccatccaagaaaaagtgataatactaaagaatccagcatctgtgaaagctgatctactgcntgtggccttagacgaggaagaagctgcacg

SEQ ID NO: 36110 - DNA, 101 bp, rice(Oryza sativa)
  misc_feature (71): n=t or c
tatggttctatgctcaatcatatgtaccatgacccagcatggctctttgtatgtgatatggttgccctaangcaagtattactttgtatgagagttttcct

SEQ ID NO: 36111 - DNA, 101 bp, rice(Oryza sativa)
  misc_feature (71): n=a or c
acgaaacatatagaacccctaaaagttgggcatgtttaggtagcttatggtggctgcaactgtagctattngtagaatctctagctccctaaaagtcagat

SEQ ID NO: 36112 - DNA, 101 bp, rice(Oryza sativa)
  misc_feature (71): n=a or g
ttgcgcgagggggacgggaagggaaaacgcaatgatttacacggagagcggaagcaaagcaagatgacgcncgcgcgcgggggcacgggcacgcacgcggg

SEQ ID NO: 36113 - DNA, 101 bp, rice(Oryza sativa)
  misc_feature (71): n=a or g
atgaatctgggatgtacattttcaggtgagatgttccatgtatgttgcagtttccactacatattctctcntgtatatatgcacctttgttagccaaaaac

SEQ ID NO: 36114 - DNA, 101 bp, rice(Oryza sativa)
  misc_feature (71): n=a or g
ccttttggtgtcaacgaggttgggcgacggcatggtggggggtcgtgatggagaaagtgctaacctggttnccgggcgatctcgtcgaagggaggagggtg

SEQ ID NO: 36115 - DNA, 101 bp, rice(Oryza sativa)
  misc_feature (71): n=t or c
aaaactttccggaaacgaatttgaaacagtaagctggttttcaagccgtttttcaccctacccgtgtgcangtgtgctcattgctctttgtggcagtggcg

SEQ ID NO: 36116 - DNA, 101 bp, rice(Oryza sativa)
  misc_feature (71): n=t or g
accacacatgcaccagcccatgcctgttgccagtatagatctcattcctgtcctcgtcataaaaaagcgcngtgacatcttcaagagcttctggaatggtg

SEQ ID NO: 36117 - DNA, 101 bp, rice(Oryza sativa)
  misc_feature (71): n=t or c
acaaattttaaccctcaaattcatcccagatcttagcaataataaaaaaaaaagaatccagaccactctgncgttgtcccgacatcgttgtcgtcgcacgg

SEQ ID NO: 36118 - DNA, 101 bp, rice(Oryza sativa)
  misc_feature (71): n=t or g
ggcgagcaagacggcgatgatctgaaacctcgccttcagtttctccttcatggtgatcaaacctatagctncctgagagagagagagagaaattacaggga

SEQ ID NO: 36119 - DNA, 101 bp, rice(Oryza sativa)
  misc_feature (71): n=t or c
accaccttttcaaccacaaaaggtaaacggtaagaaaacactacaagcttgtttggcacagctccagcttnctttttctgagttggagtccaatcaaacag

SEQ ID NO: 36120 - DNA, 101 bp, rice(Oryza sativa)
  misc_feature (71): n=t or c
cttgtaggtattggcagctcttaggattaccatgccctcatgctatatcatgcatattctatagaacaaanaagctagatgactatattgcaccttgttac

SEQ ID NO: 36121 - DNA, 101 bp, rice(Oryza sativa)
  misc_feature (71): n=t or c
gcaccacgctgtggttgtgtaagattgggatcacctaaagtttcaatagagattgcaagctacgctactgnacgcaactgcaaccatccattttgatattg

SEQ ID NO: 36122 - DNA, 101 bp, rice(Oryza sativa)
  misc_feature (71): n=a or g
cagatcatcattagatagctggctctagcagtagccggctctagtagtaactttggtttaattttgagttnagtggtgttgaagttgaaggatgtagtatt

SEQ ID NO: 36123 - DNA, 101 bp, rice(Oryza sativa)
  misc_feature (71): n=t or c
aaggtgtggtcggacctggccgagacgttcttccccaacaacccgttccgtgggatcagcgtgctgctccnggccaggcatgcgtggggcgcgctcaagta

SEQ ID NO: 36124 - DNA, 101 bp, rice(Oryza sativa)
  misc_feature (71): n=t or c
cgagcccaaaccaagtctgagctttttatccacccctaactacatatcaggctccgttcatcatttccgcnggagcttacagtggctcgaaaaatggatta

SEQ ID NO: 36125 - DNA, 101 bp, rice(Oryza sativa)
  misc_feature (71): n=a or c
aacatgcaaaaggcttgcgtgtcaatacacatttgaaatacatgcaatctgtggttcttaatggattatanacattgaaatatctgaataatgaacctttg

SEQ ID NO: 36126 - DNA, 101 bp, rice(Oryza sativa)
  misc_feature (71): n=t or c
tctccttccagaaccagcaacaggggaaatcaacaaccaactaaacctagctagcggtcgtcaagctccangccggccggccatgtggtgtggttaatcca

SEQ ID NO: 36127 - DNA, 101 bp, rice(Oryza sativa)
  misc_feature (71): n=t or c
agtcgcaccaagtttggaatgttgaaacagagacagatgtgtatgaggacccatgtcctgccaaaaatgangtggagaacaccccggtcgataacaatggc

SEQ ID NO: 36128 - DNA, 101 bp, rice(Oryza sativa)
  misc_feature (71): n=a or g
aacatagacatggaagataagtttgatgaaattactttgcagggttaccggactttgcaaccagtcctttngatgtcaatgttttcatgcagctccatcca

SEQ ID NO: 36129 - DNA, 101 bp, rice(Oryza sativa)
  misc_feature (71): n=t or c
agacaaccagagctagtactaatactaacaataaagttaaaatatgtgctctagctaggcctaattttttntagagaagggtattttttacccatcctcta

SEQ ID NO: 36130 - DNA, 101 bp, rice(Oryza sativa)
  misc_feature (71): n=t or g
ctctcctctagtttctttcttttgtttcctcacgaccaggagcggatctacagtgttatgacctgtctcanacggcaccgacgtctttcgacaagctatgc

SEQ ID NO: 36131 - DNA, 101 bp, rice(Oryza sativa)
  misc_feature (71): n=a or c
taacaaagccgttgatgaccgatgagaacgtaacaacatttggactgatcgatttctcctccatttccagnaacacctgctctgcctcatcgacgttgtga

SEQ ID NO: 36132 - DNA, 101 bp, rice(Oryza sativa)
  misc_feature (71): n=t or c
tattcgagtgtcccgcagccacgacgagactcatgttgatgtttttgcgatgtgttgtgttactgtttgtncatattcaacctgatattctgtggccgttg

SEQ ID NO: 36133 - DNA, 101 bp, rice(Oryza sativa)
  misc_feature (71): n=a or g
attgggctgtgacaccactgcgtggtgagtgagtctccttagtatcacctcttcccaggggcggatctacngtacagtcatcggtgtcgatatcaggcgac

SEQ ID NO: 36134 - DNA, 101 bp, rice(Oryza sativa)
  misc_feature (71): n=t or c
ataagtgataaccttatccatgccatgcctgataaagggccttttggaggttctagcagccgtagctactnctagaatcaaaaagcttttctaaacaattt

SEQ ID NO: 36135 - DNA, 101 bp, rice(Oryza sativa)
  misc_feature (71): n=a or g
tcttgtactcataacacctgctactgactcattcttgttcctcgctatgctatacaactcaggaaaatgtncagcaatagggtccgcacttggacgctggg

SEQ ID NO: 36136 - DNA, 101 bp, rice(Oryza sativa)
  misc_feature (71): n=t or c
ttttagttgtgcttatgcatcatgcatgataggcagttaggcaccacccagaaagatcgtatgctaatggntaacctggtgatatggttggtaaacacatt

SEQ ID NO: 36137 - DNA, 101 bp, rice(Oryza sativa)
  misc_feature (71): n=t or g
tcttaactactatgcggtgaacataataaagaaagcctctaaatcaagtatcctaatggctctgaagatanctaaagaaaatcacaaaatcaaatatcata

SEQ ID NO: 36138 - DNA, 101 bp, rice(Oryza sativa)
  misc_feature (71): n=a or g
agttttcaagacggttttgtgaggcagtgatggccctctttatctcacttactcttttccaaaggcggttnatcaaaccttctctaatgctagtaaaagat

SEQ ID NO: 36139 - DNA, 101 bp, rice(Oryza sativa)
  misc_feature (71): n=t or c
actatgacggtaggtactggaccatgtggaaactgcccatgtttggatgcaccgatgccacccaagtgctnaaggagctcgaggaggcaaagaaggcatac

SEQ ID NO: 36140 - DNA, 101 bp, rice(Oryza sativa)
  misc_feature (71): n=a or g
tcatccaaccaattttattaagagcgaggtaatacgatgaccctataatggggctcatgttagattccatnatgcaattaggggacatcactagattcagc

SEQ ID NO: 36141 - DNA, 101 bp, rice(Oryza sativa)
  misc_feature (71): n=a or c
ccaagcgtgattctgcccctcttatgagaatcatggtagaacccgatagctcatgggtgatctgctgcatntacaagaagaggcagcgtgccccgcctgtt

SEQ ID NO: 36142 - DNA, 101 bp, rice(Oryza sativa)
  misc_feature (71): n=t or g
caatgtggccggccaggcctctcgcgtaaagcagcgacgcgacgatcgatgaccacaaaacggttcggtcnccttgagcagatcctcctcctccttcctcc

SEQ ID NO: 36143 - DNA, 101 bp, rice(Oryza sativa)
  misc_feature (71): n=t or c
aaatattgatatatatgatcctgctctctttgctgcagggagttgatgatttaagaaagaggtcaataggngagtgacggtcaatatttccatggcaaaaa

SEQ ID NO: 36144 - DNA, 101 bp, rice(Oryza sativa)
  misc_feature (71): n=t or c
tcttgccactttgagttgcacgtgaatgtgacaaataaatcaggagacccataaacacgacataacgccantgcatcttgatagttcatgaccatatacct

SEQ ID NO: 36145 - DNA, 101 bp, rice(Oryza sativa)
  misc_feature (71): n=a or g
caacttttcctggccacaaggaaacaatttggacacttggaagtaaaggccatccatgatcaaattgttcntgagctagcacaaacactacaattatttgt

SEQ ID NO: 36146 - DNA, 101 bp, rice(Oryza sativa)
  misc_feature (71): n=t or c
agtcgatctttataggtggttaggctaggagagttgtctgcaaaaataactatatttttataggcgctcantactacaggaatgatttttcgtacaggagt

SEQ ID NO: 36147 - DNA, 101 bp, rice(Oryza sativa)
  misc_feature (71): n=t or c
aacgatgacaacgcgtttttcccgggttcatccatacagtactacgtatgttacgtttacatcatggcacnatctgagatgatggccttcaattactataa

SEQ ID NO: 36148 - DNA, 101 bp, rice(Oryza sativa)
  misc_feature (71): n=t or c
accgtcgatgtcaccatcgctacccttgttcttcttctcatttctgcagcccatctctttcctccaatgcncttcttttggctcctcaacacccaattcag

SEQ ID NO: 36149 - DNA, 101 bp, rice(Oryza sativa)
  misc_feature (71): n=t or c
cctgaatacaacgaaatgaaacagtgttacagcttgtgtatgtttggtgcaacattggcttctgaatttgngcactgaactcttagcccgaataacgcatt

SEQ ID NO: 36150 - DNA, 101 bp, rice(Oryza sativa)
  misc_feature (71): n=a or g
cgtcggacatgcaatgggacatgggaaacttcgcggagacattgccatcataacgttacaataccgtccgntttcagaatcgcaaagggcgacaacgaacg

SEQ ID NO: 36151 - DNA, 101 bp, rice(Oryza sativa)
  misc_feature (71): n=a or g
aatacgaatttatcggcattaaagcaaaatagaaaacaggatagttggagctgagcatagggaaacttacntttacaatgcgagtagcttggctgagtgcc

SEQ ID NO: 36152 - DNA, 101 bp, rice(Oryza sativa)
  misc_feature (71): n=a or c
tcacactattgattttagctcctgaaaatgccagtctaaaactggagtacgtggggctatgatgacactcntttatttgtctttcacttatttttcttttt

SEQ ID NO: 36153 - DNA, 101 bp, rice(Oryza sativa)
  misc_feature (71): n=a or g
aaataactcagttctaaaaaatacctgacaacacgaagtccaatttatgcgtttttgttatttatttatcngaggggactaccgatcgggcatgacgtcag

SEQ ID NO: 36154 - DNA, 101 bp, rice(Oryza sativa)
  misc_feature (71): n=t or c
cattgtgcgaacatagctctcatcaaagtaacctagtgtgcggagctaatgcacaaggaatcacaatgtgngaacagtttcgtcattatggttgttttgac

SEQ ID NO: 36155 - DNA, 101 bp, rice(Oryza sativa)
  misc_feature (71): n=t or c
tagaactgcctgtggatcctaacgaaccaacatattgcctctgcaaccaagtcagctacggagagatggtngcatgcgacaataatgatgtacgtgtcact

SEQ ID NO: 36156 - DNA, 101 bp, rice(Oryza sativa)
  misc_feature (71): n=a or g
ttgtgagtgtgtgtttggcattaacaaattacgaagaaaacttcattgttttctatgtacgcgcttttctnaattgttaacggtatgtttttttaaaatat

SEQ ID NO: 36157 - DNA, 101 bp, rice(Oryza sativa)
  misc_feature (71): n=t or g
attattatgacaaaatatcctgcaacttgaaataaagatacgacaacgaatatagtagcagttattaaagnagtactccctccatctactcttggtggtca

SEQ ID NO: 36158 - DNA, 101 bp, rice(Oryza sativa)
  misc_feature (71): n=a or g
tctcgtgtcacaatactcctgcagcacggtcttctttgactgaacctcttcttcagttgtgtcactagatngtgcttccctgttgctgttgttgccggtcc

SEQ ID NO: 36159 - DNA, 101 bp, rice(Oryza sativa)
  misc_feature (71): n=t or g
atcatcaaaacaagacaatatagttgcctaacccgaacttaaacttataccttgcgatagactgtacgtcngtccatccttacaagagtgattttttagtt

SEQ ID NO: 36160 - DNA, 101 bp, rice(Oryza sativa)
  misc_feature (71): n=a or g
tatccgtcgacaacactctggtttgaccataggcttctatatggtcttactgacattgatcttgcaaccancacaacttcatcaggtttgagagtaacttt

SEQ ID NO: 36161 - DNA, 101 bp, rice(Oryza sativa)
  misc_feature (71): n=t or c
cctgccgagctgtgggacacgggcgccttggtgtacaccatgtcgtagaggtagttgagctctatctccancacctcgaacgccttgtccgccgtcatgtc

SEQ ID NO: 36162 - DNA, 101 bp, rice(Oryza sativa)
  misc_feature (71): n=a or g
aatctcgattgcaatttgcaagcacgcggcaacgaaccagctcaccctctcgtcggcagctcagatggctnccggaggcttcatcgccggctcgagcctgg

SEQ ID NO: 36163 - DNA, 101 bp, rice(Oryza sativa)
  misc_feature (71): n=t or g
atttcaatcacgtattataccttctttctttgtaagctaccgtgtcgatcttttgcaaagttgcaacaaanatcaacaacaacgtcccgccgcatctcctg

SEQ ID NO: 36164 - DNA, 101 bp, rice(Oryza sativa)
  misc_feature (71): n=a or g
attatgtcatgttagcgtttttgttgcaccggtggctttataataacttcaattaatctggtggcttcatnctctcacactcactactacttattttggct

SEQ ID NO: 36165 - DNA, 101 bp, rice(Oryza sativa)
  misc_feature (71): n=a or c
gatatgatttttgtttgcaaggctgaattagcaccaatccaaattctaccattatgtttgatcaaaccccncaccaattcaaagccatgctcattaggaga

SEQ ID NO: 36166 - DNA, 101 bp, rice(Oryza sativa)
  misc_feature (71): n=t or g
gttcatgcttaagacaaaagttgttggggttgatacctctgggagtggtgtcaagttaactgtggagcctncagctggtggagagcagagtgttcttgagt

SEQ ID NO: 36167 - DNA, 101 bp, rice(Oryza sativa)
  misc_feature (71): n=a or c
gaccagccatggtgacaatggccaatggaagcccgctgcacatttcccagatcctgcggggacgcactatntctttctgttcaccatctatctctttctgt

SEQ ID NO: 36168 - DNA, 101 bp, rice(Oryza sativa)
  misc_feature (71): n=t or c
ccttgcacgtgcacgattactagtttattaaaaggactgggctcgtatagccaatcttacaggacaacccnttttgggtggaagcagatcctctgacatgc

SEQ ID NO: 36169 - DNA, 101 bp, rice(Oryza sativa)
  misc_feature (71): n=t or c
gattacctggtttaatcagctctctaatatcctatttttgagcttaaaaggttgcatgctggtcaggttanctgaaagcattggtgagttgcacagtctcc

SEQ ID NO: 36170 - DNA, 101 bp, rice(Oryza sativa)
  misc_feature (71): n=a or g
taatggtaattttcaggcttttcacggtttaagtggtttgtactgcatgtttcctggcgagcacggggttngatgggatgagatcatgacgaagcccgaat

SEQ ID NO: 36171 - DNA, 101 bp, rice(Oryza sativa)
  misc_feature (71): n=t or c
aattacaaccaagtgctcaattggtctgatcaacagttcagatccatgttgaattagtactatctatttangtatctggtatttgttcatactgagtccaa

SEQ ID NO: 36172 - DNA, 101 bp, rice(Oryza sativa)
  misc_feature (71): n=t or c
gatattatcgcttgcggtgtttatctctttctgttttatccgatctctcctcctaatcctcccgattctgntgttataagtcggttgagtggttaaggtat

SEQ ID NO: 36173 - DNA, 101 bp, rice(Oryza sativa)
  misc_feature (71): n=t or c
ctaccaacccatctcctcctctagcgtgtgtatcagggaaagggaataattcgaggtcaacctcgtttggncaccttattgttcccctcaagccgaacgga

SEQ ID NO: 36174 - DNA, 101 bp, rice(Oryza sativa)
  misc_feature (71): n=a or g
tcccagtcaagcgaaacgcgccgaatcagcatcaatcgagtgacccaagcccttactggaacttggaaganaggaagcgaactcaccggcgggcggcgaag

SEQ ID NO: 36175 - DNA, 101 bp, rice(Oryza sativa)
  misc_feature (71): n=a or g
gtactcaccctctttgctttcaattgcttctgattctcgtccagtcggtaactagcgggagaggagttgcncggcggtcggccgccagtaggagaggattt

SEQ ID NO: 36176 - DNA, 101 bp, rice(Oryza sativa)
  misc_feature (71): n=t or c
gttgtgcctttctacttgtcaataaatatattgtcaagtctataggagtatgttggacgttatccatcccngtcctggaaatatctcgcttaggatagtcc

SEQ ID NO: 36177 - DNA, 101 bp, rice(Oryza sativa)
  misc_feature (71): n=t or c
ggcatatgctttcaagttgcaactaccaggaaatctctagctctagccggcatgcatgcgtgctaagaaanttttcaatggaattgaacataagttattac

SEQ ID NO: 36178 - DNA, 101 bp, rice(Oryza sativa)
  misc_feature (71): n=a or c
tttgaaaaaaaattggggtaagctcctgagcccattggtgatggatgggtgtttgtcatgtgatgatgaantgcaggacatatgagtatgactcatcccat

SEQ ID NO: 36179 - DNA, 101 bp, rice(Oryza sativa)
  misc_feature (71): n=t or g
atattttaagatgaagacagtagcgatgaacaacatgctcatgactcaggagtcaggagtcaggacaggantcgcagcttcttccggggtgccccgaaacg

SEQ ID NO: 36180 - DNA, 101 bp, rice(Oryza sativa)
  misc_feature (71): n=a or g
atatgatacagattctacctcggtttttaaaaagttaaacgatgcgtctcgtgcggaatctttctgtatanaagttgctttaaaatatcagataaacccat

SEQ ID NO: 36181 - DNA, 101 bp, rice(Oryza sativa)
  misc_feature (71): n=a or g
tgttatcttggtctccagctaccatgtgctgcgataaaagatgatgaattagtatcctgtaatctgatgcnacctgaagttactttctttggaacagcttg

SEQ ID NO: 36182 - DNA, 101 bp, rice(Oryza sativa)
  misc_feature (71): n=t or c
cttttaaaaccggacaaattacccttacaatatatggtatggtgattttgtttgacaatgtgactgttttngtttaagtatgaatactttgagtaaattat

SEQ ID NO: 36183 - DNA, 101 bp, rice(Oryza sativa)
  misc_feature (71): n=a or g
cactggactttggatttgctattgtgctcaagtggtgcaaagattacttgctgttacacacctataatccnctgtgtttattttgacttaagtgtaggcat

SEQ ID NO: 36184 - DNA, 101 bp, rice(Oryza sativa)
  misc_feature (71): n=t or g
tcagttttctgaacaggcaagaaatgcatcatgtaaaaggaaggatgaactcaaactacaaggcaactccnctttcaacaacgaggactacgatgctgcaa

SEQ ID NO: 36185 - DNA, 101 bp, rice(Oryza sativa)
  misc_feature (71): n=a or g
tcttgttaggaaaggtaaacacggtgagctgtatccatcgttagatgccatatctcgagcgttcttatatnaggtgcatattaaatcgtctcttctgctgt

SEQ ID NO: 36186 - DNA, 101 bp, rice(Oryza sativa)
  misc_feature (71): n=t or c
tactgttccgttttccgtgcaggacatgtattcacaatgtggaaaggacggagtggcagtcctgcgcatcngccatgcgggagagaggggccggtcccgcg

SEQ ID NO: 36187 - DNA, 101 bp, rice(Oryza sativa)
  misc_feature (71): n=a or g
agcagaaaaccctgttagcgtgcgttggaaatcagtgatttttcgcacaaaatatgaaggtgtgtggtatntagcatctcacctatagggcacttcgtgcc

SEQ ID NO: 36188 - DNA, 101 bp, rice(Oryza sativa)
  misc_feature (71): n=t or c
atttatatttgcacatttttcaaaagggaaaatggtactcgtgcatcgaatcaaaagtggttcccagggtnaatttttaattcaactcacataaaacactt

SEQ ID NO: 36189 - DNA, 101 bp, rice(Oryza sativa)
  misc_feature (71): n=a or g
tagaagtctgtataatgtccttcatctaaccttcgggctgagaccatcatcagcctccttgctcactaaantccatcttgtgtccctctacaacccaaaac

SEQ ID NO: 36190 - DNA, 101 bp, rice(Oryza sativa)
  misc_feature (71): n=a or g
gcagaacggcgtcgtcgaacgccggaatcagtcggtggtgagcacggcgcgaagcatgctgaaagctaagnggctcccaggtatgttctggggggaggcag

SEQ ID NO: 36191 - DNA, 101 bp, rice(Oryza sativa)
  misc_feature (71): n=a or g
ctgtattgcatttcttctacataattttagttcctttctgtttgaatgtttgttaattttgggtctccccnaatagctactgatgagagttaagactttga

SEQ ID NO: 36192 - DNA, 101 bp, rice(Oryza sativa)
  misc_feature (71): n=a or g
ctttgctttgtaacatactacaccctaaactaggatgaacagaaattaaaggagttggagagggcaggganttgttgcttctgtttagtgtcatatattat

SEQ ID NO: 36193 - DNA, 101 bp, rice(Oryza sativa)
  misc_feature (71): n=t or g
gaaattaaaacacataggcatccatatttggagataaaactttacggtgcatgtattggtctcggtctacnagtaacaacttttacgttaaaattggaaat

SEQ ID NO: 36194 - DNA, 101 bp, rice(Oryza sativa)
  misc_feature (71): n=t or g
gaatctaaagagatgagggaggaaatagacttgttttatagggaagcacggtggactgttgtgtcttcggnctagcccggcacgacctgagtcttattgtg

SEQ ID NO: 36195 - DNA, 101 bp, rice(Oryza sativa)
  misc_feature (71): n=t or c
atttacagcttgttgctgccaccccaccttaaaatatagtaaatcttagctatacattgtgagatattctntctatatacattatcaagctggagtatcca

SEQ ID NO: 36196 - DNA, 101 bp, rice(Oryza sativa)
  misc_feature (71): n=t or c
ttggtttggatttggagatggagggacggttgacttgcgggttttttcttttacttgtcaattgctcgccnaactagaaaagattcctacttctcattttt

SEQ ID NO: 36197 - DNA, 101 bp, rice(Oryza sativa)
  misc_feature (71): n=t or c
tcgtaatggacacttaatgaaaacgtgcacctatgcggacttatagttcgataggtagcaaagcataccgnctctacgtacacaagctaccctcccacgat

SEQ ID NO: 36198 - DNA, 101 bp, rice(Oryza sativa)
  misc_feature (71): n=a or g
ccgcccccaagacacgccctaggcttcaactgccgaagttgggctgcgttccaatagatttgtgttgacancaaaatccgcgctcggccgatggtgccaga

SEQ ID NO: 36199 - DNA, 101 bp, rice(Oryza sativa)
  misc_feature (71): n=t or g
ttaacagtaacaattatagcatgaaaacggtcctggcttttacggtaagaccttgtttagttttttcttcnaattttttcttcacatcaaaacttttctac

SEQ ID NO: 36200 - DNA, 101 bp, rice(Oryza sativa)
  misc_feature (71): n=t or c
cccatttaaaatttggatttgtggagtgtattacctattttacccactttgtacatacccattttctatgngtaaaacttgcacctaaaatttttaaactc

SEQ ID NO: 36201 - DNA, 101 bp, rice(Oryza sativa)
  misc_feature (71): n=t or g
agcctctattcggtgctaacaattacaggaagtaaaccaaacatgcccaagagtttagtagtcgccgtgtnttatgggtaaaagcatctaacttgatacaa

SEQ ID NO: 36202 - DNA, 101 bp, rice(Oryza sativa)
  misc_feature (71): n=t or c
ctggcacagtcgtcgtcgtcgtcttcgtctccccattgtccttcaagatcgccttgatcaccttctccganaacggccgtgaccacggcgccggtacgatg

SEQ ID NO: 36203 - DNA, 101 bp, rice(Oryza sativa)
  misc_feature (71): n=a or g
tgcacacacgagatgacacaatccggcagctacgctagctaagggctagtttggagagcttctaattaccncagtttcacccagaattagaagcttcctca

SEQ ID NO: 36204 - DNA, 101 bp, rice(Oryza sativa)
  misc_feature (71): n=t or c
ctccacttggcctggcacctccttatgggttatgatatctagatgtgtggggaatggtcactggttatgtngcctgcaggtgacctcaccagtggtgcgca

SEQ ID NO: 36205 - DNA, 101 bp, rice(Oryza sativa)
  misc_feature (71): n=a or g
tttggggaattttttttgacttagattctaatttgctacatcaatgtctgaacccaacaaaccaacgtagntgtccatcaattcatctagcaagaaaaatc

SEQ ID NO: 36206 - DNA, 101 bp, rice(Oryza sativa)
  misc_feature (71): n=a or g
gcttgtcaggagagaacacatgcagaacatgccgagctatggatcgcttgattagtcctagcgacacagtncaagaccgacaaccaattttctccgtctcg

SEQ ID NO: 36207 - DNA, 101 bp, rice(Oryza sativa)
  misc_feature (71): n=a or g
gctccgtgaatggcccatgttccaaaaactaggcccatccaacccaaaagcgctccaaatcgtttcctgtngaggcacattaattaattattatcatgatc

SEQ ID NO: 36208 - DNA, 101 bp, rice(Oryza sativa)
  misc_feature (71): n=t or c
atgttcttctcaagttgcatgctggcggcaaaataattgtccacttatttatgcccgatctcatatacttnatatactgtttattcctcttcaacatctcg

SEQ ID NO: 36209 - DNA, 101 bp, rice(Oryza sativa)
  misc_feature (71): n=t or g
ttgccaagggaaataattgagaaataacttttaagacgaaaaatgtttgcttgacgatgtctccccaaaantggtagaacccccagctacaaacagaggag

SEQ ID NO: 36210 - DNA, 101 bp, rice(Oryza sativa)
  misc_feature (71): n=t or c
catctataccgcgctgcgtcgccagccggggtcaccggctttctaccgtatttgtcttttacaacactaanaacaactaaagatcagctaatttatgtcag

SEQ ID NO: 36211 - DNA, 101 bp, rice(Oryza sativa)
  misc_feature (71): n=a or g
atgatgttttccatagtagtgactaggtcacgtgttgtcagctgattatgtacgataataaagcgacgacnacattaattggacctggtcggccgcacctt

SEQ ID NO: 36212 - DNA, 101 bp, rice(Oryza sativa)
  misc_feature (71): n=t or c
gggacacttgccgctgctggatagggaaagagaagggggagtgggagcgaggccggtcaggataggtagcncggtccggttttttccactatcagacgggg

SEQ ID NO: 36213 - DNA, 101 bp, rice(Oryza sativa)
  misc_feature (71): n=t or c
ctaatgccttgatcaattatcaaaggttagaaatgattaggatgcatggcgtgacctttgggagtaggccngtccctgaggggggtcgagccatgccaccg

SEQ ID NO: 36214 - DNA, 101 bp, rice(Oryza sativa)
  misc_feature (71): n=t or c
catgcactttcacacgtatcaaaaacgcattcatacggagtatctttctttagtacgaacatatgtttctnacgcactaaaggccttctccctccgcttca

SEQ ID NO: 36215 - DNA, 101 bp, rice(Oryza sativa)
  misc_feature (71): n=t or c
gacaaagatgtggggtgccaactagtaagttcaatgacagactcctagcagaaagatccgctcatcctcgngcgaacctagaacagaaaccgagagaacgc

SEQ ID NO: 36216 - DNA, 101 bp, rice(Oryza sativa)
  misc_feature (71): n=t or c
atcacaattttctcgttgttgaggtactcggtacattggtgcctacttgagggaaactattctaatccttngaggggatgttctttcatttgcttaaaaac

SEQ ID NO: 36217 - DNA, 101 bp, rice(Oryza sativa)
  misc_feature (71): n=t or g
ctcctctcctccctccccgccgccccgatcatgtatccagagtatgatggcgtggaagccgtcctggttanccttgtcgaggccccgcacggcacggaagt

SEQ ID NO: 36218 - DNA, 101 bp, rice(Oryza sativa)
  misc_feature (71): n=t or c
cctccacgtgcaactagcctcggtaggtgaaacctctctcactttatcgatgctcagctcctccttgcccncaacccttctcactaccgctcagtcgacgt

SEQ ID NO: 36219 - DNA, 101 bp, rice(Oryza sativa)
  misc_feature (71): n=a or g
agaaaaagcgaaaggaggaggaggaaagggagctttgcctccctccattttgggcggcggggctggcgagncatgtaggagcggcgtcaccacgttggtgg

SEQ ID NO: 36220 - DNA, 101 bp, rice(Oryza sativa)
  misc_feature (71): n=t or c
tacacaattagtggtaatatgcccccttatcgcaaccaaattatagtacggtcgcaataacccctaagtantgtaatgaaaatcacgttgttgcatcaaat

SEQ ID NO: 36221 - DNA, 101 bp, rice(Oryza sativa)
  misc_feature (71): n=t or c
gacctcgcttggtatctacgtacaacacctgcaataagctctcaggaacgatgcttcaatttgacttaggnctggtttagttcccaattttttcttcaaac

SEQ ID NO: 36222 - DNA, 101 bp, rice(Oryza sativa)
  misc_feature (71): n=t or g
cagtgggggctaattgggtactctcgttctcttttgtgctgtggcttgctgtgtcgaaattggtcgacagntattgttcttacgttgtcatatcttttgtt

SEQ ID NO: 36223 - DNA, 101 bp, rice(Oryza sativa)
  misc_feature (71): n=a or g
atgtcacatgtttaaatttttcattgatgtttattggcatagcctcagataacttgagtaacggtaactcngtaagacataagacatgaaaagggtgagga

SEQ ID NO: 36224 - DNA, 101 bp, rice(Oryza sativa)
  misc_feature (71): n=t or c
cagagcacaggcaatggcgtgcgtcccggagaagaactggaaccgattaacaaagagctcatcactagtanaagaagctcagtttttcacgaacgcgcaaa

SEQ ID NO: 36225 - DNA, 101 bp, rice(Oryza sativa)
  misc_feature (71): n=t or c
tatgtgtgcatgataaaaaaaaccacgtgtttttttaaacccggtttgaacagactggataaaatccaaangtaacatatctattatattattaaaggaat

SEQ ID NO: 36226 - DNA, 101 bp, rice(Oryza sativa)
  misc_feature (71): n=t or g
atgacatcatctataaaataaatcatctttctcatattgggattgtttggctgccctttatttggttgtgnctatagctatcgctagtagattgctagtag

SEQ ID NO: 36227 - DNA, 101 bp, rice(Oryza sativa)
  misc_feature (71): n=a or c
ctcaataccttttttaatgtgtaatacggttaaaggcaaaagacagcacattcttaacgtgtctatgtgtntatgtgtatataaggtggtctctaatttaa

SEQ ID NO: 36228 - DNA, 101 bp, rice(Oryza sativa)
  misc_feature (71): n=a or g
gtcaaatctcatggggaagttttctcaaaagttcaaggcagtctcgctctctctatatggcaagtctagtnagccatacttaaattagtttatcaacctat

SEQ ID NO: 36229 - DNA, 101 bp, rice(Oryza sativa)
  misc_feature (71): n=a or g
tggtttattagaccaaccaataaggctctatgtctgatctgatgagggaaaacaaagagcaagtttaatantaaatgagctataagattatctcttttttt

SEQ ID NO: 36230 - DNA, 101 bp, rice(Oryza sativa)
  misc_feature (71): n=a or g
tctctatattccaaaagatcccttcatgggtgacgaaatgccaatttactcccttcccttaatattacaantcattttgtcttttcttaagtcaaaattgt

SEQ ID NO: 36231 - DNA, 101 bp, rice(Oryza sativa)
  misc_feature (71): n=t or c
tttcatctcccctttttcctatcttcctctccccaatggcggataaagcgaggcgaggtcaaggcgacaangccggcgaagcggcccacgcgtcgagggcg

SEQ ID NO: 36232 - DNA, 101 bp, rice(Oryza sativa)
  misc_feature (71): n=a or g
ttatttatacgtgtcaagagaaaattaacggttacatatacataacctttttttgaaatgcacgaattccntatccagaatacaattttgatatgaactac

SEQ ID NO: 36233 - DNA, 101 bp, rice(Oryza sativa)
  misc_feature (71): n=t or c
gatgcatacacggacaatattatcgcccgcctactgactacgctctacttttctttgtccttggagaattnggtgtcgtagtttttaggtaggattcttct

SEQ ID NO: 36234 - DNA, 101 bp, rice(Oryza sativa)
  misc_feature (71): n=t or c
tggattttgttttctaagattttggtgattggtagggtgacagaaggtgaggtggcagccggcaaggtggngcccggcgaggtggcagccagtggggtggt

SEQ ID NO: 36235 - DNA, 101 bp, rice(Oryza sativa)
  misc_feature (71): n=t or g
ctccccaatgacggttatgaccgttttcaccgtggaacccgtcagaaattggacacttggcatgacaaganagaagatgctctttggatgcttggagcatc

SEQ ID NO: 36236 - DNA, 101 bp, rice(Oryza sativa)
  misc_feature (71): n=a or c
acatatgaatcgcgatcgccaccgttgggggggcacgtacgtactatacgtaactatactattgtagtgcntgcctttttgtgtagtggaccaggatgtgg

SEQ ID NO: 36237 - DNA, 101 bp, rice(Oryza sativa)
  misc_feature (71): n=t or c
aatctatgtcgccggagtctctttgcaacctcaaggatgattctcaggttgtaaacctagttccagatgtntggaatagtgacttgacatcctaaatgtcg

SEQ ID NO: 36238 - DNA, 101 bp, rice(Oryza sativa)
  misc_feature (71): n=t or c
gtaataaaaataataatatgatttgcagtgttgcacttcccattgcaatgtaaacacctgtgttctgtagntctccttgaatttttatgttgttgtctgaa

SEQ ID NO: 36239 - DNA, 101 bp, rice(Oryza sativa)
  misc_feature (71): n=t or c
ctgcagcctaaaaacaccagggcatactgtcaatcaaataatccaataacaccagctccgaacacaaccgngcataacttaaaaacctgattaccgactca

SEQ ID NO: 36240 - DNA, 101 bp, rice(Oryza sativa)
  misc_feature (71): n=t or c
gtacctctaaaaacagtaagaaattactatcagcattcatcgctgtgacaaagagaaagttaggctactgnacaactgggaaatcaacagacaatatacct

SEQ ID NO: 36241 - DNA, 101 bp, rice(Oryza sativa)
  misc_feature (71): n=t or c
gtgtatctcggttcctaaatgtggtgactctggaaatctcagggaaatcgcatggggcgatcgaacactanccgcgaaaagaaaatttttggatggggttt

SEQ ID NO: 36242 - DNA, 101 bp, rice(Oryza sativa)
  misc_feature (71): n=t or c
gtggttttttttcatagggaatatctactgccagtatgatgaatctattttgtgcacgacactccaatatngcataacaccttattatcaagcatattatt

SEQ ID NO: 36243 - DNA, 101 bp, rice(Oryza sativa)
  misc_feature (71): n=t or c
tcaatcggattactgaacttttttggcttctggctgaaatttccgccattttgagctcacatatataatantatgagcaaggattttaacagaaattaagg

SEQ ID NO: 36244 - DNA, 101 bp, rice(Oryza sativa)
  misc_feature (71): n=t or c
ctcgtgaccggcgaggcagggacgtcgcggcgcgtcttcaacgagagggagcgacacaatctccagcgganggtgtctccgatgctcccctccatctctgt

SEQ ID NO: 36245 - DNA, 101 bp, rice(Oryza sativa)
  misc_feature (71): n=t or c
aaagtccattaaacttcctacaaacgctctaaggctgccatgtggtatcctataaatgctcttaagtcccnatgtgtcactctaaaaaattagtaaaatct

SEQ ID NO: 36246 - DNA, 101 bp, rice(Oryza sativa)
  misc_feature (71): n=a or g
cttgtttgattgttgtgcaaaagacttgagtacttcagattcaggggacaggggacgcgtcacggcaaacntgtggaccgggggctctgcgaattcgtcgt

SEQ ID NO: 36247 - DNA, 101 bp, rice(Oryza sativa)
  misc_feature (71): n=t or c
gagcatcgtaccgggcctgccaaaccggcccatccccaccacgcctgccgcgctacgcctgaaatttttanattttggtcctttttgaaaacttattttac

SEQ ID NO: 36248 - DNA, 101 bp, rice(Oryza sativa)
  misc_feature (71): n=a or g
tagactccaggctcttgttcgtggccatgctgtccgaaagcaagcagcagaaacacttcaatgtatgcaancattggtaagagctcaagctcgtgtcagag

SEQ ID NO: 36249 - DNA, 101 bp, rice(Oryza sativa)
  misc_feature (71): n=t or c
aaccaggctagacgcatgaaaacggacggaaacggttattactccctctgagggcatgtttactttaatgncatttttaacataaagttactaaaaatatg

SEQ ID NO: 36250 - DNA, 101 bp, rice(Oryza sativa)
  misc_feature (71): n=t or c
caccctcccttgcatgataccttggtatatttttgttgtcttacatcactctcttcctcctcctcctcctncttcttcttcttcttcttcttcttcttctt

SEQ ID NO: 36251 - DNA, 101 bp, rice(Oryza sativa)
  misc_feature (71): n=t or c
aagttgaagccaactactccctttgtaccaaaaagctaacctaaataggataggacataacctataacaangaatctcgaaataaatatgttcatattcat

SEQ ID NO: 36252 - DNA, 101 bp, rice(Oryza sativa)
  misc_feature (71): n=t or c
gtccagaagcctacatgagtgatttgtgggtttaagggaaacaattgtttcagatacttcgaagtatgctntgattccactgaatgtgatcatatagttcc

SEQ ID NO: 36253 - DNA, 101 bp, rice(Oryza sativa)
  misc_feature (71): n=a or g
gtattatctgtattcgatcgaacgaccgagattgcttggacgtcccctcgcagatcgctcccacccacgcncgtttctccgcctccctcacagatctcgct

SEQ ID NO: 36254 - DNA, 101 bp, rice(Oryza sativa)
  misc_feature (71): n=t or c
taaacacatgggctagtcactttgagccatatagactccacacagtgggcactatatgatggtttgcggantcagaattggaggttaaactagggggaaga

SEQ ID NO: 36255 - DNA, 101 bp, rice(Oryza sativa)
  misc_feature (71): n=a or g
cttcaaggcagtccatctcaacgcatgtgctagggcaatcaatgaaaggttcaatagtactctcacaggtnagcaaattaagaaccatttgaagacatggc

SEQ ID NO: 36256 - DNA, 101 bp, rice(Oryza sativa)
  misc_feature (71): n=t or c
tctttccttatctctggaacaccttttgtatatgtgtcatgattatgtataagacttgtaatatggtggancctgccaagcccaaccaaaaactattgggt

SEQ ID NO: 36257 - DNA, 101 bp, rice(Oryza sativa)
  misc_feature (71): n=t or c
aaaatgaggacgaagagacgtaggaatgtccggaggacgtcgttcatgagtgcttggaatgtggtgggggngttgcaaagcccgaacggcatgaccatgaa

SEQ ID NO: 36258 - DNA, 101 bp, rice(Oryza sativa)
  misc_feature (71): n=a or c
ttattttaagtgtttttggttagtgacttttcgtgttgtgcattctggagtacattttgcggactgccagnaaagatcattttgcctccatcaattatagg

SEQ ID NO: 36259 - DNA, 101 bp, rice(Oryza sativa)
  misc_feature (71): n=t or c
aattataggctgtactctgatggcaagaaccctagctagcccaatgcagtatatatagtagtagtagtagntagaagagcagtgcttctgtcaccttggtt

SEQ ID NO: 36260 - DNA, 101 bp, rice(Oryza sativa)
  misc_feature (71): n=a or g
agggtggtcttatctatatttaccttattgtttgtcgtgtaaaacactaaacctctatttgagaatggganagtataactatatcaaaagtcaattaaata

SEQ ID NO: 36261 - DNA, 101 bp, rice(Oryza sativa)
  misc_feature (71): n=a or g
ggtagtgactacccatgcccgtgcccacgaggtaatttatgtccacgggtatacccgttactacatgacgngcaaggagtacttcccatgcccgtcacccg

SEQ ID NO: 36262 - DNA, 101 bp, rice(Oryza sativa)
  misc_feature (71): n=t or c
gttggatttgccacactcgcagttctgttcagttgtcttgaatcgttgcacaaatccaggctttgtcagtnatcactgcctctcaccagtgcactataccg

SEQ ID NO: 36263 - DNA, 101 bp, rice(Oryza sativa)
  misc_feature (71): n=a or g
acattgcctattagaccatttctacgcaaacaaccacagcaaatcagcatgtcatgctatattttcacaanaacaatttattattaataactgtaattaac

SEQ ID NO: 36264 - DNA, 101 bp, rice(Oryza sativa)
  misc_feature (71): n=t or c
tgaaagtacatgctagtaaatgtattacttgtaggagatggtgtaaagcctttgctaatgaaatagggtanagtaactctcggtaaacaatttactcccta

SEQ ID NO: 36265 - DNA, 101 bp, rice(Oryza sativa)
  misc_feature (71): n=t or c
tggatcactgaaatagctactgatggtgttcatttggtaagcgtgtcattattgctggcaatcttatcatngatggtgtttgtgcgagttgccacatttat

SEQ ID NO: 36266 - DNA, 101 bp, rice(Oryza sativa)
  misc_feature (71): n=a or c
gttaagcatcgtggcatacacgccctcctaaccccatgtctagcctcacctgcacacatggtactactcancttatcatcaagagcaaacatatagtcata

SEQ ID NO: 36267 - DNA, 101 bp, rice(Oryza sativa)
  misc_feature (71): n=a or g
tctgattctctttccgccacactcggagatcgagaccacgatgaaggtgaacgacggcaaaaatgacatcnatttgcatccatcagtcctacgcctggatg

SEQ ID NO: 36268 - DNA, 101 bp, rice(Oryza sativa)
  misc_feature (71): n=t or c
tcaatgctatcacctgtaaggggattaccgaccgtatagccctgttcatcacccagaaatacaaattggtncatactcaattgtaactattttactagatt

SEQ ID NO: 36269 - DNA, 101 bp, rice(Oryza sativa)
  misc_feature (71): n=a or g
ttcagacgaatagtggtcaaaccatttttttaagcggatgcggttagtgtgtggatactgatatcgagcanattgttttggatgttgaaaatggtgcggac

SEQ ID NO: 36270 - DNA, 101 bp, rice(Oryza sativa)
  misc_feature (71): n=t or c
agaaaatgttttcttccagcaacaggattcggatgcttgaccattttgcattgacctatcgtcaaggtggnctaattctcctgaacttcaggctgcaatca

SEQ ID NO: 36271 - DNA, 101 bp, rice(Oryza sativa)
  misc_feature (71): n=t or c
tgggactttattcttgctttacccaagccatgaagcagcagtcgactggagcatcgtgcgagataaaagancggtatggcagcaattgggtattgcatcat

SEQ ID NO: 36272 - DNA, 101 bp, rice(Oryza sativa)
  misc_feature (71): n=t or g
gtgaaaagaaaaggaaaaaaagaagaaaggttgatttattttgggtgccgcggtatctggaaaagtctccngctacatttactggggcagattgtgcagag

SEQ ID NO: 36273 - DNA, 101 bp, rice(Oryza sativa)
  misc_feature (71): n=t or c
caatatgcactggtagtagcaccatcaaccaccttcgcaccgtgatacgccgtgccagattgaggagagangaggttgaggtcgcacagcccctgttggcg

SEQ ID NO: 36274 - DNA, 101 bp, rice(Oryza sativa)
  misc_feature (71): n=t or c
agtgtctttcagctgtgacagaatcatttgcacagtattccccacctaatgttagtattttccttgaaaantcaatcaggaatcacaagaaccatacagat

SEQ ID NO: 36275 - DNA, 101 bp, rice(Oryza sativa)
  misc_feature (71): n=t or c
atggtgagcaaaactacatcgccgtgcacaaatccattgtcaatctaggtatctaactgagttcaagttcnggcaaatgcgagaaccaatcattactacaa

SEQ ID NO: 36276 - DNA, 101 bp, rice(Oryza sativa)
  misc_feature (71): n=t or g
tgaacaactattaatcagagtaaataatgctttgataaaccattaggatgtcattaacgagggtaacaacntaatttttgacatcaggttttgtttggtgc

SEQ ID NO: 36277 - DNA, 101 bp, rice(Oryza sativa)
  misc_feature (71): n=t or c
ataattaatacttaattaaatatatactaatgagtgcacagaaaatctctctccaaacggatagaaccaanagtcttattactgctactagcataacccta

SEQ ID NO: 36278 - DNA, 101 bp, rice(Oryza sativa)
  misc_feature (71): n=t or c
agccttcatatgatggttggaatggcagttgtggatgtcagtacgcccacaatcgtcactggggagcaacnagggactgcgacgtgtagggtggagatggg

SEQ ID NO: 36279 - DNA, 101 bp, rice(Oryza sativa)
  misc_feature (71): n=t or c
ctggtcgtgcgtgggcattattgtcagatttgaggtggtgcaatccagaatggcaggcttactcccgtgcntgtagcgaacgcagggcaaagatgaaaacg

SEQ ID NO: 36280 - DNA, 101 bp, rice(Oryza sativa)
  misc_feature (71): n=t or c
aaaatgtctaggtgggtattatggtggtgtttcacatatttctgtctttgtgtgtgtaatccgtggatgtntcaataaataaaatgtaacaccccaggtag

SEQ ID NO: 36281 - DNA, 101 bp, rice(Oryza sativa)
  misc_feature (71): n=t or c
gatctataataatatcaaaacccgctaactcaagttagtgagattattactcgatcgaatattttttttcnatgtgtttctcgctaccactgagtttatta

SEQ ID NO: 36282 - DNA, 101 bp, rice(Oryza sativa)
  misc_feature (71): n=a or c
gtgaatggtttcgaaactattcgggagcggttcttttgatagttcagttttataaaccttggctatcccanatcatcctttaattaaactgtatattcctt

SEQ ID NO: 36283 - DNA, 101 bp, rice(Oryza sativa)
  misc_feature (71): n=a or g
gtcaaatctctgtgcataagttgagggaggagctgagaggatgcatgaggtgctgccggtgtgggacaacntatcctatgcatacaccaaacctcctgcac

SEQ ID NO: 36284 - DNA, 101 bp, rice(Oryza sativa)
  misc_feature (71): n=t or g
ggctccgtcggtgccatcaaatgagaacagatcaaaacggaacgaatgaacaatgcgataagagggatcanactacacctcccagtccgatggatcccata

SEQ ID NO: 36285 - DNA, 101 bp, rice(Oryza sativa)
  misc_feature (71): n=a or g
acatatatacttgctacataaaaataaaaatcaactcctagctagctagagacgaacttagcatttcgtcntattcagacctttggcccatgcattcaata

SEQ ID NO: 36286 - DNA, 101 bp, rice(Oryza sativa)
  misc_feature (71): n=t or g
tgtgaatgtgagcgatctgctagcagaaaagcgttgggctctagctagctttccgtcatcgtcgtcggcanatgagatcattgggcgcgccttgcatattt

SEQ ID NO: 36287 - DNA, 101 bp, rice(Oryza sativa)
  misc_feature (71): n=a or c
agggcatacacatattaattcagcctgacttgcatactaacggtccaacctatatatggagttatggacgntatccagacagatcaatgggcggccacata

SEQ ID NO: 36288 - DNA, 101 bp, rice(Oryza sativa)
  misc_feature (71): n=a or g
aatattccaaaagccaaaacttagagataggtttggacttattatctccatttcctaaagacgaaggcggnaagagaaatgggagtttcaaggaaggagtt

SEQ ID NO: 36289 - DNA, 101 bp, rice(Oryza sativa)
  misc_feature (71): n=a or g
tcgggatatatcgttggttttcgtctctttgagtgtgtatgtcacggatgtattattcgtgggtgtgggantgtggtgttatgtgaatagtgatgcatgtc

SEQ ID NO: 36290 - DNA, 101 bp, rice(Oryza sativa)
  misc_feature (71): n=t or c
taagggacaattgcttatttgaccctattttgaagtctatcaccaatagctaaccctgttttccctccacngttaaggtttcatagaaatgtattttctag

SEQ ID NO: 36291 - DNA, 101 bp, rice(Oryza sativa)
  misc_feature (71): n=a or g
actcgagtatcaactcacagccaagaatgacgtatatagcttcggtgttattcttcttgagcttttaactngtaagaagccattctcaaaagaaaggaaga

SEQ ID NO: 36292 - DNA, 101 bp, rice(Oryza sativa)
  misc_feature (71): n=a or g
gttttttctattttacgaggaacataccgtaatgggccggaaccatataaattaaggctgtgtttgagggngaggggattgagaagattggaaagaaacgc

SEQ ID NO: 36293 - DNA, 101 bp, rice(Oryza sativa)
  misc_feature (71): n=t or c
tgaccactagtcacaaaaacgtcagatttgcaattttgccacgtataagtggatggcatttgttcttctgnggttttgccacatatgtatgtatgacatgt

SEQ ID NO: 36294 - DNA, 101 bp, rice(Oryza sativa)
  misc_feature (71): n=a or g
tactagataggaaaagtctctggatcgatcgaattgtccgataaaagctagacaaaggtatcgactgatcnttggatccaacgaactggtttagtaacttt

SEQ ID NO: 36295 - DNA, 101 bp, rice(Oryza sativa)
  misc_feature (71): n=t or c
ttggtcgccgccaaggcggtgacaaccgtgtcgtcgacgacgaccttgacatcgcacggcgcgacctttcngtcgccgcattcggcggccggcgagtcgat

SEQ ID NO: 36296 - DNA, 101 bp, rice(Oryza sativa)
  misc_feature (71): n=t or c
ttttctcatttcactgcttatttttccactactaattaacagtcgaagccaaccaatatagcactaagggnctgtttggtacagctccaactcctaaattt

SEQ ID NO: 36297 - DNA, 101 bp, rice(Oryza sativa)
  misc_feature (71): n=a or g
gatggcgctctctcgccaaatctagcaacagtggccaccagatccggtcaggtgagcgcgcgagggtgacnaagacagcggtcatgcgtgatggagacgat

SEQ ID NO: 36298 - DNA, 101 bp, rice(Oryza sativa)
  misc_feature (71): n=t or c
gccatgtggagctgcccctaggtgctcatcgaatcggggggcagcgaccaaaaccaacgctgagccacgtngtcaagggcaagcgggaagcacttggccat

SEQ ID NO: 36299 - DNA, 101 bp, rice(Oryza sativa)
  misc_feature (71): n=t or g
tttacctagggatacttagcgctttcaaatgaaattgatacatcagcaatttcattagagttctgtactanaaaaatagatgccatttagattctcttttg

SEQ ID NO: 36300 - DNA, 101 bp, rice(Oryza sativa)
  misc_feature (71): n=t or c
gaagcatgcctactagtatccaaaacatggaatccaagagtattctgaacataatctactatcatctggangaactgggcatagagttcaagcagcgaagg

SEQ ID NO: 36301 - DNA, 101 bp, rice(Oryza sativa)
  misc_feature (71): n=t or c
cctaacaagacagcatgacccatgacattcaaagattgtatgcaagaaagcatgacttcgcagcccctacnattaatttcaacgggagcaaagaagaggtg

SEQ ID NO: 36302 - DNA, 101 bp, rice(Oryza sativa)
  misc_feature (71): n=a or g
cactgagatttctgttgtattggcccctttggacaattaagttcacattattactgtttggggcttattgntattttggctgataccaagtcctttaaaaa

SEQ ID NO: 36303 - DNA, 101 bp, rice(Oryza sativa)
  misc_feature (71): n=t or g
cgagaacaagaatttgtaccattgtggtaagttctactgtcagtctgaatatttctaatttaattttcttnattttggaccttaaatgctttatgaaaagt

SEQ ID NO: 36304 - DNA, 101 bp, rice(Oryza sativa)
  misc_feature (71): n=t or c
gaatcttattgttgatcggtcggtcagttaagaaatgatgaagttaatcgtcgtctgtcagttccagtganggtttgttttggcaatttgtttacaactca

SEQ ID NO: 36305 - DNA, 101 bp, rice(Oryza sativa)
  misc_feature (71): n=a or g
atttagctagaaaacacaagcagcaagctggtgattccaagaaagaggggaaactgtacaatgatcaaacntgcaattaacacactgagggcccctttgaa

SEQ ID NO: 36306 - DNA, 101 bp, rice(Oryza sativa)
  misc_feature (71): n=t or c
ttgaacacatggccttgactgaatcagacatatacatagtcacagcaaagagattggggtagctggtgcanttaaaatcatcattccataaatcattctag

SEQ ID NO: 36307 - DNA, 101 bp, rice(Oryza sativa)
  misc_feature (71): n=a or g
caatactaaattcggtttttatgggacaaagagagtagacaaatagcttgcctggaggagagaagggattngggactggaccgtgatttcaccgggttcgc

SEQ ID NO: 36308 - DNA, 101 bp, rice(Oryza sativa)
  misc_feature (71): n=t or g
gaattctttcctgattcctgtgatttttattgtgctctatctaaacggctattccaaagtggaggatgcangtcccttgtggtgctagtggtcggcttgtc

SEQ ID NO: 36309 - DNA, 101 bp, rice(Oryza sativa)
  misc_feature (71): n=a or g
aacacatccgcagcaaaaaggaaatcctctgtgaaaaaaaatgagaagattaaatttgcggtgagcgtggntcgaacacgcgaccttcagatcttcagtct

SEQ ID NO: 36310 - DNA, 101 bp, rice(Oryza sativa)
  misc_feature (71): n=a or g
ttcctgccctgccattaactagcgctaccaatttctacctctcaatttattattagcaagccgtatttgtntaactgctactcctcctatctaaattcata

SEQ ID NO: 36311 - DNA, 101 bp, rice(Oryza sativa)
  misc_feature (71): n=a or g
aaaaaaacttgaaaaatagattaatatgattttttaaagcgtatagaaattatattgttgggaaatttganaagttgtgggccactagccttatgcatggt

SEQ ID NO: 36312 - DNA, 101 bp, rice(Oryza sativa)
  misc_feature (71): n=t or c
tgttcgcaagtcaaggtacccaacttccactccctcgttttcctgtgtgcacgctttttgaactattaaanggtacgtcaataaatttgtataggaaagtt

SEQ ID NO: 36313 - DNA, 101 bp, rice(Oryza sativa)
  misc_feature (71): n=t or c
acatcaacacaatgcatgccaaacttgtgcattggaggatcctcaggtctcctagtaattatcagtaccanagagccagcagtactgttgaaattaatttc

SEQ ID NO: 36314 - DNA, 101 bp, rice(Oryza sativa)
  misc_feature (71): n=a or g
acaagtaccgcatgtcatttatgctattagagtagggcaatacgatggtcgaccagaaggattgatgatgncacatcatgggtgcaatgtgcacaatgtaa

SEQ ID NO: 36315 - DNA, 101 bp, rice(Oryza sativa)
  misc_feature (71): n=a or c
agctagcgatgtcaatttcaatattaattcactcttgcggaatcaaataactaatttacgacaatctaacntgcccaaataaattagctactagccaaatt

SEQ ID NO: 36316 - DNA, 101 bp, rice(Oryza sativa)
  misc_feature (71): n=t or c
ttcaaattaacgtttgaaaccatttattgaccgccaggcgggttcacaaaactgatcagcattttaaaaancgttgatggttaatttgtcaaaaccggtcg

SEQ ID NO: 36317 - DNA, 101 bp, rice(Oryza sativa)
  misc_feature (71): n=a or g
tttttacagatttgtttcttacagaacaacagaaattatatgagctccagtattctctccgttctttacanttggtagattattctttgtaattacaatat

SEQ ID NO: 36318 - DNA, 101 bp, rice(Oryza sativa)
  misc_feature (71): n=a or c
gcatttgtgcctaaccttccggacaaggatttaggtgaccttccggacaaggattttttacacctaagtantgtggtatccatcaattatatgtgactcaa

SEQ ID NO: 36319 - DNA, 101 bp, rice(Oryza sativa)
  misc_feature (71): n=a or c
aaaacttctcaaacgagtactacatccagaaacttcatactaccacctctgttgtcgattactactccttncgtctaaaaaaaaaagacaaacatgagttt

SEQ ID NO: 36320 - DNA, 101 bp, rice(Oryza sativa)
  misc_feature (71): n=t or c
gggaccatacccatataattggagtttgggtacgtggtggatggattcagaataaaccaagtgataggctngtataattagagattggctaggtaatggat

SEQ ID NO: 36321 - DNA, 101 bp, rice(Oryza sativa)
  misc_feature (71): n=a or g
acacggctgctagctagtcaaactggaacctgagcttaattacagcagccgtcgtaaagtggtaaggaaantgattgatatgccctgattcgtttcactcg

SEQ ID NO: 36322 - DNA, 101 bp, rice(Oryza sativa)
  misc_feature (71): n=a or g
gccagcccagagaaaacgtcgccgctgcttgtctaggcactctaaagcttcctttgaagttttcagagcgntcagtaagtagattggctgcgccatcagca

SEQ ID NO: 36323 - DNA, 101 bp, rice(Oryza sativa)
  misc_feature (71): n=t or c
tgattttctatagcaatttttatgttgtgtttaaaagaaacacgtcatttagcagattactaagtgtgtangcgaaaaacgagagattataaattgggaaa

SEQ ID NO: 36324 - DNA, 101 bp, rice(Oryza sativa)
  misc_feature (71): n=t or g
tgaaaatcatctatttttgcaggcttttgcgtccagacgatcatttcctctgcctgcgaaaactgtttttnaccgcctgcaaaaacgattttgctagtagt

SEQ ID NO: 36325 - DNA, 101 bp, rice(Oryza sativa)
  misc_feature (71): n=t or c
ggtttcatagcggaaaaagggaggtgttctttaggataaaatccctaacttgtacagtgcgaacgagcctncgatggaaaaatcaagatatgaggcagact

SEQ ID NO: 36326 - DNA, 101 bp, rice(Oryza sativa)
  misc_feature (71): n=a or g
gattgcataataagctttacaatattgttggttgcgtagacctgcttgtggcatttccttgtttcatctcncatagaagtcagtacacttcgtcgctaact

SEQ ID NO: 36327 - DNA, 101 bp, rice(Oryza sativa)
  misc_feature (71): n=a or g
gaatgcaggtagtgcggcgcatctggacatgtcgtacgtaacgtatagcggctgccatgtgcggtgaactnatttggagctcgggagcgagagagcacgtg

SEQ ID NO: 36328 - DNA, 101 bp, rice(Oryza sativa)
  misc_feature (71): n=a or c
taaatatgggaaagaatatacgaatagccatttagataaatggaaaaggagagtatttgtaggtgtgcggntaattcagtcaatgcaaaaggcaaagggaa

SEQ ID NO: 36329 - DNA, 101 bp, rice(Oryza sativa)
  misc_feature (71): n=t or c
tgtaatctcttcagaagtttcataggaagtttctatttctcgacaactgttgaactatgatcttggttagntgtgagattctaccgatgtaacagttttgc

SEQ ID NO: 36330 - DNA, 101 bp, rice(Oryza sativa)
  misc_feature (71): n=t or c
aaaaaagtaggttaagagcaaaaaaaatatccataaaagataccgtagtagtagcagcctgcatgctgatnagtgtgtgcaactctactctgtggaagtgg

SEQ ID NO: 36331 - DNA, 101 bp, rice(Oryza sativa)
  misc_feature (71): n=a or g
ttggaatttttatcttttttcgtgatttttcgttttcacaacggttgcgctagccgcacgtgaaaatcatnattttcgtagacattttctttcgggtgcag

SEQ ID NO: 36332 - DNA, 101 bp, rice(Oryza sativa)
  misc_feature (71): n=a or g
ggccatggtagtaggtaggctgtacggcaggagaggtggtagtggtttgcacacgtattgaaaaaaatttntgaaatatgtaaaactatatgtgtacatga

SEQ ID NO: 36333 - DNA, 101 bp, rice(Oryza sativa)
  misc_feature (71): n=a or g
agccccgaaaggcgtgatgaatgaagtcttcaagcagtcgaactcatttaagcggatctgatgataccctnagtagcaatccagaaaactgagtagctcac

SEQ ID NO: 36334 - DNA, 101 bp, rice(Oryza sativa)
  misc_feature (71): n=t or c
ctactacacaagtccactccacgtccaactcccgaaactaaatttatcggttagagttctacaaaataganccgtcatattgtgcgtgcgactgtgaggcc

SEQ ID NO: 36335 - DNA, 101 bp, rice(Oryza sativa)
  misc_feature (71): n=t or g
tctagtttttcctttccttgggcagagtgcctcctgtactgaatgattgcgaagttgcttgagatgaacantcccacagaagcatggtgagaaatggagag

SEQ ID NO: 36336 - DNA, 101 bp, rice(Oryza sativa)
  misc_feature (71): n=a or g
agagtcctgaattttgctgctgattagaatgttataaacataactgcaggcataggcagcattatctgtcnttgttctgctaattaatctcgtagcattat

SEQ ID NO: 36337 - DNA, 101 bp, rice(Oryza sativa)
  misc_feature (71): n=t or c
agctccccgcacaaattgagatggtatatatccccggcgagttccacgacctcgccgtggtatatatcccnggcgagttccacgacctcgccgagcagttg

SEQ ID NO: 36338 - DNA, 101 bp, rice(Oryza sativa)
  misc_feature (71): n=a or g
ggaggggtctcctaccttttcaaattaaccttttcagactggggtaagggtctgtttgggggaggtgtttnggggaggtttagattctgagaaacagctgt

SEQ ID NO: 36339 - DNA, 101 bp, rice(Oryza sativa)
  misc_feature (71): n=t or g
ctataaaagaaaagcccttaattattttattgcgcaataaataaccccggatgacgtcagcaaacaggggngcaccgacatgcgggccctacccgcagcga

SEQ ID NO: 36340 - DNA, 101 bp, rice(Oryza sativa)
  misc_feature (71): n=t or c
aaaagatagagatgttgttgggaggtttggaggtgatttggaagggataagtgtcacgccctaaaaatcgnctgatttaaaaatacattgtttaagtcatt

SEQ ID NO: 36341 - DNA, 101 bp, rice(Oryza sativa)
  misc_feature (71): n=a or c
agacctcatttgctcccagataaaaatcaacattagcagcagcggtagcagtaccggacagtctgggctantctctccgtctcaaaataaattaacttagg

SEQ ID NO: 36342 - DNA, 101 bp, rice(Oryza sativa)
  misc_feature (71): n=t or c
gttgtacataacatacggaagtactagctgctggtactctccaaattactcactcctcctatactacatanaggcggggcttgcatgaattaaaagtggag

SEQ ID NO: 36343 - DNA, 101 bp, rice(Oryza sativa)
  misc_feature (71): n=t or c
cacacgaggacaagcatgttagcatcaactgcaaggtgcttaatgtgtaaggaactaaggacgatgtggangcaaggcacacttgcacatggaccagtcat

SEQ ID NO: 36344 - DNA, 101 bp, rice(Oryza sativa)
  misc_feature (71): n=t or c
gggcctaaggaaaatattaaaatagcagcggaaatatgataaacgcgtagtagctccattcaacttcccanaggcagtcaactgggactcacgacctattc

SEQ ID NO: 36345 - DNA, 101 bp, rice(Oryza sativa)
  misc_feature (71): n=a or g
aaaagcattcatcttctccaaattgaagagtgatcgagatcaaggttactcacacccataacagaaaaacnaggtgacccgatgtgaggattgaccacatg

SEQ ID NO: 36346 - DNA, 101 bp, rice(Oryza sativa)
  misc_feature (71): n=a or g
atactacgtctagtgttttttcaaaaaaaattgcatatgccagtgccaacctggcacaccccgtaggtccncccctgatcctatctgatatgatatataaa

SEQ ID NO: 36347 - DNA, 101 bp, rice(Oryza sativa)
  misc_feature (71): n=a or g
tcttgtctttgattggaaggcattcattaatacagaagagctagggctcttaaccaaaggtaccttgggcngatcatcaaatgattgttcatcgatgccat

SEQ ID NO: 36348 - DNA, 101 bp, rice(Oryza sativa)
  misc_feature (71): n=a or c
catggttcacgagccagtcgtatgaaagattgtggcattcctccgaagcaacgagagccctacaacagctngcactaactagtgatgaaactctatgccat

SEQ ID NO: 36349 - DNA, 101 bp, rice(Oryza sativa)
  misc_feature (71): n=a or g
caatcaaggtgcttatatataagatgaagatactctgtctgcctgtctgtaagtgccagacatgcaactcnatcatcgccctagaaaacacatctctgtca

SEQ ID NO: 36350 - DNA, 101 bp, rice(Oryza sativa)
  misc_feature (71): n=t or c
tcaatggatcgctctctgccttgcaaatccaggctgcaagaaagtgaaatgataagcgagtcttcaacaanaacaacaaaaaagagaacacatgaatgtgc

SEQ ID NO: 36351 - DNA, 101 bp, rice(Oryza sativa)
  misc_feature (71): n=a or g
cctcttgtgtgcacagaaaaattttcacatccatcgtctatcaacctgaggtgacctaagctagctttgtntcactgtctttgatggcatatgcgcagcaa

SEQ ID NO: 36352 - DNA, 101 bp, rice(Oryza sativa)
  misc_feature (71): n=t or c
acctaaatcaaactcatcaggatatggcttttggtatgtacctgctcttcccataagctctatccagaagngctccattgttatactagccaatcgatcat

SEQ ID NO: 36353 - DNA, 101 bp, rice(Oryza sativa)
  misc_feature (71): n=t or c
ccatggttgcccattggcgtgtaagctagaatcaacaatcaagttcagccatcaacaatctgccggtggtnaagttgctatccctactcttcccaacttgc

SEQ ID NO: 36354 - DNA, 101 bp, rice(Oryza sativa)
  misc_feature (71): n=a or c
aatggctgactggaatgaaacagaccagcatgataacgaatcatttatggcttgaatatccctgcacatgncaaacaacacttacagtaaaactgaagtgc

SEQ ID NO: 36355 - DNA, 101 bp, rice(Oryza sativa)
  misc_feature (71): n=t or c
tcaaggcaggagaactttaagtaaggcatgaatgctgaaagatggttgagcggaagatacttgtgttaagncactcgattttgttcatctgtagctttgtg

SEQ ID NO: 36356 - DNA, 101 bp, rice(Oryza sativa)
  misc_feature (71): n=t or c
tagggtcatgacctatggcgtactattattcatatctatctacatgatgcatcggctgcgatgatctcatnaattgaacccacccagttatacctcagcca

SEQ ID NO: 36357 - DNA, 101 bp, rice(Oryza sativa)
  misc_feature (71): n=t or c
gttagtcttcttttcccctctatatatatgttgcgtcttacactcaaatttcgataagatgccagtctganagatgcattataagtttaagttacctctta

SEQ ID NO: 36358 - DNA, 101 bp, rice(Oryza sativa)
  misc_feature (71): n=t or c
tcatttgaaacgcatgaaaaatatccgcgttcctgtatatatatcctctagaataaccatgggagttcacntttttttccataaagttgtctttcttttat

SEQ ID NO: 36359 - DNA, 101 bp, rice(Oryza sativa)
  misc_feature (71): n=a or g
gaaaatcataggaaaacctaatcaaggttacagaaaacatgatgccaaaccttacgttattttttctccgnaaatcccatgaaatgagttgttacataaga

SEQ ID NO: 36360 - DNA, 101 bp, rice(Oryza sativa)
  misc_feature (71): n=t or g
gctagagtaatgatttcattgtatataatttgagaagattgcgtttgtggacggaggagaacttagagcangtacaatagcaggctagaagccaacatatt

SEQ ID NO: 36361 - DNA, 101 bp, rice(Oryza sativa)
  misc_feature (71): n=t or c
taagatcgaacttcgagaaaagaaacaatatatgcaggaagatggggaaaaatattttctaccggtactcncttcgtcaaaaaaaactcaacctaatccct

SEQ ID NO: 36362 - DNA, 101 bp, rice(Oryza sativa)
  misc_feature (71): n=a or g
aaaaaaactccaatcgactcgatcataagccttagacaaatcaagtttataggcacaagctgctttggctngactattgttcctctggatgaggtggaaac

SEQ ID NO: 36363 - DNA, 101 bp, rice(Oryza sativa)
  misc_feature (71): n=a or g
cacgagcatcctacttcaagagaatgggccggcttatcttaagattggtaaagtcaccacaagcataggtntagccataaatacacgtatttttgagattg

SEQ ID NO: 36364 - DNA, 101 bp, rice(Oryza sativa)
  misc_feature (71): n=a or g
gaccatcgattttcacttaaaatctgtgcatccattttttccaaccattggatctacttttagctgcaatntgttgtgtcttaaaaattaggaaacaaaac

SEQ ID NO: 36365 - DNA, 101 bp, rice(Oryza sativa)
  misc_feature (71): n=a or g
gggtgttggctcaatgatcactgtcctcctccctcctacctaatagtactagtataccggtgtcggggacnaagcaagcaactctcgaaggcaggttatgg

SEQ ID NO: 36366 - DNA, 101 bp, rice(Oryza sativa)
  misc_feature (71): n=t or g
ataccgtcaggcgtcagctgtcagatggcccaactgtattgccatttttgttctgctttacgcgtttcttnaactcatgggtctcactaattaagattctt

SEQ ID NO: 36367 - DNA, 101 bp, rice(Oryza sativa)
  misc_feature (71): n=a or g
ccttacacgtactcccgcccagcacctaaacactatcaattcaattctaagagaaagcccatttgacccantcttgcaccctgatggtgatctttgggttc

SEQ ID NO: 36368 - DNA, 101 bp, rice(Oryza sativa)
  misc_feature (71): n=a or g
tggaggcaaatgagagggatcagaggttagttttccattgaaaacccaatcgtttcgcatcagccaaatcncccatgtgcctgcagctaagcatgcaagca

SEQ ID NO: 36369 - DNA, 101 bp, rice(Oryza sativa)
  misc_feature (71): n=a or g
caatagagaatcggcgatcccgagattaccggcgagatcccttgtcaagatggtttcaacgagatctcccngcgggtaggcttcacgtcctccggattgta

SEQ ID NO: 36370 - DNA, 101 bp, rice(Oryza sativa)
  misc_feature (71): n=a or g
atcagagtcaaagtactacagaagctcacttgtggatgaaagtggaggcattggaccagaggaagaggacngccagggagagaatgaggcagtggcacacc

SEQ ID NO: 36371 - DNA, 101 bp, rice(Oryza sativa)
  misc_feature (71): n=a or c
acattgaatattttgaatctctcaaataaaaactcaagcgacagttttactatagtcataaagtggagganaattactgtagcactggaaagtggggactt

SEQ ID NO: 36372 - DNA, 101 bp, rice(Oryza sativa)
  misc_feature (71): n=t or c
attctttcgcacgtccagcggccatgcgctccttcacttcttggatcacttcgttgtccttctgggcttcntctatctgggttctcaaaagagggtgaatg

SEQ ID NO: 36373 - DNA, 101 bp, rice(Oryza sativa)
  misc_feature (71): n=a or g
gattgactgacttgagtacatactacgaaagtgtagttactaccaatgggtacttgggcttttagttgctnacacaacccaagtcgtacctgagaggttga

SEQ ID NO: 36374 - DNA, 101 bp, rice(Oryza sativa)
  misc_feature (71): n=t or g
tcctaatttttaaaatacaatcatcaataaagcaaatatttaaaaggaaaagtaactaagagcatgctaanattgtagccaaaataaatcttaccaaattt

SEQ ID NO: 36375 - DNA, 101 bp, rice(Oryza sativa)
  misc_feature (71): n=a or g
aagcaaattaagaagattgtgaacttccgaaagctccaagaaatgtaacctgtcggtctgaaccgacaagnatatatctttccttggctgccgagaaaccg

SEQ ID NO: 36376 - DNA, 101 bp, rice(Oryza sativa)
  misc_feature (71): n=t or c
ctgtttctttcaccggcgcaaaagccaatcgaggaatgaccacgcgctcgagcgctacttcggagacctcncctgcgtcgaggtgatcggcgagcccggcc

SEQ ID NO: 36377 - DNA, 101 bp, rice(Oryza sativa)
  misc_feature (71): n=t or c
actcgaatccacatctatgccggtggactcaccttcctcccagtagagcgaccattcacatacctagcgcnagctcgaaggttcctcagctgctgctcatt

SEQ ID NO: 36378 - DNA, 101 bp, rice(Oryza sativa)
  misc_feature (71): n=a or g
gcttggtttggggcaatgagagtaagagccatggggtggttgttgtatttgttcaccccaggtctttcaanagactccttcctgtagctctatgatgtacc

SEQ ID NO: 36379 - DNA, 101 bp, rice(Oryza sativa)
  misc_feature (71): n=a or g
aattgcgtttaaaaatttaaattttggttgtggctggtaagtcaagatgatgcaccatccatcgaaaatgngttgatttctggttatgcaccaataaatca

SEQ ID NO: 36380 - DNA, 101 bp, rice(Oryza sativa)
  misc_feature (71): n=a or g
tcagaacgcgctttacaaagaagtaatgcggggagggctgtccagcgtggtaccttcgcggaggcccttgnagcgggagaagtcgacgtgggacggcctct

SEQ ID NO: 36381 - DNA, 101 bp, rice(Oryza sativa)
  misc_feature (71): n=t or c
tttttgctaaagattgtgtaaacatcagaaacttactactaactactctgtcaaaaaaaaaaggcaaactntaattataaatctagacatacacgcatgtg

SEQ ID NO: 36382 - DNA, 101 bp, rice(Oryza sativa)
  misc_feature (71): n=t or c
tggcaatttcctgacggcgacggccactcgcacatttttttttccggcagatttaattattcggtgcccanatatgtttatgctatgtcactgtcactact

SEQ ID NO: 36383 - DNA, 101 bp, rice(Oryza sativa)
  misc_feature (71): n=t or g
catgcacacaaagttaagccaattagtccacttgattggcattctcaattaagttaactagatgtcccgcnctttaccgcggaatatatattagatatttg

SEQ ID NO: 36384 - DNA, 101 bp, rice(Oryza sativa)
  misc_feature (71): n=t or c
aagaagatccaaataactcatcttgtactggtagacagtattaaacaccaagatgaacacaaaccccaacnactcaaattaatgcacacaattcggttttg

SEQ ID NO: 36385 - DNA, 101 bp, rice(Oryza sativa)
  misc_feature (71): n=a or g
caccgattcactgaaaaaaaataaataaccttaaatacgagcatttgtgccaagtatagaatttgaatcancatgaatagttttcaccagcagaaatctag

SEQ ID NO: 36386 - DNA, 101 bp, rice(Oryza sativa)
  misc_feature (71): n=t or c
attccgaaagatcgcaagatacagttaattaagaaagcattccataagcaatccgcacaggagagattagncactcataacagaataacctactgacccat

SEQ ID NO: 36387 - DNA, 101 bp, rice(Oryza sativa)
  misc_feature (71): n=a or g
aggaattaaaaaaaatagagaaaatagagaagtgtaaaagacaacaaaacatagaaatgaccgtttgtttngaccgtaaaacaaaataatacaagaatcgg

SEQ ID NO: 36388 - DNA, 101 bp, rice(Oryza sativa)
  misc_feature (71): n=t or c
ctagaaaagcagtcaagtcaccactgaacattctgcatagacgtcccttctctaagggaaaagaggagtgngttgtaacaaatagtgctccatgtggtcct

SEQ ID NO: 36389 - DNA, 101 bp, rice(Oryza sativa)
  misc_feature (71): n=t or c
gtacctactccgatcctaacgtaccctagctacagccattaattgaattaaatgtttctcaacggctgcanagtcatcaaggtctccatgctgatctcgat

SEQ ID NO: 36390 - DNA, 101 bp, rice(Oryza sativa)
  misc_feature (71): n=a or g
gtcgtttcaacggagggaggtggctcctcgtggcggtgccagctgtgatgccttcttcgtctaggaggtcnctgtcctgctccttgcgacggttgcggcgg

SEQ ID NO: 36391 - DNA, 101 bp, rice(Oryza sativa)
  misc_feature (71): n=a or g
ccttatctaagaattacggtctttcgtcaaaaaggaaaagagatccattgcttactgctgctgagaagaanaagaaaaaaaacatctccctcgtgatacta

SEQ ID NO: 36392 - DNA, 101 bp, rice(Oryza sativa)
  misc_feature (71): n=a or g
atccgtttcttcttctcttgtttgttgttcactcgtcgactcaaatattctttccctccctgttgaacgtntgagattcttttcttttctttgccagatga

SEQ ID NO: 36393 - DNA, 101 bp, rice(Oryza sativa)
  misc_feature (71): n=a or g
tcagccaagcgcggtgccatgtggggttgttggggtggatcgaagaacaaatgtcaaggtcattgccactngctctgctttggtgtatcggagcactgact

SEQ ID NO: 36394 - DNA, 101 bp, rice(Oryza sativa)
  misc_feature (71): n=t or g
aacggaagataagcgtattggatgtatcctctaatgttgatatgcataaagtattaaccccgtccacaaanataattaagatcctgaatatgcaggaacaa

SEQ ID NO: 36395 - DNA, 101 bp, rice(Oryza sativa)
  misc_feature (71): n=a or c
ctatgtgcattttgttgtgccgtggcttccctcaaagatttttcaaccttcacaggaaaaacaatgtttcntatgtcaacacgagatgatgctgcaggctt

SEQ ID NO: 36396 - DNA, 101 bp, rice(Oryza sativa)
  misc_feature (71): n=a or g
ctaaacatatgttacctgaagttagagagagtgacttcaggaagggttcacaggtaagcttaaaattctcncttgcatgttaatgggctatttactgttca

SEQ ID NO: 36397 - DNA, 101 bp, rice(Oryza sativa)
  misc_feature (71): n=t or c
cgtggtaataggtcgacctctattgccatgctcacagtttggttgctatagatagttcccactattaccangctacacatgtcttgttgctatagttggac

SEQ ID NO: 36398 - DNA, 101 bp, rice(Oryza sativa)
  misc_feature (71): n=t or c
ttggagatggagctattttcttggagaggagtcctgccaaacagccccatagaggggattgagtgaattgnttttacgatggagtataatggtgtgcttgc

SEQ ID NO: 36399 - DNA, 101 bp, rice(Oryza sativa)
  misc_feature (71): n=a or g
ctagaagagagatgagtcaactcgatcgagatcaaattactcatgttatgtccagattcacagatttatantactaggatatgccacatccagtcttaggt

SEQ ID NO: 36400 - DNA, 101 bp, rice(Oryza sativa)
  misc_feature (71): n=a or g
tccactctatgactggtgggccctgatgccggttagtagtggattagctaaaattcagtcgattttgactnacatgtgggcccggcaatccttgttcttgt

SEQ ID NO: 36401 - DNA, 101 bp, rice(Oryza sativa)
  misc_feature (71): n=t or c
agaccacgacgagcaggatggaagcgggagtgatgagagatcaggagaagcgaaggtctgagcctatgtgngttaggatgctacgtagataattttttttt

SEQ ID NO: 36402 - DNA, 101 bp, rice(Oryza sativa)
  misc_feature (71): n=t or g
tggggcccacccgtacttggggttttttttaatgtatacacccgtcccagtcacggacaactagtatgagnaaggatatgtgtgagtgagtgcctcgtccc

SEQ ID NO: 36403 - DNA, 101 bp, rice(Oryza sativa)
  misc_feature (71): n=a or g
gactttgcttatatgtatatctttggtagatcaggttggtgcatatatatattttttctatagaagccctntttgattcaacttaagattattataatctc

SEQ ID NO: 36404 - DNA, 101 bp, rice(Oryza sativa)
  misc_feature (71): n=a or g
tagtcattcttagattggactatatcaatttttcagatgatatattctgttcctctgcaaaagtttccaantgaaaattcggcatattaattgtcataatt

SEQ ID NO: 36405 - DNA, 101 bp, rice(Oryza sativa)
  misc_feature (71): n=t or g
ttagcaagataattaacttactggaagtgcacccgaaatgctcggtgcaattctctctgcttcatttacanattctatgatatctgtgagttgtatccttt

SEQ ID NO: 36406 - DNA, 101 bp, rice(Oryza sativa)
  misc_feature (71): n=t or c
aaaggctgtaggaatatatcaccacctgtcatcatcataggatggacaagtggctcatcccgcaaagtttnccacactactacaaaacatcaaataggtgt

SEQ ID NO: 36407 - DNA, 101 bp, rice(Oryza sativa)
  misc_feature (71): n=t or g
gagagagagagtgatcaggtcaattatatcatgctcgttttcaattatatcctatcctgtgaaactgacgngccggctaaatgtgtaccaaacaaatagta

SEQ ID NO: 36408 - DNA, 101 bp, rice(Oryza sativa)
  misc_feature (71): n=a or g
aacatatggggtagtaggcagtgggagcatgctatgttcctcatcttgcattgttgtatctgtatcatctngacggagatcatcccatgcctttgtgatct

SEQ ID NO: 36409 - DNA, 101 bp, rice(Oryza sativa)
  misc_feature (71): n=t or c
acgagcaccatgcaaaatcagtaaaaaaacaagcccaccaagaatcgaacccagacactaagccttcaaanctcgctgtactagccatttgagctctattt

SEQ ID NO: 36410 - DNA, 101 bp, rice(Oryza sativa)
  misc_feature (71): n=a or g
gtgcgggccgtgtgaccgctcgtggcccatacttcttatggcccagtccactttgactcctttaatagttngccgaatctaatttatatgcctcaaccaga

SEQ ID NO: 36411 - DNA, 101 bp, rice(Oryza sativa)
  misc_feature (71): n=t or c
ggcggcgcaatgaggtgaggcggagggggagagcgaacagcgactttagggtttggtgagaaattcccgtngaattttttttggccgaaatatttgaccgg

SEQ ID NO: 36412 - DNA, 101 bp, rice(Oryza sativa)
  misc_feature (71): n=a or g
aatggcatgtaaatgagcatgcgaaggggcagctctagatgctgacactgatgcagctaagtggcctaacnagccccatctctcaccaacaacctatattg

SEQ ID NO: 36413 - DNA, 101 bp, rice(Oryza sativa)
  misc_feature (71): n=a or c
ttctcaaactccctccctcgatcggtcatggtcaccgcggtatgttttttttggaaaaaaagaaaaggaanaaaaggaaaacacataggaaaattgtagaa

SEQ ID NO: 36414 - DNA, 101 bp, rice(Oryza sativa)
  misc_feature (71): n=t or c
atcaccccgcaatcgcaaaaccagataccgggcgtccttcgactaataaaaccgtttgccttagctccctnggtggttttgaccccggttttatgcgacgt

SEQ ID NO: 36415 - DNA, 101 bp, rice(Oryza sativa)
  misc_feature (71): n=a or g
atcatgttttcttaaggatgttccaaggggtcaagatgaccgacctgaacatgctgacctcaaaaacaaanattacaaaaggcaggtggactgcaagcaac

SEQ ID NO: 36416 - DNA, 101 bp, rice(Oryza sativa)
  misc_feature (71): n=t or c
atccaagccgctatgtacaccctcaccaaagattgtaaatttggtgataagcagagcacaaagctaagtgncaaagggcatgtagcctagtgattgcagtg

SEQ ID NO: 36417 - DNA, 101 bp, rice(Oryza sativa)
  misc_feature (71): n=a or c
catttgccttagctgggattgaggggagatgaaattaagagaacaatgagatgatagatgagccattaacntatgattaattaaaaaaacctatagatttt

SEQ ID NO: 36418 - DNA, 101 bp, rice(Oryza sativa)
  misc_feature (71): n=t or c
tgtccattcatgggggtgatgatacgcgtgttgtgagcaagttttattttttaaaaaactagaaaaaatgnccgtgcgttgcaacgggtgaaatttatttt

SEQ ID NO: 36419 - DNA, 101 bp, rice(Oryza sativa)
  misc_feature (71): n=a or g
gtagctgtacaataattagtgagaaaatttggtagcaactatgtacaattcctgaaggcatgccattcctnaaagttaaagagccacacaacatcaaaatt

SEQ ID NO: 36420 - DNA, 101 bp, rice(Oryza sativa)
  misc_feature (71): n=t or c
ttacttgtaccaaaaagaaaacaaaaaaaacaggctgaaattttatggccctcgaggaggcacctgatggnaccacaaaattctagtattaatttgtggta

SEQ ID NO: 36421 - DNA, 101 bp, rice(Oryza sativa)
  misc_feature (71): n=a or g
ccgttccttcttcctctccgctctctcgatggctggtcctcctccgcaccagccgtcctcctccggagatntcgaggtcgccgtagagagcggctccgggg

SEQ ID NO: 36422 - DNA, 101 bp, rice(Oryza sativa)
  misc_feature (71): n=a or g
cacatttgttccatgcggaaaattctaagtgattgctcgaaatgtaacgtgaacattttctgtacatgccnattctcgtaaatgtgcttctgaacatattt

SEQ ID NO: 36423 - DNA, 101 bp, rice(Oryza sativa)
  misc_feature (71): n=t or c
gacgtccgttgcgcacacgaatgctatcgtaagtacttattatcagagcaggtacaataaactgactcagngagctgcaaaactatgccacatcatcatat

SEQ ID NO: 36424 - DNA, 101 bp, rice(Oryza sativa)
  misc_feature (71): n=t or g
tgtcttcatgatatacattgcaacatggcctacttatgacctcctgggcattggcatgaaactttgaaagntcatgcattttgtttcccttagtatcagca

SEQ ID NO: 36425 - DNA, 101 bp, rice(Oryza sativa)
  misc_feature (71): n=a or c
ccgaattctaaccctatgtaccacatctctgaattttgtagagtagattataaataagttagcactctctncattttatattataagtctttttttacttt

SEQ ID NO: 36426 - DNA, 101 bp, rice(Oryza sativa)
  misc_feature (71): n=t or c
accaagccatcacactaagtagatcaactgttagggctcaagattaaccagaagatgatgatgattttgcnagtaattaccactccctccgtcccataaaa

SEQ ID NO: 36427 - DNA, 101 bp, rice(Oryza sativa)
  misc_feature (71): n=t or c
acaacacatcttgctgctctagaagcgaagaattctcaaagcaaaaccttaacgacgacaacagcagcagntagcatggtttgaccaagacaaaatgacga

SEQ ID NO: 36428 - DNA, 101 bp, rice(Oryza sativa)
  misc_feature (71): n=t or g
tgttcatggaagatatatagcaggcacatgacagccacaatcatcaaggcaaagctgtttatggctgatantacaagttctgttagacagacctttcaggg

SEQ ID NO: 36429 - DNA, 101 bp, rice(Oryza sativa)
  misc_feature (71): n=t or c
gtcctgtggaggaaaccacggacgttgatatgaactctgatgcaacagagtcaaccagcataaacaataangattgtgacgatgaaacaatgactgaagat

SEQ ID NO: 36430 - DNA, 101 bp, rice(Oryza sativa)
  misc_feature (71): n=a or c
tgtatctgttgctttggttttgttttctcatggtttctctttttgcctctgcaaaagtgcaggaatgctangtgttcgtagttagggatgaaaacggtcgg

SEQ ID NO: 36431 - DNA, 101 bp, rice(Oryza sativa)
  misc_feature (71): n=t or c
gaggttcaccgaaaccaattaaagttttagtatgacatgtttttgactctatggaatccatgacaggaggngaattcagatcaaatgaaaccacggcacga

SEQ ID NO: 36432 - DNA, 101 bp, rice(Oryza sativa)
  misc_feature (71): n=t or c
aactggaaagcaaccagcaggggccctcggccctcccatctgtctatactactggagtagtatctgctggntgctgcccatactacccactcacccaccca

SEQ ID NO: 36433 - DNA, 101 bp, rice(Oryza sativa)
  misc_feature (71): n=t or g
ctaaggatatctagtaggaaattagcattaggtaactacaattcatctgtacttttgtatatactaatcangtgtacttttgtatatactaatcaggtcta

SEQ ID NO: 36434 - DNA, 101 bp, rice(Oryza sativa)
  misc_feature (71): n=a or g
atcctcaaccaggacatctttgctaaaataccatcttagacaaaaatgttagaacaattgggctaggcccnatttattctattaaatctcaaaggcccata

SEQ ID NO: 36435 - DNA, 101 bp, rice(Oryza sativa)
  misc_feature (71): n=a or g
gaaggccaagcttgccattgatgaactcccatgcttcatgtgtaaccagaccttcctgtggcagaggctcngcctacgaccaaggacctccgccgagcttt

SEQ ID NO: 36436 - DNA, 101 bp, rice(Oryza sativa)
  misc_feature (71): n=t or g
cgaccattgttgtcgctcttatctcctcccggtcaaccaagtcaacggagcgaagctaccagcatggcaanggcaacgctgacgtggccgatgctccccac

SEQ ID NO: 36437 - DNA, 101 bp, rice(Oryza sativa)
  misc_feature (71): n=t or c
cgtgctcaattagcctgtctctatagtaatctatcagatcgatcggagctttgcgccgtgccgccaattantggcgctatacgcacattcccgtgctgccg

SEQ ID NO: 36438 - DNA, 101 bp, rice(Oryza sativa)
  misc_feature (71): n=t or c
gcatgtatggagcttggtgtcatcagctgatgggataacaactgctccaacttaccagcagtctagagaanaaggattgaaaatgctcagcagaacataaa

SEQ ID NO: 36439 - DNA, 101 bp, rice(Oryza sativa)
  misc_feature (71): n=t or c
gacgtctagcaaggggaaggacgtggtggtgactcccgacccggtctccaagaataagttgataggttcgncgggataacccgggaatctaggggcaacga

SEQ ID NO: 36440 - DNA, 101 bp, rice(Oryza sativa)
  misc_feature (71): n=t or c
ggattgcacctggcacgagttagtgaccgggtaagttgttctaccgatttgtggcttgcttttgtgattgngattggttcgaatcagttagaggtgcgaat

SEQ ID NO: 36441 - DNA, 101 bp, rice(Oryza sativa)
  misc_feature (71): n=t or g
acttgtcctttcatactgaatactgactactgagcaacactcaccatgttaattgcacggtgaaaagaaangcaaccttttctatcatggagtacagagaa

SEQ ID NO: 36442 - DNA, 101 bp, rice(Oryza sativa)
  misc_feature (71): n=t or c
acagagaccactccctgttggtttgccagcgtggctatggtattttaattacgaactcttacttcataccnggatgtgaaggaattcaaaggaccgacatg

SEQ ID NO: 36443 - DNA, 101 bp, rice(Oryza sativa)
  misc_feature (71): n=a or c
ttccatccaactcacgcgcaacagcctccttccatccaactcaggcgcaagagcgcaatcgaccacggcanaaggcaaaccagaccacagagaccaagatg

SEQ ID NO: 36444 - DNA, 101 bp, rice(Oryza sativa)
  misc_feature (71): n=a or g
agagataacagaagactggcggactccgctcatcgatttcttggttgtcgacaagtagccagaggacgacncggaggcagaaaagctattccgtcatgcca

SEQ ID NO: 36445 - DNA, 101 bp, rice(Oryza sativa)
  misc_feature (71): n=t or g
agaatatattttataaataggttctcaacataatttatcaacctcttcacatcagcgacttagttaccacnaaggacgagagtgttaaggttattggtgtc

SEQ ID NO: 36446 - DNA, 101 bp, rice(Oryza sativa)
  misc_feature (71): n=t or c
gagttgtgtgcagggtttacagtttacattttcagaactgagtttttaaaattcctgaactgtcggaactngatttccgaaattaagagtttcagacattt

SEQ ID NO: 36447 - DNA, 101 bp, rice(Oryza sativa)
  misc_feature (71): n=a or g
gaaaatcaatgcacaccctaagtttgccttttttttcttgatcattggaactatattggaaactcactcgncatatcggcacggttgaataaaaccagcat

SEQ ID NO: 36448 - DNA, 101 bp, rice(Oryza sativa)
  misc_feature (71): n=t or g
ttccgtcacacgtaacattcattgtgaagtcacggctcacgagcaaactacaaaagagagtttgtgtgatntggatagcaagcgaatgaaactcgcagagt

SEQ ID NO: 36449 - DNA, 101 bp, rice(Oryza sativa)
  misc_feature (71): n=a or g
taattgatattgtatacatcaatgaacgaacaatgagtaaatgataacggttaaactgttgaattttttgngacataacaatatatactaacctttagttt

SEQ ID NO: 36450 - DNA, 101 bp, rice(Oryza sativa)
  misc_feature (71): n=t or c
aagagcaaaagaacaaatgggaggaggatgggtggctgatgaagcctaaatacctgagaaaaagtcgcgcngacctcatgccgccgctcgacgagatggga

SEQ ID NO: 36451 - DNA, 101 bp, rice(Oryza sativa)
  misc_feature (71): n=t or c
gatgagagagagagagagatagagagaacgacgaataatggaagagatagaggggtgaggggaagagaagnaggtgggtcccaccatttttttaaaaaaaa

SEQ ID NO: 36452 - DNA, 101 bp, rice(Oryza sativa)
  misc_feature (71): n=t or g
gcatcaaaaggtctaattgagatactactctcgccgtagtacctcccacagtaatccaaactagtaaattngtgccatttgcatctaactttaatgttcaa

SEQ ID NO: 36453 - DNA, 101 bp, rice(Oryza sativa)
  misc_feature (71): n=t or c
gttgcaaccagtagcatcagtgcacttcagaaatcaaaacagcaaagcactctgataagtgatcaggctangagcactcggatccaaaatcgcaagaaaaa

SEQ ID NO: 36454 - DNA, 101 bp, rice(Oryza sativa)
  misc_feature (71): n=a or g
aggtaactaaaaaatctattgattttgtcatttattacattcatcggtcattactaacatgtctttccttntttcccttgttcaatgctgcagcgcaatta

SEQ ID NO: 36455 - DNA, 101 bp, rice(Oryza sativa)
  misc_feature (71): n=t or c
ccgtggccggaggccggaggcgagcgttcagagtgtgcagagatgcttccaaggcgatggcgagttgaagngttcgacgtgcgcacgagttcgcattggtg

SEQ ID NO: 36456 - DNA, 101 bp, rice(Oryza sativa)
  misc_feature (71): n=a or c
tagttttaatcgtttcatctcggtcttgtctcacattaaacttcacaaccatacaaatctcacaacctttnaatgagggtatgtttagttttttgggtgta

SEQ ID NO: 36457 - DNA, 101 bp, rice(Oryza sativa)
  misc_feature (71): n=t or c
gttagctggctaaaagaagggcgcaagtttggatccctgaaagtgaaaatggtaacagagataaatcatgnattagtacaactgcaatgtaaagttaacaa

SEQ ID NO: 36458 - DNA, 101 bp, rice(Oryza sativa)
  misc_feature (71): n=a or g
aagatttgccattgagataataaaggaataactacaatttaaactacttttatatactatctttatctcanaatataagagatatatgcattcaaaatttt

SEQ ID NO: 36459 - DNA, 101 bp, rice(Oryza sativa)
  misc_feature (71): n=a or g
caacaaccaacaactacgtaccgagtcccagcttcgtgataagatggttaggcaatgctgagaaacgctcnagggtttttttttctagctttataagatgg

SEQ ID NO: 36460 - DNA, 101 bp, rice(Oryza sativa)
  misc_feature (71): n=a or g
agtgataccagctgaatcactgtgatatgtatataatttgaagaatgatggcaacaggtggttgtgagatnctgtgtctgggggcacacacacaaactggg

SEQ ID NO: 36461 - DNA, 101 bp, rice(Oryza sativa)
  misc_feature (71): n=t or c
tttggagattaacatatagacattagacattttctttcatgtaatatagtagtagaacacacaagaggttnaagcttgaatgattagaaaagcttcttgcc

SEQ ID NO: 36462 - DNA, 101 bp, rice(Oryza sativa)
  misc_feature (71): n=t or c
catcaggaagcggcaggatcgacaatggcattggttgtgacaaaagagaccttccctaaggaagcgatggnggtggcaggaggaggggcagtcaagagcaa

SEQ ID NO: 36463 - DNA, 101 bp, rice(Oryza sativa)
  misc_feature (71): n=a or g
atgaagtgatgaacacaggattggatattgtactctattgttaggtcggatatagatatccttggggcganctgagaaagactagctagcggatcagagta

SEQ ID NO: 36464 - DNA, 101 bp, rice(Oryza sativa)
  misc_feature (71): n=t or g
ttcccaagacagttagcaaagaacacactgggaattgacccattgacaggacatttcccggtgtctcccanacctaagtgtcctagaagagatttgctccg

SEQ ID NO: 36465 - DNA, 101 bp, rice(Oryza sativa)
  misc_feature (71): n=a or g
ttgttgcaaagtctgtagctcttgggttgaattgaatctctaagtgaggtgcggttagataccccgatttngattattggagtagtatttcttcactgaac

SEQ ID NO: 36466 - DNA, 101 bp, rice(Oryza sativa)
  misc_feature (71): n=t or c
cacctgactgaaaagctactccttccgcgctttgcaaatgcatgcagccgtcactatatatgactacacanatatatatatacaccacacacataaccttt

SEQ ID NO: 36467 - DNA, 101 bp, rice(Oryza sativa)
  misc_feature (71): n=t or c
tttgtcatatacattggtgatgcccttaggagcagacattttaaaaccactttggaacagggtttgaaatnccggttcgaaatttctgaaatttcaataat

SEQ ID NO: 36468 - DNA, 101 bp, rice(Oryza sativa)
  misc_feature (71): n=t or c
atagttaagggaaaatgataataatcttggaaaggataattacttacaaatgattgttttgatgacttacnggttaggtacatgtataccaaacatattaa

SEQ ID NO: 36469 - DNA, 101 bp, rice(Oryza sativa)
  misc_feature (71): n=t or c
aatggggtaaaaagtcctggagacaataaactattgaactgttggaagagtacatcaaagcactataaccntacccaagaaaaagatctaaaatactgtcc

SEQ ID NO: 36470 - DNA, 101 bp, rice(Oryza sativa)
  misc_feature (71): n=t or c
aaaggggaaaaatattttgggaaacctttggaatttggatgatgcgtcttttgtttgcttcttggtatttnttttcttatggatattctctagatttatct

SEQ ID NO: 36471 - DNA, 101 bp, rice(Oryza sativa)
  misc_feature (71): n=t or c
gtattacatattttttttattttttaactaagataccacgtcaaccaaacattgattcgtatgatctgtangattttattcaacccagttttaaaatatgg

SEQ ID NO: 36472 - DNA, 101 bp, rice(Oryza sativa)
  misc_feature (71): n=t or c
ggtgagagaaaaatagaaccctctccctcgcactagttttcaaacgtggtcattttgtgatgccaaggcancgcctcaagagaactagcgtcttgatcggg

SEQ ID NO: 36473 - DNA, 101 bp, rice(Oryza sativa)
  misc_feature (71): n=t or c
gagtttgcaatggatatctaaggtcgcactttactaattgataatgtaattcctatgtaacattttgatcntaattaagaaaggtccttttgtagaagtcc

SEQ ID NO: 36474 - DNA, 101 bp, rice(Oryza sativa)
  misc_feature (71): n=a or g
cttcatggtccttcaaacgctctgaagaacaatgagagagcttttttttttctataagatcctttgcactntcagatatctttagaactgattgaaaatca

SEQ ID NO: 36475 - DNA, 101 bp, rice(Oryza sativa)
  misc_feature (71): n=t or g
aggaggggaggatgtggccgccttggctaccgtggctgctagatccactctgcatcgatgagccagtccanatctggatgggcagatccaagcaccaattc

SEQ ID NO: 36476 - DNA, 101 bp, rice(Oryza sativa)
  misc_feature (71): n=a or g
tttcagaatctgggtgacaatctgaactatttgggatatagagattctctagaaggagctgcaacacctanaaactcctccaaacatgtccacagtaaccc

SEQ ID NO: 36477 - DNA, 101 bp, rice(Oryza sativa)
  misc_feature (71): n=t or c
gcagcccgaacctgtataatccttggtcttccatgcatactcgtgaacgatccagtagttagatctcaagnggaagtctcttgatcatcgcgccatctccc

SEQ ID NO: 36478 - DNA, 101 bp, rice(Oryza sativa)
  misc_feature (71): n=a or g
atcataccggacttaacgcttgcctgtgcgactagggcggaggtgttcctgcgattcatcttctggtagcnggcttccagatccatgtactgctctcgaag

SEQ ID NO: 36479 - DNA, 101 bp, rice(Oryza sativa)
  misc_feature (71): n=t or g
tgaaagattaaaaatacccctgagcccacttgtcatattcttcttcctcctcaattccccttttctcccanatccacgctgccgccgccaacggcgtccta

SEQ ID NO: 36480 - DNA, 101 bp, rice(Oryza sativa)
  misc_feature (71): n=a or g
tgtctgatgagaatattcgtcaatcagagagaggtatgagctcttgtgagcgcggttaccatgataattcntatggttgttttttattaatttaaattcag

SEQ ID NO: 36481 - DNA, 101 bp, rice(Oryza sativa)
  misc_feature (71): n=t or c
ccaagcacccttagctcagctccatgcacattctaaacaagacagaaggaaaaagctcaaagaaatgcaangccaaacacctagatttgcatggacagcaa

SEQ ID NO: 36482 - DNA, 101 bp, rice(Oryza sativa)
  misc_feature (71): n=t or c
ttgccctcgttgttttggccggtgggctggtggagccatgtcctcaccatttcatcctcttatagcatcancaacagattatctataattttcttctaaaa

SEQ ID NO: 36483 - DNA, 101 bp, rice(Oryza sativa)
  misc_feature (71): n=t or c
ccactggtccaaagtgatacattttggtaacaaaatctggtgtgaagtgaaagcatggagttaatggtggnttaatgtgaaaccatggttaaaaaacatgg

SEQ ID NO: 36484 - DNA, 101 bp, rice(Oryza sativa)
  misc_feature (71): n=a or g
ctcaacttgcaccgcctgaaaaaactcggaatttggtctctaaatttgtgtgttcaggccatgaacaaagnctgtgtttagattcaaagtttggatccaaa

SEQ ID NO: 36485 - DNA, 101 bp, rice(Oryza sativa)
  misc_feature (71): n=t or c
agcctccttagaaggctaaacagcagatatgctgattcaactaatgttattacctatgaacaatgtttcgntcatgcaggtaagtcaacccattaagaatc

SEQ ID NO: 36486 - DNA, 101 bp, rice(Oryza sativa)
  misc_feature (71): n=a or g
acatgatagttgaggaaggctcaggcatcttcctttaatttcgagcctcattcttaataatatctgatatnagagcccctcctctcatatccagcgtttta

SEQ ID NO: 36487 - DNA, 101 bp, rice(Oryza sativa)
  misc_feature (71): n=a or g
catcacattgagcatttacttgtccctgagtaaagattattgattacatcagagctgaaagtgtcaattangcctagaggggggggggggcggtgaatagg

SEQ ID NO: 36488 - DNA, 101 bp, rice(Oryza sativa)
  misc_feature (71): n=a or c
aagtatggcccagtaagttcaacaaacatggaaagcgcatagaagtgattcaccagtagcatttgcagcanaggtgaatggaagacatgtaatataaaaag

SEQ ID NO: 36489 - DNA, 101 bp, rice(Oryza sativa)
  misc_feature (71): n=a or g
gggggtggcgaagacgcgtccacggcctgggtaaatcaagcgcgagttgaggttgacacctttcgaatacnaagttaacgaaccaagggactcaccgatgg

SEQ ID NO: 36490 - DNA, 101 bp, rice(Oryza sativa)
  misc_feature (71): n=t or c
ctctctctatataaaccgagccaccacctcctcacaacatacgccaaaacaacctagggtttgtctcctcntctatactacattattgctcgtaatctact

SEQ ID NO: 36491 - DNA, 101 bp, rice(Oryza sativa)
  misc_feature (71): n=a or c
tgtttttcctttactccatccacacctattcgcatgaaattactatatatttcaaatcctctgttttatanttacattcctatcctatttctatatttttc

SEQ ID NO: 36492 - DNA, 101 bp, rice(Oryza sativa)
  misc_feature (71): n=t or c
ggacgcgaattagactttgactgcgcttcttttctctagcccgattgaaagagggtcatgaaatggacttngggaaagagagggagatgggctgacgatga

SEQ ID NO: 36493 - DNA, 101 bp, rice(Oryza sativa)
  misc_feature (71): n=a or c
cagatactgcctttcctaattcctgtttatttgtctctaatatctcatatgcatgtatgggtagaatgtgnactcgttagtgtttaagatctaggtttagg

SEQ ID NO: 36494 - DNA, 101 bp, rice(Oryza sativa)
  misc_feature (71): n=t or c
attcactttgagttttttttaatttagaagattattgaagtgaaacaaacgtgagtggcatgtttacgtgngtgtgtgtgatatttgaaatccatagacct

SEQ ID NO: 36495 - DNA, 101 bp, rice(Oryza sativa)
  misc_feature (71): n=a or g
tccctccgttccaaaatataagtatttttagttatgaatatagacaaccatgtgtccagatttagggagcntatcctatgcacacaggccctcgcgtgtac

SEQ ID NO: 36496 - DNA, 101 bp, rice(Oryza sativa)
  misc_feature (71): n=a or g
aagaagaagaaaagtaaagtttaattacacaacacaagcagcagaaggctgttgtcagtggacaaggatanaagaaccgaaaacaagtaacaaacaaaaat

SEQ ID NO: 36497 - DNA, 101 bp, rice(Oryza sativa)
  misc_feature (71): n=t or c
tgtatgggtatatgtaattgcttttaatgcaggtgataaaactcacaagaaagatgatcccatatgcatgntcccacatcattttctctttttctttttgc

SEQ ID NO: 36498 - DNA, 101 bp, rice(Oryza sativa)
  misc_feature (71): n=t or c
ctaacttgctgacaccaccttcatctaaaagtgagtggtgaaatggtactacagcaccagtagctgcagtnaatgtgtctttcatactatgtgtcccacga

SEQ ID NO: 36499 - DNA, 101 bp, rice(Oryza sativa)
  misc_feature (71): n=t or c
tgggagggaaactgctcctcttttgaaacgaagaaagctgatgtctttgtaagcagacacggctatgaagnatcaggcaatttctgaaataggaatgtggg

SEQ ID NO: 36500 - DNA, 101 bp, rice(Oryza sativa)
  misc_feature (71): n=t or c
agctgcttttgctagcttgagctcgcgctagctaggtaaatgatagtactccatacactgatctagccggncggcatggtgtacgtaacgtgtatgtgttg

SEQ ID NO: 36501 - DNA, 101 bp, rice(Oryza sativa)
  misc_feature (71): n=a or g
gacggagggagtatactgtttaagacacatacattgtgaggtgtggttctctacccggttgttgacgaccnaatttggtaaattatgaacaaagttcgaca

SEQ ID NO: 36502 - DNA, 101 bp, rice(Oryza sativa)
  misc_feature (71): n=a or g
tgattggcatgtacaattattttgcatgcataatttatgattacaatagttggatgaattatttggtttancactcggatcaggggggctcactgacgaca

SEQ ID NO: 36503 - DNA, 101 bp, rice(Oryza sativa)
  misc_feature (71): n=a or g
tatgtttcaaaacaccccaggtagatgggccaagctaaaaaaccccacatttacttagtttttacctaatnggcttgccaacgtggttgtttgacccactc

SEQ ID NO: 36504 - DNA, 101 bp, rice(Oryza sativa)
  misc_feature (71): n=t or c
cctatgacaacatcacaaaaatgagactccgaaaatggtgccatcatataggtcatgacatcatggatgtngacatcgcccatttaagaaacatgcggttt

SEQ ID NO: 36505 - DNA, 101 bp, rice(Oryza sativa)
  misc_feature (71): n=a or g
gatgcgcattactactacttaggtaactgattatatagctaggaccatacatataggaagtacacccctgnttggacactacaggcatactctctccgtcc

SEQ ID NO: 36506 - DNA, 101 bp, rice(Oryza sativa)
  misc_feature (71): n=t or g
cgtcagattagttaatgtgtgattttgtgacattctaggccactaatatagaaccgggtgacagagcccantggcccatcactgaggcactcacttgtaac

SEQ ID NO: 36507 - DNA, 101 bp, rice(Oryza sativa)
  misc_feature (71): n=a or g
acattactgtagaagaaaagcggctgtccagaattgaggtctgatcaggacagtagcagtgaagtacatgnaagggttagattttcaatactggccgtgtt

SEQ ID NO: 36508 - DNA, 101 bp, rice(Oryza sativa)
  misc_feature (71): n=a or g
ggacttttccgagaacatccagaacgatgtccgaaaaatcctttgttgtccaaactgttggtgctgagctngaattttcggacatgtccgaaaatctttcg

SEQ ID NO: 36509 - DNA, 101 bp, rice(Oryza sativa)
  misc_feature (71): n=t or c
gtgcccgatctttttaatgcaagctgccttctaaaaatattcttgtgtatgatgctgccatgctggtgttngtttttgaattcgtggtgtaagatcttgaa

SEQ ID NO: 36510 - DNA, 101 bp, rice(Oryza sativa)
  misc_feature (71): n=a or g
gaaactagccaatgagttgatggaattttcaaatgactcaagaaaattgagcacatcaaacagatgcaatntgtacacagtttgccatgacagatgcccct

SEQ ID NO: 36511 - DNA, 101 bp, rice(Oryza sativa)
  misc_feature (71): n=t or g
tggcctcgacgaggtatcagccgcgcctccaagatgagatgggtcaggccccgtttggcaagataaatgtntactgagggtattttagtcattttgaacta

SEQ ID NO: 36512 - DNA, 101 bp, rice(Oryza sativa)
  misc_feature (71): n=t or c
accgtaccaaaaactaatttcaaaaataggtcattttctcagcgccattgtgattagcgctgagctataanatctcagcgccactatcattgacactgaga

SEQ ID NO: 36513 - DNA, 101 bp, rice(Oryza sativa)
  misc_feature (71): n=t or c
taacctttttttcttagcaattctcatcttggagatggtcagtgcaacccattggcccaagagaatctatncatgactcgaagtctcgaacaatggcctgg

SEQ ID NO: 36514 - DNA, 101 bp, rice(Oryza sativa)
  misc_feature (71): n=a or g
tcttcatccctgatttccccagagacttgacttgacgagtaaacgcgttctcctgccgccgccgcacgccngtatccttggcggtgccccctcgcttcggc

SEQ ID NO: 36515 - DNA, 101 bp, rice(Oryza sativa)
  misc_feature (71): n=a or g
acgcccttttttttcctccctgatgaggggggtgctgtaacatgaattggacagtgtttagcatcttgttnaagagttgtgcaaaccttttcttccgatga

SEQ ID NO: 36516 - DNA, 101 bp, rice(Oryza sativa)
  misc_feature (71): n=a or g
ttagatcatttattctataaaaactgcaacacactctatacggtgcacgtaagtagtaattaaggagtatntcttttctaaatcaactgacagttatagct

SEQ ID NO: 36517 - DNA, 101 bp, rice(Oryza sativa)
  misc_feature (71): n=t or c
ttgagggaggcaaaatagacttattccttataactaagggcctatttggtttggggaaattttgttcaatnttagagaaattgaactgttcctatgaaaat

SEQ ID NO: 36518 - DNA, 101 bp, rice(Oryza sativa)
  misc_feature (71): n=a or g
aattattcatcgttgttattaccgttaaacatcagaactgaagttggagactaagatggtacaagtgtcantagccgagttaccttcagaatgtatcacaa

SEQ ID NO: 36519 - DNA, 101 bp, rice(Oryza sativa)
  misc_feature (71): n=a or g
tcttcgtaagtagcatgagttatgcagaactatgaaagtagtacgatgcaaaacaaaaagaatctccgcanaaggcagatgaataagaataatataaaata

SEQ ID NO: 36520 - DNA, 101 bp, rice(Oryza sativa)
  misc_feature (71): n=t or c
atcgtccatgagacccacacgagcaactaacttggtaactaacaccccgagaaaaagccaccaacttttgntccccaatcgatcatcatctcccatgtatc

SEQ ID NO: 36521 - DNA, 101 bp, rice(Oryza sativa)
  misc_feature (71): n=t or c
ggcagcagactcaataccgagttttttgtgttctgaactctaaactcttttctttggctatagatatcggngaaccatcacgataaaaattttgatcgggc

SEQ ID NO: 36522 - DNA, 101 bp, rice(Oryza sativa)
  misc_feature (71): n=a or g
ctgccagaaagaataaggttatttttatagacggttcttttagaggtccgctaggcttatttttataagcngtcttctcgaagactccgtccatagaaaac

SEQ ID NO: 36523 - DNA, 101 bp, rice(Oryza sativa)
  misc_feature (71): n=t or c
ccttcgtcctaccaaacgcatcgatcctgcatgtagcacgatgaacaaatcaacccaaataacgtaccgtngattttactagactcgtgttatcgttgcca

SEQ ID NO: 36524 - DNA, 101 bp, rice(Oryza sativa)
  misc_feature (71): n=a or g
gttcgccgacaaccgccgctcctatgcctttcacctgtgagcttttccttaatccaatctaacctaatccnctgtctgtctagcgtagtcgtcgtctccgt

SEQ ID NO: 36525 - DNA, 101 bp, rice(Oryza sativa)
  misc_feature (71): n=a or g
aaaccaacagataatttttttttgtttggcttttataaagctataagtcactcttagactgtgcagcaagngatgggaagtaatccctcccgcacagaaaa

SEQ ID NO: 36526 - DNA, 101 bp, rice(Oryza sativa)
  misc_feature (71): n=t or c
ataccccatgtattaatatgtaaaaaccgctctcatttgggtggattgaatgcagaggaatatatttacanttgttgagttcttgcaacaactccaggcat

SEQ ID NO: 36527 - DNA, 101 bp, rice(Oryza sativa)
  misc_feature (71): n=a or g
ccagcagccaggcaagacccttagagatgaagacaaagaacgaggaacgacgttgaccccagattgtatcntcggtgttatcgacatcggttcttccgaac

SEQ ID NO: 36528 - DNA, 101 bp, rice(Oryza sativa)
  misc_feature (71): n=a or g
ttagatgccgtacctttcggatccacggagaccatgagggacagtaggatttttttaaaaaaattacacantacaacgcagacactcacaatggaggcacg

SEQ ID NO: 36529 - DNA, 101 bp, rice(Oryza sativa)
  misc_feature (71): n=t or c
catgcggttgagccattgtgttcggctgtggcccggttctaaactgcattccttgcatatctgccgaaacngtgcttgtcatctggcttaggtcgaattgt

SEQ ID NO: 36530 - DNA, 101 bp, rice(Oryza sativa)
  misc_feature (71): n=t or c
attctcaagtaataaactaaaatggagaaatcgagagccttctaacatttgaacaactactttggttcttncaataaccaaccagctcagtaatatgataa

SEQ ID NO: 36531 - DNA, 101 bp, rice(Oryza sativa)
  misc_feature (71): n=a or g
tccgctaatttaaacaggcaaacctctattttcttttgacagagttctcaattcaccaccctcgttttttncgtgcacgtttttcaaactgataaatgtga

SEQ ID NO: 36532 - DNA, 101 bp, rice(Oryza sativa)
  misc_feature (71): n=a or g
atactagtgcatactgcatacatcatggaaactttgatcgtgcttcttgctttctaccgcatgagtatatngtaggggtacaaaaataaacgaagcaaaat

SEQ ID NO: 36533 - DNA, 101 bp, rice(Oryza sativa)
  misc_feature (71): n=a or g
cattgtttacagagtatctctgccaggttgcttcagatcttgaggagtccatccagggataccctacactncgagctgagtttctctatgctgtcctcagt

SEQ ID NO: 36534 - DNA, 101 bp, rice(Oryza sativa)
  misc_feature (71): n=t or c
ccttaaaaatatatattccttagaaataaaaagttctttaaaaagataaaaaaggcacactgcaccctttnggcatgctatcacgcactcggcccatgaaa

SEQ ID NO: 36535 - DNA, 101 bp, rice(Oryza sativa)
  misc_feature (71): n=t or c
gaatcacccccgcgtcaatctggaaccctatctgaacgccaccgatctagatcgatcttccaccacagtcngtggtgcatcagctagcgttcacagccagc

SEQ ID NO: 36536 - DNA, 101 bp, rice(Oryza sativa)
  misc_feature (71): n=a or c
actagttgcttctcagaatcttgagcttccccgaaacaacccctaacacttagggtcagggtttacattanctgttgaccactaaatttcgagctccatcg

SEQ ID NO: 36537 - DNA, 101 bp, rice(Oryza sativa)
  misc_feature (71): n=a or g
ttaaacacattctaatattacgatggataaaccttctattcggattaatcataataggatgtgtctaatcnatcctaaattagaatgtgcctaattcgatt

SEQ ID NO: 36538 - DNA, 101 bp, rice(Oryza sativa)
  misc_feature (71): n=a or c
tgagccgaagccgcttctccgagcattcaatttcctaacgaagggtgtcaagagctggtgaagaagcaagnaagctgcctaggattattaattattgcccc

SEQ ID NO: 36539 - DNA, 101 bp, rice(Oryza sativa)
  misc_feature (71): n=t or g
attgaacattccaacagttttttacatccatgcccaagggtgaaaatgactttttcacatatattaaacgntcaatcgacggaacatatagaagagataaa

SEQ ID NO: 36540 - DNA, 101 bp, rice(Oryza sativa)
  misc_feature (71): n=a or g
ttgatagctgagatttggagccagcaactaactaaaaggaagagatctagctagtgatgtaggagactatncacttcactaaactacaggaggtcatcatc

SEQ ID NO: 36541 - DNA, 101 bp, rice(Oryza sativa)
  misc_feature (71): n=t or c
actagcggttcttaaacttgtaacaaagtttcacttagctccgcaaacttgcaaaacgcacatcaacatcnctaaacttggtttaatgtatcatcccggtc

SEQ ID NO: 36542 - DNA, 101 bp, rice(Oryza sativa)
  misc_feature (71): n=a or g
aagaagctttcgaaggttgcatgtcataagcttaagacggcggccatgcaacattttgccaactatgggtngagatttacaaatagacttaaataattgtg

SEQ ID NO: 36543 - DNA, 101 bp, rice(Oryza sativa)
  misc_feature (71): n=a or g
tgggatataaccaatcataatcactcaccattcaactttcttacctatctgcacttcttaatcaagcatancttttttcagtttagttctagaacattttg

SEQ ID NO: 36544 - DNA, 101 bp, rice(Oryza sativa)
  misc_feature (71): n=t or c
gaaaaaataattagtactgtcttgggagagaatgatcaagctgctatgctgctttgttttgtttttttctntgtgtctctttagacagcattttttttcag

SEQ ID NO: 36545 - DNA, 101 bp, rice(Oryza sativa)
  misc_feature (71): n=t or g
actttgtaaatacaatttgatgaaatgaagttaatatactttcaagagcatcttccgtttgtgtttttccntgtttcgacggtcggtccagcaactagggc

SEQ ID NO: 36546 - DNA, 101 bp, rice(Oryza sativa)
  misc_feature (71): n=t or c
ttaatccatatatctacttgattccatggttttgaatggtttgagtctagaatttatttgttctgaaggtntttacaacacaaatatatacaatcatctta

SEQ ID NO: 36547 - DNA, 101 bp, rice(Oryza sativa)
  misc_feature (71): n=t or c
gggaaacgagaacgttaacgaagccgaggtaatcggtgggaaactgggaatagctttctcttttctttttntttttcttttttttttttgtctcttgaaca

SEQ ID NO: 36548 - DNA, 101 bp, rice(Oryza sativa)
  misc_feature (71): n=a or g
gcgtagtagtaagcttatgtttcaatctttgaaaattactctgacattctggtgtccattcgaatttcctntcctttttaagtaatctggtcataggtttt

SEQ ID NO: 36549 - DNA, 101 bp, rice(Oryza sativa)
  misc_feature (71): n=a or g
taaggagttgtcattaattttgaccatggaaaaaaatctttctatggacccctttgttggtggggatcttntttatttactttcaatagatgttaaacttt

SEQ ID NO: 36550 - DNA, 101 bp, rice(Oryza sativa)
  misc_feature (71): n=a or g
agtagttcttgaatacttatgtgccacttcagatataggtaaagttttcactactgaaaaatacagagaantacaatcatatcctctagtactattaatta

SEQ ID NO: 36551 - DNA, 101 bp, rice(Oryza sativa)
  misc_feature (71): n=t or g
agtagaacggatctgatttaccttttttgggtgcctcctaagtgggcttcctcttccttgagatccatttncccctttttttttttgacgacaaaattttg

SEQ ID NO: 36552 - DNA, 101 bp, rice(Oryza sativa)
  misc_feature (71): n=t or g
cttaattcagttgaattctatgtttcagactgaatctgcagaaattcctgattctgtcagaaaaattttgnatcaattcaagagtgtttttgaggaaccaa

SEQ ID NO: 36553 - DNA, 101 bp, rice(Oryza sativa)
  misc_feature (71): n=a or g
agaaacttgcttgaaacacgcaagcaaagggatctgtatctcatctgggacttggggatatggagtatagngatggcaattgtgcccgtttgcccgtttac

SEQ ID NO: 36554 - DNA, 101 bp, rice(Oryza sativa)
  misc_feature (71): n=t or g
agtttattatgggtacatggtcgagtaggacctgatcattgctcatcgtcatcatggatgtaagaatgctngggactgattttgttagcgcagaatagatg

SEQ ID NO: 36555 - DNA, 101 bp, rice(Oryza sativa)
  misc_feature (71): n=t or g
actgctcgccccctacgctatcccctgccgtggtggggcccaccagaagaaattgtcactaatctttattntctcttgggcgcggttccagaagcttccgt

SEQ ID NO: 36556 - DNA, 101 bp, rice(Oryza sativa)
  misc_feature (71): n=t or c
acagtggcgacccaatccccaatctccattttcttgagatttggatcagctgcagtagtagtactgactgnaacttatgcagtcatagttgctaccgtttg

SEQ ID NO: 36557 - DNA, 101 bp, rice(Oryza sativa)
  misc_feature (71): n=a or g
taatttcttgtggcaaattaaatcgaccaagtaatgaacctccacaaggctcgtaggtgcgagaggcatcnggagttactcagccacctctctgctgctcg

SEQ ID NO: 36558 - DNA, 101 bp, rice(Oryza sativa)
  misc_feature (71): n=t or g
cctttatgtcgtttcggacagcaaaagataactagatgcaagccatttcaatggtctaaaacgtcaaatanttatatcaaattccgaagggagtatatata

SEQ ID NO: 36559 - DNA, 101 bp, rice(Oryza sativa)
  misc_feature (71): n=t or c
ttcccgtagcttccactcttaaaagctctaaaaaaattgataaggcttcaccccaaagcccaacacattcnatatgatcaaccccaaaacatactaaccaa

SEQ ID NO: 36560 - DNA, 101 bp, rice(Oryza sativa)
  misc_feature (71): n=t or g
aagattgatgcatcgacattgaggctagccaaaccagcttgtggtgggctacatttctgaacttgtttagnaaatttttgtcttttgacgactaccttggc

SEQ ID NO: 36561 - DNA, 101 bp, rice(Oryza sativa)
  misc_feature (71): n=a or g
cggcgattattcccacctcttccaggaagaattacagcaagatcaagaggttgtgaggttttccggcacgnctctgataccaatttgttagcgacctaact

SEQ ID NO: 36562 - DNA, 101 bp, rice(Oryza sativa)
  misc_feature (71): n=a or c
aaggtttttcaccaaattggatctcttggattgaatccttcatttccaggggaagcgtggcagtcaaagcnaatgataacattggatcttttttccggact

SEQ ID NO: 36563 - DNA, 101 bp, rice(Oryza sativa)
  misc_feature (71): n=a or g
cagaagtaattaattaatcagagatgcagagcctcgatggagaactctgaactcattcaagatgaatttgnggagaaaataatatatcagacaacatgcca

SEQ ID NO: 36564 - DNA, 101 bp, rice(Oryza sativa)
  misc_feature (71): n=t or c
actgtgtgtacatctatattttctattactatttatttaaatcaaaatggttgacatgattgtttgttcgnaagagttttgtaaaagaagtgtagcagcgc

SEQ ID NO: 36565 - DNA, 101 bp, rice(Oryza sativa)
  misc_feature (71): n=a or g
ttatatctaacatttatccctttggcagccttctcctccttcttcccctcttgtgcaggtagaatcaggcngccgcactccatcggctgcaggcagtcatc

SEQ ID NO: 36566 - DNA, 101 bp, rice(Oryza sativa)
  misc_feature (71): n=t or c
gactggcggcttactatcggtcagaccgaacttcttagccgatctaaccaccagactaggccggtctgacngattctctaggccggtctgaccaacggctt

SEQ ID NO: 36567 - DNA, 101 bp, rice(Oryza sativa)
  misc_feature (71): n=t or g
gaaaaaaaaagaacgggaaaaaaaaagaacgggaacacgatctaacctctgcaatccccacgccgccgccncctcattccttcccgaaccgtcgcacatcg

SEQ ID NO: 36568 - DNA, 101 bp, rice(Oryza sativa)
  misc_feature (71): n=t or c
gtgtttacttgatggttttttaaacaataagagggtgtcattacttaatcaaataaagagcaatcaacatnatgtactacctccgttttttaatagatgac

SEQ ID NO: 36569 - DNA, 101 bp, rice(Oryza sativa)
  misc_feature (71): n=a or g
ccaacagatctggctttatcagcagactccatcttgtttggccgcaaatacaaaaacaagttgttgcgtcncctgtcatgggccaatgggcttgtaacttt

SEQ ID NO: 36570 - DNA, 101 bp, rice(Oryza sativa)
  misc_feature (71): n=t or c
gatgtacagagccaaaaaaatgaaggcttgcttccttcagtaccagagcatgcccaagatcaataggatgncgcatcccatcatacataaaagctttgagg

SEQ ID NO: 36571 - DNA, 101 bp, rice(Oryza sativa)
  misc_feature (71): n=a or g
aattttgcttctataaattgaaaattaaaacatttaaatttcattgtgcggccacccgaccagcccggtcntcgggtggtggagtggatccacccctggcc

SEQ ID NO: 36572 - DNA, 101 bp, rice(Oryza sativa)
  misc_feature (71): n=a or g
acatctacatgcaagcgtgtgttattcatgtcacaagttttaaccctacatacgtcatcgtgttatcgttngattaagaccacgttcatctggatattcat

SEQ ID NO: 36573 - DNA, 101 bp, rice(Oryza sativa)
  misc_feature (71): n=a or g
gtaacttactttattatctacagtactttattgacaaagcttttatattaactttttgttttctatatttncaaaaaaaatttgaataagcgagtggtcaa

SEQ ID NO: 36574 - DNA, 101 bp, rice(Oryza sativa)
  misc_feature (71): n=t or c
aaacatcacacgctggccccttggtttaaacacttgttaagaaacgacctatggtgggtgggccctcgtgnatggggcaggggcctcaaagcatttgttaa

SEQ ID NO: 36575 - DNA, 101 bp, rice(Oryza sativa)
  misc_feature (71): n=a or c
gttttgtctataataacatacacctggtccaagctaaaaggacacacgagagcatttgcccaattcgtatnttgccggcgcacgtaagcttttacagatcg

SEQ ID NO: 36576 - DNA, 101 bp, rice(Oryza sativa)
  misc_feature (71): n=a or g
aagcagcctcgccagattgatatgcttccaattgtctgaagtctgaatcttggccaaacaatctttttcantcgttttaccgcaactctttccaaccaaag

SEQ ID NO: 36577 - DNA, 101 bp, rice(Oryza sativa)
  misc_feature (71): n=a or g
aatgcactcttataataacatatcagtgttagtactctctgcaacccaaaatgtaagacacaactacaccnttaacacaaagtccaagaaataatttaatc

SEQ ID NO: 36578 - DNA, 101 bp, rice(Oryza sativa)
  misc_feature (71): n=a or c
ttaacttttctattgattcacttgtttcactggtttctcaggcaaaattgaccagtgatgaatctcttatnacaggtgatacatgacaagcttcgttgctg

SEQ ID NO: 36579 - DNA, 101 bp, rice(Oryza sativa)
  misc_feature (71): n=t or c
gttcatacttcctccgtcggacaaaagcacaaatctaagtattacttagatatgacatattctaatacaanaaacctgttcagatttactgtacttagata

SEQ ID NO: 36580 - DNA, 101 bp, rice(Oryza sativa)
  misc_feature (71): n=a or g
tggaagtccatttgatccggtggagtatgatggcaaaatatacgtgcctggccaggtcttaacaataaacnccattgactttattgcaaagattttatcag

SEQ ID NO: 36581 - DNA, 101 bp, rice(Oryza sativa)
  misc_feature (71): n=a or g
gttttttctattccttcttttttcccaatcatgcgaaacccttaaggtaatgacccgacataagtactcancgtccaacctcacattcaaagggtgcctca

SEQ ID NO: 36582 - DNA, 101 bp, rice(Oryza sativa)
  misc_feature (71): n=t or c
ctgagatcatggctttaaccgtgtaatttttaagtttacaatctaaatgacattaccgctaaagtttaagnaccgatcatgtgttttactcataaatctaa

SEQ ID NO: 36583 - DNA, 101 bp, rice(Oryza sativa)
  misc_feature (71): n=a or c
ctcaccacgcaggggtagggggctgctcggcatttggaacggtggaaccgcccagatttgtgcgttccggncggatctggtaggaaggaagttggcggcgg

SEQ ID NO: 36584 - DNA, 101 bp, rice(Oryza sativa)
  misc_feature (71): n=a or g
cgatctgctcttgtcctgttataggaagaaatatttgcgtggatgggatgcggcgaggaggagaggagacngggtatttatagagagaaggtgggggcccg

SEQ ID NO: 36585 - DNA, 101 bp, rice(Oryza sativa)
  misc_feature (71): n=a or g
attataaaaaaaatcaaataagattgacgatcaaagtcgcggaaactttggttacacttaaaatgagacgnagggagtaccatttattaatggagtcaaat

SEQ ID NO: 36586 - DNA, 101 bp, rice(Oryza sativa)
  misc_feature (71): n=a or g
ttttctctgaccatttctgcacttttgtctattcatatgcaagatggatagacccagtagaagcattgtangcgtgtgcaagaaatggtgaagggatgcat

SEQ ID NO: 36587 - DNA, 101 bp, rice(Oryza sativa)
  misc_feature (71): n=a or g
aattatattccggatgaaaaacaactgccttgtaaaattcaacgtatcatatagttccacgttaaaattanaagtttgaaaaaactagaacgatgtagtga

SEQ ID NO: 36588 - DNA, 101 bp, rice(Oryza sativa)
  misc_feature (71): n=t or c
gagcccgttgcaaggtttgacggcaagtcaacacattgatccggaaatatattttttcttttaggcaaacnagaaatttcattactcatgatccgagatat

SEQ ID NO: 36589 - DNA, 101 bp, rice(Oryza sativa)
  misc_feature (71): n=t or c
gatcatgataagtctcaggaccaccttcacattctcggttctgtacacaggtgtacgggacaagcatgtgncaccggaactccattcgcttgcgtacttgc

SEQ ID NO: 36590 - DNA, 101 bp, rice(Oryza sativa)
  misc_feature (71): n=a or g
acatggtcacatacataccgcgctggtgagctctcataagttagatggcaacacgtatcaatgcgcacctngcactacataaaacggaatagttttaacaa

SEQ ID NO: 36591 - DNA, 101 bp, rice(Oryza sativa)
  misc_feature (71): n=t or c
cacatgagccaccttccaacacacactatgctgctatagttcatcagttatacgtagtagttctctctctntctctctctctctctctctctctctctcct

SEQ ID NO: 36592 - DNA, 101 bp, rice(Oryza sativa)
  misc_feature (71): n=t or c
gatggagttagcggggtcaatggagatctctttcttgcgtggatatcgtgaaacaccgtgagttaaatccngaagcaaaaaatacattgtacttagttgta

SEQ ID NO: 36593 - DNA, 101 bp, rice(Oryza sativa)
  misc_feature (71): n=a or g
ccatggcatatgaccatatgaactataatcgtaaaggtataattagtggattggtcaatatttgaatgccnttatctgtgtcagatttggttttatctcta

SEQ ID NO: 36594 - DNA, 101 bp, rice(Oryza sativa)
  misc_feature (71): n=a or g
cagttcagttccatcttcagcagcagatcgcgaccgtcacgtcatttcaacgcatcgtgatacccatacanctagccaggaccccgcgcgttgccgcgggg

SEQ ID NO: 36595 - DNA, 101 bp, rice(Oryza sativa)
  misc_feature (71): n=t or c
cccttgtttgtttagaaaacaaactttttcctggcataggttgatcgaaggacaagctgtagccgtcaagntgtgtaagcttagcaacctcgcacagcatg

SEQ ID NO: 36596 - DNA, 101 bp, rice(Oryza sativa)
  misc_feature (71): n=a or g
ctgctgtgtccgtcctcctgctactagtacgttttttcacgggctggtggagtgatggacctggtcagctnctcagtttgcattcatgcatgcaccaccgc

SEQ ID NO: 36597 - DNA, 101 bp, rice(Oryza sativa)
  misc_feature (71): n=a or g
gctgctgatacaatagagaaatgaagatggcaaggaaggaaattgttagaggtatgagtagtggtggtagnggtgaccggaaatcttcaccagtagcaagg

SEQ ID NO: 36598 - DNA, 101 bp, rice(Oryza sativa)
  misc_feature (71): n=a or g
ccaagcaattgctcgcccaagctgggcggtgcatctgccgcagtaagccttatttaggctgtgtttgaggnagagataattgggaagattagaaagatacg

SEQ ID NO: 36599 - DNA, 101 bp, rice(Oryza sativa)
  misc_feature (71): n=a or c
tattacaagatcttatatttacaagctaaactttaagtacatattcagtccccgtataagtatttctacancttcatattttttaactaataaaacaaatg

SEQ ID NO: 36600 - DNA, 101 bp, rice(Oryza sativa)
  misc_feature (71): n=a or g
aggactccctcaccgccagcatagacatggccaaagaggatctcccgaacccgaaagacagcctggccganctcatcaggatgttcaaggagcacgacctc

SEQ ID NO: 36601 - DNA, 101 bp, rice(Oryza sativa)
  misc_feature (71): n=t or g
tctgcagcttctgtaatctttttccgtgatgtgcacattagccttttctgcatagtcatgggcatggtcangaacagttgccaataattctgctggaccat

SEQ ID NO: 36602 - DNA, 101 bp, rice(Oryza sativa)
  misc_feature (71): n=t or c
aagggattatactatgtctgtctctagatataaaggattttagtcgaatgtgacatattctttttctgtcnagattcgttattcgttattctaggatatgt

SEQ ID NO: 36603 - DNA, 101 bp, rice(Oryza sativa)
  misc_feature (71): n=t or c
taaataatccctatgaaccaacggccaacgcttcccttggcgccttagaccactgcctcacgtcatgaacnatcgtcggcctcataggtccgagcccggga

SEQ ID NO: 36604 - DNA, 101 bp, rice(Oryza sativa)
  misc_feature (71): n=t or c
ggtcaagggaggtcaaggagagatccaccttggtttttacccgacccaaccgctcgccctgctgctcgagnttgaggtcaatctacatcaagtgcgtggcg

SEQ ID NO: 36605 - DNA, 101 bp, rice(Oryza sativa)
  misc_feature (71): n=a or g
ttgcattcatcgttgttgcaatataagaggtacgtgctattattaacacgagaattaaaaaggtagtaacngttcaacctatactaggtgatatcccgcgc

SEQ ID NO: 36606 - DNA, 101 bp, rice(Oryza sativa)
  misc_feature (71): n=a or g
cttattgggcacgaaagctcttttttctccaccgagaaaactaagtattcttcacttaaaatcgtgttctncactgtaatttctaaatgtttttccataaa

SEQ ID NO: 36607 - DNA, 101 bp, rice(Oryza sativa)
  misc_feature (71): n=a or g
tcttcagcgacgcactggtggaagatgacttgccgaggttgattgctgattcaagatcgccggagaaaggncctaggttgatgaacgcttacaggtggaat

SEQ ID NO: 36608 - DNA, 101 bp, rice(Oryza sativa)
  misc_feature (71): n=t or c
atttggtcgttaacaacttgttatgatactgagcttagctagtacaagccttaacagttactcctccctcnattctagaataacttcgtgtattcaatata

SEQ ID NO: 36609 - DNA, 101 bp, rice(Oryza sativa)
  misc_feature (71): n=a or g
tattggacatccaaagtttaccttttttgctggataggacttcaagacgtgtttcagcatttgaaaaaaanagtgaattgcattttaggccatgttttatc

SEQ ID NO: 36610 - DNA, 101 bp, rice(Oryza sativa)
  misc_feature (71): n=t or c
gcctctacatatcactagtacataaaccctctaataccggtttctcagccagcactaatttatcgatatcnaacatagatgtatacaaccaagctaattgc

SEQ ID NO: 36611 - DNA, 101 bp, rice(Oryza sativa)
  misc_feature (71): n=t or c
gaaatttaccgactgcaccaataccgtttccgtaaaaaataatatcacttcctattgttatgaaatttagnttttctagtttctatttgcgttgtattgaa

SEQ ID NO: 36612 - DNA, 101 bp, rice(Oryza sativa)
  misc_feature (71): n=t or c
tttctttagccacaccaacgtttgatttttgaaatttgcacataatcaaaaatcatacataaaacgaagangaagatgaagatgaagattaagtttttttt

SEQ ID NO: 36613 - DNA, 101 bp, rice(Oryza sativa)
  misc_feature (71): n=a or c
aagaccgatcggcccgcacagaagagaagagagggagagatagatgactcagcctgacacatggggtccangtgggtcccacgctaactcagccgccacat

SEQ ID NO: 36614 - DNA, 101 bp, rice(Oryza sativa)
  misc_feature (71): n=t or c
gtcttgtgagcactttcaggccgttttacgctagaagaagcacgaagcacgatcccattactacttagcantaaccattctactcaggacctgaggtctga

SEQ ID NO: 36615 - DNA, 101 bp, rice(Oryza sativa)
  misc_feature (71): n=a or g
tttatcttgtacaacgaaggaagcagtgcagtactacatgtaaaaagtccctgcatgtcgaagggactacngggagaacggtttcatcttctctctcacgc

SEQ ID NO: 36616 - DNA, 101 bp, rice(Oryza sativa)
  misc_feature (71): n=a or g
ttgggagtaaacaatgttcaaatgtcctacacttttctatctgcaacacgtacatacggagcatatgtgcnagcaaattagagtttcgatgtcagggcagc

SEQ ID NO: 36617 - DNA, 101 bp, rice(Oryza sativa)
  misc_feature (71): n=a or g
ggcctagtgggctggttcgcccacgcaatttcaggtcatttttatggaaaaaaaaacaatcatttaggtcngggccagcgaagatgagggcggaggcgagg

SEQ ID NO: 36618 - DNA, 101 bp, rice(Oryza sativa)
  misc_feature (71): n=a or g
catgtttttctgttgaaaaatgagtgcttttggtgttttctcttatattctcagattttaagggccctttnaatcgcaggattgagaaaacatagggatag

SEQ ID NO: 36619 - DNA, 101 bp, rice(Oryza sativa)
  misc_feature (71): n=t or c
cactgccttttgggccccctacgtgcccctgcccatctgctacgcgtctttaccacatactccattgcaanaaatcacacatatattatagaaactctcta

SEQ ID NO: 36620 - DNA, 101 bp, rice(Oryza sativa)
  misc_feature (71): n=a or g
ctcgtcacgtagcttcccagggatccagcaggagacgtctacacatcccgtcaccatcgccatcctctccntcacataaaatactcctcctactagtactc

SEQ ID NO: 36621 - DNA, 101 bp, rice(Oryza sativa)
  misc_feature (71): n=t or c
tgaaaaatacagggaccttaaatacttagataaagttacattgcaactttgcaagttacgggttttttttnctgcaaaataacaattaattagtactatcc

SEQ ID NO: 36622 - DNA, 101 bp, rice(Oryza sativa)
  misc_feature (71): n=a or g
cccagcgagtaattttttttttgaacattccagcgagtaattggagcagtaacaaaggctttatttagttngggaaaattttagatttggttaatgttact

SEQ ID NO: 36623 - DNA, 101 bp, rice(Oryza sativa)
  misc_feature (71): n=t or c
acatagaaactgaatagcaaactcgacgaggaaaggacaacaggaatattgcttattattctagcatttcncacattcatattgatgttaatgaatctaga

SEQ ID NO: 36624 - DNA, 101 bp, rice(Oryza sativa)
  misc_feature (71): n=a or g
accacactcgtggtttcgtaggctgggacacatgtgttatgtacttagagtgttttcacatagtgccctcnaattttaaaaggtttattcaagagtagctt

SEQ ID NO: 36625 - DNA, 101 bp, rice(Oryza sativa)
  misc_feature (71): n=t or c
ttgaattattgaacgtgaaagaaatcactctagacaaaattacttttgcgtaggaactttctttcttatcnagagtcttagtactagagcactcatataat

SEQ ID NO: 36626 - DNA, 101 bp, rice(Oryza sativa)
  misc_feature (71): n=t or c
aaatctttagatgaagcaaggaacaaagatagttttaccatccttgagaagttccctttttaatgtataangctgttgattttttgagatacgtttgacca

SEQ ID NO: 36627 - DNA, 101 bp, rice(Oryza sativa)
  misc_feature (71): n=t or c
gcacgtgcggttcggtttttttcgtgcgggtggtgtgtggtttctgttgggcaccgggggatgtgtgagcngtcggcgtacgcgtaaaccatcggtggatc

SEQ ID NO: 36628 - DNA, 101 bp, rice(Oryza sativa)
  misc_feature (71): n=t or c
catctcggcctctctgaaaaacatctttttgtcttctacaagtttaattgaaaacttggaatgtcatgcanaggaattcgccttgatgaagtcggatcctc

SEQ ID NO: 36629 - DNA, 101 bp, rice(Oryza sativa)
  misc_feature (71): n=a or g
cgcttgtgtcttgtgggcccaacgagaaacgtggcggcgattttccaccgttcgcatacgtggaccgcccnggccaaacgacagcacacgacaccgtgaat

SEQ ID NO: 36630 - DNA, 101 bp, rice(Oryza sativa)
  misc_feature (71): n=t or g
ttggtttttttttataatttgctagagtgacacatggtgagatgcgagtgtttgtagaaagctgtacaacngtttgagagcgttttaaggatgtttaatgg

SEQ ID NO: 36631 - DNA, 101 bp, rice(Oryza sativa)
  misc_feature (71): n=a or g
catggtgcttggcccttgctcttgggtatcatctatagttgttaaggtgaactcttccttagaagaaacancacccttcttggaagaaaagacaacttaga

SEQ ID NO: 36632 - DNA, 101 bp, rice(Oryza sativa)
  misc_feature (71): n=a or g
tattttggataaataaaaaatttaagcggactgggtcgcttttttttaaaaaaaatatggtttttcggtcnatcgcacgtatattatagcacaacggatta

SEQ ID NO: 36633 - DNA, 101 bp, rice(Oryza sativa)
  misc_feature (71): n=t or c
tcataaatgggtgaagacttgtggtggtccttttctcatggaggaaaccctgaatgacgccttgatgggangggtcatacctacttccactccgcctgtta

SEQ ID NO: 36634 - DNA, 101 bp, rice(Oryza sativa)
  misc_feature (71): n=a or g
actatgtaaatttgtataaatatatgagaagtgtctctttttttttcaagaaaagatgtttgctatgctgnactcccggccttagcatactattattttag

SEQ ID NO: 36635 - DNA, 101 bp, rice(Oryza sativa)
  misc_feature (71): n=t or c
cagcatatccaacagtttggcttgcaataactgagaggaatgccccagaaataggacttggccattttttngtgtgtaatgaaagaatagcggatctatcc

SEQ ID NO: 36636 - DNA, 101 bp, rice(Oryza sativa)
  misc_feature (71): n=a or g
ttaaatgcaaaatcttaaaagtataaaatagttaaatgctccttttacgagtacttttcttcgtcccatcntaagtttatttttagatagttctatttatc

SEQ ID NO: 36637 - DNA, 101 bp, rice(Oryza sativa)
  misc_feature (71): n=t or c
aattttgattaatcatatacttattatagttacttttatataaactgtgtgattgtgtcacaaattttganagtttgaccctttgcaaaaactaattttac

SEQ ID NO: 36638 - DNA, 101 bp, rice(Oryza sativa)
  misc_feature (71): n=t or c
gagatcgaggataattatataagtaaagcaaagaaatatatcacgtagggttgtcagcttgaaattcaccnggcttgcttgatacatgccggtttatttta

SEQ ID NO: 36639 - DNA, 101 bp, rice(Oryza sativa)
  misc_feature (71): n=t or c
tttctagtagtgggtgtggcgtgatggtcatgtggatccggacatccggcgccatagcgcgtagctcccgnggagcacccaaagcacctagtccaggtcaa

SEQ ID NO: 36640 - DNA, 101 bp, rice(Oryza sativa)
  misc_feature (71): n=t or g
gaaaagcacatccttcgtacgcaaatcaaaccagcaaagacatccatcctaatgtggtcaaataagaaggntcaagaattatgaatcatattctcaaggta

SEQ ID NO: 36641 - DNA, 101 bp, rice(Oryza sativa)
  misc_feature (71): n=t or c
catatttagtacctttctctatgtaccttctgttatacaccgtcagattgtatgtaatcaatggctgccangccttccaagcaccctagaagatctcttta

SEQ ID NO: 36642 - DNA, 101 bp, rice(Oryza sativa)
  misc_feature (71): n=t or c
ttctcatcggtgtcttctttgctctgtatatctatctctcccacatatgaaggaaacaccggaaagctctngaataccctcctttattcaatggctaagaa

SEQ ID NO: 36643 - DNA, 101 bp, rice(Oryza sativa)
  misc_feature (71): n=a or c
ctgactcacaagccgagtattgacgtggttaaaaggaagagggcaccatctagctaagatgaaaaatgtcnccaaataaaactttcagaggattattgact

SEQ ID NO: 36644 - DNA, 101 bp, rice(Oryza sativa)
  misc_feature (71): n=a or g
ctccaccagctataggaagcaatgaaacatgacgtgttgtgtgctttcctttgccgcttttcttcgacacngtaccgacccgttgttcaccaaaccattta

SEQ ID NO: 36645 - DNA, 101 bp, rice(Oryza sativa)
  misc_feature (71): n=t or c
gccggcacacaccggaccgggaccacggatcgtctttgatccgcgcaaaactctagagtcgccgccgccgncactggtggagaaaccgtttgtagtcccgg

SEQ ID NO: 36646 - DNA, 101 bp, rice(Oryza sativa)
  misc_feature (71): n=a or g
ctgtccttttacactgaaccattctagcaggaaggaccaaaggagcacttaaatgcactgggcaattctcnggttagatttggtgtttttgttcaagaaac

SEQ ID NO: 36647 - DNA, 101 bp, rice(Oryza sativa)
  misc_feature (71): n=a or g
gagacacgtggcttgttttgcagattcttggcagctcggtaggagtttttatgcgggaccaaaaccatctnaaagtagactccatatgctttccaacaagt

SEQ ID NO: 36648 - DNA, 101 bp, rice(Oryza sativa)
  misc_feature (71): n=t or g
atcaatcggcaagccaaaaaacaaaaaaagatttcttttcttttcttttcctcctgttgctcgtcgacgcnccgccgccgccgccgccgccgcctcctcca

SEQ ID NO: 36649 - DNA, 101 bp, rice(Oryza sativa)
  misc_feature (71): n=t or c
aatgggttcagagattccatccaaactcacactgttaacttgaatcaattcttcacatccaaattattctnattgagtgtcaaatcacagcttctttggaa

SEQ ID NO: 36650 - DNA, 101 bp, rice(Oryza sativa)
  misc_feature (71): n=t or c
ctatcctccttggaagcaatcctttctcagaattgttcagcacgctcaattctgcatgcacaatcaagtanttttgccaagcttttaagttagaaatataa

SEQ ID NO: 36651 - DNA, 101 bp, rice(Oryza sativa)
  misc_feature (71): n=a or g
cgaaatgcatggacacctgtgagcagctcatgtgatagcctataatcatgccacgccgctgccagtgttantttatatctctatgcgtctgctggtttttg

SEQ ID NO: 36652 - DNA, 101 bp, rice(Oryza sativa)
  misc_feature (71): n=t or g
aggaggtgtggcggattgggatgaggcgaagggcgatggactgggagaagacgagtagctggaagggtagntgaggaaattttttcgttctgctccctgta

SEQ ID NO: 36653 - DNA, 101 bp, rice(Oryza sativa)
  misc_feature (71): n=t or c
gtctcgtccatgaaaacccttttttagtagtggaacttagcactgcaaataacctaatccgaaattcgctnctatggagatttgtacttaggatcttaaag

SEQ ID NO: 36654 - DNA, 101 bp, rice(Oryza sativa)
  misc_feature (71): n=a or g
attagaggtcatttccacttacagatagctgtaatcgatgatttcgggtccggatactgtgctgattattncgattggagatatattataatgtagttcag

SEQ ID NO: 36655 - DNA, 101 bp, rice(Oryza sativa)
  misc_feature (71): n=t or g
cgcggatggacgcggtcttcagtggaccgagatgtgtggagcgtgcctgctgatgtgtcattaacggcttntgacggagcagagttgaaatgttaatacag

SEQ ID NO: 36656 - DNA, 101 bp, rice(Oryza sativa)
  misc_feature (71): n=a or g
aatcatcatcactacattatgcatgataattaggagtacaatgcaaaagtgcatcatatatactctcttcntccttaaatatttgacgtcgttgacttttt

SEQ ID NO: 36657 - DNA, 101 bp, rice(Oryza sativa)
  misc_feature (71): n=t or c
cgctagcactaatcttgaggcgaatccgacggtcgaaaattcgacagttttttcccccgtttactatcganagtaaactagcaaatccgattgtagaaata

SEQ ID NO: 36658 - DNA, 101 bp, rice(Oryza sativa)
  misc_feature (71): n=t or c
aaatgcataggtgttgctgaaaatagcaccaacaaatatattctcatcagaataatatatgtgctattttncacctaagacacaaacctatgcctgttcca

SEQ ID NO: 36659 - DNA, 101 bp, rice(Oryza sativa)
  misc_feature (71): n=t or c
cctgaggtcctagtccttccctatggcatctcctcccttgccaccccttgtaggtccaacatggtctgagntcactgtcaatggcctcatgtcatgggctc

SEQ ID NO: 36660 - DNA, 101 bp, rice(Oryza sativa)
  misc_feature (71): n=t or c
ttgtgaatttataatgtttggatataatgattacttccctggtcatctcatgggctgttaggctatatgancaacactatttttcaagaagcatgttgaat

SEQ ID NO: 36661 - DNA, 101 bp, rice(Oryza sativa)
  misc_feature (71): n=t or c
cgctcgcgctcttctcctccatcgcggccccggacatctgctcccacaacaccctcatctccgcgctctcncgctccccgcgccacctcccctccgcgcgg

SEQ ID NO: 36662 - DNA, 101 bp, rice(Oryza sativa)
  misc_feature (71): n=t or c
ttcaagtttcttatgaattttatcacccaatgagttcagctaggcagttcggaatgggacaattgccgatnggcttgtactttgccgataagatccagtgc

SEQ ID NO: 36663 - DNA, 101 bp, rice(Oryza sativa)
  misc_feature (71): n=a or g
gagagtgacaatgacacgccatagcaaggaagttccatgcaatggaggtgatgagatggggaggtaaaacncaaaactgaaaaagaaaaggcaaaacatat

SEQ ID NO: 36664 - DNA, 101 bp, rice(Oryza sativa)
  misc_feature (71): n=t or c
aaaatataagaatctagaatcagagaagatattttgcagtactatgaatctagatagataggaaatgtctnattcggttataagttattatattttgggac

SEQ ID NO: 36665 - DNA, 101 bp, rice(Oryza sativa)
  misc_feature (71): n=t or c
acccagttcaccagtgagctgtttggtgactattgcgacaacatgggcatcatgttatgcttcgcctaacncgcccaccccaagagcaacggccaagtcga

SEQ ID NO: 36666 - DNA, 101 bp, rice(Oryza sativa)
  misc_feature (71): n=a or g
tgactatcaaatgacttttaaaggtagtttgaaaaacataaacatggcatatatagatctgtcttgaaatntacttccataatataataaacttattagat

SEQ ID NO: 36667 - DNA, 101 bp, rice(Oryza sativa)
  misc_feature (71): n=a or g
tgttttaaatatatttgttatatctagcctatttgctcatatgtaatctagaactgtctcggttgggtccnatctttaatattactgctaataatctaagt

SEQ ID NO: 36668 - DNA, 101 bp, rice(Oryza sativa)
  misc_feature (71): n=a or g
ctagcaacctgaacaaaattgtggcaggaaaaagcattaaaagattaaactccgtaacatgataagaacancaaaaactaatgcttgattgctcatctaag

SEQ ID NO: 36669 - DNA, 101 bp, rice(Oryza sativa)
  misc_feature (71): n=a or c
gctttgacaacaccagtacagtacttgagaaactaggggctgtttggatgccttccatagtttatcacaanatatttggcaaagtgtggcaatgccacata

SEQ ID NO: 36670 - DNA, 101 bp, rice(Oryza sativa)
  misc_feature (71): n=a or c
tcgtagcatgttaatactactatattgtgtttaatctaacattatttattaatccctccatcgtagaatanctatagtttcagagttgaacacggttatta

SEQ ID NO: 36671 - DNA, 101 bp, rice(Oryza sativa)
  misc_feature (71): n=t or c
atgcacgtggaggcgaacgcttcctgctagttgctatgaactgctgctgcttcatacttcctccgattaanaatataagactttataggattgctcatatt

SEQ ID NO: 36672 - DNA, 101 bp, rice(Oryza sativa)
  misc_feature (71): n=a or g
agaagtgccttgagaggcaaaaggcagcaaaacagaggaaaaaaggaaaaggtgctccatcaactttgggngacaagccaagtcaaaatatggttctcttt

SEQ ID NO: 36673 - DNA, 101 bp, rice(Oryza sativa)
  misc_feature (71): n=a or g
taaaagatgagattagcaagatttaggctctgttcgctgctgcaggttcccaatggaaacagtgcacacgnaaaatagagcgatccattagcatgtgatta

SEQ ID NO: 36674 - DNA, 101 bp, rice(Oryza sativa)
  misc_feature (71): n=t or c
actagattaaaaaaacgtgtaattgaatcagtatctgcatttggacgatcctggcgcaccagcatatatanatatatatatatatatatatatatatatat

SEQ ID NO: 36675 - DNA, 101 bp, rice(Oryza sativa)
  misc_feature (71): n=t or c
ctgtcagtctgtgatactaatatgcaaggaaaaagaagtgcccgtacggttttttcattaaaaaaattctnaacatttttaagaaaagtagtaagatcagt

SEQ ID NO: 36676 - DNA, 101 bp, rice(Oryza sativa)
  misc_feature (71): n=t or c
ccacaaaacacatttattagagtatatatttcctgctatatattttgtttgtagaactatctactctctcnatcccataataagcgtagttgtgggtttca

SEQ ID NO: 36677 - DNA, 101 bp, rice(Oryza sativa)
  misc_feature (71): n=a or g
cacggaagtaattaactcctccgatccataggcttgtcatatactcgtgtcagttcagttcagttcatagnagtagaccttgacctggacttcgatcaatt

SEQ ID NO: 36678 - DNA, 101 bp, rice(Oryza sativa)
  misc_feature (71): n=t or c
tgggtgtgattttttatccgtggatatgcccgcccgatacccgaagacattgtgggtaacagtcgggtttnattttttacctgtcggtaactcatgcccga

SEQ ID NO: 36679 - DNA, 101 bp, rice(Oryza sativa)
  misc_feature (71): n=t or g
gaccctcagttacatgcataaactgtggatgaaacaaagcatgtcacagaacaggatatatagtaggctgngtctaacacagaatccaattctaaaattca

SEQ ID NO: 36680 - DNA, 101 bp, rice(Oryza sativa)
  misc_feature (71): n=t or c
gcagctagcagcaagctctaaaattttatcatgtcaaggtagagctaacttaaggagccaactcatacaanaagttaactacaagttagttataagctgtg

SEQ ID NO: 36681 - DNA, 101 bp, rice(Oryza sativa)
  misc_feature (71): n=a or g
gacacgggattgcaagaacatgcccatccagcttttaagattaaagatcccagtcaaattggtcttacaanttcgttttacaagttcgttttgcttctagg

SEQ ID NO: 36682 - DNA, 101 bp, rice(Oryza sativa)
  misc_feature (71): n=t or c
gaaccttaccccaacacacactgctgcataatatgtcatatgcgctggtttaggattataggtgctggatnttgatccggcaccaatttattagaatcgtc

SEQ ID NO: 36683 - DNA, 101 bp, rice(Oryza sativa)
  misc_feature (71): n=t or c
taattaggaacgagtatatgggcccaatttccatttatgggctggggctgtggaccgccagacttcatcgnctccgtcgtcggcgcagatctccggctcct

SEQ ID NO: 36684 - DNA, 101 bp, rice(Oryza sativa)
  misc_feature (71): n=t or c
gtttcttgaaagtttgctcaagcggcacagatgtggagacttattatgcagatgaacagaggtgttaccgngtagcatttcatggttactttgataatgaa

SEQ ID NO: 36685 - DNA, 101 bp, rice(Oryza sativa)
  misc_feature (71): n=t or g
ttgggatatcaatatatatgataccacggaatactccttgaagtactacatcggtaatttcacgtgcttangaaacttttttgtaggagcattagaaatac

SEQ ID NO: 36686 - DNA, 101 bp, rice(Oryza sativa)
  misc_feature (71): n=t or c
caaatcaatttatagtaaaggtttaccgtccaaaacaatggaacatttcatagcctagcatgtaattaaanaaaatatgaactatgaataaatttattatt

SEQ ID NO: 36687 - DNA, 101 bp, rice(Oryza sativa)
  misc_feature (71): n=t or c
catgtccgacgtccccacttgcgtattctaaataaggtaacatcgcgtgggtccttgtcttctcatgttgnaccacgccgcagcttaggagcgtttgtagg

SEQ ID NO: 36688 - DNA, 101 bp, rice(Oryza sativa)
  misc_feature (71): n=a or g
ttgtgtttaagcagaaatataggacaaacgaataaaacgatgagaagaatagcatctaccctatagttcancaagttgttttactcattactcatttgtca

SEQ ID NO: 36689 - DNA, 101 bp, rice(Oryza sativa)
  misc_feature (71): n=t or c
atataaccattgctacagtggttttgcataatatatttccttatgtggctggacagtgctctaaaaatctnggcccttagatgtaatttcgatggttctag

SEQ ID NO: 36690 - DNA, 101 bp, rice(Oryza sativa)
  misc_feature (71): n=t or c
cttttgatatggttttgaacaagtatgagaagaaagagtgccgaacaatatcctaataaaggaaaaagacnaagatctcctcctagcgagagatttggtcc

SEQ ID NO: 36691 - DNA, 101 bp, rice(Oryza sativa)
  misc_feature (71): n=a or g
aatggagactaagacacactctttggcagcttgggatatagtctgccaaccaaagaaaaaaagggggactngggataataaatctagaatttcagaacatt

SEQ ID NO: 36692 - DNA, 101 bp, rice(Oryza sativa)
  misc_feature (71): n=a or g
caaagcgagaagcagctccttctgacgtattcgtcgaacatgtttatgagccgactgtaccaagtaaaganataatcaaggctacggacacccaagatgta

SEQ ID NO: 36693 - DNA, 101 bp, rice(Oryza sativa)
  misc_feature (71): n=a or g
ggagccctcgaacagtgccacccccaacaccagcatgccgaagccctagctcatacagcgccaccacctcntgcttgcgcctctcctcctccttcattttc

SEQ ID NO: 36694 - DNA, 101 bp, rice(Oryza sativa)
  misc_feature (71): n=t or c
atgaatgttgaactgttcttggttggataggaaaaggctaaaccaaattccatgggatgagcagggatttngattcaattttttgggcctaatctctcttg

SEQ ID NO: 36695 - DNA, 101 bp, rice(Oryza sativa)
  misc_feature (71): n=t or c
ttatatattttctaatgggtgaaaaggagtttgttggagcaatttatatgttatgcttgcatacatacaangttctttgttgttgctggcccgctgcatac

SEQ ID NO: 36696 - DNA, 101 bp, rice(Oryza sativa)
  misc_feature (71): n=a or g
acctgtgctgtctagctcaactctcacagaaagaatatgaattcctcacaagccctccaggttcaagagtntctgaaatcagtgcagctgagatagaaaag

SEQ ID NO: 36697 - DNA, 101 bp, rice(Oryza sativa)
  misc_feature (71): n=t or c
ggcgccggcctggtcgcccacagatttagttgggattcaaatgggcccattttatttctgcagcccaacangaacgggattgcggcccatataccatgttg

SEQ ID NO: 36698 - DNA, 101 bp, rice(Oryza sativa)
  misc_feature (71): n=a or g
gatttctcgatttcttgatgttgatcgttattagtaacatttgaagaggaagattattcatggttgatcgntcaatgattactcttcaacccgttgccgat

SEQ ID NO: 36699 - DNA, 101 bp, rice(Oryza sativa)
  misc_feature (71): n=t or c
tttagttcctgcggccaaggggaaacgcgcggcatggaggcacacgaaaatcaaagagaaaatctgtgtancctgaaagtttatctaatgtcttctgtatc

SEQ ID NO: 36700 - DNA, 101 bp, rice(Oryza sativa)
  misc_feature (71): n=a or g
gatatgtcccgtaggtacacgatacagaagttgccgtaacacacacaccgcgtgcaacgcaaacggcgcangcaaaaaggaaaatccgtggtcgcgggacg

SEQ ID NO: 36701 - DNA, 101 bp, rice(Oryza sativa)
  misc_feature (71): n=a or g
aggcattagggtttcggagttgtcaaattaatctacatcgagtggatccaaccgataggagggacaggttngtgaaggagttggtcggagaaggatggaac

SEQ ID NO: 36702 - DNA, 101 bp, rice(Oryza sativa)
  misc_feature (71): n=t or c
cactttacacatctacaatagtagaatactactagtatgaccacgtatatacatccgtcttatatttttanggatcattatacgccttccctttttaatta

SEQ ID NO: 36703 - DNA, 101 bp, rice(Oryza sativa)
  misc_feature (71): n=a or g
ccttttgcattttaatcttctgatcctccttttggtttcttttgtgacctattttgctgcaaaaacaccanactaagatagagtttgcagtggtcaggtag

SEQ ID NO: 36704 - DNA, 101 bp, rice(Oryza sativa)
  misc_feature (71): n=t or c
accaacgcacctgttagtactctagtgaatgcgtccgtcatgtcaggacctatctttgtctttcccctttncccccttatccagtatctcctgcaatgagg

SEQ ID NO: 36705 - DNA, 101 bp, rice(Oryza sativa)
  misc_feature (71): n=a or g
aaaaattttaaatcaaaaattttgctttgaccataaactgaaacctaatcttctcggttttgcattttcancctaactaaaaaaatatatttaagttaaat

SEQ ID NO: 36706 - DNA, 101 bp, rice(Oryza sativa)
  misc_feature (71): n=a or g
caacaaagatagagcaccatccccctcaagtactatctatctttccctgctcagtccaacagatatatagnacccctttgttcacgctcagtaatccaaac

SEQ ID NO: 36707 - DNA, 101 bp, rice(Oryza sativa)
  misc_feature (71): n=a or g
attttttttttaagaaaaaaatagtatagacgcaagcgctcacaatgtgcacacgcacactataccctatnagtaccttcggaagactgttggtatatctt

SEQ ID NO: 36708 - DNA, 101 bp, rice(Oryza sativa)
  misc_feature (71): n=a or g
tggtctgtggcattgacatggcataaagtcaatgccacatgccagattaataccgtcatgtagacgccacntcaacgaaaccgctcttgaaaaccaccgag

SEQ ID NO: 36709 - DNA, 101 bp, rice(Oryza sativa)
  misc_feature (71): n=a or c
tcagtccctaatctcagagcaacttcaattttagagacctcgagggacttaagtgcagtgccaaatattcnagatctgaccacaattccatttaaaaacaa

SEQ ID NO: 36710 - DNA, 101 bp, rice(Oryza sativa)
  misc_feature (71): n=a or g
gcacaatagacgcatacagaactgaataatggagtgagtaattggacataaatactcgacggcggaaaatngagttttcctcttttcttcttctcctaaca

SEQ ID NO: 36711 - DNA, 101 bp, rice(Oryza sativa)
  misc_feature (71): n=t or c
agaaaaggccatgttttacaaataagtgcaaggaggaggattgtacaaaaaggagtcaatattcaaccttncattctttcacgcacacatattccttttcc

SEQ ID NO: 36712 - DNA, 101 bp, rice(Oryza sativa)
  misc_feature (71): n=t or c
gcttctgctgcaaaagcaagcacgagagtattcacacgcattttttggaccgtatgttctcgaatggaatngtgggcgcctgctgttcgtgggctgatttt

SEQ ID NO: 36713 - DNA, 101 bp, rice(Oryza sativa)
  misc_feature (71): n=a or g
gcgtcactcatgcgcaagcgacacgggggcaaaaccctaccgccaccggcaaagctaggatggcggtaacngggcctccacgatgcggcgcgggggaagcg

SEQ ID NO: 36714 - DNA, 101 bp, rice(Oryza sativa)
  misc_feature (71): n=a or g
gtgaatacagaagaacaaggcaatttaataaattatgcaagctgataatatatgtattgtgtgtgtgtgtntgtatgtgtgtgtgtgtgtgtgtgtgtgtg

SEQ ID NO: 36715 - DNA, 101 bp, rice(Oryza sativa)
  misc_feature (71): n=a or g
tctttgtgtttatttgtttttcgtttgcaatcgtgtagatgttggagcggaagagcagtttgctccagaanacgctgtgcaaggacaatactgggatcaag

SEQ ID NO: 36716 - DNA, 101 bp, rice(Oryza sativa)
  misc_feature (71): n=t or c
ccaacgtaccccaataccctattcttcctgtctgtgagtatcactcgtcggcagtcttctctggctgaacntcttcgtcagccaaatttctagatggcgct

SEQ ID NO: 36717 - DNA, 101 bp, rice(Oryza sativa)
  misc_feature (71): n=a or g
aattggtttttgcgtgcagatcttccacctgtctagaacgaggtgtctgccaaaatcgtgattttgctgcnggcgcttaagccgcccgcacgggaaaaata

SEQ ID NO: 36718 - DNA, 101 bp, rice(Oryza sativa)
  misc_feature (71): n=a or g
atgtacttgtagggcttgggaagtgactggaaagccttgtgatcatgctttggctttcattgtgaagcttnatagtgaggtacaaatggatgattttgtgg

SEQ ID NO: 36719 - DNA, 101 bp, rice(Oryza sativa)
  misc_feature (71): n=t or c
gcctttcatagtgcaagcaccggttatgagttaccacaaggtgacagctaagatgaagacactttctccanagtgcaagcaccacctagtgggacccacaa

SEQ ID NO: 36720 - DNA, 101 bp, rice(Oryza sativa)
  misc_feature (71): n=t or c
agtatttttattataggcttatttggtcgtttcttcgtgtgcgtacgttagatagcgttgaagatcccacnggactcacaggaactgaagtgggcctagaa

SEQ ID NO: 36721 - DNA, 101 bp, rice(Oryza sativa)
  misc_feature (71): n=t or c
accatagtaacaatgtatatttcctaaaataacataacgggttcgtgttcaccaaatttgaacagatatanagagaaagcaaataatgatctcaaaccaca

SEQ ID NO: 36722 - DNA, 101 bp, rice(Oryza sativa)
  misc_feature (71): n=t or c
ggttgggtcggtgattcttcaccgaccccaagaggcatttgggccgtatatgccacagcaattgggccgtngcccaccggcccaccccatcaaaacagtac

SEQ ID NO: 36723 - DNA, 101 bp, rice(Oryza sativa)
  misc_feature (71): n=a or g
accttcgcttcgggggagaatgggagggatttggggggattccgtgtaggggtctaaaagcaaaattaccntcacgccatgacatggaggagggtggatgc

SEQ ID NO: 36724 - DNA, 101 bp, rice(Oryza sativa)
  misc_feature (71): n=a or g
ttggagatattgggtgcgagatatgaaaaaaagaaaaaaaacctgttaccaactagaattaaaaataggcntctttagtcctggttgtataaccaggacta

SEQ ID NO: 36725 - DNA, 101 bp, rice(Oryza sativa)
  misc_feature (71): n=a or c
aaaagtgaacagtggaataattttaactcaggaaaagtatgccaatgacattctgcgccgagttggatgcnagattgtaaacctgtaagcactcctttgct

SEQ ID NO: 36726 - DNA, 101 bp, rice(Oryza sativa)
  misc_feature (71): n=t or c
cacctttactcccttaactactgactaaatctaattcgtatttcttgaccacgaatccacgatacagatanctcgaccctccaactattaaaaatggtgta

SEQ ID NO: 36727 - DNA, 101 bp, rice(Oryza sativa)
  misc_feature (71): n=a or g
ccaactgatgggaaaaatatctaagataagccagtcagttgcattttcctaagatctacatccttcttttntttgttaaatggtatacataaacaaaagct

SEQ ID NO: 36728 - DNA, 101 bp, rice(Oryza sativa)
  misc_feature (71): n=t or c
attacaaacggatgaatttccttgcaattacattgcagcttgtatgatttcaactacaatccttacaaacngttaacatttcgcagattacatagtacata

SEQ ID NO: 36729 - DNA, 101 bp, rice(Oryza sativa)
  misc_feature (71): n=t or c
ggtctgcgtctggagagaaggggacatgagtaggacgaaaaccatagattctattctactccctccgtccnaaaataagtacagttttgcactattcacgt

SEQ ID NO: 36730 - DNA, 101 bp, rice(Oryza sativa)
  misc_feature (71): n=t or c
ccttttgatttgcctcctcatcacaacaccctggctatacccttgcatcatcaactctctaatatctctangcatgtgttgtgtgtcatgtggactgctgc

SEQ ID NO: 36731 - DNA, 101 bp, rice(Oryza sativa)
  misc_feature (71): n=a or g
tttttttctacgtatgttttgttgaaaatggtaaattagtttgatgttttctctactataacttacaagtnttcatgttgctgcatacggacgaagtacat

SEQ ID NO: 36732 - DNA, 101 bp, rice(Oryza sativa)
  misc_feature (71): n=a or g
aatttcttacttgttgtctattttttttattcgagaattatgaagcactactacagaaaagcacataaagntcggtatataggtgctgaaatagataaacc

SEQ ID NO: 36733 - DNA, 101 bp, rice(Oryza sativa)
  misc_feature (71): n=t or c
ccctggctgaaagctttccatcacaaagaaggggcgaaaaccatcagaaaaactcgaaactttctgctgtngaggcaccgacaggccagaaacaatagtca

SEQ ID NO: 36734 - DNA, 101 bp, rice(Oryza sativa)
  misc_feature (71): n=t or c
aacactattccatatgattatgcgaaagtgcagttgcaagtggtgaacaaagggttagagtcatacgatcnggacatccaaactcctgatggcatatccgt

SEQ ID NO: 36735 - DNA, 101 bp, rice(Oryza sativa)
  misc_feature (71): n=t or c
atcaattaaatagttttaaaattattaataactggttaatttgtaagtatcacttcaaaatatgtaacttnaaattcagctttatttttttataattaatt

SEQ ID NO: 36736 - DNA, 101 bp, rice(Oryza sativa)
  misc_feature (71): n=a or c
taagcatgcaactagctacatactatgtagaaaggtgatatgttggctactccctccatcaaaaaaaaaancctgggtttccgtgtccaacgtttgactct

SEQ ID NO: 36737 - DNA, 101 bp, rice(Oryza sativa)
  misc_feature (71): n=t or c
ttgggttgaattggagaggagagtgtgcaaaggtggaggaaaggaggaagacgaagtgttctggtgtgatncgaacgttctaccttcaaacgcgcatctaa

SEQ ID NO: 36738 - DNA, 101 bp, rice(Oryza sativa)
  misc_feature (71): n=a or g
tttgttctatccctaatgtccttatcaaattcggcacaaacaagctaaaattggtccagccgcattctggnaatttatgctgctggcgataaaacaaatta

SEQ ID NO: 36739 - DNA, 101 bp, rice(Oryza sativa)
  misc_feature (71): n=t or c
gcagacaagaaagaaagaaagaaatgataaagatagctgctacttctatagttctatgtactccccccgtnccataaaaaaaccaacctagtaccgaatgt

SEQ ID NO: 36740 - DNA, 101 bp, rice(Oryza sativa)
  misc_feature (71): n=a or g
gaggtgcactacaattccttgtatgacattgaaggtgagttcttttgcttttctgtgatctgggagtgaangaaaggtttcctacaattcctcggtttttc

SEQ ID NO: 36741 - DNA, 101 bp, rice(Oryza sativa)
  misc_feature (71): n=t or c
gagtgatgagtgaggaatggcgactcggactggaggagaagagagcaagaaaatcaaagcccgaggtcgtngacacgttgtggccacgcgttggcttgctt

SEQ ID NO: 36742 - DNA, 101 bp, rice(Oryza sativa)
  misc_feature (71): n=t or c
acaagaaataaaccaagaattcacggtcgaaaatccgagctgaaaacgaagctgaaaccacagcacaattnagagagtgatcaccaatgatcggtgaaatg

SEQ ID NO: 36743 - DNA, 101 bp, rice(Oryza sativa)
  misc_feature (71): n=a or g
aaatttcagcctgtagccattgaccccacgaattaaccaaagaccagatcgaatcagtcgtgtagaactcnagtgagagcaagtataacagtgagatgtaa

SEQ ID NO: 36744 - DNA, 101 bp, rice(Oryza sativa)
  misc_feature (71): n=t or c
tcctagaaataagcacactgctaaagtttctagcctacccttattccttaatgattgttgaaacttattcntagatagaaataagaatactgttaaagttt

SEQ ID NO: 36745 - DNA, 101 bp, rice(Oryza sativa)
  misc_feature (71): n=t or c
tcccgagctgaattcatggagtaggttttaaattctcaaggggatgtggactggttgttttaatgtcactnaaatagttataaaaaaaataaatattaaaa

SEQ ID NO: 36746 - DNA, 101 bp, rice(Oryza sativa)
  misc_feature (71): n=a or c
gaaatgcactacgccttaaaagtaaatagagaagactactgtatatgacaatccttgaggctgatcggttntgatcgctgtttattaaaactggctttttt

SEQ ID NO: 36747 - DNA, 101 bp, rice(Oryza sativa)
  misc_feature (71): n=t or c
gatttgtatccttgttgaatgtatatcctggtagtcactcatcaatttatatctattttatttttattcgngttaaatgtgtatcctagtgtgtcacttaa

SEQ ID NO: 36748 - DNA, 101 bp, rice(Oryza sativa)
  misc_feature (71): n=t or c
gctacaagagtttaagaatttcgtgaattttgcatatattaagtaggggtgctttagagggatatttaacnttttgccacttttaagatgtggaaattaat

SEQ ID NO: 36749 - DNA, 101 bp, rice(Oryza sativa)
  misc_feature (71): n=a or g
aactagatcgttcaatagcagcacctaaaataaatggctctcatcaaccttttaagaatcaaactttaganaaagacaatccttttgatgctagtgatgac

SEQ ID NO: 36750 - DNA, 101 bp, rice(Oryza sativa)
  misc_feature (71): n=t or c
tccacttacggaccgcatggaaacaaaaggaggcggtgtccaaaaaaaatctatcgtgtagtagtgcctcnttcttcctccacccaaccatctctcctacc

SEQ ID NO: 36751 - DNA, 101 bp, rice(Oryza sativa)
  misc_feature (71): n=t or c
tcttaatattgccaccagagaaaaccgattttcgttggtagccgtcttactgttgccgccagagaaaaccnattttcgttggcggccttcttagtatggcc

SEQ ID NO: 36752 - DNA, 101 bp, rice(Oryza sativa)
  misc_feature (71): n=t or g
gtaaagccctctcatcctccactccatcacacactcaagcaagaagttctcatactctctcaagtttagtntagtgtcacaagttcaatttagaatagaat

SEQ ID NO: 36753 - DNA, 101 bp, rice(Oryza sativa)
  misc_feature (71): n=a or g
tacggtgggccaagaagattttatttgttgggccatatgtgggcctgtacctagcagcgcgagtccgactncaatcctgtctcctcttgaattttttttat

SEQ ID NO: 36754 - DNA, 101 bp, rice(Oryza sativa)
  misc_feature (71): n=t or c
cacggagctccatcaccctctccatgaacataatgaacgccaattccgtcttttcatcatagtatccttcngagtcggagtcccgcgtgaactcgtctatg

SEQ ID NO: 36755 - DNA, 101 bp, rice(Oryza sativa)
  misc_feature (71): n=t or c
taaaaaaattgaatggagacttagggggtatctatagattttgtgggtgtaagggggactcccttgcacgnatgttggatccgcccctggccccctccagc

SEQ ID NO: 36756 - DNA, 101 bp, rice(Oryza sativa)
  misc_feature (71): n=t or c
ggaaacttttgaaacaaatgatcgagtcatatcctatcctatccttaaaaattactgtagaataggtaatnctataaagatttttggaggaaaattaacaa

SEQ ID NO: 36757 - DNA, 101 bp, rice(Oryza sativa)
  misc_feature (71): n=a or g
cgtgccgggaaatggctcgctgaagagctcgtccatctcattgctcgtgtcgacgaggaggacacgggcgntgagcacagcgtagaggaaggccgacgcgg

SEQ ID NO: 36758 - DNA, 101 bp, rice(Oryza sativa)
  misc_feature (71): n=a or g
tttgatttaagctgatgttttgtgcgggaactttgtagcttaccgtatgcttgaattgtatagtgatgganacatgggcatcagtctcatttgagtcgttt

SEQ ID NO: 36759 - DNA, 101 bp, rice(Oryza sativa)
  misc_feature (71): n=a or c
tacatatatagtggggactccaaaggacagaagcagctgcgtgcattaacttgagattaagcaccaccaantggaagtataggtagactttaattaagaaa

SEQ ID NO: 36760 - DNA, 101 bp, rice(Oryza sativa)
  misc_feature (71): n=t or c
tgggaatttataaaacccgatctctgtaccaacatggatgtatacaaccacttctttctatcacttacttnctccatccaaaaaaacttaacctaggaaaa

SEQ ID NO: 36761 - DNA, 101 bp, rice(Oryza sativa)
  misc_feature (71): n=a or g
gactaccgaatttggatcttaatgtgccattggaccctcatgatcttgctgaaagtttgcctatagtgcangattccagtaatatactctaccatgaaact

SEQ ID NO: 36762 - DNA, 101 bp, rice(Oryza sativa)
  misc_feature (71): n=t or c
cagaatagcccattgtatccatcaaaatttggttatcctggtacccctaattcacaactaaagaatccctngcccttcaagcatcaccaacaccgtgggat

SEQ ID NO: 36763 - DNA, 101 bp, rice(Oryza sativa)
  misc_feature (71): n=a or g
tatcattctgtagaacttgtggagtgacaaagaacactcttttagacttccaaaagcatgatcgctttgangggcttagattccccttcaagtcaattgtc

SEQ ID NO: 36764 - DNA, 101 bp, rice(Oryza sativa)
  misc_feature (71): n=t or c
ccgagccgtccatccccctcttaaccccccccacgaaagaaaaaaaatataaatcgaatttaagtcgaaancccacgcgtccgccgctcccaccaccctcg

SEQ ID NO: 36765 - DNA, 101 bp, rice(Oryza sativa)
  misc_feature (71): n=a or c
cagagtgatgaacaatagatatcactgcaatttattgacatgtaaaatactgcaaatcccaaatagttacnattggtataatggaaatattaattgaaaac

SEQ ID NO: 36766 - DNA, 101 bp, rice(Oryza sativa)
  misc_feature (71): n=a or c
aaggagaatgcctctttagacgtggttaagagccaaggtgaggttcaatgttcctacttgtcatgctttgntgacttactgtttgcagttacgttattcct

SEQ ID NO: 36767 - DNA, 101 bp, rice(Oryza sativa)
  misc_feature (71): n=t or c
taagtccaatgtttcgccggtccagccaattgtatcgtctacgctgacgtcgtttaaggctgcatcagtanattcgacctcttggattactctggtatgga

SEQ ID NO: 36768 - DNA, 101 bp, rice(Oryza sativa)
  misc_feature (71): n=t or g
gattctcatatcaagttatagataaggcaaacaccctgatcagattgaaaatgaactaggaaggttgtacngcaccatctaaggcttgaggaaataggcta

SEQ ID NO: 36769 - DNA, 101 bp, rice(Oryza sativa)
  misc_feature (71): n=a or c
aaattggtaactactcatgcgtcataaattttgtctcataacaaaaaacaaaaatatgaccctttcggagntatttttttcgtgtcatcatgcccgtttag

SEQ ID NO: 36770 - DNA, 101 bp, rice(Oryza sativa)
  misc_feature (71): n=t or c
tgtcgtccccaccgattcgccgccatgacgcagtctactccgccggtcacgatctccgtcatcattgcgangcaagtctccctctaaaggtacaaatccac

SEQ ID NO: 36771 - DNA, 101 bp, rice(Oryza sativa)
  misc_feature (71): n=t or c
ctctcaagaagaagaaattcaggtcgctcacacagggttcccgcacagtcactgagtatctgcatgagttnaatcgtctggctcgttatgctccggaggat

SEQ ID NO: 36772 - DNA, 101 bp, rice(Oryza sativa)
  misc_feature (71): n=t or c
gatggaaagaaaccagaatcaatccaataaagagagtcccaagcgcactctttcatcccaagcacccttcnttttttctggtaaagttcttaagggcctat

SEQ ID NO: 36773 - DNA, 101 bp, rice(Oryza sativa)
  misc_feature (71): n=t or c
tccaaaaagctgacccaaaaggatctttaggaaatgatttgttgagatccgtgtagtcaacacacatgcgncattgtcctgttttcttccgaactaagact

SEQ ID NO: 36774 - DNA, 101 bp, rice(Oryza sativa)
  misc_feature (71): n=a or g
atactactattgctactcctaccagctaggcaccatagcattgtacgctagtttgaatcggatttgaagcnaggctgcaactgtttccttggtaggtcaat

SEQ ID NO: 36775 - DNA, 101 bp, rice(Oryza sativa)
  misc_feature (71): n=t or g
cagtctcaacaagtcatataggatagaactacacaaatatcacaacactcactatggaaagcactgtaaantatatttgtgtttcagtccctacttattta

SEQ ID NO: 36776 - DNA, 101 bp, rice(Oryza sativa)
  misc_feature (71): n=t or c
ctccctcttccaatcgggccgagaaagaaagcccagcaagaagtctgttttgtgtccctctactacagtgncacccccaacctccagactccctgccgagc

SEQ ID NO: 36777 - DNA, 101 bp, rice(Oryza sativa)
  misc_feature (71): n=t or g
atcagtgaacctcagaaaattcctactgaaagtgcatccgcttatgcgtagcataatgataccctgttagntattgttgggtttgaaggggattgaagagg

SEQ ID NO: 36778 - DNA, 101 bp, rice(Oryza sativa)
  misc_feature (71): n=t or c
gatctatagccgtcagtcagcaaaggtcgtggcccacggggcggcagctgatgctcttggttgctgaagtnggacatcttggggacggacaagccataatc

SEQ ID NO: 36779 - DNA, 101 bp, rice(Oryza sativa)
  misc_feature (71): n=t or g
ggataaaatatggtattacagaggttgatgtgcgcacaatctagctttacagaagaaaaacaaatgaacanataaagcgataaagatgtctatctgtataa

SEQ ID NO: 36780 - DNA, 101 bp, rice(Oryza sativa)
  misc_feature (71): n=a or g
gacatgtgacgccccgacattcgttagctataaacacagctaacttacatcagggtgttatgcattacctntgatatagtaccagtcccaggatacactag

SEQ ID NO: 36781 - DNA, 101 bp, rice(Oryza sativa)
  misc_feature (71): n=a or g
gttggtgcgacgtccttgtggttgtctccttattggtaaggtgttcttgtggtgatgtctttgttagatcnggttagctggtaatggcggtggcatgacct

SEQ ID NO: 36782 - DNA, 101 bp, rice(Oryza sativa)
  misc_feature (71): n=t or g
ggtctgaaattatttagcacacattacaacatcacccacctcattcattcacaagccactacccgctaggnaaaaaaaaaggttgaaaccaaacggtaaga

SEQ ID NO: 36783 - DNA, 101 bp, rice(Oryza sativa)
  misc_feature (71): n=a or c
gattcacacaatatgtgcatttttgtcatctcagataatgatgccagaggaccatattgaaaattttgtancattgctaaaagtctagcttattaatttat

SEQ ID NO: 36784 - DNA, 101 bp, rice(Oryza sativa)
  misc_feature (71): n=a or g
atgtttcctctcattatacagaaataatttttctatacaagacactcacggatcgtaactggtcgagtctncaaaaatcaacctctattttcgcatacaac

SEQ ID NO: 36785 - DNA, 101 bp, rice(Oryza sativa)
  misc_feature (71): n=t or c
aaaatgtgttcgagtcaattattggctcgaatgaagtttccacccaaaaagtagttttaggtctgggaatntgtattcaccataaaggtttcgtcccaagg

SEQ ID NO: 36786 - DNA, 101 bp, rice(Oryza sativa)
  misc_feature (71): n=a or g
cactggcaggttttgagcctacaggtgtagcagtaccgcagacagcaaggactatcaagcccaagagcccnaggccttcgctcaacccctagttggttgcc

SEQ ID NO: 36787 - DNA, 101 bp, rice(Oryza sativa)
  misc_feature (71): n=t or g
atggctttcatgtatctccaggtatcaatctctattacaaattttgaactaggagtttatcgtacttgcantttacctatttcggacatagccaagacatt

SEQ ID NO: 36788 - DNA, 101 bp, rice(Oryza sativa)
  misc_feature (71): n=t or c
atatggatataagtggagagggccaaatatctctagcaaaagagatcaaggaacgaaacccgttgcatttnggactccaggtacatattccattttatgat

SEQ ID NO: 36789 - DNA, 101 bp, rice(Oryza sativa)
  misc_feature (71): n=t or g
aaaaatagacatgcattgtgtgcactagtaacaactggaccttttctcacgcagttgtactagtagcacangaccttctctcacatactagtaccactgga

SEQ ID NO: 36790 - DNA, 101 bp, rice(Oryza sativa)
  misc_feature (71): n=a or g
acaatgcttgacttcaacttggaaaatggcatccatgtatatatgtgtatgttttatcggaaaagcgaacncgcgcgtgcgcgttggcggcgagagtttcc

SEQ ID NO: 36791 - DNA, 101 bp, rice(Oryza sativa)
  misc_feature (71): n=t or c
ccgacaagttgttctcgagctccgacattcggtgctcgagtccttgtcgctgccttttgttgccggtcacnagctccctcatctttaggaggtcctctcga

SEQ ID NO: 36792 - DNA, 101 bp, rice(Oryza sativa)
  misc_feature (71): n=t or g
gcatagcataaacacaagtttccctgctccacaaaattcaagcttgacaactaactttcgtcatgtgaacnaagcctaccagaattttcctatccagaaac

SEQ ID NO: 36793 - DNA, 101 bp, rice(Oryza sativa)
  misc_feature (71): n=a or g
tgcaaaaaacttcaaaaataatggtttttagctatgtgcaatcaacaatggtaccgaggtataatatctcnacttgactcgctaagatggtacaagttcta

SEQ ID NO: 36794 - DNA, 101 bp, rice(Oryza sativa)
  misc_feature (71): n=t or c
ttttttttaaaaaaaattcttgattcactcggaactctggaacagaggaatatatacagtatatagctacngtagaagtgaagggtatgcctgagtacctg

SEQ ID NO: 36795 - DNA, 101 bp, rice(Oryza sativa)
  misc_feature (71): n=a or c
agaatacaaagatgtaactcccaaaataagcattgggtaatgccttgcttggatgcctcccccctcccccnaaaaaaaaaaaaagtacagttgaacccaaa

SEQ ID NO: 36796 - DNA, 101 bp, rice(Oryza sativa)
  misc_feature (71): n=t or g
gctgactagttcttactgttgatacttctgtacatgttcatcaattggcagccattggggtattctggagnttttgaagaaggaaccttgtcccacacatt

SEQ ID NO: 36797 - DNA, 101 bp, rice(Oryza sativa)
  misc_feature (71): n=t or c
agggaagcaggccaaacggaaggaggtagcaaattggcttagggttaaaaaggaaggaaggttttcggccnaaaacccagaaaatattttcattaacttgt

SEQ ID NO: 36798 - DNA, 101 bp, rice(Oryza sativa)
  misc_feature (71): n=t or c
cccctgggggggagagctttattgactacataacaggatcaagaatagtggtaccaaattatttggcacanatttgataatttgctagcaattagtcaatc

SEQ ID NO: 36799 - DNA, 101 bp, rice(Oryza sativa)
  misc_feature (71): n=t or c
accggttcaatattgtttttaaaccgaaaagttagaatatcgaatgaattttgtagaaagcgattacttgngtcaaaatctgactagtttcttgttaaatt

SEQ ID NO: 36800 - DNA, 101 bp, rice(Oryza sativa)
  misc_feature (71): n=a or g
ccaccatgtaaggttccacgttagaaagttgttgtgagcctatgacaagcattttttctttggccatggantcgatataagaagtagagacatgcatttat

SEQ ID NO: 36801 - DNA, 101 bp, rice(Oryza sativa)
  misc_feature (71): n=t or c
ctataataaaccatcaacttttacttaacttctataattaccatcatcatccggttagccttctttagtantgtatatttttttttgtccaaataaccaaa

SEQ ID NO: 36802 - DNA, 101 bp, rice(Oryza sativa)
  misc_feature (71): n=t or c
cgcataagaggccatgggccgaccggctagggcgggaaaaagtctgatttaggtccctaagcaacactttnttgatcactgtacacactccgtaatcactc

SEQ ID NO: 36803 - DNA, 101 bp, rice(Oryza sativa)
  misc_feature (71): n=t or c
gccccttgccatgacctttcatgtactttaatatttccctagtggatcaacaataacaatctttgttgaantgcggttgttcgacatggtattaaccttat

SEQ ID NO: 36804 - DNA, 101 bp, rice(Oryza sativa)
  misc_feature (71): n=a or g
ctcgggctagttattcttttcctatacttcggggcaactgcctgcgtccttatgattgccctactctaagngtggtgggcctcacagcaccccgcgcgccc

SEQ ID NO: 36805 - DNA, 101 bp, rice(Oryza sativa)
  misc_feature (71): n=a or c
gattagggtttagtttaacgcctcgctatcctctcgaaatgcgaggaacaaccatttcatcttgccctctnttccttgcttgttccgctcgcgatttctct

SEQ ID NO: 36806 - DNA, 101 bp, rice(Oryza sativa)
  misc_feature (71): n=a or c
gtatttttttcttcaaaatgttgttaatgagattatgcttgatatatttcactattacacttatgcctatntctgaacacaatacctaaaaatatcttatt

SEQ ID NO: 36807 - DNA, 101 bp, rice(Oryza sativa)
  misc_feature (71): n=a or g
tggtgctgaggcattccagccaaggaggaacattcttggcgaggatggccactgttttacgctgggtgtgngtgtggttaggtctatggtttgttatcatg

SEQ ID NO: 36808 - DNA, 101 bp, rice(Oryza sativa)
  misc_feature (71): n=t or c
gagagcacgggagcaggtggaagacggcgtcgaagcttctcttcaccgcctctctcccagatctggcacancgtcagccggatctggcatgccggcggctg

SEQ ID NO: 36809 - DNA, 101 bp, rice(Oryza sativa)
  misc_feature (71): n=t or c
tttgcgcaaagaaatgaatccagtattgaatttgttgtgctgacggcacaactgaatctccattctccaanggggaaaaggaatgtgtgtgagcaacgttc

SEQ ID NO: 36810 - DNA, 101 bp, rice(Oryza sativa)
  misc_feature (71): n=a or g
acttactcggttagctcgttgagctcgtgatgcattaaaatagaagttaattgtctatatatttacaggtntaaaggtcgtaaattcataattatccattg

SEQ ID NO: 36811 - DNA, 101 bp, rice(Oryza sativa)
  misc_feature (71): n=a or g
attatctttgaggatttggatgtgcagaatggagaaaaatgtcacacgtgattatgagctaaagggaggtnaatggatgagtaatcaatgattaaattaga

SEQ ID NO: 36812 - DNA, 101 bp, rice(Oryza sativa)
  misc_feature (71): n=t or g
tgaaatttaagaaacctgaattaaaataaattattcattagttaaatagaagtggtgatttacttcccttnaataaatatattaatactagtaaaattatg

SEQ ID NO: 36813 - DNA, 101 bp, rice(Oryza sativa)
  misc_feature (71): n=t or c
ctgctgtctggtccatggatcacaacttgaacgagttgtttgagcttcccatggatttgaggtccttgtanggccccgacgaggtgagctcctgctccatc

SEQ ID NO: 36814 - DNA, 101 bp, rice(Oryza sativa)
  misc_feature (71): n=t or c
aatcattctgaggtcaagtcgatgccatgctggatgcaactttgataattttgttcccctaattgatcacnttagctcataatatgcaacagttttctagt

SEQ ID NO: 36815 - DNA, 101 bp, rice(Oryza sativa)
  misc_feature (71): n=t or c
ataagccacggaatatgggtaaccgatgagaccttaagacttcgttagaaaaaaaatcaacaattcaacangccttacattccacgtatgtctctgaaatt

SEQ ID NO: 36816 - DNA, 101 bp, rice(Oryza sativa)
  misc_feature (71): n=a or g
tgacttcatttctgatcttcctgatcatccgatagtttttatgtagtttttagtatacccgaacaacattntgaaattatgcacctaataaagcatgccat

SEQ ID NO: 36817 - DNA, 101 bp, rice(Oryza sativa)
  misc_feature (71): n=t or c
gctaccgtgcaggaccggaggaggcaggtcggggcgccgttaaataaacctaggctgtgtttgcaagactnccgtctcgttttccacgcgcacgtttttca

SEQ ID NO: 36818 - DNA, 101 bp, rice(Oryza sativa)
  misc_feature (71): n=a or g
cgttatatatattaaatagatatgtacaaaatatttactaggacaatcacataatatcttagctattattnccaattggatttatctactattctacttct

SEQ ID NO: 36819 - DNA, 101 bp, rice(Oryza sativa)
  misc_feature (71): n=a or c
ctcctccgactccgactccgactccgacgatctccacctcctcctcccgaatctcctcccttccgccgccnccgccgcatcagacgcgcagctccaccact

SEQ ID NO: 36820 - DNA, 101 bp, rice(Oryza sativa)
  misc_feature (71): n=t or g
catcatcgatctctgtgtgtttctgcctgcatcttaatttgttctttctgtaattaatcttgcattgctcnctctacaagtatatacttactagctagtag

SEQ ID NO: 36821 - DNA, 101 bp, rice(Oryza sativa)
  misc_feature (71): n=a or c
tgaaaaacctaggagtagtatacatactctcaagagtatgtgctttagatagtaattaaacagtatctggntgcttatactttttttttacaaatcttttt

SEQ ID NO: 36822 - DNA, 101 bp, rice(Oryza sativa)
  misc_feature (71): n=a or g
atgattttcgaaatatcaccaagcaacgagcttatggttggattttcttcggaagcttcttttgtgcttcnactgctatgcctgtacaaagttcacagata

SEQ ID NO: 36823 - DNA, 101 bp, rice(Oryza sativa)
  misc_feature (71): n=t or c
gtaggaaataaaatgaggacagttgtgtttgctaggggaggatgggaacctgcacactacgcacggaaaangatgtagtctattagcgcgtgattaattaa

SEQ ID NO: 36824 - DNA, 101 bp, rice(Oryza sativa)
  misc_feature (71): n=a or g
gctgcatattttgtaaagacatagtatcaattctgtctcgccgtgggcatagctgctcaatgatcaaaggnccaagacgaattcatagtcccaggaatgaa

SEQ ID NO: 36825 - DNA, 101 bp, rice(Oryza sativa)
  misc_feature (71): n=t or c
actcactcatatgcggatgcgcctccctatcccgggcaaaagctagattcaccgtgtcatctactccctcngtctcaaaaaaaaaaaagaagcaaacccta

SEQ ID NO: 36826 - DNA, 101 bp, rice(Oryza sativa)
  misc_feature (71): n=a or g
ttcctgaggtggattctctgcaatacgaaagtatccttattcagcaaggtgggcgacaggatgatagaagncatgtatgagaagacttacatttacaagac

SEQ ID NO: 36827 - DNA, 101 bp, rice(Oryza sativa)
  misc_feature (71): n=a or c
cattgtcgatcttcaccgcgttcttctagtgttcttcacgttcttgaggtattcgccctaaaatcaaatcntttgattcctcaagttttatcttgcgattt

SEQ ID NO: 36828 - DNA, 101 bp, rice(Oryza sativa)
  misc_feature (71): n=t or c
ctttatacaagatatattttaatctaaaatttttcatgaacgtttgtgtcgatggtggatacccgtagacnggatatagagggtattggggtacgttggta

SEQ ID NO: 36829 - DNA, 101 bp, rice(Oryza sativa)
  misc_feature (71): n=t or c
tctatgtcgcggctgtggacgaagaggatgagcacgagcttgatctgtcgccgccggtgtcaccatagctngattcgcggcctcagagctcggtttgcacc

SEQ ID NO: 36830 - DNA, 101 bp, rice(Oryza sativa)
  misc_feature (71): n=t or g
tgcatccatctcaacattcatgcattttagtatatcaattgcatgcttatgtcttctcaattctgttgttnctccattcctctctctaatattatctcctt

SEQ ID NO: 36831 - DNA, 101 bp, rice(Oryza sativa)
  misc_feature (71): n=t or c
aacatgcaaaccttgtgatcagaatatacctatgtacatcagcaccaagccagagatgaaagaggagtctnagaagccagaacatgagtagaaatgcccat

SEQ ID NO: 36832 - DNA, 101 bp, rice(Oryza sativa)
  misc_feature (71): n=t or g
cgggctgaattttaaagtttggattcctacctttggtttatggtccatattcaaaggagtaagttcaattnaggtctcccaagttgtcgccgagtttaaaa

SEQ ID NO: 36833 - DNA, 101 bp, rice(Oryza sativa)
  misc_feature (71): n=t or c
acgatccaccacaaattaggcataccagacgacaagacctgctattaattgggcccgcgcccatcccatancatatggtaactttaggccttcagcccaat

SEQ ID NO: 36834 - DNA, 101 bp, rice(Oryza sativa)
  misc_feature (71): n=t or c
ttcaaatgaaacgaaatgaatataaacgaagtgagaataactcgactgaagttattaagttccttgtgacngagattatccatcaaatttaagatgtacgt

SEQ ID NO: 36835 - DNA, 101 bp, rice(Oryza sativa)
  misc_feature (71): n=t or c
actgttatctttattaaggatttgtaatcgaagtagaaacctatatagtgaaatgcttaaacaggttatgntgtgaacgagtactactctttttacgggct

SEQ ID NO: 36836 - DNA, 101 bp, rice(Oryza sativa)
  misc_feature (71): n=a or g
cctgatttaattgactgtaaataatgaatggttatttaatgaggcttgaaatgccattcaacccataattnggtggttgaaacacggtgttgcatttaacc

SEQ ID NO: 36837 - DNA, 101 bp, rice(Oryza sativa)
  misc_feature (71): n=a or g
aaagaaaacaatgggaagattagtgaaaaaagcaacaaagcccaaggggaatgtggggtccgcaggcatcnctgttgctggcacgaaggttaggctttcgc

SEQ ID NO: 36838 - DNA, 101 bp, rice(Oryza sativa)
  misc_feature (71): n=t or c
acttatgaaatataccgataagatataccttcacatacacagatcatccccatgaatatcgtatggaatcngcttcaaattatggaaaatatctctttcca

SEQ ID NO: 36839 - DNA, 101 bp, rice(Oryza sativa)
  misc_feature (71): n=t or c
cctatatcgttgtctacttctacaatgttgttgagggcagaggaaaaggcacaggtattctacattttctnacgtctctactgcggcgggagggacagaga

SEQ ID NO: 36840 - DNA, 101 bp, rice(Oryza sativa)
  misc_feature (71): n=t or g
tggatttgacagcattaatacgtgtaccagaaagatgcagttgtactacttgaagggagcactaggatctnatctcacccccaaaaaaatagggggcaaaa

SEQ ID NO: 36841 - DNA, 101 bp, rice(Oryza sativa)
  misc_feature (71): n=a or g
tctgttctcccccacatactgaattacctgacttatagacagtattctagcagtgtagtatttgaaaacangctcctgaatgtgcttttcactttttgtca

SEQ ID NO: 36842 - DNA, 101 bp, rice(Oryza sativa)
  misc_feature (71): n=t or c
ctttctttttcctttcggtctcctctccctccaatgaaataagttcacttcaagtccttcaatttatcgtngagtctaaaattcatccctgaatccaaata

SEQ ID NO: 36843 - DNA, 101 bp, rice(Oryza sativa)
  misc_feature (71): n=t or c
cccaactcttctttcattgtgatttctatggtttgcggttgcacgggcaatttgggttgcagtggagacgngacggcggcagtgacgatgacaatgatgat

SEQ ID NO: 36844 - DNA, 101 bp, rice(Oryza sativa)
  misc_feature (71): n=a or g
tcgcttgtttcgtctttaaggttattgcccgcgcaagtttcatacgagcaagttttataatagggatagcnataacatctaattttatttaaattattatt

SEQ ID NO: 36845 - DNA, 101 bp, rice(Oryza sativa)
  misc_feature (71): n=t or c
aacaacgtccaggtgatccatggacgagagagtgagcccattgtagaaactctgtaggatgagccagttgnccatcccgttgtgaggacaggcggccacat

SEQ ID NO: 36846 - DNA, 101 bp, rice(Oryza sativa)
  misc_feature (71): n=t or c
atttgtcaacaaaataaacccaatttcccggtggtccatctcaccatgttgaaaaatgaacgtgtgaaacngtcctaataacctaagcgtttaattgactc

SEQ ID NO: 36847 - DNA, 101 bp, rice(Oryza sativa)
  misc_feature (71): n=t or c
tctctcatgtgggaattaacccaacatgacctaaagtggaatgtggtgtttgattgccaacagagaaaggncaccatgcaggggtggatccacccattagg

SEQ ID NO: 36848 - DNA, 101 bp, rice(Oryza sativa)
  misc_feature (71): n=t or c
ctcgttcagtaattgtgcatgtgaggatggagctcaaatattaacattaacttacatgcaattgtctatantattatcaggttattgcaggtatgtaggag

SEQ ID NO: 36849 - DNA, 101 bp, rice(Oryza sativa)
  misc_feature (71): n=a or g
atcgattcagatgtatgcatgactggatctaaaagattactagctagctattgtatactccctccgtttcnaaatgtttgacgccgttgactttttagcac

SEQ ID NO: 36850 - DNA, 101 bp, rice(Oryza sativa)
  misc_feature (71): n=a or g
tcactgctccttcctttctatattccaactactttaatgatatgtttgtttacaggaattcgtttcgattnatttcttcctggtttggtctcgcaaattcg

SEQ ID NO: 36851 - DNA, 101 bp, rice(Oryza sativa)
  misc_feature (71): n=a or c
tatgtgcattgcactgctacgatgttgaggaaatattggggaagagaggagggatgcaagcaggaccgatncacgaatttacttataggttaaatagatga

SEQ ID NO: 36852 - DNA, 101 bp, rice(Oryza sativa)
  misc_feature (71): n=t or c
ttttcgcagacatgcctcttaaaggttcgcccaaaagtctgagttacctcctcctccctctttagcacttnagatttttcaagtcatcctatctactccct

SEQ ID NO: 36853 - DNA, 101 bp, rice(Oryza sativa)
  misc_feature (71): n=t or c
tttggcaaaggcttgtgtaagttaaagtaaactatacttaagtgacttaagacgatgaaaaacattacttncttcgttccaaaatataagaagttttagtt

SEQ ID NO: 36854 - DNA, 101 bp, rice(Oryza sativa)
  misc_feature (71): n=a or g
atgcatgcgtatgtcttctttgtgacggtggggagaagtggatagtggccagtagtataaggccagtctcnacccaaaacactagacatagtttacataaa

SEQ ID NO: 36855 - DNA, 101 bp, rice(Oryza sativa)
  misc_feature (71): n=a or g
aaagatccagtaagtccaacgatgattccttcggacgtgtcaattgaacaaatacgcccatagtgactcgnatggatatctcggctccgaaaacttgcagt

SEQ ID NO: 36856 - DNA, 101 bp, rice(Oryza sativa)
  misc_feature (71): n=t or c
gatagaggtagtaaaaaaaaaacagagaaacctatactaaaacttaaagaacttctttggcatgaagcaanattatgaaaattttagaggaactgagccat

SEQ ID NO: 36857 - DNA, 101 bp, rice(Oryza sativa)
  misc_feature (71): n=a or g
ggcctcgacaccggtgagcgccacaaataataacgggaaaatatatagcgtatatcatatgtgtatgtgtnaatttaaaaataccgtggaataaaaaatat

SEQ ID NO: 36858 - DNA, 101 bp, rice(Oryza sativa)
  misc_feature (71): n=t or c
attaggatgattgccatatttggtccattggttgtcatggcgatgtgcatcggtacgtgtatggacacttngagttggtggtgtggtttattctcagttca

SEQ ID NO: 36859 - DNA, 101 bp, rice(Oryza sativa)
  misc_feature (71): n=a or c
ctcgatccacggaaacaagaaacgcatacgcatgcatgatcctaccagcaaagggcaagaacagcagagtnaaaacctcacctcgctggagccagggctga

SEQ ID NO: 36860 - DNA, 101 bp, rice(Oryza sativa)
  misc_feature (71): n=t or c
agatgaagagatatggtgtgggttgtggtgggatatagacgagaacaccttgagtagtgaaacacatttcngagagtcatgaatatatatattttttaggg

SEQ ID NO: 36861 - DNA, 101 bp, rice(Oryza sativa)
  misc_feature (71): n=a or g
acaacaacataaactgataaacatggatacttagggtattctcaacccaatgattaggatagacataaatnaatatgtcttgtatgagacatggtttctac

SEQ ID NO: 36862 - DNA, 101 bp, rice(Oryza sativa)
  misc_feature (71): n=t or c
catcaatactataaataccagtttttataaaaaaaaacccgacatctttagtttagtttattgtaggtgcnggttataaaacaccaacacctataataaat

SEQ ID NO: 36863 - DNA, 101 bp, rice(Oryza sativa)
  misc_feature (71): n=t or c
acacgtacgcgcaaggaagagactggtggacccaaaaggccctccgtgggagagataggcttaacgaggcncaaatacacctaattaggctcaattggacc

SEQ ID NO: 36864 - DNA, 101 bp, rice(Oryza sativa)
  misc_feature (71): n=a or g
ctcagggaagttgattcttatttagattgacaatgcgtatgtgtccttttatgctgccttttactgtatcnatgttgttataaaaaattcttttgtgggga

SEQ ID NO: 36865 - DNA, 101 bp, rice(Oryza sativa)
  misc_feature (71): n=a or g
cggaagctaccaaatgccacctgcacactgaatgtacatgttctatgcacacaaccacctgcacaccgttnatgacctgcatagccaccacgacggaccag

SEQ ID NO: 36866 - DNA, 101 bp, rice(Oryza sativa)
  misc_feature (71): n=a or g
ttttgtgcactttatattgtggaacaaagtgtcgacattgtactagtaataattgtaggatcaaaacacangaactaagccaaccaggggggtgagtggtt

SEQ ID NO: 36867 - DNA, 101 bp, rice(Oryza sativa)
  misc_feature (71): n=t or g
ccaattcttatagaagataatatttcaggtgcaatccaacagcatggaactgggttgcacagagccaaacnacgcatgataaaacttaagtaccatagtaa

SEQ ID NO: 36868 - DNA, 101 bp, rice(Oryza sativa)
  misc_feature (71): n=a or g
gtcatatatccagggaattgctgcatattgatctgttgctagtagttagtacattgtttcagtatgttgangatgcattttttttgaatgaaaaattgaaa

SEQ ID NO: 36869 - DNA, 101 bp, rice(Oryza sativa)
  misc_feature (71): n=a or c
attttcggatttttcctttaatgatagaatttggatccaaaatctcaagatactactggtctctctctctntatatatatccatatacacgctcaagacag

SEQ ID NO: 36870 - DNA, 101 bp, rice(Oryza sativa)
  misc_feature (71): n=t or c
taacatggtaccgtaattactggatcttgtattagacatgtttatcatgtatagtactagatcatgacatngacatggtacctataagtatcatgtatggt

SEQ ID NO: 36871 - DNA, 101 bp, rice(Oryza sativa)
  misc_feature (71): n=a or g
gcattgggggtggtccaatgggagctctagaggaagtcaatctcgagcaaaacatgtgcatactagcggcnggacatagttgggtgtgcctatgtaggcgg

SEQ ID NO: 36872 - DNA, 101 bp, rice(Oryza sativa)
  misc_feature (71): n=a or g
ccttgagctccactcaaaggagctcgccaccgttgtcggtagttcttcatatcaatgagaccgcattggcngtcgaggaggccgtagacaggtcaagtaga

SEQ ID NO: 36873 - DNA, 101 bp, rice(Oryza sativa)
  misc_feature (71): n=t or c
atcctccttcctatgtcaatcctccgcgattcccactgattccaccaatttcgcctccacgtgatgattcngccacaatgactccgttgcatgcatcctct

SEQ ID NO: 36874 - DNA, 101 bp, rice(Oryza sativa)
  misc_feature (71): n=t or c
ctatcgctggtcttgcctaatcacgaagcaaattagttaagcgtgtgccagctaaattcacagtgtaaacnttcgtcattagctagcagaccttgtcatta

SEQ ID NO: 36875 - DNA, 101 bp, rice(Oryza sativa)
  misc_feature (71): n=a or g
tgaatatttctgagttctgactgctgtgatgcatattgatgtttttttttaaaccccgcggggtgtatttntaaagtagggggaaaaactgtacaatagcc

SEQ ID NO: 36876 - DNA, 101 bp, rice(Oryza sativa)
  misc_feature (71): n=t or c
agcggccgtcgatccacgtggattataattagcatctctccattactaatcgccaggagacaagaaaaaanccatgacgcgatgcaaaatcattaaccgct

SEQ ID NO: 36877 - DNA, 101 bp, rice(Oryza sativa)
  misc_feature (71): n=a or g
agacagactccacctaaagttaagggaatttactccacgtaagttggaaggcctcttgggccttggtccanctaaattgtttgatggaacgcattggttga

SEQ ID NO: 36878 - DNA, 101 bp, rice(Oryza sativa)
  misc_feature (71): n=a or g
taataactttccaggcaaatatatgcatgatgtttttgttttatgaaaaattagcatttgagaggctactnatggtcaaaggcttgaaaagtttaaccgaa

SEQ ID NO: 36879 - DNA, 101 bp, rice(Oryza sativa)
  misc_feature (71): n=t or c
ctgcatgcgaagagcggaatactactctgtcaaaaaacgaattcttagtttgtgtccagccttccaggttnataggtagtattattttttttttttggacg

SEQ ID NO: 36880 - DNA, 101 bp, rice(Oryza sativa)
  misc_feature (71): n=a or g
ctttcgtcaacaagttcgggaaaacggaatccctatcgacagggatgcgtggtgacgcccttagatggccnaaataccaactgaagctcgctacctgccat

SEQ ID NO: 36881 - DNA, 101 bp, rice(Oryza sativa)
  misc_feature (71): n=t or g
tccaaatcaaccaacaaattagcatgaatgcactgtcaaaatccgtcctatagctcgtccggaaacaacgncttgttgccagccacctgacgccagcgagc

SEQ ID NO: 36882 - DNA, 101 bp, rice(Oryza sativa)
  misc_feature (71): n=t or c
caacctgtgtatttctgttgcatattagaatccttacttcactaaagtaaaacggatcggtcaattagcgngtgattaattaagtattagttaattttttt

SEQ ID NO: 36883 - DNA, 101 bp, rice(Oryza sativa)
  misc_feature (71): n=t or c
tatttattgaatatagaagggatcaataattacgagtaaggagtaagtgtaatattttaaaaaacgattanggaccatagcaacatctctgctaggcgttt

SEQ ID NO: 36884 - DNA, 101 bp, rice(Oryza sativa)
  misc_feature (71): n=a or g
aagaaaatgattgggatgctccaattaaaaagaacaacaaacaatgactttatttggtttttattagtctntttcctcttttgaatgctatagtacacttc

SEQ ID NO: 36885 - DNA, 101 bp, rice(Oryza sativa)
  misc_feature (71): n=t or g
gatgccctcgtcatttttcagctgagctaaaggagctcctttatggaatccttgatcctgatcctagtacnaggatgtctatctcaaggataaagagaagt

SEQ ID NO: 36886 - DNA, 101 bp, rice(Oryza sativa)
  misc_feature (71): n=t or c
cttctcatccaccaatagaccagctacttctctcacgaagcaacaaccaagcaaacagttagagcatctcnagcagggacactaaatatagcccctaaaca

SEQ ID NO: 36887 - DNA, 101 bp, rice(Oryza sativa)
  misc_feature (71): n=t or c
ttgaatgggattgttgggtctatattattgtaatgggctacttttagagaagtaactcacatccgggaccnctccgggtcacttgcgggttaattccgatc

SEQ ID NO: 36888 - DNA, 101 bp, rice(Oryza sativa)
  misc_feature (71): n=a or g
ggctcgaggctactgcttcattcgtgctagaatattataacctataactaatggaataacatagtaatccnaatctgaatatatttatcagttagtctctt

SEQ ID NO: 36889 - DNA, 101 bp, rice(Oryza sativa)
  misc_feature (71): n=t or g
ttccattatcagtcacataaaaggccttattcttgcatgtgatagtagcatggttttctgatatctgcaangaagttgaacaaattggagaagcattagtt

SEQ ID NO: 36890 - DNA, 101 bp, rice(Oryza sativa)
  misc_feature (71): n=t or c
aggcaaaaaaaaaaaagagctgtacaaattacataagcgctatgattaagctggtaagaattctccaagtngccttgtgcctgccattatccaggttcttg

SEQ ID NO: 36891 - DNA, 101 bp, rice(Oryza sativa)
  misc_feature (71): n=t or c
aatacctatcggaagatcgggacctaacatcctcatcagccactccacccgtttgccggctttgcccgcangtcaccccacctgctccgctccgcctccta

SEQ ID NO: 36892 - DNA, 101 bp, rice(Oryza sativa)
  misc_feature (71): n=a or g
tgaacaaccctaaaaaatgtgaatatacatataacacatctctctataggggagagattgatggttaaggntcatgttgtcaagtttgccctagggccctc

SEQ ID NO: 36893 - DNA, 101 bp, rice(Oryza sativa)
  misc_feature (71): n=t or g
gttagggaattgtgatttgcacagattatcaggcatacttgttgtcaaatctgtcttactctcattttttnaagtgccagcatactgtcaagaattaatga

SEQ ID NO: 36894 - DNA, 101 bp, rice(Oryza sativa)
  misc_feature (71): n=t or c
agcgctactaaccgggtaggctctccatctcgctcctattttctgtagcttcttgtcgccggtttcggccnttttttttttccaataaatttggcttctca

SEQ ID NO: 36895 - DNA, 101 bp, rice(Oryza sativa)
  misc_feature (71): n=a or g
tgacagtatttaattataaaagttaattggctaagtagctgaccctattagtcagtttttttaagataaangaaaataagcctttatctttttattactat

SEQ ID NO: 36896 - DNA, 101 bp, rice(Oryza sativa)
  misc_feature (71): n=a or g
agtgcacggggcgcgtgtgtagctgtcggaatgacacatgttgtgggttgggctaggtatactgtgctgcntgggccacggggaacagcccacagagagac

SEQ ID NO: 36897 - DNA, 101 bp, rice(Oryza sativa)
  misc_feature (71): n=t or g
aaacatgctaatgttcatggtacaatatcacaaaaataacaaaagtaaaacatactccctctatctcactnaataaggcacgtgcacattctaacattgaa

SEQ ID NO: 36898 - DNA, 101 bp, rice(Oryza sativa)
  misc_feature (71): n=a or g
acacatgacccaaaaaaacaccctacgacagcctgtgcccttgggttagcaacctacaaagtaaaacttgnagcacaagggctccagagtccagacaggca

SEQ ID NO: 36899 - DNA, 101 bp, rice(Oryza sativa)
  misc_feature (71): n=a or c
ttgctaacaagtacagtacgtagctgcagggagatggatcgatgatgagcttagctagccatgcacgtggnggcatatatagttagggatcgagagaaatt

SEQ ID NO: 36900 - DNA, 101 bp, rice(Oryza sativa)
  misc_feature (71): n=a or g
atataagcaattatgtagccgaatgggttgatggaaaatctgaaccatttgtttgcttagctttaaaaccntctccgcagatgtgtcggttaaaggaaaag

SEQ ID NO: 36901 - DNA, 101 bp, rice(Oryza sativa)
  misc_feature (71): n=a or g
tcatattactatatggcatcatctgaacatgagtaaaggatatcacggcttatttgttaactcgagggaangggattgggagtttacatgagggaattgat

SEQ ID NO: 36902 - DNA, 101 bp, rice(Oryza sativa)
  misc_feature (71): n=a or g
ctctgcaaagatttcacatttctcactgtcaatttgacaaatgaactcatccaatctagggacaacatctntttggatttaacaagaatggaccaaccaag

SEQ ID NO: 36903 - DNA, 101 bp, rice(Oryza sativa)
  misc_feature (71): n=a or c
aatatgtgttttggcttatttggtaccaaatgatgggggccctggtgtgatgggtggccttgccggcggcnacggcacggcaccgcaccggccatgaacgg

SEQ ID NO: 36904 - DNA, 101 bp, rice(Oryza sativa)
  misc_feature (71): n=a or g
gacgtggcatcctattaatttcatgcgatggcttgtaatagggtgccacgtccttgtcctaagtggaacanccacgtcatatcacgggtgaatccattcat

SEQ ID NO: 36905 - DNA, 101 bp, rice(Oryza sativa)
  misc_feature (71): n=t or c
cgcgaggaggagaaaaagagggagaacgaaatggagaggtgcaaggcgccattgctgggaatgaatatttntagtaatgtcgttaagaaataccaacacaa

SEQ ID NO: 36906 - DNA, 101 bp, rice(Oryza sativa)
  misc_feature (71): n=a or c
aacatcccggttagacggttagcagtttaaaaagtgtgctcacagtatacgaaaaactcgatgtgctaacnggccttatcctacatgatgatgtattggtt

SEQ ID NO: 36907 - DNA, 101 bp, rice(Oryza sativa)
  misc_feature (71): n=t or c
aaccttgtttgtaggggagggggctcggaggatggagagcatgatgtaggccggcgtctttaggatcagangactctgtgcactgtagggtatgtctgtgt

SEQ ID NO: 36908 - DNA, 101 bp, rice(Oryza sativa)
  misc_feature (71): n=t or c
ttttacttattatgtgataatggaattaattatatgtaaatccaacaatgagtatcgggatttagtcagtngtcatgaaatacacggagaatgcttgtaat

SEQ ID NO: 36909 - DNA, 101 bp, rice(Oryza sativa)
  misc_feature (71): n=a or g
gatctaataatgttatatttagtggcgcgcaacgattggactggtacctcgaggtacatccaacgattagnctggtacctcgaggtatttttttgttcgac

SEQ ID NO: 36910 - DNA, 101 bp, rice(Oryza sativa)
  misc_feature (71): n=t or c
cttttttcaggttctccaaaacctaagaaagttaggcatgaagtcaacttataaccagattagtactagtnaggtacctcgagcatcttcagttttgcatc

SEQ ID NO: 36911 - DNA, 101 bp, rice(Oryza sativa)
  misc_feature (71): n=a or g
aaacctctgtaagttttacattcctacaggagtgaaacaaaaacattaacacaaccaaatgcacactattnttcataattaataaagtggacgataattga

SEQ ID NO: 36912 - DNA, 101 bp, rice(Oryza sativa)
  misc_feature (71): n=a or g
cctatcacctaaaatcctatggatgggaaagacactgtttggatagagcacagaaaaaatgcaggaatcanaagatatatatacacaaatggtattttttt

SEQ ID NO: 36913 - DNA, 101 bp, rice(Oryza sativa)
  misc_feature (71): n=t or c
ccaattccatatgaatatcgatctgatcgaacttgtttgattaatctattgcaaaatacttggagtcctcngtgtcgaatggaccaaatctccatatatat

SEQ ID NO: 36914 - DNA, 101 bp, rice(Oryza sativa)
  misc_feature (71): n=t or c
ttatatggacttatacagtagaacttgcagctcattttctgttatccgttgcagctcattttctgttatcnggtactttataggataaccgctgatgatat

SEQ ID NO: 36915 - DNA, 101 bp, rice(Oryza sativa)
  misc_feature (71): n=t or c
cccaggagttcaccgctggggtggtggccggtaagcccgtcaacgggaggaggcagtggcagtgtgaggtnagcgacaaggagctccggtaatccgcggcg

SEQ ID NO: 36916 - DNA, 101 bp, rice(Oryza sativa)
  misc_feature (71): n=a or g
tccggtttcaaaagttgagggtgtagaatgtttggttttcgagtagaagggtgtaattcggtcgaccacgntagttcagggggtaaatcgtactttttttc

SEQ ID NO: 36917 - DNA, 101 bp, rice(Oryza sativa)
  misc_feature (71): n=a or g
caatcaaatcggaatctcgcctctcggagtcggagccgtacgtccgttaatcttgcgtgccctgtcgagtntcctgaaacttgctgcgttggttgaacacg

SEQ ID NO: 36918 - DNA, 101 bp, rice(Oryza sativa)
  misc_feature (71): n=a or g
gtcggtccacggtgttgcactgtgaagggccttaccccatgtttcataacctatctctctcgttttccgcncacacgcttttcaaactgctaaataatacg

SEQ ID NO: 36919 - DNA, 101 bp, rice(Oryza sativa)
  misc_feature (71): n=a or g
ctgaatcttttctttcttatcttgaaactgatggttttggaaggcttcaatccgtggagaaataatagatngactccttcccaacccaagatgggccatag

SEQ ID NO: 36920 - DNA, 101 bp, rice(Oryza sativa)
  misc_feature (71): n=a or g
tctccgaagttacacgtcatcgcccatccgtatcgcatcgcccgttgcgtcatcttgccattgccggtgtnggggaggaaggccgccgttgtggggaggag

SEQ ID NO: 36921 - DNA, 101 bp, rice(Oryza sativa)
  misc_feature (71): n=t or g
cctcctcgctggccaagatcgagtcggcggtcaacacgtaggagctcagcgacgtgctattcgtctccgcngcaggtgtcgtcgcgacgattgactgacgc

SEQ ID NO: 36922 - DNA, 101 bp, rice(Oryza sativa)
  misc_feature (71): n=t or c
aaacggcggcggcctcgggttaacagtgggggtggagtttcggtgaggggttagggaaatggagtagcggncgggcttgccctcgagacggcgaagccggt

SEQ ID NO: 36923 - DNA, 101 bp, rice(Oryza sativa)
  misc_feature (71): n=a or g
tttataataactagtaagcgtgcacgtgcaaggcacgttgatacataaaattgaagaaaatacaattattntacatcattaaagaatcatagtaggaacca

SEQ ID NO: 36924 - DNA, 101 bp, rice(Oryza sativa)
  misc_feature (71): n=t or c
tggacaagcccggaaaaaccatggataggaaccctgccgccctgtgatgacaccgatcgtgttctgtttgntgctgccaccaaagtattggtcggagatgg

SEQ ID NO: 36925 - DNA, 101 bp, rice(Oryza sativa)
  misc_feature (71): n=a or c
tccgattttaagagattttgaccattatacttttttagggtgtgttcttttctttattttctcaacttttntctctcatttctcacgcgtacgcttcttaa

SEQ ID NO: 36926 - DNA, 101 bp, rice(Oryza sativa)
  misc_feature (71): n=a or g
tacatcggcttaccttgtccgattcggtatctgccgatgcagtcccgaagccgatttatactctgtttctnttattgatttccttccaaatccgcttcggc

SEQ ID NO: 36927 - DNA, 101 bp, rice(Oryza sativa)
  misc_feature (71): n=a or g
tctaatcatacatgtccaataaataatacatagcatctcatccgtcactgtcacgccctgaactagccccnagcgggactagcccgtgacgctccaaatta

SEQ ID NO: 36928 - DNA, 101 bp, rice(Oryza sativa)
  misc_feature (71): n=t or c
taagataatagaattatatctttacatctctgtctgcttaatgattttttttctctgcctgactagatgtngctagcacattgcttaatgtcatcaatatc

SEQ ID NO: 36929 - DNA, 101 bp, rice(Oryza sativa)
  misc_feature (71): n=a or g
ggttaagggtgtgctcttttctccaccttctcttatttccgcacacacgctttctaaactgatattaggtntggttttttttaaaaaaaatctatatgaaa

SEQ ID NO: 36930 - DNA, 101 bp, rice(Oryza sativa)
  misc_feature (71): n=t or g
actttaccggaggggatggggaggatctgaggtggtgggcttgctgcggcgacggggatatggagagggcnagtgcgcacggcggaggaggcaacagcaat

SEQ ID NO: 36931 - DNA, 101 bp, rice(Oryza sativa)
  misc_feature (71): n=t or c
tcttaaaagtagctggttggttgccaacttctaagaatctggaaaatatgtgtttcctaacttttagcttntactttattttttggattaatctaggtaaa

SEQ ID NO: 36932 - DNA, 101 bp, rice(Oryza sativa)
  misc_feature (71): n=t or g
cgagcatagataacagagcttgttatgttaccacaagtatagcagggggcacgcatacggttgagttgagncatgtctagtggtggcggccaccattgtta

SEQ ID NO: 36933 - DNA, 101 bp, rice(Oryza sativa)
  misc_feature (71): n=a or g
aaagagagaactaacattatgtatattagttacaagcaatgtacttccacttgtcttggagaattactatngatgcaagaattataccatgagttgttctt

SEQ ID NO: 36934 - DNA, 101 bp, rice(Oryza sativa)
  misc_feature (71): n=a or g
aacaaagatgagttgccagcaatgagctgcaaatatatactccctccatacccacaaaacaagtcgtttangataagattgtgcttaccaatgagtgatta

SEQ ID NO: 36935 - DNA, 101 bp, rice(Oryza sativa)
  misc_feature (71): n=a or g
aagtacatatcgtccaaatatcttgacatgcaatatatttttttctttacaccaaattacagagtataagncactatctccacagcataaataaaaaaata

SEQ ID NO: 36936 - DNA, 101 bp, rice(Oryza sativa)
  misc_feature (71): n=a or t
ctcagaaaagaactatgaacctgaaggatatgtctggtcgaagtgttgaggtaaccatgtggggtgacttntgcaacagagaaggctcacagcttcaagga

SEQ ID NO: 36937 - DNA, 101 bp, rice(Oryza sativa)
  misc_feature (71): n=a or t
ttcacagaaaatatacaaccatctggaatctaattcggaaaatcagttccaacttgtatagtgtttttttnaaaaaaatgttctctttgttcccaaataaa

SEQ ID NO: 36938 - DNA, 101 bp, rice(Oryza sativa)
  misc_feature (71): n=a or t
caagagctacctcctaaaattgatatggcacgaacgtcggatacacacatgtaatgctagttttttttttnaaaagaactacatgtaatgttagttgttgg

SEQ ID NO: 36939 - DNA, 101 bp, rice(Oryza sativa)
  misc_feature (71): n=a or t
gacttggaactgtatctagcaatagtcaacagatacgagcaaataacttcataacatgatagcttagatgnatagcggatttgttctttagcttatcattt

SEQ ID NO: 36940 - DNA, 101 bp, rice(Oryza sativa)
  misc_feature (71): n=c or g
tgacacgagtggtcatgttgtagcagtgagaggacatatgcatcctcatccggagctggcctttcggcaangagatgccgagcacctccacgctcctgcta

SEQ ID NO: 36941 - DNA, 101 bp, rice(Oryza sativa)
  misc_feature (71): n=a or t
gttcaagaaagcctgtggagagcatggccgcaatctttcttttttgctcgcaatttaatttgtgtgtgtgngagagagagagagacgatgcgaagaagagg

SEQ ID NO: 36942 - DNA, 101 bp, rice(Oryza sativa)
  misc_feature (71): n=a or t
ggcctcatcagataagcgaaaaaaatgtttattttcaaaagaaaaggagtaatccctattcatcctcgcanattttatcgaggatatataaataaagacaa

SEQ ID NO: 36943 - DNA, 101 bp, rice(Oryza sativa)
  misc_feature (71): n=c or g
gaggtgctaaggagggaagtggagctcgtgcatccctggccggagtggatcgagctgatggatcggctggngcagcagaaatacttcgaccttgggggcac

SEQ ID NO: 36944 - DNA, 101 bp, rice(Oryza sativa)
  misc_feature (71): n=c or g
ttttgggggttttcgttttgatgcttcaaggatagagattcatgtgaagatgctacgagaaccacgtttgngagtgtttctcctgtgaattttgggaacca

SEQ ID NO: 36945 - DNA, 101 bp, rice(Oryza sativa)
  misc_feature (71): n=a or t
atttcctctgttgaacatggagacaactagactcttagccaccatgccagagacagcacaataattttttnaaaaaaaggacgtacatatgtgatcatcaa

SEQ ID NO: 36946 - DNA, 101 bp, rice(Oryza sativa)
  misc_feature (71): n=a or t
tttctcccacacttagtatgaggtaaccttacaacgcaattatatttttgttagttttcctcatccattgnttttattagttgtttacctaaatattttta

SEQ ID NO: 36947 - DNA, 101 bp, rice(Oryza sativa)
  misc_feature (71): n=a or t
accctttcttacttgtgaataaagtgccgactgaactgtgttctattgttgatagctgaattctttttttnaaaaaataatgacgtgcttttatccatttt

SEQ ID NO: 36948 - DNA, 101 bp, rice(Oryza sativa)
  misc_feature (71): n=c or g
ctgatttttgttcatccatctgtgatgtgtcggcaagccatccatggagatccactcaactcctctctctnagagagagagagagagacagacagacagac

SEQ ID NO: 36949 - DNA, 101 bp, rice(Oryza sativa)
  misc_feature (71): n=c or g
cttgcagcaggcgagtttcatgagagaaccatgcagctgcccaatttgccatgcagcagcagcagcagcancaccaccaccaccaccaccaagttatctgt

SEQ ID NO: 36950 - DNA, 101 bp, rice(Oryza sativa)
  misc_feature (71): n=c or g
atccacctcaagctctttctttgcttcctgcgtgcaaatcctaggcaattgacttcctatgatccgaatgntctcaacttttgtattcctttgtttttcat

SEQ ID NO: 36951 - DNA, 101 bp, rice(Oryza sativa)
  misc_feature (71): n=c or g
aattaatattgctatgcaggagggtgtagagctgcgtgtcatctgtgaggagcttgttcagtccggcttgncatcgggcgagaacacgaccgtcatcctgg

SEQ ID NO: 36952 - DNA, 101 bp, rice(Oryza sativa)
  misc_feature (71): n=a or t
gtccattgtgattgggcggttgatttaattaattgagtgcgtgctaaatgatcgaattagctcaaggaagntttcttcggttccggaatgaagtagtggtt

SEQ ID NO: 36953 - DNA, 101 bp, rice(Oryza sativa)
  misc_feature (71): n=c or g
aggaaaaggagtacatctgacattcgtcggaaatgggacaaatccaaaaatgtaaaggaaagctagcagcnaaaaaggactagacggcgaacagtactcat

SEQ ID NO: 36954 - DNA, 101 bp, rice(Oryza sativa)
  misc_feature (71): n=a or t
aagtatgaaacaagtagcgtcaatgtgaaccaattagagggcactagctttattgtgttggattttttttnaaaaaaatagagcccttaaattataaaaag

SEQ ID NO: 36955 - DNA, 101 bp, rice(Oryza sativa)
  misc_feature (71): n=a or t
aaaaaaaatccaaccaaaccaaaatcagccactcattcaccactcatcagcaacccaaccgatcaatcagnaccccttcaaaacccacccaatttttcctt

SEQ ID NO: 36956 - DNA, 101 bp, rice(Oryza sativa)
  misc_feature (71): n=a or t
agatgcgtgggcatgctatttattgttcataaaagaaatgctaaaagaaagcctacctgaaaacagtaaanaaataaatatatatatatatatatatatat

SEQ ID NO: 36957 - DNA, 101 bp, rice(Oryza sativa)
  misc_feature (71): n=a or t
cgccccacccaccgctgcctgcagttgcccagcgcaagaaatttccgactctccagtgtagttttgatttnaaaaaaatggtacggtttcttattattttt

SEQ ID NO: 36958 - DNA, 101 bp, rice(Oryza sativa)
  misc_feature (71): n=c or g
aaatattattctttaccctaaacattaatattattctttactcaatgttttcttagtggagcagatctcanattttcttcagggccctcaactgactgccc

SEQ ID NO: 36959 - DNA, 101 bp, rice(Oryza sativa)
  misc_feature (71): n=a or t
tcacaatgatgaacaagagagccagcaagattcgctcgttgtgcatacccatagaggctgcaaccatcatnagcgtcgcaatggcgaacaagagagccagc

SEQ ID NO: 36960 - DNA, 101 bp, rice(Oryza sativa)
  misc_feature (71): n=a or t
ggctgcttattcgtcatcacggagcaacccgataccttttcttaggcgagcggcagagacgagagctttcnattatgccgttttggtcaaatcccagggct

SEQ ID NO: 36961 - DNA, 101 bp, rice(Oryza sativa)
  misc_feature (71): n=a or t
gatgtgctaagatttgatcattctgtttcatgcattctagcaaaaacggattctcaaacagtaaagatganacatatacagatgaacatttccatacatta

SEQ ID NO: 36962 - DNA, 101 bp, rice(Oryza sativa)
  misc_feature (71): n=a or t
atgaaagtaagtttggtgctgtgagattgcaaagaacaaccccaggcagtactgctagtaagaaaaagacngcctggggaaagatttttggtgccagtgat

SEQ ID NO: 36963 - DNA, 101 bp, rice(Oryza sativa)
  misc_feature (71): n=a or t
ttacatgacgcccatcttagactcgcgcatttacacatttgcaggcttgcaacccgtccgccagtcacccnctgtcacgcccagaaatttagcccaaattt

SEQ ID NO: 36964 - DNA, 101 bp, rice(Oryza sativa)
  misc_feature (71): n=c or g
acttttctgaagtcaggaaggtaatcgacatcaatttagttggtgtattccacgggatgaaacacgcagcncgcatcatgatccccaataagaaggggtcc

SEQ ID NO: 36965 - DNA, 101 bp, rice(Oryza sativa)
  misc_feature (71): n=a or t
acgagcgccatgatggatggaccttcaattcttgcgtgtgctgaggagattgctaattttaatgccacttntatatatacacacacacacgcacatataca

SEQ ID NO: 36966 - DNA, 101 bp, rice(Oryza sativa)
  misc_feature (71): n=a or t
ccttgaggtgtgaaatggcttgcttgtaggtggcatgatcaggctcctgcaaatcaggcagaatggtttantttttttttgatttgttggcatcaagtcaa

SEQ ID NO: 36967 - DNA, 101 bp, rice(Oryza sativa)
  misc_feature (71): n=a or t
tctctctctctcttcactgccatgctgatgcatgtgtgatgtgaaactctcgcactgcaggtcgatctganccattgcctgcgtcgcttctatctgtccaa

SEQ ID NO: 36968 - DNA, 101 bp, rice(Oryza sativa)
  misc_feature (71): n=c or g
tcgacgacgcaggcgaggacgaggatgcacttggtcgacctgcggacgctggacgcggtcagcttggatgngccgccgtcggcgcggaagatcctgaccgc

SEQ ID NO: 36969 - DNA, 101 bp, rice(Oryza sativa)
  misc_feature (71): n=a or t
tcggttttttttccgtcataccctgtgggttggactcttttcaaaaaaatatctcctgtgggttggactcntttcaaaaaacaatatcacaagatatcagt

SEQ ID NO: 36970 - DNA, 101 bp, rice(Oryza sativa)
  misc_feature (71): n=c or g
catttctatacacataaatcatttgtttgacccatttattttttatacgaggttatcaccacttcttgccnaagagaaaagttctacgaagctccaggtat

SEQ ID NO: 36971 - DNA, 101 bp, rice(Oryza sativa)
  misc_feature (71): n=a or t
ccatgccatctcacatcacacgtagcctgatggagttggcacttgctgcttcaactggtaggaaaaataanaaaaaaaacgagttaggcgcagaggaaatt

SEQ ID NO: 36972 - DNA, 101 bp, rice(Oryza sativa)
  misc_feature (71): n=a or t
atacagatagtagatactgttcatgatgttataaggtcgagtttagtgtcaaacttttccttcaaacttcnaacttttccatcacataaaactttcctaca

SEQ ID NO: 36973 - DNA, 101 bp, rice(Oryza sativa)
  misc_feature (71): n=a or t
ttttctctgcatcttcattttttttcttcaataaaactactgtctataacacttgctataagatatttgtnttgttcatttcataaaatatttaattcaac

SEQ ID NO: 36974 - DNA, 101 bp, rice(Oryza sativa)
  misc_feature (71): n=c or g
ggttgctgcgtagtgtatgaagaaccaacaaaattggctttgccgcgcaaaattaactggttccgattcgnaaaatcagcgatctcccggacgatgtgctc

SEQ ID NO: 36975 - DNA, 101 bp, rice(Oryza sativa)
  misc_feature (71): n=a or t
tgaggtcctgtaattttccatgtatttcagtagaaagtattcaaactaactgggagatgtttttaatacanatcatctttcatatcctacacaaaatattt

SEQ ID NO: 36976 - DNA, 101 bp, rice(Oryza sativa)
  misc_feature (71): n=a or t
ttgacgagtttcttatgacaacctgtcataaccctcaaaccaaagtaggatacaaaggtgtatcctacccnaggaaattgtacgtagaaatataaactgtg

SEQ ID NO: 36977 - DNA, 101 bp, rice(Oryza sativa)
  misc_feature (71): n=c or g
tatttcttgtgccatcaactcgtatttccatcactctggcctgaatattgcatggttacattccatcgaangctggttaggtactgctccctccgtcaaaa

SEQ ID NO: 36978 - DNA, 101 bp, rice(Oryza sativa)
  misc_feature (71): n=c or g
cggttcatctacagataggagtccctcacgcgtttgtgttgtttcctctccctcacgcgatcgcacgcttncatcttgcggctgccggctagggaccctgg

SEQ ID NO: 36979 - DNA, 101 bp, rice(Oryza sativa)
  misc_feature (71): n=c or g
gagggccaaccggccaagcccaacttcccccaaaagccctaacgaaataaacccttccgcccccgccgccnccgccgccgcctcgccgcggctcgcatccc

SEQ ID NO: 36980 - DNA, 101 bp, rice(Oryza sativa)
  misc_feature (71): n=c or g
caagcaatgcgaaggctggcgacgaccacatcttttgtggatcttgttgtaggtggcggcagaggaaggcncaggcggcaatggtgtgaccacgacatcaa

SEQ ID NO: 36981 - DNA, 101 bp, rice(Oryza sativa)
  misc_feature (71): n=a or t
ctttatgagcatgaccatgagtcagcgtcgaaaaatattgagacatcagaaaattaacgcacagcggggtngcggggttgtttggttgatgcctaagcttg

SEQ ID NO: 36982 - DNA, 101 bp, rice(Oryza sativa)
  misc_feature (71): n=c or g
aatataaacttccgatcgagagcgtttaagaacaatttaatattgttcatgcagtcgtaaaaagatttttntcgacaatactcccacttttatctaaaagt

SEQ ID NO: 36983 - DNA, 101 bp, rice(Oryza sativa)
  misc_feature (71): n=a or t
aagccggtgagaagcaaccggaaatcctggatcaagtacgtgcaggacactgctccctcctgcatcaagtncgtcgagatggtgacccgccctggtgatcc

SEQ ID NO: 36984 - DNA, 101 bp, rice(Oryza sativa)
  misc_feature (71): n=a or t
gctcacagtctcaagtctcaacggggccgctcggagaaaaaacaaaccccacaattacccaactttttttnaaaaaaaaataatcaaactttccaaatctt

SEQ ID NO: 36985 - DNA, 101 bp, rice(Oryza sativa)
  misc_feature (71): n=a or t
ggtaccgaacaccacgataaggagcaatgaactgtggtgtgttggcataaccaccatctactagaaaaaanttaccatttgggacttgaaagccactattc

SEQ ID NO: 36986 - DNA, 101 bp, rice(Oryza sativa)
  misc_feature (71): n=c or g
tgcctgtgtccatggctagggaaatggcgcgcgcggcgagattccatcggctaggtagctgcatctcatcnatccagaccaacagtatgcgagccagcgag

SEQ ID NO: 36987 - DNA, 101 bp, rice(Oryza sativa)
  misc_feature (71): n=t or c
cctcctccaggaagtatcgtatcacttggataatcaaaactctgccagagcaccatggaatcatttgtttnatctcgtatgacaagatttcctatgtcaag

SEQ ID NO: 36988 - DNA, 101 bp, rice(Oryza sativa)
  misc_feature (71): n=a or g
gatattaagagatcctgaacattgaaaataaattaaggtggcggcgatgctgtgttcgattgagcctctcnctgtcttttcttttccttccgatactcgat

SEQ ID NO: 36989 - DNA, 101 bp, rice(Oryza sativa)
  misc_feature (71): n=a or g
gattcttcatgtagttgccgttcccatgtttgttgaagaaactatcgggactatgtttcgccatactcctntacacacgttttgctggatatataagaaaa

SEQ ID NO: 36990 - DNA, 101 bp, rice(Oryza sativa)
  misc_feature (71): n=a or g
caagaaatatgtaaagctggggaatcatggtgaagtaattggaacggagaaagtagagaagaagtatacanatgtgttgtgtgctgctcagctactcggag

SEQ ID NO: 36991 - DNA, 101 bp, rice(Oryza sativa)
  misc_feature (71): n=t or c
gagggcacgaggccaaaccaaacactttgcagttctcgcgtgaacgagtaagaactcagaacgagtgatanggaatccagcgaacaatgcgccctcctgcc

SEQ ID NO: 36992 - DNA, 101 bp, rice(Oryza sativa)
  misc_feature (71): n=a or c
acccggtccaaccctttgcttttgccactctataaatacatcttcttcatccttaatccacctgcaaaatnaaaaattcagactcaactctccttaatctc

SEQ ID NO: 36993 - DNA, 101 bp, rice(Oryza sativa)
  misc_feature (71): n=a or g
tgtccccatcaccatcgtcgccgcctaccaaaactgtgtggatggctagatctgatggtctccaaccttcnggaagccagatctggcacctccgaagtggt

SEQ ID NO: 36994 - DNA, 101 bp, rice(Oryza sativa)
  misc_feature (71): n=a or g
gagatagccatggagggaggtgttcatgagttcgatggctcaaccttcagagagtgcttctccctctcatngaggaacccttatgtccttaggctcgcctt

SEQ ID NO: 36995 - DNA, 101 bp, rice(Oryza sativa)
  misc_feature (71): n=t or c
ccggcggcggccggacgaggagggagatggagatggtcaagtcgtcgatcacatgcgcggatcccgattcngatgccgccatgatggcgggctcatgctcc

SEQ ID NO: 36996 - DNA, 101 bp, rice(Oryza sativa)
  misc_feature (71): n=a or g
aagtcaaatgcctcataaacaacatttcaagctcatcttgcgccaagaaagagtggggcaataagataacngaagtaccttgttgccgattgctcgcccta

SEQ ID NO: 36997 - DNA, 101 bp, rice(Oryza sativa)
  misc_feature (71): n=a or c
agattgtacttaaaattctctaattgccttaccgataaagcctttgtgaatccatcagctacttgatctcntgtaggaacaaaatccacttcaagcaacct

SEQ ID NO: 36998 - DNA, 101 bp, rice(Oryza sativa)
  misc_feature (71): n=t or c
gtacaagcagagttgggatggaagttttttgaaacataaataaggagctcaccgtaggcaatggcggagcngacgccggcgaacacaaagaggagtgtggc

SEQ ID NO: 36999 - DNA, 101 bp, rice(Oryza sativa)
  misc_feature (71): n=t or c
caatgtttgtagccgttagatcagaaagtaattaggtcatcgtttcctagaccgctgcttgacatcaaacnagttgtcttcgtcgagctcatcatcaatat

SEQ ID NO: 37000 - DNA, 101 bp, rice(Oryza sativa)
  misc_feature (71): n=a or c
aatcctggacctcagtccgtttcttagtccactccctcttcgtctcattactaggctgatccaacagggtnggtgctgtggccgctaccccgatttggcgc

SEQ ID NO: 37001 - DNA, 101 bp, rice(Oryza sativa)
  misc_feature (71): n=t or c
cgccactattgcgtccacctcgtcgatgaagacgatggctgtgtcctgtccctggcgagccggaactagcnagtcaggcaccatactcggcccattgtacc

SEQ ID NO: 37002 - DNA, 101 bp, rice(Oryza sativa)
  misc_feature (71): n=t or c
aatgacatcttgccctctcgtctttccattgtctccctgttatttcccttcccaccaaaccacttcctaangcaacaagatcggcgtagatggcatgcatc

SEQ ID NO: 37003 - DNA, 101 bp, rice(Oryza sativa)
  misc_feature (71): n=t or c
actattgcattgtgaatcttaatttgtttctttgttattccatccgcagatgaccgaagttataatccttngagagcaccttgttcccctgatcaccgtct

SEQ ID NO: 37004 - DNA, 101 bp, rice(Oryza sativa)
  misc_feature (71): n=a or c
cccattttttgattttttttcagcgatttatggagcgagcttacaagatctggggcgccgtcgctgtgctnccgccgccttccacctccggcgtgcgcgtg

SEQ ID NO: 37005 - DNA, 101 bp, rice(Oryza sativa)
  misc_feature (71): n=t or c
aattcttatttatggatgggatcattgtttcattgggcaaatgtgtgtgcccagctgataaatgtccagancactcattgggtaaaccaagacactcactg

SEQ ID NO: 37006 - DNA, 101 bp, rice(Oryza sativa)
  misc_feature (71): n=a or g
cgtccgccccgcgccgcgcgcagccacgctgaaccaatcaactggcaactgcacgggagtacgtgtgagcntgtggctggctctacacctatacgcgcgcc

SEQ ID NO: 37007 - DNA, 101 bp, rice(Oryza sativa)
  misc_feature (71): n=a or g
gacccaacgctcgggccttccgcccccgagctcggagatgcccccagtcatagccaatcgaccatgcactnggtgatgaacttcaatggctccctcacctt

SEQ ID NO: 37008 - DNA, 101 bp, rice(Oryza sativa)
  misc_feature (71): n=a or g
atgatcttgatttttgccacagcaatatcaccatttcgaagccacacaaacatagctggaaggaccggctngcccgggtattgttggacaaccagacagag

SEQ ID NO: 37009 - DNA, 101 bp, rice(Oryza sativa)
  misc_feature (71): n=t or c
cgtgtcgccacgacaccactctcaccgctctcgccacgacacatttttcccttcaaataagtttttacccnagaaggtcgccatggaactggaactgcctg

SEQ ID NO: 37010 - DNA, 101 bp, rice(Oryza sativa)
  misc_feature (71): n=a or g
tagctgctgaagtggctgctggagcacttgttgcaggttcagaaaaaagaagaaggcatattagcaagttnttcatctgcattgtatgtgtagtgaatctc

SEQ ID NO: 37011 - DNA, 101 bp, rice(Oryza sativa)
  misc_feature (71): n=a or g
ccaactgcaatgatacactatcctttattgacaacctagaagagcaaagacctctggttttacaagaatgnaatttcagactaatactcaaggatcattct

SEQ ID NO: 37012 - DNA, 101 bp, rice(Oryza sativa)
  misc_feature (71): n=a or g
ggacttctaaaatatctttttgttcgttcttgtgagccatattgtaatttcatcaagtcctggatttaccnagcttctgttgatgatccttatgaggaatt

SEQ ID NO: 37013 - DNA, 101 bp, rice(Oryza sativa)
  misc_feature (71): n=a or g
tactcttctagctgctctatctgaacttctcatcaaacacactgcaaacattacggtatctcttgcgttgntgtcttggtgatcgacaggatgcaaggttt

SEQ ID NO: 37014 - DNA, 101 bp, rice(Oryza sativa)
  misc_feature (71): n=t or g
gaatagcgactggagaggacagtgtatctcctttgcatggagggatgcaatttctgtccagcattttacanagggttatggaattgccatttgttctaccc

SEQ ID NO: 37015 - DNA, 101 bp, rice(Oryza sativa)
  misc_feature (71): n=t or c
gcaaccggttgcagtggataatagtgcactatgcttaccatgctactccaactgctttgtttttgggatgnagaattgcaagtttgtatcaccatgaaatg

SEQ ID NO: 37016 - DNA, 101 bp, rice(Oryza sativa)
  misc_feature (71): n=a or g
ttcttgtcatcaatctttgcactactcttgccaccggtctcaagacagcccttaattctcaatttcctctntctccctacacccctcttacctagtggtgc

SEQ ID NO: 37017 - DNA, 101 bp, rice(Oryza sativa)
  misc_feature (71): n=t or g
gtgaccagtgttcttaccggctcctcgcgaagactatgccatagaacctgggtttgttttcctttcttttntgctccaatgtgatttaacacatttacaat

SEQ ID NO: 37018 - DNA, 101 bp, rice(Oryza sativa)
  misc_feature (71): n=t or c
ttctctccaagaggagttgtatcgtgatgtcccacgcagggtaacacgacgaatggcgatagaagcacccnaggaggcgtcttcctcttcaccaccagtgc

SEQ ID NO: 37019 - DNA, 101 bp, rice(Oryza sativa)
  misc_feature (71): n=t or c
ccacaaaacttgtggcgctatttccctccggccttctctaaccctagggttcatgcccccttttcttagangagatcaccatcacttgatgcaactggaaa

SEQ ID NO: 37020 - DNA, 101 bp, rice(Oryza sativa)
  misc_feature (71): n=a or g
ctgcacttaaaatgctcttctgtgtggtgaacaaagcactttgttttatgataccttgcggttggttgtgngtaggggcgcctgcatgagagagagaatat

SEQ ID NO: 37021 - DNA, 101 bp, rice(Oryza sativa)
  misc_feature (71): n=t or c
ctcctccccacaatcgaatcgaatcgaatcctcctcctccaggctccaagccgaaaccaaaccctagcccngtcgatctccctctcctcgcatggcggctc

SEQ ID NO: 37022 - DNA, 101 bp, rice(Oryza sativa)
  misc_feature (71): n=a or c
actccagtactctctgtgtatcatcagatcgatcaaccgcatcacatggactataaatcgtatactgactngatcgttactacgggcacgatcaagtggca

SEQ ID NO: 37023 - DNA, 101 bp, rice(Oryza sativa)
  misc_feature (71): n=t or c
tacgtctaatcccctaattcgccggtgtccgatggattgcagcggtgggatggaaaagcgaccagccagcnagttcaataagtcacaatcgccgcggggag

SEQ ID NO: 37024 - DNA, 101 bp, rice(Oryza sativa)
  misc_feature (71): n=a or g
gattcaaggttaatgctccgtctttaccgtttctggagtcccaacggattgcaaggcctaaacgccttgtntgtaatgctcatggaagttactagagaaaa

SEQ ID NO: 37025 - DNA, 101 bp, rice(Oryza sativa)
  misc_feature (71): n=t or c
tagggtagccacttgccttgtccagtattgttggtgtcaccctgattctggtttgcagacaaatcaggttngagtccaacctctgtggcttcaatcaggct

SEQ ID NO: 37026 - DNA, 101 bp, rice(Oryza sativa)
  misc_feature (71): n=a or g
gggaggtggaaggggggaagggaggaggaggaggcgtacctgcacagatccagattcagccgaccaaaccnaccgctgcgacgccctagagcgccaccctc

SEQ ID NO: 37027 - DNA, 101 bp, rice(Oryza sativa)
  misc_feature (71): n=a or g
tggtcgccggtcggtggtgcggccaaggccgctttatccgtgcgtgaccgtgtttgtgtttgacgtattcnacgtggaggtggctccgctatggcggttcg

SEQ ID NO: 37028 - DNA, 101 bp, rice(Oryza sativa)
  misc_feature (71): n=t or c
tggaagttctccgtttcttggatatccacgagatggttgaggtgacacagtgtaaccaaagcgaattcacngaagcttaaagttaactcatctatagagct

SEQ ID NO: 37029 - DNA, 101 bp, rice(Oryza sativa)
  misc_feature (71): n=t or c
cgatgagaaggctaaacgaaaacaacgattccgggagtaaacagcaatatccataaagagatgatcagcangacctgtacaactgctatctttcgtaatgt

SEQ ID NO: 37030 - DNA, 101 bp, rice(Oryza sativa)
  misc_feature (71): n=t or c
cagttacccgatcttctaaactcaggtgctaccaaagtatcaggatactgtatcgcttctggaagatgcangccatcaccatgctcctttgtgacatgacc

SEQ ID NO: 37031 - DNA, 101 bp, rice(Oryza sativa)
  misc_feature (71): n=t or c
cccgaagtgattgcactttgttcaccttctctgttggagttagagtatgaggtcttccgcttcttagttgngcttgctccttctacttgtgtgttttggtt

SEQ ID NO: 37032 - DNA, 101 bp, rice(Oryza sativa)
  misc_feature (71): n=t or g
ctctggagtactgatgttttcttggtaatatcattaggtcggtgatcttctgaacctccttagtgcctttngttttgcaattcatatgctcaggactgagc

SEQ ID NO: 37033 - DNA, 101 bp, rice(Oryza sativa)
  misc_feature (71): n=a or g
ttcactgttcctgggagcaaaccttaacatctgatctgatggcaacaagtttgagattcttgggacctcanttttatctgtacataatctcaatggattat

SEQ ID NO: 37034 - DNA, 101 bp, rice(Oryza sativa)
  misc_feature (71): n=t or c
agcttgcgtaatcatgcacaacatgatcatcgacaatgagcgagatgaagatgtagactttgactatgatnagggggacagtgaggtgttgaggaaggagg

SEQ ID NO: 37035 - DNA, 101 bp, rice(Oryza sativa)
  misc_feature (71): n=t or c
aagacgggcaataaagcagttgatccctacaatagagagcgacttggaagagtttttgcaacaaaggaaanataagccaaaggtgccactatttgattctt

SEQ ID NO: 37036 - DNA, 101 bp, rice(Oryza sativa)
  misc_feature (71): n=a or g
ctaaagtttgtccctctgattcctgcttacactgttattcttgcccgcaatgcttcttcaggatgatgganccaaattcataaaactcttgcgagctttgg

SEQ ID NO: 37037 - DNA, 101 bp, rice(Oryza sativa)
  misc_feature (71): n=a or c
catctggtttccttcgtcatccacttgatcaaattacctcaaactctgtcttttaacaggcaacagaatanactgcaccgatcgagagcccaactgagggt

SEQ ID NO: 37038 - DNA, 101 bp, rice(Oryza sativa)
  misc_feature (71): n=a or g
aggatccctgcccaattccccaaaaggttgcttctagataaccctgcggttgattcggatgggccatcacnggggccaccgctccagctcatccagccggt

SEQ ID NO: 37039 - DNA, 101 bp, rice(Oryza sativa)
  misc_feature (71): n=a or g
aaggcaacataaagctgcccatgagagaacacgggacttggcaagtaaacaccaaccttgctaagtctctntccttggctcttgtttatcgtcattgcata

SEQ ID NO: 37040 - DNA, 101 bp, rice(Oryza sativa)
  misc_feature (71): n=t or g
catccacaacccatcctgggccaaaatttgttccagaaggcagtagtcgtctgattctctttgctgctatntcccagcctacgggaccaaattttgcagca

SEQ ID NO: 37041 - DNA, 101 bp, rice(Oryza sativa)
  misc_feature (71): n=a or g
taagcccgttggcttggtttcaccagctccaaagtgtcaacacccacaccttttacgtctcccatccctcngatgtccttggtctcgtcccgaatgccatg

SEQ ID NO: 37042 - DNA, 101 bp, rice(Oryza sativa)
  misc_feature (71): n=a or g
aagatacttcaatctttgaaaagcagatgaaagttttccatggctgtctgatgttccacaagattcatatnaaaggataaggtatactccttgattgaggg

SEQ ID NO: 37043 - DNA, 101 bp, rice(Oryza sativa)
  misc_feature (71): n=a or c
ctagaatcttcatgcaaataagcaagagcacgtgcagcaccaagtgcaattttaagcctagcatcccaatnaagtggagcagttcccttatctgatcctgc

SEQ ID NO: 37044 - DNA, 101 bp, rice(Oryza sativa)
  misc_feature (71): n=a or g
aatatacattacgatagtcaaaagagcttttagccttttacccattgagaggtcgtcgcctttttggttcnttgctgatttctccttcttgaggagccgac

SEQ ID NO: 37045 - DNA, 101 bp, rice(Oryza sativa)
  misc_feature (71): n=a or c
gataattttgaaagctcagcactcagagaggacttctccagtgaatggttctgcaatgaatcatggacagnctgctccagctccttaatcctgtcctggag

SEQ ID NO: 37046 - DNA, 101 bp, rice(Oryza sativa)
  misc_feature (71): n=a or g
ttctccgccaaatccgccgccaaggccactcaaccacgaaagttggccaggagaggagggccgccggttgnggagatgatgaggagcgctggccgtgggag

SEQ ID NO: 37047 - DNA, 101 bp, rice(Oryza sativa)
  misc_feature (71): n=a or c
ttgaagaaggagatgcctgcgatgatgggcaaagccaaagctcagcagcgacttatagacaatttggagantgagttcgcaaaggtatcttagctctgtaa

SEQ ID NO: 37048 - DNA, 101 bp, rice(Oryza sativa)
  misc_feature (71): n=a or g
tatggcacgacgtctttccttcttgactatagatagcctcttaggtctgcagtcttggtgtttttttcctnctatattttttttcgaggaaccgatgatag

SEQ ID NO: 37049 - DNA, 101 bp, rice(Oryza sativa)
  misc_feature (71): n=t or c
caggttccacagaaggtgtataatggggtctgttgtccttggggtgggtcttgcaggtgtctcctgtgtcnggtatactcgtagttacaggaaggccctca

SEQ ID NO: 37050 - DNA, 101 bp, rice(Oryza sativa)
  misc_feature (71): n=t or c
atatccggtttccctataaaaggaataaataatctcttgtgagctctcatacgccacacatataacactgntgttgtctagctaggcagatagcaacacat

SEQ ID NO: 37051 - DNA, 101 bp, rice(Oryza sativa)
  misc_feature (71): n=t or g
gatcacatcttcttcttgcatcgaaagctttggcgaggagaacccattggttcccgttggtggtggtggtngttgttgttgttgttgttgttgtgtattct

SEQ ID NO: 37052 - DNA, 101 bp, rice(Oryza sativa)
  misc_feature (71): n=t or g
gatccttagttctgaattctgatggccagtacaggattttgcgatctagctagagctgatttatttgttcnaattaaacaccatgcgcatcctgcgaccct

SEQ ID NO: 37053 - DNA, 101 bp, rice(Oryza sativa)
  misc_feature (71): n=t or c
gctttgagaggctttgacccgtcctctcctcctccattctcttctccacacacccttgtccctttgcactntgcagtttgcagcctgaaccctgaagcccc

SEQ ID NO: 37054 - DNA, 101 bp, rice(Oryza sativa)
  misc_feature (71): n=t or c
agcgatggcggtggcatcccaacgtgctccttgcttgaatcttcctctagccatgttattagctcgaatcnccgtctttgacggcccatgtgccccaacca

SEQ ID NO: 37055 - DNA, 101 bp, rice(Oryza sativa)
  misc_feature (71): n=a or g
aaagaaaacgagcacaaacttcctgagaaaaggagccaaaacctggttcattaaagcctgaaaagtagctngagcattggtcaagccaaatgacataacat

SEQ ID NO: 37056 - DNA, 101 bp, rice(Oryza sativa)
  misc_feature (71): n=t or c
catttctgattgtattttgtcatcactttcttctcagcacaataagatgctactgttctgatgctaccaantgcatcagttgcaacttggcttgcttcttc

SEQ ID NO: 37057 - DNA, 101 bp, rice(Oryza sativa)
  misc_feature (71): n=a or c
tcaagctccttcctcatctcactctgggagaacagctggcgtatgaactcaggattatgcataactcgtgncaagaatgccatcatgtgctgttgcttttg

SEQ ID NO: 37058 - DNA, 101 bp, rice(Oryza sativa)
  misc_feature (71): n=t or c
tgagttccgactacatctcttgtgaacaggctctatcaaagacgacatcgttctcactcgctttcttctcnaagccgccatcggagctcccccagcaccgc

SEQ ID NO: 37059 - DNA, 101 bp, rice(Oryza sativa)
  misc_feature (71): n=t or c
gctgatatcattgacgtccaagacaccacgtccctctcatacatttcctcgaaaaccttgcttgcttcctnaacacttctaaaggcaccataataattaac

SEQ ID NO: 37060 - DNA, 101 bp, rice(Oryza sativa)
  misc_feature (71): n=t or c
gagagtgaaaataggagactgaaagtgactctactcaaagagatgcagaagtgggatgatgcagctgactnaagaaatctgtcccagggtgagtggaagca

SEQ ID NO: 37061 - DNA, 101 bp, rice(Oryza sativa)
  misc_feature (71): n=t or c
gtgcctgcataaatttcataaagaggtagtacatgcaaacactccagttatacacttgaactgctttgaancttaaatttcagcttggcatcttctctgaa

SEQ ID NO: 37062 - DNA, 101 bp, rice(Oryza sativa)
  misc_feature (71): n=t or c
taaaaataatattaattctcaaaaaaattcgatttttaggtggtgatcagatcacgtgaacagacggtggncctgattaatccgacgtatttctatttcgc

SEQ ID NO: 37063 - DNA, 101 bp, rice(Oryza sativa)
  misc_feature (71): n=a or g
ggatgccggggagtgggcggcgaatgcccccggcatactgtggagggccacctccgcaatccccattgccnccgtgctcccaactcaaatgggtgactgca

SEQ ID NO: 37064 - DNA, 101 bp, rice(Oryza sativa)
  misc_feature (71): n=a or g
cataatgatccatacctcctagctagaacaactctagcatcttcatcattagcacattttcgattagcctntgatgatcctatctttgcatattttgtcca

SEQ ID NO: 37065 - DNA, 101 bp, rice(Oryza sativa)
  misc_feature (71): n=a or c
ctctggtttatttttcaaagatgtaaaagaaaagtgtaggaatacagattgtcaatagaaaacttacactnagaaaattgatttgtttgttggatattaat

SEQ ID NO: 37066 - DNA, 101 bp, rice(Oryza sativa)
  misc_feature (71): n=t or c
tgcactgaaaatagcagcaggaatgagcaacattgcgagtatactgtgaaaactgtacccaattgcacttngtgacaggccacttgcttcagtggcgtcaa

SEQ ID NO: 37067 - DNA, 101 bp, rice(Oryza sativa)
  misc_feature (71): n=a or g
ttctttcacattactaggaactgaccaagaacgaacaacccgaatgttctttggatcagtggacacccccnctgcactgatcacatgccccaaataagtca

SEQ ID NO: 37068 - DNA, 101 bp, rice(Oryza sativa)
  misc_feature (71): n=a or g
tcatagggaaaaaaaattgaaaataacctctgtccctgaagcacagcattctcagggctgatatcagtgtncatgtcaccgttgacaggaggggcaactgg

SEQ ID NO: 37069 - DNA, 101 bp, rice(Oryza sativa)
  misc_feature (71): n=t or c
aacttattgaccctttccactttttttcatttgatctagcatcacgacatgtggctacattgtcatacaanttttccaagtgtcgtaccgagacccaatct

SEQ ID NO: 37070 - DNA, 101 bp, rice(Oryza sativa)
  misc_feature (71): n=a or c
atgtaacaaagaagtagtatagtagtagacaatgagagttactgtgtttaatttaccagagtcagggtgangggtgtggtgaatgaaaggaggcttgcatt

SEQ ID NO: 37071 - DNA, 101 bp, rice(Oryza sativa)
  misc_feature (71): n=a or g
caaaaatggatccaagctttgctagaatcaagcaagtcggcagttctgttaaatggcattccaggaagatngataaattgttcacaaggccttcgtcaagg

SEQ ID NO: 37072 - DNA, 101 bp, rice(Oryza sativa)
  misc_feature (71): n=a or g
ctgttgatttgttgatatctttttgaagcacataactccatggctgcctctaatgagctggtagtgccacnatatgaaggagatgctccacctcttcaaga

SEQ ID NO: 37073 - DNA, 101 bp, rice(Oryza sativa)
  misc_feature (71): n=t or g
ttgttcatcacataataagaatcaaaacacacgttgatctctcttcaggaattgtacatggcaaacacctnttgctgctgctggtctgacgataagaacga

SEQ ID NO: 37074 - DNA, 101 bp, rice(Oryza sativa)
  misc_feature (71): n=t or c
tcgatctagggggtggattgctggtaaggggtaccaaggatgtagacgcccagagcgttgatgtactggtnggtgcggccgaagaacgccacgatctggcc

SEQ ID NO: 37075 - DNA, 101 bp, rice(Oryza sativa)
  misc_feature (71): n=t or c
ggattgcaccctgtgatgccaccaacctccaggattttcttagcgtatgcgctctggcagattgtgatgcnagccgcgttctgcttaacgtcgatgccgag

SEQ ID NO: 37076 - DNA, 101 bp, rice(Oryza sativa)
  misc_feature (71): n=a or g
gaacatcacaagtgctgttatcatggttggcatggatggtaaatcaaggtgctttggtttcatcaattttnagagcccagatgatgctgctcgtgctgttg

SEQ ID NO: 37077 - DNA, 101 bp, rice(Oryza sativa)
  misc_feature (71): n=a or c
cgcccaggtgacctgagtagcctcactggcacattcctccagtgacgccttgtgtgcttccccaagccacnactgttggcttgcctcaaactcctggagca

SEQ ID NO: 37078 - DNA, 101 bp, rice(Oryza sativa)
  misc_feature (71): n=a or g
acactttcagctaaattgaaagaaaaacttcttaataaaacgagaatgcccctaaagcttctaacgtgccnttggagtgaaaatttagaaagtaagtaact

SEQ ID NO: 37079 - DNA, 101 bp, rice(Oryza sativa)
  misc_feature (71): n=a or g
accggtggggacatgatgctgatgcagctggtcctagctgaggtcgcccatctgatgtcgctgctcgtctnggggtggtggcgggaattgaggggggcgct

SEQ ID NO: 37080 - DNA, 101 bp, rice(Oryza sativa)
  misc_feature (71): n=t or g
cgcgaacgctgtcgggaagatggtgatgcaagtgccacaaggtcttcaagcttacgcttgagatccttatngttgttacttccattccccctgacggctgg

SEQ ID NO: 37081 - DNA, 101 bp, rice(Oryza sativa)
  misc_feature (71): n=a or g
tgttggtggaactacggaaaagcatcctattaccaaaaagatgattcttgtcggtgaagttttccggttcnatttggatacactggtatgtcagttatatg

SEQ ID NO: 37082 - DNA, 101 bp, rice(Oryza sativa)
  misc_feature (71): n=a or g
ttgatcgcagagcaggatttgcagaacatgatagtgcacactgccttgatggaaatgtatgtcaagtgtcnggctattgacgaggcacgccgtgagtttga

SEQ ID NO: 37083 - DNA, 101 bp, rice(Oryza sativa)
  misc_feature (71): n=a or g
caaatccccagaagtttggtgatgttcttatggacaaccggagacatgatgaccattgccactctgctacngaactcctcttttccagcctcatatctatc

SEQ ID NO: 37084 - DNA, 101 bp, rice(Oryza sativa)
  misc_feature (71): n=t or c
ttgacagcacgatcacgtactatgggaagatcgttaagttggaggcctgatcttctcccttgtctgttctnagctgcgcaatccaaggattcctctggttt

SEQ ID NO: 37085 - DNA, 101 bp, rice(Oryza sativa)
  misc_feature (71): n=t or c
cacatgtttgtgtgtgtttatgttgtgattgatgttgatgttgatgggcatgcgtatatgtagatggtganggtgaacgagcatggaaactatgtgataca

SEQ ID NO: 37086 - DNA, 101 bp, rice(Oryza sativa)
  misc_feature (71): n=t or g
aaggccagaagcagttccgatacaaatagctgctcttttttgccagtttaacggaatacacctactccttngtcctgatcacaaaggtaaatttaacacaa

SEQ ID NO: 37087 - DNA, 101 bp, rice(Oryza sativa)
  misc_feature (71): n=t or c
ttttctcttggctgagtagccttttgactgagaagtttctcaccaaccaccatattgcaggcagagagtgnaaatgttagcagagatgtatctggggaagg

SEQ ID NO: 37088 - DNA, 101 bp, rice(Oryza sativa)
  misc_feature (71): n=t or c
aatgctaataggtggatgaagaaagctaaggaagccatgaagaaaggagggagctcgtataataatattgntgagtttgcctcaaagtacgcttcatattg

SEQ ID NO: 37089 - DNA, 101 bp, rice(Oryza sativa)
  misc_feature (71): n=t or c
gccaaacctcactggaataccatgcgctcatgcccttgctgtttgcaaggatagaaatttcaatgagaatnaatttatccatccatattactcttcatcaa

SEQ ID NO: 37090 - DNA, 101 bp, rice(Oryza sativa)
  misc_feature (71): n=t or c
aagtgacttttgaggtgagacggcattgagacacgtgcggagcatttgagacaggtgtgaagggcaacaangtgccaacgtgagggaagcggaggctcaca

SEQ ID NO: 37091 - DNA, 101 bp, rice(Oryza sativa)
  misc_feature (71): n=t or c
tacatgctgactacaaaggtgatgccaaactggacaaagatggtcatcctacagcaatttcaaacatagcntggaaagataacaaagaacataggggtaaa

SEQ ID NO: 37092 - DNA, 101 bp, rice(Oryza sativa)
  misc_feature (71): n=a or g
ggcgtgatttgcgttgcgacgagaggtggaggggctagatccgacacaaccggatcttgcttgtcggtcancctggtgaacggagctagagatggcggatc

SEQ ID NO: 37093 - DNA, 101 bp, rice(Oryza sativa)
  misc_feature (71): n=t or g
aaactgcaggccttgaggttattttctgccaatgccagcatcaactatgtgctcattgccacaaactgtcnttgcctctgctgcaaccgcgcaattcacag

SEQ ID NO: 37094 - DNA, 101 bp, rice(Oryza sativa)
  misc_feature (71): n=t or c
gtgatcttattaattcaattcggatcaagattgtattttaagatgtggtgctcaccggcaacaactccagntgatgaatgataccttgaggcaggaccatc

SEQ ID NO: 37095 - DNA, 101 bp, rice(Oryza sativa)
  misc_feature (71): n=a or g
cataggttaggaatatttttaaatttgtatctttgcctattttgcagtggtatggactcacgtccacctgntggattcttaagttactttcaggatccatc

SEQ ID NO: 37096 - DNA, 101 bp, rice(Oryza sativa)
  misc_feature (71): n=a or g
cttctgattgtcagggtcaggagtatccctcacaggtgatctacaagatccagtatccatgtcatctaccncggagaactcgattctgtgagtaccagtct

SEQ ID NO: 37097 - DNA, 101 bp, rice(Oryza sativa)
  misc_feature (71): n=t or c
ctccatctccaaactcatgcggccaatctcatcatccttggctcgaagatgtatcctaaatctgtcaagangggcccgcacggttcgctctatcgaacagt

SEQ ID NO: 37098 - DNA, 101 bp, rice(Oryza sativa)
  misc_feature (71): n=a or c
agtaggctagccataagggcattccaggaagctacgtgtgacttgtctgacaatttgaattgcatctgggnatggtcaataaaatcacaagacccgtaata

SEQ ID NO: 37099 - DNA, 101 bp, rice(Oryza sativa)
  misc_feature (71): n=t or c
aaagatgaaggagatcgtggccggcaatgagatgcaacgccagggcatggagaagaagatgaacgacacgnaggaaatcctcttctccctccacgactccc

SEQ ID NO: 37100 - DNA, 101 bp, rice(Oryza sativa)
  misc_feature (71): n=a or c
acataacaaataaagaagtttttttacacaaacaattacttcgaaaggaattactgacccaggaaatagcngagctgctgtccgaaatgcagccattgctt

SEQ ID NO: 37101 - DNA, 101 bp, rice(Oryza sativa)
  misc_feature (71): n=t or c
tcttggcagcttcttcttcttcttcctcctcgcgctcgctcacctctccattgttgtcgattgtgttgtantggtaggaggatgaggggccgggcggcggt

SEQ ID NO: 37102 - DNA, 101 bp, rice(Oryza sativa)
  misc_feature (71): n=t or g
aactcccacgtttatgtttttagtagcatgcttgcatgcagatccaacaacttgtatctggggtagctggnagaaaactttattcattgactgaattatta

SEQ ID NO: 37103 - DNA, 101 bp, rice(Oryza sativa)
  misc_feature (71): n=a or g
cacatggaggccggcgggtgcaagctgcacctcctgacagcgttgcgggactgcgtggacaagccgcgctnggacgacgacgacgacgacagcgagagtgt

SEQ ID NO: 37104 - DNA, 101 bp, rice(Oryza sativa)
  misc_feature (71): n=a or g
cataaattcttcctgcaggctatagcaacctggagatgctaaattagccatactgttgattccaatccccntagcttgatgataatctacatgtccttctg

SEQ ID NO: 37105 - DNA, 101 bp, rice(Oryza sativa)
  misc_feature (71): n=a or g
aatgaaattgccataccatgtcgtgatagatcataataatggctcaattggggaaagtttgtcttgccctntttgcctgcaggtacaagctccacatcaca

SEQ ID NO: 37106 - DNA, 101 bp, rice(Oryza sativa)
  misc_feature (71): n=t or c
tttacacttctattaattgatcatcccctgaaaccaacaggtggcaatattctcacgtgtcccatggtatnattttttctgaacgaaactgttcctatcat

SEQ ID NO: 37107 - DNA, 101 bp, rice(Oryza sativa)
  misc_feature (71): n=t or c
tccaaaagggacagaggagaagaaaacaagatgagatgggcacatacatcagcatattcgactgatggcgnggcagacgggctggcggaggtcgacatcgc

SEQ ID NO: 37108 - DNA, 101 bp, rice(Oryza sativa)
  misc_feature (71): n=t or c
taacatttcttcctacctctctggacgctgtcttccctgcgcatgtgtgtgcgtgtgcattgtggatgttnctttgatgattctggtggaaaggttgtggg

SEQ ID NO: 37109 - DNA, 101 bp, rice(Oryza sativa)
  misc_feature (71): n=a or g
tccatgatccaagcaccttgatcaggatcgacatgtggtatcttccatccatggggctcgaagacacactnaacgggtgccactccaagaacgacagctcc

SEQ ID NO: 37110 - DNA, 101 bp, rice(Oryza sativa)
  misc_feature (71): n=a or g
ccatcagttgtcatactcatgagattacctctcatgatgaagagcatttcatatactggatcctcttcacnaattatgcagctgccttctgtatatagaac

SEQ ID NO: 37111 - DNA, 101 bp, rice(Oryza sativa)
  misc_feature (71): n=t or g
actgtttgtcgacaacgacagggaatgaactggtggtgggcacaggagttactttcaaattgaagttgacntggcgttgtgctggcatgcagtggtgaccc

SEQ ID NO: 37112 - DNA, 101 bp, rice(Oryza sativa)
  misc_feature (71): n=t or c
ctcatcgacaacaagggtcctcctcaatggatgcccaggatcacctataaagcatggaagaggcctctggnagggtgaccccctctcgccgctgctagtta

SEQ ID NO: 37113 - DNA, 101 bp, rice(Oryza sativa)
  misc_feature (71): n=a or g
tcttgagctatttctcaacagattcataggactatcgaccaaagaggaagtgttcctttgaaggagattgnaggaggtggtgaccctagtatctattgcgt

SEQ ID NO: 37114 - DNA, 101 bp, rice(Oryza sativa)
  misc_feature (71): n=t or g
gagcgaggaaaatctagcaagtttcgtagtggaaggtggatgggagatcgtttgtggatgtggtcaaagcngaggagatggatcgtcgtgctcggcagcga

SEQ ID NO: 37115 - DNA, 101 bp, rice(Oryza sativa)
  misc_feature (71): n=t or c
gccattgctattaccgttactattccagtggttatcatatgcttgattccctgcgtacgaacgaaacgaancatgacgaagcagacgtagaagcaacatag

SEQ ID NO: 37116 - DNA, 101 bp, rice(Oryza sativa)
  misc_feature (71): n=a or g
ctgctaccatttctagactttgttcgacggaacaatctgcagatggaattcttctctattggctcaaaccngtgtaagagactcacattatgaatctgaat

SEQ ID NO: 37117 - DNA, 101 bp, rice(Oryza sativa)
  misc_feature (71): n=a or g
gtaccacgttttgtacttgaacaagggttgcttggctacatacatacacagccaaaaatctagctccaggnatatacggtcccttgttgtttgcagaagct

SEQ ID NO: 37118 - DNA, 101 bp, rice(Oryza sativa)
  misc_feature (71): n=t or g
cgttgggtgctctcctcataccaaaagaaaccatcacacaaactaaagagattcagcagcactagcattantaactcacaacatctagcaatattcacata

SEQ ID NO: 37119 - DNA, 101 bp, rice(Oryza sativa)
  misc_feature (71): n=t or c
ggaaactgtggattttcattcacttctcagggctacaaatctggtactaccatgcgtgtaatcctcgccgngtttagttctaaaataattcttcaaacttt

SEQ ID NO: 37120 - DNA, 101 bp, rice(Oryza sativa)
  misc_feature (71): n=t or c
aattgatacatacttcttttcctgttgcaactcacgaacacctaacaagttaacttagaaaaaccattggnttatgaaatcttgataatgatttcaatata

SEQ ID NO: 37121 - DNA, 101 bp, rice(Oryza sativa)
  misc_feature (71): n=t or c
agaggaggcggagtggtccaacgtggtcccaaccgttggcgacgaatggctggagacagcaatggcgagcngtggcacgagagtgtggtggaagtggcgga

SEQ ID NO: 37122 - DNA, 101 bp, rice(Oryza sativa)
  misc_feature (71): n=a or g
ttccaactgagaccataggtttgacttcattgacatgtccgcagcccctggttctctcaaaagctccatgncaaaggatgctactcgccagattccagatc

SEQ ID NO: 37123 - DNA, 101 bp, rice(Oryza sativa)
  misc_feature (71): n=t or g
aaatgcacgagatatcctcccgctcgataatgccatcctcatgtcggtgctcttcctgtgatggcatgacnccatgcggtcgcagctagtggggcactctg

SEQ ID NO: 37124 - DNA, 101 bp, rice(Oryza sativa)
  misc_feature (71): n=t or c
ttaatttatgtgtcccataagctgatattgttcatgtttcacaggcacaataaaaagttccactttccggngaaaagaaatctgccctatttcctccatat

SEQ ID NO: 37125 - DNA, 101 bp, rice(Oryza sativa)
  misc_feature (71): n=t or c
ctacaactaccacagggggtgttgcgccatagcaactagtacaccaactctgaattgttgttgttcttgtngtgccaagaacaaccttgaacctactagca

SEQ ID NO: 37126 - DNA, 101 bp, rice(Oryza sativa)
  misc_feature (71): n=a or g
atggcattgcttccaattcatagcaaacatatccttcgctcgatatcaatttgagaaataacctaataacnagttcgatttggactcaccttatggccata

SEQ ID NO: 37127 - DNA, 101 bp, rice(Oryza sativa)
  misc_feature (71): n=a or g
actgcagattctggaagagtgtctctgctattccgctggaaagacttgtatttcgagggattttactccangggtacgtattacggtatatctaatctact

SEQ ID NO: 37128 - DNA, 101 bp, rice(Oryza sativa)
  misc_feature (71): n=a or g
tgtaagggtggtggactcggtggacccaatttcagagtcattatttgggtagttgtatgtcatggatgacncgctgaccgaggggcctgaacctgagtccc

SEQ ID NO: 37129 - DNA, 101 bp, rice(Oryza sativa)
  misc_feature (71): n=a or g
aatcaaccgattaagacaaaacagttgtagtagtagctaagagcagccagcaaagtaatcaatcgttctcncctcagcttccttggtgtgttgtgctggta

SEQ ID NO: 37130 - DNA, 101 bp, rice(Oryza sativa)
  misc_feature (71): n=a or g
gggttcaagaatcatctaatttgccatctagttcaactgccttacaaggttttgtcgtttttgcaacagtngaagatgacagtgccgccgaagatttcaca

SEQ ID NO: 37131 - DNA, 101 bp, rice(Oryza sativa)
  misc_feature (71): n=t or c
ctgaaaccaaaattttgtagaacttcaagcaggtatgcccaattaacagtgtcaaaggccttagaaatgtnaacttttaggaaaagagtaggcttttttgc

SEQ ID NO: 37132 - DNA, 101 bp, rice(Oryza sativa)
  misc_feature (71): n=t or c
tgaggtagtgtagaagaggaagaagagctagcaagcagcagaacacagctgcgtccatgattgagcaatcngagctgtgtgattagtttgtgattaggtga

SEQ ID NO: 37133 - DNA, 101 bp, rice(Oryza sativa)
  misc_feature (71): n=a or g
ctcgcccccatgaacacccagtacctgaccattacacagccgcgtgccgttcaattcgatcgttgtcgtcnagcccttccgatgcatgtacgtagctgtgg

SEQ ID NO: 37134 - DNA, 101 bp, rice(Oryza sativa)
  misc_feature (71): n=a or c
tcctaattccccacacggcgaaagcaaatcaaatccaatccacctctcgcctccaaatcccaaatcctctnctcgtcgtcgtcgcggttcatctccagcga

SEQ ID NO: 37135 - DNA, 101 bp, rice(Oryza sativa)
  misc_feature (71): n=t or c
acaagttcttactacagaggtgcccatggcatcattctaggtaattctattcccaacttatgttcaggacnatcaatatttctaagcatttatcatgccta

SEQ ID NO: 37136 - DNA, 101 bp, rice(Oryza sativa)
  misc_feature (71): n=t or c
aagaaggcaaatgaaacaaatcatgaaggagaaatagtacctgcatactatatttgtggagtgccaggttnctattacacaaggctttttcctcaacaaac

SEQ ID NO: 37137 - DNA, 101 bp, rice(Oryza sativa)
  misc_feature (71): n=a or c
agtttcagattttggtacgtcaagattggtttctatcgatcaaacccatattgtcacaaaggtgcaaggcncatttggttatttagatccagagtattgtc

SEQ ID NO: 37138 - DNA, 101 bp, rice(Oryza sativa)
  misc_feature (71): n=t or c
gtcccaacctttcacaaaagcgtatagctcccagatcgtacagaatgtcgcgtagtttgtgtgattgtgtnatttctagtactaataaactactccttccg

SEQ ID NO: 37139 - DNA, 101 bp, rice(Oryza sativa)
  misc_feature (71): n=t or c
catctagcatctctctgaaatccaagctagcttcttcatctctatgatattctttcagtttgctgcattcntatgccttgaacatttttgttgtaattgca

SEQ ID NO: 37140 - DNA, 101 bp, rice(Oryza sativa)
  misc_feature (71): n=t or c
aacagtagatagaaataaatgtaagatttgttgcaaacgcctacccagtgctctgtgctcatattcctttnaaagatactccctctgtactcgtaaagtaa

SEQ ID NO: 37141 - DNA, 101 bp, rice(Oryza sativa)
  misc_feature (71): n=t or c
aatcaagaagcagtataagggacacaacagtgtcgtcaattatttgctatggagctcgatcagctaaaaanacccgctagtcttcaggattggtttctttg

SEQ ID NO: 37142 - DNA, 101 bp, rice(Oryza sativa)
  misc_feature (71): n=t or c
ttgattctgcctaattaatagataaattgctatgccatatccttcttaaatttggtctcttccagataagntttctttattaattgattaatttacttaac

SEQ ID NO: 37143 - DNA, 101 bp, rice(Oryza sativa)
  misc_feature (71): n=a or g
ggtcttgtagccaatcatatttaggtccttgaatccttgccacgtcgaccgaacaaaaatggagagagcgntcgtctcgcgcgaggctcggagccttggat

SEQ ID NO: 37144 - DNA, 101 bp, rice(Oryza sativa)
  misc_feature (71): n=t or c
caaggcatgacataaaaatggggtggagaaatgctcaattcatggtagaaaaggtacaaaactccgctagnattttcgtcatgccatcatcattcttgttg

SEQ ID NO: 37145 - DNA, 101 bp, rice(Oryza sativa)
  misc_feature (71): n=a or g
ctcatccatgacacaaaattccatcggcaatgcaaacaccatgttgacatccatgttctgtcttggcagcnaatcattgctaataaccagtaacccacctc

SEQ ID NO: 37146 - DNA, 101 bp, rice(Oryza sativa)
  misc_feature (71): n=a or c
tggggtagatgtctacatttagcagactttgttgccatgcttggatatgactctgatggaaagttgaaaanttattggttattgcctggaaagaacatgtc

SEQ ID NO: 37147 - DNA, 101 bp, rice(Oryza sativa)
  misc_feature (71): n=t or c
tttttttcagggaatacgaatcagactgctatttgtgcgtgtatacgtacccgtttccaaatggcagggtncatcttaagcgcgatcacctggatcatctg

SEQ ID NO: 37148 - DNA, 101 bp, rice(Oryza sativa)
  misc_feature (71): n=t or c
aaattagcatccttggttctcgaaacatttgattcagtgttgggggaacttcttctgaacaaacctcttancttcatcctattaattgaaccaccacttct

SEQ ID NO: 37149 - DNA, 101 bp, rice(Oryza sativa)
  misc_feature (71): n=t or c
ctgtttttttttttggtcctctagggctcagaagcctcatggttcatcaagttcatcatcctctgctgcancaccaaaccgctattggcttgcagttgtgg

SEQ ID NO: 37150 - DNA, 101 bp, rice(Oryza sativa)
  misc_feature (71): n=a or c
caaagactccgaaagataggaagatcaggatcgtgtatggaagccgagtcacaatgaaaaggaaggagtgntgtggtgctaagatcgtagaacctgaagaa

SEQ ID NO: 37151 - DNA, 101 bp, rice(Oryza sativa)
  misc_feature (71): n=a or c
ggatgatctggcatcaagggacaattatttggccatcatagccccctggtttcttcctacaggaatctctngggggaagaaaagcttctccaatgaatttt

SEQ ID NO: 37152 - DNA, 101 bp, rice(Oryza sativa)
  misc_feature (71): n=t or c
atgatagggtataccctctgctggagatgagtgttgagattgataggtaatatgtgcttcgtatgaaggcncgctcccttgacagccttgttgccatggtt

SEQ ID NO: 37153 - DNA, 101 bp, rice(Oryza sativa)
  misc_feature (71): n=a or g
ggtactgatgatagcacgaagagacgaaggttgtcttcaaccaaacatgcacccgaaagttcaacgtccantgatgaaaacctttcagcacccccttgtgt

SEQ ID NO: 37154 - DNA, 101 bp, rice(Oryza sativa)
  misc_feature (71): n=t or c
ttcattggagagcaaaacattatggcttctcttcatgctataagcctcctgttggataaattgtaaaggcncgtagcaggtagactctaatttgtgcattt

SEQ ID NO: 37155 - DNA, 101 bp, rice(Oryza sativa)
  misc_feature (71): n=t or c
aagaaatgaaagtgttgaccggtgaaaagagagagaatgtgcttaccaccaagcataccacacaagatgcnattgacgaccccggattttgtcgccaacat

SEQ ID NO: 37156 - DNA, 101 bp, rice(Oryza sativa)
  misc_feature (71): n=a or g
ctttgctagctcgttttgatttgtgtgcttctgtatttgtgtgttttgtgggcgaaaggggggctttcttngttcttgttccgggcgattgttattcttgt

SEQ ID NO: 37157 - DNA, 101 bp, rice(Oryza sativa)
  misc_feature (71): n=t or c
aaactgcttcactcatggctatacacgccttagcagcagagcgccaaattgagataagggatgtcaattancctcaggtgcagcatctgcgccatcaggtg

SEQ ID NO: 37158 - DNA, 101 bp, rice(Oryza sativa)
  misc_feature (71): n=a or g
cacctttcactccgtttattcgccacagttatataacttttttatcaaacatgtaggacaattgcgtatcnttgcattacagaagaaccggtgattatatg

SEQ ID NO: 37159 - DNA, 101 bp, rice(Oryza sativa)
  misc_feature (71): n=t or g
gggaacagatatttctttcttcacaggtacgcgtattgttcatctctttccgttttttttccgtttcactnccgtttccacttttaaggtgataagttttc

SEQ ID NO: 37160 - DNA, 101 bp, rice(Oryza sativa)
  misc_feature (71): n=a or g
acccgttgcctccgagatgcaacatttctagtttggacatgttgaaaattaactcaggtactggtccaganaagtggttatatgctatttccaagtgttga

SEQ ID NO: 37161 - DNA, 101 bp, rice(Oryza sativa)
  misc_feature (71): n=t or c
actttctttataagtacggagggaccaaaagaaacaaaagttaatggtgagcttctacttcacaggttgtnattaaaaatgtattcacttattccctccgt

SEQ ID NO: 37162 - DNA, 101 bp, rice(Oryza sativa)
  misc_feature (71): n=a or g
cttttttacgcccgtctttaatcggaaagaaccgcccaaattgcgacgtgcttcaacacgcttatgtactngatctatgctgttcttttttttaatgcaat

SEQ ID NO: 37163 - DNA, 101 bp, rice(Oryza sativa)
  misc_feature (71): n=t or g
aaaaatcggttttgtgggacccattgaaaaaaaaaactcaatcacaccttttctctcgctcttacacccgncagcaacaaatattttttgatggtcggtgt

SEQ ID NO: 37164 - DNA, 101 bp, rice(Oryza sativa)
  misc_feature (71): n=a or g
cgcagagttggtacaatctgccggacatggatttttcgttaacacccttttggcacgtctaacgggacacncattttgtaccaacatgtctgaagaggaag

SEQ ID NO: 37165 - DNA, 101 bp, rice(Oryza sativa)
  misc_feature (71): n=t or c
tactaagagcaggtttaatagtagcgtccatagttggctccaatttattttcaccttagttaccgtcgatncaaaagccaacacgtacattaagtagtctc

SEQ ID NO: 37166 - DNA, 101 bp, rice(Oryza sativa)
  misc_feature (71): n=a or g
attcttctagttcattgaataactttatagtcccagtttttgagttgggattactatgctcacatgaattnccagaccaaagaatgacaatgagcgaagtg

SEQ ID NO: 37167 - DNA, 101 bp, rice(Oryza sativa)
  misc_feature (71): n=t or g
tggctacttatagagttataatgaagtgtcaaatactatggacggaggaactatacctatgcttttagcanggccgtcccgtcaaatttaggggccctgtg

SEQ ID NO: 37168 - DNA, 101 bp, rice(Oryza sativa)
  misc_feature (71): n=t or c
ttagggtgtgccacattgatggtgtactactacatgactccacaattccttggcaattaatccaaagaggnagtaccaccactgttatccatgtgagctac

SEQ ID NO: 37169 - DNA, 101 bp, rice(Oryza sativa)
  misc_feature (71): n=a or c
tgcatggatgcgttgttgtaatttggataacccaaccttctctttggaaaacagcaaatcttctatctatntatctatctatcttctatctatctatctat

SEQ ID NO: 37170 - DNA, 101 bp, rice(Oryza sativa)
  misc_feature (71): n=t or c
acaaagtcgagcttttttttctctaagtatatctgccacataccgaaatttagtcaaatctgaaagacctntgcaattccaaaagatacctatcatgacga

SEQ ID NO: 37171 - DNA, 101 bp, rice(Oryza sativa)
  misc_feature (71): n=a or g
aatctgactcagcaacatacaagtacaccaaacaactcaactccctcaaagaatgaaggctcagcaggacnccaatttggcaatctaaatatcttcaaaca

SEQ ID NO: 37172 - DNA, 101 bp, rice(Oryza sativa)
  misc_feature (71): n=a or g
ttggtatgcgccgtcgaagtagtcagaccacctgagctcgtccagcacgccggcatagtggtccatcatcncgaaggggttggcgtgtcctaggtccagcc

SEQ ID NO: 37173 - DNA, 101 bp, rice(Oryza sativa)
  misc_feature (71): n=a or g
gtattgtgccacatcgttcgcaaaacaagaaccattgaatcatttgcatgcgtcgtctcgcaatcatccantagatattatacatcgacagctattatttt

SEQ ID NO: 37174 - DNA, 101 bp, rice(Oryza sativa)
  misc_feature (71): n=a or g
cagtcaactgatcaataggcggtgcccgttccttctccttcaggtaattaattaatcagagcatgcataantggccgtcaccagattggcagattcggctt

SEQ ID NO: 37175 - DNA, 101 bp, rice(Oryza sativa)
  misc_feature (71): n=t or c
cgcaacagcagatgtggcagttgctataggcacaattatcagcaataccttggaccgacgagaaccttttngatctgtacctctacgaggtaagtcaggta

SEQ ID NO: 37176 - DNA, 101 bp, rice(Oryza sativa)
  misc_feature (71): n=a or g
gagagaaaagaacacaccacccgtgcatattattgatttccaaacgaattcattggcgcaagttctgatcnaattcaccagagaaattaatttcttcctca

SEQ ID NO: 37177 - DNA, 101 bp, rice(Oryza sativa)
  misc_feature (71): n=t or g
tgtcaccaaagtctctagggaaccttcgagtctttttgagatgtctaagaggattgacttgaggtcatcgnctaggggcaccagagcctggcttgttgttt

SEQ ID NO: 37178 - DNA, 101 bp, rice(Oryza sativa)
  misc_feature (71): n=t or c
gcaggttgcaagcgaacctgaacctgtggtgatgcaaccggtgttggcacaggcgtaggcagtggaggcantggcacgggtagcatggacacagacgttgc

SEQ ID NO: 37179 - DNA, 101 bp, rice(Oryza sativa)
  misc_feature (71): n=t or c
aattgcggatcggttgccatagttgctagaacggtacatagatgccacctaactgtagtgagcggcataantttcatattgtgtttatcgactatctagtt

SEQ ID NO: 37180 - DNA, 101 bp, rice(Oryza sativa)
  misc_feature (71): n=t or g
aaattcaacgcatcctaaaactattctcagggaattctgcatcgcaacgagaggctttgaaactgatccanctactcactaaaaccaccaaaggggtgcaa

SEQ ID NO: 37181 - DNA, 101 bp, rice(Oryza sativa)
  misc_feature (71): n=a or g
gtggggggagaagatgaccagtcagccaatgctcatggcccgttggatctgacggaggtattgacagaacnaagtgacatagctataatttcaaaataatg

SEQ ID NO: 37182 - DNA, 101 bp, rice(Oryza sativa)
  misc_feature (71): n=a or g
aaacacagagtttgctaatctagctatagctagtcttgtgcggcactgtctccggcgtctcctgtgcgtcncctctgtcgtggcggctcctcctccgtctc

SEQ ID NO: 37183 - DNA, 101 bp, rice(Oryza sativa)
  misc_feature (71): n=a or c
catcaccatgcgcgggcatcgcctttgtaggatcgatcagcttctccctcggcttgctttagtgggccggnagtgcaagttgggccgggccttctcttgcg

SEQ ID NO: 37184 - DNA, 101 bp, rice(Oryza sativa)
  misc_feature (71): n=t or c
taagcaagttggccaacctcatatcatgtgtgttcttttctctcatcaggttattcgctctaaaatactcngcggatgctgcatgtactgtactgcgggtt

SEQ ID NO: 37185 - DNA, 101 bp, rice(Oryza sativa)
  misc_feature (71): n=t or c
ttctaagtcagtgctcagtggcaaaaggggagcttttagtccctaaacttaccagaagacaaaaatctcanaaacttttcgccaatcgagaacgtttccag

SEQ ID NO: 37186 - DNA, 101 bp, rice(Oryza sativa)
  misc_feature (71): n=a or g
aatttaagtatctccgccatgtgtggcagggatttctcttggttaggattaacctaattaaccatccggcntgatccatgcatggcacagcttgtgggtct

SEQ ID NO: 37187 - DNA, 101 bp, rice(Oryza sativa)
  misc_feature (71): n=t or c
tccttgtaacaattaattagaactaaagcatgttatcttacggttccttacgcgtcatccttctcggcagngagttcacatttgcgcttctcgtcgagcat

SEQ ID NO: 37188 - DNA, 101 bp, rice(Oryza sativa)
  misc_feature (71): n=t or c
aggtttccttcatggcccgtccggcttactgagcgcgatatacaaacctttgcagggagatccaagacaanggcatgcacatccacatgtacatggctgcc

SEQ ID NO: 37189 - DNA, 101 bp, rice(Oryza sativa)
  misc_feature (71): n=t or c
gagtatccatccagagaaaaggctatggtggtcaaactcattagggcagtataactttatgagctcccgcntggctgatggcaagtcgaggataaccgagg

SEQ ID NO: 37190 - DNA, 101 bp, rice(Oryza sativa)
  misc_feature (71): n=t or g
tattttgcaaaaatataccggattgtgaaggttttgcacaaatatatcattggtatcgctggttgaaagancgataccgaggttcgcaactagaaagtgcg

SEQ ID NO: 37191 - DNA, 101 bp, rice(Oryza sativa)
  misc_feature (71): n=a or g
ccctgataccccttaccagcccggcttgccggatgttctgaccccagacattttttatcgtcacgccgtcnacgacaggaagcttgctcggatcatatgat

SEQ ID NO: 37192 - DNA, 101 bp, rice(Oryza sativa)
  misc_feature (71): n=a or g
caccagatttccataggtcacatcaaagtaacacaagaggacctgcctgaatatagcacgacttttgtacntggtcactagcttggtaaatcttgtgcttg

SEQ ID NO: 37193 - DNA, 101 bp, rice(Oryza sativa)
  misc_feature (71): n=t or g
acgcgcacggcgcatcatatcgctcactctgcatggcttcggcttcttctgtcagcttaatgctgctcgtngctgcagctatggcctcagccgcctcggcg

SEQ ID NO: 37194 - DNA, 101 bp, rice(Oryza sativa)
  misc_feature (71): n=a or g
aagcttgtgttggcgtatgttcctgcgtcgtggattattattcatcgtgggttcctgattgatcctgcgcntgcacattattgttgttttgagttgttgag

SEQ ID NO: 37195 - DNA, 101 bp, rice(Oryza sativa)
  misc_feature (71): n=t or c
tcaatctttataacactaccaggttttctaagtacctttgccctccatctatacagcatgtgaaaactttnctcccatgttccatacagctgatccaaagc

SEQ ID NO: 37196 - DNA, 101 bp, rice(Oryza sativa)
  misc_feature (71): n=t or c
atcgttcactcgttctcacattttgggctgttgaacactacattttggagtttggactgacgacactcgangacgactctcatgcttgttgatactagtat

SEQ ID NO: 37197 - DNA, 101 bp, rice(Oryza sativa)
  misc_feature (71): n=a or g
gaagcgagagaactgagagagaagagggggagtcaatggcggcggtgacggtatgggattcccattcccantccggggccgcgcgtcgagtgccgtacagc

SEQ ID NO: 37198 - DNA, 101 bp, rice(Oryza sativa)
  misc_feature (71): n=a or c
gggctacggcgcctaatagctcacctcgtttttgcgtatcagagtgagaagatataaaaaacgagatgtgncattagctcatgattaattaagtactaatt

SEQ ID NO: 37199 - DNA, 101 bp, rice(Oryza sativa)
  misc_feature (71): n=t or g
ggctggagtactgataccagaacattattgtggagagaaagataacattgggaggtatatgagcagaacanctggtgaggaggccagcattggcattggag

SEQ ID NO: 37200 - DNA, 101 bp, rice(Oryza sativa)
  misc_feature (71): n=a or g
actgtctccgtacatcgatccaggcatctttcagttggtaccctttttcgagctgagtacaaagttgatcnctttgcattaatattagtgatacactatta

SEQ ID NO: 37201 - DNA, 101 bp, rice(Oryza sativa)
  misc_feature (71): n=t or c
taaacagtggcaagctagcaggcaagatggtgtgctcatctctcaaatagggcattcattaacatgagctnggcccctttctctgtcatattatctgcaaa

SEQ ID NO: 37202 - DNA, 101 bp, rice(Oryza sativa)
  misc_feature (71): n=a or g
gttttgccggggtgggatctgatggaaaatggccctttctacgtcagcatgacataactggtgacatggantttcttgttatagcaagtcaaggcctctgg

SEQ ID NO: 37203 - DNA, 101 bp, rice(Oryza sativa)
  misc_feature (71): n=a or g
cttgggcctccattgatatgctcaccgtttgacagaccggaaagctttaccacagaaatggcacaaattgnaggtaagttgctgagccgtagattttggtg

SEQ ID NO: 37204 - DNA, 101 bp, rice(Oryza sativa)
  misc_feature (71): n=t or c
acctgaattttcagatggggaagtcctccatcgaacacggtgacgaacacggaaagcaaccacgtggcgangaacacggctccgactgccgcgtgggccaa

SEQ ID NO: 37205 - DNA, 101 bp, rice(Oryza sativa)
  misc_feature (71): n=a or c
tttaaaatgaaacgattaatgacttaactccttgatcatgcagttcttttccctgaagttggcggcaatanactggactcccaccatacattcgttcttga

SEQ ID NO: 37206 - DNA, 101 bp, rice(Oryza sativa)
  misc_feature (71): n=t or g
agacggcgtacccgtcgacagcagttttgtgcttttagtgatatacagcgtaatagtgtcctatctattcntgtggaatataacgcgtactaaatcactag

SEQ ID NO: 37207 - DNA, 101 bp, rice(Oryza sativa)
  misc_feature (71): n=a or g
agcttccatgcttggcgattcgatgccatgtaggaagacgaagatgatgaagctagcgtagcctagtgatngctcaacccgccatggaagggacggtgcag

SEQ ID NO: 37208 - DNA, 101 bp, rice(Oryza sativa)
  misc_feature (71): n=t or c
ggttaagtttgctgcttaattctcccaacccaattaattattaatcccactgctcatgcatacctagcttnctttttttctctgctggtaattaaagcgta

SEQ ID NO: 37209 - DNA, 101 bp, rice(Oryza sativa)
  misc_feature (71): n=t or c
gctgctttcgtacacggtggtcgtgccgaccgtgagcaataaggtgctgggcagcgagacggtgcctgcangacacaaggagatcctgctccaagctgtcg

SEQ ID NO: 37210 - DNA, 101 bp, rice(Oryza sativa)
  misc_feature (71): n=t or c
ctgctcatggcatcgccggagatcactagctccacgtcgttttgtccgccactcactcctcgctcatcaangggttgccctccggcgagctctccacacca

SEQ ID NO: 37211 - DNA, 101 bp, rice(Oryza sativa)
  misc_feature (71): n=t or c
caaggcctaagtgtatttactcactttgtatacgcctaggtgagttaatgaggtttttgtccatgttcatngaatttgagggcctgttgggtacagctcta

SEQ ID NO: 37212 - DNA, 101 bp, rice(Oryza sativa)
  misc_feature (71): n=a or g
aaaagactatgaaggttaaactacgaaaaagaaaacactgctcctatattgagggtggtttgtggcagaanaacccccactatactgccaacaggcccaaa

SEQ ID NO: 37213 - DNA, 101 bp, rice(Oryza sativa)
  misc_feature (71): n=t or g
caggtccgtttcattcatctcatctctcttcccctcgttcttgggcacaagtcagaattgtacagttgcanctcacaggacagcagatgaatatatatgca

SEQ ID NO: 37214 - DNA, 101 bp, rice(Oryza sativa)
  misc_feature (71): n=t or c
gcgatctgaagctaagtagagtgttctcgtaaaataaattagagaggtgaagttgaatttttggctgcttnataactgcattctaaatccaacttctagag

SEQ ID NO: 37215 - DNA, 101 bp, rice(Oryza sativa)
  misc_feature (71): n=a or c
agtaaacgacagtgtaagttccaaccattttaatcctgcaattaacacggccaaagccatattatcaacgnaataaaatatcccgcaagaatcttatcgtt

SEQ ID NO: 37216 - DNA, 101 bp, rice(Oryza sativa)
  misc_feature (71): n=a or g
cacgcgacctaccaatacgtcgggtcgaccaaggggaacatcggttatgtggcgtttttgttcgtcctcgntgtgctgttcttatgcgtggctggcctttt

SEQ ID NO: 37217 - DNA, 101 bp, rice(Oryza sativa)
  misc_feature (71): n=t or c
gagacgtggatcctctgtagtactgcagtatatttgcgatagcactgcagtatatttgcgatagcggtgantgacaggtggacccggtcccacatgtcagc

SEQ ID NO: 37218 - DNA, 101 bp, rice(Oryza sativa)
  misc_feature (71): n=a or c
caatctttatggccaaatgccctgaatctagtagaaaatactgagtagagcccaagaggtggcctctctcnatcatagttgcgctctgctctgttgaacct

SEQ ID NO: 37219 - DNA, 101 bp, rice(Oryza sativa)
  misc_feature (71): n=a or g
aggactaacagtagggaaaatttttcgaaaccccccaacgcgagcaaaccatggagagagggatagaaggnaaagccgcacgagatcaagcatatacatct

SEQ ID NO: 37220 - DNA, 101 bp, rice(Oryza sativa)
  misc_feature (71): n=a or c
gagacaccggagaaagtagcgcgggtcctgattttatgctccatgtcgcggaggaagtcggaggcgtggtnggggtcgtcgatgaggcctgggagaaccgc

SEQ ID NO: 37221 - DNA, 101 bp, rice(Oryza sativa)
  misc_feature (71): n=t or c
taatgtccctttgaatctcacaaaaacaatcacaagttttgagttactaactgcagttttgtggcggtgcngcaccgtggcactaggctataagccttggc

SEQ ID NO: 37222 - DNA, 101 bp, rice(Oryza sativa)
  misc_feature (71): n=a or c
ggaacaatttgatctgtctgttctgctaacttgtcgtggtgatgagaacatgttgtgcgtgatgtgaaatnctccctccgtcccattttaagtgtagccac

SEQ ID NO: 37223 - DNA, 101 bp, rice(Oryza sativa)
  misc_feature (71): n=t or c
cgtcgtaggaggcgcaccgtgaagtctcatctcgtttcacttgctcgctcactttatcgcattctttgttngacgaggatagggaagaggtggaacggcag

SEQ ID NO: 37224 - DNA, 101 bp, rice(Oryza sativa)
  misc_feature (71): n=a or g
ctggtattgattctgtcacagagactagtgctttgaaaagcgggcaacataacatgttaagtagcaattcngcatcaaacatgtcgatcaaggtgagtgat

SEQ ID NO: 37225 - DNA, 101 bp, rice(Oryza sativa)
  misc_feature (71): n=t or c
atactagggaagggactagagaggcttcagttgacgagaggcccattatttttctctctcgtgggtattgncatttgtggtccattggtcctaagcccacc

SEQ ID NO: 37226 - DNA, 101 bp, rice(Oryza sativa)
  misc_feature (71): n=t or c
tcaataatgtaagtgcagggtgcaggaaaaggttgcaaccatggccaaaactgcagcagctcctctcctcnatgacttccctcttcctcctcacataacac

SEQ ID NO: 37227 - DNA, 101 bp, rice(Oryza sativa)
  misc_feature (71): n=t or c
cccctggtccatgtttatgatgcaagtgtagatcaaggtcagacggctagggatgtcgaggataattttgnatctctcatcactactgatttgactgaatt

SEQ ID NO: 37228 - DNA, 101 bp, rice(Oryza sativa)
  misc_feature (71): n=a or g
gtagttggagctattcaaaattttgcattataaaagtacccatgctttccatattagttttgtggccactngatctatcctcccattgaattgtgctatgt

SEQ ID NO: 37229 - DNA, 101 bp, rice(Oryza sativa)
  misc_feature (71): n=t or c
gtgtgcggttaatgagaaggccacctcttccacaacctcctttgctgatcctacaagaaagcagttcctgngccaccatccgaattctcatgtgattttgg

SEQ ID NO: 37230 - DNA, 101 bp, rice(Oryza sativa)
  misc_feature (71): n=t or c
acatcaacaaagttactctttcaattgctaaagaggtatccctccactcctcaaataccacacaaatagtngtgaattttttttaaaaaaatatccataaa

SEQ ID NO: 37231 - DNA, 101 bp, rice(Oryza sativa)
  misc_feature (71): n=a or g
atctgctttgcggccgtgctcagctacgataatgaaagctcgaagaccactgccccaactgaaatgcatgntctggaaaatcctccaagtatttaatactg

SEQ ID NO: 37232 - DNA, 101 bp, rice(Oryza sativa)
  misc_feature (71): n=a or g
gatatgattcgaaacagagtaatggttgagtaacattgcgaagtgagcgtagctggtagttttttatggtncaacctatctattcggattaagctctagac

SEQ ID NO: 37233 - DNA, 101 bp, rice(Oryza sativa)
  misc_feature (71): n=t or c
tcatgcattcgacaggtatgcacttctccatttcgattcctctctactacttgcaataggcttcggtttangagtttatgcagatagtcgtttgcaacttc

SEQ ID NO: 37234 - DNA, 101 bp, rice(Oryza sativa)
  misc_feature (71): n=t or c
atgctatgtgcatgtgtggtcggatggctttgaggcgtgtcacgtgatatgactaaaacgggaggcttctngatttagattttatatttattatgttgatt

SEQ ID NO: 37235 - DNA, 101 bp, rice(Oryza sativa)
  misc_feature (71): n=a or g
atgatcagttttatagaaattagacggtcaactcatggaaggggtttgaaagggatgaagttaaattttcngtggtatagaagggatcaggtaaattttag

SEQ ID NO: 37236 - DNA, 101 bp, rice(Oryza sativa)
  misc_feature (71): n=a or g
agaattgactttcttgtattgttggcaaagtccttacactgacataaagtctctagtattgctgtataggnagacaaaaatagaaacaattctctgttaga

SEQ ID NO: 37237 - DNA, 101 bp, rice(Oryza sativa)
  misc_feature (71): n=a or c
catcctcaagtcaaggggataagcggaaagtacttcagcaattgcaatttagatagcccaagctcacatgnttcaaatgcagagttggcaaagaaactatg

SEQ ID NO: 37238 - DNA, 101 bp, rice(Oryza sativa)
  misc_feature (71): n=a or g
caatctgatcgatcccgatatatatctctctctcgatcttctcggctgctaccttctcatcgttgccgccnccaccgacgaaggggtggctgctgcaagcc

SEQ ID NO: 37239 - DNA, 101 bp, rice(Oryza sativa)
  misc_feature (71): n=t or c
ttatctatcctcctatttaaaattcttaacgattaggcacttgagccacctccagcgctgacaaaattgcnctcacagtgatctagtggtaccttcatttc

SEQ ID NO: 37240 - DNA, 101 bp, rice(Oryza sativa)
  misc_feature (71): n=a or g
cacaattgaggagaacagttctcttttcatgccatttgatgctcatctagcgcagaggaatggaaatatgnttgttgacacaaatcttagctcggcactgg

SEQ ID NO: 37241 - DNA, 101 bp, rice(Oryza sativa)
  misc_feature (71): n=t or c
ccacaaccaacaatagagaccacttttagagaccctttcatctccatagctagcagctcaatgatacgctncttaggaccatcaatgcccacaagtttatc

SEQ ID NO: 37242 - DNA, 101 bp, rice(Oryza sativa)
  misc_feature (71): n=t or c
ccacctttatcactgtgcttgaaatccatggctattttagtggcctaatgcaagagtactcttcttgaccntggtggtgagtggtgactggtgagctgagc

SEQ ID NO: 37243 - DNA, 101 bp, rice(Oryza sativa)
  misc_feature (71): n=a or c
cgagctgtacaagagcgtggaggatctcagcgccgactacttccacaccaaggcctgcaaggcgatgcttntgaagcctcacaacaccgcagcggagcagt

SEQ ID NO: 37244 - DNA, 101 bp, rice(Oryza sativa)
  misc_feature (71): n=a or c
agaccttgagctcaaagttgtcttattgtccagggactcaacttttgggatgtgtttattggcatggaganaaaaaatacaaatatatgaagcctctgact

SEQ ID NO: 37245 - DNA, 101 bp, rice(Oryza sativa)
  misc_feature (71): n=a or g
gagaaatcttctctttcacctgctgccgaacgcagttacaagaggtgcaatttcaactttggtgtgtttgnataatgtgaaatgaggggtgggattgagat

SEQ ID NO: 37246 - DNA, 101 bp, rice(Oryza sativa)
  misc_feature (71): n=a or g
atgtgagacccatatgtgttccatcttcttccttcattcttccctcttcttactcttccccatctcccctnagccaaatgtggtaggcggcgaggaccact

SEQ ID NO: 37247 - DNA, 101 bp, rice(Oryza sativa)
  misc_feature (71): n=t or c
ttcattcgtctcatctctctgattgttggtggattaggaaaatcaaaagatcgaagcctgccggtgatagnagaacctgcgccattgcggataaaattaaa

SEQ ID NO: 37248 - DNA, 101 bp, rice(Oryza sativa)
  misc_feature (71): n=t or c
catccgttaagttgaaggttcaggagccctgcagggaatgtaatttttattactgacatttttgactgtgngaaagctccaagttgaatcagtagtccaca

SEQ ID NO: 37249 - DNA, 101 bp, rice(Oryza sativa)
  misc_feature (71): n=a or g
ttatgtaggttcacgggtggtggcattttcactattgcttgtatttttgtcgggttgatccgaattccttntttcatgactataaatccgagaaattttcc

SEQ ID NO: 37250 - DNA, 101 bp, rice(Oryza sativa)
  misc_feature (71): n=t or c
ccaaaatactaaattgtcaaagttcttatgctataacgcgctacttgttaagttgttgcacccagacattnaattctctactatatcacactcacatgtca

SEQ ID NO: 37251 - DNA, 101 bp, rice(Oryza sativa)
  misc_feature (71): n=a or g
gcattatcaacttcagttgatgatttctgttcaagaagctctccaacagtaatatggttctctgccaagcnaaagcactttttcattcttgcatagtccac

SEQ ID NO: 37252 - DNA, 101 bp, rice(Oryza sativa)
  misc_feature (71): n=a or g
gaggtgcgaggaggttaattaggagagtatggcgctgtggctgaagctgttcttgtccgtgttcctgccgntcgcggcgctggtcgcggtggctgttcttg

SEQ ID NO: 37253 - DNA, 101 bp, rice(Oryza sativa)
  misc_feature (71): n=t or c
gagagctgaacagaagattccggcaaaaaagagttgaataaaagagaagagacatcctttttcacacgcanactgctaaacggtttatttttctttaaaaa

SEQ ID NO: 37254 - DNA, 101 bp, rice(Oryza sativa)
  misc_feature (71): n=t or c
tgtgcagtcaatagtgtgctgaccacaggtgctggggaagatatagctaacacaaagcctgcgatatcaangtaatatttcttttttgctaattattgagg

SEQ ID NO: 37255 - DNA, 101 bp, rice(Oryza sativa)
  misc_feature (71): n=a or g
agagttttttttttagataataagaggagttctgaaatacaggaagcacgcaaaagcctggcttaacttcntattaagacagagaaacagcaagggaccta

SEQ ID NO: 37256 - DNA, 101 bp, rice(Oryza sativa)
  misc_feature (71): n=t or c
ataatgttaattgtcaaaaacttcattttgctattacaaacgaagggactaccttaccttaggctgcgttnggctccttggcacggaaaacggagcaacga

SEQ ID NO: 37257 - DNA, 101 bp, rice(Oryza sativa)
  misc_feature (71): n=a or g
cacaagtgtgactggagcggtttacaaaagaacatgactgtcggtggatctcaagttagcttgcaaacgcncaaggcatcattcaactatgaaatgtaata

SEQ ID NO: 37258 - DNA, 101 bp, rice(Oryza sativa)
  misc_feature (71): n=a or g
gttggcatcagcttcgcctgtcgttggcttttcgccagtcggggtttctactcggaaggtcccagtcccgnttgcgggtgaagtttttccttcttcaattg

SEQ ID NO: 37259 - DNA, 101 bp, rice(Oryza sativa)
  misc_feature (71): n=t or c
catacctattgtttcagaaattggaggagaaagggtactctgcaacagccgatacttttaataccctgatnggtgcgttttctgggaaactgaatatgcat

SEQ ID NO: 37260 - DNA, 101 bp, rice(Oryza sativa)
  misc_feature (71): n=t or c
ttactgtgagacgatattatattatttaatcgtactcaagttttcacccttactcttggcagcgattgttnattcacacagaagctggttgatggaaagct

SEQ ID NO: 37261 - DNA, 101 bp, rice(Oryza sativa)
  misc_feature (71): n=t or c
ggtggcgcatgaccacctcgtcggctgcccgaatatcggccatccacgaataactgcggcagcacgagtgnggcaacgcggcgtccaggcccagtagcgcg

SEQ ID NO: 37262 - DNA, 101 bp, rice(Oryza sativa)
  misc_feature (71): n=t or c
tctgccatacatggtttccgctactgctgtcaagattgcagccatcttcatggtggcgctgaccatcggcnagctgatggctgaagcatcgtcgtcgtcgt

SEQ ID NO: 37263 - DNA, 101 bp, rice(Oryza sativa)
  misc_feature (71): n=t or g
ctattctcttttctttacataagcgtagttgttcagtaactgaacctggcctgatggcattagtgctagtnacttattattagcagtggagattaagaaat

SEQ ID NO: 37264 - DNA, 101 bp, rice(Oryza sativa)
  misc_feature (71): n=a or g
ctagccagtagggtccggacacgtgtcatattaactggatatgcttatctcggagcatgttgagctgctgnccaggacaaattctttctagtaagctttgt

SEQ ID NO: 37265 - DNA, 101 bp, rice(Oryza sativa)
  misc_feature (71): n=a or c
caagagttttttctcgggaacttggcatatatatcctggtagtagtgaactgccaaactatactagttccncgattccatatcacccatgatagaacttgt

SEQ ID NO: 37266 - DNA, 101 bp, rice(Oryza sativa)
  misc_feature (71): n=a or g
tccagtttctgttatcaaagcatatgttgaaaaagtaaaagaggctgctcaagacatggttagcaaggacncagtttcactgcaggcattggtataccttt

SEQ ID NO: 37267 - DNA, 101 bp, rice(Oryza sativa)
  misc_feature (71): n=a or g
cgcatgaactttttatgtaaaagatcgtacctttagcacttctcatatcaaatatactagaggatgccccncgcgttgctgcgggacttggttaacatcaa

SEQ ID NO: 37268 - DNA, 101 bp, rice(Oryza sativa)
  misc_feature (71): n=t or g
agaagaagcagataaagtttgccctgaagaaaagcaattcagctatcagatgaaagtacacgcacctcagngctcacaagacaacatatattatcataaca

SEQ ID NO: 37269 - DNA, 101 bp, rice(Oryza sativa)
  misc_feature (71): n=a or g
aattggtagcgtaactgactgggtctcgggtacttttcacttaacacctcagcttattacgatattgtaanttaatccacaagatagagaaatctcggtgc

SEQ ID NO: 37270 - DNA, 101 bp, rice(Oryza sativa)
  misc_feature (71): n=a or g
tacctgcttcaagcattgtttggaagtaattagctagttataaaataacgttttatagtgctcattccagncacaaatgaataatcaaaattttccaacta

SEQ ID NO: 37271 - DNA, 101 bp, rice(Oryza sativa)
  misc_feature (71): n=t or c
gggaatatgcgaatcttgcatgatactggaacatggaggtttgctgatagattctgtacaagggattttangagaggaaggttgttcatgagaaacgcacc

SEQ ID NO: 37272 - DNA, 101 bp, rice(Oryza sativa)
  misc_feature (71): n=a or g
cactgatgtgtaaacagccgtgaggtctcgatgccgcatgtacatttcatatagagattatgccgacacanaaacgatacatggaaatcaataagccagtc

SEQ ID NO: 37273 - DNA, 101 bp, rice(Oryza sativa)
  misc_feature (71): n=a or g
caacggacgaaatcctctacgataaccatacggcctaaagtgggggcaggatcagtacctccttcctcccnctccatagcctcgctgttggggagggctcc

SEQ ID NO: 37274 - DNA, 101 bp, rice(Oryza sativa)
  misc_feature (71): n=a or c
agtgttacataatattaagcaatataaaagaatctttttgacccgagacagaggccacgcaagacgcaagncatgacccattccgggccgaatccaagcca

SEQ ID NO: 37275 - DNA, 101 bp, rice(Oryza sativa)
  misc_feature (71): n=t or g
ggtctgattctgtcagctcatgttgaacgtgcaggcacatattatgcaacagactcgctgccacatatatntatttatcatcatggattagaatcataatg

SEQ ID NO: 37276 - DNA, 101 bp, rice(Oryza sativa)
  misc_feature (71): n=a or g
acatcacaggaataataaatgaattttaaatgaaaacaattaaggaagttataaactgcatgtgccgttantttggtttaattaaaagagaaagagaggag

SEQ ID NO: 37277 - DNA, 101 bp, rice(Oryza sativa)
  misc_feature (71): n=t or c
acaatgtgcatcagctgcaatgtgcaatactttgtagcaattataagacatgtgttgcattcttttttgtngggtcggccgaaagattcggtcgaccaatt

SEQ ID NO: 37278 - DNA, 101 bp, rice(Oryza sativa)
  misc_feature (71): n=a or g
ctccatctgcaccccaccctgctatctgcatccatttacatttgatcataaatgagtcagattttgcagcnaaaatgttggaaaaagaaaaaactaaattg

SEQ ID NO: 37279 - DNA, 101 bp, rice(Oryza sativa)
  misc_feature (71): n=t or c
gatgtgtgatgtaatttcatcgtggttttgatttaacccactctcgtgtatatgtaactagaaaatacccngcgcgttgctgcgggattcgtaggtaggaa

SEQ ID NO: 37280 - DNA, 101 bp, rice(Oryza sativa)
  misc_feature (71): n=t or c
attgaattttgcttgcaccaccgctagcaaaaaaccacaactaaagataagcgcaaaggtgatgacattgngacatcacctccaagcatatctgtggcaac

SEQ ID NO: 37281 - DNA, 101 bp, rice(Oryza sativa)
  misc_feature (71): n=t or c
tcttagaattaagatggcgagtggttcatagtttctgtacttgtgctagggtggtggaaattatgaagaangatgcgctaaaagatcctgctacagatcct

SEQ ID NO: 37282 - DNA, 101 bp, rice(Oryza sativa)
  misc_feature (71): n=t or c
agtactgtggccaccgacagtagatgatggggatcaaatcggccggcgggaaaactgctccgtttctgcgntcgtagggaggaacagatgagaaagaagcg

SEQ ID NO: 37283 - DNA, 101 bp, rice(Oryza sativa)
  misc_feature (71): n=t or c
tcttttaaggatcggccttgaagtttgattggcctcccccttccctctccacccgttcaaaatttcacccnaaccttatcttctcctcatctcctctcagt

SEQ ID NO: 37284 - DNA, 101 bp, rice(Oryza sativa)
  misc_feature (71): n=a or g
tccccatgcctcggtacctaatagttgggcaccgggtacataataccctaggtactagaccctaggtaacnggtctggtacctaatagttgggtaccgggt

SEQ ID NO: 37285 - DNA, 101 bp, rice(Oryza sativa)
  misc_feature (71): n=a or g
tggttgaggcctcgaagatggaaatcttcatgcaccatagcttgattcagtgagagcatgaacatctattnctttcacattacaaaataatggctgaacta

SEQ ID NO: 37286 - DNA, 101 bp, rice(Oryza sativa)
  misc_feature (71): n=t or c
ggccttcctctcaagattcttcctgatgggcaaggccaacgctcttcgtggaagaatatccagcttttagnaaacgagggatgaaaccattcttgaagcct

SEQ ID NO: 37287 - DNA, 101 bp, rice(Oryza sativa)
  misc_feature (71): n=t or c
aggtaatgattttctttgagatcacactccctggcatgctcgataatggttttccagtctttatgatcttnctttatacctagtaacttcatgccaatgaa

SEQ ID NO: 37288 - DNA, 101 bp, rice(Oryza sativa)
  misc_feature (71): n=t or g
tttttaggatttttctttatgtgttttacatgatactgatcatcttactgatgagagatatctgatgaganatacttttttctcctttcaactgtgtgcag

SEQ ID NO: 37289 - DNA, 101 bp, rice(Oryza sativa)
  misc_feature (71): n=t or c
tcaaacaccaggcatactagtatcactgcgtgcattgacatgcatgtatgaatggatgtacctgtgctgcnggtcctgtgaaacagaacaactgcagtcat

SEQ ID NO: 37290 - DNA, 101 bp, rice(Oryza sativa)
  misc_feature (71): n=a or c
gcaacttcttatttattctatttgtatcacttggtgttcctgttctgaacatgggagatgaatgtgggcantctgctgctggttcagtatcatacaaggat

SEQ ID NO: 37291 - DNA, 101 bp, rice(Oryza sativa)
  misc_feature (71): n=t or c
tactgtaataaatgtcgatcttgacgtggtttaatttggggtcacagctcactcacatatgagggcatccncaatgtttttgtttcaaaagtaagaaggtg

SEQ ID NO: 37292 - DNA, 101 bp, rice(Oryza sativa)
  misc_feature (71): n=t or c
cgaagtattttctatcaagttattcatgataattagcggtgatgaccgatcagtagtatttggtagttagnacaagtcactaatttgttgtgtgatattgg

SEQ ID NO: 37293 - DNA, 101 bp, rice(Oryza sativa)
  misc_feature (71): n=a or g
tgccttgtactgcaaaggaatttccatgagtgccgaaagggcaaattctgtttccttcttgctctgactgnttttctttgacattattgaagtgaagttga

SEQ ID NO: 37294 - DNA, 101 bp, rice(Oryza sativa)
  misc_feature (71): n=t or c
aaaaggcctattacattcaggttagacagatttgatatggtagcaggaatactgccagttaagttgttatnatttgcataaaaatattgtaagttgttaga

SEQ ID NO: 37295 - DNA, 101 bp, rice(Oryza sativa)
  misc_feature (71): n=t or c
caaaatcaaatgtctcctcttttccggaatccttgacccattgacatgtgaccactcttttattcctcgcncactcggctgttgctacctcaggatcctct

SEQ ID NO: 37296 - DNA, 101 bp, rice(Oryza sativa)
  misc_feature (71): n=a or g
cctatgcattgacgcggcaaaggctgacgtggcatccggcatatcaaaaaccacgataaaaacagcctggnggtgttaagtgtccgatattaatagttctt

SEQ ID NO: 37297 - DNA, 101 bp, rice(Oryza sativa)
  misc_feature (71): n=t or g
tgcttccatgctagttgggccgtcagccgagacctttcttgtggcccaataacggaattgtgagttacatncagccgattttacctaccgactggaaattt

SEQ ID NO: 37298 - DNA, 101 bp, rice(Oryza sativa)
  misc_feature (71): n=t or c
ttggcaagtggggatcttgatcgccggacaggagatcggctgcaattatagacaaataatacaaaacaaangaagaattaatattttgcagttgtagttat

SEQ ID NO: 37299 - DNA, 101 bp, rice(Oryza sativa)
  misc_feature (71): n=a or c
tcaatttcttcatctatctcttgatacttcctcctttgcacataaagggtgataactgtgacagccagtanaaggataagaattgctgaaattgttgcacc

SEQ ID NO: 37300 - DNA, 101 bp, rice(Oryza sativa)
  misc_feature (71): n=t or c
ataaagatatgagcgtagtttaaccggttattcgcgcatataataattacatacgagtgtagttttaacanggttagattatttagacttgatacgaatag

SEQ ID NO: 37301 - DNA, 101 bp, rice(Oryza sativa)
  misc_feature (71): n=t or g
tctcagaatcttaagctccctaaacaggcccttaatatgggtatagccgggaatatgtgtcccaattaggncatgtttagatcaatttgctgtagcaaata

SEQ ID NO: 37302 - DNA, 101 bp, rice(Oryza sativa)
  misc_feature (71): n=a or g
tttgatggccaaaactcatactatatgagactggcctctaatcttgtttatatgcatggtagctatataantgtgtgcatggggacataatatatataggt

SEQ ID NO: 37303 - DNA, 101 bp, rice(Oryza sativa)
  misc_feature (71): n=t or c
acagaactatctaggagtagtccctaacagtagtactaaggtttagagcagcatatgtgctatattatggncctgtttagttctaaagttttttttccaaa

SEQ ID NO: 37304 - DNA, 101 bp, rice(Oryza sativa)
  misc_feature (71): n=t or c
ctttgatacgttgcaccggcgttctttaatccgaaagtcacaaccacctactcaaatagaccaacaaatcncgggcacctgaaagccgtcttgtacatatc

SEQ ID NO: 37305 - DNA, 101 bp, rice(Oryza sativa)
  misc_feature (71): n=a or g
ggttacacgcagattctttcagccccaattggagcattcttatttttccggatcaccatggaatcgaatcnttgctccaaacaaggactcaactgattatc

SEQ ID NO: 37306 - DNA, 101 bp, rice(Oryza sativa)
  misc_feature (71): n=t or g
aagtctgcaacgtgatgcgaaaagaaaaaaaaagagctgcaacgtacgtgatgcgaggactgtatgaaacngctcgcttgggttgggccttaaggcccatc

SEQ ID NO: 37307 - DNA, 101 bp, rice(Oryza sativa)
  misc_feature (71): n=a or c
actacggcctccttgtgtgttgcatcggaaagcgtgcgtttgtatcatatgtgcttcgtatctactactanctccgtcccaaaataagtgcagccatgaga

SEQ ID NO: 37308 - DNA, 101 bp, rice(Oryza sativa)
  misc_feature (71): n=t or g
gtggttatgcacatcttcctgaagcaaagtatccagaagagtgattgccgcgactgcgttctgctgtgggntacgaaaaaccgccgtcccttcaacatctt

SEQ ID NO: 37309 - DNA, 101 bp, rice(Oryza sativa)
  misc_feature (71): n=a or g
cggccgcgacgcccgccacctgttcgacggaatgtctcctccaggggaggcggggaggaggggcaaggganccgcgcgcccgagcgacgatcggatagggc

SEQ ID NO: 37310 - DNA, 101 bp, rice(Oryza sativa)
  misc_feature (71): n=a or g
atgtagagaggccaacggtagaaatattttaggaatgatcttttatgcagaggtgttcacgtacaacctgngtatcccaatgaaccaaaccgcttgactag

SEQ ID NO: 37311 - DNA, 101 bp, rice(Oryza sativa)
  misc_feature (71): n=t or c
gtaaacatgtgtgactgtcttagcagcagcagcagcagcatatgattcgcgtcttgcatgcaccggctgcnatggtcgaggctgaaacggagggatgagga

SEQ ID NO: 37312 - DNA, 101 bp, rice(Oryza sativa)
  misc_feature (71): n=t or g
aatgcagaatacgcgtacactcactctaactgatatagaatacgcatacactcaccttaactgtcgatggntacgttgcctaccaacgaaaaaataattaa

SEQ ID NO: 37313 - DNA, 101 bp, rice(Oryza sativa)
  misc_feature (71): n=a or g
atgccaatcagagtattagagggtgtatgaacaaaaccttcaataaaggtactattcgagagtgtagagcngagtatcaccttgatcttcgccaacataac

SEQ ID NO: 37314 - DNA, 101 bp, rice(Oryza sativa)
  misc_feature (71): n=t or g
tgttttgcacaggttgaattagacatttcttttctttagcatgacagttttatatcaacccacgagtatgntttttgccctgcttttttcaattgttttta

SEQ ID NO: 37315 - DNA, 101 bp, rice(Oryza sativa)
  misc_feature (71): n=t or c
ctaacgaaaaggtttatcttgttgtctgtgtttgtctaacagtataaacttcttattcacatctccttganttcccctgcagtagtaaactgtgctgttgt

SEQ ID NO: 37316 - DNA, 101 bp, rice(Oryza sativa)
  misc_feature (71): n=t or c
attattctgcaaattctatgtgactgatgaatatagcttagagcaagtttaatatatagccaactactagntccaaatcatctataaccaatctaatagct

SEQ ID NO: 37317 - DNA, 101 bp, rice(Oryza sativa)
  misc_feature (71): n=a or c
cgcctgctaccataatgcctctaattctctttacgtaatctgccaaaataccaatattttgaatattatcnccttgattctgtattgctgtctgatatcag

SEQ ID NO: 37318 - DNA, 101 bp, rice(Oryza sativa)
  misc_feature (71): n=a or g
atattttaagatgaaataagacagaaacaatatatggaagaactatttttgtaattttaaagtagacgcangagtaattggtaaacaaatagggttagtgg

SEQ ID NO: 37319 - DNA, 101 bp, rice(Oryza sativa)
  misc_feature (71): n=a or g
gtgtttcaacaaaaacacaatctaatgtttgtagtggtagttgatgctaccccatcccataatgtatgacntgaactaacataaagaataaatgaagagac

SEQ ID NO: 37320 - DNA, 101 bp, rice(Oryza sativa)
  misc_feature (71): n=a or g
tcaactcttgttccatgttaagactgacaattgtggaccaactgcgtccttcaggacagtcggtgtctctnatgggaagatcaagttcgtagatgttgaca

SEQ ID NO: 37321 - DNA, 101 bp, rice(Oryza sativa)
  misc_feature (71): n=a or g
taaactgaagaaatgcctcgaacatggtagcactggtagtgcagtgttagcaacaactcgtgaaggagganttgctgaactaatgcacacaactgatgcat

SEQ ID NO: 37322 - DNA, 101 bp, rice(Oryza sativa)
  misc_feature (71): n=a or c
attgtacaaacacacagttacatgctcacatgcacaagagaatgaaaacaccaccagcacgcagcacacanactggcagccaccgatttttttttaagttt

SEQ ID NO: 37323 - DNA, 101 bp, rice(Oryza sativa)
  misc_feature (71): n=a or c
cgttgttcgatactaataaagatattggatgctttttggaagctcggcgaccaataacgtgtgatctgatntagccaaagtttaatttctcattaatcaag

SEQ ID NO: 37324 - DNA, 101 bp, rice(Oryza sativa)
  misc_feature (71): n=t or g
ttgcatttttaacttaattattctatttttgtgctcggttatgtttatttagacattttttatcttgttgngtgcgctccaactagccattatttggtaga

SEQ ID NO: 37325 - DNA, 101 bp, rice(Oryza sativa)
  misc_feature (71): n=a or c
tagtacaaaccaaccctgccgcaaaacatgtatagagaaacatactcagactatcagacataccaaagaanaagaaaaaaaaactgctgccggtaagtggt

SEQ ID NO: 37326 - DNA, 101 bp, rice(Oryza sativa)
  misc_feature (71): n=a or g
catttcatcagatagtgacgatggtgatgcctatcttccgattttatccttttttcgtagcattacacctnctaacaagtttggattaaacacgagcagaa

SEQ ID NO: 37327 - DNA, 101 bp, rice(Oryza sativa)
  misc_feature (71): n=t or c
tgtgcaattaaggtgggtcccactaaaggcaaaaaaaaaaatcagccggagctgaagctgcaggctgcagnatgcatgcacctggcataactatgattttt

SEQ ID NO: 37328 - DNA, 101 bp, rice(Oryza sativa)
  misc_feature (71): n=a or g
aatcatcaccaacaagtgctcctacatccttccaactacttgtgccaagaaccatccaagtgttgagacantatgtgaaaaaaattgatgagaagtatttg

SEQ ID NO: 37329 - DNA, 101 bp, rice(Oryza sativa)
  misc_feature (71): n=a or c
ggttcttaggatgggtttcaccgatgaaagccttgagatgctagcccacaactgtccattacttcaggatntcgagctcacatttgcaggtgttgaggact

SEQ ID NO: 37330 - DNA, 101 bp, rice(Oryza sativa)
  misc_feature (71): n=t or c
ccggactcaggaggtcttcttgtcaatgcaaatgccaagaatgatctccttgtgctccccgtgcagcatcntgggtggcacggccaagaacgtcgcctcct

SEQ ID NO: 37331 - DNA, 101 bp, rice(Oryza sativa)
  misc_feature (71): n=a or g
aagtgtgaccacaaaggtgggtcaagatatgaagctgaaattcgacttcgacatgggaagtaagtagtcantccttcgatcttatattttctaacccagaa

SEQ ID NO: 37332 - DNA, 101 bp, rice(Oryza sativa)
  misc_feature (71): n=t or g
aaaagtagcgttttatcaagggtgacaatgacaatgcagtaaatggcattttatcgaatccaaacttaaanaaaacagtggtgtatgattaattttttttt

SEQ ID NO: 37333 - DNA, 101 bp, rice(Oryza sativa)
  misc_feature (71): n=a or g
gagatcagcctccacctcagcatctatgagaaaagccccgtcagccacaaatattggggatgatctatctnatttatttggaggtactagtcttccctaac

SEQ ID NO: 37334 - DNA, 101 bp, rice(Oryza sativa)
  misc_feature (71): n=a or g
agaggatctggccgaagaattagacaagatgcaagaatcgacacaaacactaggcattggttcggttctanttgtgactgtgacgtttggtgcaatgtttg

SEQ ID NO: 37335 - DNA, 101 bp, rice(Oryza sativa)
  misc_feature (71): n=t or c
ttacaagaaatgaactaggtcatagtgtctatctatttgtagctcgcattcaccatgcaaaatggatgagncgtgtacctattttctcggttgtcttattg

SEQ ID NO: 37336 - DNA, 101 bp, rice(Oryza sativa)
  misc_feature (71): n=a or g
ataactccctgtaatgtcacttgccgattctgccactggaactgcaaagttttgagtttccaatcaatttncattgggctatgccgctcaagccagtccat

SEQ ID NO: 37337 - DNA, 101 bp, rice(Oryza sativa)
  misc_feature (71): n=t or c
ttcaccactggtgtgcctgggggaacctgcagtttcatcaaccaaactcctcatcaatttcaaatgatttntcagcacattgcattgcaacagaaactaac

SEQ ID NO: 37338 - DNA, 101 bp, rice(Oryza sativa)
  misc_feature (71): n=t or g
tcagggggtgcaagttgaggatcttggtccagatggcaatacagcacaactgtagtttaataatttccaanatcggattgactacgccgtgcaacatgctt

SEQ ID NO: 37339 - DNA, 101 bp, rice(Oryza sativa)
  misc_feature (71): n=t or g
attgcccgatcaaaaaccaagaaccccccgcaatccccaccccaagaaacccacctcgattccctcacaanatccagctcccgcggaggaattaatccgga

SEQ ID NO: 37340 - DNA, 101 bp, rice(Oryza sativa)
  misc_feature (71): n=a or g
gaaaagttctccaaaccaattgatctttttttacgtgggctggacacccaacgtgtaattgttacttatcnatttttttttctcccattttattgttcgag

SEQ ID NO: 37341 - DNA, 101 bp, rice(Oryza sativa)
  misc_feature (71): n=t or c
acaactaaaactacgaagtcacgatgtccctttacaaaatttgcctttctattgtcttgctctcccttcantttatctatgcttgtatgcatctagcaaga

SEQ ID NO: 37342 - DNA, 101 bp, rice(Oryza sativa)
  misc_feature (71): n=a or g
tatttattttttgccccttaacattcttctctttcgtttatctatcagttcatttggctgaaggaatttcnagaaatcaaggacaagtccagtgccattaa

SEQ ID NO: 37343 - DNA, 101 bp, rice(Oryza sativa)
  misc_feature (71): n=a or g
acttgaaggtggtcaaacggaagcgtctacaagggtagatcagtggcatccgaccggatattattattctnctaatttatagggttttttcagaagctgga

SEQ ID NO: 37344 - DNA, 101 bp, rice(Oryza sativa)
  misc_feature (71): n=t or g
atttgtatcctttctttcttctgaacttttcagatcactggaggctctaaattttgcttgtaatacagatnattagcactactcactgtgaagccatccta

SEQ ID NO: 37345 - DNA, 101 bp, rice(Oryza sativa)
  misc_feature (71): n=a or g
gaggctgtctgatttttcttactatggctgggtcaaggtaaactagcctaaagatagcaactcgaggctcnagggatttgtgacagatgatgccagctagt

SEQ ID NO: 37346 - DNA, 101 bp, rice(Oryza sativa)
  misc_feature (71): n=t or g
aaatcttgatagctcaggtataccgcatcatttagttcaccaggaggtactgaccatataaaatcttgcanaacttgttcccaatcggctctctgtttctc

SEQ ID NO: 37347 - DNA, 101 bp, rice(Oryza sativa)
  misc_feature (71): n=a or g
cgagctttccgagcggtcggagttgggggagagttgttccattttgattcatttcctagcttccaagtccnaaattttcccctctggcgatgtggcgtctg

SEQ ID NO: 37348 - DNA, 101 bp, rice(Oryza sativa)
  misc_feature (71): n=a or g
gcaccggggagacgtgaggtgcagacgcaagcatgggagctcgttcagctgcctgcccttacaatctgctncacccaccgcctctcttcaagtcggtgacc

SEQ ID NO: 37349 - DNA, 101 bp, rice(Oryza sativa)
  misc_feature (71): n=t or g
atttaaccaagtgctaataagagtagtttgcttacttcatgctataaatgccttttcatcttcagacaagntttggaaaatctttgcaatcaaaagttggt

SEQ ID NO: 37350 - DNA, 101 bp, rice(Oryza sativa)
  misc_feature (71): n=t or c
ggccaagtatgcccatcatagcagccttatggacacagaaagtcagaagatggcatgactttatcatcctntcttgtctgcgttctccattcggcagagat

SEQ ID NO: 37351 - DNA, 101 bp, rice(Oryza sativa)
  misc_feature (71): n=a or g
ttaacctaatggtggatctgacgcgatcgatcattcatggacagcataattaacactagtgtcacaacatncgatcgactctcaccacatgcatggacaag

SEQ ID NO: 37352 - DNA, 101 bp, rice(Oryza sativa)
  misc_feature (71): n=t or c
tgcggtagttcgtgttcgggatttgctcaaagatgaaagatcatcgccagattgtgaagccaacacaaganattatcccagaaaccaacagatggacggtc

SEQ ID NO: 37353 - DNA, 101 bp, rice(Oryza sativa)
  misc_feature (71): n=a or g
ctttcaaacatcaaagttatagggctcgatcagatctacaactttggtactaatgacctttttatttaagntcatttagaggaccaaataagcgtttcaag

SEQ ID NO: 37354 - DNA, 101 bp, rice(Oryza sativa)
  misc_feature (71): n=t or c
tagctcctgtccaaattccattctcctgctttcatccatccctttgcatctttttattgcaacaggaatgntttctataaatcccttgtaaactgtccctt

SEQ ID NO: 37355 - DNA, 101 bp, rice(Oryza sativa)
  misc_feature (71): n=a or g
gttttccatcaaaacataatgttagctagagtagcagccagccacgccatgcccttggctcaagctcaccncgcacgcacgtgtggcaatcccaccaccat

SEQ ID NO: 37356 - DNA, 101 bp, rice(Oryza sativa)
  misc_feature (71): n=t or c
tggaaaaaaactgaagtttagatccaaacagccttaggctgcgttctttcgaaggacattggggagagatnggggagactgtgactcgttttccgcgcgca

SEQ ID NO: 37357 - DNA, 101 bp, rice(Oryza sativa)
  misc_feature (71): n=a or g
aaacaacaatttgcttagcgcccttctggataagaattcttgtataattgttccaaacgctgatttcttcnttccatcctttcctgttgcactggaatctg

SEQ ID NO: 37358 - DNA, 101 bp, rice(Oryza sativa)
  misc_feature (71): n=t or c
tacaacattgctcattctgatcaatacaagcttcttaagtaaacatagcctttccagagaaagtatttgcnattttccacaattttctagataaagtgttt

SEQ ID NO: 37359 - DNA, 101 bp, rice(Oryza sativa)
  misc_feature (71): n=a or g
tcacaaggaaaaattatgttgtggaggaacccaacttctctaaattcgctcccaagttgcaaacttgattnataagtaagcattgtatgcgacttacttgt

SEQ ID NO: 37360 - DNA, 101 bp, rice(Oryza sativa)
  misc_feature (71): n=t or c
gggtgccaggcggtgcaccgccattgctacttcctccgcaccaccggcgtcgactaccgctccgagaagangttcatgagcaaggactacctcgagatgat

SEQ ID NO: 37361 - DNA, 101 bp, rice(Oryza sativa)
  misc_feature (71): n=t or c
aatgctggcaggatgagttctcagctgtgatcatgaaagcgttgatgacacttgtacatggccttgaaacnaaatttgatgctgaaatggttgcaatgact

SEQ ID NO: 37362 - DNA, 101 bp, rice(Oryza sativa)
  misc_feature (71): n=t or c
atcagtattgggattggacgcttggtgtccccgccttgcgaacgtttgtacagtcttcacataactaaacnggaatgctacaaaatagtatcccgtttaga

SEQ ID NO: 37363 - DNA, 101 bp, rice(Oryza sativa)
  misc_feature (71): n=t or g
aaataatctataatttaaaattcgctcctatgaagtaactatttgaacattatattggcgcagatgagtgnctagaagagaatccaatgtacactgacact

SEQ ID NO: 37364 - DNA, 101 bp, rice(Oryza sativa)
  misc_feature (71): n=t or g
caggacttgggttatccatcctctgcaaaaactgaacagttagtgacttcatcagttaaaggagtatcaancggcagtaaaggaaatgaagcagtcaacac

SEQ ID NO: 37365 - DNA, 101 bp, rice(Oryza sativa)
  misc_feature (71): n=t or c
gagagaggggggctgacgtggacacctagcatatggggtctacgtgtattccacgctaactcaaccaccangttggataaaaccggggtcaaaaagtgaac

SEQ ID NO: 37366 - DNA, 101 bp, rice(Oryza sativa)
  misc_feature (71): n=a or g
gtgccataggaaaaacactcattttatattactaattgaaccgtggttggaccggacagagcagcggtccnactactaaaccagtgaaccaagagctcgac

SEQ ID NO: 37367 - DNA, 101 bp, rice(Oryza sativa)
  misc_feature (71): n=t or c
aagtaatcagcatggtaggctattaaaatgtcaaatgggagacctttgccttcaaaaactagttaagtggngtgtgacgatccaattgcttcttagtttca

SEQ ID NO: 37368 - DNA, 101 bp, rice(Oryza sativa)
  misc_feature (71): n=t or c
taaggttccatggctgttacttgaccaggcaaggtttaaaggagttccaatggattatgctatggttggcnagatcactgatataaacggaaaaaaagtgc

SEQ ID NO: 37369 - DNA, 101 bp, rice(Oryza sativa)
  misc_feature (71): n=t or c
aacatatgtccaccaaaaagaacatttgagagtgcttaagtgatgtaccccatttccatattaagagtccnagaataggttaacccattgtaaatttcttc

SEQ ID NO: 37370 - DNA, 101 bp, rice(Oryza sativa)
  misc_feature (71): n=a or g
tcacacattcgacatccgcttcagtcgccttccttttccgacgctcatgtatggagaaaatccaagaaatnacattaacaagtgctcaattccaaaaaaaa

SEQ ID NO: 37371 - DNA, 101 bp, rice(Oryza sativa)
  misc_feature (71): n=t or g
aaccttttgatcaaggaggtttgggaatcagagatttgctaactgttaataaaagtctgcttattcagtgngcttggagaattcttgaaaatccaaataac

SEQ ID NO: 37372 - DNA, 101 bp, rice(Oryza sativa)
  misc_feature (71): n=t or c
tacttccaagttccaactcagataaactgtggtatgaacaaaaagtattgagatgtgagatgtatactatnatcgtcctaccaaatttcattgcaaaatat

SEQ ID NO: 37373 - DNA, 101 bp, rice(Oryza sativa)
  misc_feature (71): n=a or c
tatatgacactgaagtgtcgagtgactctgaagaggtcagaggatccatcttttcctccttattttcattnatgcatatactgcgcttcattgtgaatgac

SEQ ID NO: 37374 - DNA, 101 bp, rice(Oryza sativa)
  misc_feature (71): n=a or c
aataaggaacaaagagattaacaaaggttgggcttctatatatttgcccagctgcaggtttgatccgatcntacgatcataatatctatttaatttttttt

SEQ ID NO: 37375 - DNA, 101 bp, rice(Oryza sativa)
  misc_feature (71): n=a or g
gctgatcgacttgagcctctcaatcccatacctatgagccgcgacgagcagattctgagccatgaacgccntgtctcccttgtcgatcttaggcagggtat

SEQ ID NO: 37376 - DNA, 101 bp, rice(Oryza sativa)
  misc_feature (71): n=t or g
tgccggagcctgaaaggctggacgcactaagaaaaatattatttcgtccgtcttaaaatatagcgaactantattggattagatatgtttagagctttaaa

SEQ ID NO: 37377 - DNA, 101 bp, rice(Oryza sativa)
  misc_feature (71): n=t or c
cagaagtgttacgcactacgctaggaaggatataccatgccatcaaaacgatgtcaacctccagcttgccnacttcaaatttggtcctcatagagatgctg

SEQ ID NO: 37378 - DNA, 101 bp, rice(Oryza sativa)
  misc_feature (71): n=t or c
gcgcttttcttgccattaaaccaatcagttgatagacctgttgttgctggaacagtatggtttggaacacnacctgcgggcgcccttggagcaattgcctg

SEQ ID NO: 37379 - DNA, 101 bp, rice(Oryza sativa)
  misc_feature (71): n=t or g
atggagatgacattcggctctcggtgttggaggaaatggacatattggtccatcaacggaatccggtcgangagctccttcgatacttccgttaataggtc

SEQ ID NO: 37380 - DNA, 101 bp, rice(Oryza sativa)
  misc_feature (71): n=t or c
gcagtatagatgagtgaatagcattgtacaccattacacaacccatacataccgtcagtagagtaacatgnatgttactcctacctcctatatatattaag

SEQ ID NO: 37381 - DNA, 101 bp, rice(Oryza sativa)
  misc_feature (71): n=t or c
catccgccgctgtcctccaggacatggatctagtcgccgctgctgccttccctgcctcccaactgacgacnacccgcggatctggcctccgggatgcagat

SEQ ID NO: 37382 - DNA, 101 bp, rice(Oryza sativa)
  misc_feature (71): n=t or c
cgacctcagagggacgagaataaaagaattgccagagaccataactcaactacagcaattggttcgcctantgttgggacgctttggtgtaaaaatgccaa

SEQ ID NO: 37383 - DNA, 101 bp, rice(Oryza sativa)
  misc_feature (71): n=t or c
acaaatcattcaacccatagagaaggatctccctagaattcaaatcctagcactaagtctgtttcccctcnttttgcgccaatcccagccggcccaaccat

SEQ ID NO: 37384 - DNA, 101 bp, rice(Oryza sativa)
  misc_feature (71): n=t or g
tttcaggcttttgtgatccgtgtatatgtcgcaatgattcccaatcaaataatgcctccatatctttaatncatgaactacagccgccaattccaggtcat

SEQ ID NO: 37385 - DNA, 101 bp, rice(Oryza sativa)
  misc_feature (71): n=t or c
cagttgaagtgctagctaaatttcagaactgcaagctcgtggatttttcaaccacttttttaaatattaanattttttttattttcacatctgaacctttt

SEQ ID NO: 37386 - DNA, 101 bp, rice(Oryza sativa)
  misc_feature (71): n=t or c
ctctaagttcagtcactatacaaccatttcgcacactaactctcatcggatccaataagaaggagccgccngatctagctcttcatcggatcggcttctgc

SEQ ID NO: 37387 - DNA, 101 bp, rice(Oryza sativa)
  misc_feature (71): n=a or g
ctgcatctcagatatctccactcgcacaccaggacaaaacatcccaaattttcatgcaatggttaaggttnttgagttgtgatccaaatttgccccgcacc

SEQ ID NO: 37388 - DNA, 101 bp, rice(Oryza sativa)
  misc_feature (71): n=t or g
cctggtgagaaaatactgggtttggcgaagttttttcttggtatagggctaccaggtagcgcaaaggattnctttaaccagattgagtcattatcattctt

SEQ ID NO: 37389 - DNA, 101 bp, rice(Oryza sativa)
  misc_feature (71): n=t or c
gttgaacaactaacctcacttcccatctgagcctcaggcttgcagccacagactggatgacaaaaagaccntgaacttctgcaaatgaatcccgtgagtgc

SEQ ID NO: 37390 - DNA, 101 bp, rice(Oryza sativa)
  misc_feature (71): n=t or c
aaaagtttttatacggcttatgtttactgataggtaaacaccaaagacatgtttgatagacgatattgtgnagtggggattgtctgcagtactgcagctgc

SEQ ID NO: 37391 - DNA, 101 bp, rice(Oryza sativa)
  misc_feature (71): n=a or g
tttgtattttttttttgcaaatttctggcgccaatcttggcagtcatgccaaaaaaaattaaggtgaaatntccattttgtccgtacaatttcataactac

SEQ ID NO: 37392 - DNA, 101 bp, rice(Oryza sativa)
  misc_feature (71): n=t or c
accaatgaattcccgggattcagatttgtggcaacaatagatcctcagggatctggttatccaatgttagnacaacgtaatattcttcttctgtgagtgga

SEQ ID NO: 37393 - DNA, 101 bp, rice(Oryza sativa)
  misc_feature (71): n=a or g
gatacacttcttttttggttgtagggttttctgaagatatgccaattgccctcagcatataactatgacanctactggcctgttcaaaaggtacctcactg

SEQ ID NO: 37394 - DNA, 101 bp, rice(Oryza sativa)
  misc_feature (71): n=a or g
ttcttcattctcaacttatggtgcctcggtaactttttcatcaatcgagttggtcgaagtggatgtttcanattgtgactcgatggttgaaggctccttta

SEQ ID NO: 37395 - DNA, 101 bp, rice(Oryza sativa)
  misc_feature (71): n=t or g
tcaaaaattatctcatcattcaattcaaagctacggtagaatataatgacaacaatctagttaaaaaaatnagcagtgaactaagttttggttatatatat

SEQ ID NO: 37396 - DNA, 101 bp, rice(Oryza sativa)
  misc_feature (71): n=a or c
actctatgcttcaaagacccggtggacatgatgcaagcaaatgggacctgtgacggcataggttgctgcangatcgagacgatgagggaagtgcagggctt

SEQ ID NO: 37397 - DNA, 101 bp, rice(Oryza sativa)
  misc_feature (71): n=a or g
gatcagtcaaactcatgtttccctctttgcttaggcaaggggagatgttccaagagaatttaattgtgcanacatggtatatggtgtttttgtttccttag

SEQ ID NO: 37398 - DNA, 101 bp, rice(Oryza sativa)
  misc_feature (71): n=a or g
ttaacatagtaaaacaatttgttcgtagtcaataggaattaaccgtggaccgtggtaacttaagttggatngaagtttactccacttattattttcttggg

SEQ ID NO: 37399 - DNA, 101 bp, rice(Oryza sativa)
  misc_feature (71): n=a or g
atgaaatcattcccggtcaggaaacaaatgaacacaaagtcatctatcatcctctcaacatcaagagtctngatcgggttcggtatcttcatatcaagctc

SEQ ID NO: 37400 - DNA, 101 bp, rice(Oryza sativa)
  misc_feature (71): n=t or c
acccataatctcctgcatcgctttattgcccagacagttggattggacagatcagggtttacgattccganaggccctttcgtttcgggcactggcggaat

SEQ ID NO: 37401 - DNA, 101 bp, rice(Oryza sativa)
  misc_feature (71): n=a or g
ttatagttggcccacgtcttttaataaattttgataaagttctcaacttaccttcctcgttttttctcgtncatgtttttcaaaatattaaacggtgtatt

SEQ ID NO: 37402 - DNA, 101 bp, rice(Oryza sativa)
  misc_feature (71): n=a or c
ggcgtgattagggttgggaccatcggtccaattgctgtatctaatatcaaaatcgttaggtcactttggcntggttttgttccagttcagactggactcga

SEQ ID NO: 37403 - DNA, 101 bp, rice(Oryza sativa)
  misc_feature (71): n=a or g
tttagcttccagcggtgccttagcacgattggcaaggaccttagcaacaaagcatgcacacagacttcccncaagtaacgaaacgataacggccagttcat

SEQ ID NO: 37404 - DNA, 101 bp, rice(Oryza sativa)
  misc_feature (71): n=a or g
gtcgtgtctcggtgagatcttcaagtttgatgtatctctaactttgaagccggaatccgatgaagggaccntagctggcacggtgtcggttttggaatcct

SEQ ID NO: 37405 - DNA, 101 bp, rice(Oryza sativa)
  misc_feature (71): n=a or c
cagaagcaagcgtggcattaattaatcgtgacggaagtgtcatcaaagcatctgcatgcacgaacatacanacatttgatgaaacattaatgtattatatt

SEQ ID NO: 37406 - DNA, 101 bp, rice(Oryza sativa)
  misc_feature (71): n=t or c
tcaatcccaacacattgattactacttaagtaagactatcatgttgactcgacgaatgaagaaacacacanatatatatttagcctagctaaatttgtata

SEQ ID NO: 37407 - DNA, 101 bp, rice(Oryza sativa)
  misc_feature (71): n=a or g
ttacccactgtattcagcaagtcataccggaaaaggagttgggccaagaatgcagaaatgaggagtttganaaaagggagtggttggctatctcaatgggg

SEQ ID NO: 37408 - DNA, 101 bp, rice(Oryza sativa)
  misc_feature (71): n=a or g
aaatatttctgtttgtttgtatatatgagctcaaatattgatgatcaagtttacagttcctggttaggganagatgaggaaatcatgttagacgtaacaac

SEQ ID NO: 37409 - DNA, 101 bp, rice(Oryza sativa)
  misc_feature (71): n=t or c
cggagctcgagaacaacctgtcaaggatccgaggctcgctgcggatatcgcacaccggcctgcaccaactngccggcgagtgtggtgtcacgactaccatc

SEQ ID NO: 37410 - DNA, 101 bp, rice(Oryza sativa)
  misc_feature (71): n=a or c
tgttgttgtttttttttttttaccttttgttgttttagacttctaatagtagggcctgtttagcataactntatcttcagtttcaccttttctggagctgg

SEQ ID NO: 37411 - DNA, 101 bp, rice(Oryza sativa)
  misc_feature (71): n=t or c
aaagacgcattgatcgtccggaaaaaaaaaaggaaccaaacatgagtgacagggtggaccagtacgggggnagctccgcgaatccagaaaccccacaaaga

SEQ ID NO: 37412 - DNA, 101 bp, rice(Oryza sativa)
  misc_feature (71): n=a or g
tcctttgaagctgtctgtctaactctggatgcaacagtgacagcaaaattaactgtagagaagctggtacnccattctgggggagaaatttcatcttaggg

SEQ ID NO: 37413 - DNA, 101 bp, rice(Oryza sativa)
  misc_feature (71): n=a or g
atgcaaatcacacatagagtttggaatatggccagtgatacgattggagaagagatgcagataagataagncaaggtcatctccaaagttcgatggcagag

SEQ ID NO: 37414 - DNA, 101 bp, rice(Oryza sativa)
  misc_feature (71): n=t or c
acacacaccacacctcacagactcacacacgcacatgccgccctcgcacaatcactagggcggcacccacngtgcctatcacatcgcctaacaaaaaccga

SEQ ID NO: 37415 - DNA, 101 bp, rice(Oryza sativa)
  misc_feature (71): n=t or c
tcttatttgaaaaaaaaaacattattgtctaagactttaattcactgggctaacggaagtaaactcataanggcaatctgatccgcagtagcgtcacacgg

SEQ ID NO: 37416 - DNA, 101 bp, rice(Oryza sativa)
  misc_feature (71): n=t or c
gccgatgacaggaggagatggtccacctccatttggaattaatcccgaggcatattcaatgttcctgccantgttactttggcgaggaggagagaactctg

SEQ ID NO: 37417 - DNA, 101 bp, rice(Oryza sativa)
  misc_feature (71): n=t or c
gttcgcttttagataagccataaatcaatatcttcatagtcgctttcagacattccatactccccatcagngtcatcactattgccctcttctttaggaat

SEQ ID NO: 37418 - DNA, 101 bp, rice(Oryza sativa)
  misc_feature (71): n=a or g
ggcgtcgtcgccgtcgttgccggagccgtgcgtgaagaggaagagcttcttgatacgccggacggtcgccncgccggcgaaccgcaggcggtcagggtgca

SEQ ID NO: 37419 - DNA, 101 bp, rice(Oryza sativa)
  misc_feature (71): n=t or c
accagatcgacaccttttggtagagaaaagctcctagggatacttgtcatgatggtgtggttgaagtttgntggcatacaatcgtcatatttgcgcgcagt

SEQ ID NO: 37420 - DNA, 101 bp, rice(Oryza sativa)
  misc_feature (71): n=a or g
aatctaaaagtggcaaatagttaaattcccctctttcaccaatattatgatttcatgtcaagatctatatnatggttatttccttagttaatgatttatag

SEQ ID NO: 37421 - DNA, 101 bp, rice(Oryza sativa)
  misc_feature (71): n=t or c
gccgttctgatctccattataccacctcggaatcccacggacaccgcgcgccccacataaccccatgaccnggatccctccccgccacccatggacgctcc

SEQ ID NO: 37422 - DNA, 101 bp, rice(Oryza sativa)
  misc_feature (71): n=a or g
ctaaatgctcggttgaggctgtcctcctgcacaaatcattccttttgtctgaagaactggcctccccatcnatcaaggcatgcagcttgctaaattgtgaa

SEQ ID NO: 37423 - DNA, 101 bp, rice(Oryza sativa)
  misc_feature (71): n=a or g
tctatggtgttgtggcgtcacagtttggtaaaaatggtgatgttctttcggttcccggtgggagccctacngtagtgaagcaattcttggaggacaaccta

SEQ ID NO: 37424 - DNA, 101 bp, rice(Oryza sativa)
  misc_feature (71): n=t or g
gccgacgccgtcgcagttgccgctcaccgcgctgctggaatcgttgcagtagcacaggcagccggtgtacnagacgtggtcgtagtcgtcactgcccacga

SEQ ID NO: 37425 - DNA, 101 bp, rice(Oryza sativa)
  misc_feature (71): n=a or g
gggaatggtttatggttccaactcccaagtcgttcgtgcatcattcgattccgacatcctcgatattttcnataaatgggattcttctgatgttcttttct

SEQ ID NO: 37426 - DNA, 101 bp, rice(Oryza sativa)
  misc_feature (71): n=a or g
ccattcctgcccacaaagcaaccgtctgtgggaacccaatcatcaactttatttcctaccacttttgtgcntccatccgtggagttgcaaaagaatgcctc

SEQ ID NO: 37427 - DNA, 101 bp, rice(Oryza sativa)
  misc_feature (71): n=t or c
gtcctatgctaatccaatttggttgtaattgagtaaattaattaactttgagtgtggcaggtggcgttcgngtcgctcaattcgcgcgtgtacaccaatgg

SEQ ID NO: 37428 - DNA, 101 bp, rice(Oryza sativa)
  misc_feature (71): n=a or c
gcattaatttttacatgagaaatacattgcccaattcacataggatgtctcgggagcccaggctatgctanccgtcgcaatgggcgagctcgagcgcgttc

SEQ ID NO: 37429 - DNA, 101 bp, rice(Oryza sativa)
  misc_feature (71): n=a or g
agctcccctttgtaggggaggttactgcagtcttcaactctctgatttgttgttgctttctggtgccctcnagctagtgttcaagatgtcctttgtcgcct

SEQ ID NO: 37430 - DNA, 101 bp, rice(Oryza sativa)
  misc_feature (71): n=a or g
ctaaaaataaattaaacggtttaatgctgcaaattattaaacttgccaagaacagtaattaaataatgcanaacgttaaataattgtgaatacacacataa

SEQ ID NO: 37431 - DNA, 101 bp, rice(Oryza sativa)
  misc_feature (71): n=a or g
actttaaaattgacttataaacaccaatacacacacgtggtgacgtcagatattaactcgtggaatcaacnggcagcccacacgaagcttacgtacacttc

SEQ ID NO: 37432 - DNA, 101 bp, rice(Oryza sativa)
  misc_feature (71): n=t or c
gataaggataagaatttagggatgggcgtagtttatcatatatggttattactgttgggatacgcgtaggntacgatagcataaatcaaaattttatatcg

SEQ ID NO: 37433 - DNA, 101 bp, rice(Oryza sativa)
  misc_feature (71): n=a or g
atccatggatgttataacaagctttgagaagttaattgcgtacgatgcatggtactcctgggtgggtgagnatgtaggcgtagcccagaatgaccttgtca

SEQ ID NO: 37434 - DNA, 101 bp, rice(Oryza sativa)
  misc_feature (71): n=t or c
ctatggaagctctggcctcaacttatctattcatagggtgtgttcgctactccccgttcccagcctcgaanagtatacaaggaaaacggagcggttcatta

SEQ ID NO: 37435 - DNA, 101 bp, rice(Oryza sativa)
  misc_feature (71): n=t or c
tcacaaaagctaatccaatcattcagtgagtgagtcagtcaatcagtccacaagcaaccaaatcactccantaaaaaaaaagaagatattcacaagcgcgc

SEQ ID NO: 37436 - DNA, 101 bp, rice(Oryza sativa)
  misc_feature (71): n=t or c
gatcaataccccctcaatccctcaggccataaggtgatttcttccacacatctgtttactagcctagtatngattgtggttgcccacaaaagaccacatca

SEQ ID NO: 37437 - DNA, 101 bp, rice(Oryza sativa)
  misc_feature (71): n=t or c
agatcctgcggaactgcaaggtttcacgtattcttccacttatagctgacacggcaaagaatgatcgcagngctatccttcgtgctaggtacttgtgttta

SEQ ID NO: 37438 - DNA, 101 bp, rice(Oryza sativa)
  misc_feature (71): n=a or g
ttgcgcggcgcctagggcttccagataggggcattgaaattgaagcttttatgccaagaagttgtgcgttntaggccgatgtcgtcatgtattcgccgtga

SEQ ID NO: 37439 - DNA, 101 bp, rice(Oryza sativa)
  misc_feature (71): n=a or g
acgcagttgtcccctgaagacggagccgaatccgccttcgccaatcttttcagaaaagtttttggttgcanaacgcaaatctttgtacctgaaagccacga

SEQ ID NO: 37440 - DNA, 101 bp, rice(Oryza sativa)
  misc_feature (71): n=a or g
tggaaactcgaattatcagactcgcaattcgatattggtacttgtcacgatacgacacatggtgttattcnattgtgctcccagcttcagcagctatatgc

SEQ ID NO: 37441 - DNA, 101 bp, rice(Oryza sativa)
  misc_feature (71): n=t or c
ttttatggtggtctctacttgttgtttcctacaaccaataatatcccgcgctttgcttaatgagttttacncgataccccgcgttttgctgcgggatatat

SEQ ID NO: 37442 - DNA, 101 bp, rice(Oryza sativa)
  misc_feature (71): n=t or c
gtccgccacccaccgggaggagatttcgccgtccttcttctggaacgcctcgttccttcgtgccccgcatncggagacaacaggtcgtcgtgccgagccgc

SEQ ID NO: 37443 - DNA, 101 bp, rice(Oryza sativa)
  misc_feature (71): n=a or g
aacatcatattctgttcataggatgccaataacggtttacatgcatgatgaagatgctggtggtttaatancaattgctgaatatggccaacaatatggaa

SEQ ID NO: 37444 - DNA, 101 bp, rice(Oryza sativa)
  misc_feature (71): n=a or g
ggtggcgggctagacctaacgccggagaatgaggttagttgccacagattcaggcctccatgctatcgccncctaggactgtgtgtagagaagcctggtag

SEQ ID NO: 37445 - DNA, 101 bp, rice(Oryza sativa)
  misc_feature (71): n=t or c
caataatataaagtccgagtgtcctccacagaaaagtagcaatggaagcaagaaaaatactaggatttganggtatctgcaggtgcatcggtggcaccaac

SEQ ID NO: 37446 - DNA, 101 bp, rice(Oryza sativa)
  misc_feature (71): n=t or c
gttggcggcagcggaggtgaggaggaggaggccccatgggcaacttatcttttatgaaattttccctctcnatttgaacataatataataaaatacattgg

SEQ ID NO: 37447 - DNA, 101 bp, rice(Oryza sativa)
  misc_feature (71): n=t or c
gcgcttcaagtccgcgggtttggcgtccgcgagccgagccgacccaagatgagccgatagcgatcttcttntccgaccaatcgcgagtggacggctcgctt

SEQ ID NO: 37448 - DNA, 101 bp, rice(Oryza sativa)
  misc_feature (71): n=t or c
ctctctcccctcggtcttcgttcgtggcagtacgagtgaaagtgcatgttacatgaatgaagagaagctgntattaacataatttagatgttttttttctc

SEQ ID NO: 37449 - DNA, 101 bp, rice(Oryza sativa)
  misc_feature (71): n=a or g
taccgacctagtctctaagaggtgtttataggttaaaggtgtgtacattcatacaagtgaatgtgcgtgcntatgtgaatgttcacgtttgtatcatgtgt

SEQ ID NO: 37450 - DNA, 101 bp, rice(Oryza sativa)
  misc_feature (71): n=a or g
tttttatttctatgttacttttgtgagagtaactaaacatttcatagccaacttcaattctattgagtgtnaattttgtgaagatctttatgcttcatttt

SEQ ID NO: 37451 - DNA, 101 bp, rice(Oryza sativa)
  misc_feature (71): n=a or c
tgacaggacgaaaatgagggcatatgaaaatccagatgagtttgctgatgcacttgctaaagggagccaanatggaggtattgcagcagtcgtacatgaag

SEQ ID NO: 37452 - DNA, 101 bp, rice(Oryza sativa)
  misc_feature (71): n=t or c
cgaatagtccttgtcgcatcctttggcttcgtcgtacagaagctccttcgctgtttttttcaacgcttccnaactgtccaaccctcgtcttgtaccagtta

SEQ ID NO: 37453 - DNA, 101 bp, rice(Oryza sativa)
  misc_feature (71): n=a or c
gtctacataaattacaagaactgaatcactgatttccaacacacacagctctagcagggttgatcctattntgacaaatcgagctcttttctgctctttat

SEQ ID NO: 37454 - DNA, 101 bp, rice(Oryza sativa)
  misc_feature (71): n=a or g
gttttatgcaggtattgacggcattattttggcacttaacaatcgtcaacacctatctatagctccatgcntgcttgaagaatgttcaattgaccaagcgt

SEQ ID NO: 37455 - DNA, 101 bp, rice(Oryza sativa)
  misc_feature (71): n=a or g
acgtgttgggggggggggcacgatcgcgttgtggaggtcatggcctcaagtaagaggacgcggcggatatngtgcctgccttgttgtcgtcccccgcttta

SEQ ID NO: 37456 - DNA, 101 bp, rice(Oryza sativa)
  misc_feature (71): n=t or g
tcaacagagaatgaagcccctttctccagcagtgatttggttatgtcttaattttacccacattgatttgngtatgtctttttttttatttaatgtgtagc

SEQ ID NO: 37457 - DNA, 101 bp, rice(Oryza sativa)
  misc_feature (71): n=a or g
cccatgcacatgtcgggccaaactcaacatggtcagcgttgattcggttacaacacttccaaagagaaggncccctacgtactgtccggaaagatcaagca

SEQ ID NO: 37458 - DNA, 101 bp, rice(Oryza sativa)
  misc_feature (71): n=t or g
ggagcgccgcagaatctttcccttgtttgtgtgtctacgaccagtgaaggcagcagctagcttcttttgangtaccttctgtgcctctgcttggggaacct

SEQ ID NO: 37459 - DNA, 101 bp, rice(Oryza sativa)
  misc_feature (71): n=t or g
aagcccaaagacagactaacccacaaaatttatacttatggatcaggccaattcttgtagccatggtattngagtattttggtaagtactactctgtccca

SEQ ID NO: 37460 - DNA, 101 bp, rice(Oryza sativa)
  misc_feature (71): n=a or g
ggccatagttgctaccgcacacagcaccgccaccaccatcaccacccttctcatcatcgccatgaccatcntctcacctaaggtggttactacgatttata

SEQ ID NO: 37461 - DNA, 101 bp, rice(Oryza sativa)
  misc_feature (71): n=a or g
atcataaggactgcttttagcctcttcaaccacatgttttgcacttccgttggaggcaccctccttgtgtnaggcctcgtgcttcttcttcttctcaggtt

SEQ ID NO: 37462 - DNA, 101 bp, rice(Oryza sativa)
  misc_feature (71): n=t or c
gtacatatacctgtagggtagaaatagaatcagcaagtataagagcttttatatatagctcatctattttnatcatgtgtatattctctaaatacaaactt

SEQ ID NO: 37463 - DNA, 101 bp, rice(Oryza sativa)
  misc_feature (71): n=a or c
tcagggtaaactttctttaatttttatgcaggacatgtgtacagatcttagggtgctagttgcatcagganaacaccaagaggcaagaacataccctattg

SEQ ID NO: 37464 - DNA, 101 bp, rice(Oryza sativa)
  misc_feature (71): n=t or c
tatcttgtggagcagatccacgcacttcacttttagaaaactgaggatctagtattgtttggttcaactcnggctctaactctgccatatgcccaaatcac

SEQ ID NO: 37465 - DNA, 101 bp, rice(Oryza sativa)
  misc_feature (71): n=t or c
tccaggcagcaggctcacatcaggcgatcaagatacgcagccacctcgcagtctaactgcaaggaaggganaacaatacagagaaatgtgtcaggtttggc

SEQ ID NO: 37466 - DNA, 101 bp, rice(Oryza sativa)
  misc_feature (71): n=t or c
gaggggttctttatgagataatttgatgctttcaggcaacaaagcttttgcccaaattgtatcagcaatgnagaatacaatcaatgcttgctccaatgtct

SEQ ID NO: 37467 - DNA, 101 bp, rice(Oryza sativa)
  misc_feature (71): n=t or c
acaccaagccaagccaagagattccagaagttggagctcaagcagatagtcctcgcggtcaagatgccagncacgaccgaaggtctggatctccttcaaag

SEQ ID NO: 37468 - DNA, 101 bp, rice(Oryza sativa)
  misc_feature (71): n=t or c
tcagccgttctgtcacaacatgatctggttagagaaagcggtgagaggtatatatatgtacttttctagcngtgatgctgctacaagcgtttttgtcgcca

SEQ ID NO: 37469 - DNA, 101 bp, rice(Oryza sativa)
  misc_feature (71): n=a or g
tcgtcgtcttcaggtctctctcacaccttttcctttttttattcactcgcgtgtatgatgtagcagcaagnatgataaacctctgctgaatttgtgcttaa

SEQ ID NO: 37470 - DNA, 101 bp, rice(Oryza sativa)
  misc_feature (71): n=a or g
tcaagcataggaaatagtttttctgaggtcaagatactagggaaattcgctggagctgtcggaaattacancgctgatgttgttgcatatccagaagttga

SEQ ID NO: 37471 - DNA, 101 bp, rice(Oryza sativa)
  misc_feature (71): n=t or g
cactacttggctggctttgttcgggaacagagacaattgatctatcttgctcatggaaactaactacaganttttcttgttcatgaaaaccaacaattgat

SEQ ID NO: 37472 - DNA, 101 bp, rice(Oryza sativa)
  misc_feature (71): n=t or c
tcaactgatctaaccagccaaacaacatcaattgtacacacttatccatgacacggtaagccaggatgatncatacgggctatgctagactagtgcagata

SEQ ID NO: 37473 - DNA, 101 bp, rice(Oryza sativa)
  misc_feature (71): n=a or g
cgtaaactaaacacacctatagaacattcaaggactgcaactactaaatggacaacactaggtttgatttntagactatgttttattgatgttggagcaat

SEQ ID NO: 37474 - DNA, 101 bp, rice(Oryza sativa)
  misc_feature (71): n=a or g
aaataagaaattttttgtctagtccttggaaacatggcacaagcaaaaccttcataactctctctacactnatcatgttaaggtaaagcaatatcaaaatg

SEQ ID NO: 37475 - DNA, 101 bp, rice(Oryza sativa)
  misc_feature (71): n=a or g
tcagatttacacaacctttgtttatgttttctagctctcatttccctggagtaatggcacgctcctttganaaagttttctagttctcatttccctggagt

SEQ ID NO: 37476 - DNA, 101 bp, rice(Oryza sativa)
  misc_feature (71): n=a or g
tggctttacaaggacatcagtaaggtgtattcactggatctggatccgctgtctttttacaaagactttantaagcgggggctgcgcttatatattgatga

SEQ ID NO: 37477 - DNA, 101 bp, rice(Oryza sativa)
  misc_feature (71): n=a or g
cgtttagaattcagcttttatagggatgaattagagcatgtacaatagcactattaacattaacagtgctngctataaacatattttaataagataaaaga

SEQ ID NO: 37478 - DNA, 101 bp, rice(Oryza sativa)
  misc_feature (71): n=t or c
gtcagaagaacagtactattacctccctcccattttaattacagatgtgagtttcgtgttatttatttttntcttaaaaaatagtcacaccaaaagtaata

SEQ ID NO: 37479 - DNA, 101 bp, rice(Oryza sativa)
  misc_feature (71): n=a or c
tatgctaaaaatacttatattttgggatggagaaagtacatttttaataaccgtgtcaacctaaaaaactnttatatatcatgaggcaaatgtaataataa

SEQ ID NO: 37480 - DNA, 101 bp, rice(Oryza sativa)
  misc_feature (71): n=t or c
catctctcaaatttgtcccctcccatgtctacgactacgaggaagaggccgaaaagagcaaaggcgttggnttgccagtgcaagtttctcccgataggtgg

SEQ ID NO: 37481 - DNA, 101 bp, rice(Oryza sativa)
  misc_feature (71): n=a or g
ataaatattggttctaaggagaaatctcgatctactatatgacaaattgtatactcttgactatattgtcnactttttcactttgctattgaatatgacga

SEQ ID NO: 37482 - DNA, 101 bp, rice(Oryza sativa)
  misc_feature (71): n=t or c
gtccaatgggtgattgaacactttgtaagaaactgcccttgtacaccataaccaccgtgggtagcacttgntgcttcagggatcgatggtggcttagctgt

SEQ ID NO: 37483 - DNA, 101 bp, rice(Oryza sativa)
  misc_feature (71): n=a or g
ttgcaaaatgtttcattgaaaaatgttcacatgtttcatcaaccagagaaaaatgtttcatcgcatagacnaaagtgtttcaaccaaattcaatcaaaaca

SEQ ID NO: 37484 - DNA, 101 bp, rice(Oryza sativa)
  misc_feature (71): n=a or g
aggtagggacggtggcggcgcattgtgctggcgatggtaatggtaagttgtcacgaggcggctagtgtagnggaggttcgggaattcgactagtcgagtga

SEQ ID NO: 37485 - DNA, 101 bp, rice(Oryza sativa)
  misc_feature (71): n=t or c
ctaaaattacatatgtaagtgttacgtaagtgggatgtaagtggtgtgtaattaactttgttagtcatctntaataattacacttaattaacacattacct

SEQ ID NO: 37486 - DNA, 101 bp, rice(Oryza sativa)
  misc_feature (71): n=a or g
gaaaggaggaagtatatatcacaagaatagtttggatattaatttctcagaatgcaatggaacgttgcgcnaaaataaataaaatgtatttaaaggagaag

SEQ ID NO: 37487 - DNA, 101 bp, rice(Oryza sativa)
  misc_feature (71): n=t or c
aaatacgcaacggttagtgatacgtgcagaacatggcccttagcagtatggcaaacctagagaacttgaanatattttcagaaatgagcctccacctagta

SEQ ID NO: 37488 - DNA, 101 bp, rice(Oryza sativa)
  misc_feature (71): n=a or g
tataattactattatgacttgatctataaggaaagactctttaagtataaattatattttgcatgtttgcntaaaatttttaaataagataaatgatcaaa

SEQ ID NO: 37489 - DNA, 101 bp, rice(Oryza sativa)
  misc_feature (71): n=t or c
gtggtggaagaagaaaaggctagtcccatagagcaaggaaaaactgcagcgcttgaagaacaagcgctcangagagaatctgccatgctaaaccaagaagc

SEQ ID NO: 37490 - DNA, 101 bp, rice(Oryza sativa)
  misc_feature (71): n=t or c
tttccgaagcgaattggtggaaaaaccgtgtgttacgatcgccatactgtagccagtgtgtcttcgcgcgntggcgccaatacagatcacattgatcttct

SEQ ID NO: 37491 - DNA, 101 bp, rice(Oryza sativa)
  misc_feature (71): n=t or g
cggtggattccacagccgaggcgtttattgcatttccccgagcaagaataacgctgatgtgagcatcgacncgtctcacgatgtgagccgcaaaagcacat

SEQ ID NO: 37492 - DNA, 101 bp, rice(Oryza sativa)
  misc_feature (71): n=a or g
ggtaaacagggttgaccacagcaataaactcgtgggcatcttccaaaatcatagtttttgtacttctccanctgtgacaaaaaatattaacaactgtcaat

SEQ ID NO: 37493 - DNA, 101 bp, rice(Oryza sativa)
  misc_feature (71): n=a or g
agccatatatctaagttttgggccatgtgctcaggtttgacgactatagaccagacggttgtcgtaaaacnatgaaccgatactagtgcaataccataacg

SEQ ID NO: 37494 - DNA, 101 bp, rice(Oryza sativa)
  misc_feature (71): n=a or g
catcctaggcagctttatgtacccatcctatccattcttatctacttaggccctgtttatttcgcaaaatnaaaatttttgggtgtcacatcagatatgtc

SEQ ID NO: 37495 - DNA, 101 bp, rice(Oryza sativa)
  misc_feature (71): n=a or g
cttagtttcaggggatgctataaaaggaatcccgttcggatgggatggcaccggttaggtatcagatgatncttaccaagtatcatacgattcttactagg

SEQ ID NO: 37496 - DNA, 101 bp, rice(Oryza sativa)
  misc_feature (71): n=a or g
tcatacttcttttacacgtctaaagacgtggaccgataaaccagccacaacagtacaacaccatgcatatncctatatcctactccctctatcccatatta

SEQ ID NO: 37497 - DNA, 101 bp, rice(Oryza sativa)
  misc_feature (71): n=a or g
agttcatgactgccgtcaaagaggtagcacaacaactgcgaggcgcttacgagaacctagataagaagtgncacgaagagcggttcgtcgagttgatggtc

SEQ ID NO: 37498 - DNA, 101 bp, rice(Oryza sativa)
  misc_feature (71): n=t or c
ctcgccttcgtcatctttgtcggcaccttcctccggaggctcagtcactggaacccttcgacgagcttganggctacctcctcgggagcttctcctgcctc

SEQ ID NO: 37499 - DNA, 101 bp, rice(Oryza sativa)
  misc_feature (71): n=a or g
atagttcaggggtgtaattcgtacttttttctttttataataggttgaaatcgaacacagctgacaacggntgaaaaattctaatgataatatacattttt

SEQ ID NO: 37500 - DNA, 101 bp, rice(Oryza sativa)
  misc_feature (71): n=a or g
caatgtgagctactcctagagtgtcctcactaactgaagacactctaggggaactcagctcgcaatgaagngtatccctggatgggctcctcaaaatataa

SEQ ID NO: 37501 - DNA, 101 bp, rice(Oryza sativa)
  misc_feature (71): n=a or g
tttcttatatcagttacatcatttcagcgcaatccagatgcttgtgagtcgtattccgaagttttccttgnaagatattttaccactcttgaggagatacc

SEQ ID NO: 37502 - DNA, 101 bp, rice(Oryza sativa)
  misc_feature (71): n=a or c
cacaaaaatcctaatcagttgggttacgtttacttcggtatgaactaatgattggtcttatctattaagtnaaaaaaaatgattgatcttatctagtttag

SEQ ID NO: 37503 - DNA, 101 bp, rice(Oryza sativa)
  misc_feature (71): n=t or g
gtgttaaggccactttctctgtgtctaacctaagtgaaaggacgagcaagccaggagcgggggctgctgancgcgggtgcatagggcttgcagcggctgat

SEQ ID NO: 37504 - DNA, 101 bp, rice(Oryza sativa)
  misc_feature (71): n=t or g
ccttctgcagataacactgcattttctgggtgcacggataacttttcagaataaaagggtgtttccacagnaataggcatatcatagttggtgtgggaact

SEQ ID NO: 37505 - DNA, 101 bp, rice(Oryza sativa)
  misc_feature (71): n=a or g
tgccatgcaatccttgaggtgatcacaccggagttgggtagagactatgtcaatagttttatcaagaactngagttcaattagtgctcaagtgatggggtc

SEQ ID NO: 37506 - DNA, 101 bp, rice(Oryza sativa)
  misc_feature (71): n=a or g
tcctgagctcaggagtggctccatcttcaaacatggattaaaaaaagtccccatgatgtaactctgaaaanattgtatttttatttttaaaaagtgtatga

SEQ ID NO: 37507 - DNA, 101 bp, rice(Oryza sativa)
  misc_feature (71): n=t or c
tttctttcttcactgcatcaacgcactgcaaatcctttggtaaccactagaatggatgctaacatggacantcctttggagcaaaaacagaaggacagctc

SEQ ID NO: 37508 - DNA, 101 bp, rice(Oryza sativa)
  misc_feature (71): n=a or g
gaagtaaacattgtttctcactgattaaaatttgcaggtagccctgagtgcaatttatgtcctgagccccntcgacattcttcctgaaagtaagttcgata

SEQ ID NO: 37509 - DNA, 101 bp, rice(Oryza sativa)
  misc_feature (71): n=t or g
agctggctttggagaagggcaagcgagtaggtgtagtcgaaaagatcactgagacaaccactcaggactcngacttggcgtacccagattccgatcttcat

SEQ ID NO: 37510 - DNA, 101 bp, rice(Oryza sativa)
  misc_feature (71): n=t or c
tgaggggccggtcgcgctgtaacggtcgaagcggctttggcaacgtacaccggagcttgatatacttgtcnagagacagccgaagcctgtgcagcaagggg

SEQ ID NO: 37511 - DNA, 101 bp, rice(Oryza sativa)
  misc_feature (71): n=a or g
gcaccacacccagttgtaagtgcacctgttgcaaatggcttgcagtgggtacccagatctcactcatctgnctctgaaatggacaatggtgaggattatga

SEQ ID NO: 37512 - DNA, 101 bp, rice(Oryza sativa)
  misc_feature (71): n=t or c
tgctagatcgagctcgtagcgtgcaagggacaggaaatgatgtgtgtttatgttgggtggcgtatttatgnttacgtactactagtaattcacaatgtaag

SEQ ID NO: 37513 - DNA, 101 bp, rice(Oryza sativa)
  misc_feature (71): n=a or g
tgtataatctttttgtgtataatagatcagataattatttacgatttgacacatcagaatggtttgtcttntaatataggctgcgaggatgaacagttcac

SEQ ID NO: 37514 - DNA, 101 bp, rice(Oryza sativa)
  misc_feature (71): n=a or g
gctgccagccggccgccgagagattaacgatgagatggctgggttatgacttagagcatctccatcagtantcactattttagagtcatcaaaggttaaat

SEQ ID NO: 37515 - DNA, 101 bp, rice(Oryza sativa)
  misc_feature (71): n=a or g
acatgacatcaagaaaatagtgctaagtaaatatttatagggcctgtagtaggtatttacctggtgagatntccactgaaactgaaagctattgagatcat

SEQ ID NO: 37516 - DNA, 101 bp, rice(Oryza sativa)
  misc_feature (71): n=a or g
ccgcccgattgagatgagggtatccgttctagtgtatcgcccctcccttaaacataggggagccaaggctnattaaaaggaatcaatcaaaagtgtttgca

SEQ ID NO: 37517 - DNA, 101 bp, rice(Oryza sativa)
  misc_feature (71): n=t or c
aagaagtgtgagctagcctatatatattgcattggctactgagtgagcagggtaaggaacaaaacacatancagatttccccaaacaccagctactactct

SEQ ID NO: 37518 - DNA, 101 bp, rice(Oryza sativa)
  misc_feature (71): n=a or g
tcttaattgacacagtagcaacatcgtcatgcacaaaggaaacttttatcatggatcttgccggctggccntgacattgttgatgatttcagatcaatgag

SEQ ID NO: 37519 - DNA, 101 bp, rice(Oryza sativa)
  misc_feature (71): n=a or g
caagaggaaacaagtgtgcccatcatcatcgtcgacgacagccgcctcgcatgctgtgatccccgccaccngtgccgcccctgtccaccgcatcaacaaat

SEQ ID NO: 37520 - DNA, 101 bp, rice(Oryza sativa)
  misc_feature (71): n=a or g
aaaatcactaatatttcgtgccttatacacttgaatttggcagccaataatatatcgggtgcaatgcctcngcatttgtcaaattttacaagtatgtcagg

SEQ ID NO: 37521 - DNA, 101 bp, rice(Oryza sativa)
  misc_feature (71): n=a or g
tgataattatgtttgattttgaaatcccatggacaataaagagggcagttagcgggtgagccgtagagaantacaatagcaaagccagtgatggtttggcg

SEQ ID NO: 37522 - DNA, 101 bp, rice(Oryza sativa)
  misc_feature (71): n=a or g
gctccgcctccgccattgcacaccttcttgctgagctcggcaggaatcgagatggacgaagctctcaacgntggcggaagaggctgaattggcgacgttga

SEQ ID NO: 37523 - DNA, 101 bp, rice(Oryza sativa)
  misc_feature (71): n=t or g
ccacattttttgtaagcccagtgcagtccgatccaaaatgaaatcccaggccgtttcaatccaaccaaaangatccaaatgaggatccagcccacttaatc

SEQ ID NO: 37524 - DNA, 101 bp, rice(Oryza sativa)
  misc_feature (71): n=t or g
caactactacttgccactgaagagtggctgcttgcaggcttggcttgcagctggggagagagcatgagcancggcggcgtcggcggcgggagcttgggcgc

SEQ ID NO: 37525 - DNA, 101 bp, rice(Oryza sativa)
  misc_feature (71): n=a or g
gaaacctccttatctccagatgcattctgctgcactggatgaatcaagtgacattgttggcagagacgacnacaaggaggtggtggttaagctgttgctgg

SEQ ID NO: 37526 - DNA, 101 bp, rice(Oryza sativa)
  misc_feature (71): n=t or g
tatgcgagagtgcgcgtattcatatatagatctcctgcttgacaaggcctacatcaaacacatgatttagnagtaggaggcatggggaaatatgctacgag

SEQ ID NO: 37527 - DNA, 101 bp, rice(Oryza sativa)
  misc_feature (71): n=a or g
gatccagcggtgacggcgatggaaaagaaggctagatccacaaatccctccttttgtctcctttccaatcngcaccctgaagcagtggcatcgacaaggca

SEQ ID NO: 37528 - DNA, 101 bp, rice(Oryza sativa)
  misc_feature (71): n=a or g
actatactctgaaatgatttagtttcagtaaaagccaccttgacagctcacactttatgaaacacatgttnattcgattaaacatatgaatactatgatgg

SEQ ID NO: 37529 - DNA, 101 bp, rice(Oryza sativa)
  misc_feature (71): n=t or c
tgattgatgatttgaaaagaagaaagcttatcacaaaagagtaagtgcctcttatttgaacaagcacaatnatttttttttgtgctgtatattgcaattat

SEQ ID NO: 37530 - DNA, 101 bp, rice(Oryza sativa)
  misc_feature (71): n=t or c
aaagagatattggaacggagagagtacaaaggcaatatttcacatttagggtccctttataggattgaaancctacaagaaatcttcctatttggcttttt

SEQ ID NO: 37531 - DNA, 101 bp, rice(Oryza sativa)
  misc_feature (71): n=t or c
cacttctaaactttcaaaggtgtgctatactactatcttttgtcaaatggatagctagtcacactgacttnagctgctcagatatagttgtcaatgggaga

SEQ ID NO: 37532 - DNA, 101 bp, rice(Oryza sativa)
  misc_feature (71): n=t or c
ctttcaaacgcctacttgtcaggccatgctgcgtcgaatactattgatgtggtgccttcagcacccagaanatggataccgccaaggtaaggaactccttt

SEQ ID NO: 37533 - DNA, 101 bp, rice(Oryza sativa)
  misc_feature (71): n=a or g
gaagtgggggggagtgtcgtggtgagtggtttactgggcctttttttctacgaggatttaatgggctttanccaatcatgggccgtggggatccgaatggg

SEQ ID NO: 37534 - DNA, 101 bp, rice(Oryza sativa)
  misc_feature (71): n=t or g
cgcaacagatcgcggatcggcgcaacagatatggagtgaacaacccagaacactgtgacagcagcaacagncccagacccagagcccatgctgcggctcaa

SEQ ID NO: 37535 - DNA, 101 bp, rice(Oryza sativa)
  misc_feature (71): n=a or g
gagccaaactgaagaactaagttaccagacgaagttcttatggatccatcatagcatgctgtgacatctcngagtcttgacatcatgttcttgaaaagact

SEQ ID NO: 37536 - DNA, 101 bp, rice(Oryza sativa)
  misc_feature (71): n=t or g
tgaagatggtgatgaccaattgtctggatcaagtgataaccaggatgagcatgatgatgaggtgaggactnctgatggagcttccggtgatgccagtgcaa

SEQ ID NO: 37537 - DNA, 101 bp, rice(Oryza sativa)
  misc_feature (71): n=t or g
ttgtgaccaactggaaaagtcttctttcttcctctattcgctctagctaatgttgtaatgcttcctgatgnacccctcttcctcttttcaatataattcag

SEQ ID NO: 37538 - DNA, 101 bp, rice(Oryza sativa)
  misc_feature (71): n=a or g
cgtcaccaacctccaacagcaagtcagccgcgtcaggccgagtggtgaggtgatgcatcagcacgaggtcntgaggctgcccggcggcgggcatccagacg

SEQ ID NO: 37539 - DNA, 101 bp, rice(Oryza sativa)
  misc_feature (71): n=a or g
tgatgacattgtcaagcaacctactcaagtcacaattcctatggactgtttccagatcttaggctctctcnacgaccgcacctatcaaatcatcaatgctt

SEQ ID NO: 37540 - DNA, 101 bp, rice(Oryza sativa)
  misc_feature (71): n=a or g
taatataatgctaagtggagtagtgtagaataatgttcgaaagtcctccaagtctttggaagagttttcantatggctctagtagctcttgtaatctcttt

SEQ ID NO: 37541 - DNA, 101 bp, rice(Oryza sativa)
  misc_feature (71): n=t or c
atgttattttcccatatgtcttgaatggtgtcttgcccttcttcacgtattgtgtgtttagagtgtttttncatccgcgccatgacttgtccattgtttgc

SEQ ID NO: 37542 - DNA, 101 bp, rice(Oryza sativa)
  misc_feature (71): n=t or c
ttaaatctgtatagaatcccttaaaaagagtcgtttaggggtggcttaaattcttgagagaactctcaccnaactattacaaccccattccacactataaa

SEQ ID NO: 37543 - DNA, 101 bp, rice(Oryza sativa)
  misc_feature (71): n=a or g
actcaaaatttgcatcacatattcatcaatccaagcattgatcaacaacacaacaacagcaggcagtgganggaaacagcgtgattgattgatggtagata

SEQ ID NO: 37544 - DNA, 101 bp, rice(Oryza sativa)
  misc_feature (71): n=a or g
ccgttacatctattttaagaaaatatatctgcctcccaaacccggtcccacccagagcctatacattgacntacgtacgtgcatctatgcggtacgccctg

SEQ ID NO: 37545 - DNA, 101 bp, rice(Oryza sativa)
  misc_feature (71): n=a or g
acttgctagtaagcacatcacgccgcagttgaagacaagatagatgatgtagcttgaaagctgcctgctcntctcctttcgctccttggtcgtcttcactc

SEQ ID NO: 37546 - DNA, 101 bp, rice(Oryza sativa)
  misc_feature (71): n=a or c
ttttcactaatgtgtggtgattcttgcaggcacaatcctttgtcctttcacggcaaacgacaagtcagttnagtgagatacaagttttcgagcgtgacgag

SEQ ID NO: 37547 - DNA, 101 bp, rice(Oryza sativa)
  misc_feature (71): n=t or c
ccaagctcttgggatgggcatattgagtcagaatctgcattctcatccttcccactgatcccgttcgagtncagctcttgctcgctccccatccaacaaaa

SEQ ID NO: 37548 - DNA, 101 bp, rice(Oryza sativa)
  misc_feature (71): n=a or g
gtctcagttaacacaatgctttggcaaatccacactggataaatgtgctacagatacaatacagagaaatngaattagcgattgcgaagatgaaagaggat

SEQ ID NO: 37549 - DNA, 101 bp, rice(Oryza sativa)
  misc_feature (71): n=t or c
taggcttctgttctttcaaagtggggaaaaaagtagtgccatttactgcactatgctcattacaaacaacngtaataaagaagcagcatgagttctgattg

SEQ ID NO: 37550 - DNA, 101 bp, rice(Oryza sativa)
  misc_feature (71): n=t or g
ctgaggagcaagcacagctcactgtgctcggcttgtgaaaacatcacaagcgaagcagtcaactttcttantgagaaacaaatacaagataagataatgac

SEQ ID NO: 37551 - DNA, 101 bp, rice(Oryza sativa)
  misc_feature (71): n=a or c
tgttcatcgagatatgggagatcgtcgccgacgtgtgctccaactggaccaagatggccctgctcgcccantacatcaggcacgactcgccgtggcgccga

SEQ ID NO: 37552 - DNA, 101 bp, rice(Oryza sativa)
  misc_feature (71): n=a or g
atatatatatatatatatagacacacacaccagctggaacgtgccaataattagaaaaatctctcgatcangtcaagcactagtgtactacagctcaggca

SEQ ID NO: 37553 - DNA, 101 bp, rice(Oryza sativa)
  misc_feature (71): n=a or g
tcccccggtgtcgactcacaaccaacagagatcgtagagtatgatgaattcggctattgttacgacgaccncaacctcgacgacttcgccgaaagctttga

SEQ ID NO: 37554 - DNA, 101 bp, rice(Oryza sativa)
  misc_feature (71): n=a or g
tcatctgccgagtgccctgtgttcttgcagaaatcgcagacggcactccacttgatcttctccgcctcctnaaggtggcgtgcaccatggtggtaggggcc

SEQ ID NO: 37555 - DNA, 101 bp, rice(Oryza sativa)
  misc_feature (71): n=t or c
agaactgcaaggaatttttagataatagtagcagactagtgaacgggtacacgagatttttgaaggagtantcctgccagtttcattcgtatcttgcatag

SEQ ID NO: 37556 - DNA, 101 bp, rice(Oryza sativa)
  misc_feature (71): n=a or g
taaggtcgaagttgcttccatcattgcttgtggcgtgtgaacaggcttcgcgtactaggcttgaggtgccntcaggcgaacaggtgccgaggccacttgcg

SEQ ID NO: 37557 - DNA, 101 bp, rice(Oryza sativa)
  misc_feature (71): n=a or c
tcgtctcgaatagttcttccggttccttcaccaaagaaaattgtgacagaaaaatgtcatgtttacagtgntcaaggagaccaaactataagtaaaatacc

SEQ ID NO: 37558 - DNA, 101 bp, rice(Oryza sativa)
  misc_feature (71): n=t or g
ggttgcgtatttccgatttgcgagtgaaagatatggcatctttgcattcgcgttgacgattttagtgtttntggagacaaccagcgtcaggcctgtagttt

SEQ ID NO: 37559 - DNA, 101 bp, rice(Oryza sativa)
  misc_feature (71): n=a or g
ggctgcctggtttttactaccctactagcagctttattaatttgtcgacaccatccttgtcaaccccttcntatccttttgtacgtgcgctgattcgcatc

SEQ ID NO: 37560 - DNA, 101 bp, rice(Oryza sativa)
  misc_feature (71): n=t or g
ccgccttgtgcgagcagtgcccttgtcacggttgatttttggaggaccatccaagctagtaatgcattgtnatggaagtgtcctcgatggtaacctacgta

SEQ ID NO: 37561 - DNA, 101 bp, rice(Oryza sativa)
  misc_feature (71): n=t or c
tgatctcaagctgatgatcagatcagttcatgccctgacatgggtctatctgccaaaatttaaattttcanctttaaatttaggattgattttaatgtttt

SEQ ID NO: 37562 - DNA, 101 bp, rice(Oryza sativa)
  misc_feature (71): n=a or g
gccacggccacgctcagcgagcagagcaaggaactcgaaatgctgggcaaggagaaggacgttgtgattancatcccggcgccggtgtacgctccacggtc

SEQ ID NO: 37563 - DNA, 101 bp, rice(Oryza sativa)
  misc_feature (71): n=a or g
tcgttttgtttcttcttactcccttgcccctgctcaatagtgagtggcatgctaaataactgctcaacctntgcaagccatccaaaagtatctgacttgcc

SEQ ID NO: 37564 - DNA, 101 bp, rice(Oryza sativa)
  misc_feature (71): n=t or c
aaacaaggacagacggacgcacctactaggccaacacacattgcagctccattagctccattgatctcatnatagtagccaatacacgagcgtcatcccca

SEQ ID NO: 37565 - DNA, 101 bp, rice(Oryza sativa)
  misc_feature (71): n=a or g
actgcaaacgtggttgctgacttgcttagaaggaaccatgattttcaattatggaacagcgtattgcagcncttcaaggagatggtaaaaagtaacttgtc

SEQ ID NO: 37566 - DNA, 101 bp, rice(Oryza sativa)
  misc_feature (71): n=t or c
aagaaaaaaaaagagatatatggagcagctaaataagaggtccaactcgcggcacgacggatttcgctagngacgggggacgccctccaggagtccaggtt

SEQ ID NO: 37567 - DNA, 101 bp, rice(Oryza sativa)
  misc_feature (71): n=a or g
cggcggcgatcgtggtgtcggacgcggtggaggtggatttcccggtcatctacgtcaacgccgccttcgangccgccacggggtaccgcgccgacgaggtc

SEQ ID NO: 37568 - DNA, 101 bp, rice(Oryza sativa)
  misc_feature (71): n=a or g
aataatcttgcaggaggtacaggtgtgccgacgaaggatcctcctagaaatgccaatgagccgccaaagantcctcctggtacccgtgaagccaacctagg

SEQ ID NO: 37569 - DNA, 101 bp, rice(Oryza sativa)
  misc_feature (71): n=a or g
gcatgtcgttttaaacacgcatgttttaagtcaaaccccgactgattgctaccttttcatatgtacatggnccaacactagaggagccaaggcatgccaac

SEQ ID NO: 37570 - DNA, 101 bp, rice(Oryza sativa)
  misc_feature (71): n=a or g
ccagttcatcggtcgcaactgaggaatgcctagccttgtcgctatagtgtcccaaattgttctcgtgatcnggaattcgtagaagaggtgatgggccgtct

SEQ ID NO: 37571 - DNA, 101 bp, rice(Oryza sativa)
  misc_feature (71): n=a or g
ctattaacatatagttccattgcaggttgcaattgaacttccgtacatcttccttcagaccataatatatngcatgctagtgtatgcaatgataggatatg

SEQ ID NO: 37572 - DNA, 101 bp, rice(Oryza sativa)
  misc_feature (71): n=a or g
aagaggagagagagagcgcgcgtaccttgcagtcccatggccgcgcattaccccgcgcagcaaggaaggcngcggcggcggcgacgtgttggggggatggg

SEQ ID NO: 37573 - DNA, 101 bp, rice(Oryza sativa)
  misc_feature (71): n=t or g
gtgtgtgtgtgtccctttcgatctgttggttttgattcttgctaggtccccagttagatctatcttgttcntccttttggaggaaattttctccttatttc

SEQ ID NO: 37574 - DNA, 101 bp, rice(Oryza sativa)
  misc_feature (71): n=a or g
atgttatgttatccaagtctttgtttatgagtgaaagtttgctagtcataaactggtgcgctctgacgggntatctgtgctacggacttaatttgggtttg

SEQ ID NO: 37575 - DNA, 101 bp, rice(Oryza sativa)
  misc_feature (71): n=a or g
ataaatttccagaattaggagtatcagcagaaaactagcatttccaaggtaggaagtcatagaacataccnctattaacatatctatcttattacgtgatc

SEQ ID NO: 37576 - DNA, 101 bp, rice(Oryza sativa)
  misc_feature (71): n=t or c
actttgaggagcaagcaagtcatggaacctaccaagccaaagtatatctttgagcacctaatgccctaaanagacaagttcataaactttacatttgattt

SEQ ID NO: 37577 - DNA, 101 bp, rice(Oryza sativa)
  misc_feature (71): n=t or g
caccatcgttatggaaaataacctcacatatcttgatcagtgctagtaagaagatggacctctcagatcgnaccgcattcctttgtccgttatactacatg

SEQ ID NO: 37578 - DNA, 101 bp, rice(Oryza sativa)
  misc_feature (71): n=t or c
ctccatctccaggtgtggcagcagcaacagcggcgacggcggcaccagacatggtagcagatgacgacgangaagaggagcaatcgtgcagaagcactccc

SEQ ID NO: 37579 - DNA, 101 bp, rice(Oryza sativa)
  misc_feature (71): n=t or c
cgcgcgtggacacgagctttacagacctggatcggcgagaattcatcaaaattctcagaagcagccacccncaacccccccttcacagttcacacactgac

SEQ ID NO: 37580 - DNA, 101 bp, rice(Oryza sativa)
  misc_feature (71): n=t or g
gcttttccgcgcttaatttctcgacctgtcgaatcctcagtcgccaccgctgcgtcgacgaggagagaganagagagagagagagagagagaaaatccaaa

SEQ ID NO: 37581 - DNA, 101 bp, rice(Oryza sativa)
  misc_feature (71): n=t or g
ctgcttcgatggtctctttaaataaccagtgagtctgtgagtgcacaagcagcagcgagcgacggcgagtnaagctcgttccccttttcttttttcctttt

SEQ ID NO: 37582 - DNA, 101 bp, rice(Oryza sativa)
  misc_feature (71): n=a or g
cataagtttggaccccaacctcaagataacctccctttgttacctgcgtggcaagaagcaggatttaatcnccaattcatcgaattgtaccacgccaatta

SEQ ID NO: 37583 - DNA, 101 bp, rice(Oryza sativa)
  misc_feature (71): n=a or g
gtcctgtacatattgttggcagacttataagtcacttattactcctgcttactgtcctgctctagactttntaggatgagatataacttctgtgatgcatt

SEQ ID NO: 37584 - DNA, 101 bp, rice(Oryza sativa)
  misc_feature (71): n=a or g
agatgttcaagaaattttgtataccatgacagtaatgcaaaacaaatatgcacgattgtgctcactgctcncactgctgccattaatttgtttatgaacga

SEQ ID NO: 37585 - DNA, 101 bp, rice(Oryza sativa)
  misc_feature (71): n=a or c
catcaggtggctacaacaccttcttccaggtgctcctcctcagcatccaccatggcaaccatcaggtatanctccacagattctcctcagccgctgccagt

SEQ ID NO: 37586 - DNA, 101 bp, rice(Oryza sativa)
  misc_feature (71): n=t or c
tttgcaactgctaatttgctctacaagatcaccaagtccttcgtatcctggggctggaacaaaaagaacangcccattgtaccgccgcaagctcaccacac

SEQ ID NO: 37587 - DNA, 101 bp, rice(Oryza sativa)
  misc_feature (71): n=a or c
ccatgttaattctctcctgtacacggctcatgttttgtaaaatgcattgattaatttagccaacagaaatnatgcttcaaaaaatatctccatttgatgat

SEQ ID NO: 37588 - DNA, 101 bp, rice(Oryza sativa)
  misc_feature (71): n=a or g
aataatgccctctgttaagtctacttgacgatgatgaagccccctcactactctttgcaaacctcctgtcnaaccggcgcttcgagcccggtcagaccgga

SEQ ID NO: 37589 - DNA, 101 bp, rice(Oryza sativa)
  misc_feature (71): n=t or c
atgaatgtgagcgccatgcttatatttaagacaacacacactttgctaatatggtagcatttttagtattngaaacattcttaaaaaatacaagtgatcaa

SEQ ID NO: 37590 - DNA, 101 bp, rice(Oryza sativa)
  misc_feature (71): n=a or c
agcaggccccgcttggacttgggcttgtcgtcgacgctggacgactggcaccttcaacaacaacaacaacnaccataacatcacccccccccccccacccc

SEQ ID NO: 37591 - DNA, 101 bp, rice(Oryza sativa)
  misc_feature (71): n=a or g
ctctgacgttcactggtgtcgtagatccaatgaggtcaagcatggattcagccagctcgtggctggatccnctactgccggtggcccctcgaccgccacga

SEQ ID NO: 37592 - DNA, 101 bp, rice(Oryza sativa)
  misc_feature (71): n=t or c
gccagctagagcagattttagctccggctgaccaattagtttgcggcgcatcactaagcaagattttgtangacggtagttaccaggatcttttttttggg

SEQ ID NO: 37593 - DNA, 101 bp, rice(Oryza sativa)
  misc_feature (71): n=t or c
tatcgtctacctcaggctccccctctcggtttgcaaactaactaaagcggagattctgcttatgatggacnggttagccaaaagccttgctgggtggaatc

SEQ ID NO: 37594 - DNA, 101 bp, rice(Oryza sativa)
  misc_feature (71): n=a or g
accattatggtagaggatgtgaacccctcacgcggatggatgtctacttattgcataatttagattttatnaacatccgtatgaatttggacacgtatata

SEQ ID NO: 37595 - DNA, 101 bp, rice(Oryza sativa)
  misc_feature (71): n=a or c
ggcgcacccagcgctggcggctacagctaaagagatcgcatccgtcctgaacgggtcattcctagggatgnatatattgatcgccctgatgcgatccgacc

SEQ ID NO: 37596 - DNA, 101 bp, rice(Oryza sativa)
  misc_feature (71): n=a or g
ccgattgtatcaaccaggacgagcaaatcgggactaaaatttgagatctttagtccagattgagagaaccngtactaaagttgtatagcaaatgaaaaata

SEQ ID NO: 37597 - DNA, 101 bp, rice(Oryza sativa)
  misc_feature (71): n=t or c
ctcgtcggatacggtctctctcttctcttcttgccatatcctctttgtttgttgatgacttgatatagtcnaactagcggttagttttgagatgttagctc

SEQ ID NO: 37598 - DNA, 101 bp, rice(Oryza sativa)
  misc_feature (71): n=a or g
gaccggctgagtgcacttgctgcagcgaactgtcacgacctggttactttctcatttcttcctcgctcgcncgctctctctctccctctctctctctctct

SEQ ID NO: 37599 - DNA, 101 bp, rice(Oryza sativa)
  misc_feature (71): n=t or c
acgccgtcatctgaaggtatgtatcccctcctatcccctcctgccccaccatgtcgcccgacaatatggcngccgcatgttcgatgaaatgtccagtaaga

SEQ ID NO: 37600 - DNA, 101 bp, rice(Oryza sativa)
  misc_feature (71): n=t or c
tttattttctcatcgtgatctttatcttgctaaatgtttcatcgatcactctccgcttcacatacgccacntactcttgtatcacatcattgtatatcgct

SEQ ID NO: 37601 - DNA, 101 bp, rice(Oryza sativa)
  misc_feature (71): n=a or g
ataagaaatgatgtcatgggcctgatttaaaacttctacagcacaggtaattttcccagagagctcaacangactaacattgttcttatccctaagaaaaa

SEQ ID NO: 37602 - DNA, 101 bp, rice(Oryza sativa)
  misc_feature (71): n=t or c
tgcggcgccggcggcactcattgggatctacaacggcctcaatgttggcaagcagctcgtcgccatcgcgnaggcctgagatgacatgctatttgccatat

SEQ ID NO: 37603 - DNA, 101 bp, rice(Oryza sativa)
  misc_feature (71): n=a or g
gagtaggcagaccgcaccgagaagtcaccattaggtgccgccttccatatcatagagtccgtacttctggngtcgagagaaatcccggctgtcggtgacat

SEQ ID NO: 37604 - DNA, 101 bp, rice(Oryza sativa)
  misc_feature (71): n=t or c
ggagatggttccagtcaacaagcatgtgaccactgggattgcaaaagtacatcataggccactaactctgnaaatggatggacgacagctgaataggaata

SEQ ID NO: 37605 - DNA, 101 bp, rice(Oryza sativa)
  misc_feature (71): n=a or c
atggttgaaaatgtaacagaaacattcaggtagcaacaggcacactgattcagtagaaaaatagcacacanaaaaaaaaaactactgaagacactagcaaa

SEQ ID NO: 37606 - DNA, 101 bp, rice(Oryza sativa)
  misc_feature (71): n=a or g
acttatgggcactatgggttgggactgccctaaggtgcttaccaaggtccaacaaggttggtcgcagtctnaacaatagcaagggcatccggaacggcttg

SEQ ID NO: 37607 - DNA, 101 bp, rice(Oryza sativa)
  misc_feature (71): n=t or c
tcaaagctgcatgcaagagatcaatagtttttgcacagcttgacgacgagttcgacgtacgtgctagcttntgcttttcttgttcggacgatcaaaagcct

SEQ ID NO: 37608 - DNA, 101 bp, rice(Oryza sativa)
  misc_feature (71): n=a or g
gaaatacccaacatacttcatctcctaccacaagtatgcaacgcagggactgtacaagaatgagctgttgngcttggtctttgaagatattggcggtggcg

SEQ ID NO: 37609 - DNA, 101 bp, rice(Oryza sativa)
  misc_feature (71): n=a or g
tgtgcaccaaggaagcatctcatgaaaggccaacaatgagtacagtggtggcagagctaaaggttgcattngcattggaaaaggctcgtgcaagtggtagc

SEQ ID NO: 37610 - DNA, 101 bp, rice(Oryza sativa)
  misc_feature (71): n=t or c
tgctctccaggggcggaggcgggcgccggggaagggactatatagatatcgttgtagaaagtttcattttngtggaaatgtatttaaattggctcaaattt

SEQ ID NO: 37611 - DNA, 101 bp, rice(Oryza sativa)
  misc_feature (71): n=a or c
caagtccagagtagaagtgagatgtataattaacaaggaactaatacctgtccgcctgtcaagctattcangaactgggaaggcaaggaaagagttctagg

SEQ ID NO: 37612 - DNA, 101 bp, rice(Oryza sativa)
  misc_feature (71): n=t or g
aaatcattagacaggcggatgttaagctgtgtgtttcgggaaaagaaatccattcagatttcttcaaattngtgggagatttgttcaaactgctaaattta

SEQ ID NO: 37613 - DNA, 101 bp, rice(Oryza sativa)
  misc_feature (71): n=t or c
aataaccacatatgcactgaccatgactcctcttgcccttagtatggaggagttgctacctcctaatcganagacatactcaaacatagtcatgcttagat

SEQ ID NO: 37614 - DNA, 101 bp, rice(Oryza sativa)
  misc_feature (71): n=a or g
cgtgtccaattcgaccacagtagactactcactctgtcactcacctcacctctgcctctgctcttcctctnagaacctaacgacacccactgcccaccccg

SEQ ID NO: 37615 - DNA, 101 bp, rice(Oryza sativa)
  misc_feature (71): n=t or c
atagttaggaattggtttttctcgaggacgaggacacagaatctgaatcccaacatggcaacatgtgaaantaatagagtctgagatagagggactgcatt

SEQ ID NO: 37616 - DNA, 101 bp, rice(Oryza sativa)
  misc_feature (71): n=a or c
tcttcttctctcgcttgttcctcagcggatgcttcttttatttaactaagtcttcgagtttctttgtgttntttaattagtttatttaagtgagatatatt

SEQ ID NO: 37617 - DNA, 101 bp, rice(Oryza sativa)
  misc_feature (71): n=t or c
ttatcaactgcagtcctatagaaactttattcattaaatccaacgacctatatcgtccaacccaacgctcnaaatcatctcacgttccccctcccctctct

SEQ ID NO: 37618 - DNA, 101 bp, rice(Oryza sativa)
  misc_feature (71): n=a or g
gactcagagatctctgttatactcctggcacttgatatttctagttgacccatcatacgtgtaacaatggnccagaatgtctccgtcttgagaaaacctgg

SEQ ID NO: 37619 - DNA, 101 bp, rice(Oryza sativa)
  misc_feature (71): n=a or g
agaatgtatgcctatctaaaattgggaggactagtccaaagaagactatcaaatatactcgctccgtttcnaaatgtttgacaccgttgactttttagcac

SEQ ID NO: 37620 - DNA, 101 bp, rice(Oryza sativa)
  misc_feature (71): n=t or c
tttttggacggagggagtactatccagtagcagtacccagtggacggcctactactctaccagaaccctcnctggcagttaactgaccacaacaacacacc

SEQ ID NO: 37621 - DNA, 101 bp, rice(Oryza sativa)
  misc_feature (71): n=a or g
atgatcatgtcaagcaccatatcatgcaccctacaagctagtaccttgccatcataccgaacacccactgnttcaatcatgcttctgttgatgagctcatt

SEQ ID NO: 37622 - DNA, 101 bp, rice(Oryza sativa)
  misc_feature (71): n=t or c
ggggcggagtcacgatctcgggataatttaggcttgtgaacctatctgaggctgtgttccttacctgtagntgggagcaaatccctcccgtacgaaaaata

SEQ ID NO: 37623 - DNA, 101 bp, rice(Oryza sativa)
  misc_feature (71): n=t or c
catctttaattccggattgggcatcccggtaacatatccaggattaaaaggtgtttcgaactgggagtgangtgggtttctccagtagtgataggagataa

SEQ ID NO: 37624 - DNA, 101 bp, rice(Oryza sativa)
  misc_feature (71): n=a or g
aggtagatgatgcatgcataaccagatttttaggaaaatgagaaatcagggctgcaactgcctctcaaacnggaaagcgagtgcattaatgtactgaatga

SEQ ID NO: 37625 - DNA, 101 bp, rice(Oryza sativa)
  misc_feature (71): n=a or g
tgggaggttgccactccctgaaagggttcccaatccatggtgcaagtgctccaggactgaagaatgttganttagtacataatggtgataaaagctggtac

SEQ ID NO: 37626 - DNA, 101 bp, rice(Oryza sativa)
  misc_feature (71): n=t or c
ggagtagtagtattttgatatttgtatcaaaattagcattaaacacatatccatgacacgaacatatactntggtttttttttaataaaacttgtttggaa

SEQ ID NO: 37627 - DNA, 101 bp, rice(Oryza sativa)
  misc_feature (71): n=a or c
cagatttccaaaccggcagcactaagcaacactgatgagagagctgataaccatgttgattccacaagccnaaaaaagaaaacgcatcatcaagtcgatac

SEQ ID NO: 37628 - DNA, 101 bp, rice(Oryza sativa)
  misc_feature (71): n=t or c
cacgaattacggccagtctcgatcgctcagcttgagctagctaagctatggtacggggcacttctaagggnccgtttagttccaaaaagtttttcccaaaa

SEQ ID NO: 37629 - DNA, 101 bp, rice(Oryza sativa)
  misc_feature (71): n=t or c
ttataaataatttaatattgtcaaccaattgctccagtttgctatgctagtcaacgggcatagtttgctanggaagatggctacatcagcacctccgacgt

SEQ ID NO: 37630 - DNA, 101 bp, rice(Oryza sativa)
  misc_feature (71): n=a or g
acttttctagatatgctgtctatctgatcatttatctgccctcctccaaataactgttcctgagaagactntatcttgtccacctgaccaagcacctcccc

SEQ ID NO: 37631 - DNA, 101 bp, rice(Oryza sativa)
  misc_feature (71): n=a or g
ggcagcatttggttcactgttgcgtccatctccatgaattcattttgttcccttcaggagcagcagccgcntggaaggtcgctcactcgtggccacggggg

SEQ ID NO: 37632 - DNA, 101 bp, rice(Oryza sativa)
  misc_feature (71): n=t or c
tgataatggtttcgatgacagatacctggggtttccgacaccggagggtagaatgaagaaagggcatttcnagagtttacaagagaaggtttggaaacgaa

SEQ ID NO: 37633 - DNA, 101 bp, rice(Oryza sativa)
  misc_feature (71): n=a or c
tgtgatgaatacgcgtgtaagagggtttatgggtgcaacttgggagtttaattaagaagtacccctccgtnccattctaagtgtagttatgattttccgta

SEQ ID NO: 37634 - DNA, 101 bp, rice(Oryza sativa)
  misc_feature (71): n=t or c
accgcagagagaattcccaataaccaatatgctcattaaaacagaatcaattactgtgtttattaccgttngggaccatcaaccgcgcgtgcttaattcag

SEQ ID NO: 37635 - DNA, 101 bp, rice(Oryza sativa)
  misc_feature (71): n=t or c
ccaagcgccattttgatctcatccaagctctcagctgtacttaagatgtacaacctgcaataataatcccntaggatggattgatggtgttctatactaat

SEQ ID NO: 37636 - DNA, 101 bp, rice(Oryza sativa)
  misc_feature (71): n=a or g
actctcaaaatgcatttttgatctctaaacttgcatcgtgtattatttaggtctaatcgagctccaacccnctttgtgtgctggtatggtatgtcatggta

SEQ ID NO: 37637 - DNA, 101 bp, rice(Oryza sativa)
  misc_feature (71): n=t or c
aaaaacttatttcgaaactaaccatacaaaagaattcatccaaaaataggatgggggcttagcgccaaagnagttggcgctgaggttagccgtctaccagt

SEQ ID NO: 37638 - DNA, 101 bp, rice(Oryza sativa)
  misc_feature (71): n=a or g
ttcttcaatgccggtgacaacccaaactctagcgaagagccaataaatgagggtcccgggttagagtgggnatgggaggggtggaaggggaagggagaaga

SEQ ID NO: 37639 - DNA, 101 bp, rice(Oryza sativa)
  misc_feature (71): n=a or g
gggaccaaatcccaccacccccaagcactcaatccaccatgaccagaccaagcaggcaagcacagctaccncccctcccaactcacagcgagcgaattccc

SEQ ID NO: 37640 - DNA, 101 bp, rice(Oryza sativa)
  misc_feature (71): n=t or c
agtagcgaggatgacatgtgaggccacatgggcctcaccattgtttttattgttttgtgtgtgtaactaanatgtgggcccatgatttttttatttttctg

SEQ ID NO: 37641 - DNA, 101 bp, rice(Oryza sativa)
  misc_feature (71): n=a or g
cccaatccataagcacaagtggataaaaaaagcctaatcgaacataaaaaaacggtgaaaaaaaatagacnggccaaaaaatcatattcagttaaaactga

SEQ ID NO: 37642 - DNA, 101 bp, rice(Oryza sativa)
  misc_feature (71): n=t or c
catcttgttacatgatatcggtcgacaaaactgaggttgacttctccgttgaccacaaaccaccgaaagtntgtattttcacatatatagttattacttag

SEQ ID NO: 37643 - DNA, 101 bp, rice(Oryza sativa)
  misc_feature (71): n=a or c
ctaggatctagtaatagttctgtaaatttaacccttggcaagtccttccctgtactattggcaccaacacntggtacgatgtgcaatggagcagctggaga

SEQ ID NO: 37644 - DNA, 101 bp, rice(Oryza sativa)
  misc_feature (71): n=a or c
cggcttctctccaaacgaggacttcctcctggatagccctgtagacctacgccgccatgcagtttttgtgntcgaaaatcctgacattcctttctttccaa

SEQ ID NO: 37645 - DNA, 101 bp, rice(Oryza sativa)
  misc_feature (71): n=t or g
tcagcaaatacaatatttataaccaaagaaagaaagcactccctccagttcttataatgtttaaccattcntcttatttaaaaattaagtataagtatcta

SEQ ID NO: 37646 - DNA, 101 bp, rice(Oryza sativa)
  misc_feature (71): n=a or g
caagatggaatgtttccaactattccttatctcctggtcacctaccgacgttgtcgctcctgttcaacatnttgtcgacgttgttcctctttcctccactc

SEQ ID NO: 37647 - DNA, 101 bp, rice(Oryza sativa)
  misc_feature (71): n=a or g
agagccattttaatctcagaattggagtaaggtttgcacaactcctcattaatgaaatcatccactttgcntggtatggactccaacacttcctccatcga

SEQ ID NO: 37648 - DNA, 101 bp, rice(Oryza sativa)
  misc_feature (71): n=t or c
taggacgaagagatcggcggtgaagttgtctccgttgatgatgaacgatgcttggcgcaggacgccgaggnagggaacctgctctccgttggcgacaatga

SEQ ID NO: 37649 - DNA, 101 bp, rice(Oryza sativa)
  misc_feature (71): n=a or g
aacgatttgataactttgtacccccatcttcaaaatcttgcgtccaccactgacatttgaagtattaaacntagactaataacaaaacaaattacagattc

SEQ ID NO: 37650 - DNA, 101 bp, rice(Oryza sativa)
  misc_feature (71): n=t or c
gacggcgacggcagtctccaaggtcgttggcgaccgatgtgtatgtgttgatatttacatgttgaaaatgntgtgagaaatcgatgcagatgtttggactt

SEQ ID NO: 37651 - DNA, 101 bp, rice(Oryza sativa)
  misc_feature (71): n=t or c
agtttacattctggttgtatgtcatgtacccaggaagtacaagactctagttctgagctctactgcaggtnatgaagaggtaagcattaagaaccagtagc

SEQ ID NO: 37652 - DNA, 101 bp, rice(Oryza sativa)
  misc_feature (71): n=t or c
ttcaccttcaccaccgatcccttttctgtattctccaagatcggcagcgacgaatctagctcgccctcgangagggataaaaacagtctcgatcggagcta

SEQ ID NO: 37653 - DNA, 101 bp, rice(Oryza sativa)
  misc_feature (71): n=a or g
ccagacaagccgagtccgagcctctcctaaagctcgcaagctttgtcgggctgatgttgagcttttaacgngcctaataatatgtgtttttttgttgctat

SEQ ID NO: 37654 - DNA, 101 bp, rice(Oryza sativa)
  misc_feature (71): n=t or g
ggaaaagtgggctacatttttcatccagctttgacaagcatacttctgctatttaacattttgtaacatanttatttcaagaatccattattatcctatgc

SEQ ID NO: 37655 - DNA, 101 bp, rice(Oryza sativa)
  misc_feature (71): n=t or c
tggaagtgtaatgtgccgcagaaggtgaagatattctccgggaaggcagctaataattgtctggctacctnggaaaataagaagaagagaaagctcgagca

SEQ ID NO: 37656 - DNA, 101 bp, rice(Oryza sativa)
  misc_feature (71): n=a or g
agcatggcgacatgccttcatcggctaccgttagtaagtagtcctagtattattctcttatggctacctanagaatatgtaactgtgtttaattaatttgc

SEQ ID NO: 37657 - DNA, 101 bp, rice(Oryza sativa)
  misc_feature (71): n=t or c
acggtcggcgatgaagcatttgtatctagtcggccaaaggtgaaaacggtgcaaatagcgtgtcgctgtgnatggagggattaaatttgaaaaatatattg

SEQ ID NO: 37658 - DNA, 101 bp, rice(Oryza sativa)
  misc_feature (71): n=a or g
ggtgacggacgggctggaggtgacgcccatgtcggccatctccagcatcactctcatcaacaagttcagcntcggcaaagacgtcgagcttgccgagaagt

SEQ ID NO: 37659 - DNA, 101 bp, rice(Oryza sativa)
  misc_feature (71): n=t or g
tgatgaccgacgaccaccgtgtatctttctcgccgctctttcgcttcgtctgctctcttcctcagcttctncatctctttggccaactgaagcttcgacgt

SEQ ID NO: 37660 - DNA, 101 bp, rice(Oryza sativa)
  misc_feature (71): n=a or g
ttctatatttttattcaagtgtgtttatatacaggaataccggatgtgaatttgattgtcagaggtcttcngaccagatgtgctgtgagcactctgtcgct

SEQ ID NO: 37661 - DNA, 101 bp, rice(Oryza sativa)
  misc_feature (71): n=t or c
tttccaagctttaggccacgatcatacatggccataacttcctactgctaccccatgtttcgaggtgttgntggtgcaaaaactaagcggcgcggtgaggg

SEQ ID NO: 37662 - DNA, 101 bp, rice(Oryza sativa)
  misc_feature (71): n=t or c
tttgtcaatatcgaggtatgctagccaagtcttttagaggtgattataaggatatatggttctttacagcnttctctcagcccacccatataatagttagc

SEQ ID NO: 37663 - DNA, 101 bp, rice(Oryza sativa)
  misc_feature (71): n=t or c
tgaggtaaccgtgttgcaatcttatcccatccatcagggagctgaccagatagctcattgaacgaaatgtncacaacagaaagtgagatcatgttacttag

SEQ ID NO: 37664 - DNA, 101 bp, rice(Oryza sativa)
  misc_feature (71): n=t or c
atgcataaccatagtatgatccagtaatttacctaggtcaaacctgttacaaagcagagggcatattatantatataagaaatttcacgatctttattatt

SEQ ID NO: 37665 - DNA, 101 bp, rice(Oryza sativa)
  misc_feature (71): n=t or c
acttttgaattatttctgatcgaagttaatttcaaaaatctcggttatatcagtgccccctggacagaaanaggcaaaatgatataatagaacctggctag

SEQ ID NO: 37666 - DNA, 101 bp, rice(Oryza sativa)
  misc_feature (71): n=t or c
ggctcaagcaagcaaacatccttcctttctgtctctagctctgactcttatgcctggcactaattgatttntcactttgggacttcaattagtccaaagac

SEQ ID NO: 37667 - DNA, 101 bp, rice(Oryza sativa)
  misc_feature (71): n=t or c
atttaattgtggttgcccatgctgcctaagtatgactacatactctctccggttttaacagataacgctgntgacttttggatatgtatttgaccattcgt

SEQ ID NO: 37668 - DNA, 101 bp, rice(Oryza sativa)
  misc_feature (71): n=a or g
tgaatggtggtgggttgtgattggttgagtagtgaaagtaggtgaggaaagtaaatggtggagagttgtgntaggttagaaagagaatattggtggagaag

SEQ ID NO: 37669 - DNA, 101 bp, rice(Oryza sativa)
  misc_feature (71): n=t or c
cacataaaggtcgaaaagacggataaaatcgagatggcacctattttcctctctggtgtcccaacagttcngctcgatagtagttctggtgggacaagaac

SEQ ID NO: 37670 - DNA, 101 bp, rice(Oryza sativa)
  misc_feature (71): n=t or c
aatgtaaaaaaggagataaaactagttaaaaggaagtgcacgagtttattagaatcaggtagaaatagtangataaatattatcatggtcatacatatttt

SEQ ID NO: 37671 - DNA, 101 bp, rice(Oryza sativa)
  misc_feature (71): n=t or c
agatgaacatgtaccgtgtacaaggaactcttagagagtgggtcacaagagatgaagtccgccgctttatngcaaagaagttcaaagaattccttctaaca

SEQ ID NO: 37672 - DNA, 101 bp, rice(Oryza sativa)
  misc_feature (71): n=a or c
tttggaactaaacaagggccgagcaatctcctaaaactgggttataattcggtcccccactgacagagacntttattattattattttcccaaactaagca

SEQ ID NO: 37673 - DNA, 101 bp, rice(Oryza sativa)
  misc_feature (71): n=t or g
cgttctgtggtttctgatgaatgttgatccaagagcatgcagatgaaatggctgagctcagacaattgaanaattcagcccatgtattgacgcttgtaaca

SEQ ID NO: 37674 - DNA, 101 bp, rice(Oryza sativa)
  misc_feature (71): n=a or g
aaaagaaaacaaagtgtcgaaggtgtccctcatttaacatggtagtaatgtaattcctccgtttcacagcncaagtcattctagcatttctcacattcaca

SEQ ID NO: 37675 - DNA, 101 bp, rice(Oryza sativa)
  misc_feature (71): n=t or c
gactccggcctacagctctatgatgtaccgaacgtggagaattacaaaggacagatatggctgttaccacntgccatcaacttctacaacccgtggagcac

SEQ ID NO: 37676 - DNA, 101 bp, rice(Oryza sativa)
  misc_feature (71): n=a or g
tctactattagatatgcaacatgttaattaaaacaaagcatgcaccaggttcaaaacttggtgaactcacntagcttcagcagagcctctatgggtaatgg

SEQ ID NO: 37677 - DNA, 101 bp, rice(Oryza sativa)
  misc_feature (71): n=a or g
tccaccagttaaagcagattttgaaccacttggctcatgcttggtctttggctcctctcctcttccacgcntgaaactgctatctttaacatcttgactgc

SEQ ID NO: 37678 - DNA, 101 bp, rice(Oryza sativa)
  misc_feature (71): n=t or c
ttaccagaaccgcacatggactaagagactctcgtacgaaccctttattaagcaattcctaaacttgatgntcaatctccttggtttcttcagggttggtt

SEQ ID NO: 37679 - DNA, 101 bp, rice(Oryza sativa)
  misc_feature (71): n=a or c
tgcatgctgtttttctgcagaatgcttagggaggaacggggacagttgcggtacaagatagtactccgtcnttccctaaatgtttgacgcgattgactttt

SEQ ID NO: 37680 - DNA, 101 bp, rice(Oryza sativa)
  misc_feature (71): n=t or c
gatatcatgcacatctcacgtgctaaatgtccatgctatgaaaccggatgatgagcaccttagccttactnagaaagctcctgcttctgcaaccaacagta

SEQ ID NO: 37681 - DNA, 101 bp, rice(Oryza sativa)
  misc_feature (71): n=a or g
gcctcttcatcctcctcctgagccaagttagcttcatcctcacgagcatgcctatcaaccctcttgtcacncccggaatttctatccaaaattccaaacgc

SEQ ID NO: 37682 - DNA, 101 bp, rice(Oryza sativa)
  misc_feature (71): n=t or c
atttgatttagaatggtcataagagaagtattatagtctggttgtcatttcacatctatctatatatcttntattatatactaaaagtccattaaacttcc

SEQ ID NO: 37683 - DNA, 101 bp, rice(Oryza sativa)
  misc_feature (71): n=t or c
acagcagattgttagtacactccaaagtccgatcagttccttgttatgaaacagattctcagcagtaatantttatttttggactttataaataataacta

SEQ ID NO: 37684 - DNA, 101 bp, rice(Oryza sativa)
  misc_feature (71): n=a or c
gcagaaagggtagcaaattaatagagagcttatctcctagtggaaaaggaatgcttatcaggtgggtactngctctgaaatggtaacgtattctacatgag

SEQ ID NO: 37685 - DNA, 101 bp, rice(Oryza sativa)
  misc_feature (71): n=a or g
agattagcatccggaagatggctcgacgacaaccgtcaccggagcagcacaaaccatggtggccgaagtcnaccatctgcggcattccaagaaggaaggca

SEQ ID NO: 37686 - DNA, 101 bp, rice(Oryza sativa)
  misc_feature (71): n=t or c
atagatcggtggttgattcttagttgtccagtctcaagtaataaagaaaccggagatgtgtgatttagggnattggataagttcgtgatgtcttagcttga

SEQ ID NO: 37687 - DNA, 101 bp, rice(Oryza sativa)
  misc_feature (71): n=t or c
aggttagatgtttttgccttcttttgattttttttagaaataattatagtgccacgtggaggcttaggagnatttgtagggttgctatgtggcggcttagg

SEQ ID NO: 37688 - DNA, 101 bp, rice(Oryza sativa)
  misc_feature (71): n=a or g
tggtgctgtctcaagtggtgtcgtatagagaggtgcccgaagatagaaattgtcttccctaaacacgcatngaatttctacggtctggaaaccgcctgggt

SEQ ID NO: 37689 - DNA, 101 bp, rice(Oryza sativa)
  misc_feature (71): n=t or c
atttaaagtaagtaattaatggctcagaaatgttgcatggacataataaaactttaagcattatgaagaanagaaggaagaaagacccatgaaatacagaa

SEQ ID NO: 37690 - DNA, 101 bp, rice(Oryza sativa)
  misc_feature (71): n=a or c
tattgtagtagcagccgaaatcaaccgtgccggcaacgtaacacaagatgcgtttcaccgccacgtcatgntcggtggttggaacttccatgaagcggctc

SEQ ID NO: 37691 - DNA, 101 bp, rice(Oryza sativa)
  misc_feature (71): n=a or g
tatgtgtttgcaggttgtggtctccactaagagccccaaatcagataagcaatatgtatgggaaggtgtanctgacagtagctcttatgtcatcaaggaag

SEQ ID NO: 37692 - DNA, 101 bp, rice(Oryza sativa)
  misc_feature (71): n=a or c
gacgaatatattgtctatattgtacagagcaaacaatatcgacttaccaagagagtacaggttatactggnctcacatcgcttcactgctcagctgaaaga

SEQ ID NO: 37693 - DNA, 101 bp, rice(Oryza sativa)
  misc_feature (71): n=a or g
gacagcttgcagctacggcggcatggtcgaggtcgggaagatcctgtaccgagccatgcaggtggagtacngcgtcgagccgaggctggagcactacgcct

SEQ ID NO: 37694 - DNA, 101 bp, rice(Oryza sativa)
  misc_feature (71): n=t or c
gtttggaaatctgatgtatggattgatcttcttcgatcgccttccgagagaggcttgaattctcgtatccntgtgacctcaagaaacctggatgttttggt

SEQ ID NO: 37695 - DNA, 101 bp, rice(Oryza sativa)
  misc_feature (71): n=a or g
agtgctagtgaggaccggtggcatgcgcctcatgatatccaatgcagggacaatcaacttcctagatcaantggtgtgcctccatttccaagtgaatggcg

SEQ ID NO: 37696 - DNA, 101 bp, rice(Oryza sativa)
  misc_feature (71): n=a or g
ataatacatttataccaagcgtaataccatggaaaaggagaagtaagttgccggtggtgcatactcgcttngtagatgaacttgatctccttggtcgcttg

SEQ ID NO: 37697 - DNA, 101 bp, rice(Oryza sativa)
  misc_feature (71): n=a or c
gcctgtgctattcgtgcttcaaatggtacttcagtttttcttatggagggtcaccatatcatattcaaggntgttaaaatcgcaatcagaagttctcaacc

SEQ ID NO: 37698 - DNA, 101 bp, rice(Oryza sativa)
  misc_feature (71): n=t or c
ggacccacaaacatgtattgtgcactgtgaagtgtggttctttacggcatgtgtgttacccgcactgctantggccttaggggaagatggtggcctggccc

SEQ ID NO: 37699 - DNA, 101 bp, rice(Oryza sativa)
  misc_feature (71): n=a or g
agaaaaaaaacaggatgaaatgcctgaaataacaaactgttttttactagaaacccccctccactgctatntagagcaagccaaaaagaccatcgatcaca

SEQ ID NO: 37700 - DNA, 101 bp, rice(Oryza sativa)
  misc_feature (71): n=t or c
tcgacctccacttccttcccccgcccgctctcgagcaatctcggtgggctgaccagatcaaaggcaacagnggtggtgagttggggtccgtagcggtaaca

SEQ ID NO: 37701 - DNA, 101 bp, rice(Oryza sativa)
  misc_feature (71): n=t or c
ttacccggggtcctcttgccccctgctgcatccaccagtgtctatctgattcgttccatatcagtgaaagntctttttttatgagaaagaaagttctttat

SEQ ID NO: 37702 - DNA, 101 bp, rice(Oryza sativa)
  misc_feature (71): n=a or g
cttgttgtttgtctaggatctcttccctttcaatttctcattggtgacatagaagacaactacatctttgntgctcctatcttcaactttcagttcctctt

SEQ ID NO: 37703 - DNA, 101 bp, rice(Oryza sativa)
  misc_feature (71): n=t or c
ccacttgagctccgagggaagattaccaactgagcttggcaagtgtccttgcagtccattcccatccaagnagagtctttgcagctgagtgcagtttgcaa

SEQ ID NO: 37704 - DNA, 101 bp, rice(Oryza sativa)
  misc_feature (71): n=a or g
aagaaaaaaaatactatgacccacatgtcagtgggtgatgggacccacagtcaaataaaaggatgatgagnctgtcggtgtcgccgtgtcagctatggagc

SEQ ID NO: 37705 - DNA, 101 bp, rice(Oryza sativa)
  misc_feature (71): n=t or g
atatttgttgattcaggagacatctcttcaactagttggctcagaaactgtagatatgtgccaatcaatgntatagatcaaaacatttcacatattaggct

SEQ ID NO: 37706 - DNA, 101 bp, rice(Oryza sativa)
  misc_feature (71): n=t or c
tacaccgccggacacttcaacgagtattgggccgagctcggactgcgtcgagaactcacagcgctgtattngccacagcagaacggcgtcgtcgagcgccg

SEQ ID NO: 37707 - DNA, 101 bp, rice(Oryza sativa)
  misc_feature (71): n=a or g
gacgaacgccggagatgggtgggagggtagccagagattgtagtgagagcactcgcaatggtggattttgnggggtcatggtggtggatttggagaagata

SEQ ID NO: 37708 - DNA, 101 bp, rice(Oryza sativa)
  misc_feature (71): n=a or g
cggacaccgtgatggttctatatttaagggcaaccgtggctggaaaatagacttccgtattgcaaaccctnatgagagtaagtagtttaaatttatgtatt

SEQ ID NO: 37709 - DNA, 101 bp, rice(Oryza sativa)
  misc_feature (71): n=t or c
tccaatattctaattaagttattacttgcgttgcttatttgatatattggatctttcttagattgctctgntgtccttgttaggttatttaaatcgattac

SEQ ID NO: 37710 - DNA, 101 bp, rice(Oryza sativa)
  misc_feature (71): n=a or g
gttaggcagcaggtgactgaaacctactgcgctgctgttgttcatcatgaagtcaggctcttcagcttttnctaatcttagtcctctcaatgcccatatca

SEQ ID NO: 37711 - DNA, 101 bp, rice(Oryza sativa)
  misc_feature (71): n=t or c
aaaaatatgaatttttgaaatattttgggtgtacctgtcgatggtgatggtagcaggatcaaagttgatanggaggccttccaaatagggtggatgacgag

SEQ ID NO: 37712 - DNA, 101 bp, rice(Oryza sativa)
  misc_feature (71): n=t or c
cggaggggattgggccgagtggcaggcagcgcacggatgagcgagttgggtgggatgcgatttttttttcntttttttttttcgtttcgccttttttttta

SEQ ID NO: 37713 - DNA, 101 bp, rice(Oryza sativa)
  misc_feature (71): n=t or c
aatacttgtcgtgcatggtttccgagagaaataggaaagctaatctgagacaggttcaagctactacacgnattaggaaacaattcaattaaagccattgc

SEQ ID NO: 37714 - DNA, 101 bp, rice(Oryza sativa)
  misc_feature (71): n=a or g
ttgctcaaaataggaatggtgtgttaggtatcgaaggaaaatcgatggctggtgtttctagtcgaaagcgnaaactttttatgctattttttggtactagg

SEQ ID NO: 37715 - DNA, 101 bp, rice(Oryza sativa)
  misc_feature (71): n=t or c
ttatacatggctgggccacttctctccatatttctgcatggcatcacattgccgcaactctttagtagacnagtagccatcttatttgaggacattgcact

SEQ ID NO: 37716 - DNA, 101 bp, rice(Oryza sativa)
  misc_feature (71): n=a or g
gtcagaagtgatagaatactggtcatcattgacctgtagttgaagttgatgcaagtgtttatttcttcttnaggccttgttcggttaatccccatggggga

SEQ ID NO: 37717 - DNA, 101 bp, rice(Oryza sativa)
  misc_feature (71): n=a or g
gtaccataaaaaactaatctaatctagtattgaatataacatattttagcactgttcagtgtccagattcntagtagtaggatgtgtcacatctagttcta

SEQ ID NO: 37718 - DNA, 101 bp, rice(Oryza sativa)
  misc_feature (71): n=a or g
acgcgcgcgcgcgcgccgcggatggattaggctagggacgagtacacgacaggggagggagggagggaggnatccacgagtcgtgaaaagccgaaagagcc

SEQ ID NO: 37719 - DNA, 101 bp, rice(Oryza sativa)
  misc_feature (71): n=a or g
actgctggggtaacgggtagcagagcggaagaggcaacaaagaagaaacattactttgtacacttgggccnccacttattcgactgccttgaaaacacttg

SEQ ID NO: 37720 - DNA, 101 bp, rice(Oryza sativa)
  misc_feature (71): n=a or g
ctctctagcattttgggaacgatgaggttgttcatccatttgactcatctgaggtccgagattttggtttnggctatcctccaatactagtttatggtttt

SEQ ID NO: 37721 - DNA, 101 bp, rice(Oryza sativa)
  misc_feature (71): n=a or g
attacattatagtacgttgtgctggttttgcatcgatttggcacacaagtttataaaagttaacagcgtcnaatatttagggacagaaggagtattaactt

SEQ ID NO: 37722 - DNA, 101 bp, rice(Oryza sativa)
  misc_feature (71): n=a or g
gtacttcatgatcttcaacctctttctccctagacccacagagatcttaatagattcatcattcttctccnactcagaaattgggtgtttgaacttcctca

SEQ ID NO: 37723 - DNA, 101 bp, rice(Oryza sativa)
  misc_feature (71): n=t or c
tgaaaaggagtgtttgaactctgaagatggaaaagatgttcaaccgcggaacttgagggaaaacactacangagcaaggaagataccataaaaagattgca

SEQ ID NO: 37724 - DNA, 101 bp, rice(Oryza sativa)
  misc_feature (71): n=a or c
ttcttctgcaataaataaattagttggaggagatgtcccaatcgtccggcagctttaatttttcatgcgangctagctgatatgtttgacttaggatgaca

SEQ ID NO: 37725 - DNA, 101 bp, rice(Oryza sativa)
  misc_feature (71): n=t or c
gaccagtgtgtgagcaattgagttacaacagcgttaccttttttagccactcgctgatccaagaactgcanaggaatttccaaggaccccaaagaagatgg

SEQ ID NO: 37726 - DNA, 101 bp, rice(Oryza sativa)
  misc_feature (71): n=a or g
ggctctgccactgatcatcgcatctacaaccttgacctctactctgcctactccctgacagcgatctcctncacaacaaccttgaccatgttgtgctcgct

SEQ ID NO: 37727 - DNA, 101 bp, rice(Oryza sativa)
  misc_feature (71): n=a or g
gacctttgccagcatccgcgcattcaggatgaagttaaatcctgagaaattcaccttcggagtatcgtcanggaagctgcttggctttatggtgtcccgta

SEQ ID NO: 37728 - DNA, 101 bp, rice(Oryza sativa)
  misc_feature (71): n=t or c
cagccaatttttatcaggattagcaatatatttatgatgtcatcagggctagtgactaacctcttcttttncttatcttctttcaaaattctcctaacatg

SEQ ID NO: 37729 - DNA, 101 bp, rice(Oryza sativa)
  misc_feature (71): n=a or g
tttccatcaatctgctgctaccactggggtgcctggtgtcagtatgaaatattcgatgccacaatacaagngcagccttcctgctacaagcccaccacagc

SEQ ID NO: 37730 - DNA, 101 bp, rice(Oryza sativa)
  misc_feature (71): n=t or c
actgcagtgagataatgcattcatatgtgctacaagaagtttctgtcagtgaccagttgtttcaaagctcngagaatacattggatgatttggtctggaca

SEQ ID NO: 37731 - DNA, 101 bp, rice(Oryza sativa)
  misc_feature (71): n=t or g
tcgaccaaccttatcgcggaggatccagcatacagaagcagtgagttattaatcgtgatccttttaagatnaagcctaatagcatactaatcgtgatgcta

SEQ ID NO: 37732 - DNA, 101 bp, rice(Oryza sativa)
  misc_feature (71): n=a or g
tactgagacttctgcttatgcaagcatagccttatcctggagtgagcttgagctacttgatccatggctcntgccaagtctagctctagctgctcaggccg

SEQ ID NO: 37733 - DNA, 101 bp, rice(Oryza sativa)
  misc_feature (71): n=a or g
acgttatgaagacagatgaggttaactcgacgtatcacgtataggttctcaaattatttacaaatagcatncaaaacgattcatttcaacaacatcagagt

SEQ ID NO: 37734 - DNA, 101 bp, rice(Oryza sativa)
  misc_feature (71): n=a or g
ggcagcacagaacagatttcccctccaatgtattaggggagagattagattttctaagcagaaacgttctnagattcgaccagaaaactgaattgatattt

SEQ ID NO: 37735 - DNA, 101 bp, rice(Oryza sativa)
  misc_feature (71): n=a or g
gtgtgaagtgcttcttttattctgctttgttttttattaattcagtgaatccggatgcaaattctctgtancggtaagaataaataagaaactatgttttt

SEQ ID NO: 37736 - DNA, 101 bp, rice(Oryza sativa)
  misc_feature (71): n=t or c
tcgcttgagcagatcaaactgataatgtggagcatagctttgacagtccatgagtggtggaaggcgttagntgctaacacgggtctaccaaagaaaaggtg

SEQ ID NO: 37737 - DNA, 101 bp, rice(Oryza sativa)
  misc_feature (71): n=a or g
actaaagaagtgttgcttgtgtatgttttagtcaacgtccttatgtccttccttgctttctcagttacttnatctttgattgtctttataagattatagat

SEQ ID NO: 37738 - DNA, 101 bp, rice(Oryza sativa)
  misc_feature (71): n=t or c
tcccttcagccttgtttaatccatctacagtggcaccaacaacatttcatttacaacatgtagtacaattnttcttcaattgaagccaaacaaaagaggag

SEQ ID NO: 37739 - DNA, 101 bp, rice(Oryza sativa)
  misc_feature (71): n=a or g
attatcaccaagcgccacgtacccatgaatcagcgtgttatacgtgaccgtgttgggcataacccccttcnccctcatctcgctcagcacctggttcgcct

SEQ ID NO: 37740 - DNA, 101 bp, rice(Oryza sativa)
  misc_feature (71): n=a or c
atgcagtgtttggctcgttggttaggcaggggcggacttaaaagatagtgctcccattggttccataattntttgatgtataaaacagtgatataacctct

SEQ ID NO: 37741 - DNA, 101 bp, rice(Oryza sativa)
  misc_feature (71): n=a or g
cagagttatatagttctggcagctatattaccagctcgtatgcaatttaatgtcgcctttcgtctgccgcntgcgagaggtcggcattggtgaggcgtagg

SEQ ID NO: 37742 - DNA, 101 bp, rice(Oryza sativa)
  misc_feature (71): n=t or g
tgtttcatatttgcataaaattgttttattttctgataaacaacaagttttctccaagaggggacaaaaanaatgatgaacatacaaaatcatataccaaa

SEQ ID NO: 37743 - DNA, 101 bp, rice(Oryza sativa)
  misc_feature (71): n=a or c
tgtattcgcctaccagcagctccccaagcttggggagtagggtgttcattgcccctgtggcaacgttcatnttgacctatctatcttcaagtgagctcttg

SEQ ID NO: 37744 - DNA, 101 bp, rice(Oryza sativa)
  misc_feature (71): n=a or g
tttcttcgatctgcctgccttttttttttcagcgttgactgggtactacacaatggaaagtctatttcttnctgacatgcgggcccacccagagctatctg

SEQ ID NO: 37745 - DNA, 101 bp, rice(Oryza sativa)
  misc_feature (71): n=t or c
tcgaaaatgtttcgatcgtttaaatcgagcaccgtttcaccttaaataaaaatattgtttcaacaagtagngaaagaatgtttaagtcactgcaacatttg

SEQ ID NO: 37746 - DNA, 101 bp, rice(Oryza sativa)
  misc_feature (71): n=a or c
tggaaaattgctggataagaataattgtgttctctcacgaggaaacagaaatgcttcggtttgaggcatgnatgcctttaaatcattttcaaccggagtta

SEQ ID NO: 37747 - DNA, 101 bp, rice(Oryza sativa)
  misc_feature (71): n=a or g
taacaaaagagaatgaaacacaaagtgagtatgtggcatacctaatagactgaagcctttggtatcccgtnaatcgattgcggttgaattctctgacagat

SEQ ID NO: 37748 - DNA, 101 bp, rice(Oryza sativa)
  misc_feature (71): n=t or c
aaaataaatcgttggaacccacctattagcttctctccccctcacccctttctcttccatttttcattccnctctctctcatctctctggcgtcgtgggcg

SEQ ID NO: 37749 - DNA, 101 bp, rice(Oryza sativa)
  misc_feature (71): n=t or g
atagatcaatttctctcaaattgagactattgatcacttcattaaaaagaaaaggccaacggggatcaaangaattattattcttttcttcttgcgacctg

SEQ ID NO: 37750 - DNA, 101 bp, rice(Oryza sativa)
  misc_feature (71): n=t or c
aataaccgattttatagtttagggtggaagtagactttgagaaaggttcaagggctaaaactagacttttncctttttaaaaatctaggttatgagttgag

SEQ ID NO: 37751 - DNA, 101 bp, rice(Oryza sativa)
  misc_feature (71): n=a or c
agctagcgttagtattagtttagacaatcgtccttatcagaaccaaattaaatgtaattaactagtacacnggaagagtgtctctacttgtattggtactt

SEQ ID NO: 37752 - DNA, 101 bp, rice(Oryza sativa)
  misc_feature (71): n=a or g
acataattatgtgataattctgcacataaaacatacccattttcttctgtcgagtcgacctgaagagacgnttcagagctgaaatatctggctggtgcctc

SEQ ID NO: 37753 - DNA, 101 bp, rice(Oryza sativa)
  misc_feature (71): n=t or c
tttgatccatatagtggttttcactaacatgaactcattgtgggcctgatcgattgagtgacctgtacacnggtaaaaaagggttaattggatccatgcca

SEQ ID NO: 37754 - DNA, 101 bp, rice(Oryza sativa)
  misc_feature (71): n=t or c
tcccagcgaggtcccgcatcattgtaaatgcatgggctatcgggagggatccacgatactgggacgatgcngaggagttcaaacctaagcgcttcgagaaa

SEQ ID NO: 37755 - DNA, 101 bp, rice(Oryza sativa)
  misc_feature (71): n=a or c
ggccactctccttcgatatttgctcctccattgaacagctccagaaaggacacaatggcaggtgcctacanctggctgtctggcactgcattgaatgcacc

SEQ ID NO: 37756 - DNA, 101 bp, rice(Oryza sativa)
  misc_feature (71): n=a or c
ttatgtcttcgtcaatactattgtggttatcaaaccacacttcactttatcgaaatttttttttggtatcncaacatatgttttaatgtgtttttttatta

SEQ ID NO: 37757 - DNA, 101 bp, rice(Oryza sativa)
  misc_feature (71): n=a or g
actctcagctaatcttggccatccaattaaagatgaacggacaagataatactcctctgtgttcaggtgcntaaccagcaggagatagtagaatcaatata

SEQ ID NO: 37758 - DNA, 101 bp, rice(Oryza sativa)
  misc_feature (71): n=t or c
ggtcggctgagggcagtgatcactcgagattgggtcaagaatgctgtttcaccccttcttgattcctcctngtttcccgctgatcgagcaaatcaggttcg

SEQ ID NO: 37759 - DNA, 101 bp, rice(Oryza sativa)
  misc_feature (71): n=a or g
aagccacatttttaccacaacctaacgaacataatctgccatttttgtaggcgcatgcaggagcaaaagcntcagggccgcttatggcggagatgattata

SEQ ID NO: 37760 - DNA, 101 bp, rice(Oryza sativa)
  misc_feature (71): n=a or g
ggagacaagggggagacctgggaggggagagccgtctccgttgccgccgtcattcccttcagccggatctnggagtggggagggaggaaggggaagggagc

SEQ ID NO: 37761 - DNA, 101 bp, rice(Oryza sativa)
  misc_feature (71): n=a or g
attattgagggcacactgtgtcctttacatatacgggcttctaatgggccaacagactcggcccagtcatngcgaaggggctcctcaagggcacgacggcc

SEQ ID NO: 37762 - DNA, 101 bp, rice(Oryza sativa)
  misc_feature (71): n=a or g
ttgggttcttgtggtcaggagtttgagttcgatggtgatgactgggaaggctggacggtgtacatcgaganggctggcaaggtcgatccgaacaagctgat

SEQ ID NO: 37763 - DNA, 101 bp, rice(Oryza sativa)
  misc_feature (71): n=a or g
ctccacacgtcgaggtttcggacacttgtcagcaaaatggcctggctcatcatagttgaagcacaccactngcatgtttccttgctccttgataggctggt

SEQ ID NO: 37764 - DNA, 101 bp, rice(Oryza sativa)
  misc_feature (71): n=t or g
catcccatccaatgccattgactcatcctcagattcatcaacaccatcaccctcagatgcatcctcagatntatcctcagatgtagcccaagattcatcct

SEQ ID NO: 37765 - DNA, 101 bp, rice(Oryza sativa)
  misc_feature (71): n=t or c
atctaacggctgaactaaatcgggttcaccacatgtgcggctgacgtggcagacagaggctgaagcagcgnggatgtggcggtgttgggttcatggctggt

SEQ ID NO: 37766 - DNA, 101 bp, rice(Oryza sativa)
  misc_feature (71): n=a or g
ttgctccacagcagccgcgccacgcttgtacagacgacgagcgatgatctgaactggaatcaattcttcanactcaacaagaggaagaggccgaactgcaa

SEQ ID NO: 37767 - DNA, 101 bp, rice(Oryza sativa)
  misc_feature (71): n=a or c
atggaggtagcagctgaaatagacaggatattgagacctgacagatggtttgtgttgagagacaccacagnaatgataaaaaagatgcggccagttctcaa

SEQ ID NO: 37768 - DNA, 101 bp, rice(Oryza sativa)
  misc_feature (71): n=a or c
atgagacaacagttaatgagaggaatggaccatgcattaatagcttttttgttgtatccatggctgatatntaagagcaagttcaatagtatagccaccta

SEQ ID NO: 37769 - DNA, 101 bp, rice(Oryza sativa)
  misc_feature (71): n=a or g
attctagaggtcagcctacatgcatataggacatgaaatgcttcatgcccaaaagaattgagagacatacntagtgttgagtaattaatcaatcgatcaac

SEQ ID NO: 37770 - DNA, 101 bp, rice(Oryza sativa)
  misc_feature (71): n=t or g
gtcgagtcgtggtcctcctgaaggttggggaggccggaaggttggggagaggaggggtggtggtgttagcnggcggcgcaaggtatggcgagcgccagatc

SEQ ID NO: 37771 - DNA, 101 bp, rice(Oryza sativa)
  misc_feature (71): n=t or c
atattttgttgtctatgtattgcagtcgacttgtacaccgagtctttccatccctattaagagctggagcncaatattatgatgggatttgctataaatgt

SEQ ID NO: 37772 - DNA, 101 bp, rice(Oryza sativa)
  misc_feature (71): n=t or c
ttggtaaaatggatctaacactagtagcaaaaagtaagtaagttggcatttatcatttggaagatcatagnagcaaatttggcaaaaaagcgtcgggtccc

SEQ ID NO: 37773 - DNA, 101 bp, rice(Oryza sativa)
  misc_feature (71): n=a or g
taaacatcatgtgactaataatcaggctaaatatgaggtagttttaaaagggttacaattgcttcaggagnttgaagccgatgctattgaaattgtgggtg

SEQ ID NO: 37774 - DNA, 101 bp, rice(Oryza sativa)
  misc_feature (71): n=t or c
ggaagtcaggactcaggagtagcaaaactagtcaatcagtggtaattcaggttttgacctgctgccgccgncgcggcgcctcctcgtcctcccggccgagc

SEQ ID NO: 37775 - DNA, 101 bp, rice(Oryza sativa)
  misc_feature (71): n=t or c
tataataagtagaataattcagaacaggccctccctccagaaccgaataattcagaacaggccctccctcnagaaccgcgcagcccagcccaaccgacggg

SEQ ID NO: 37776 - DNA, 101 bp, rice(Oryza sativa)
  misc_feature (71): n=a or g
gttgatcgatctgccttttgagttttgtacacatccatcttttcctagcatgtatagcgaaaaagggcaantagtaaacatgtgtacacgcgttctgaact

SEQ ID NO: 37777 - DNA, 101 bp, rice(Oryza sativa)
  misc_feature (71): n=t or c
tggcccatcagcgcagcgatatgtaacgctgtgcttccttcactgtcctgcatggcaacaagactctgtcntgctggatcaccaaataatgatttcgattt

SEQ ID NO: 37778 - DNA, 101 bp, rice(Oryza sativa)
  misc_feature (71): n=a or g
ctgtagtatatatagcttctttctgatgataacagaagtgatccttgactactgttagcgaagtatccccnatacagattttaatgggcaccaccagcata

SEQ ID NO: 37779 - DNA, 101 bp, rice(Oryza sativa)
  misc_feature (71): n=a or c
aaagtggtgctagtggggaaattcaacaggagtcagttgagcatggcgaaacagagtttgtggcacaaagnccacacatccatcttgattcagtgggagag

SEQ ID NO: 37780 - DNA, 101 bp, rice(Oryza sativa)
  misc_feature (71): n=a or g
gcaatttctggaaggtgaagaattagaagaagctgtggatgaagcagccgaaaacattagtgaaacaaganagcaaacacctccagccgatattcctgctc

SEQ ID NO: 37781 - DNA, 101 bp, rice(Oryza sativa)
  misc_feature (71): n=a or g
atggggggcagagacaccttctggtattaattggggggagagcatttatggtgttttgtaagcatgctgcntcctcacacacacaacacacttacctagag

SEQ ID NO: 37782 - DNA, 101 bp, rice(Oryza sativa)
  misc_feature (71): n=t or c
atttgccacagactggatggttgtggtcagtattatcctgctgcttgtaccattgtcttcaaaggtcgatnttatgatgttccattgatccatcccgatgt

SEQ ID NO: 37783 - DNA, 101 bp, rice(Oryza sativa)
  misc_feature (71): n=t or c
caaatcagggggcctctcgcctcagctcgttgtcagcacatgccatggaaagtgttaggcttaaattgccngaaagctccttaaactagcaacttggtgtg

SEQ ID NO: 37784 - DNA, 101 bp, rice(Oryza sativa)
  misc_feature (71): n=a or g
cccatcagcggtgtttagagtcgcactgccgtgaaggcgaggacatgagtcggtggcagacgaggcaactngcggtgaagacgatgatgcccaccagtggt

SEQ ID NO: 37785 - DNA, 101 bp, rice(Oryza sativa)
  misc_feature (71): n=t or c
ctttaagaaagtcatgggtgatgtgaagcaggcagattctgtcccacaagttcaaaagaaggctgcagcancaaaggagcagaagccaaaggaagccaaga

SEQ ID NO: 37786 - DNA, 101 bp, rice(Oryza sativa)
  misc_feature (71): n=a or g
aactgctcgtccactaacggcctcttgtgtctctgggggaacgacaacagccttgcatcgcaatactcctncggcacaattcgttcaggctgagctgcctc

SEQ ID NO: 37787 - DNA, 101 bp, rice(Oryza sativa)
  misc_feature (71): n=a or c
tcagctgtgaaccacgcattgatcaaccagtctagggtcttggtcaatacacttgctaatttgatcaagtnagtggttgatggatccattgctgagcacga

SEQ ID NO: 37788 - DNA, 101 bp, rice(Oryza sativa)
  misc_feature (71): n=t or c
atgggatatcaccgttaacaattagacatgaatgtcctctctaaaaggtggagctaccaactctttatttntttgttgcctttaaacatgggttccgaatc

SEQ ID NO: 37789 - DNA, 101 bp, rice(Oryza sativa)
  misc_feature (71): n=a or c
gagctcgccaagttcgcctagatatacgtgccatattgccatgacgatgtgtgtaaggatctcatctcatntcatttgggtcacaagttcacaaccctgct

SEQ ID NO: 37790 - DNA, 101 bp, rice(Oryza sativa)
  misc_feature (71): n=t or g
ttgcgaattaggcttgaccagactgtgacaccgtcccgcgcacgttcatccagttggcttatttaaagcangtacaatattagactataaaccagctataa

SEQ ID NO: 37791 - DNA, 101 bp, rice(Oryza sativa)
  misc_feature (71): n=a or g
atttctttactgttgtagttgtctaaatcgtgaacctattataacatggatcagtggcgttattccaaatnatgaaattctggctttggctgttgacgaat

SEQ ID NO: 37792 - DNA, 101 bp, rice(Oryza sativa)
  misc_feature (71): n=t or g
attaacttgctgtaagcatcatggaggctattactgtaacatagatcggccgtcgattggattctttatanattcgcttgaatgcagcaataataagtaaa

SEQ ID NO: 37793 - DNA, 101 bp, rice(Oryza sativa)
  misc_feature (71): n=a or g
cgagcatactgaggttggcgaaggaagtgagggtggtggagaagaaccaggagcttgcttgatcgatatgnccggtcaaattgatagagattattacacat

SEQ ID NO: 37794 - DNA, 101 bp, rice(Oryza sativa)
  misc_feature (71): n=t or c
atgctctcctccccctcttctcctcccttctccaagaacccaagaaaacccgatctcgaagctgctctccngttcacgcacgcacgcgcacctaccaaccg

SEQ ID NO: 37795 - DNA, 101 bp, rice(Oryza sativa)
  misc_feature (71): n=a or g
aaagagtttctggaagctctagtctctgaagatttctcatccttccaatctccggtggaacaacaccgctnaaagagtttaaaccaatggtaaatattgag

SEQ ID NO: 37796 - DNA, 101 bp, rice(Oryza sativa)
  misc_feature (71): n=a or g
gtttgcttctataataagctttaattcttattaactcgatggttggtttaagtgtttatcagggccttgcngacaaatcaccacatttactggatttttat

SEQ ID NO: 37797 - DNA, 101 bp, rice(Oryza sativa)
  misc_feature (71): n=t or c
accaaacgtgccataaaaattgatgacatggaggtagaagtgtttgcggcgatgcttactttcatttacanagatgcattgcctgagatgaagcagcaaga

SEQ ID NO: 37798 - DNA, 101 bp, rice(Oryza sativa)
  misc_feature (71): n=t or c
ggctctcgtcgttgcaactaggagcaattagcaggcgagcaacaatcaacaagacaatgggagaggtaganatataagagaatctagtttcttcaagttgt

SEQ ID NO: 37799 - DNA, 101 bp, rice(Oryza sativa)
  misc_feature (71): n=a or g
cttcatcaagtccacggcacttagggccgccactgacctgtgcatttccgatgccatccaccgcaatggcngcgctgccaccttgtctgacctcgccctca

SEQ ID NO: 37800 - DNA, 101 bp, rice(Oryza sativa)
  misc_feature (71): n=a or g
gtgattgtgtcattgcaaggagtcgatgaacctactgatgggttgtttcgagcacctcattcataccactnggccaagtggatctggagagctctagcaaa

SEQ ID NO: 37801 - DNA, 101 bp, rice(Oryza sativa)
  misc_feature (71): n=t or c
attaatgagttcatcaaagtaactctctcctttttcatatagacttgtaccttgtcttggctggataaaancttcagctatccatctccatattaggtcat

SEQ ID NO: 37802 - DNA, 101 bp, rice(Oryza sativa)
  misc_feature (71): n=t or c
ttaagcgcagctatttcatttagcctttcacggacctttcttatttttcttcccagttcaaaaggaaaganggttagttgggcaaaataagtacagatttc

SEQ ID NO: 37803 - DNA, 101 bp, rice(Oryza sativa)
  misc_feature (71): n=t or c
gctccggcagcgtctccgagatcgtgatcgactcgaggagtggatcacgggtttggcgcgtgattgtcacncacacgcgcttgtggatgcggctcgggttt

SEQ ID NO: 37804 - DNA, 101 bp, rice(Oryza sativa)
  misc_feature (71): n=a or c
tagaactgcaacatcagcttactacatcttgacagatggaaccattaatcttgacaagttggcatacgtcnatagcaccaccaccaggcacaactgttggg

SEQ ID NO: 37805 - DNA, 101 bp, rice(Oryza sativa)
  misc_feature (71): n=a or g
tccattctacttactgacttgtacgcctaagtttggttttgatccacttatacttcttccttggtgagtcntttaacaaccctgcgaaatttatattagtt

SEQ ID NO: 37806 - DNA, 101 bp, rice(Oryza sativa)
  misc_feature (71): n=a or g
gaaaaaaacaaaaaaaaacacggtgggagggagaaacaaaagaaaaatccgcagctctcaggtgtgagtcncgccatggagctttcctggcgcgctgcgcg

SEQ ID NO: 37807 - DNA, 101 bp, rice(Oryza sativa)
  misc_feature (71): n=t or c
cccgagctcccatcgcgccctctcgagctccccgtgtcgctcctctctctccgccgttgctggtgatctcnagccaccactcgccgccatcctagccatcg

SEQ ID NO: 37808 - DNA, 101 bp, rice(Oryza sativa)
  misc_feature (71): n=a or g
ttaactccggccaagccgcggcaaccaaactccggccccgtacggacaaacaaaatgaagaaaaaccactngtcctctataaattaggttttaactatttt

SEQ ID NO: 37809 - DNA, 101 bp, rice(Oryza sativa)
  misc_feature (71): n=a or g
gtagtacttttttttggatgtatatgagaagactcgaagacctacaggccttttcttttctaggaggcatnaagtacgaactgatgaggatgatagccgtg

SEQ ID NO: 37810 - DNA, 101 bp, rice(Oryza sativa)
  misc_feature (71): n=a or g
tttttcatgttcaaaatgcttgtatgctgtgttcacttccatgcatgttaattgaatctagtgaactctgnatgaggatttgaatcgatgctcgaaaattt

SEQ ID NO: 37811 - DNA, 101 bp, rice(Oryza sativa)
  misc_feature (71): n=t or c
ttttgctgaatatgcccctgatgataatcactctgattcctcaccatctgactgttctatctctttgttgnaaaagatgggagtggatatgtgcagcctag

SEQ ID NO: 37812 - DNA, 101 bp, rice(Oryza sativa)
  misc_feature (71): n=t or c
aaatacccagccaccttcataacccatccagagtctctctttccctccctccgccacctcacctgcgcctngattgctttgtgatcgatccagatagcaac

SEQ ID NO: 37813 - DNA, 101 bp, rice(Oryza sativa)
  misc_feature (71): n=t or c
ttccaactttagaaggaactaaacacaaccgaagaagtatgatatcagtcgcactgctttaaatagctttntgttattttgaacaaactaattaatatgtt

SEQ ID NO: 37814 - DNA, 101 bp, rice(Oryza sativa)
  misc_feature (71): n=a or g
tcggttagcaagtagcagagtactttgactttgcttgaagtgtttttacttatatttttaaggggcaattncatccatgccctcattttgaatgtcaactg

SEQ ID NO: 37815 - DNA, 101 bp, rice(Oryza sativa)
  misc_feature (71): n=a or g
attttatattttacatataccggtggctgtttgtagttgaccacatgctatttggtttcaaatagacactnaaagatgagatatttaaccatttgccacat

SEQ ID NO: 37816 - DNA, 101 bp, rice(Oryza sativa)
  misc_feature (71): n=t or c
tgggctaggcatcaatactaatagagctgtcttaggcactactacatgattgattttcatgcacgcctccnctttttgtttccagacggtccgtaagttaa

SEQ ID NO: 37817 - DNA, 101 bp, rice(Oryza sativa)
  misc_feature (71): n=t or c
tagctagctagctcgctcgctctggaaagcatgcttatgtccatcactacgctttttgtccagttaattgnccgttataagctcggattagaggaacgatt

SEQ ID NO: 37818 - DNA, 101 bp, rice(Oryza sativa)
  misc_feature (71): n=a or g
ccaacaaattagcaatactagtacttaaaaaaaatgtaacgaatcgagcatcccgttgactcgcgatagcnggaggaacaaggggggaagagagccgttgg

SEQ ID NO: 37819 - DNA, 101 bp, rice(Oryza sativa)
  misc_feature (71): n=t or c
tattactccctctattctaaaatataagcatatctgctcgttttcgaaaatgtatctggacggaaggatgnccaaatacatttttaaaatactcatagaaa

SEQ ID NO: 37820 - DNA, 101 bp, rice(Oryza sativa)
  misc_feature (71): n=t or g
cagcaattaaatcatggacggttcagggagttaacaacttcaacaccaacatgtcgtgtatacattttttntcgtgtatacattttttttctttttgccct

SEQ ID NO: 37821 - DNA, 101 bp, rice(Oryza sativa)
  misc_feature (71): n=t or g
tgctggtgcatgtgagagtaaatgatagaggacgtaccctgcttattttccaccttctatggtgtttgatnttgtttgatgtatttttcatcagagcatca

SEQ ID NO: 37822 - DNA, 101 bp, rice(Oryza sativa)
  misc_feature (71): n=a or g
ctgtgcgtgattgtatgttgttgcactcgaaaaaattgagaattgcaatttacctgtctcatttgggtgancaggagaatgggaacctgaggtctgcgctg

SEQ ID NO: 37823 - DNA, 101 bp, rice(Oryza sativa)
  misc_feature (71): n=t or c
cctatcttggctaggggacacaggatactggattttgaaaaggcaaaatccaaggtggaggtgacagtctncggcgaggtcaggtaccaggcgcactacac

SEQ ID NO: 37824 - DNA, 101 bp, rice(Oryza sativa)
  misc_feature (71): n=t or g
gcaagctctttcttcttccattccttcttcgaaagctgcctttctgtctctttagattgtgcaggtattanaccagaattcttaacctcaagctcagatgg

SEQ ID NO: 37825 - DNA, 101 bp, rice(Oryza sativa)
  misc_feature (71): n=t or c
tgtagtcagaacttgctgtaatcagagttgttaactagagacctcaaatgttctatttgcagcgtataaancaatggtagcattattgtaacaaagatcgc

SEQ ID NO: 37826 - DNA, 101 bp, rice(Oryza sativa)
  misc_feature (71): n=a or c
gcatagaaaagaattgcaacaaaatcctccctgttctgcagcacaagagtaactgccttttgcagaacaanatcatccccctggcacataaaatggagaat

SEQ ID NO: 37827 - DNA, 101 bp, rice(Oryza sativa)
  misc_feature (71): n=t or c
tttcaagaaatttgatgatcctagagagagaatctcgagtatctaaatttttacattaaaattgtttatanctcaagatacttattatttggatgtaccaa

SEQ ID NO: 37828 - DNA, 101 bp, rice(Oryza sativa)
  misc_feature (71): n=t or c
aggttgggatttggatttagggatcgacccaacttaggttgtgatagtcctaactcctgaatgataagcgnggattagctgtgttgttccatgcaatctga

SEQ ID NO: 37829 - DNA, 101 bp, rice(Oryza sativa)
  misc_feature (71): n=t or c
ctcaaggagaatagaggtttgtcggagggtgttttccttttctactgatctgaattcggtccagaagaatncttgaggtttgcgattgcatatttactgca

SEQ ID NO: 37830 - DNA, 101 bp, rice(Oryza sativa)
  misc_feature (71): n=a or g
catcgctcctctcaactaccgctgggtaataattcaattccttcacctcatgtatcacaaattcaaggganaaaaaagagctgcaattcaaacattttgtc

SEQ ID NO: 37831 - DNA, 101 bp, rice(Oryza sativa)
  misc_feature (71): n=a or g
ggagggatacggtatttggcgaaaatatacagaaaccaatggcatgtgtttggcacagctcaaaaagctcngctaaacggtctctagctccaacaaaaata

SEQ ID NO: 37832 - DNA, 101 bp, rice(Oryza sativa)
  misc_feature (71): n=a or g
aagagggattgggcgaacaagtgggtccaataaaattttcttttacttgttttggctgactgactatcacntgtgtgtcactaaagagcaaaaccgcccta

SEQ ID NO: 37833 - DNA, 101 bp, rice(Oryza sativa)
  misc_feature (71): n=t or c
catgaggttgggtagtgttccaagtatctctatggctctaccatctagttcgcttagccgcaaaaaaatcntccgcagctgcttaaggttcctaaaagagt

SEQ ID NO: 37834 - DNA, 101 bp, rice(Oryza sativa)
  misc_feature (71): n=t or c
cagtaactcgaataacaacatcaaaagcagggtttttgtgaaacaagttgttgatctgatggagcagatgngtctttcccacacctccagggccccataac

SEQ ID NO: 37835 - DNA, 101 bp, rice(Oryza sativa)
  misc_feature (71): n=a or c
ctgacacgacctccaacaacataatgcggtagtggtcattgaaaaacagcaactgtccatctagaatggtnttgtttggcaagtgcacaagcacctgaaaa

SEQ ID NO: 37836 - DNA, 101 bp, rice(Oryza sativa)
  misc_feature (71): n=t or c
tgcgtgccctgacattcctttcggcccatcaaggcttacatttatagtattaaatagctcaattgtgccantcatgcaaagagtcgatatgtccgagtggt

SEQ ID NO: 37837 - DNA, 101 bp, rice(Oryza sativa)
  misc_feature (71): n=t or c
ggggatctgccagatgtcatgcctacagatgaagatcttcctccagtcaatcacatttccgttcctgaacnagtgccacaagtgcagccagaagtggagct

SEQ ID NO: 37838 - DNA, 101 bp, rice(Oryza sativa)
  misc_feature (71): n=a or g
attcttaaaaacattcgagaaatttcactcgtaatatactttttcccacaccgaaaccacaaaattgcgtngttttcgaccggttttcattgaaaacttat

SEQ ID NO: 37839 - DNA, 101 bp, rice(Oryza sativa)
  misc_feature (71): n=t or c
atatcagacaaaaaacaaatatgcccccattgccagtacatgaaaatgcactaatcctcccccaactctgntgccaaccctcgggcccacatgtcagtgag

SEQ ID NO: 37840 - DNA, 101 bp, rice(Oryza sativa)
  misc_feature (71): n=t or g
agggtgtttatttgtaaatagttattaatatttacacaccacatgggtttacacaccacatggcacatggntgcaaaagaatttgcttcaagtttattcga

SEQ ID NO: 37841 - DNA, 101 bp, rice(Oryza sativa)
  misc_feature (71): n=a or g
gagcccagcatatatgatgagaggttgacggttaatttagaacattagcccctagtgtgaacatagccctngagttccgtggtgggcatgctagccaccat

SEQ ID NO: 37842 - DNA, 101 bp, rice(Oryza sativa)
  misc_feature (71): n=a or g
acttcagctcacgcagtgcttcctcattcccataaaaaacaaacctagtattgtatgtgaccttagcccanatttattgtactagaatgtgtcatatctta

SEQ ID NO: 37843 - DNA, 101 bp, rice(Oryza sativa)
  misc_feature (71): n=a or g
gtagggaaatgactgaagaagagaaagcaacaacgagacagctggccattgtggcactatggtgcattcantggaacccaaataaccggccatcaatgaca

SEQ ID NO: 37844 - DNA, 101 bp, rice(Oryza sativa)
  misc_feature (71): n=t or c
gtgcagataacttattaggacatttattttgcaggcttcgaaccaaaaatggtccttagagcatctccagnagggaccttaaacccagtccctaaataaat

SEQ ID NO: 37845 - DNA, 101 bp, rice(Oryza sativa)
  misc_feature (71): n=a or g
taagatattagttctactgtaccggtcctaccttagatttttggttcgattttctatcctgcaaggagatntgtgtgtgtgcatatccagcgtgaattttc

SEQ ID NO: 37846 - DNA, 101 bp, rice(Oryza sativa)
  misc_feature (71): n=a or g
tgaaaagggaacttgtcaaatgcgtgcaacctgaacaaattattcgtagcaatgcagatctagcaactttncatctttcagtacatccggaacaagtaatg

SEQ ID NO: 37847 - DNA, 101 bp, rice(Oryza sativa)
  misc_feature (71): n=t or c
ctttctttccctcctgttgtacccccccttgtatattggtgcttttaataaaatgtgcagtaggagcttcncctactgttttaaccctcaaacaatgggaa

SEQ ID NO: 37848 - DNA, 101 bp, rice(Oryza sativa)
  misc_feature (71): n=t or g
ttgtcgtcgtcgtcgtcactgcccatggccttgtcatctttgcctccctcctcctgcttctgcttgcgttnatctctgctgccttgtgcttgtacgggctg

SEQ ID NO: 37849 - DNA, 101 bp, rice(Oryza sativa)
  misc_feature (71): n=t or c
gtactcatcctcttcatccttttttcagtcccccatcttcctcatcttttccgtttctcctcaccttcttnatggggatccaacacgatagggagaactcg

SEQ ID NO: 37850 - DNA, 101 bp, rice(Oryza sativa)
  misc_feature (71): n=t or c
aggaaaaattggaaataaattttgtaaaaaggaaaaaacaggtgcatgaccattgcataccgacaaataangggtaatcaaatattatagtttagtgtgag

SEQ ID NO: 37851 - DNA, 101 bp, rice(Oryza sativa)
  misc_feature (71): n=a or g
atcgttaagtggatataaattaaggtttgaaatttgcgaggttttgtttctgtttttttttccatcgaacntgatatagcaacgcgcccatgatctcgatc

SEQ ID NO: 37852 - DNA, 101 bp, rice(Oryza sativa)
  misc_feature (71): n=a or g
aacatggatatatgtttacagaagagcaacgccgacaacaatttggccggggctgtcctccctgcagagtncagagtacatagtactaatgtatgacgtcg

SEQ ID NO: 37853 - DNA, 101 bp, rice(Oryza sativa)
  misc_feature (71): n=a or g
agaagcaacaatagtgcgacaacggatgggacaatgatttcgacgagcttagctgtctgtgaattgtctgnaacagaattggtggctgcaaaattcacaga

SEQ ID NO: 37854 - DNA, 101 bp, rice(Oryza sativa)
  misc_feature (71): n=t or c
cgccgcctgaagcatccgtaggcgatttggtgattggcgagagctccgactttcgccaaagattcagcgtntgttattgttagtcaagaacggctgcgcgg

SEQ ID NO: 37855 - DNA, 101 bp, rice(Oryza sativa)
  misc_feature (71): n=a or g
tactgttaacgatgtcgaaccttgatttctgcagcttcaatggacacatccgcatctttaccacggaggcnttggagcgctatttcaaactccttttgccg

SEQ ID NO: 37856 - DNA, 101 bp, rice(Oryza sativa)
  misc_feature (71): n=t or c
gcaacatcactaaaattgacatcaacggtcattctgggcaccagcctagaaatagaacttccatcggctgngttttctgatggctgaggcacagtagtgcg

SEQ ID NO: 37857 - DNA, 101 bp, rice(Oryza sativa)
  misc_feature (71): n=t or c
gaggttgagaaataagggcagaaccatggtccatctggttgcagcagaggagcaaaaaagctttattgggnaattcactcaaattcaactattcatggtaa

SEQ ID NO: 37858 - DNA, 101 bp, rice(Oryza sativa)
  misc_feature (71): n=a or g
aaacaaatataaacaaatatagatctttctttattagaaataatcttgatagatatattggaccaatccgngacaatataaggttcaagttaataaagatt

SEQ ID NO: 37859 - DNA, 101 bp, rice(Oryza sativa)
  misc_feature (71): n=t or c
taattggtatggtgttttaatttgggcatggtgtcttgattgatgcaacttaaaagggcggcaaggggccnagatgcaaaatctatcagccaaatgctttt

SEQ ID NO: 37860 - DNA, 101 bp, rice(Oryza sativa)
  misc_feature (71): n=t or c
ttaggattatcccagagcgcgatttctttgaaaatcaggcttgcgaccggagaagaaggtccattcagatntagcgtatggatcgagcccagacagtttaa

SEQ ID NO: 37861 - DNA, 101 bp, rice(Oryza sativa)
  misc_feature (71): n=a or c
ccagttgatgagttgccagatgtaggagtaggtgatttcatggctgtttctataggtcgtctaaggctatntttgctgccttctggatttaacctttttct

SEQ ID NO: 37862 - DNA, 101 bp, rice(Oryza sativa)
  misc_feature (71): n=a or g
ttgtgattttgtgaacttttagtcatgatcgacgtacagggtaatttgtcacatgccaattaagatgaatntgcttttgtgtaacttgggttacactccag

SEQ ID NO: 37863 - DNA, 101 bp, rice(Oryza sativa)
  misc_feature (71): n=a or g
cctccccatcggtaagtctcttgggttgttaattacgtagtcggaaggtgtcaccctcacgttgtactcgntttacttaggccttggatgcgtctccgcca

SEQ ID NO: 37864 - DNA, 101 bp, rice(Oryza sativa)
  misc_feature (71): n=t or g
tggtttgctaccaaagttgcatcttgacatattgaactgagccaaataatttggcaaggcaactttttttngccacaaaccaaacaaataacaaatatttt

SEQ ID NO: 37865 - DNA, 101 bp, rice(Oryza sativa)
  misc_feature (71): n=t or c
agacaggaaaaccattgtagcaatcatggatttttttttgcggggcaatcatggattaataacatatactncctctgttttacaatataagtcattctagc

SEQ ID NO: 37866 - DNA, 101 bp, rice(Oryza sativa)
  misc_feature (71): n=t or c
tgtgtgtttttttcgtaagtaattagtagttacagcctccttctctcgtactccctccatacccacaaaanaagtcgaaacaagtcgtttaggtcaaagat

SEQ ID NO: 37867 - DNA, 101 bp, rice(Oryza sativa)
  misc_feature (71): n=t or c
gaagtccactggttttgtaacgttgaactttactttacgggaacatatcctatcctatttacacgagcttnctgtgcacaatccgtgcacaccacctagca

SEQ ID NO: 37868 - DNA, 101 bp, rice(Oryza sativa)
  misc_feature (71): n=a or g
caaacgttaatccgattactaccacttcatcccaacttccatggcagcaaacaaatgttccatttcactcnactcgataaactactcttctatcttctacg

SEQ ID NO: 37869 - DNA, 101 bp, rice(Oryza sativa)
  misc_feature (71): n=a or g
ttccattaaaatcgaaaaaatcactactatacaaagcgtctttccatgttgttgggaagcatctttccatncggttgccccaaccgcatggacaaaatcgt

SEQ ID NO: 37870 - DNA, 101 bp, rice(Oryza sativa)
  misc_feature (71): n=t or c
acgcccggtgggacacgacaaacagcaatgtcggcagaaaagccacccccgtcattgacaggcaagccccnagtttctcctcaaaccaagattccaaaacc

SEQ ID NO: 37871 - DNA, 101 bp, rice(Oryza sativa)
  misc_feature (71): n=t or g
gagagacgacagacgaagaggtgaaaaaaatggagtcatgttttgtaacgccccacgaggacacgccaganacgatagaagaagaggtgaaagagatggag

SEQ ID NO: 37872 - DNA, 101 bp, rice(Oryza sativa)
  misc_feature (71): n=t or c
agagcggcaagatgcggctcgtgcgggtcgtgcatgtgaagacatatctgctgcacggcataagagatgcntggcctggtgaaactcaagtactgcagggc

SEQ ID NO: 37873 - DNA, 101 bp, rice(Oryza sativa)
  misc_feature (71): n=a or g
tgaggctggcgcatcccgatttaaacctcaaagaagctttggatcggggagtcgccaataacgcgcgtaangacacgatggaggaagtcgacgacttgggg

SEQ ID NO: 37874 - DNA, 101 bp, rice(Oryza sativa)
  misc_feature (71): n=t or c
gggagatcactggtggaatccggtgggcttgggatgcaacaacaacagctactgcacacaacggcgaaatnggtggcgacccttcctgtgacgatggatgt

SEQ ID NO: 37875 - DNA, 101 bp, rice(Oryza sativa)
  misc_feature (71): n=t or c
aagagacgtaaatgtctcctttaataatatttttttagtgcaccttcctagtatactactccatccatccntaaatatatgtgattttagctagacgtgac

SEQ ID NO: 37876 - DNA, 101 bp, rice(Oryza sativa)
  misc_feature (71): n=a or g
tgcgcaaaagcatacatttcactgtttcaaaaggttcctttcaggtctggtgcatcggcatcagtctctcngtgcataacacgccttgccatgctaagtgt

SEQ ID NO: 37877 - DNA, 101 bp, rice(Oryza sativa)
  misc_feature (71): n=a or g
cagactatccggttgcataccagattgtccaatccatataatccttaggcctcctccatgtgatttgagtngattgcctgattttcaccatactgtccagt

SEQ ID NO: 37878 - DNA, 101 bp, rice(Oryza sativa)
  misc_feature (71): n=a or g
ccctataaaattttatatttgcattggtctaacatactatttttttcatgcttccaatctagagtgaattntggacaacaactaagctatttgggatgatt

SEQ ID NO: 37879 - DNA, 101 bp, rice(Oryza sativa)
  misc_feature (71): n=a or g
gtgaataccatgggtgttatcaggaaaaactggggtcaacgaacaatggaaagattcagatgggagccgancgacacatacatgggcgctgagtttcagga

SEQ ID NO: 37880 - DNA, 101 bp, rice(Oryza sativa)
  misc_feature (71): n=a or g
tgctctatgtcgatgcagtcatgccaggaatctttggatggaaatggccaaggcaggaaatcttgtatctnacattaattcgatcagagggggttcttact

SEQ ID NO: 37881 - DNA, 101 bp, rice(Oryza sativa)
  misc_feature (71): n=a or g
ctactgctaattagtacttcccccgctctaaaatataagcatttatgcgtgtttttcaaaatgaataggcngagaaatgttcggaaatattttaaaaaaca

SEQ ID NO: 37882 - DNA, 101 bp, rice(Oryza sativa)
  misc_feature (71): n=a or g
gaatatctctataaatgtccccatcaaggcttttagttatgtaaaaccctagggtgcggttattatccttntagtctatatgaatagaccgcaatgggtag

SEQ ID NO: 37883 - DNA, 101 bp, rice(Oryza sativa)
  misc_feature (71): n=a or g
ccgcgacctaactggtctgtcgccaccagaatactcgcccttctcgatatagtctgtattcgtcttcacanactcgtcttgtgatccgatctcagacatca

SEQ ID NO: 37884 - DNA, 101 bp, rice(Oryza sativa)
  misc_feature (71): n=a or g
gcattaaaaaaagaacaagtatagataatctatgcataaaaaaatgaacaaggggcacaggggcagcggcngcaacaacaattcatcaaaaaagaacaagt

SEQ ID NO: 37885 - DNA, 101 bp, rice(Oryza sativa)
  misc_feature (71): n=a or c
aaagctggatgcagagtctcctcgggcaatttcaccagcaagtgtatccaaatctttaccatctctgatcngtttttcaaatattgccacactaagtgaca

SEQ ID NO: 37886 - DNA, 101 bp, rice(Oryza sativa)
  misc_feature (71): n=t or c
gtgcacattagcccaagcttggccatttgtatggcgcatgttagtatttcaggcacaacatgatttgggtnttcaccttcacaatattcggtgatagtagg

SEQ ID NO: 37887 - DNA, 101 bp, rice(Oryza sativa)
  misc_feature (71): n=t or c
agtgccaatttgtaccatgccaatattttggtagctttaaatagtactttgataacatttggattgtgacnattttttgcctaactaataataaatctact

SEQ ID NO: 37888 - DNA, 101 bp, rice(Oryza sativa)
  misc_feature (71): n=a or g
catagttttacaaagaaacggtcgaaaatatggctcattctaattttccaacgagatcactatatttatgncgtcgttatatttttaagtacataatcagt

SEQ ID NO: 37889 - DNA, 101 bp, rice(Oryza sativa)
  misc_feature (71): n=t or c
gatggcacggcgtccatggtggaagtagcaacgtttgacatggtagatgggttggtcaaggaggtgatgcngtgacgccgatcgatgtcggcatggccagc

SEQ ID NO: 37890 - DNA, 101 bp, rice(Oryza sativa)
  misc_feature (71): n=a or g
ttgacagccaattgagatcatcacacaccgagtctggcaacttgaacacacccattacatataccggaatngcctgaatcacagatttaaacatcatctcc

SEQ ID NO: 37891 - DNA, 101 bp, rice(Oryza sativa)
  misc_feature (71): n=a or g
ccgacctttccaaaagaacgcagccttcgatgttgagtagataggtcaacagggtgtggccccaccgcatnagggtcaggcttatagttggccaaaaggcc

SEQ ID NO: 37892 - DNA, 101 bp, rice(Oryza sativa)
  misc_feature (71): n=t or c
cgaaagatcccattatgtcccatcacaagagctgcatttggagcctgcgcaagagcctcttctaatgctgntttccactcaaataaatcttcagaagtttc

SEQ ID NO: 37893 - DNA, 101 bp, rice(Oryza sativa)
  misc_feature (71): n=a or c
tcacgacattaggttcgacccctttagctaccatctctgtgtatatagccattgctatttccatttccccnttcttcgagtgcccatctatcaaggaggag

SEQ ID NO: 37894 - DNA, 101 bp, rice(Oryza sativa)
  misc_feature (71): n=a or c
tagggcatatcactaacaggtccaagcacagcaggtgatagtaagcactcatttttttttggttccttctntgtcgatctgttgcacaaaggtcaaatttc

SEQ ID NO: 37895 - DNA, 101 bp, rice(Oryza sativa)
  misc_feature (71): n=t or c
acatctgttgtcaggcctcaaaacaaaagtcttaggccttgcggtgctcaataaattgaggctaagacagngcttgagattaacttggcttaaagaaggtg

SEQ ID NO: 37896 - DNA, 101 bp, rice(Oryza sativa)
  misc_feature (71): n=a or g
acaggagccatttgtgcagattcagaatgtctcatttgttcctgcaatgaacgcgattgaggatactttcntgaacctgtcctctgatcaagggagcaact

SEQ ID NO: 37897 - DNA, 101 bp, rice(Oryza sativa)
  misc_feature (71): n=a or g
ggacctcgagaatgagaatggaggtgctggggtctattctgctagtctcaagaagcattacttattggctnatgatgaatggaaggaagatattctgcctg

SEQ ID NO: 37898 - DNA, 101 bp, rice(Oryza sativa)
  misc_feature (71): n=a or g
taattaacttcccatgttgttcatggacgtatgtgtggataatcttcgattgtggatcgctaggtggaccnctatagagcccctccacatcactgagcatg

SEQ ID NO: 37899 - DNA, 101 bp, rice(Oryza sativa)
  misc_feature (71): n=t or c
gttatatggatgacagtatgaggctggtttgaatctagcttcttagaaaaaaaaaggccgaaatgtatttnatttatctaaaaatgtagaggttgaattaa

SEQ ID NO: 37900 - DNA, 101 bp, rice(Oryza sativa)
  misc_feature (71): n=t or c
ggtacgtgtatgcctagtacgtagctcttagccatgcatatgcatactctctccctttaaaaaaactcaanctagaagagatagttcatattcattatact

SEQ ID NO: 37901 - DNA, 101 bp, rice(Oryza sativa)
  misc_feature (71): n=a or g
aatctcaaccaaatcagacatattcagcttgggtgttttgataatcgagatagtgactgggttaaaagtcnattcgagtagccaagatgttacttcaaagg

SEQ ID NO: 37902 - DNA, 101 bp, rice(Oryza sativa)
  misc_feature (71): n=a or c
caggccacagaggtgacgaaccagtcccggcaactccctaaggtggcgaaccaattccagtgagattcggngacacccaaactgtgaggggaagggaacgg

SEQ ID NO: 37903 - DNA, 101 bp, rice(Oryza sativa)
  misc_feature (71): n=t or c
gaagccatggacacatcatcttcagacaatgctagttgtcaaaacaaaccccttcccccgacggcgtcgtngggcggcggcggaggagggaggccgccggc

SEQ ID NO: 37904 - DNA, 101 bp, rice(Oryza sativa)
  misc_feature (71): n=a or g
ttctacgaccaaaccaccaaggaggttgccagcttctccacacagttcaccttcaagattattgtaccaanatttaacaacgacaaggagaagggagatgg

SEQ ID NO: 37905 - DNA, 101 bp, rice(Oryza sativa)
  misc_feature (71): n=a or g
tctagtcatccggttgccactcttgccaacgtccattcaaagccggttaagaggaggggagttaggcatanctcttgggatgggtcgtcaaaagagaatga

SEQ ID NO: 37906 - DNA, 101 bp, rice(Oryza sativa)
  misc_feature (71): n=t or g
actcattgtgaacagacaacgaattgcggcaaggcatggcgcatgccctcgatgtcgcactctcccggcanccgtccataagcccgatttctgctcaccgc

SEQ ID NO: 37907 - DNA, 101 bp, rice(Oryza sativa)
  misc_feature (71): n=a or g
atcagctgataatatctgcagaaaaatttgcagaatttacctcattgagaccaagtgcaggtaggacgacntccttgtaccggtactcggcgttgctgacg

SEQ ID NO: 37908 - DNA, 101 bp, rice(Oryza sativa)
  misc_feature (71): n=a or g
aaggacgggatgtgcgggacgctgttttccccaacaaactcttcgataaagccttcggccagcctcttccntaagttcattcatgccctccctctccacac

SEQ ID NO: 37909 - DNA, 101 bp, rice(Oryza sativa)
  misc_feature (71): n=a or g
attgcttggtcctgcacccccagtatctgaactaacagttttgttagccttttcagccgcaacagcagcanctgctgcatctgtgtcaccgtcaacctcct

SEQ ID NO: 37910 - DNA, 101 bp, rice(Oryza sativa)
  misc_feature (71): n=a or g
ttccactggttctcctcctatggtagaatcccccctcttctctgttcctacacagcttctatcaatccccngttctaagttcctgcgtgcacaggtactga

SEQ ID NO: 37911 - DNA, 101 bp, rice(Oryza sativa)
  misc_feature (71): n=t or c
agacgtcggtgaccttctccatgatcccttgcaaaggtattccttgttccaccttggcactggactagccnagctgcaaacttggccttgatcttctccac

SEQ ID NO: 37912 - DNA, 101 bp, rice(Oryza sativa)
  misc_feature (71): n=t or g
gattatattggcaatatagttgggttcggtgcgcaaatatgttgcagcaagtttttactactcccataagntagtgcaagtactatccagataatttgctg

SEQ ID NO: 37913 - DNA, 101 bp, rice(Oryza sativa)
  misc_feature (71): n=a or g
gattccctttgaatcacagttttgtacgttgaacggaacggcattcgaagggaatgagaacctctgtgganaaattgttgacaagatttgtccaatgaact

SEQ ID NO: 37914 - DNA, 101 bp, rice(Oryza sativa)
  misc_feature (71): n=a or g
aaattattcccgatagacggagagtattatgtagaaattatatcatttcccgatcgttttcttccgacccntacacgtaacatctgcgctcctttatccaa

SEQ ID NO: 37915 - DNA, 101 bp, rice(Oryza sativa)
  misc_feature (71): n=t or c
caaccccgagttagccaaatacctcaccgatgtcaggaagctggagcgaaagtttgacggtgtcgaaattnggcatcaaagataagcctagacaggggata

SEQ ID NO: 37916 - DNA, 101 bp, rice(Oryza sativa)
  misc_feature (71): n=a or c
attcataagtcttaacttcacgtaaagaacagatgcagctgcaacggggccaataaaattgactaaaggantgtagctctttggagcaaaggccgggatgt

SEQ ID NO: 37917 - DNA, 101 bp, rice(Oryza sativa)
  misc_feature (71): n=a or g
ccgtcacttgctaatactttatccaattatctatagctcttgcgtcctcgtgagaatctaatcgcgtgatnatttcgggcagtggaccggtaataaccatt

SEQ ID NO: 37918 - DNA, 101 bp, rice(Oryza sativa)
  misc_feature (71): n=t or c
ggtttcggcatttccttgcaaatacctaggtttgccgctttctcttggaaagcttaccaaggcagacctanagccaatggtagagaagatagctggctgtc

SEQ ID NO: 37919 - DNA, 101 bp, rice(Oryza sativa)
  misc_feature (71): n=t or c
aaaccagcatcactcaactctgtcagtgcctcctgatcagccctcaaagctatattatcaggtccctctcnttcctgtgattcccatcgaaataacctata

SEQ ID NO: 37920 - DNA, 101 bp, rice(Oryza sativa)
  misc_feature (71): n=a or g
gaaaatatactacactaacctctccgatctatgcaattcaggtggacgagtctcgtgcgttgctgttgatnctaaatcaggtgtagtagcagtggccgacg

SEQ ID NO: 37921 - DNA, 101 bp, rice(Oryza sativa)
  misc_feature (71): n=a or c
tattttatttgcttccctaaaccacaaactctggtatgaagtatcccttaaccatcaaaacaaatagggcntgtttggttgctaccctgagcaacctgcct

SEQ ID NO: 37922 - DNA, 101 bp, rice(Oryza sativa)
  misc_feature (71): n=t or g
cagcaccgtcgggtcggcgtcgtagatcctcaccttcgtgatgccgttctccttcagaagattcaccacgnccggtggatccatcaaatcgtccgcgtccc

SEQ ID NO: 37923 - DNA, 101 bp, rice(Oryza sativa)
  misc_feature (71): n=a or g
ttcatccgagtttttaaattttacccgaatttgtgggagaaaaactaaaccagagtgaacaaacgagacanagattcccatgagtgaccatggcgacgaaa

SEQ ID NO: 37924 - DNA, 101 bp, rice(Oryza sativa)
  misc_feature (71): n=a or g
ggtctaaggatgaaatatagttgatttcaagaactgagagatcaacaatgaagagcttcgtatagtggatngaccatgtgaaagggcatgcagtctagggg

SEQ ID NO: 37925 - DNA, 101 bp, rice(Oryza sativa)
  misc_feature (71): n=a or g
aaccgtttgcgaaaaccaaaacttaatacaacaaaacttcgactagggcggcaagaatagaatatgggtgnttctaggaaacggttagtcgccgaccctgg

SEQ ID NO: 37926 - DNA, 101 bp, rice(Oryza sativa)
  misc_feature (71): n=t or g
gaaaggaaagacacgcatatcacacacgtttatgaacgatacaaaggtatggtgcaattcgaacccgatcnagctggcctccaatgctatgctgaaggata

SEQ ID NO: 37927 - DNA, 101 bp, rice(Oryza sativa)
  misc_feature (71): n=t or c
cttaccagcgggttaagagtttatttgcttggacaggaatgaaaaagaaggtacagtccagggtgcaaaantgtcaaatttgtttgcaagccaaaccagat

SEQ ID NO: 37928 - DNA, 101 bp, rice(Oryza sativa)
  misc_feature (71): n=a or g
agtaagaacacatcatgccgagataaggatgaatgataccttggccgtcgacatagatcgactagctgatnagtggggcagacgagccgccatccttgcac

SEQ ID NO: 37929 - DNA, 101 bp, rice(Oryza sativa)
  misc_feature (71): n=t or c
ccggcacttatagtcgtaccttttttttttgtatttcagcctgcaaaggtgggaaaaacactataggtgcnagttttcgctggttttagctattccagcac

SEQ ID NO: 37930 - DNA, 101 bp, rice(Oryza sativa)
  misc_feature (71): n=t or c
gcccgcatgtctgctgtattagctgatgaaggtggcttgatagttaaagaccacattgttaccttggagcntgtgactggtaattgacaatttgacatgtg

SEQ ID NO: 37931 - DNA, 101 bp, rice(Oryza sativa)
  misc_feature (71): n=a or c
gaacggcggcgcttggcctctccggacggcatttcttcgttttcttttttgaggcgacgattgaagttcgnaattgagcgccaagagaaagccctcgtcca

SEQ ID NO: 37932 - DNA, 101 bp, rice(Oryza sativa)
  misc_feature (71): n=a or g
attataggatgaagagagtagtccaaagtaaaaagaatattataagggtcgtacaaagaatatatgcccanagtgcaatctatctactatatatactactt

SEQ ID NO: 37933 - DNA, 101 bp, rice(Oryza sativa)
  misc_feature (71): n=a or g
gctttgatctgatacgtgggtggatctgttagcacgccgccatgccgtgccgtcgccaatcgatttaaaanacggccgcagcagccgagggagcgcgagtg

SEQ ID NO: 37934 - DNA, 101 bp, rice(Oryza sativa)
  misc_feature (71): n=t or c
ggttcaaaggtggtgaaatttgctaaaggacactcaaaatgtgtggtctttgctagtgagagtgcaagaangtgaatttacccgaggacactttaaaagag

SEQ ID NO: 37935 - DNA, 101 bp, rice(Oryza sativa)
  misc_feature (71): n=t or c
atgaaaactgctcaagattaattgccccagaaaaaaaattcataatagtacagctttgtgatatgccaagnatataaatatatgaagttatagaaagtaat

SEQ ID NO: 37936 - DNA, 101 bp, rice(Oryza sativa)
  misc_feature (71): n=t or c
agggtgggagcgggcggtgagaggcgggtggtgtcgctgccaatgggaagaggaggagcagggcaggaganggggctcggtggctcagggtcaccatatgc

SEQ ID NO: 37937 - DNA, 101 bp, rice(Oryza sativa)
  misc_feature (71): n=t or c
aagaagttcaatcacaagaaggttgcaggtagcaagctcaaggggaaggaagtacttagagaggaaggatnagatgaggagtcaagtgatgaagagatctt

SEQ ID NO: 37938 - DNA, 101 bp, rice(Oryza sativa)
  misc_feature (71): n=t or c
cccgaagagctccgccttaacactggtgatcgtgccgcgagcactagtcggtgcgccgtgaatatctcacngcggaccatgaactcaacgtcggcgccctg

SEQ ID NO: 37939 - DNA, 101 bp, rice(Oryza sativa)
  misc_feature (71): n=t or c
ggttcccatttccatttagcaacgcacaacctttgcaattgtgcaaccaatctctccttggacagggatcngcccaccacatgcacaagggccaactttgt

SEQ ID NO: 37940 - DNA, 101 bp, rice(Oryza sativa)
  misc_feature (71): n=a or c
taaagaaaagcgacatatatgtatatagagaattctagggaaaactgaagtctattttacaaacttgaatnaacttttagaaagcttttcttttttaaaaa

SEQ ID NO: 37941 - DNA, 101 bp, rice(Oryza sativa)
  misc_feature (71): n=a or g
cctcatttgatggccagtgggctgcatgtcttatacttcgaggtcctatgggtggcgaggtcgcactatantctcgaccctgcactaaatcagggcctcat

SEQ ID NO: 37942 - DNA, 101 bp, rice(Oryza sativa)
  misc_feature (71): n=a or g
ccttacgcgcgtcctcctctcccctttccagctttcctcacaccgtcatgcgcatcctgcgaagatgccanctcagccatcaaagcgacagaagaagttgc

SEQ ID NO: 37943 - DNA, 101 bp, rice(Oryza sativa)
  misc_feature (71): n=a or g
ctgcctcttgcaagagggaaccaaatttgtgaatcccatgtgccggggttaaccattcgacaattggcccngagctctcaaatcacaggagctttctaaga

SEQ ID NO: 37944 - DNA, 101 bp, rice(Oryza sativa)
  misc_feature (71): n=t or c
agcacaactttaaggtgaaacttcaaacattatcccaaaatgtacctagaatttttggaaacccaagttanaatattagataaggaagcttaataactgaa

SEQ ID NO: 37945 - DNA, 101 bp, rice(Oryza sativa)
  misc_feature (71): n=a or g
agccacgtcattttctagccgattgagggcacagtgtgtgaaacttggaatgaactcaaactaatgaaatnaagaattttaactaattcggatctttacaa

SEQ ID NO: 37946 - DNA, 101 bp, rice(Oryza sativa)
  misc_feature (71): n=a or g
aagggttgcgccgccgccaccgaagcagcaggcagtggctctactgatgacacaaggagaagatcaccacnacgggcactcttaggggcagcagcactgaa

SEQ ID NO: 37947 - DNA, 101 bp, rice(Oryza sativa)
  misc_feature (71): n=a or g
gcctacaccaaatgtaccttatagttctcaatttccagcaaacatgtttccaaatcaacggcgtgatcccntcagtcgacagggccaccctgtgaagcttt

SEQ ID NO: 37948 - DNA, 101 bp, rice(Oryza sativa)
  misc_feature (71): n=a or g
gcttacccacgtaccaagataaaatagcgttacagagggcaagagacgcaatttttgcactagatggcacnaatagattgaatgcctgtaatactactaca

SEQ ID NO: 37949 - DNA, 101 bp, rice(Oryza sativa)
  misc_feature (71): n=t or c
gcaggggctcgtacctgcgatgatgtggtccccggcaaccgggacaatcgtccagcagcagaacaactgancttgatcactccccatgatcaccatgggct

SEQ ID NO: 37950 - DNA, 101 bp, rice(Oryza sativa)
  misc_feature (71): n=a or g
gctagtgaaatattaccatgacctataaatgaccatggcccaccacccacccgtggcgacttttttactancgattttaccgaggtatctctatcctctcc

SEQ ID NO: 37951 - DNA, 101 bp, rice(Oryza sativa)
  misc_feature (71): n=a or g
ggtctcttgatttgcatcatctgaggtgcttctggaagattcagcttcttgagtatcagagagatgtgtangttgttcttcaagcatggccatcacctttt

SEQ ID NO: 37952 - DNA, 101 bp, rice(Oryza sativa)
  misc_feature (71): n=t or c
tggcgcgcgcggccacagttgtgatcggtgatcggtctcaggaacgcagcaaaacgtacgtactgttcacngcccgcgcccccgcgcggctgcgctcgcgc

SEQ ID NO: 37953 - DNA, 101 bp, rice(Oryza sativa)
  misc_feature (71): n=t or c
tgacacgatgggcgcccacgacacgtcgaggtagctcttgacgtagccctccatacgctcctcccgggcangtgcccatcccggtggcaggaacatggcga

SEQ ID NO: 37954 - DNA, 101 bp, rice(Oryza sativa)
  misc_feature (71): n=a or c
tttcagattagcatacataccatcacgccgcacacagatctctggtatatttttcacttgatcattaattntgtcattgtagactctggtctcaatatcac

SEQ ID NO: 37955 - DNA, 101 bp, rice(Oryza sativa)
  misc_feature (71): n=a or g
tcatataggtagcaggtactattcaaaattaaggttgtgttcgaaagtgtgttcaacctatttcttctgcncgaaaaataaggtagcccataattaatcaa

SEQ ID NO: 37956 - DNA, 101 bp, rice(Oryza sativa)
  misc_feature (71): n=a or g
gcactgatgcaaagagtctgaactttacttaaagcatcagggtcaaaatcataaccagcaatgacttcctnaatccaatctggaacaactgaagaaacagc

SEQ ID NO: 37957 - DNA, 101 bp, rice(Oryza sativa)
  misc_feature (71): n=t or c
agggttccaatgcgtgcagcttgcaaagcattgcagcgtgaaaggctaaaaggttgtactccctccgtctnacaatataagggattttgagtttttacttg

SEQ ID NO: 37958 - DNA, 101 bp, rice(Oryza sativa)
  misc_feature (71): n=t or g
tcaccttccggtcacctctcccttcatgggcgaatgaatttatttcgacgatggcataagttctttcaacnttattatgaacttgtggatgcattgcctcc

SEQ ID NO: 37959 - DNA, 101 bp, rice(Oryza sativa)
  misc_feature (71): n=a or g
acagtgccctgaacaaacaaaagaagaagatggtggcatgaagaaagcggtttggtatgattgtcaacacngcagcagactattcaaagttcttgctttgt

SEQ ID NO: 37960 - DNA, 101 bp, rice(Oryza sativa)
  misc_feature (71): n=a or g
acgaaactttgtcacggtcaatgcgtggtattgcttcagatccaccacagtaatgcttttgcctaccatcntatatgaactctccattatagtggaactgt

SEQ ID NO: 37961 - DNA, 101 bp, rice(Oryza sativa)
  misc_feature (71): n=t or c
aatagtagagagagaaaacaaaagaaaaatagaaaatgataggtgggctccacttaatcaccactctctcnatcctaaaatataaatggttgaatgagaat

SEQ ID NO: 37962 - DNA, 101 bp, rice(Oryza sativa)
  misc_feature (71): n=a or g
gagggcttgacccaagacttgcacggcttcgcctccaaaaccccgaagcgaagtcggtgcttgagacaacnccacggtcggtagccccatcttggcatatg

SEQ ID NO: 37963 - DNA, 101 bp, rice(Oryza sativa)
  misc_feature (71): n=t or g
acaattaatagtctcaccgtacaccatccaacatattcagatatgcttgcagcttgcgaaagtacaaagtnattaccaactgacacagtgacacacgtacc

SEQ ID NO: 37964 - DNA, 101 bp, rice(Oryza sativa)
  misc_feature (71): n=t or c
tatattatgggcccaaaattcggatcatatatttaacattttacggtgcttatatggtacgtggaggtagngagagatgaacaatatagactattgattaa

SEQ ID NO: 37965 - DNA, 101 bp, rice(Oryza sativa)
  misc_feature (71): n=t or c
ccacatgtcatgctcacatccacgcggccggtgtattccgcggaccaggttattccccactttaatttttnctttccacacgatgcggctacggaaatagg

SEQ ID NO: 37966 - DNA, 101 bp, rice(Oryza sativa)
  misc_feature (71): n=t or c
tccgataccagtatcatcccgtccgaatggatattagccgatacataagagatatcatcatgtcctgtagnatttttcgaaaaagaatttggacatgcttt

SEQ ID NO: 37967 - DNA, 101 bp, rice(Oryza sativa)
  misc_feature (71): n=a or g
tcagtgcagcgtccacatctggacgatgttcgctctagcatccgcacctgattactaaatatttaattttntgataattaattattatagataaaaattcg

SEQ ID NO: 37968 - DNA, 101 bp, rice(Oryza sativa)
  misc_feature (71): n=a or g
tactttttagttcaggtgatgaatgagcttggctacaaattcactctacctgatccctatttggatcgacnacttcaagcaccactccatacatctatttt

SEQ ID NO: 37969 - DNA, 101 bp, rice(Oryza sativa)
  misc_feature (71): n=t or g
agccataaaggctatttgtaccgtgtgtttccttctccttaatacaagtacatcgcgaaggggtttttaanaaggcactacacaagctgtcctcaatctgg

SEQ ID NO: 37970 - DNA, 101 bp, rice(Oryza sativa)
  misc_feature (71): n=a or g
ctgatgtcgtcggcaagcctcgccttcccctccgcgtcctcgccgctcgccaactcttttttttttgaacnactcgcacgagacggtgcgaagttctatta

SEQ ID NO: 37971 - DNA, 101 bp, rice(Oryza sativa)
  misc_feature (71): n=a or g
gctacttggatcgatcataccagtacaagttaatttgcttggaataagaaggcatggatgcccctcgactntgtgtgtattcttcttatatatgtgtgctg

SEQ ID NO: 37972 - DNA, 101 bp, rice(Oryza sativa)
  misc_feature (71): n=t or c
aaggaatggaactccatggttttcgactctgcattatcttcagtctcggaggtcctgcagtccatcctctnagagggccatctatggtcgttagctggcat

SEQ ID NO: 37973 - DNA, 101 bp, rice(Oryza sativa)
  misc_feature (71): n=a or g
tgtaaactcttctcaaccgatggagctgtcatcaatctttcaactctctgctccgcgggacgaatcttacnagccacctccttcatcggagccaattttta

SEQ ID NO: 37974 - DNA, 101 bp, rice(Oryza sativa)
  misc_feature (71): n=a or g
taacattttattgttactgcctccactattgatgattcagcgtgtactgttaaattgaataatttagaagnttaaacttgtatttatgttagtggtatgtt

SEQ ID NO: 37975 - DNA, 101 bp, rice(Oryza sativa)
  misc_feature (71): n=a or g
gcggctgtcgacggtcgactcttacagtgatgacgaggaggcaagtgatggcagcaaattgtacctcactnaggagcagtggcaggcccgtgtcaagcagc

SEQ ID NO: 37976 - DNA, 101 bp, rice(Oryza sativa)
  misc_feature (71): n=a or g
ggtctttcctcctactgcagtttcatttccttgcaattgtttcttacatcaaaatggcgctcggcctcacncggcgatatgctgctcctgcatttcgtgag

SEQ ID NO: 37977 - DNA, 101 bp, rice(Oryza sativa)
  misc_feature (71): n=t or g
ttgtgtcatccaaagtacacaagcacatgctaaatgttagcatgaggttgacacaatgctaactgccattncaacaacagagaaaaaacagactagttaac

SEQ ID NO: 37978 - DNA, 101 bp, rice(Oryza sativa)
  misc_feature (71): n=a or g
gacagactatggagaaggggtttctgtcatcacctaataaatcgatcttctgggaaggatatcagaagggntacctaatagtttgattcaataaagaataa

SEQ ID NO: 37979 - DNA, 101 bp, rice(Oryza sativa)
  misc_feature (71): n=a or g
tccctcggacagcgaggggtgaagtcccctccccaagagtgaagatctgaccagggggtttgcagtgagangtacggacaatctgcaatcagaaaggattc

SEQ ID NO: 37980 - DNA, 101 bp, rice(Oryza sativa)
  misc_feature (71): n=a or g
ctggcgccgtttgtagtcgcgccggtggctaagctagctttgcgacggtgccggtgaagacgaacgaaganggagctaggggggaagtgaggggaggaacc

SEQ ID NO: 37981 - DNA, 101 bp, rice(Oryza sativa)
  misc_feature (71): n=t or c
tctggccacacttttccttttgcccattccatgtacatctcgcagcccttttgtcgctctgttattgtagnagtatatacatgaagatgtgatacattgga

SEQ ID NO: 37982 - DNA, 101 bp, rice(Oryza sativa)
  misc_feature (71): n=a or g
ccggcagtatttacacagagcttcttttggctcattagctgtgctttacttaggtggtgtttggatccagngacttaactttagtccctctatttaaacac

SEQ ID NO: 37983 - DNA, 101 bp, rice(Oryza sativa)
  misc_feature (71): n=t or c
taattagtagttgccaaattaaaaaaaaataatagtacccttccatttaaccatatctttgcggtgcgctngctggtccagcataattaaggttgtgttgc

SEQ ID NO: 37984 - DNA, 101 bp, rice(Oryza sativa)
  misc_feature (71): n=a or g
ggaatctcgtgaagacagtggcttcatgggaagcacaagcacagtcagtgataacacattttctacgtccnggtttggtccatcagcaagatgaagctgca

SEQ ID NO: 37985 - DNA, 101 bp, rice(Oryza sativa)
  misc_feature (71): n=a or g
acatataggaaaataacagagctacgacgtcgttcattgacgatattgccgacccaaaatcatcatacatnctgcgccgttcgcttcgggaactagtattc

SEQ ID NO: 37986 - DNA, 101 bp, rice(Oryza sativa)
  misc_feature (71): n=a or c
aacaggtactcctacccagaaaacacagcacaagtgtagcagggaacaagttaaaagatgcaaggggcaancattgacacttgaaacttacaataaacttc

SEQ ID NO: 37987 - DNA, 101 bp, rice(Oryza sativa)
  misc_feature (71): n=t or g
aaaacttgcttatgccctagtgatggcttcaagaaagctcaaacactacttacaagcccacagaatcgtgnaaccttcgcagtatctgaaaataaataaat

SEQ ID NO: 37988 - DNA, 101 bp, rice(Oryza sativa)
  misc_feature (71): n=a or g
cctttctctgtttgcaccagccacctttctgttggaatctaccctaccttcagtatgcctctgactggacnatgtgttcttcaatccatatccattagaca

SEQ ID NO: 37989 - DNA, 101 bp, rice(Oryza sativa)
  misc_feature (71): n=a or g
gcctgctcctctcacggttacaaggctgaggttccccttgtactgcacaatgtatccaccaacgtctccancaccctgaatttcacaagattgaaacagat

SEQ ID NO: 37990 - DNA, 101 bp, rice(Oryza sativa)
  misc_feature (71): n=t or c
gaaatggtgcccgctctttagaaacttaaagacactgctattgaacgagtggtttttggaaaatggattanggggagtacttcgcattctacaacattcac

SEQ ID NO: 37991 - DNA, 101 bp, rice(Oryza sativa)
  misc_feature (71): n=t or g
accatcagagataagattttattatcactgaccactcatctgtgatgaggcctatacacgtcaatgacccngggtcctatgggctgtgatgaggcctatac

SEQ ID NO: 37992 - DNA, 101 bp, rice(Oryza sativa)
  misc_feature (71): n=a or g
tgagacatcatgaatgcttacaaactccagagtgcgaaaagccatcttgtgcaagcatttggaacaggatntcctcgtactgctgttgagactcatcatag

SEQ ID NO: 37993 - DNA, 101 bp, rice(Oryza sativa)
  misc_feature (71): n=t or c
tgcatgcacatgggaaaacatagcatagcatagcatagagtgtatatacacttggaagcattaagctccanaccaaaaggaagatcaaattaaccagtcta

SEQ ID NO: 37994 - DNA, 101 bp, rice(Oryza sativa)
  misc_feature (71): n=a or c
cacccagcatcacagttgattttgagctcttgtggagactgcggaagtaccttgtaatgcttgcaatcttngcagtcagtgtgacatataatgctggatta

SEQ ID NO: 37995 - DNA, 101 bp, rice(Oryza sativa)
  misc_feature (71): n=t or g
atccttggcactatgctggaactcgctactaggtttaggtgaccaacagtcaagaaggatgacgtaagcgnctgagaattgaagcagccgcgttctgggag

SEQ ID NO: 37996 - DNA, 101 bp, rice(Oryza sativa)
  misc_feature (71): n=a or g
caaaaagcagcccggagtgagaaaattggtcagtttacatgcaaatatatcgggtgtagtcgcaaaaaatntataaatgtttaactattttccgctcttac

SEQ ID NO: 37997 - DNA, 101 bp, rice(Oryza sativa)
  misc_feature (71): n=a or c
gaaccagctacgaggacagtgaagtgaagaacatcgaggagatctacaacaagctctgtccatcacgaaanttgcagtacatctttatagatgggttccct

SEQ ID NO: 37998 - DNA, 101 bp, rice(Oryza sativa)
  misc_feature (71): n=t or c
ctgccgccgcagctgtcgtcgtcgtcgctgtatctgctgtgtgcgtagtagaacttgtagtcagtagagcngcaccattccagcgcgagcgaggtcgccgc

SEQ ID NO: 37999 - DNA, 101 bp, rice(Oryza sativa)
  misc_feature (71): n=a or g
tttcttgtgggtgccggattttattttcccccaatcatgagaacagaatatgcaggcaggtaggctggagngggttctttctgaagtatctaaaaaaattg

SEQ ID NO: 38000 - DNA, 101 bp, rice(Oryza sativa)
  misc_feature (71): n=a or c
taaaaggctcagtttttagctttctcaaaaaaaagcagggtaatgaaaagttgtgcatcaaacataaaacnggattgaaaactattttgcaccatattcta

SEQ ID NO: 38001 - DNA, 101 bp, rice(Oryza sativa)
  misc_feature (71): n=t or g
ctcgaaaggaagaaaaaaaaattgttggcgtctttgcttctcctcgtctccctcctcctccttcccctccngcgctcgatctcgctgagtcgccgcacacc

SEQ ID NO: 38002 - DNA, 101 bp, rice(Oryza sativa)
  misc_feature (71): n=a or g
agagattatggagtggagaggttgtggagagaaggggaggaagaaggaaagatttggatggaagaaaaaancatataaagattgatatgtgggatccattg

SEQ ID NO: 38003 - DNA, 101 bp, rice(Oryza sativa)
  misc_feature (71): n=t or c
tgagttgaaggccttagcttgccatgatagtgcagacgccatggctcttactgctacaaaaatgaagcagncgacgatggccacgaggctggctgcaggct

SEQ ID NO: 38004 - DNA, 101 bp, rice(Oryza sativa)
  misc_feature (71): n=a or g
gaatttgttccctactaaagagaattttaggctacctaatcgagggcagttgatgagaagtttcttgatcngatgcccaattaggacgtcaaagtcttgga

SEQ ID NO: 38005 - DNA, 101 bp, rice(Oryza sativa)
  misc_feature (71): n=a or g
tgtgcgagattctagtcgttttcaccattttgaatgtggaaaatgctcttgtagtgaattctggtagcagntctgctgatgtccagttgtgcttccagtct

SEQ ID NO: 38006 - DNA, 101 bp, rice(Oryza sativa)
  misc_feature (71): n=t or c
gtaatattgaaattggtcagacatctagggtttttaagctatcaatatagtaaattgcacaagtgatatangaacttgtaaggttagtgcaatctagtata

SEQ ID NO: 38007 - DNA, 101 bp, rice(Oryza sativa)
  misc_feature (71): n=t or c
gttggtcagataatgatcagcgcatcctcgaaggcggacgatatccccatcgcactctgcaacaaggacgngaccgaacgcgccgccgcgattaatgtaag

SEQ ID NO: 38008 - DNA, 101 bp, rice(Oryza sativa)
  misc_feature (71): n=t or c
aatgcctacgcaatattcgaactttttagggatcatgagaatttcacgaaattctaaccattagacatcangatctaaattgaactgttcggataactccc

SEQ ID NO: 38009 - DNA, 101 bp, rice(Oryza sativa)
  misc_feature (71): n=a or c
tccagttccgtgatccggctgacgacatggtggtacatgggacagtcagacactggaccgagaaagtaganaaagctcaaatagtaattacataaacagta

SEQ ID NO: 38010 - DNA, 101 bp, rice(Oryza sativa)
  misc_feature (71): n=t or c
atcttttttttccaaggccatgccaatggtaaaaaacagaaccttttttttttcctgacaggccggagtanataacagaggtttcattcactcatctgaca

SEQ ID NO: 38011 - DNA, 101 bp, rice(Oryza sativa)
  misc_feature (71): n=a or g
acgttgcgaggggcgtgtacaggtgccaaaagaaaccctcaatctccaccctcgaatcttcatccctgttncggcggcagcgacgacgcgaagctcctcgg

SEQ ID NO: 38012 - DNA, 101 bp, rice(Oryza sativa)
  misc_feature (71): n=t or c
cgcacacagctactcctacgcgcgagataaaaaacgagcggtattgctttctcgcacatcacgtgagatanatagttgctcacaagtcaataatggtagta

SEQ ID NO: 38013 - DNA, 101 bp, rice(Oryza sativa)
  misc_feature (71): n=a or g
atccggacgttgcatcggcttgtaaggatttcatatatatatcgactcccttatcgactccccggcctctngcgaatgctgagtagatgttgctgtgtctt

SEQ ID NO: 38014 - DNA, 101 bp, rice(Oryza sativa)
  misc_feature (71): n=a or g
gaggaggagaggagaagaaatatgtgacactgatatgtgggtcacgcgtgcttactaagctagttagtccnggtcaacgagctatattagtctcaaaaatt

SEQ ID NO: 38015 - DNA, 101 bp, rice(Oryza sativa)
  misc_feature (71): n=t or g
ggcactggcaaaacatttttgtacaaggcgcttcttgctagagtgcggtcttaatagccattgcaactacnacatctggtatagcagcgtcgattttgccc

SEQ ID NO: 38016 - DNA, 101 bp, rice(Oryza sativa)
  misc_feature (71): n=a or g
ctgacatgtacaaacctgtgcatatgtattggcagcagaaatgatatcatagttccccgatccagtaaacnctgaaaataaaaatagaggttgcagtaaaa

SEQ ID NO: 38017 - DNA, 101 bp, rice(Oryza sativa)
  misc_feature (71): n=t or c
gcgaccatttatcggggtggtcggacatcggccgctcgttcaggatttccctcaatttcggaaacatctgngcaaattttgcctcgtaagagtattcacat

SEQ ID NO: 38018 - DNA, 101 bp, rice(Oryza sativa)
  misc_feature (71): n=t or c
tggctaggttctgctagctacttttacacaaacgcaacagctgcattacctagcattggtggtgctcatgntgataccgtagttgtcattgctttgcagcc

SEQ ID NO: 38019 - DNA, 101 bp, rice(Oryza sativa)
  misc_feature (71): n=a or g
ttacttaagccgatcagacaatttttagttgagtcgaacaaaagttatgttcacactcacttcctcgctgnagtgatatttcttctcgacgaagacaaact

SEQ ID NO: 38020 - DNA, 101 bp, rice(Oryza sativa)
  misc_feature (71): n=t or c
atgtgaactttagttttgattaattgtgtgatgctaagccttgttggtcatgcaaatataatgcatcatgnaacgttactgtcagcatttaattaatttga

SEQ ID NO: 38021 - DNA, 101 bp, rice(Oryza sativa)
  misc_feature (71): n=t or c
tatcaatcggctaactcaggagcaaattgcagcaatgttcaggctacctcagccggttatcgagccagttnactcaacaccaatcaggcagcaagtagtgt

SEQ ID NO: 38022 - DNA, 101 bp, rice(Oryza sativa)
  misc_feature (71): n=t or c
gagctcagctagttcacaatggtcaatggatgcaaaccatcaggctcgtcgcttctctacgcgtttctttngatacacctggacttgccgggcagcagcca

SEQ ID NO: 38023 - DNA, 101 bp, rice(Oryza sativa)
  misc_feature (71): n=a or g
ctttcaatctctactattttagttgagttaattactgtgcaatgcatgcttaattagttactaattgtacntgtagatgaagctggggcggccggcgagag

SEQ ID NO: 38024 - DNA, 101 bp, rice(Oryza sativa)
  misc_feature (71): n=t or c
tctttatccctcatctagtgtagaagcgtggattgttttgtgtgctcgcgctctttccgtggttttttttntctctcgtctttctagtttgcttttgtaca

SEQ ID NO: 38025 - DNA, 101 bp, rice(Oryza sativa)
  misc_feature (71): n=t or g
aaggaaaaaaactcgtgacccactaaaaaatcgaatgaaaaaaaggcaagtggagaagggaaaaaaccagncccacaaaaaaacgaaaaaaaaccaaaaga

SEQ ID NO: 38026 - DNA, 101 bp, rice(Oryza sativa)
  misc_feature (71): n=a or g
gaaccagtggtggtggttggagaggaatggagctctaataggtccgacgagccaccaccagatatctcggngagaacccgcaacgccaaagcgatgctatg

SEQ ID NO: 38027 - DNA, 101 bp, rice(Oryza sativa)
  misc_feature (71): n=a or g
cacccatcagcgatcctcgtagtcgctagtacacaagcgagtcgggcacatccatccgcgaaaaaaaaaanggggggatctctgtctgcgcatcggtacct

SEQ ID NO: 38028 - DNA, 101 bp, rice(Oryza sativa)
  misc_feature (71): n=t or c
gtctacatggggatgtcgataatctagagccccacccgaatgatcttgaacgggtagttgcaccactaaangcccattgggaaggtatttggcataacaat

SEQ ID NO: 38029 - DNA, 101 bp, rice(Oryza sativa)
  misc_feature (71): n=a or c
tacctaacagcctaaaggttcaaattcattactctcagaagctccaagttttcatcaggaagtgtcacagngagaagtccagcacctctcccaacaccagt

SEQ ID NO: 38030 - DNA, 101 bp, rice(Oryza sativa)
  misc_feature (71): n=t or c
atacattcctcaagcaaatcatggatttgaactaggtgttccttcaagggacaattcaccagcaatcttcncccaagccactttagcatcacctttcacaa

SEQ ID NO: 38031 - DNA, 101 bp, rice(Oryza sativa)
  misc_feature (71): n=t or c
accccataaataacaaatatatgagagagcatataagtaacaaaatatacaaggagtgcattgatgtgtgngcacgtgggaaacatatcctatgcacgcca

SEQ ID NO: 38032 - DNA, 101 bp, rice(Oryza sativa)
  misc_feature (71): n=a or c
gataaattagtgggcagtactactgctaatattactggatggctcatgcacaaattttgactatttgaccntttaaaaaaactaattttacaattgaaccg

SEQ ID NO: 38033 - DNA, 101 bp, rice(Oryza sativa)
  misc_feature (71): n=a or g
tttcgctttgaaaaaaaaggtgtacaagcaactggcgtgaaatgtggagcttaaggggtgcaatttcttcntaacattctgatggtcaaagcaagaggcga

SEQ ID NO: 38034 - DNA, 101 bp, rice(Oryza sativa)
  misc_feature (71): n=a or c
gccggatctggccattctcaccaacacgtgctgttgcttccattgcgaccgtctttgccgccatctccttnttcggccacagctccgaggctaccatgtcg

SEQ ID NO: 38035 - DNA, 101 bp, rice(Oryza sativa)
  misc_feature (71): n=a or g
gtggcagcaaagcaaagcaggaggaggaggaggaagaaggaggagcaacagcggtcttcattcagtcaccncccgcatcgctctggggagggatctacacg

SEQ ID NO: 38036 - DNA, 101 bp, rice(Oryza sativa)
  misc_feature (71): n=a or g
cagtattaccactacagtcactctaaagttgaattccactgtccttccaagtcgatgagttaaaagagtcnaagtatcgcgtaacacaaataatgtgaatt

SEQ ID NO: 38037 - DNA, 101 bp, rice(Oryza sativa)
  misc_feature (71): n=a or g
aatcctggctggttagctacaacagaccctacaattttgtcaaagattgttttttggttagcattaagttncgcaatcaaagaatctgcatgcatagacat

SEQ ID NO: 38038 - DNA, 101 bp, rice(Oryza sativa)
  misc_feature (71): n=a or g
caatttgctttgtcagaaagccagtagtcaactaatctggattgcacaattaggatgtgtttggttgggtntatgatagttttccttctatctagaaaaaa

SEQ ID NO: 38039 - DNA, 101 bp, rice(Oryza sativa)
  misc_feature (71): n=a or g
tgtatactgtgttacgatcacctcatattgacaagaagtccagggagcaattctcgatgcatgtcaagaancaatttctggtacagaaagcggaaacgcac

SEQ ID NO: 38040 - DNA, 101 bp, rice(Oryza sativa)
  misc_feature (71): n=a or g
ttcaacatcatcaccccatgaacaaccttctgttctaaggagtagaaggttgttgtcgcaatgcgatggcncgggttcatgctcgacacgtgtggacgggc

SEQ ID NO: 38041 - DNA, 101 bp, rice(Oryza sativa)
  misc_feature (71): n=a or g
taacttcaaaaaaagtgagggtgatccatttcatgttgaaactacagtatccttgatgagtcctaaacccngcaaggagaagagttgcacccataaacgca

SEQ ID NO: 38042 - DNA, 101 bp, rice(Oryza sativa)
  misc_feature (71): n=a or g
tcgccggtgatctagaaatggcgtgaattaattgatggcaattgtggcaggcaataacgggagcccttgtnttcggagagttagaggagatggcaatggtg

SEQ ID NO: 38043 - DNA, 101 bp, rice(Oryza sativa)
  misc_feature (71): n=t or g
cgctgtcgtgcaagccacgagagagttagtagagagagaggagaaaggggaggaacggtccctgccccatncgtcccacgcattatttttattatcgttgt

SEQ ID NO: 38044 - DNA, 101 bp, rice(Oryza sativa)
  misc_feature (71): n=t or c
tccagggcagatccgtcttccagctccgaatggaatgagctcaaaatccgcacctttaaagtcagttgccntttctagaaatctctccggcataaacttct

SEQ ID NO: 38045 - DNA, 101 bp, rice(Oryza sativa)
  misc_feature (71): n=t or g
ttcaatgcgagttttacactaactcgatggagccattgagtactgccttaccactggtgagcgacagacanagcgagggatcagctgcagtgctccatcaa

SEQ ID NO: 38046 - DNA, 101 bp, rice(Oryza sativa)
  misc_feature (71): n=a or c
ctttatcagttatagctgaaacatgctcctgcaataaattctctcgaagctcatccatagagggcccctgnaagccagggccaaattttccaatttcatct

SEQ ID NO: 38047 - DNA, 101 bp, rice(Oryza sativa)
  misc_feature (71): n=a or c
ggaatccctaaaatgcatgtgtcgcgttctagttcgtatctacgcacctgaatatgcgacatgctccttcntcctccttttcccaccgccctttcctatca

SEQ ID NO: 38048 - DNA, 101 bp, rice(Oryza sativa)
  misc_feature (71): n=a or g
tgaaatttattctacaaatggacctcaagtgggtgccaaaacaattgacactgatacataatgtgttggcnccaggcagattagcatcgggtcttgtgtgg

SEQ ID NO: 38049 - DNA, 101 bp, rice(Oryza sativa)
  misc_feature (71): n=t or c
atactcaaggcacaaatatacaattaatgacacgggttaagttggttagtttattgaagacaaaaatgatntgtccaagagatcctgagttcaaggattgg

SEQ ID NO: 38050 - DNA, 101 bp, rice(Oryza sativa)
  misc_feature (71): n=a or g
acaaggatcctgatccaaaccatgctttaggggctaagtggatagattatttcccactgctcctatctagntttattaaccataaccactctttaagggta

SEQ ID NO: 38051 - DNA, 101 bp, rice(Oryza sativa)
  misc_feature (71): n=a or g
ccacattcaggaagccatatctccacccgagttagggaacaaaatactgccaaatatgtataacgcgtacnctctgcagtaacgctgcaacgtgtcgtcgt

SEQ ID NO: 38052 - DNA, 101 bp, rice(Oryza sativa)
  misc_feature (71): n=t or c
acttcaccgcctgcagttacgacttacaaaactttatgtttccttgaggttacatttgaccaagatcatanacgcgtaacacgtatatataatcatgcagt

SEQ ID NO: 38053 - DNA, 101 bp, rice(Oryza sativa)
  misc_feature (71): n=t or c
aatattatccccaaataattgcccgcagcccaaggcacataccactccttccatcttctaaccactctacntgagcaaggaggtggccatgggtttctctt

SEQ ID NO: 38054 - DNA, 101 bp, rice(Oryza sativa)
  misc_feature (71): n=t or c
tatttgagccctacgtgggtgcggctagagacacaatggcagatctggtatgtttgagggagatttagaangaacggtgtgtacacccttcctaacccttg

SEQ ID NO: 38055 - DNA, 101 bp, rice(Oryza sativa)
  misc_feature (71): n=a or g
acctcactgtgtcactggcactaagaaccacgtgttgtactatgcttacattgagatgtgtcggcagctcnacccacaggggctattcaatgtctaatcaa

SEQ ID NO: 38056 - DNA, 101 bp, rice(Oryza sativa)
  misc_feature (71): n=a or g
agctttgcttctcttgtcaagcttgaggtgtatgataaccccaacctggagagtatcacttccctcaacangttacagaagctcgtcattgacggctgcct

SEQ ID NO: 38057 - DNA, 101 bp, rice(Oryza sativa)
  misc_feature (71): n=t or c
atttgttcctctaatcaattccctgcacagatcctttttaaatcaatatgcattatgcagtatcggatgantgttttcaggcatgataataagaacttact

SEQ ID NO: 38058 - DNA, 101 bp, rice(Oryza sativa)
  misc_feature (71): n=t or g
atgattggttggtttggcgcagtcgtatgagagttgtatggttcagtcggatgtacagcactactcattcnctacatactactccatccgtcccaaaataa

SEQ ID NO: 38059 - DNA, 101 bp, rice(Oryza sativa)
  misc_feature (71): n=a or g
ctggggaacgccctgtggagcaagtacacaatgacgggtcccacggcgccagcgaggaagaaccaattgancgcgccgtagttgccgagtggcccgaagat

SEQ ID NO: 38060 - DNA, 101 bp, rice(Oryza sativa)
  misc_feature (71): n=a or g
tctttaacctaggatctacacattgtttgaccttgtcttcgcttaatctaggagtagcctggagagaaaangtacacaaacaagttaaatttggaacaact

SEQ ID NO: 38061 - DNA, 101 bp, rice(Oryza sativa)
  misc_feature (71): n=t or g
tgctcaaagttgaagatatacccaatactgcagaaggtgcctatcttgatatactcccctggcatttatanttggagcataagctccctttattgacaggc

SEQ ID NO: 38062 - DNA, 101 bp, rice(Oryza sativa)
  misc_feature (71): n=t or c
attccacccaaatttgagacatttttctctttgttttcgagaggccccgtcgtcggctgctgtaaattttngcccttttttattcggaactgctattcctc

SEQ ID NO: 38063 - DNA, 101 bp, rice(Oryza sativa)
  misc_feature (71): n=t or c
ccctcccgctgtcgctcgccggcattttcatccacttcaacgccctcacgttcccggagttcttctctcgnccatcttcgtcaccgacaaccgtaaggggc

SEQ ID NO: 38064 - DNA, 101 bp, rice(Oryza sativa)
  misc_feature (71): n=t or c
gcaagattctttttcataaagatgcagtacagcaagaaccataccatagtgctagcacaagtatgctactnacacaatttcattttcagtttattctcatt

SEQ ID NO: 38065 - DNA, 101 bp, rice(Oryza sativa)
  misc_feature (71): n=a or g
ggctctatgcctgacgcaaagccaaacaacaactgaaacgaggaccacaaaaacgactgcagcaacaatgnatccaatcatcaccggccctgtaattaaaa

SEQ ID NO: 38066 - DNA, 101 bp, rice(Oryza sativa)
  misc_feature (71): n=a or g
ggatatgatattatgtaatccgcttcactttgaatccgtccaaggatattggtatagctatttggtggatntggatgccgatgtagatgatgatatgatat

SEQ ID NO: 38067 - DNA, 101 bp, rice(Oryza sativa)
  misc_feature (71): n=t or c
gtcatctgtataatcttccgataatgcttttccctttcgaagcctgtgttggtgaggaaaatttagtaatnggccaccttccaccactgaagaaataaaga

SEQ ID NO: 38068 - DNA, 101 bp, rice(Oryza sativa)
  misc_feature (71): n=a or c
tagagaataatgtaagaataccgtgaagagatgtaagaaacactaaaatatgattacctggaagtggcggnagaatttcatggtctttgtagtagaatcct

SEQ ID NO: 38069 - DNA, 101 bp, rice(Oryza sativa)
  misc_feature (71): n=t or c
ctcgcctcgccgcgatctgatcgccatggatcacgtcctcgcctgcgtcggcatcctcgtcgccttcacgncgctgttcctccttgccgtgctcccgctca

SEQ ID NO: 38070 - DNA, 101 bp, rice(Oryza sativa)
  misc_feature (71): n=a or g
aaaactcccgtgccacctggcccaaatgtcgcgattaccactgtaatagtatccgaagacccggtttgtgnaggatagcccaggtgcgaatccaccgggtg

SEQ ID NO: 38071 - DNA, 101 bp, rice(Oryza sativa)
  misc_feature (71): n=t or g
catggtacgacgaagcatttgtatgatattcaatgtagggataaatcaaggcgtggtatcaactgtaaganagcgttgcaagagtgtgtcctgaaagctga

SEQ ID NO: 38072 - DNA, 101 bp, rice(Oryza sativa)
  misc_feature (71): n=a or g
tcagataaatttctttgtgtaaaagcttctagaaataattagattttaaaacggaggaggcagctactacngctgtgtttagatccaaacttccaactttt

SEQ ID NO: 38073 - DNA, 101 bp, rice(Oryza sativa)
  misc_feature (71): n=a or c
tatagatcacctccacatttgtgtactttgtgtagggtttgggcattttgtatagccaaaggagatactantggagaaatgatctttgctgtgtcatgcaa

SEQ ID NO: 38074 - DNA, 101 bp, rice(Oryza sativa)
  misc_feature (71): n=a or g
tctttcaagaggagtatctgtccagacacttgtatcaccacgtccttctttaccattcatactaaatgacntagtcgaatgcattggtactccaggctgaa

SEQ ID NO: 38075 - DNA, 101 bp, rice(Oryza sativa)
  misc_feature (71): n=t or c
actggaaaggaaggaatcaagatcagcataagctgcagtgatatgcagcagtcgcaaatgctgagcctccntgaaagcatcttggaaggatttaaaaaaat

SEQ ID NO: 38076 - DNA, 101 bp, rice(Oryza sativa)
  misc_feature (71): n=t or c
gacaatgatttcacaaggccaatgctagaactttgcacttgaggtcgcggcacggttggaagatgattttncgagccaacagtattggcattatttttttt

SEQ ID NO: 38077 - DNA, 101 bp, rice(Oryza sativa)
  misc_feature (71): n=t or c
atttcgtccaaactattgttctttgatgtggaattcctccaaatacactcgggtggacgtccacctgtttnttacatgtcatctaaatggttatgaaaaat

SEQ ID NO: 38078 - DNA, 101 bp, rice(Oryza sativa)
  misc_feature (71): n=a or g
ccatccaccggcagaacggcgtgccggcagtccagttggtggcaagaatgttgtagggatcggagagctcncctttgaaagccagcagcgcagcgagatcg

SEQ ID NO: 38079 - DNA, 101 bp, rice(Oryza sativa)
  misc_feature (71): n=a or g
cctaattcatccacaatgtgctgagaaaccaggtaatagacattcaatgctcctctacaacctggtaatanccattgtagaactagtaaataagtagtacc

SEQ ID NO: 38080 - DNA, 101 bp, rice(Oryza sativa)
  misc_feature (71): n=a or g
ggcgctagctgccgcggtgatagcgtgcatacatgcatgcagtagtgcagagtgcatgatcgaggtactcnctccgtttcaaaggccaatatgaacatttt

SEQ ID NO: 38081 - DNA, 101 bp, rice(Oryza sativa)
  misc_feature (71): n=a or c
aataatttaaactgggtaaaattcatgtaaactcatgtctcatgactcagccacctcaccagcattgaagnaggcgtccttgctaatgcagtcggcgtagc

SEQ ID NO: 38082 - DNA, 101 bp, rice(Oryza sativa)
  misc_feature (71): n=t or c
aaaccttgacgggtaaaatttaatcactcaatagcaagctcgatctagctcctcgtagttgatatctatanaggagtattttccggctctgttcatgtcag

SEQ ID NO: 38083 - DNA, 101 bp, rice(Oryza sativa)
  misc_feature (71): n=t or c
aggctcggaaaaaaaaaatatatatggtcaaaacctcgtggtgcaatcgtaccaaacgtttcctcacatgnatactgaactttgaaaagtatgaaggaatc

SEQ ID NO: 38084 - DNA, 101 bp, rice(Oryza sativa)
  misc_feature (71): n=a or g
tggtttgctgcttcattagttgtgagattgcgtgctatctgaaatgaaacgttccatgtaaatgggtcagncttttttttttttgaaaagcttgtttattc

SEQ ID NO: 38085 - DNA, 101 bp, rice(Oryza sativa)
  misc_feature (71): n=a or g
caaaattggctcctctggtggttttgtcctaagtggtgcttaggtggcattctagatagccaaaaaaaatnacagtgggccccacatgtcagtctcacttt

SEQ ID NO: 38086 - DNA, 101 bp, rice(Oryza sativa)
  misc_feature (71): n=t or c
agaactaatctggattccaacggctttgggagtaggaaatcagtcttctccgttgatctaattatagtatnagaaccaactcgtacagagttttcgcaaaa

SEQ ID NO: 38087 - DNA, 101 bp, rice(Oryza sativa)
  misc_feature (71): n=t or c
gattcggcagcgtacttgccaaatgcaacctggattttgttcttcaggacatttaatactccctccgttcnaaaaaaaactcaattcctgggtttctgtta

SEQ ID NO: 38088 - DNA, 101 bp, rice(Oryza sativa)
  misc_feature (71): n=t or c
tcgttctttcctaatcattttttcttgatggaatccatcagtctaccaccatatgatgttgtagatgtgcngccggtgatccctgtcgcactacggtcggg

SEQ ID NO: 38089 - DNA, 101 bp, rice(Oryza sativa)
  misc_feature (71): n=a or g
catcttacgtcgagtttgaatttgtataacgtgtctctcaactgcaataccggtatacccgagattgtagnacggtatacaaaagagttgaatgggacgag

SEQ ID NO: 38090 - DNA, 101 bp, rice(Oryza sativa)
  misc_feature (71): n=t or c
actgcatgtgcatgtgctgttacatcagcggatctgcttccctttgttggcccctctcacatgttttgtangtgaatcccttcccgccttgatgatcctgc

SEQ ID NO: 38091 - DNA, 101 bp, rice(Oryza sativa)
  misc_feature (71): n=a or g
aattttcgattatacacaacacgccctcacgatcatgcaaactgtaagactctaaatttatacgtttaccncgacgacagagtcgcgggcggcgagagcga

SEQ ID NO: 38092 - DNA, 101 bp, rice(Oryza sativa)
  misc_feature (71): n=a or g
gcagatttctcagaactgaatcccagaaatgatttcttgcgatcatcctggtccatattcccatgtaaacngaacactttgcagctaataaacttttgctt

SEQ ID NO: 38093 - DNA, 101 bp, rice(Oryza sativa)
  misc_feature (71): n=a or g
cctgaattcaagcaccttttgacatgcttcgaatttgttgtgatgatctgggaagcagttcttaagaatcnactaataaaccagtccatcagatcgggtca

SEQ ID NO: 38094 - DNA, 101 bp, rice(Oryza sativa)
  misc_feature (71): n=a or g
atgatgattctaaacacgatttcgaattcagaaggagatgatggctcctgctgtgaaaggcaccaggaatntgctggaggcttgctctgccgcaggtgttc

SEQ ID NO: 38095 - DNA, 101 bp, rice(Oryza sativa)
  misc_feature (71): n=t or c
ccttttgtcatgaacagtggggatacatatgtatgcagtacaaccacacaaagaaatgacgaagacatgcnacggggtggttaacacttgaaaagacacat

SEQ ID NO: 38096 - DNA, 101 bp, rice(Oryza sativa)
  misc_feature (71): n=a or g
tcattttttacttctaaaagtcctgccaaccaccgtgcttaacggcatgcctgctatcctcatcttaatcntcatagggactctaaaaatcatatataatc

SEQ ID NO: 38097 - DNA, 101 bp, rice(Oryza sativa)
  misc_feature (71): n=t or c
aagaaagtattggcctaccatagcaccaggtggtgtggattgcattatatcattgccgagattaccatcangtagtgcctcatatgctaaatgcacgtgtg

SEQ ID NO: 38098 - DNA, 101 bp, rice(Oryza sativa)
  misc_feature (71): n=t or c
gaaaacatgaacattcacctgcagagactaattcagaaccggaacagaaagaattaggacatgaacaaagngggagaagcatgaacattcatccgcagaag

SEQ ID NO: 38099 - DNA, 101 bp, rice(Oryza sativa)
  misc_feature (71): n=a or g
ggttgatgctcatgtaaaatccctgaaaacgttatgcaaacgaaaagcaaaaacagctaaggagggcgaancactgatcctgaagtgggtgcagcaactta

SEQ ID NO: 38100 - DNA, 101 bp, rice(Oryza sativa)
  misc_feature (71): n=t or g
tttacctaattgaaacaaagcgggcaagaggcatggtggaatcgttacgagttaaactattattttcttanctagctagaaattgattgattcttggatac

SEQ ID NO: 38101 - DNA, 101 bp, rice(Oryza sativa)
  misc_feature (71): n=t or c
tatcttggtacaattaaataataattaaatacattctcacgataacaaagtgtctatcatatttttcacgnatatgctttctaatctattaaacagtgtgg

SEQ ID NO: 38102 - DNA, 101 bp, rice(Oryza sativa)
  misc_feature (71): n=a or c
ccatctctagtaataagaaaaatacaacactgccccaaagatgccatcattggtgccacgcggatcaaccngtccaagtgctggagccatgggatccagcc

SEQ ID NO: 38103 - DNA, 101 bp, rice(Oryza sativa)
  misc_feature (71): n=t or g
ctgagaaatctccaagcaaagactttgactttgggaggaatgttcttgtctttccaggtggccttaataanagcaagggtttgggaatctacctgttgaag

SEQ ID NO: 38104 - DNA, 101 bp, rice(Oryza sativa)
  misc_feature (71): n=t or c
caagatcttatcagagtccctaaaacttctgcgcatcactcgctgcaaattcagtcaaacatcacgggttngtatttgtgtcccaagtcttgtttcactgc

SEQ ID NO: 38105 - DNA, 101 bp, rice(Oryza sativa)
  misc_feature (71): n=a or g
ttcgaagttagaagtgtgtgaaattacctcgaaccatttccttccttccttgctgttggagggagaaatgncacttcattttattcccctatttagttatt

SEQ ID NO: 38106 - DNA, 101 bp, rice(Oryza sativa)
  misc_feature (71): n=t or c
taacttggatttgttcttttttgttgggctccagatgaagttaaaaggtgataagactggaagaaaaggcnatttatctgtagcaacggaggtattggaaa

SEQ ID NO: 38107 - DNA, 101 bp, rice(Oryza sativa)
  misc_feature (71): n=t or c
tgttcagttggtgatgcactggtgtggcgacgataggtgtgggaagggtgttgcaggaaaaagcttagccnaggtttccctgagctgacaacgatgatgtc

SEQ ID NO: 38108 - DNA, 101 bp, rice(Oryza sativa)
  misc_feature (71): n=t or c
caaaaaaaaaagaaagaaagaagaagcagcttcgctagaagggcatgtttatatcctctggcaagtttttncactgtgtcacattgaatgtttagacaaca

SEQ ID NO: 38109 - DNA, 101 bp, rice(Oryza sativa)
  misc_feature (71): n=a or g
cattctgcaagctgagaagctgagtgaacttggggatcccagaagctactgcttctagcttcttgacagtngcagaaactttcatggtggattccttggat

SEQ ID NO: 38110 - DNA, 101 bp, rice(Oryza sativa)
  misc_feature (71): n=t or c
cgccaaaggtggaataagtaattaacttgcctgaagggatattttataccggagaccaaccagttatgttntacgtaagcgtggctctgaaggtccttttt

SEQ ID NO: 38111 - DNA, 101 bp, rice(Oryza sativa)
  misc_feature (71): n=a or g
cttgaccattggtgggttttggaccagaggctcaaggccaatctcaagcagaagtttcacttattaaatgnaactctacagtgaacggcatatattgtcga

SEQ ID NO: 38112 - DNA, 101 bp, rice(Oryza sativa)
  misc_feature (71): n=t or c
aatagtcgaacttactggcatcatcttgacatgagggttgtaaaatacaatctcttagttccatagtcttncttgatgtttgttgctgctgctgttgatgt

SEQ ID NO: 38113 - DNA, 101 bp, rice(Oryza sativa)
  misc_feature (71): n=t or c
ctttttgccagaccaacctcaaacacactgtgtgcttgtttgtattgtggtggaccctaggaaaaaaaagntggtatgaatttgaccactccatggatctc

SEQ ID NO: 38114 - DNA, 101 bp, rice(Oryza sativa)
  misc_feature (71): n=t or c
gctgatttgcatgcatcgatttcgcctttgcagtataaatgttccatcgatcgagaaacatgcatatgtgnatcaggccattcccaacccaatgactatta

SEQ ID NO: 38115 - DNA, 101 bp, rice(Oryza sativa)
  misc_feature (71): n=a or c
ctggagcagatgatcttgcaaaatacagtattgaagggtacataatctagatccatctacctctccctctnttttatttaatatttgatttgcttatgata

SEQ ID NO: 38116 - DNA, 101 bp, rice(Oryza sativa)
  misc_feature (71): n=t or c
ctggaggaggagagtggtgttttggatggggaatttgcgactcgaccgctcaaacggaaaagggaagacgngtttccggctacctttgtatatatagccag

SEQ ID NO: 38117 - DNA, 101 bp, rice(Oryza sativa)
  misc_feature (71): n=a or g
accactactaccattttggacccaagttatatatggggaagggtgtaagacattattcatgaaaaatgttncaaaaaaaaaacatagaaaaacatggagat

SEQ ID NO: 38118 - DNA, 101 bp, rice(Oryza sativa)
  misc_feature (71): n=t or c
ttgatggtttctccccttcggacgtttggataagtctgttggtaccctatatgttgttattaatttgtganggtgataccatattatatatgtacttaagt

SEQ ID NO: 38119 - DNA, 101 bp, rice(Oryza sativa)
  misc_feature (71): n=t or c
cttcatcataaagttgtatcgcactccttttgctatcttaggttctggccacttagcatcttctggtacanggatgcatttgtatcctagatttttgtaca

SEQ ID NO: 38120 - DNA, 101 bp, rice(Oryza sativa)
  misc_feature (71): n=a or c
ctaactgaaaatgaaagcgagtcagatcaagcacagcaaaccagtgaactcctctccaaatttttgccagnaacagtgaaaaaatcatcaagaccatggta

SEQ ID NO: 38121 - DNA, 101 bp, rice(Oryza sativa)
  misc_feature (71): n=a or g
gtccttcgtgttctttctccgacacacatgatggttgatgaaatgctctggttaagagctactttcttctntaatgataacaacccggtggcacttgcgat

SEQ ID NO: 38122 - DNA, 101 bp, rice(Oryza sativa)
  misc_feature (71): n=t or g
acaattttgactcatgttttacagagctagcatcatgtagcaaagcatcacaaagtcgagcaaatggcctnctcgcagtcgcagtaaagcaaggcaagcag

SEQ ID NO: 38123 - DNA, 101 bp, rice(Oryza sativa)
  misc_feature (71): n=t or c
tcaagaacagcccttgacgtggcacttacaaaggatatgatcaagttgttacaacggatgttatccatctnaactaccctattatctagccagcaactcaa

SEQ ID NO: 38124 - DNA, 101 bp, rice(Oryza sativa)
  misc_feature (71): n=t or c
cccacttcaaatactgttaattggccattgataccactatttggtggaattcggcctcggaatctatttcngtggaggatgaatttttcaaggacagagat

SEQ ID NO: 38125 - DNA, 101 bp, rice(Oryza sativa)
  misc_feature (71): n=t or c
ggagaatgctcaccgagtgcaataggcgaaggaaggcgaccagcggcgagcagatagcggcggcgctcctnggggaaacggcgtggtcagtagtccgatgg

SEQ ID NO: 38126 - DNA, 101 bp, rice(Oryza sativa)
  misc_feature (71): n=t or c
gatgacataataatacggttgttaataaaataacgatggtagaaagtctgggcgctttatgaaataacganagcagaaaaacaccgtctttcataaaataa

SEQ ID NO: 38127 - DNA, 101 bp, rice(Oryza sativa)
  misc_feature (71): n=t or c
gctcggtgatgacgacggcgatgataaccgtaacttggtgacggtagcgacaaccttgacaatgagcaganggccatttctgagcgacggtgggcaagggg

SEQ ID NO: 38128 - DNA, 101 bp, rice(Oryza sativa)
  misc_feature (71): n=t or g
atatacggtcttgtaccactttgacgttgacaatgagatggctcagctgttatcttgtccttcatcctganaataatctgctcactatattcatctaaaaa

SEQ ID NO: 38129 - DNA, 101 bp, rice(Oryza sativa)
  misc_feature (71): n=a or c
attgaccgtgcaaaggttctctttgatgaaatatcacgggctttacatcagcactctgacaaaagggctcntagtggttctcttaacatggaatgcggcaa

SEQ ID NO: 38130 - DNA, 101 bp, rice(Oryza sativa)
  misc_feature (71): n=t or g
gccgtcagaccttgtagccggccgtcgttcgtcgtcgcgtcgttgttcgttgtgtcggtgagttcgcttcnccgtcctcttcgcataggtgttctcggata

SEQ ID NO: 38131 - DNA, 101 bp, rice(Oryza sativa)
  misc_feature (71): n=t or g
acctgtaaatttttgttacctagaattgccagagaaaagataactccctgtattgatatgtttgggtgagntactgatgtcctccagtcaccaactgcaga

SEQ ID NO: 38132 - DNA, 101 bp, rice(Oryza sativa)
  misc_feature (71): n=t or g
aagaggtgcctctggaacttttgtcctcctcttcatggcattcctcaggcctagctgtgtgagctttcganaaacttgaacagaagaaatctttccactgg

SEQ ID NO: 38133 - DNA, 101 bp, rice(Oryza sativa)
  misc_feature (71): n=t or c
catgcttgataccttgtaccaaggtctgatatctaggtaccacccagtatcttgggtactaggcatcaggnatcgatcgatacctagtcggtaccaaaggt

SEQ ID NO: 38134 - DNA, 101 bp, rice(Oryza sativa)
  misc_feature (71): n=t or c
ctgactcagtgctgttgaaattgccacgtagaacaaaaccattcactatactgacttaggacatatattgnaccggttttgatagttgagggacccgttgt

SEQ ID NO: 38135 - DNA, 101 bp, rice(Oryza sativa)
  misc_feature (71): n=t or c
ggccatgctattacagtagcagcagcaactcaaggaccaccaaggaaaaaacttcaagttaggaggctgantgtggcctgatgacatatatagatattttg

SEQ ID NO: 38136 - DNA, 101 bp, rice(Oryza sativa)
  misc_feature (71): n=a or g
cggcgagtcgctcgagttcttcacttcgagcacctctcttgagctgcccgtcttctttaagcgccgtcttnataggtaaataatatgtgttctctccatta

SEQ ID NO: 38137 - DNA, 101 bp, rice(Oryza sativa)
  misc_feature (71): n=a or g
attcagactcagagaaagagagagagcccaactccttccttaaataaaggaaagcaataataagaaaagangaaaatttctgagccactgaaacaagggag

SEQ ID NO: 38138 - DNA, 101 bp, rice(Oryza sativa)
  misc_feature (71): n=t or c
ggtgctttgctgtctcatgtcgtaggaattccagtgtgagcacacaacctgcaatctttaagcatgctatntctgctactgcctctatctttatctgattc

SEQ ID NO: 38139 - DNA, 101 bp, rice(Oryza sativa)
  misc_feature (71): n=a or g
tggagaaaaaagaaccaccacatcaaacagcttcgagaccgaatcatcaggagaactaacagctgcaacancgccatcctgaaaagtccaccgaaacgtcg

SEQ ID NO: 38140 - DNA, 101 bp, rice(Oryza sativa)
  misc_feature (71): n=a or g
tccaaactatggtacgtcgtccgtatccgattcccatgtgcgtaacattcatcacgaagtcacgacttacnagtgaactgtgaaagagatttcgtgtgatg

SEQ ID NO: 38141 - DNA, 101 bp, rice(Oryza sativa)
  misc_feature (71): n=a or c
ctagtgtacttaaattactagtactagtctactactgatcaaagctaattgtaaattagtggcacggtganagtgaggagtaactatggctgtggattcat

SEQ ID NO: 38142 - DNA, 101 bp, rice(Oryza sativa)
  misc_feature (71): n=a or g
tgtagaaaggaagagagacggggtctcattttcacctaatgatacaacatcagttgagagcttcgttcagnaccttcaggtttgatttcctccctgtaatg

SEQ ID NO: 38143 - DNA, 101 bp, rice(Oryza sativa)
  misc_feature (71): n=t or g
ggactggttgtgcttgtagttgcagcagcagcagccgcagatcgctgtgaaaacattctcttgaaggaatnaggcatgtgagacattgcaacaggctgccg

SEQ ID NO: 38144 - DNA, 101 bp, rice(Oryza sativa)
  misc_feature (71): n=a or g
atcgaaaggaagcagctacacctaaggatacccagatacggttcacaggtaacttatccgtatcggatgtntcagatacagatatgtatcggatacacccg

SEQ ID NO: 38145 - DNA, 101 bp, rice(Oryza sativa)
  misc_feature (71): n=t or c
gcctccttgccccgcgaacatgtttgcatccttcatcttcttaactataagtgtagtgaaggcctccattncattctgtttaatggaaacaccacaattgc

SEQ ID NO: 38146 - DNA, 101 bp, rice(Oryza sativa)
  misc_feature (71): n=t or c
gggcgaaaaccttttatatttatgaacagagggaatacgtactatatatggtgttgtgtccatgtttttcnaatcagatctaaatactacgacgatgatta

SEQ ID NO: 38147 - DNA, 101 bp, rice(Oryza sativa)
  misc_feature (71): n=t or c
agtatttgctactacacctaggaggaactccaggattttatattccactggcaaaagtgcccgtgcgttgnaacgggaagtgtatagaccagaaaataaag

SEQ ID NO: 38148 - DNA, 101 bp, rice(Oryza sativa)
  misc_feature (71): n=t or c
gggagttgtttatgactcatccatcatataaaactagcctactcgcagttagaaataaccagcaagaaacngaaattttcgacactttttcatgtatcacg

SEQ ID NO: 38149 - DNA, 101 bp, rice(Oryza sativa)
  misc_feature (71): n=a or g
taccggactggtttatctaccaggaggagtgttcctaaactatcagccattaatcactgataatcaaccanttggccagttaattcctcttaatgcaccat

SEQ ID NO: 38150 - DNA, 101 bp, rice(Oryza sativa)
  misc_feature (71): n=a or g
ggacgatgaaggggcggctaaggtgcagttcaacactgctgagtcgtgggaggggttggagaggatcggcntggccttaatcgctagtggcgagcggctgg

SEQ ID NO: 38151 - DNA, 101 bp, rice(Oryza sativa)
  misc_feature (71): n=a or g
aatctggaatggtaacaaccatgattacacccacaaacaggcacagaagttgttcgttctagctatcagangcacggcaaatgccgccggcctaagcacta

SEQ ID NO: 38152 - DNA, 101 bp, rice(Oryza sativa)
  misc_feature (71): n=a or c
atgtctgagccaactttgaaggaaaaaaaaaaggaggcagcaaacgtaaaagtgccagttgcaatacaggnccacttcattcgcatggcaagaccacctgc

SEQ ID NO: 38153 - DNA, 101 bp, rice(Oryza sativa)
  misc_feature (71): n=t or c
attctgtctttgaaacatttcaggaaggcttgagctttttcatcatgagaggtgataatgctgccatcatnaagtgttaaatgaaagatcttgttttggcg

SEQ ID NO: 38154 - DNA, 101 bp, rice(Oryza sativa)
  misc_feature (71): n=a or g
gctactagcttaattttaagcttttagcctagctagctagctgctgctaccactgtttattactacctccntttcagattataaaattttatagcattgtt

SEQ ID NO: 38155 - DNA, 101 bp, rice(Oryza sativa)
  misc_feature (71): n=a or g
taattactttaatctaaccaccatttcgtgcttggggaatgttccttcacatgcggttatttcttcattanttacatctactacgtgcgtatttacaagat

SEQ ID NO: 38156 - DNA, 101 bp, rice(Oryza sativa)
  misc_feature (71): n=t or c
aacatatctctgaacctgattttgataggcctattacaatccaggcatgtcttctccatcatgttgccatnacatgagcatatgcttttctcgagaagatg

SEQ ID NO: 38157 - DNA, 101 bp, rice(Oryza sativa)
  misc_feature (71): n=t or c
ctaactggaaggaatgacttacactcactagcagaaatatgatatttacaccttaactgtgggcatcttanaggaaccttgttggtttgcagcttctcttg

SEQ ID NO: 38158 - DNA, 101 bp, rice(Oryza sativa)
  misc_feature (71): n=t or c
aaaaccagatactctctccgcaaaactatgtcacatcgtaggttctttttttagaacgaagggagtacaanggatcttctaacttacaaaacaagtgtaaa

SEQ ID NO: 38159 - DNA, 101 bp, rice(Oryza sativa)
  misc_feature (71): n=t or c
tctatgttcttttccaccactcgctgcatttcgtccaatgcagacaatccacattcaaacagcaggcgacngcagcgcgattgagagggggaaaaaaactg

SEQ ID NO: 38160 - DNA, 101 bp, rice(Oryza sativa)
  misc_feature (71): n=t or c
gcaagcatccccttgccgcccttctgtagaggtcttttttggcccagggtataaaacccccatctctctcntgaaattttttttactattccatattataa

SEQ ID NO: 38161 - DNA, 101 bp, rice(Oryza sativa)
  misc_feature (71): n=a or g
ttggacagttaattgtcatttgtggtcggaacaaaacgctgagctcctcattgcaggctcttgaatggaanataccaattaaggtatatgatagaaacgtg

SEQ ID NO: 38162 - DNA, 101 bp, rice(Oryza sativa)
  misc_feature (71): n=a or g
atttctgaaagcttatttcagtttattttgataaatcagcatatgaaaaaagtacccgcagccgcagcttnaaccgcagttgcaacttccaccgcacgaca

SEQ ID NO: 38163 - DNA, 101 bp, rice(Oryza sativa)
  misc_feature (71): n=t or c
accaaattttttcatgccatggctacaataagacaggaaaaacaaaatctcctccctaccaggttcactanatcggtttagggtttttatcgggggtcacc

SEQ ID NO: 38164 - DNA, 101 bp, rice(Oryza sativa)
  misc_feature (71): n=t or c
tatagagcaactggtgggaatggctaaatctggagctataatgtacttggtgaagatagctgagactactnatgaggaagaatttcccatacctgaaaaaa

SEQ ID NO: 38165 - DNA, 101 bp, rice(Oryza sativa)
  misc_feature (71): n=a or g
gtcagttgttatcttaattcaggctgtcattggagctgtgaggattggtagtagaacggtacttttctccnttctaaaatataaaagattttagatgaatg

SEQ ID NO: 38166 - DNA, 101 bp, rice(Oryza sativa)
  misc_feature (71): n=a or g
ccatttgcctcagcgagaagtgatacaaatgtatctcctattacagtggaggaaatcagggtggtacttcntttatatgcacctatcgcaatgcgagattt

SEQ ID NO: 38167 - DNA, 101 bp, rice(Oryza sativa)
  misc_feature (71): n=t or c
tgagtgacgagaagtttctggttcttgctgagacaccgcactaataaaagccgcaaactctctgctaacangtgaatcacctgattcttcagaagatggta

SEQ ID NO: 38168 - DNA, 101 bp, rice(Oryza sativa)
  misc_feature (71): n=a or g
tcggcgggcttaatttgaatatggtgacgagaaatgcaaccgtttctcatattgacctaaatgcccttgtntgagtggatatacggtataccaaccgtgag

SEQ ID NO: 38169 - DNA, 101 bp, rice(Oryza sativa)
  misc_feature (71): n=a or c
gtcttcctgtgctggacttcttgtaccatattaacaagcctgtcggttccatcagaaccaagcccacaagnattgtagctgtagtggcactgccagaaaac

SEQ ID NO: 38170 - DNA, 101 bp, rice(Oryza sativa)
  misc_feature (71): n=a or c
gagaacctgcatgaatcgaagaatttcctagaagcacaatcaacatgaggaaaagcagagtaccagttctntccattcttctttgttggtttttcttttgg

SEQ ID NO: 38171 - DNA, 101 bp, rice(Oryza sativa)
  misc_feature (71): n=t or c
atcatagtcgtagtgcaaacctgcaaactcactgtggcgctcagccgctcacagtcgcttgatcggtcggncagtaaactcgctgccgcgccaaagttcgc

SEQ ID NO: 38172 - DNA, 101 bp, rice(Oryza sativa)
  misc_feature (71): n=t or g
ttcatcctggaacggaaagaaagggatcgattattattcgtatgtacctgaagatagtaggcagtggctgnaccgtcgaaccctcccatgggttccacacg

SEQ ID NO: 38173 - DNA, 101 bp, rice(Oryza sativa)
  misc_feature (71): n=a or c
aataaagtactgtgacaacacaactatagtactactagtctactaccgtggtatctgctatatctctcacnagagatccgaattggctaccttgatattat

SEQ ID NO: 38174 - DNA, 101 bp, rice(Oryza sativa)
  misc_feature (71): n=t or g
tagaacatatttagttttatttaaaaaaacctttagaggagaggagaagagaatatacgtaaaatgagatnagccattaacgtatgattaagttaagtatt

SEQ ID NO: 38175 - DNA, 101 bp, rice(Oryza sativa)
  misc_feature (71): n=t or c
taacatgtaacgtgcagctctccaattatgttccctttttcgttacaacaattcagtttgactgtggaccnaggttctagaatgttttttgtaccatgttt

SEQ ID NO: 38176 - DNA, 101 bp, rice(Oryza sativa)
  misc_feature (71): n=t or g
agctccacgaattgccaccatttcctctgcatggattattaatccatggttgcagagttcagagggaggcntaaattttgggtggcattcctgctggactg

SEQ ID NO: 38177 - DNA, 101 bp, rice(Oryza sativa)
  misc_feature (71): n=a or c
ataataatatcaatagccatgaccatcctcctactcgttgtgttcttctgtcggatgttgggtaacatggngggcaagaacaagaggaagaagcaacctaa

SEQ ID NO: 38178 - DNA, 101 bp, rice(Oryza sativa)
  misc_feature (71): n=a or g
ctgtttttatttcctagacccacctctagagctatcttggtgccaggaatttatattgaactcacacgtcncatataaattgaacaaatgagaattaagaa

SEQ ID NO: 38179 - DNA, 101 bp, rice(Oryza sativa)
  misc_feature (71): n=t or c
ttagttagcgacatgacaaatgttggtcgatcagttatgttgcagctagcaatagatgttcggagcatatnatgtatacatcattggccataatagatgtt

SEQ ID NO: 38180 - DNA, 101 bp, rice(Oryza sativa)
  misc_feature (71): n=t or c
cactccaatatacaccaaatggaaaagtattcctcgaacagagccaatgtcatgttgtgtcgtatgtcttngagccattgctgattgcataatggctcttg

SEQ ID NO: 38181 - DNA, 101 bp, rice(Oryza sativa)
  misc_feature (71): n=t or c
gtggcctgtgcaagcttgccgttcttcatgtaattccagagctcatcgactacattatctgttttttgggnaagcagtctaatcacctccaaggaaactat

SEQ ID NO: 38182 - DNA, 101 bp, rice(Oryza sativa)
  misc_feature (71): n=a or g
aactcactggttgtaactaacacgtatagtaacgcctgcttatctcgccagctaagtactccacaaacttncaaactaaaacacgcaaaaaaaaaaaaaca

SEQ ID NO: 38183 - DNA, 101 bp, rice(Oryza sativa)
  misc_feature (71): n=t or g
ggcccttcagttcatctgatttactaattttaatttcagattccggctgttagttgacattttattgtctnctgcttgcttctgttctttgttgttggaag

SEQ ID NO: 38184 - DNA, 101 bp, rice(Oryza sativa)
  misc_feature (71): n=a or g
gttgtttttgtcacaaagaggagacgattagacatcttttcaatgaatgctgccttgcaaattctgtttcntctatcattcaagttgtcaaggttacggat

SEQ ID NO: 38185 - DNA, 101 bp, rice(Oryza sativa)
  misc_feature (71): n=t or c
gagagaagaggggaaaggtaagaaagaagatgagattaggagaaagttcctgacatgtgggtcttacctantaactcagcgagtcaaccgtggttaaactg

SEQ ID NO: 38186 - DNA, 101 bp, rice(Oryza sativa)
  misc_feature (71): n=t or c
tgttactctctgcaaaatcaccagttgcagatcgcaaaatggagatgtcgatgagcatcgaatctaaattntcaatgtcctctgcttcagtggagtaattg

SEQ ID NO: 38187 - DNA, 101 bp, rice(Oryza sativa)
  misc_feature (71): n=t or c
taatagcagcaaacataccttaacgcaaataccacaaccaatacacagctcttcagaaatgaacgcaagcntcgacgccggagttacttcgatgcaaagct

SEQ ID NO: 38188 - DNA, 101 bp, rice(Oryza sativa)
  misc_feature (71): n=a or g
gcgtaccatagccgcatactaagtgctggcatgagtgtgcggtgcgagttcccagaagctgacacaggccncacacgcagctcctgcagctgcctcttgtc

SEQ ID NO: 38189 - DNA, 101 bp, rice(Oryza sativa)
  misc_feature (71): n=a or g
agaaattgaacttcgtgtgtaccttttcatggtattaccagaaagacctcagaaatgaaggtagggatgtntaactgatcaaaatttgaattcatcgtcca

SEQ ID NO: 38190 - DNA, 101 bp, rice(Oryza sativa)
  misc_feature (71): n=t or c
ttttttttcaagggtttcattatatgtctcggcttaggcttagccaaccaaatgcataaactaggaaactnaatttcttttttttaaactcttggagagct

SEQ ID NO: 38191 - DNA, 101 bp, rice(Oryza sativa)
  misc_feature (71): n=t or c
gcaagccttctgatggggacttccgcacagatattcatgatctgatgctcaccatcgtaaaattcctgagngatactggtggagctttcactgtcaacatc

SEQ ID NO: 38192 - DNA, 101 bp, rice(Oryza sativa)
  misc_feature (71): n=t or c
cgtcccagcagttaagctttgccattcccctcacggctcatcattgttaacctgatcctaattagcttttncccccccgattaatttaatccattagttta

SEQ ID NO: 38193 - DNA, 101 bp, rice(Oryza sativa)
  misc_feature (71): n=t or c
acaacattgtgggacatgtagattgattttatagcattacaggtttgtgaagttgacgtagtagggcatantgaattttgtcgtgaccgtttacacaactc

SEQ ID NO: 38194 - DNA, 101 bp, rice(Oryza sativa)
  misc_feature (71): n=t or c
aatggtagtttatctcttctgcccttatctatttcattgtctgctaagaatttaagtatgacaacgtacanaaatcatcatctctttttcagaagcactca

SEQ ID NO: 38195 - DNA, 101 bp, rice(Oryza sativa)
  misc_feature (71): n=a or g
tgaagaagattgctggagatcgaactgttcctgttgaagtaaatgccttttgctctttacactagatctgnaagactattatatggaaacaagccatttct

SEQ ID NO: 38196 - DNA, 101 bp, rice(Oryza sativa)
  misc_feature (71): n=t or c
actcctgaaagctcgtttgaggacagatccaaagcctccatttggtttagatgaccgagtggagatggaancggccccgtcagtgagttgtgtgacatgtt

SEQ ID NO: 38197 - DNA, 101 bp, rice(Oryza sativa)
  misc_feature (71): n=a or g
ggaaacgggggggggggggctcttcttctgtggttgtggttatgggagctcacttcattagtttgactcancgttgaataataatactcccacgtcgttta

SEQ ID NO: 38198 - DNA, 101 bp, rice(Oryza sativa)
  misc_feature (71): n=a or c
ctactaggttgcaagtttgtaatgatatatggatgtgtgactaattaattactgtaattaacatagatcgntggacgcatgcaggagctactaccggtgca

SEQ ID NO: 38199 - DNA, 101 bp, rice(Oryza sativa)
  misc_feature (71): n=a or c
gttttccactgtaaaagagtaaagatataactgatgaatagagtgcaactttgggtactacaatcgtcagncaaataagcacttcacatgcatcgaaaatt

SEQ ID NO: 38200 - DNA, 101 bp, rice(Oryza sativa)
  misc_feature (71): n=t or c
tgcagtagcatattcatattagtcaattcctttgccatggtttggttcttcacccggtcttgaatgttcantccaataatcatctctactgcttcaagggt

SEQ ID NO: 38201 - DNA, 101 bp, rice(Oryza sativa)
  misc_feature (71): n=a or g
ctgccttcctggttaagaaaaaaatttcattttttctgacagcttttgccctctcccccttgcgtgctctnttcatcgtttaaatccctactcctatatac

SEQ ID NO: 38202 - DNA, 101 bp, rice(Oryza sativa)
  misc_feature (71): n=t or g
ttcgatggatggtacatccattcatcccagcttttctgcccccagtttgaactgtcgacctacaatgcttntatacgaatcagccattcacggagatcaat

SEQ ID NO: 38203 - DNA, 101 bp, rice(Oryza sativa)
  misc_feature (71): n=t or c
gcaaattaaaaaaaaatgtagagctcaaatgagatcagaaatgtaaaagaaatcaagaacctagcggagcnatcgtttcgcttattcgcggaataagtgaa

SEQ ID NO: 38204 - DNA, 101 bp, rice(Oryza sativa)
  misc_feature (71): n=a or c
cgaagagcaggttcatgaacattctctggaaacatcacatgaccataccttgcagcagcataacccatatntcttgcaagttcaatctaatgagcaaagag

SEQ ID NO: 38205 - DNA, 101 bp, rice(Oryza sativa)
  misc_feature (71): n=a or g
acccaccatacactgtttgagttttgctataggggacagctagaacttgtcaggttgaaggggaggcttcntagctacgccatccctcggaatattccaaa

SEQ ID NO: 38206 - DNA, 101 bp, rice(Oryza sativa)
  misc_feature (71): n=t or c
ttgtttctttgtcccctacaggcggaaatggaaatggttgctggtggacttaagaagaatttacaagttgnggaaagggttcatctcttatctctatatag

SEQ ID NO: 38207 - DNA, 101 bp, rice(Oryza sativa)
  misc_feature (71): n=a or g
gttcatgtccgatctgttttttcttttttcaggtggaacagttggaatcatttcgggtgcaacatcaacgngaacaccatccggagcaccggtaatttaag

SEQ ID NO: 38208 - DNA, 101 bp, rice(Oryza sativa)
  misc_feature (71): n=a or g
tcacctgaatcacccctcgcaatgcgaagctttctgcattcaccaaacatgagagctcagtaaacaaaacnatggcatatctcaaactttaaaaaattata

SEQ ID NO: 38209 - DNA, 101 bp, rice(Oryza sativa)
  misc_feature (71): n=a or g
tcgtaaaattctctctccctgtattgcccctctatactgatatttgttgtttgttccttatgtgcccgagnatactgttagttaaccccatggttgtatcg

SEQ ID NO: 38210 - DNA, 101 bp, rice(Oryza sativa)
  misc_feature (71): n=t or c
ctcactgttgagccagatcgccatttaagattcttaaggtgcagtttgtctttgtgccagcgtcccaagantacgagcccgacaagagcagctgcaaccac

SEQ ID NO: 38211 - DNA, 101 bp, rice(Oryza sativa)
  misc_feature (71): n=t or c
cccttctcaatgacaagcggcgaaaaccacagtcctccgcacaggactgccaaagaccctagcaacgaccntgacaatccggtcagcaaaggccaaagccc

SEQ ID NO: 38212 - DNA, 101 bp, rice(Oryza sativa)
  misc_feature (71): n=a or g
ctataatagtcgttgatgatatgtgggattgggtccacctgttaatcactatcaccgcaagggcagcactncaggtaatccaccatgtgcaaatgtacgtg

SEQ ID NO: 38213 - DNA, 101 bp, rice(Oryza sativa)
  misc_feature (71): n=a or g
ccccatcctcctcatcgcggcggatcaagcaacaagcttggttgcaacatggaccggcggcgattccgacntggtgctcccaggacgctggtaggttcctc

SEQ ID NO: 38214 - DNA, 101 bp, rice(Oryza sativa)
  misc_feature (71): n=t or g
tcctatggtatcatccgtccttccctctttagttgccaagttgaagacagccaagagcaagtttttatcanccagtgttgctgcatcagcatcaagtgttg

SEQ ID NO: 38215 - DNA, 101 bp, rice(Oryza sativa)
  misc_feature (71): n=a or g
tagatattcttttaaaagttgatgttaccggacgtcttcctaaatacaaggattatgagaagctgtaattntataataattcagaaaatgacatagaagtt

SEQ ID NO: 38216 - DNA, 101 bp, rice(Oryza sativa)
  misc_feature (71): n=a or c
ttggtcttcagagattgcatccatttcttttggatcttcagagatcacgcttgtttcagagttctccattntctcttctggttttggcgtctcttcttgtt

SEQ ID NO: 38217 - DNA, 101 bp, rice(Oryza sativa)
  misc_feature (71): n=t or g
agtgggagaccaaaagaggaaattgtgatccagaaagaaaaggagctgcgctcccaattactcaaagatgngttgaagcctcaacatggttgtttgcttgc

SEQ ID NO: 38218 - DNA, 101 bp, rice(Oryza sativa)
  misc_feature (71): n=a or g
atgttccttgctggtgcagttttatgtctgataaccagctcactggaagcattccgacgtcactatcaatncttcagagtttaacagacatgtatgactat

SEQ ID NO: 38219 - DNA, 101 bp, rice(Oryza sativa)
  misc_feature (71): n=t or c
gccaaaattagcttgagcatattcatctactagcggtcattgtccaattcaagcttttatttatgggttcnccttaccgttttcggcgtggttaccggacc

SEQ ID NO: 38220 - DNA, 101 bp, rice(Oryza sativa)
  misc_feature (71): n=a or g
cctgcaaatagacaggagatgattatgtcaaagaaatggtgctttgattgtcaaaacattagacaacatgncgttcactaaagattatatgaatatgacca

SEQ ID NO: 38221 - DNA, 101 bp, rice(Oryza sativa)
  misc_feature (71): n=t or g
gcctctggtcctcttcgctatcatccatgtaccatgcttctatcacctccgtcttaccatccttttttttnggggggaaaaagaacagtacaacaatcaac

SEQ ID NO: 38222 - DNA, 101 bp, rice(Oryza sativa)
  misc_feature (71): n=a or g
ggcagaaagcaatcagtggtcaatcaggcaaaggcaactacctcgggtcccaactcgatgttgacaccaancgcctccagcacatcggcgctgccgcaggc

SEQ ID NO: 38223 - DNA, 101 bp, rice(Oryza sativa)
  misc_feature (71): n=a or g
acgatacagattgaagtctccaggccacattgttgtctttccacacctaagctttatcactttcctctcangatccatggtgacgaagagttcattttctt

SEQ ID NO: 38224 - DNA, 101 bp, rice(Oryza sativa)
  misc_feature (71): n=t or c
gctgttgagcatgatggtggagaagaagatcgggagcaccatgagcacgatcttgacgtcctccacctccngcaccgtgcacgacagcgccccgcaccgcg

SEQ ID NO: 38225 - DNA, 101 bp, rice(Oryza sativa)
  misc_feature (71): n=a or g
atgctccctctgaggtagcatgtctgaacaacaggatcatgctagcaaaagttcttgctcaagtcttagcnccagtactcaggagagtgaggaggatgtga

SEQ ID NO: 38226 - DNA, 101 bp, rice(Oryza sativa)
  misc_feature (71): n=a or g
caagggcccagggaaacttggggcggaagaaaacgacttcacttcagagcgcgcgaccttccccctacctngcgcgccagctgtcgagggaaggccctcga

SEQ ID NO: 38227 - DNA, 101 bp, rice(Oryza sativa)
  misc_feature (71): n=a or c
acatctctaaacgcctgcatttgggcattactccttttcctaacagaagtatgctcaaattgccatagagnttcattaaaatcccctacgacaagccacgg

SEQ ID NO: 38228 - DNA, 101 bp, rice(Oryza sativa)
  misc_feature (71): n=t or g
aaagataaaaaggcaaaatcttctcttgctctaaacggtactccactcgggaaaacttaaatcatccctanaagagatatccctttatttttcatgttact

SEQ ID NO: 38229 - DNA, 101 bp, rice(Oryza sativa)
  misc_feature (71): n=a or g
gtgggagctccatgcggtgcaagtcgaccggacctcttatcccaaaaacacatcccaaagatagacaacgncaaggtctcggcgcatctaacaaatgcatc

SEQ ID NO: 38230 - DNA, 101 bp, rice(Oryza sativa)
  misc_feature (71): n=a or g
gtcaataccgtgctgcctcttcaagactgcctgagcatcttctggaggctcatctatcacatatctctcgncaacatttgtcaggtaaaattggactgaat

SEQ ID NO: 38231 - DNA, 101 bp, rice(Oryza sativa)
  misc_feature (71): n=a or g
ctaccaagactttctcgccgaggtcagcatcatcaatcgtctgcgccacaagagtattgtccctctcatcngttagtctcctccaattcttgtacagttta

SEQ ID NO: 38232 - DNA, 101 bp, rice(Oryza sativa)
  misc_feature (71): n=a or g
ggctcggatctgggtggtctttcgccatccgcacggccccccactaccggcgagacgagagaaaaacgaanccccgctgccatcgtccttgtggccgcgcg

SEQ ID NO: 38233 - DNA, 101 bp, rice(Oryza sativa)
  misc_feature (71): n=a or c
agaacggatgaaatattggagtgagtacagaaattttagtgtcagccctcccctaaaagacagcttctcanctgtaactagttccaaatcaaggaacccta

SEQ ID NO: 38234 - DNA, 101 bp, rice(Oryza sativa)
  misc_feature (71): n=t or c
atcacagccgcaaatcctatggagtatgtctctccacagaaaatcactctaggtgatggaaatgtgggtanagatggccaaaaggcccgaggctcgacggc

SEQ ID NO: 38235 - DNA, 101 bp, rice(Oryza sativa)
  misc_feature (71): n=t or g
ctccagcagatgtcgtagtctgcccttcatgtacaatacccatttactgttcaaacaggtgccaggagaangctataggacaaatgtcttgtaatcaaaat

SEQ ID NO: 38236 - DNA, 101 bp, rice(Oryza sativa)
  misc_feature (71): n=a or g
tcttgttgggtgagcccaagatgtctggaaatgacgataagtctcaggctgcagctgagagaataaaagcncaggccttatctgctgccaagggattgagc

SEQ ID NO: 38237 - DNA, 101 bp, rice(Oryza sativa)
  misc_feature (71): n=t or c
acgatgatggtagcaggcagcagcagtgtactgctagtattagcttagaccttaaagtacgtagtccttgnggcatatactacctccgtaatcgtaaaaaa

SEQ ID NO: 38238 - DNA, 101 bp, rice(Oryza sativa)
  misc_feature (71): n=a or g
agtgaaattggtggtttcactcacacaaatactgatatggttgtccaaccagaacttttggatgagtccancttgtcactctcccctcccctcccctcccc

SEQ ID NO: 38239 - DNA, 101 bp, rice(Oryza sativa)
  misc_feature (71): n=t or c
atcttgtcaaggagatgaccaaaaccctgaagttcttgtgaggaagaagttgctgaaagcagtggcataangtaagcttgaggttgctggttctgagctct

SEQ ID NO: 38240 - DNA, 101 bp, rice(Oryza sativa)
  misc_feature (71): n=a or g
tcgatgtgcttaaaatttgtcaaattacaacaggctgaggaaaacaaattgcattgcagaaaaatatcctntaaatatatgatacaacagctgtgatctta

SEQ ID NO: 38241 - DNA, 101 bp, rice(Oryza sativa)
  misc_feature (71): n=a or g
actgagatcgacagacgtcagctctctgaaatagtatacgtgtaaagcttagtaggagtagactgttgaanttggaacagaacacgtaggagtagcacaca

SEQ ID NO: 38242 - DNA, 101 bp, rice(Oryza sativa)
  misc_feature (71): n=a or g
agaacacgtggatgacacccttcttttcgctaaaggcaaggagggcacagttacttgaagcaaaacgacgncgagtataggtgacttcctcggagatggag

SEQ ID NO: 38243 - DNA, 101 bp, rice(Oryza sativa)
  misc_feature (71): n=a or g
taccaacatgtacgtacatcatgtcgagctccttgatgctgctgtgtacagctcgttgatatagccgatcntagagtccttgtttacaagcttgatgaagg

SEQ ID NO: 38244 - DNA, 101 bp, rice(Oryza sativa)
  misc_feature (71): n=a or g
actcggtcactcctcgcttcgatctgtgtaagtatctgcttcgatcatgctacagtttctttcccgctgcngattttgatttttgacacgcggttgcaggg

SEQ ID NO: 38245 - DNA, 101 bp, rice(Oryza sativa)
  misc_feature (71): n=a or g
tttgagaaacacagtacaatcgttggtgcttataacacacgcatacgcatacgcataccctgtctctatgngtatatccacgaggctgggccggtatatct

SEQ ID NO: 38246 - DNA, 101 bp, rice(Oryza sativa)
  misc_feature (71): n=a or g
atgagcctctcgtggcgatttctgaatctgattgtgggcgacaatatgcctcaaaccagatcaatttgctncatcgaccttacacgacaacaattctttca

SEQ ID NO: 38247 - DNA, 101 bp, rice(Oryza sativa)
  misc_feature (71): n=a or g
aaattattctagtcaacatctctcctggcatgttgttgttgctctcaacaatacatttttcgcagatgcgncaattgtacacctttttatatttagtcatt

SEQ ID NO: 38248 - DNA, 101 bp, rice(Oryza sativa)
  misc_feature (71): n=a or c
caatatgttgaccaacaatttcactgaataactttggtctgtacttctggctcaaacttctccggtctgcnattgccagatcagctccatgaacagctgga

SEQ ID NO: 38249 - DNA, 101 bp, rice(Oryza sativa)
  misc_feature (71): n=t or c
cactacaccaggcatgcctgctagcttgcttgcttatcacatatagccaagggcgaagatagcatcaaaanaagggggtgtgcactaccattgaaaattta

SEQ ID NO: 38250 - DNA, 101 bp, rice(Oryza sativa)
  misc_feature (71): n=t or c
cggtccaagttacttttgcccacatataaatacacaaaccctattccccactcatcttccatagccgccgngtcgtcgcgcgcctccaccaaccacctcga

SEQ ID NO: 38251 - DNA, 101 bp, rice(Oryza sativa)
  misc_feature (71): n=a or g
gcgtcggaacagcagcacacacactccagacgaaaccttttacgttgctgtggaaaatggtagaaaattangtgtaagatgaatttatttgttagctagac

SEQ ID NO: 38252 - DNA, 101 bp, rice(Oryza sativa)
  misc_feature (71): n=t or g
ggccaactgatcattcatttcttgttatgctcgcgttagctatatggtggcattcagagatatctggagcnattcccagatggtggctattttgaagggaa

SEQ ID NO: 38253 - DNA, 101 bp, rice(Oryza sativa)
  misc_feature (71): n=a or g
aaactatatttgtgaaattttatggccaaaatactgatgaggacatcaacaacaccaacgatacatccacncctccacaagtacaacttcatggtcctatt

SEQ ID NO: 38254 - DNA, 101 bp, rice(Oryza sativa)
  misc_feature (71): n=t or c
tccaaaataacttcgcaaagtagctgaaccaaaacaaaacatttcgatgtctctcctctctcgaccatganaaattcaaatgcaaccaattacacaattcg

SEQ ID NO: 38255 - DNA, 101 bp, rice(Oryza sativa)
  misc_feature (71): n=a or g
ctccttccaggtgctcgccgtggaggtcgaacccgaaggcgagctggctctccaaaactacagctcggagnccggcgcatggggcccggtcatccgccccg

SEQ ID NO: 38256 - DNA, 101 bp, rice(Oryza sativa)
  misc_feature (71): n=t or c
tctcaaattatccacattggtgccacgtcagctgaaatcacgtccagtccgcctgagacctatattgcacnagttctgatagttgagagatccattgtatt

SEQ ID NO: 38257 - DNA, 101 bp, rice(Oryza sativa)
  misc_feature (71): n=a or g
ccaagcattaatcttgcacacgaaaaaaaaatgttcactgagcttaatatgtactaatccctctgtactcntaaagaaagtcgtttaggacaatgtttaag

SEQ ID NO: 38258 - DNA, 101 bp, rice(Oryza sativa)
  misc_feature (71): n=t or c
tgtatataagagcaggagctagcatcatcagccaagatgaccactgaattccttagagtggagaagtaccngagtgtgaagaggatggagctgcagccgga

SEQ ID NO: 38259 - DNA, 101 bp, rice(Oryza sativa)
  misc_feature (71): n=t or c
aataaataaggtcattttgtacactgccttgtcttaatttctcatcacttgattttcacatgcatactttnaaaactgataaatggtattttttagaagtt

SEQ ID NO: 38260 - DNA, 101 bp, rice(Oryza sativa)
  misc_feature (71): n=t or c
tggcaccaaattcaatgtacagtactagtagtacgtgccaggtgcaacttgctaataataaatcgcttaancgagcatgcgcaacggcacggcgagacgag

SEQ ID NO: 38261 - DNA, 101 bp, rice(Oryza sativa)
  misc_feature (71): n=a or c
aactcctgcctggcagcacccctctcctccctgtcctcctctggatcccctcccttcgacctcacatctangcgacggcgagggagcggagggtgtggcga

SEQ ID NO: 38262 - DNA, 101 bp, rice(Oryza sativa)
  misc_feature (71): n=t or g
aaatataagtcgtatattttcttaacgttagaaatggacatgagtataacggacatgacatagtgtctcangatcggtaccattaggcctagtttcagctt

SEQ ID NO: 38263 - DNA, 101 bp, rice(Oryza sativa)
  misc_feature (71): n=a or g
atgagatcattccagttcctttctcaaagatgtaacctttatattgtttgtctttcaggacggctgcattntttgcccaacaacagatagtacatttgatc

SEQ ID NO: 38264 - DNA, 101 bp, rice(Oryza sativa)
  misc_feature (71): n=t or c
gaatttgctttcagagtccgctgttttcaggactacatgtccttttctaccgcggatattacaacaatganatagcaaatattgcaattcatagcttatag

SEQ ID NO: 38265 - DNA, 101 bp, rice(Oryza sativa)
  misc_feature (71): n=t or c
ggacacgcttcggagtttgcatgaagttacggatagtgttagcgagttcaaggtggagattctcaaggggnagtttgagcggtttgtgatgttggatggtg

SEQ ID NO: 38266 - DNA, 101 bp, rice(Oryza sativa)
  misc_feature (71): n=a or c
atggtgtcctgcagcgcgaggactccattgcgccgtagaccgcgttgagccagagcagcagccgcatgagnacctcgctgacgacatgatcctcctcctca

SEQ ID NO: 38267 - DNA, 101 bp, rice(Oryza sativa)
  misc_feature (71): n=t or c
tccgacatgatgcttgcaagatcaagggacaagctatgattattggaggtggtggtgatggtgtagtttgnggtgttcaacgcccgcggtaaggcgccatc

SEQ ID NO: 38268 - DNA, 101 bp, rice(Oryza sativa)
  misc_feature (71): n=t or c
taattttctgagaagtgtgtggttagtactaacataataattgtaatggagacaatgcgtaaattcttccnagcaatcgccgtcctcctacttcttgttgt

SEQ ID NO: 38269 - DNA, 101 bp, rice(Oryza sativa)
  misc_feature (71): n=a or g
gcctttgctgaaggtgaaatctccaactcagtgacccataaagaaattctccacctcctgcagcaccggcngcttgtccagatccacctcatgcgtgcaac

SEQ ID NO: 38270 - DNA, 101 bp, rice(Oryza sativa)
  misc_feature (71): n=a or g
ggtatcaggaaacttgtggcacacactgataattaactgagaagaacgaagagactactgatagtgggtgnagaaatggtctgctctgcaagactatttca

SEQ ID NO: 38271 - DNA, 101 bp, rice(Oryza sativa)
  misc_feature (71): n=t or c
gatggtctttccacctctgacaaaacaccttttactttagtgtagctgcataacacttctaaagcaactgnaaataaaatctgcaggtgaagttcattgta

SEQ ID NO: 38272 - DNA, 101 bp, rice(Oryza sativa)
  misc_feature (71): n=a or g
cagcctcttgctcttcaatctcatcttctctggtaaagtcagcctcttctttaccttcttctccttcttcnccttcacatacttcttatcaatcttataca

SEQ ID NO: 38273 - DNA, 101 bp, rice(Oryza sativa)
  misc_feature (71): n=t or c
aagaccgcgtctcgatattagaacatgagttctcgttcagggggtgattacatacagccgggtaaagtttnagcgttttacatagcatattatataaggta

SEQ ID NO: 38274 - DNA, 101 bp, rice(Oryza sativa)
  misc_feature (71): n=t or c
ccttcgagcaccatggcaaatggtttcttgccttctcgcttcggcatcaatgcaacagaagaaaaggatgntagctggaactgaagtgcaaacaaaccgga

SEQ ID NO: 38275 - DNA, 101 bp, rice(Oryza sativa)
  misc_feature (71): n=a or g
ctctactactggtgcctcctcccacgcagttatagggtctatttcaagtgatatggcatacagagattgcnatgtaccattatctccagtaatagccatgg

SEQ ID NO: 38276 - DNA, 101 bp, rice(Oryza sativa)
  misc_feature (71): n=a or c
gtactccctgcaatccatatttacagcctccgtccaaacaaaagcagcctctagacactactacgaaaatnatttttcgtggcggccattttgagtttttg

SEQ ID NO: 38277 - DNA, 101 bp, rice(Oryza sativa)
  misc_feature (71): n=t or c
cttaatgaataatactatactgcctctttcttcctgtcaagatgaagactgcataggcagttctcttggcncacatctccagcaacacatttatcttgatg

SEQ ID NO: 38278 - DNA, 101 bp, rice(Oryza sativa)
  misc_feature (71): n=t or c
tacccacctgcgcccctaccgctcaattccacagttgacgagctagatccagatgagtgaggttgtgagtntcatagatggtggcgttggagcacaaagcg

SEQ ID NO: 38279 - DNA, 101 bp, rice(Oryza sativa)
  misc_feature (71): n=t or c
ccttgccatcgggcttgccggattggaccttgaaagctttcctttggaagtggtcaaacttggtctacagncggaattgccttgtcgcttggcccaaggtg

SEQ ID NO: 38280 - DNA, 101 bp, rice(Oryza sativa)
  misc_feature (71): n=t or c
gcaaccactctcaccgattttctgccttaaagacaacagtttattctcagcattcatacccctaatattcnagcacaaaacattccaagacttgaaattac

SEQ ID NO: 38281 - DNA, 101 bp, rice(Oryza sativa)
  misc_feature (71): n=t or g
aaccacatgcgaaaactggatctagccgtctgcaaaaacccttttatagtgatggaagttaagtttattcntagaactttgcatggttgtttaatattatc

SEQ ID NO: 38282 - DNA, 101 bp, rice(Oryza sativa)
  misc_feature (71): n=a or g
cctttctgattgctgaacttagttccctgcttcctgtacatacagcaatgtagtttcatatagtgatggantgccaggtgagagccatggaatcccctact

SEQ ID NO: 38283 - DNA, 101 bp, rice(Oryza sativa)
  misc_feature (71): n=a or g
aaattggtaaaaccgacgatacgagagcacaactcaaaatatgagggcagtctgcacctatcatctactcntttgggttgtgtaggttcactacactggtc

SEQ ID NO: 38284 - DNA, 101 bp, rice(Oryza sativa)
  misc_feature (71): n=t or g
cagtccatcccaagtatcatatcatgccaagtcccaacaccttgagtacactagcaaaactttgcccctgncaccaccactcaacatttggaaccaccttt

SEQ ID NO: 38285 - DNA, 101 bp, rice(Oryza sativa)
  misc_feature (71): n=t or c
cacaagggcggcaacgggggacagcaaaagcccgtcgctatccagctacccttctacgcctacctgctcanctctgccatcaccttcatcatcgttgtacg

SEQ ID NO: 38286 - DNA, 101 bp, rice(Oryza sativa)
  misc_feature (71): n=t or c
gaatcgttttcttcaatgcttttatagtggcatattggacactgatcatttatgtgcgtaacactagaganccagttagatattcattgttagagaaaaac

SEQ ID NO: 38287 - DNA, 101 bp, rice(Oryza sativa)
  misc_feature (71): n=t or c
attgacctctcgccctaatctcacttcgttatttggtaaggctagaaattacctctctatgactgttgggntctggctacttgcattatgggctataacat

SEQ ID NO: 38288 - DNA, 101 bp, rice(Oryza sativa)
  misc_feature (71): n=t or c
cacttagctccggaaaagtccctggagaatacactatgcaaaaaggtatccatggaaccatgacacttgcncatatatgcaacccatagagttgcgtcggt

SEQ ID NO: 38289 - DNA, 101 bp, rice(Oryza sativa)
  misc_feature (71): n=a or g
aagatgccattgatgtgcaagggtgccagggctggaaggattctcttcgagaaggctacgctcgtcgacancgaggagcccgtgtgggaggtactggctca

SEQ ID NO: 38290 - DNA, 101 bp, rice(Oryza sativa)
  misc_feature (71): n=t or c
ggtgatgtgtacaagaagcaagcactcgtctgctgtcctcaggctcaggttatagttgtgtggcacagggncatgcaatgagaatgtaatgggtagcaaag

SEQ ID NO: 38291 - DNA, 101 bp, rice(Oryza sativa)
  misc_feature (71): n=t or c
aaaaagaaatttcaatatcttcagctatctacttttaagataacagagatcttgtagccagcctactttgngacaacattctgctcctctaaacctccagt

SEQ ID NO: 38292 - DNA, 101 bp, rice(Oryza sativa)
  misc_feature (71): n=t or g
gccgtctcagcgacccagccgccgcgccccctaccactgccaacccaatccatctctctctctctctactnctctccccgaacgcgctaccgttgttggac

SEQ ID NO: 38293 - DNA, 101 bp, rice(Oryza sativa)
  misc_feature (71): n=a or g
ccctcaacatccttaatagcccactttggtagttgcatgattgacaatacatgcatagggattgccatcantacctacttgatcaggcacatgccaccatc

SEQ ID NO: 38294 - DNA, 101 bp, rice(Oryza sativa)
  misc_feature (71): n=t or c
ttctctttttccttggcgctagtcctgtctatcaagaggacttctatcaccccatatgaatgatgcataanccccaatcattcgttcagagaacaaaaata

SEQ ID NO: 38295 - DNA, 101 bp, rice(Oryza sativa)
  misc_feature (71): n=a or g
accgagaagcagcttatggatgaggcattggatttgtactactcaaggcagaagaagcactcactactacnaaacatcaaataggtgtcaccactataagt

SEQ ID NO: 38296 - DNA, 101 bp, rice(Oryza sativa)
  misc_feature (71): n=a or c
gtaactcagtgttccaataccctcgctttactgatggctcgttttccatgagtatgtttgtttttctaagngaaagtttgttttcaaaaatcatgttaatc

SEQ ID NO: 38297 - DNA, 101 bp, rice(Oryza sativa)
  misc_feature (71): n=t or g
gaattcatgacattagtttcaacttcactatccactatcctcaacccatcaactatagtcttcccagacancaacgaataaaccttcaatcttggtcctat

SEQ ID NO: 38298 - DNA, 101 bp, rice(Oryza sativa)
  misc_feature (71): n=a or g
gagaaagcatacctcacccaatgagcgtatggtaagagtttcgaggtttggaaaaatatatggtagctccncgcaagcatgattgagaacagaggaatacc

SEQ ID NO: 38299 - DNA, 101 bp, rice(Oryza sativa)
  misc_feature (71): n=a or g
gctgcctttttcaatttctcttcttggcatcggacttcttccatcagaagccagcactgagaatcagaccncatcagctcatcatctataactctaactct

SEQ ID NO: 38300 - DNA, 101 bp, rice(Oryza sativa)
  misc_feature (71): n=t or g
gctagtgaaatctatgtccatttaatatgtgatgggtttttagatgggtataagacatggatatttcatgnagaggcatcgtcttcctttgctcaatatgg

SEQ ID NO: 38301 - DNA, 101 bp, rice(Oryza sativa)
  misc_feature (71): n=t or g
acggatgtagtgtataacctaggctctcccgcgagatggaaaagtcaaatcaatcaagtcattctattttntttatttcatcattaccatttttatgcttg

SEQ ID NO: 38302 - DNA, 101 bp, rice(Oryza sativa)
  misc_feature (71): n=t or c
tcaatgctaacggcagagaggctccaaccttcagtgactgatctaaaacaacttttggccaatggtgattntgttggacaccaaagtggatcatttgtgca

SEQ ID NO: 38303 - DNA, 101 bp, rice(Oryza sativa)
  misc_feature (71): n=t or g
aaactggagtcataagtctaaaatccgcttttctcataatacaagtggctcatcgttgccaacccgcacanggtataggggcgtcacatggagctaagcct

SEQ ID NO: 38304 - DNA, 101 bp, rice(Oryza sativa)
  misc_feature (71): n=a or g
ggtactgttcattccttagtcacaaccacctcttaactatatgcattcccatgtagtacagacaatatgcngttgcaggattcgatggtctaacctctgac

SEQ ID NO: 38305 - DNA, 101 bp, rice(Oryza sativa)
  misc_feature (71): n=t or c
ccctcacgccgtcatcctcacgccggaggagcagcagcggtagcacttcaaaaatctttctgcgcagcagnggtggtgtcggcggcggcacggtgcgcgcg

SEQ ID NO: 38306 - DNA, 101 bp, rice(Oryza sativa)
  misc_feature (71): n=t or c
cctgcctcttgcatcctctggacgaaataaatcatgctacgaaaatccccattttttgcatgcgcggcaanaatggtattgtatgatatgatatctgccat

SEQ ID NO: 38307 - DNA, 101 bp, rice(Oryza sativa)
  misc_feature (71): n=a or g
gcgtcttccttacgtgggccgttgccttatccagcccagaaggccggcagccgaaattgcgttcttctacntgggaggaaaaagtacacgaaaaggtccct

SEQ ID NO: 38308 - DNA, 101 bp, rice(Oryza sativa)
  misc_feature (71): n=t or c
agttaatacttcgtacaaagaatctgtggcatcactgttttagttcatttgacataggacacaccttaacntgaccgtagattcttcaattgcaagatgac

SEQ ID NO: 38309 - DNA, 101 bp, rice(Oryza sativa)
  misc_feature (71): n=a or g
ggtttctggcatgtctcatgatcaaaatgttgcatctggtgctggtctcaaagatcctagaggactcctcngtgctcatcgaacaggtgcagagagtagat

SEQ ID NO: 38310 - DNA, 101 bp, rice(Oryza sativa)
  misc_feature (71): n=t or c
aaaacaaaatacacaatcttatttgacatctattgtccttttgggtcatgagaaataaggaatttgcctgncaattggcccaatgtggtgggctggtttca

SEQ ID NO: 38311 - DNA, 101 bp, rice(Oryza sativa)
  misc_feature (71): n=a or g
ccctggcgttatctttgggccactgttgcagactgtgctactcaacaccagcagcaaagttctgctctacntcatgaaaggttcacctcaccctcttttct

SEQ ID NO: 38312 - DNA, 101 bp, rice(Oryza sativa)
  misc_feature (71): n=a or c
aaccagggatcttcttcaatgccccttgtttaatcttagccctcacatgttcgacaatattccagcttccntcaaaggcatgcagattagatactgagaca

SEQ ID NO: 38313 - DNA, 101 bp, rice(Oryza sativa)
  misc_feature (71): n=a or g
ctgcttcctctccttctccatcgcccaagaatcacaaacaatgcagccgcctcaaagaaaaacccaagaangcttccgcctccccggacaaagactgccac

SEQ ID NO: 38314 - DNA, 101 bp, rice(Oryza sativa)
  misc_feature (71): n=a or c
actgctcagcgtccctctccctgcacatttactcgtatgcacagcacaacacacactcctctcctctcctntctccaggctcacagatgagctgtgagctg

SEQ ID NO: 38315 - DNA, 101 bp, rice(Oryza sativa)
  misc_feature (71): n=a or g
cagaaggcacatagcgtggtcggtggctggcaggggagaagagcgatgtcatagcttggtggcgaagaccngctgaggccataagagaccggagcccaccg

SEQ ID NO: 38316 - DNA, 101 bp, rice(Oryza sativa)
  misc_feature (71): n=a or g
cttctagattagtacccaatatacccttgcccatatgagttgatttcattgcaggcttaaaagagtctctnaaactgccccctagagtagcttttcttacc

SEQ ID NO: 38317 - DNA, 101 bp, rice(Oryza sativa)
  misc_feature (71): n=t or c
gtggtattatcatagacggttttgagccatctgcaatctaataaactaaatgatgcatcgcactttgctgnaggatatagttagatattagataaatgatg

SEQ ID NO: 38318 - DNA, 101 bp, rice(Oryza sativa)
  misc_feature (71): n=t or c
cgtttgctgtggtccctaggtcgctgtgtccgaatcaggttcaaccctggcggcacttcgtttcgaccaangatgggtagccatctgcacggttaagtcat

SEQ ID NO: 38319 - DNA, 101 bp, rice(Oryza sativa)
  misc_feature (71): n=t or c
acttgcatcgcgaactagaagttcgccggatctctgacatatgcactcaatgtcgaaattatatcggaccntgcagctccatgacatcattaaaacatagc

SEQ ID NO: 38320 - DNA, 101 bp, rice(Oryza sativa)
  misc_feature (71): n=a or c
atatttaatttgaggttatttccaccaatgaactttgcttaagaagataatttgtaaagtcgaacttacgnattggagaacactatttcattgtcatatct

SEQ ID NO: 38321 - DNA, 101 bp, rice(Oryza sativa)
  misc_feature (71): n=t or c
gtagcttgctccacttccaatggccaattctcctgttgcacaaccacctcatgtatgccctgctctacacnctgctcaccgcgttccttgttaccaacgaa

SEQ ID NO: 38322 - DNA, 101 bp, rice(Oryza sativa)
  misc_feature (71): n=t or c
ggttgattagttgatgaggttctttcggttgcttttcatgattggtttgattgtagattttcaactactgnattcgtcccaaaataaagatttttccctct

SEQ ID NO: 38323 - DNA, 101 bp, rice(Oryza sativa)
  misc_feature (71): n=t or c
gtctgcaaatagatttatgcatcatttccagcatgtcatgaacaatactcacttgtatttgtgtagcatgnctttaacatcagcagacctctgggccccct

SEQ ID NO: 38324 - DNA, 101 bp, rice(Oryza sativa)
  misc_feature (71): n=t or c
tttaattggaataagttcaccaaccgttaatccactttacatacatcgagtctgtatgatatccctaatcnctaatattagaaatctatatccctaaacta

SEQ ID NO: 38325 - DNA, 101 bp, rice(Oryza sativa)
  misc_feature (71): n=t or c
cattatatacatgagattagaactaggccaaccgagagtctaaaagacaaattacctgtccaaatgcatangggaaagctgaatacatgccagctgctctt

SEQ ID NO: 38326 - DNA, 101 bp, rice(Oryza sativa)
  misc_feature (71): n=t or c
tggtgatggatgctatcacacaccaagatgattaggctctgggaccaatcgatgtgcccttaaccctaatnctaaacccataagaagcatgcatctcaacc

SEQ ID NO: 38327 - DNA, 101 bp, rice(Oryza sativa)
  misc_feature (71): n=a or g
agactatttatgtattctttgatgcacttaactggaatgcttaaggttaaaataccgaaatcatcagaatncttttaatttaagagacctttcatgtttcc

SEQ ID NO: 38328 - DNA, 101 bp, rice(Oryza sativa)
  misc_feature (71): n=t or c
gaaagtgttggtgacggggcatttggaaacaacagaaatgcaagggcaatgaagcctctcggggttgatgnaggcaggcccaaaaaaagagtcaacggcag

SEQ ID NO: 38329 - DNA, 101 bp, rice(Oryza sativa)
  misc_feature (71): n=a or g
tagcggtcgcaacagctgaaatagaagccgccaaaagcataaagctctcaaagatagtccttgtgtcaaanataaggaaagaggccaaaaattaggctcta

SEQ ID NO: 38330 - DNA, 101 bp, rice(Oryza sativa)
  misc_feature (71): n=t or g
cttcccaaccaaacgatgttctacagtgtttttttgcaaaatttttcacctgtttagagcatctccaaganacttgctagataactcttcaagttaaaatt

SEQ ID NO: 38331 - DNA, 101 bp, rice(Oryza sativa)
  misc_feature (71): n=t or c
ttgggtcacttatattgacctcagttgcacattgggctaggggtgggtcacttttttcactttataccacntatttttaccatcctttgcaagttggacca

SEQ ID NO: 38332 - DNA, 101 bp, rice(Oryza sativa)
  misc_feature (71): n=t or c
gtcagaggtgtgaggatctggcgtagtgaaccatataactaacgaacaaaagaatgatgacactagactanagtagtctctaatgttccatcctgaaattg

SEQ ID NO: 38333 - DNA, 101 bp, rice(Oryza sativa)
  misc_feature (71): n=t or c
gcacatagacgctctagaattactgctgtagctactctgaacaatatgatgttgtcacggtctaggagaanttttacgagattatcaacagagttattgtt

SEQ ID NO: 38334 - DNA, 101 bp, rice(Oryza sativa)
  misc_feature (71): n=t or c
gcttcttccacatcacacaggttccgcaaaatctccaagcaacactcagcaaaggttccttcagaaagaangggtgacaatcttgagacaattcccagtga

SEQ ID NO: 38335 - DNA, 101 bp, rice(Oryza sativa)
  misc_feature (71): n=a or g
agagtgcctcggatccccattgacaacccgaaagctcggaaacttcaccctccattcctgatttgccaccncccggtccagatgctccctaatatagccct

SEQ ID NO: 38336 - DNA, 101 bp, rice(Oryza sativa)
  misc_feature (71): n=a or g
caagaagcaaaaaactgcgacagccgatgatttgccatctatcgacctagatgtggaaaagtttttggacnatgaagaaatagaagaaggagttgatgatg

SEQ ID NO: 38337 - DNA, 101 bp, rice(Oryza sativa)
  misc_feature (71): n=t or c
gaatagctctctttatcctcactccttattagtttatttcgcctacacttccctcttgtttgtactctcanacaagatttatttatttaataaataaataa

SEQ ID NO: 38338 - DNA, 101 bp, rice(Oryza sativa)
  misc_feature (71): n=t or g
gacctttttgcaattacaaatgaatacacagatctttcttccttgaaagttcttagtgttgagagcggtgnctcattgtacatgtattcaagtacagatga

SEQ ID NO: 38339 - DNA, 101 bp, rice(Oryza sativa)
  misc_feature (71): n=a or g
tttcgtttaagcaaaactcatacaaggcttaagataaaattgcacgaacatgacaaaggaacatttgacantatacttatcgtgcactgtgttcatccttt

SEQ ID NO: 38340 - DNA, 101 bp, rice(Oryza sativa)
  misc_feature (71): n=t or c
gttcttgacgcactgcggccgcaactcgctcgtcgaggggctcatgtttgggaaccctctcatcatgttgnccatcttcacggaccaagggccgaacgcgc

SEQ ID NO: 38341 - DNA, 101 bp, rice(Oryza sativa)
  misc_feature (71): n=a or g
ctgttacgataattagcagcacagagagacatgcgtgcatactagctactagtagtagctagcaggtgggnggtgcggcgccggcgccgcggcggtcggac

SEQ ID NO: 38342 - DNA, 101 bp, rice(Oryza sativa)
  misc_feature (71): n=t or c
ctaaactcgatcacttggatctcccggtgtaacatagtaagttccaacaatgaactctacatcaacatganaacattgaaccagtacaaacctaaacaact

SEQ ID NO: 38343 - DNA, 101 bp, rice(Oryza sativa)
  misc_feature (71): n=t or c
tgaagtgcaccctccttatcttcctcatcaagatcaagtaagacctctgaggtagctgcaatgtgcccaangcgccttagctctcttgccatttcctcaac

SEQ ID NO: 38344 - DNA, 101 bp, rice(Oryza sativa)
  misc_feature (71): n=t or c
ctcctctctggcagcggccaaatcttcttctatggagccgatgtttggagtcatgaactcaaggagacganggcggcggcattgagccccctgagtgagcc

SEQ ID NO: 38345 - DNA, 101 bp, rice(Oryza sativa)
  misc_feature (71): n=t or c
aggtcgatccgaagaggacgatgaagacgaagaagagggatcgcttgggtcaggagcccgagttctcaaangatgatcacgtccacgatctcgactcggat

SEQ ID NO: 38346 - DNA, 101 bp, rice(Oryza sativa)
  misc_feature (71): n=a or g
atgcaccatttgcactatatgcaatgctgcatggtggtagcttacaaactggtcagtacaatgcaaagcancagcaaggcatggcatggcaagatagacgt

SEQ ID NO: 38347 - DNA, 101 bp, rice(Oryza sativa)
  misc_feature (71): n=a or g
aacaacgagaagaaaaagcaatcaggtccttgactttgcatctcttgcaactgcaacagccagaactcagntaacaacgataggagcagaaaaaccatggc

SEQ ID NO: 38348 - DNA, 101 bp, rice(Oryza sativa)
  misc_feature (71): n=t or c
gggttgggtgaatgactttgtgagccaccgatgtaatcctattagtggcaaattggcctatactgttgganttgttttgcatcggctcttttgggtaataa

SEQ ID NO: 38349 - DNA, 101 bp, rice(Oryza sativa)
  misc_feature (71): n=t or g
atgctgcataaggccaggtcaagtatcaataccacgtactcgagctcaggcatttgaccatgcatccatcncaaaaaagcagcagatacagccagactgat

SEQ ID NO: 38350 - DNA, 101 bp, rice(Oryza sativa)
  misc_feature (71): n=t or c
cttggtggctaacagctccaagaagaaagtggcacggctaggtgtgtgggtataagtataactatcttttngcccttaaattaacaccatcaaactaaccg

SEQ ID NO: 38351 - DNA, 101 bp, rice(Oryza sativa)
  misc_feature (71): n=a or c
aaagaagaaaaaacaaaacaagctgtgttggaagcaactcaagctggcaatgatatttttgtgaaggtggnggagttaaaagagatgacaatgctctcaac

SEQ ID NO: 38352 - DNA, 101 bp, rice(Oryza sativa)
  misc_feature (71): n=a or g
ggaatatcctccaacttcttggaacttttctccaatatttctgtttgttccttagtagcagcctgattcanactcgctacggatttctgcggcactggaga

SEQ ID NO: 38353 - DNA, 101 bp, rice(Oryza sativa)
  misc_feature (71): n=t or g
acaacttgacaagtggtgtcgtccagatggtttggaacagctggtgggtagtactagcttttaccacggcntcgcccgcccaatctgcagcgaactcctgc

SEQ ID NO: 38354 - DNA, 101 bp, rice(Oryza sativa)
  misc_feature (71): n=a or g
aaatactgatgtactctgacaactcctttgcagctcagaacttaaatggcaagtttttgcctcctcaaccntgcttgcataagaacaacaaatctcccggt

SEQ ID NO: 38355 - DNA, 101 bp, rice(Oryza sativa)
  misc_feature (71): n=a or g
atttgtgatattatcgagcaggtagttgcctgtgcgaacaaggatagagctggtgtcttagaaatgtcccncagactaggatttctcacaggtgaggaacc

SEQ ID NO: 38356 - DNA, 101 bp, rice(Oryza sativa)
  misc_feature (71): n=t or g
attaacggtttgttttgtttaagttgcaaaaccatgcgcattcgatgatttaggataatactacgtgtgtnctccagttatactcaattataaggttgatt

SEQ ID NO: 38357 - DNA, 101 bp, rice(Oryza sativa)
  misc_feature (71): n=t or c
atcttcaataacaggaccatgaccagaactacctgctggagtattgttgtccttaacttcaacatctatcngcctcacctccctagggtgtgtaatatgag

SEQ ID NO: 38358 - DNA, 101 bp, rice(Oryza sativa)
  misc_feature (71): n=t or c
aaggtcgtttccatgagcttcccggtgagcatcttcttcagggaaaaatatttagtccatactacaaatanagtggaaactatcgttggattgaaaaatta

SEQ ID NO: 38359 - DNA, 101 bp, rice(Oryza sativa)
  misc_feature (71): n=a or g
taaaaagataatctctttacacgtattttgcttgctgactcatatagacatcgtgatgataataagggatngaaaaatttaggacatatgtaataaaagat

SEQ ID NO: 38360 - DNA, 101 bp, rice(Oryza sativa)
  misc_feature (71): n=t or c
aataacaggttacaaaaattgtaaatttaatcatagtgcactacctcaaccaaagacggagcgtcctatangacatagtggaacacgtgacccaactttgc

SEQ ID NO: 38361 - DNA, 101 bp, rice(Oryza sativa)
  misc_feature (71): n=a or g
tttttttccgtcctccgccattgtgtgtcagtgtgcagtactgtaggggatctcagttggtatttttagcntacatttaaattttggggttcggtttgcat

SEQ ID NO: 38362 - DNA, 101 bp, rice(Oryza sativa)
  misc_feature (71): n=a or g
tagattaaatatagaagtggttcagaacattcaggcaaaagacggtctcaccgcacgtgtttagatggtanaagtggacaatgaacttcggtcaggctaca

SEQ ID NO: 38363 - DNA, 101 bp, rice(Oryza sativa)
  misc_feature (71): n=t or g
cgcacaaggatcggctcggggagctgctctcggacgacgatgagctaggtctgattcgatcgatttcgttntgtggtttcgtgtgggggtaagcgcgtacg

SEQ ID NO: 38364 - DNA, 101 bp, rice(Oryza sativa)
  misc_feature (71): n=a or c
gtcctcgagggcgacaatctcgacaagctcttccccggcgcaaccatggagattcttggctaccagctccncggcaagcagctattcattgtactcgccgc

SEQ ID NO: 38365 - DNA, 101 bp, rice(Oryza sativa)
  misc_feature (71): n=a or g
gagcttcctaaagcatggtgtaaattaacggcgggaaagggttttctactgggaaactattttcatcgagnggatatcctctcgttatttatatattaccc

SEQ ID NO: 38366 - DNA, 101 bp, rice(Oryza sativa)
  misc_feature (71): n=a or g
gatgaaggggcaaaaatatgcaaaatgctagagagggcagctgagcctgaaattcttatgtccagcatganttcagagcagctgctgtctttctcatatta

SEQ ID NO: 38367 - DNA, 101 bp, rice(Oryza sativa)
  misc_feature (71): n=t or c
gaattgggtgcattgacagaagcgaacgaagcagctgcgaaagcatttgacactcaaaatgaagaaatcangaaggagctagaggatcttaagacaaagtt

SEQ ID NO: 38368 - DNA, 101 bp, rice(Oryza sativa)
  misc_feature (71): n=t or c
gtttgctgctggctgatgctgctgctgcttgtgttgtacttttgatgttcaattccggtgattctgagttntaatggatgtaacctgtctgctattatata

SEQ ID NO: 38369 - DNA, 101 bp, rice(Oryza sativa)
  misc_feature (71): n=a or g
tccagaagcacgacaccgtagctgtacacgtcaaccttttcggttatcggaagactcgaaacccattccgnagccatgtaccctctggtccctctgatgct

SEQ ID NO: 38370 - DNA, 101 bp, rice(Oryza sativa)
  misc_feature (71): n=a or g
gcctgtggtagcggccgccggcgaaaatggatccaatcaaatccatcgctattgtgccttcaaggctaccnctcatgcaggttctattcaacggatccaac

SEQ ID NO: 38371 - DNA, 101 bp, rice(Oryza sativa)
  misc_feature (71): n=t or c
acccacctgtcaatcactcaagcttgccacctccttctccaagccaggaacggctgccacgtcgcatacangcgctagcaccccagtgcgccacctcgccg

SEQ ID NO: 38372 - DNA, 101 bp, rice(Oryza sativa)
  misc_feature (71): n=t or g
tatatatacattattttctagtattggatttgtcacaatgctttgcttccattgtatgcgccccacacaangcagtctcttcagcttgtacaatctgctcg

SEQ ID NO: 38373 - DNA, 101 bp, rice(Oryza sativa)
  misc_feature (71): n=t or g
aggggcatagcacgcgtgtgattcctcagatctatgcaacaaccgacggcgcgtaattaattggattaccngagcaacagacgcacatacctttgatccgc

SEQ ID NO: 38374 - DNA, 101 bp, rice(Oryza sativa)
  misc_feature (71): n=t or c
aacagcatcagatataccttgatgtgtttcagagcgaagcttcttctggctcagagtatggaagttgaggngagatgtctcgatacatgagaaagcattaa

SEQ ID NO: 38375 - DNA, 101 bp, rice(Oryza sativa)
  misc_feature (71): n=a or c
cgaattcgtataaagttagaaccatgcaatcgttgttacgtttcccgtcatcatgtagaccaaaatacctntagacatagaaccaacatgttagttccatc

SEQ ID NO: 38376 - DNA, 101 bp, rice(Oryza sativa)
  misc_feature (71): n=a or g
agcaatcagcccatgtgagtccattctcatccaccagctgtccaatgaccgccgccacaaccctatcgtcnccatccttggctgccaaggccacctccctc

SEQ ID NO: 38377 - DNA, 101 bp, rice(Oryza sativa)
  misc_feature (71): n=a or g
tgctaaaccatgtggcgggctccacctcattcgaagacctacgcactgttgatggcgtggtcatgccttcnttccgtgctgcagctgaaagaaggggtctt

SEQ ID NO: 38378 - DNA, 101 bp, rice(Oryza sativa)
  misc_feature (71): n=t or g
agcagacacgtcgcccttattatgtactcctaggagtaccaccagtaggttactgcagttttcgattaagnctttgaagtatacacatttaaagtattaaa

SEQ ID NO: 38379 - DNA, 101 bp, rice(Oryza sativa)
  misc_feature (71): n=a or g
aattgtacattgcagactaattttactcagataatcttttgcttgaacaagcctagttctacttgcatgtnttttgttaaatttagaactaatcatttaaa

SEQ ID NO: 38380 - DNA, 101 bp, rice(Oryza sativa)
  misc_feature (71): n=a or g
tttccttccatataagccttatctcaaccaaccaataaggaacatctttttccgaagatcttccacccccnaacacgtaaaaaaaaacaatcggatctcaa

SEQ ID NO: 38381 - DNA, 101 bp, rice(Oryza sativa)
  misc_feature (71): n=t or c
cactctcatattgagaaaagagactatcctcctcaagcaaagatgacatggccggcggagaacccctccgngtcacgaggcatgtgtgctccctaccacac

SEQ ID NO: 38382 - DNA, 101 bp, rice(Oryza sativa)
  misc_feature (71): n=a or g
gtttttctattcgcttttcctgtagatcaaaaagtgatgttcttccttcttaaacttcgcgaactccttcncgagagcgaaagtgctgataacgtattgtg

SEQ ID NO: 38383 - DNA, 101 bp, rice(Oryza sativa)
  misc_feature (71): n=t or c
tcatgccgatccattgctatttcctccgatcgaccgatcaattcttctagctagctagctaggagtatcgngatctttgctgtatatatatctagctgatg

SEQ ID NO: 38384 - DNA, 101 bp, rice(Oryza sativa)
  misc_feature (71): n=t or c
tttacataatgtttcccacaataagtcacttcgtatggtgtcttataggcttagagatggcaatggccccncgttcatcgttttcttgcggtgaattcaca

SEQ ID NO: 38385 - DNA, 101 bp, rice(Oryza sativa)
  misc_feature (71): n=t or c
agttctaagagcaccactccaaaactgtatacatcgctctgcttcgtcaacaagcccgattgaagatatantggatccatataacacatatctccaatcac

SEQ ID NO: 38386 - DNA, 101 bp, rice(Oryza sativa)
  misc_feature (71): n=a or c
tggcaagaacaaactgaagctttctttactacttcctcgtccatcccaaaataagttaatcaccctaatancattaatttacctagatacatatccaccaa

SEQ ID NO: 38387 - DNA, 101 bp, rice(Oryza sativa)
  misc_feature (71): n=t or g
ctttcaacatctgagtctacaacacttcttgctgatgctgaagaagatgacaccatcattgaagacaaagnttccagttttggaggtttgtccgtcgcgaa

SEQ ID NO: 38388 - DNA, 101 bp, rice(Oryza sativa)
  misc_feature (71): n=t or g
caagatctctttaagatcgacgttgggaagagctagcttcacacaagcgaggacatgacaaaccccagtgnggatcccgatggagatctcctccgagaccc

SEQ ID NO: 38389 - DNA, 101 bp, rice(Oryza sativa)
  misc_feature (71): n=t or c
acgacttcaacaagaccgaacttgagattatcacgggcatattcctcgggatctacaggcaccttgaactntctctggagctttcctaatctgattgctgt

SEQ ID NO: 38390 - DNA, 101 bp, rice(Oryza sativa)
  misc_feature (71): n=t or c
ccctgcaccgttctatccacactttagtttttttttccctttccacaaaggcccattgcaaggaagaccgnattgccattgtttgatttcttacatgctag

SEQ ID NO: 38391 - DNA, 101 bp, rice(Oryza sativa)
  misc_feature (71): n=t or c
ttatatttagcgtatcaagtaaatgaaggaaagacaagatagctaaatatggtaagattggctgaaactcngatactatctctattagcagtcatgaagca

SEQ ID NO: 38392 - DNA, 101 bp, rice(Oryza sativa)
  misc_feature (71): n=a or g
ggcaaaccaaggaagcagaaatttaactgacatggtggcaacaccacaaattgacaacttacttcaggaanttcaaagcaagccagataatcgaattaaga

SEQ ID NO: 38393 - DNA, 101 bp, rice(Oryza sativa)
  misc_feature (71): n=t or g
gatggaagcaattcatctgcaacaaacagcttgcacctctcattgtcggtactgcctgcaagtcggaccanagcaaggcaaaaggaaatagcacttgtagt

SEQ ID NO: 38394 - DNA, 101 bp, rice(Oryza sativa)
  misc_feature (71): n=a or g
acaaacaccaccaatttaaacatatgcaaaagttagccgattatcgtaccattccagccttggcaagcgcntcgagaagcatgttatacgcaaagatatcc

SEQ ID NO: 38395 - DNA, 101 bp, rice(Oryza sativa)
  misc_feature (71): n=a or g
atctaaatatatatcgttaaaatctttcaaatgtgctaactattagagtagagcgtgcgtacatgcgttcntcggagtaagtgtacgtgtgttttaatcgt

SEQ ID NO: 38396 - DNA, 101 bp, rice(Oryza sativa)
  misc_feature (71): n=a or g
accagagattacggagaatgcttgttgatttccgggttaaaaatatgaagggcatgttcaacatcacaaanacaaaggtaaaatccatgaattacttcatg

SEQ ID NO: 38397 - DNA, 101 bp, rice(Oryza sativa)
  misc_feature (71): n=a or g
taggctctaatactaattgtagaatcgtaaggggactttcccactcctaaaactagccaatcatgtgagangctccccacttatatattaggtccattgtt

SEQ ID NO: 38398 - DNA, 101 bp, rice(Oryza sativa)
  misc_feature (71): n=t or g
aaactgtaccgatagttgatctatacgtactgcattcttttaagggttatggaactcttcccccgtatggnatgtaaaacaaaacgatagattggtacata

SEQ ID NO: 38399 - DNA, 101 bp, rice(Oryza sativa)
  misc_feature (71): n=t or c
cgtcaaattgtgatcaatcgctaattgttgcagcttgcgtgctttatttttttagctgaaagctttgtcanactatattacagaacaagcataaacaaatt

SEQ ID NO: 38400 - DNA, 101 bp, rice(Oryza sativa)
  misc_feature (71): n=t or g
caactgtcaaatctaggatcgtttacggtggtatcacaccactatcaacataagaagcgtagtatcgttanaatcatactaaaatcggaatactaactctt

SEQ ID NO: 38401 - DNA, 101 bp, rice(Oryza sativa)
  misc_feature (71): n=a or g
cgttgttgcgtgactgtcagatcaaagaaaatggctcagattcggtcagggtacacagtcgtgtactgtanagctgacagcctggttgtgtcgtggcgcag

SEQ ID NO: 38402 - DNA, 101 bp, rice(Oryza sativa)
  misc_feature (71): n=t or c
tactctcttcttgaccagtcttcattttgggagattagctacctgtctacctctccctccttcagtccaantttttccgcaagcatcaaagctctagtccc

SEQ ID NO: 38403 - DNA, 101 bp, rice(Oryza sativa)
  misc_feature (71): n=a or g
accaaggaaacacctcaagtccctgatatcatccctccttgctccctgaaaattttggtttttaaatacgnaattaaaaattcggaataaccaaaaaatat

SEQ ID NO: 38404 - DNA, 101 bp, rice(Oryza sativa)
  misc_feature (71): n=a or g
cttgatcaccatgtgaccttaagctttataagatgatgaatcactggcactaaagagcagtccgtggattngatgaagtccctgaatcccaaaaggcaaat

SEQ ID NO: 38405 - DNA, 101 bp, rice(Oryza sativa)
  misc_feature (71): n=a or g
aaataagaagatataccgggatgaattgagttttccggaagagtagccttgcagctagaagagtgataaanacttaggggttgttcactttgatgcctaaa

SEQ ID NO: 38406 - DNA, 101 bp, rice(Oryza sativa)
  misc_feature (71): n=a or g
ccaatacaaagttatctattttttaatacggtcttacttaaatttttttaagcttccccgatctaccactncttctatttattttccttgaaacatttaaa

SEQ ID NO: 38407 - DNA, 101 bp, rice(Oryza sativa)
  misc_feature (71): n=t or c
gcaatgtgaagaacagtataacctcttgggtttctatgattaacatctgcaagtgcgagatccaaaagctnggttgtaattttggagtcacaatgttcgac

SEQ ID NO: 38408 - DNA, 101 bp, rice(Oryza sativa)
  misc_feature (71): n=a or g
gcaacttaacttgagatctcaggaccatcagcacgcacctttatccttcatccctataaaaaatgattcantacaagctactccctccgtcccataatata

SEQ ID NO: 38409 - DNA, 101 bp, rice(Oryza sativa)
  misc_feature (71): n=a or g
gcgttggtagtacaagtagtgtgaggaggttgaggaagaaagaggagagagcaatggagattgatgggtgngatgagatggcgatggagaggtggaggtgg

SEQ ID NO: 38410 - DNA, 101 bp, rice(Oryza sativa)
  misc_feature (71): n=t or g
gtggaaccagccccgtccgtatttccaagaaggcaataaccaagctaactactgacgcacttaataaaaanatggttgctaatgacaagatcttagaaaat

SEQ ID NO: 38411 - DNA, 101 bp, rice(Oryza sativa)
  misc_feature (71): n=t or c
cgagggattcaattatttttgttctagtactatgtgtcactgataccatgcaaatatactccctccgtccnataatataagagattttaattttttgcttg

SEQ ID NO: 38412 - DNA, 101 bp, rice(Oryza sativa)
  misc_feature (71): n=t or c
cctcaatcgatgatgaccccttatacatgtaaaatattaaggctccttttaaaacgtaggaattcaaaaanatagaaataggaaaaacatagaaatcgaga

SEQ ID NO: 38413 - DNA, 101 bp, rice(Oryza sativa)
  misc_feature (71): n=a or g
atggttgacttgcactttataggcaagaggacccgaatcaaaactagataaccacaatgccaccgccttcnatatttgaatgaagctcatattgacctgac

SEQ ID NO: 38414 - DNA, 101 bp, rice(Oryza sativa)
  misc_feature (71): n=a or g
tcagatttgttcttttattataacttatagaggttgaattaattgcatgtttatagagtaacggtgatatncctcatatttatctattttattaattattt

SEQ ID NO: 38415 - DNA, 101 bp, rice(Oryza sativa)
  misc_feature (71): n=a or c
cccgtgtcaagataccagttggtatccactccataggcagcatgggtagcagcagcaacatgcctttcatnaggcacgtaggagtcatcgaaacaatgcca

SEQ ID NO: 38416 - DNA, 101 bp, rice(Oryza sativa)
  misc_feature (71): n=a or g
gatttttggcttgctaatacctccctggagccttgttctgggtctaattgcttctgtttcttcaacacccnatggatgtgacaactgaacctcatcatgac

SEQ ID NO: 38417 - DNA, 101 bp, rice(Oryza sativa)
  misc_feature (71): n=t or c
aagaacaaatttctaacttttacataatgataattatgactccatatcggtcatcctggtaactgcagggnaagacatcagttgaatacgagcctgtctat

SEQ ID NO: 38418 - DNA, 101 bp, rice(Oryza sativa)
  misc_feature (71): n=a or g
gcgtgtcattaagtgtgagttgatcgaaaatgggagaattaatgcttggtgtaagataaggaacaatttgnatactcatatagtatttgggacaagaggga

SEQ ID NO: 38419 - DNA, 101 bp, rice(Oryza sativa)
  misc_feature (71): n=a or g
gcactaccgtaaaagatagaagagttttttcccttgtgggtagtctttatgtacatatagctagctcaacnaaatacatcccataaagactactctcacaa

SEQ ID NO: 38420 - DNA, 101 bp, rice(Oryza sativa)
  misc_feature (71): n=t or c
taaccaccagccggagctacattgcttcgagatgatgggaattcagagaatttgcatcgttcttgggatgntttttatacttgtgagaggtaaaccgatca

SEQ ID NO: 38421 - DNA, 101 bp, rice(Oryza sativa)
  misc_feature (71): n=t or c
acctgttcgtctcaggggtgaatctcacagaactgggtgtttttggtgaaactctgatggatcaacaaganctgtgtggtgtggttaactgaagcaaacct

SEQ ID NO: 38422 - DNA, 101 bp, rice(Oryza sativa)
  misc_feature (71): n=t or c
cgcctccacaactgtaagcctcctcatcataaccctctttcgtttcccgcgtcgcctcctttgccgccgangcggtctcccccgccgccctcgactcgctc

SEQ ID NO: 38423 - DNA, 101 bp, rice(Oryza sativa)
  misc_feature (71): n=t or c
ttatttcagattaacggctaataatatacagttccccaatgctaacagcataactgtgccctcataacctnatttatgtttgagtaattttacagctcttg

SEQ ID NO: 38424 - DNA, 101 bp, rice(Oryza sativa)
  misc_feature (71): n=a or c
agttttgacgcagggggctcaccatgtacttgcagtcgctgttttacttccggggcagcgttattagtttntagaacgcataaatttaatgggaatttggc

SEQ ID NO: 38425 - DNA, 101 bp, rice(Oryza sativa)
  misc_feature (71): n=a or c
ttctagggtttcctcatcctcgatggggtttatccttcgagcacatatataatccgcacgccgccgcctcnctctctgcttcgcactccattttccctctc

SEQ ID NO: 38426 - DNA, 101 bp, rice(Oryza sativa)
  misc_feature (71): n=a or g
catggatcgttgcttacctcatcacggacggctatggaattgtaggaagacgcttggccccatggaccatngttcatgagcttgagctgtccaccaccatg

SEQ ID NO: 38427 - DNA, 101 bp, rice(Oryza sativa)
  misc_feature (71): n=a or c
aactcattcaggtccatgaacattaactacagtatttggcctgttattttgattccttacaacttcccacnttggatgtgcatgaagcaaccaaatttcat

SEQ ID NO: 38428 - DNA, 101 bp, rice(Oryza sativa)
  misc_feature (71): n=t or c
ctgatccgccgcgccaccgccgccgtcagggatggactggatcctatgcggcaatgccaagaccaggtcgncccgcagcgcctcctccggcgagagccctt

SEQ ID NO: 38429 - DNA, 101 bp, rice(Oryza sativa)
  misc_feature (71): n=a or g
ttcaatatcatccaaggacacaaagcaaaaaatggcaaaggattgagaggatttaccagtaaggaacagtntctacagaaagcttaaatttaatcatatcg

SEQ ID NO: 38430 - DNA, 101 bp, rice(Oryza sativa)
  misc_feature (71): n=t or c
acgacgtccttgtagggcaaatctcctccgaatatatcaagggcactcccaaccgtaacatcaactcgacngttgcctgctctttttatcctctctaggtc

SEQ ID NO: 38431 - DNA, 101 bp, rice(Oryza sativa)
  misc_feature (71): n=a or g
taggtggaataccattagtaacagagcctacttgttgattaggtgatgtataatggtgcaaaacataattnttggtaatgggatcaatctccttgtcgata

SEQ ID NO: 38432 - DNA, 101 bp, rice(Oryza sativa)
  misc_feature (71): n=a or g
tgttatgaagggtattttggcagatgtcctaaaatgtcttggcgacaataagaagcacatgagggaatgcncattgactgctctagacttatgggttgctg

SEQ ID NO: 38433 - DNA, 101 bp, rice(Oryza sativa)
  misc_feature (71): n=a or g
cttcaaaaaaggagtagcaaaagtctaatcatgcattgatcttgttgttgtttggttccagcacgtgggancgaagaacattgcctggcctgctattttcc

SEQ ID NO: 38434 - DNA, 101 bp, rice(Oryza sativa)
  misc_feature (71): n=t or g
aatatagaaacttcaaatttactgcggatttgagatctagaactgtgccaaacaggacctgaattgaaatngtttaaaattttatatttatctcaaacaaa

SEQ ID NO: 38435 - DNA, 101 bp, rice(Oryza sativa)
  misc_feature (71): n=t or c
tctgtacaaaattgggtggacgtcgctttcaaaaggatgcggagagaaaccacctatatatgatgactccncaggtagtataatttattagaaaaaccatt

SEQ ID NO: 38436 - DNA, 101 bp, rice(Oryza sativa)
  misc_feature (71): n=a or c
acccaggaattacattcagaatccaagaataaaaattacatggaaggtatgatacaaacatcttctcaacntatataaagaaattgaaaacacaaacaaga

SEQ ID NO: 38437 - DNA, 101 bp, rice(Oryza sativa)
  misc_feature (71): n=a or g
atggaaatggggtatctgttgggtgttggtagctatgatttgaaccatatctgatgttggcgatgaattgnatcaacctctgcggagcaagaatatgctta

SEQ ID NO: 38438 - DNA, 101 bp, rice(Oryza sativa)
  misc_feature (71): n=a or g
gcgaggcagggaagaagaagaggaacacgctcgacgtatccatcttatcgcaagattgtcactattggctntatcggcggagaaaagagtaaccacctgtc

SEQ ID NO: 38439 - DNA, 101 bp, rice(Oryza sativa)
  misc_feature (71): n=t or c
tcgatatctaagattggtggatatggtgggaggggttgatgcaggtgaatgcaacaaaaattatgagtgcnatttttctaagcaaagtgcagtatttaagg

SEQ ID NO: 38440 - DNA, 101 bp, rice(Oryza sativa)
  misc_feature (71): n=t or c
tagagttgaactacttgccattgtcggtgatgaactctttcagcacactaaaccgacagacaatggttttncgcaagaatttctggactgctgccgaagtg

SEQ ID NO: 38441 - DNA, 101 bp, rice(Oryza sativa)
  misc_feature (71): n=a or g
caggtttgtcatccgcgccacctctcaacctactaatccccatcgtttcctacttcttctcctgctcaaancgtcctttaccgcgatgtgaaaatcctgca

SEQ ID NO: 38442 - DNA, 101 bp, rice(Oryza sativa)
  misc_feature (71): n=t or c
aaaaaaaaaaacagagagagaaagaaagaccaaggaagacttgactcacctgcaagtattgggctagtggntaatgaagttcatacacacacgtgacaaac

SEQ ID NO: 38443 - DNA, 101 bp, rice(Oryza sativa)
  misc_feature (71): n=a or g
aaataaattatattacctccatctaaaatgtaagatattggtgtatatttaagccgaccagtgctcctccnttttatattataagggttattagtatttcc

SEQ ID NO: 38444 - DNA, 101 bp, rice(Oryza sativa)
  misc_feature (71): n=a or g
gtgtgtttaaaggcaaagggaacaagctttggttgcagtgcaagttgcattgcacaccatcatccaacccnatttgatagatcatactattatatgatgcc

SEQ ID NO: 38445 - DNA, 101 bp, rice(Oryza sativa)
  misc_feature (71): n=t or g
tacacctatgctatatatttgatcgacgaagaggtagctctagctgtgcctagctcgcatggacgcggagntcggcgacggcgtgccgtcgtcctcgccgg

SEQ ID NO: 38446 - DNA, 101 bp, rice(Oryza sativa)
  misc_feature (71): n=t or c
ctttgcttttctttgtttgcttcatcgtatatatgtaggcatgacgggagggttaagtgcacaagacgtgnccattctctaagctttcgtcgcgaaataag

SEQ ID NO: 38447 - DNA, 101 bp, rice(Oryza sativa)
  misc_feature (71): n=t or c
tttaccttataaaccttaccgaaacctccttttccaagaatgttggaatcgctgaaattgtttgttgccgngacaacgtattcaaaattaacatgtgaaaa

SEQ ID NO: 38448 - DNA, 101 bp, rice(Oryza sativa)
  misc_feature (71): n=t or c
gatccattaggttgataagcattcatgtagggctgattggttgaagttgcactaactgaagctgcagtcanagcgggagcagcaagtgtaactgaagtact

SEQ ID NO: 38449 - DNA, 101 bp, rice(Oryza sativa)
  misc_feature (71): n=t or c
cccttcacagtaagagataactcacatcattgttcttgagataggggtccaggtcattgctagcatagtanaagtccccttggccggagctgaaaatctcg

SEQ ID NO: 38450 - DNA, 101 bp, rice(Oryza sativa)
  misc_feature (71): n=t or c
ctgtatgacaaatggaaggcctgacagtggctatctttattggagatggaagccctatggctgcgagatgncgcggtttgagggcgagaagtttttggagg

SEQ ID NO: 38451 - DNA, 101 bp, rice(Oryza sativa)
  misc_feature (71): n=t or c
tcgttgtactatagcaaatctagataaatatttgtccatatttattgtgctaataaggatcacatctcctnctagattggttttttttttttacagatgaa

SEQ ID NO: 38452 - DNA, 101 bp, rice(Oryza sativa)
  misc_feature (71): n=a or g
gcatatataggtacagggttttcatcttgcagatggatcaaatgtagatgatgtagccaccgcatcacccnttgggtttgcctggagccccctatcctcgc

SEQ ID NO: 38453 - DNA, 101 bp, rice(Oryza sativa)
  misc_feature (71): n=t or c
cgtcaggggctcgcagacgatgaggtcagtgaagaagaagtcgccttctgctgcatagccgctgcgtgtgngtgtcctcctcttcttggagaggagcagta

SEQ ID NO: 38454 - DNA, 101 bp, rice(Oryza sativa)
  misc_feature (71): n=a or c
gggctatgccacttcctttacctccaactacaaggggtggacctccagttttatcacaagacaggagaagngctgatcaagtcgctcagtcaaaggaagct

SEQ ID NO: 38455 - DNA, 101 bp, rice(Oryza sativa)
  misc_feature (71): n=a or g
atttttcttttcgcatgaggtcagcttaagtgcctaagtgcgaaaatctgatttttgcatacctttgggcntttgcaggctacctgtccgcatgtaaaaat

SEQ ID NO: 38456 - DNA, 101 bp, rice(Oryza sativa)
  misc_feature (71): n=t or c
aaacaaactgttcagttctgaatttctgagttctgattggtgaattgccacagtgctactgaatcagatanacaagccgattgggccgaaacctgtttcga

SEQ ID NO: 38457 - DNA, 101 bp, rice(Oryza sativa)
  misc_feature (71): n=t or c
tctttgtcagccgagttgacacacttattgacaaaatgctcgagaagatcggaacacctgaggcacttgcnctcagaggaaaggtacgcacaatcaaaatt

SEQ ID NO: 38458 - DNA, 101 bp, rice(Oryza sativa)
  misc_feature (71): n=t or c
tactacacccatctttccttttaccatgaccaccatgaaagtctggaaggcagacttagaggattcattanctatagcttgaatgctcatatcccatccaa

SEQ ID NO: 38459 - DNA, 101 bp, rice(Oryza sativa)
  misc_feature (71): n=a or c
atctggaaataaatatatactagcatcagctcgtagctggccgccgatcatcatgatatatcgatggcgangacacgagcattgcatcatcagttcatcac

SEQ ID NO: 38460 - DNA, 101 bp, rice(Oryza sativa)
  misc_feature (71): n=a or g
actggaacaatgatattttccgcatatgtttgattgtacttttttcatagaggatggcaggttgatggccnatgctgaagctggtgaattttggggttttt

SEQ ID NO: 38461 - DNA, 101 bp, rice(Oryza sativa)
  misc_feature (71): n=a or g
cccttgtgcacgcacgatatgcatgccctgcatgctcatgttcacgtgaatatgctcaagccatgcacganttccaaagctgcagcttccctgcccttgtt

SEQ ID NO: 38462 - DNA, 101 bp, rice(Oryza sativa)
  misc_feature (71): n=t or c
agacgacggcgacgctgagaagaagaaaaggagagaaccaccgtgtaaacaaagtagtcacaccaagaggnccctgttgctgatgagatttgccacaaagg

SEQ ID NO: 38463 - DNA, 101 bp, rice(Oryza sativa)
  misc_feature (71): n=t or c
cgtgcctcccatcctgcccactctacaaggcattcggcctctatgacaccaccgttcctgttgacgttgangccttgatgcgccacccctatcgctggtga

SEQ ID NO: 38464 - DNA, 101 bp, rice(Oryza sativa)
  misc_feature (71): n=a or g
aagtctgaaaaattctagatttgtagacacgtggttagcgatgtatgtattagacatgtgcaaatgtaganatgacaatgcattgaacagatacctggtaa

SEQ ID NO: 38465 - DNA, 101 bp, rice(Oryza sativa)
  misc_feature (71): n=t or c
tagttgtgttatcttcacattaatgtggcgtactgattgtttcgaacaccagcatgagataatttaaaatngagtacctgatttcgagttgcctattatct

SEQ ID NO: 38466 - DNA, 101 bp, rice(Oryza sativa)
  misc_feature (71): n=a or g
attgtacaacagttttgtgccaagtgctaactcactaataatttgttgcctcaggcacaggtaccgcgagncagagtaaatcagagccctcttgctcctcc

SEQ ID NO: 38467 - DNA, 101 bp, rice(Oryza sativa)
  misc_feature (71): n=a or g
tctggggaaactccttcaacatcccatgataataaggatgttgatcatgaaacttgtctaagttcagcagngccatctcctgtggataataatcctgccca

SEQ ID NO: 38468 - DNA, 101 bp, rice(Oryza sativa)
  misc_feature (71): n=t or g
atctccatctgaggatgatgttcaggtaccgggccattgatgcaattctgcactggatgatgcctttcatngccaacacttgcctgcatcagttgggcatc

SEQ ID NO: 38469 - DNA, 101 bp, rice(Oryza sativa)
  misc_feature (71): n=a or g
tatcactaggctcggccttcgccttgtccatcagcaagacggctgcattagcgccgccctcatgtgtctcngctgcgtgcttgtggctgactctgacacca

SEQ ID NO: 38470 - DNA, 101 bp, rice(Oryza sativa)
  misc_feature (71): n=a or g
cttataatctgaaacggatagagtagtaaaaaaagacatagtacatgagaattgcgcacaaatttaacagnatcaattaaactggtgtactagatcatttg

SEQ ID NO: 38471 - DNA, 101 bp, rice(Oryza sativa)
  misc_feature (71): n=a or g
caatagatgatgatagatagatccatgtcgtgtcctgttcttcagtgctgcttctctcagcttgcagtttnggtgtattgttccctgatctctcttctatt

SEQ ID NO: 38472 - DNA, 101 bp, rice(Oryza sativa)
  misc_feature (71): n=t or c
ccacaatgaaacgaatcaggcgcgcgatggagaaaataagaggaaaacaaaagtgagggagatcgaactgnggtgcggtgcggattaacctattatggttg

SEQ ID NO: 38473 - DNA, 101 bp, rice(Oryza sativa)
  misc_feature (71): n=t or g
gcccttgggcacacagcttatatgggttggtgctgatcagtttgcactgcagacctttgttccattaaagntagctactatgtatactgcgacctcttttt

SEQ ID NO: 38474 - DNA, 101 bp, rice(Oryza sativa)
  misc_feature (71): n=a or g
gattattagacgcaacataccaagtggcgtatacttggcttcactctttccatcagagcaagcgtaaaagntcacgtattcacgtcacatggagtaactga

SEQ ID NO: 38475 - DNA, 101 bp, rice(Oryza sativa)
  misc_feature (71): n=t or g
taggatctcaccatctcaccatctcacgccgtatattcttctgaggtctcaaagtcgaagcccttgaagancagagggatacaatattttgcatatttctt

SEQ ID NO: 38476 - DNA, 101 bp, rice(Oryza sativa)
  misc_feature (71): n=a or g
agactacaacatctaagcactttccaataaagccatacaaatggacaacgaatgccaaccaatgccacatnaataggccaattcttacttacctagtgtaa

SEQ ID NO: 38477 - DNA, 101 bp, rice(Oryza sativa)
  misc_feature (71): n=t or c
ctataggtggctgtgagtgtgaggtgccaacttagcctatttaaattttagatttgccaaagaggtcgcantagcataataaatttcttcagatacgcaaa

SEQ ID NO: 38478 - DNA, 101 bp, rice(Oryza sativa)
  misc_feature (71): n=a or g
ttatataagaggtaagatattacttaaaaaataaagtatttatttggttccttagaaagaaaatcctaacnaaagataagctaatccctccgtttcacaat

SEQ ID NO: 38479 - DNA, 101 bp, rice(Oryza sativa)
  misc_feature (71): n=a or c
cttgttggcgcccgcgtggatctctccatctatacatgggtgttcgtccacacatgtcttgtttaaaaccnaaaaaaaaacaaaaaaatagatgctcacag

SEQ ID NO: 38480 - DNA, 101 bp, rice(Oryza sativa)
  misc_feature (71): n=a or c
gaacgaccgcctaagcggttccaaagagagcgacttctatgcctccttcttgaacgctgctcgtggtcgtnttcatcatcagaccttctctccggcgccgg

SEQ ID NO: 38481 - DNA, 101 bp, rice(Oryza sativa)
  misc_feature (71): n=a or g
ccactaccccacacctgacacctcgtccatctacctcacgagctggcatgctatataaaccccaagctcangctgagcaactgtcacaccccgaagttctc

SEQ ID NO: 38482 - DNA, 101 bp, rice(Oryza sativa)
  misc_feature (71): n=a or g
attcaaacctagtaactgggtatcagatctgatactcatgggtatcagacgtggacacgtggtactattgnaagctgccatgtcgcgcctgcgccgcctgc

SEQ ID NO: 38483 - DNA, 101 bp, rice(Oryza sativa)
  misc_feature (71): n=t or c
tacacccaaatttggcacttggggttgaaatagggaaaattgcaagatttggtaatctaccgatttcctcnagaagggccgatctgaccggcggcatgtgg

SEQ ID NO: 38484 - DNA, 101 bp, rice(Oryza sativa)
  misc_feature (71): n=t or c
aagagttagactactttattgagcaagaagattttgttgaggttcatggaaagcgatttatgaagcccttngtggagaaacctgtcaatggtaattgccag

SEQ ID NO: 38485 - DNA, 101 bp, rice(Oryza sativa)
  misc_feature (71): n=a or g
aatccccaagccaccatacatagcctctgttcgtaagtgctcattcccaactctctttgccttgttttttncgcgcacgcttcctaaactgctaaacggtg

SEQ ID NO: 38486 - DNA, 101 bp, rice(Oryza sativa)
  misc_feature (71): n=t or c
ctgtcatggcttcagggcagcgtaacaaaacaaagcttctataccatccggaccgtatagccaaataacantgttttatcacttgacctcaaaatgtttag

SEQ ID NO: 38487 - DNA, 101 bp, rice(Oryza sativa)
  misc_feature (71): n=a or g
ccaactgttgatgagaccataggaattctcaaaggtctccgggagcgatatgagatccatcataaggtccngtatactgatgagtcgttgatcgcagctgc

SEQ ID NO: 38488 - DNA, 101 bp, rice(Oryza sativa)
  misc_feature (71): n=a or g
ggattggttttatgcttatattatggacaaatattggctagttttggcacgtgtctagtgagaaagggtantcagatggtgcagtgtgaattcaaacaaaa

SEQ ID NO: 38489 - DNA, 101 bp, rice(Oryza sativa)
  misc_feature (71): n=t or c
attgttaatgttggtgtagaacttaaggattttgaagattaaccactgcgaagtgttaggaaacgataagngaacaaacgataaaaaacaatagatcaatc

SEQ ID NO: 38490 - DNA, 101 bp, rice(Oryza sativa)
  misc_feature (71): n=t or g
tgatatctttctcatgttcacactggattgctgcaaagatggtttttgttttcttctcttgatgagaacanccattaaacataacaataaaattacaacag

SEQ ID NO: 38491 - DNA, 101 bp, rice(Oryza sativa)
  misc_feature (71): n=t or c
gtaacatgacagttatgcactatttctcactattgaaacagagggttacttaagcacaaacagaattctcncactctttttctaaaaattctagtagtaca

SEQ ID NO: 38492 - DNA, 101 bp, rice(Oryza sativa)
  misc_feature (71): n=t or c
tcgagtgactccgtgacgcggcctcgtcatgaactgatcgccacgcattttgtttctccaatattatactnacaatccaaaacttccttgcaatttcagca

SEQ ID NO: 38493 - DNA, 101 bp, rice(Oryza sativa)
  misc_feature (71): n=t or c
ttaattggtaaatggtttgctaaggtgaagttgtcgccgggccgttaatttgttaattgaacttaatagcntacctcggttaaatctcagccacgattatt

SEQ ID NO: 38494 - DNA, 101 bp, rice(Oryza sativa)
  misc_feature (71): n=a or g
aataattagttttgagcccttagactaagaatcagcacgacacaaatttacaggtatttcggtggtgtttnaatctcctaaagatgaagataaagattaag

SEQ ID NO: 38495 - DNA, 101 bp, rice(Oryza sativa)
  misc_feature (71): n=t or c
ttggagagctagtttacagcgaagcttaccttgtaagcctccttcttgtagcgatgtcgacactcggggcncacattatcgccgtccaacccatccgccga

SEQ ID NO: 38496 - DNA, 101 bp, rice(Oryza sativa)
  misc_feature (71): n=t or c
attcaaacatgtatcaatctttatataatctaacaccaaattattatcacaagaccacgataccctatggnagagacatgattttgctagatgtctagcat

SEQ ID NO: 38497 - DNA, 101 bp, rice(Oryza sativa)
  misc_feature (71): n=a or g
agaagttgcagcagaatatgagatttcacttcctgtgttgaaaacaaccaacaatgacatatttccatcangtgagctatcccctaaactactctgagaag

SEQ ID NO: 38498 - DNA, 101 bp, rice(Oryza sativa)
  misc_feature (71): n=t or g
tttgtcttgtgggggcatgacaaccacttggtttgttggttgtctctagccatcatctttggtcccttttnctcaaccaaaccattagagcaaaatctttt

SEQ ID NO: 38499 - DNA, 101 bp, rice(Oryza sativa)
  misc_feature (71): n=t or c
tcctcgaactccatctcaatgatcatgtctagtttctacatggccaatgcatgcctgcagagctagctacnatgttatatactccctccgtttcaaaatgt

SEQ ID NO: 38500 - DNA, 101 bp, rice(Oryza sativa)
  misc_feature (71): n=t or c
tccggttttaggttgctatattatgggatggatagagtagtgagtaaggggattgttccgcatagttttgnacagaggtagataattcacttagagttaaa

SEQ ID NO: 38501 - DNA, 101 bp, rice(Oryza sativa)
  misc_feature (71): n=a or c
aatggagggactaacaactgtgttaagctagcgtgctaattagccagtgtaattgaccattgctttgcttncatgcacggcaacattgcatgaccaatggg

SEQ ID NO: 38502 - DNA, 101 bp, rice(Oryza sativa)
  misc_feature (71): n=t or c
tcgcaccaccctcttcttctccacaacccattaatatttcttagtgctgttgatgattcttggttgattgnatgatataatcgagtaatgccatgcgtctt

SEQ ID NO: 38503 - DNA, 101 bp, rice(Oryza sativa)
  misc_feature (71): n=t or c
atctgattattggatctgatgtcgggacggagtgaggagggatgggagaataaggaatagatatggtttancggtgcaagttctcccatgtggaaacaatg

SEQ ID NO: 38504 - DNA, 101 bp, rice(Oryza sativa)
  misc_feature (71): n=a or g
cctatcctcatcgtcatcttcttctccttcatcatcgtcgtcttcgtctccttcatcctcatcatcatcanaatctccatcttcatcagtatattcatctt

SEQ ID NO: 38505 - DNA, 101 bp, rice(Oryza sativa)
  misc_feature (71): n=a or g
acatacgaagcaaagaatatagtctgccctctaggacttgaggataccaaacgattgtatcctctatcgcngtgaggagtacgagaacctagaagcatgcc

SEQ ID NO: 38506 - DNA, 101 bp, rice(Oryza sativa)
  misc_feature (71): n=t or c
ttaatttgtttggttcatattactcctttcatgctaaaatatactccctaattttaaattataagtttacnatgttcaaaatcaaactattttaagtctga

SEQ ID NO: 38507 - DNA, 101 bp, rice(Oryza sativa)
  misc_feature (71): n=a or g
tttcggttttgggtgtctcctgcttgtggtttcatcgcctgctagatcgatctactactactctgaagacnaacagattgggaggttgtttcactgaccgg

SEQ ID NO: 38508 - DNA, 101 bp, rice(Oryza sativa)
  misc_feature (71): n=a or g
aaaaataccagaaaaacacggcctgaaagaagaattcatacttcttggatggtgaaaggcgcagtaataanaatgtagtatcacaaaaacatggaagatca

SEQ ID NO: 38509 - DNA, 101 bp, rice(Oryza sativa)
  misc_feature (71): n=t or g
agcccgtaggcacgtgacatctatcgaaaaagagaggaaaaatactacccgtcctctgcttctctctttcnttctcttgctgtgttttcttcttcctccct

SEQ ID NO: 38510 - DNA, 101 bp, rice(Oryza sativa)
  misc_feature (71): n=t or g
agagagagagagagaggcggctcgcggactcgcggtggggaaggaaaggagatagtgaatgagggttaggnttagcggttttgatggattcagaatcgatc

SEQ ID NO: 38511 - DNA, 101 bp, rice(Oryza sativa)
  misc_feature (71): n=t or c
cagcctcagacgagggcatctctttctctccagtcccaaaaaagctcgcaagagcatcagacaagataatnggaagctggttaacatcagtttcagcagga

SEQ ID NO: 38512 - DNA, 101 bp, rice(Oryza sativa)
  misc_feature (71): n=a or g
aatggtacccatcacatttctttaggaggtctatagatacttgtttccaggggtggaactagagcgaaatngaggtggtgccacttacttaatttatttta

SEQ ID NO: 38513 - DNA, 101 bp, rice(Oryza sativa)
  misc_feature (71): n=t or c
ttccattagtattttgggatttgggaattatataaaggttttaattcctggttccatgttgtcaatagaantctagatgataccccgcgcattgctgctag

SEQ ID NO: 38514 - DNA, 101 bp, rice(Oryza sativa)
  misc_feature (71): n=a or g
gaatattgttaatatacgaatatgtgtttgggagtttggtgtgaaactagcttgcctgtggcgcttccctncatagtagaatatattctataagtctcata

SEQ ID NO: 38515 - DNA, 101 bp, rice(Oryza sativa)
  misc_feature (71): n=t or c
taggcccagtcatacattggagactgcaagaagtaaaaaccgacttatatttaagctggagggatgtattncatctctctccagaaatacttaataatttt

SEQ ID NO: 38516 - DNA, 101 bp, rice(Oryza sativa)
  misc_feature (71): n=a or g
gtcaaaaagtagaaattaatgtagagagaatcagaccagctagggaggagtagaaccatgcttcgacgtangaacaaaatggtttgcattggcatgcatgc

SEQ ID NO: 38517 - DNA, 101 bp, rice(Oryza sativa)
  misc_feature (71): n=t or c
ggatcccagtagcagtcttcttcgacttgcctcctccttttgcagtagtgcccaggaatcaactcaatggnaagccaaaaagatcacatcagtggggtctt

SEQ ID NO: 38518 - DNA, 101 bp, rice(Oryza sativa)
  misc_feature (71): n=t or c
tgcatggatcgatatgcatgtacgtcaattcgctgtctcccttgtactctgcgtacttagctagtagacgnagcagcaacaatgactctctctctctgcaa

SEQ ID NO: 38519 - DNA, 101 bp, rice(Oryza sativa)
  misc_feature (71): n=a or c
tccgacaaaatccacaaacaatgttgccgtcacgcaggagaggagcagggtgatgaacaagctggccgacntggtggagcagcacgccgacgagctggcgg

SEQ ID NO: 38520 - DNA, 101 bp, rice(Oryza sativa)
  misc_feature (71): n=t or c
atgcacaatcaaactgtgcatataatctggtgaagggaggtgtaggtgccaacgaaggcgatgcatactcngatgactagtattccgacgatcgccgccac

SEQ ID NO: 38521 - DNA, 101 bp, rice(Oryza sativa)
  misc_feature (71): n=t or g
gcttgatacgaaattgtaatttccatcgcaggtgaactcgggcaaaaattttaaaatcccttgtgggttcncactttttttttcctctagtgctgtgatac

SEQ ID NO: 38522 - DNA, 101 bp, rice(Oryza sativa)
  misc_feature (71): n=t or c
gatcatatggattgcttgcgcaactacgtcttcaaccgcggtcgtgacaaacctttcattgtcaacctctncgatccctttatactcttgtctggccctaa

SEQ ID NO: 38523 - DNA, 101 bp, rice(Oryza sativa)
  misc_feature (71): n=a or g
cttttggagatgaacgactttttaggcttagcttattctaaacatccctacagcatcatctaccacacacntgtatatcggtgtactgtatctgcattaca

SEQ ID NO: 38524 - DNA, 101 bp, rice(Oryza sativa)
  misc_feature (71): n=t or c
gaagccaagactgacactttctcagtagaagttaggaaaagtcggagtagtgacatttcttgcgataacgngcagggtatcaactctcttgcatcaataga

SEQ ID NO: 38525 - DNA, 101 bp, rice(Oryza sativa)
  misc_feature (71): n=a or c
gatggcccacatgtcgattggataaaaaaaagaaaaaggaaaacaaatcctaaccctaaaaccccaccggntcccacagcccacgccgccacagtcccaaa

SEQ ID NO: 38526 - DNA, 101 bp, rice(Oryza sativa)
  misc_feature (71): n=t or c
cctctatttgagatgtaagagctctctcacacatttcatcagctatgcaatctgctaagatcatatacatngttttgagatttactccggtctaacaaaaa

SEQ ID NO: 38527 - DNA, 101 bp, rice(Oryza sativa)
  misc_feature (71): n=a or c
cgtacatcttctccaaaacaatgcccttggcatgagatgatccagcaaagggtttcttccactcattgccnaagtggctcttcttgtatgccttgtcggcc

SEQ ID NO: 38528 - DNA, 101 bp, rice(Oryza sativa)
  misc_feature (71): n=t or g
tctctagacaagagtaacttacatgttactcgtatgcgaaacaatactgttgaacaagcatgctaatcaanaacttcaccagtagcaataagaaacaaaca

SEQ ID NO: 38529 - DNA, 101 bp, rice(Oryza sativa)
  misc_feature (71): n=t or c
gtttgcacatattattgatatgagctgactggagatgattatatgctgaatacaaagatgcgatgtacttntcttcatgttatttcattttgattttttac

SEQ ID NO: 38530 - DNA, 101 bp, rice(Oryza sativa)
  misc_feature (71): n=t or c
gaaaatagtgtcatagttactgatgaactttgctaactttactaaacggttggtatattgttacgccgtgnggtgagaggatgcgcacctgatgtttacta

SEQ ID NO: 38531 - DNA, 101 bp, rice(Oryza sativa)
  misc_feature (71): n=a or g
tctttgatcttcaactactcttccgttgatgttgaatgcatctgcagaagagactgtcgacacaggagacncaaggacatcccttgctagttgagctaaca

SEQ ID NO: 38532 - DNA, 101 bp, rice(Oryza sativa)
  misc_feature (71): n=t or g
aaaatacaataaaaaaccgttaacatttggttgttcttcctcttggagtgtgggatttcaaggagagagancgagaatggcaatttattgttgggtcagac

SEQ ID NO: 38533 - DNA, 101 bp, rice(Oryza sativa)
  misc_feature (71): n=a or c
gctagttttgtgtactctcgctattggtggatcgcagaagtccacaaccaacccacatttatgtatgtganctggcaatttcaaaatcagatgataaggga

SEQ ID NO: 38534 - DNA, 101 bp, rice(Oryza sativa)
  misc_feature (71): n=a or c
tgccatgggaccgcgtcgagaatggggaggttgatgaggacatgctgcggaatgggacacatatgggattnagagatgaagaggaagatgagcaagatgat

SEQ ID NO: 38535 - DNA, 101 bp, rice(Oryza sativa)
  misc_feature (71): n=a or c
cgccgtagacggtggaggcgtcggtgtcgtagaggcagtaggaccgcaggtcgtactcgtccggcaccacnttcccctgcgccgccccgctattcagagac

SEQ ID NO: 38536 - DNA, 101 bp, rice(Oryza sativa)
  misc_feature (71): n=a or g
cccacaatgaggaggaaggtgcagcatctcgccgatttgtagcgcggtgagaagagaggtgcggcgattcncccggcgctcgacgcgaagaagaaagggta

SEQ ID NO: 38537 - DNA, 101 bp, rice(Oryza sativa)
  misc_feature (71): n=t or g
tgaatatcattaaagaattcgatgataggaagaaggagttgattggtgaaattggatttgatggacttttngatatcaagcttactaaggtaaacaggcag

SEQ ID NO: 38538 - DNA, 101 bp, rice(Oryza sativa)
  misc_feature (71): n=a or c
ttggatgactttaagagtgtctacaggaagtcctacggataggatagcaaacacaacgcctatctttctcngggacattgtaatttccaaacaggtcttaa

SEQ ID NO: 38539 - DNA, 101 bp, rice(Oryza sativa)
  misc_feature (71): n=a or g
gcttggatccgggccactgaggatgtggattgatcggatcggggcagtagatcgggtagggttggttcgcntcgaaatttgtggcttgtatagtaattggt

SEQ ID NO: 38540 - DNA, 101 bp, rice(Oryza sativa)
  misc_feature (71): n=a or g
ttgtacgtcttcctctcctccgccgaccacttccccggccccatcctgcgccatcagtcagtcagtcaacngtagcatcagatcgtatccatcatttatct

SEQ ID NO: 38541 - DNA, 101 bp, rice(Oryza sativa)
  misc_feature (71): n=t or c
aagtaaagggataaagggacatctactgcttcgggattctctgcgtacttcatagtcaatctttttctgcnttttcatttctggagaatatgatgctcaga

SEQ ID NO: 38542 - DNA, 101 bp, rice(Oryza sativa)
  misc_feature (71): n=a or g
tctcagctgtagctctatgacaagagagaagtgtcttactgatatcatgttcatgttcaagaaggaggagnacataacaagaaaaccggagaatcgagaag

SEQ ID NO: 38543 - DNA, 101 bp, rice(Oryza sativa)
  misc_feature (71): n=t or c
tttgatttgtttgtttgaagtctctgcttggccactggtttgaggatggtagagtgtggtgatgttatgcntggcgcccatcttgcgtagaagttctctga

SEQ ID NO: 38544 - DNA, 101 bp, rice(Oryza sativa)
  misc_feature (71): n=t or c
gcatgaattaacgtttccttcatctgaaaaacgagttagcttctcagcctttttatgcagcagtatctatnatcatatcctggataattaattatccacac

SEQ ID NO: 38545 - DNA, 101 bp, rice(Oryza sativa)
  misc_feature (71): n=t or c
tgctcgttattctccagcatcccacattcctgcgactcgtttctagactgcgattcggtcgtcgttttgtnctgatgatcggccgggtggtcaaacgaacc

SEQ ID NO: 38546 - DNA, 101 bp, rice(Oryza sativa)
  misc_feature (71): n=a or g
agccgtccggcacggccgtgctgaggtggtggatctattcatggcggaagctcccgagctggccgcagtancatccggcgatggcgtctcgccgttgtact

SEQ ID NO: 38547 - DNA, 101 bp, rice(Oryza sativa)
  misc_feature (71): n=a or c
aattggtgcaaaccatgaatctccaagaacagaaagatgaaaggcagatttagtcgacaaataattatagnatacagtaactatgattgtgatactcgatg

SEQ ID NO: 38548 - DNA, 101 bp, rice(Oryza sativa)
  misc_feature (71): n=t or c
ttgctcgaactccttgaagggataagagtcgaagcaatagaacacatgtgcaagtacgctacaagcacctnggcaacttacaacaagaaagttcgaccgat

SEQ ID NO: 38549 - DNA, 101 bp, rice(Oryza sativa)
  misc_feature (71): n=t or c
tgaacatgatgaattgcattgcggtacaagggatcctctggaacgaacgattgttgaagtaataacgtttngaggaagggtgtgtttagtttacgttaaaa

SEQ ID NO: 38550 - DNA, 101 bp, rice(Oryza sativa)
  misc_feature (71): n=a or g
ttgcaattcacatctgcgagtagagaagtagtagacacaagatgaaacttgacaggatctgatgcggcttnttcatccaaggagcctctgaaacgcttccg

SEQ ID NO: 38551 - DNA, 101 bp, rice(Oryza sativa)
  misc_feature (71): n=a or g
tttcaaaactacgtgcaaacaaagacgctcatataaacatatgcccactcactcctttgaacatacacatntacatcttatccttatgagttcatccgaaa

SEQ ID NO: 38552 - DNA, 101 bp, rice(Oryza sativa)
  misc_feature (71): n=a or g
tgacaacattctgtgaggtgatagtgaccaggagaataatagcatattgtttttcgaaagttcagcatcanagccatactgaacttgttggaacaaaatcc

SEQ ID NO: 38553 - DNA, 101 bp, rice(Oryza sativa)
  misc_feature (71): n=a or g
tacatcttcacttgggccaggtagatccactgacatggaagacgaggtcggcactagatccggtgtccctngcctcctcgttgtcagatgcaacggcggcg

SEQ ID NO: 38554 - DNA, 101 bp, rice(Oryza sativa)
  misc_feature (71): n=a or c
ataatggcaatgcctcctagcttctttatttcttgcagcagggagttcgctgcagacctgaaggttcacanaattcaacaagctattcggaattaacaaaa

SEQ ID NO: 38555 - DNA, 101 bp, rice(Oryza sativa)
  misc_feature (71): n=a or c
cggctgggtgttttccctatcaaacccgcgtgagtacgtcgccgtccggtgcacgcacctgcatctcacantctcactcacatcacatagcgtcacaccga

SEQ ID NO: 38556 - DNA, 101 bp, rice(Oryza sativa)
  misc_feature (71): n=a or g
cccaccgaacaaatcaaaccccaaaaccaatttgcaatggtcgatcatccaccgtctccatctgtgcacgnagggattcattgtccctccggccaatttcc

SEQ ID NO: 38557 - DNA, 101 bp, rice(Oryza sativa)
  misc_feature (71): n=a or g
ttaggataacgaagctgaataaaggcttatctagattcgttgtcgtagaaagggtcacatcccatcctagnttgaattgttttgggacggagggagtaggt

SEQ ID NO: 38558 - DNA, 101 bp, rice(Oryza sativa)
  misc_feature (71): n=a or c
ccaattaccgcttcagcatagaaaattggaacttgcatcttcattataacctgccaagcagcccaccgtcnaaaaatgatagtaaatagtgttgcgcagac

SEQ ID NO: 38559 - DNA, 101 bp, rice(Oryza sativa)
  misc_feature (71): n=a or c
caaatcagtttaacagtttaaataaaccatatttatatgtttagacccctttgaagaaaaaataaggattntaaaggatttgtatcctacagaaaataatc

SEQ ID NO: 38560 - DNA, 101 bp, rice(Oryza sativa)
  misc_feature (71): n=a or g
gactgtcaatgactacaggcctatttcccttatgggaataagcctgaaaatcctaacaaaattactggctntcaggcttcaaggggtaatcctcaaactgg

SEQ ID NO: 38561 - DNA, 101 bp, rice(Oryza sativa)
  misc_feature (71): n=t or c
cgcgtcgagcttccgacgaatcgccgccgtaaccatcgtcaagctcccgatgaatggccgttgcaaccatngccggccttaccctcttcccctctcttctc

SEQ ID NO: 38562 - DNA, 101 bp, rice(Oryza sativa)
  misc_feature (71): n=t or g
actctacactagcggtcagaatacacttcgctttgaacaagccaactccacggcagcagatctcgaatagngatagctcccggaggtgaccctcatcggag

SEQ ID NO: 38563 - DNA, 101 bp, rice(Oryza sativa)
  misc_feature (71): n=t or c
ctttgcagttcatctctatttctgcacatgtgcacatcaatctaatatcagtatgttgtttactaagctanttcctccgtttcacaatgtaaatcattcta

SEQ ID NO: 38564 - DNA, 101 bp, rice(Oryza sativa)
  misc_feature (71): n=t or g
tcttgggccgttggcccaatatggcggtgctgggccatctgattatttgggccttcagcccaatatggagntgctgggccatctggatcagttgggcccaa

SEQ ID NO: 38565 - DNA, 101 bp, rice(Oryza sativa)
  misc_feature (71): n=a or g
aaaaaaaaggtgagatatttttctaaatgcccggattgccctctctttccctcgttttctgcttcgccaanaacgcgtgcggtgggttgagatcggggcga

SEQ ID NO: 38566 - DNA, 101 bp, rice(Oryza sativa)
  misc_feature (71): n=a or g
atactttgcctgcctgcataaatgtgtgccattttgattggcagaagagcagtagcttactactccctccntcccaaaataactcaattcttgagtttccg

SEQ ID NO: 38567 - DNA, 101 bp, rice(Oryza sativa)
  misc_feature (71): n=a or g
acaatcatccgcggtttgatgccaaccatgaagattggagagcctgtcccaatattgctcacatggacatnggtatttcaataatcttagcaaacacatat

SEQ ID NO: 38568 - DNA, 101 bp, rice(Oryza sativa)
  misc_feature (71): n=t or c
aacttaacccctaaactatttcttttactcattttacaaccttaactgttagaagaggtgaacttgtcacngggctaagatacatgggtttatatttgggt

SEQ ID NO: 38569 - DNA, 101 bp, rice(Oryza sativa)
  misc_feature (71): n=t or g
tgtaaaaaatcttagttcatgtgcatttttttggtataatgtcagtatggagatgtaacagacataccatnttgtaaaaatctcattatggtgaatggaga

SEQ ID NO: 38570 - DNA, 101 bp, rice(Oryza sativa)
  misc_feature (71): n=a or g
atgcaccgcccatttacggttgatgattttccaaggcttagtagtgatcattctgcgcagactgaagcgcngtatagatttccagatctttgccttcaagg

SEQ ID NO: 38571 - DNA, 101 bp, rice(Oryza sativa)
  misc_feature (71): n=a or c
gcgtttggaggcagcggtcgcctccctcactacatttccctctccctgatggctagcttgccgggtcaagntaactggaggccgaggaacacgggaccggc

SEQ ID NO: 38572 - DNA, 101 bp, rice(Oryza sativa)
  misc_feature (71): n=t or c
atgtgcttgctcttgcccgccgccaacaggagctactcctactcgacgtgtgcatccttctcctgcgcctnaacaacagtattgattgagggtgtttttga

SEQ ID NO: 38573 - DNA, 101 bp, rice(Oryza sativa)
  misc_feature (71): n=t or c
atagtagactatatgttggcaatagacgttaggatccgaattgtcatgaatactcggttatttggatgcgntttttgcccacgagttgttgtttccaaact

SEQ ID NO: 38574 - DNA, 101 bp, rice(Oryza sativa)
  misc_feature (71): n=a or c
catctttctcctgtgggtgcgggggcttgttgtcaactcgtggtgatgtggtttgcaacaaagacataaancggaagtagatcgatagttgcgtgcgttca

SEQ ID NO: 38575 - DNA, 101 bp, rice(Oryza sativa)
  misc_feature (71): n=t or c
aagagatataataagataggagtaggaagttatagggactagggaatgaattttataggcctaatttggtntaatcctattttgcgctatcaacttcgtct

SEQ ID NO: 38576 - DNA, 101 bp, rice(Oryza sativa)
  misc_feature (71): n=t or g
gtcaaaacatacgtactaccttaaccataggagtatctctcttacatgtgggggagtgaattttaaactcnagagagacatcccctcattatttacatatc

SEQ ID NO: 38577 - DNA, 101 bp, rice(Oryza sativa)
  misc_feature (71): n=a or c
ccatactacacgatctagcgatactacatgcatgccatgaaacacatatatttttagtttagttattagtnaaaaaattaattattgactctgcggaaaac

SEQ ID NO: 38578 - DNA, 101 bp, rice(Oryza sativa)
  misc_feature (71): n=t or c
ggtatgtcatagtaatggtcagtcgaggagttggttgcaaacgcagaagaataacaacgtcacacccttcntgtacggcaaagagatatataaaggaaata

SEQ ID NO: 38579 - DNA, 101 bp, rice(Oryza sativa)
  misc_feature (71): n=a or g
gacaacggtaacctcaagaacttgacattgaacagccatgagccgatgagaatctggatcgattacgaccnagaaaccacacggatcgacgtgactgttgc

SEQ ID NO: 38580 - DNA, 101 bp, rice(Oryza sativa)
  misc_feature (71): n=a or g
cggatccagctgcccgagcttgatgacgggggccatgggaatggttgcgcaagaggaagagggtgctgctnccactcaccagtggggaaagagcgctcacc

SEQ ID NO: 38581 - DNA, 101 bp, rice(Oryza sativa)
  misc_feature (71): n=a or g
catagggggtgattgcgcgtgcgctgtgaatgtcttcaaggatttgccaagttacacaaaacgacaagtanccaggttacacaaaacgacaagtaataaac

SEQ ID NO: 38582 - DNA, 101 bp, rice(Oryza sativa)
  misc_feature (71): n=a or c
aaatctcacctgcatataataaacaagccgcaagtcctacattcaaatgaaaccgtgcaacggcttccccnaaaaataagccaattctagggcatcactac

SEQ ID NO: 38583 - DNA, 101 bp, rice(Oryza sativa)
  misc_feature (71): n=a or c
gttccatcggtgagaaagtccaaatcacgtcgttatccgccgcacctctatgctagcgcttagctcagganaaggcaagaatgatctactccctccgcccc

SEQ ID NO: 38584 - DNA, 101 bp, rice(Oryza sativa)
  misc_feature (71): n=a or c
acagcaaaagaatgagagtacaatggaagagaagggattgatccctcttttctcccaaaacaaaaaaaaanccaaaaaacctctgcttgttaatttacaga

SEQ ID NO: 38585 - DNA, 101 bp, rice(Oryza sativa)
  misc_feature (71): n=t or c
ctatttgtgctgggtcgctacctggtgtaacccgcgcgcgcagcaaacagaccatatataaaaatcacttnattcgtactaaaatgtaagtatttttaaga

SEQ ID NO: 38586 - DNA, 101 bp, rice(Oryza sativa)
  misc_feature (71): n=a or c
acgttccagccgttccatcgatctcaactttacataatgttcgcagagcgacgcgccggtggacatctggntggacagcgtgtcgctgcagccgttcacgt

SEQ ID NO: 38587 - DNA, 101 bp, rice(Oryza sativa)
  misc_feature (71): n=t or c
tccagagatgcaagattttttagagctgagtattttcagctccacaaatctatggatatggatctacggtnacgctgatagcatttagataaatcattttg

SEQ ID NO: 38588 - DNA, 101 bp, rice(Oryza sativa)
  misc_feature (71): n=t or c
agaagagagagagcacaatcggagtcgagcacttgtgtcaacccaccatcggagaacatcttgccgccgcngctgccgccgccgccatgaggaggaggagg

SEQ ID NO: 38589 - DNA, 101 bp, rice(Oryza sativa)
  misc_feature (71): n=a or c
aaaccaaaagacagaacaggcatgattattgttgctggttcattcagcgattattcagttgaacaggtatntgaacaggcagggaaaatgaaaccgttatt

SEQ ID NO: 38590 - DNA, 101 bp, rice(Oryza sativa)
  misc_feature (71): n=a or g
aaggtctcgttggaacccgatgggcctccacgccgggtccgtctttgagtaggagtaccggaagttgaacnggaggtcggagcgcaccagctccggttgct

SEQ ID NO: 38591 - DNA, 101 bp, rice(Oryza sativa)
  misc_feature (71): n=a or g
cggcatggaggacgacgacgacgaggattgtgacgatgatgtcgatgctaacaacggcgacgatgatgagnatgacggggatacctccgatgacgaagacg

SEQ ID NO: 38592 - DNA, 101 bp, rice(Oryza sativa)
  misc_feature (71): n=a or c
ggcagggatgatttcggtaccatgcggtaccagtactgcaaggtactatctgatggaccagagcaaacctntatataataagttttttttaactcattatg

SEQ ID NO: 38593 - DNA, 101 bp, rice(Oryza sativa)
  misc_feature (71): n=a or g
caattaacacaagaatttaacatttcttaccgatttgccgcactggagccatcaccgtcgaggattcctcngggtgttcaaaatgagcgccgcggcgggga

SEQ ID NO: 38594 - DNA, 101 bp, rice(Oryza sativa)
  misc_feature (71): n=t or g
atccagagcagtagggttagtggtatagtgggtggttactgatgaagccataaatactgtgttttctttgntttttttaagagtgaattttacatatcaca

SEQ ID NO: 38595 - DNA, 101 bp, rice(Oryza sativa)
  misc_feature (71): n=a or c
tcgcttgaaatattcatgtttcagctattttttgcgaactgaatgtctaatttagtcatgtagggttgcanaataatatatgatggtgcaacttatgttgt

SEQ ID NO: 38596 - DNA, 101 bp, rice(Oryza sativa)
  misc_feature (71): n=a or g
agggtacattgtctccgatcagttctacttggaaactaagccaactcatgatataaaagacatacccccgnaggtgttcaggatcatcgaatcacagcacc

SEQ ID NO: 38597 - DNA, 101 bp, rice(Oryza sativa)
  misc_feature (71): n=t or c
cacccaaaagcctctcatggtgacaatggtttgcaccaggcttcttcttactctgcctaaagaaaaaaaanacaatcaagccataatcctagagcggcttc

SEQ ID NO: 38598 - DNA, 101 bp, rice(Oryza sativa)
  misc_feature (71): n=a or g
cattggctgtgcggtggtggaatcgtgggtgcatggcttcactcactagagtttaaatcgtagtgactacnaatattatacatgtataggtgaacttttaa

SEQ ID NO: 38599 - DNA, 101 bp, rice(Oryza sativa)
  misc_feature (71): n=a or g
attattttttgttgccaataacccatatggataagtataagcgaaatgttagcttatatttctacgcaggngcggaattagagtatattagggggtgccca

SEQ ID NO: 38600 - DNA, 101 bp, rice(Oryza sativa)
  misc_feature (71): n=t or c
ccgaagcccgccggagctcgctgctggtcattgtccatcgtcgtttcgtgtaccggtgagttcgtctcgtngtcctcttcgcgttgatgcctcggaaggcc

SEQ ID NO: 38601 - DNA, 101 bp, rice(Oryza sativa)
  misc_feature (71): n=t or c
atcctctaccgcattcattatgcggagaaacagaggactgctcattctattcctgcgcaatcataactaangagacatgcatatatatgcatatgacaaaa

SEQ ID NO: 38602 - DNA, 101 bp, rice(Oryza sativa)
  misc_feature (71): n=a or g
acaacaatcaaagtaaagcacaaaaactcttctcaatcacacatcatgtaatcacaaattacttgctcacntcagaaattaatcactgtgaataaatagac

SEQ ID NO: 38603 - DNA, 101 bp, rice(Oryza sativa)
  misc_feature (71): n=a or g
ataggaatagaattataccaataggaataccttctttccatttccttcctttgtcttaagggacgccaacnccaaaaccatttcaccgtatattcttcaaa

SEQ ID NO: 38604 - DNA, 101 bp, rice(Oryza sativa)
  misc_feature (71): n=t or c
tcccacaaaacaactgagcttccgatcatgctattgatcttggattagatccgttgatgaacttgtgccgntttctgaagtgtacttgtgcaaggcagata

SEQ ID NO: 38605 - DNA, 101 bp, rice(Oryza sativa)
  misc_feature (71): n=t or g
agttgcagctcgccgttggcggttggaggaagacgacgtcacccaccttttccccttttttcccctctcangctgtgtttagatcacatcacaattaaaag

SEQ ID NO: 38606 - DNA, 101 bp, rice(Oryza sativa)
  misc_feature (71): n=t or c
tttgggatagagagaatattttttttactgtaggtgttaatgagccctattatatatttgttatcggtcanatctgaatgaaaaatgaagtactagtagag

SEQ ID NO: 38607 - DNA, 101 bp, rice(Oryza sativa)
  misc_feature (71): n=t or c
gttttgagtgaaaagcacagggaaaagaactttttttttcttttataaagagaactacattcaggggttgnaaggtttgttttaagggtaattttaccatc

SEQ ID NO: 38608 - DNA, 101 bp, rice(Oryza sativa)
  misc_feature (71): n=t or c
tcgctgtgtattttctcaagtctccgtctctccgtctactgcaccttttaaacaggcagaggcgaggcganggcgccctggcctaatcccttccgagattc

SEQ ID NO: 38609 - DNA, 101 bp, rice(Oryza sativa)
  misc_feature (71): n=t or c
tcgcaagatagacgttggccctgatatgctgtaccgcaacgacgaagatagagcgggtcgatcaaatcaangccaaggaggcggctacgcacgtgtgtcga

SEQ ID NO: 38610 - DNA, 101 bp, rice(Oryza sativa)
  misc_feature (71): n=a or g
attctaacactatagattgttagtagaatcttgatggggatatatatagctaggctgttttgaagaggtanaggttactccctccgtcccaaaaaaaaaca

SEQ ID NO: 38611 - DNA, 101 bp, rice(Oryza sativa)
  misc_feature (71): n=a or g
tatttcaatcttcatcactgccggtaaagtgaacgttcgtatagaagctttgtggagattgtgatccgatntagacggccaaggtaccgatcgcttgaaat

SEQ ID NO: 38612 - DNA, 101 bp, rice(Oryza sativa)
  misc_feature (71): n=t or c
cgatttccctccccctttcttcacccaaaacctactagttcttccaaaaatccccaaatcgtcaggtctgngggaggcagcgccgacgggctgcggaggtt

SEQ ID NO: 38613 - DNA, 101 bp, rice(Oryza sativa)
  misc_feature (71): n=a or g
gtttgtaacagctaaaactcaattaataacatatgctaatggctttattacgtgcgctgacttcgtcttcntcttcatcttcatatatctcaaacaatccc

SEQ ID NO: 38614 - DNA, 101 bp, rice(Oryza sativa)
  misc_feature (71): n=t or c
gaagacaacgagctgcttggagcatccacgacagtgatgccaaaaataccacacttttccgccatcctccnctccttccatacatttagcctccttcctcc

SEQ ID NO: 38615 - DNA, 101 bp, rice(Oryza sativa)
  misc_feature (71): n=t or c
ttatatatgttcgatataatatctcggtcgttaattttgggggaaaaagctaggagagcactgatggtcgnggtctcgggcaaaatatcacgagatataca

SEQ ID NO: 38616 - DNA, 101 bp, rice(Oryza sativa)
  misc_feature (71): n=a or c
ccaaggatcgcagcgccaagaacaaggtacagtgatggcttcatttcgttggcgatttgttcttgcccacnggatgttcgacggattgctcacgagggttc

SEQ ID NO: 38617 - DNA, 101 bp, rice(Oryza sativa)
  misc_feature (71): n=t or c
cttttcgccgtcgccgtccagcttctgctcctcctgcatcctcgccagcagcacgcttagaaggtcgttgncgtgctcgccagcggcgaccccgtcgggct

SEQ ID NO: 38618 - DNA, 101 bp, rice(Oryza sativa)
  misc_feature (71): n=a or g
ggggaggagagagaaagagagagaataagggggaaaggcttttatgtcgaggcgtttgatgaaggggaggnaagggatctgggtgcgtttcgccgtttcgg

SEQ ID NO: 38619 - DNA, 101 bp, rice(Oryza sativa)
  misc_feature (71): n=t or g
attagtttgagggaaggtctgaatttccagcgatatatggttgacctttctaaacatgaaattcacacttntcatggtgtgtggagattatgatctgaata

SEQ ID NO: 38620 - DNA, 101 bp, rice(Oryza sativa)
  misc_feature (71): n=t or c
tctggacttctccaagcaaggacacacaaacacgatcgaaaatcatgagacgataagggtgtgtttagttnacaccaaaattaaaagttagtttggttgaa

SEQ ID NO: 38621 - DNA, 101 bp, rice(Oryza sativa)
  misc_feature (71): n=t or c
gaattgccaaatgcaacataaagacaggtactacagcttttttttggacagatctgtggaatgatcaattnaaatgtcagcaatatcaacatctttttgcc

SEQ ID NO: 38622 - DNA, 101 bp, rice(Oryza sativa)
  misc_feature (71): n=a or g
atgtgtgttcgtgcctttacgagagcatatatacgagagtagggggaatgatcggttgattagtgaaactnaccatgagaaattgtggttgaggtggttta

SEQ ID NO: 38623 - DNA, 101 bp, rice(Oryza sativa)
  misc_feature (71): n=t or c
ttatataggattacgtgacgtaatatatgtgatttatgtatcgttaattcagctagggatgaaaacggatngaatacggtcggaaactagctctatcatat

SEQ ID NO: 38624 - DNA, 101 bp, rice(Oryza sativa)
  misc_feature (71): n=a or g
cattgatttcaaggggacaaactttgagtacacaccattcggggcaggacgaagaatgtgccctggcatcncatttggtctggcaaatgtagagcttatgc

SEQ ID NO: 38625 - DNA, 101 bp, rice(Oryza sativa)
  misc_feature (71): n=a or g
atgtacgataaataaatacgtcgatcgtttgtagatattcgagggaattatcgagtcggaatgatataacngtttgaaataaccggagggtaaaaattgag

SEQ ID NO: 38626 - DNA, 101 bp, rice(Oryza sativa)
  misc_feature (71): n=t or g
cttaaaaaaagaagtgctgcagaatttcgcaatgcaatctcgaagttgagtaagcagcatcctaattcctnaagtatgtctccacaactacaaaactttgc

SEQ ID NO: 38627 - DNA, 101 bp, rice(Oryza sativa)
  misc_feature (71): n=t or c
tgctacagagaagatgtattacagccagtaactaaaagaaagctcatcacctctgtatccatacagattanaggcatatttatgcatatataatagatgac

SEQ ID NO: 38628 - DNA, 101 bp, rice(Oryza sativa)
  misc_feature (71): n=t or c
aggaactggacattgctatttttacttacaaattaattaaagcgaagccctgtgtatatatatactacctncgtttcagattataaaacattctgacttta

SEQ ID NO: 38629 - DNA, 101 bp, rice(Oryza sativa)
  misc_feature (71): n=t or c
cgacatctccatcggcgggcgacggcgcaagcgaccaactactggttaaataatgcaagttataacatagnagatgtgcgtggaaggccctacacattctg

SEQ ID NO: 38630 - DNA, 101 bp, rice(Oryza sativa)
  misc_feature (71): n=a or g
agcaccatcaaccttgacataaagccactaacgtctcttctgtagtactccctatgcattttattttaatntatgacgtcgttgatttttcaaccaacgct

SEQ ID NO: 38631 - DNA, 101 bp, rice(Oryza sativa)
  misc_feature (71): n=t or c
actggggcccacctgcacgtcgctgtcctcgtgtggggggaggtctcatacatataatatataatgtactnaagcatttggcaaaatattaaacgtagtct

SEQ ID NO: 38632 - DNA, 101 bp, rice(Oryza sativa)
  misc_feature (71): n=a or g
gttcacgtagcccacattgggcactcgttcttcgttagaaaagctgtcgtgcgacgcagggaagaacggcncggccgctctgtgggggtcatggcctcgcg

SEQ ID NO: 38633 - DNA, 101 bp, rice(Oryza sativa)
  misc_feature (71): n=t or c
cactcccaacagtagatgtttacaataatacagtggaacaaagaaaagtaaagaacttactgccaactctncccacaagcttttaggtttctgttctgaat

SEQ ID NO: 38634 - DNA, 101 bp, rice(Oryza sativa)
  misc_feature (71): n=a or c
acaatctcacattcgctccttctcaataggtcgtcgtccccagtacacatatatgagcaaaagatttgaantatgtccttactatttaacttggtgactga

SEQ ID NO: 38635 - DNA, 101 bp, rice(Oryza sativa)
  misc_feature (71): n=a or g
taattagttaattgagattaccagcttaattaatgctatctccacatactccactaaagatgataccctcnagaaaactatttctttgcaagagggcaacc

SEQ ID NO: 38636 - DNA, 101 bp, rice(Oryza sativa)
  misc_feature (71): n=t or c
cagtcaaaatcagtatattttacaatgaaataaaaaaagaataatggaagcgagaagttaaaatacctgcnttcctcaagagcttgtgcctgaaagctgta

SEQ ID NO: 38637 - DNA, 101 bp, rice(Oryza sativa)
  misc_feature (71): n=t or c
atcatatcctctagtcgatgtttccacgatcctctctctcccttatcatgaaaacctataagtggtcaganggacattgtgaccactcgaccaattgttat

SEQ ID NO: 38638 - DNA, 101 bp, rice(Oryza sativa)
  misc_feature (71): n=t or c
ataatctcgccgaattgcagaacgatggtgggatagttgttgatcgaatctccaatgatctgataccactngttataaaaatagatgcacaacggagacac

SEQ ID NO: 38639 - DNA, 101 bp, rice(Oryza sativa)
  misc_feature (71): n=a or g
aaagccgaaagctaaagccccttgctgttgctattctggactggaggcttcgtcaacaagagacaagacanagagaagagaagtgtggaagaaatttgatg

SEQ ID NO: 38640 - DNA, 101 bp, rice(Oryza sativa)
  misc_feature (71): n=a or g
gtggggcagagaactactgctcttggcctccttggtttcattgacattcccaacattgcttcatcacgacncagtagctacacaaataaaagagctgtcat

SEQ ID NO: 38641 - DNA, 101 bp, rice(Oryza sativa)
  misc_feature (71): n=a or g
ttgagtatgcacgacgtgtaggtatatagttttagattaggttgtttaagcatacattaacgtttcgaggnaaaaatcgattatagtgcattgcgagtggg

SEQ ID NO: 38642 - DNA, 101 bp, rice(Oryza sativa)
  misc_feature (71): n=t or c
gcagcaaaagattacctcgacattgcatgattgcagttcgtgccatgaatgtgggtggccttgctgttttngcaggttcagtacctgtcgttcgacaacca

SEQ ID NO: 38643 - DNA, 101 bp, rice(Oryza sativa)
  misc_feature (71): n=t or c
acccaaatttgacatgtggcacaatttggaaaaaactcagatttgccacgcgaggccggtctaattgctancattgggacaattagactgacggcaagggg

SEQ ID NO: 38644 - DNA, 101 bp, rice(Oryza sativa)
  misc_feature (71): n=t or c
ccttcggcgcccatcgccggagatggcgaagcgccaccggcttcggcatccgcgccactgttaccgtcttnggctcctgccgcttccttggggcaggtgcc

SEQ ID NO: 38645 - DNA, 101 bp, rice(Oryza sativa)
  misc_feature (71): n=t or c
taattttgcggcctggcccctggggttttgcggttttagtactgcagtgcgggatttggtagcagtatggntgcctctagtgaaataatcgaaaccatttt

SEQ ID NO: 38646 - DNA, 101 bp, rice(Oryza sativa)
  misc_feature (71): n=t or g
gctggtggcgcgacgactcatcttggcgtggtccagatccacggcgctcggtgcatgcactggagctcccntgggcatggcggcgttcccgtcgttgcagt

SEQ ID NO: 38647 - DNA, 101 bp, rice(Oryza sativa)
  misc_feature (71): n=a or c
ctaggctcgttgccggaggtttatttcctcgccgacgatggccagatccgttccaagaccaggttgtactncttcctcttccttggcatcgccgtcgtctg

SEQ ID NO: 38648 - DNA, 101 bp, rice(Oryza sativa)
  misc_feature (71): n=t or c
catggttcgcgcaaggttgcttctggcctagcaaacaacgcctggatttctgacatccgcggcgccctcantgtcccggtcatctcccaatttcttcttgt

SEQ ID NO: 38649 - DNA, 101 bp, rice(Oryza sativa)
  misc_feature (71): n=a or g
atggacacatggcacaaggcggtgaaagatgctctttggatacttcatcttgctacttgtcctaaggagancaaagatgctcctaggatcaagaagaagat

SEQ ID NO: 38650 - DNA, 101 bp, rice(Oryza sativa)
  misc_feature (71): n=t or c
agatatgaatgtaacagtagccggaccatttatgcaacacgcccctgcaaaaagaaaagcctcactcgaangctagctcaagataagcaggcaccttgaac

SEQ ID NO: 38651 - DNA, 101 bp, rice(Oryza sativa)
  misc_feature (71): n=a or c
gacgatatatcataggcatcattccgtcctaactgggtatcacccgatatctattaaggaatatcaaatantccctccatcccaaaatataagggcccctt

SEQ ID NO: 38652 - DNA, 101 bp, rice(Oryza sativa)
  misc_feature (71): n=t or g
aagttactaaccaaggccacgaataccatggctaaccttgaaagctgcatgcttttcactggaaccgactntggaatggagaagaccgccaggcctctcct

SEQ ID NO: 38653 - DNA, 101 bp, rice(Oryza sativa)
  misc_feature (71): n=t or c
ggcaccgccgcttgtgtcaggggtagttgggcaccttgaatgcgccatcaatgccgttggtgtcacgcgcnctggatgccatcatgttgttggaggcctag

SEQ ID NO: 38654 - DNA, 101 bp, rice(Oryza sativa)
  misc_feature (71): n=t or c
tcctttttagttgttcattttgtgccagatctactattttttcagtttgctacagaggaatgttcaatgtnagagcaaagtttgggtgctgttttgttact

SEQ ID NO: 38655 - DNA, 101 bp, rice(Oryza sativa)
  misc_feature (71): n=a or g
cgcggcatcgtccacaacgtccatctcctcgtcacggtggatggaggacgtgatggccgtgacagaagcangaagggtgccgcctaggtcgtcacgcgcgc

SEQ ID NO: 38656 - DNA, 101 bp, rice(Oryza sativa)
  misc_feature (71): n=t or c
aaggcattgcaatgtggtcacagaaaggggtttgtaactagtacccccaggcaagaaccagctcatgcatngcaacactacaatggaaatacatgggattg

SEQ ID NO: 38657 - DNA, 101 bp, rice(Oryza sativa)
  misc_feature (71): n=t or c
cttgttcggtagtccttacagttatagaactcctattagatatcttgtctgtgtccattcaacagtactanatagtgactattttatgttctcttttgaat

SEQ ID NO: 38658 - DNA, 101 bp, rice(Oryza sativa)
  misc_feature (71): n=t or c
caccaccagctagtcagactagcccataggcttcggtctgactatcaccaagaagaaaactcagtcctttncaaattcgaatgatttcctatttcgtgctt

SEQ ID NO: 38659 - DNA, 101 bp, rice(Oryza sativa)
  misc_feature (71): n=a or g
acccctacgaacaccactaaaaaactgaatcggcatatttaaagttgacggagtcactacagtacatctcnctatcaacagatatgattgcttataaaaaa

SEQ ID NO: 38660 - DNA, 101 bp, rice(Oryza sativa)
  misc_feature (71): n=a or c
tcaagatggttgatttgagtatctcctgagatccatcttgggtagatgttactcttactcttatcttcttntgtaccagatttctatatttggtttcggta

SEQ ID NO: 38661 - DNA, 101 bp, rice(Oryza sativa)
  misc_feature (71): n=a or g
cccccccatactaatcaaatggtgggatgacaacttgcagcctgcgggcatcgtcataaaccgacagaagnaagacgaagaagtgcgccagctgaagaaag

SEQ ID NO: 38662 - DNA, 101 bp, rice(Oryza sativa)
  misc_feature (71): n=a or g
gtatgtagtgggcctgaactttatagaaagataggactagttggcaccctgcgtctttgccgtgggttatntagttttatcgtcaaacaaaattatagttt

SEQ ID NO: 38663 - DNA, 101 bp, rice(Oryza sativa)
  misc_feature (71): n=a or c
tccgcataattgtgccaggcagccaagggcataaaaattgcctattgcctattgggctttgaactcactcncatagacccacatctagctctctatgctcc

SEQ ID NO: 38664 - DNA, 101 bp, rice(Oryza sativa)
  misc_feature (71): n=a or c
ggctataatctaaatatgacctagtctccggccggatgagtatatgctgattgatctaaaacttatcgtangttctggtagtcagctggccagccggagca

SEQ ID NO: 38665 - DNA, 101 bp, rice(Oryza sativa)
  misc_feature (71): n=a or g
aagctttgacaaggacggccaaattaatgatctgattccgagcaaaaaaattcttgatcaaattggtgcangaggggatatttcatgaaattaatttgatc

SEQ ID NO: 38666 - DNA, 101 bp, rice(Oryza sativa)
  misc_feature (71): n=a or g
catactcccgggtccacactgttgttgttattctgcctatcagatttgtttgcttctttgcaaaaagccanggttgtaattttcttgccaataagcagtca

SEQ ID NO: 38667 - DNA, 101 bp, rice(Oryza sativa)
  misc_feature (71): n=t or c
acatgctcatatgatgatatgaatactgcttcatatcatcatatggccccatgggtagggtttttctgcanactttgtcctcactcatgcgcacccgaaaa

SEQ ID NO: 38668 - DNA, 101 bp, rice(Oryza sativa)
  misc_feature (71): n=a or g
aggagggaagatgggcgccggtcctcctgcaaccaaacaatagtgagtaagatggccggacgtgtcgcacnatgtgactcgtccatagatggtggcagttg

SEQ ID NO: 38669 - DNA, 101 bp, rice(Oryza sativa)
  misc_feature (71): n=a or c
ccttaactaattcctaccatgctcagataatgtacatcatgcatgcatgcaaccatatactcttctgatcntaagtcgttctgatttttttctaaattaat

SEQ ID NO: 38670 - DNA, 101 bp, rice(Oryza sativa)
  misc_feature (71): n=t or c
tcggtgattaccgatatttcaggaatttcgatacccagattacttcggcacttctctatctctatctctanctctactattataaaaattaaagatgtttt

SEQ ID NO: 38671 - DNA, 101 bp, rice(Oryza sativa)
  misc_feature (71): n=t or c
tttcataaatttttttaatatattccgtacaccttggtgcagatcatcgccattatgaaagcgaagccggnttgccatttataaatgtatgatgaaatgac

SEQ ID NO: 38672 - DNA, 101 bp, rice(Oryza sativa)
  misc_feature (71): n=a or g
accaatcccagcctccgtttgtagcctcaagaatctgacctacatagacctctcttgcaacaatctcaccngtgatttccccacggtgctctacggttgct

SEQ ID NO: 38673 - DNA, 101 bp, rice(Oryza sativa)
  misc_feature (71): n=a or g
gcccttctgtcagaattcatgtaatcttggtacttcgtgtttatttgtattgtcagtgatttgccttgctnctttgctgttggaaaattgtcgtgtatttt

SEQ ID NO: 38674 - DNA, 101 bp, rice(Oryza sativa)
  misc_feature (71): n=a or g
gagctagaagtaactacaacctggttttggagatcccaccttactatctacttgggaaatatacattgagnaccctaaggccattcacaatgcatacagtt

SEQ ID NO: 38675 - DNA, 101 bp, rice(Oryza sativa)
  misc_feature (71): n=a or g
ggtatcaccttagtggctctgcagtaatcgacatcagaccagcaatcttcatctatggccttgccctcagnccagttaggattcaccatcgcagcagagac

SEQ ID NO: 38676 - DNA, 101 bp, rice(Oryza sativa)
  misc_feature (71): n=a or c
tacctgaagtctcagagtgtttttgttactcatgacaaccagtcagtggcagactacttctacagcggtgntctctgggtcagcttcgacagtgccgtggt

SEQ ID NO: 38677 - DNA, 101 bp, rice(Oryza sativa)
  misc_feature (71): n=t or c
gcatatccccttacctccctcaccccatttgcatgcttgactcctcccaagtcatcgacgcctccatcgtngttttcttcagcaggtgctacgggtgccac

SEQ ID NO: 38678 - DNA, 101 bp, rice(Oryza sativa)
  misc_feature (71): n=t or c
ctgcgtggagtgttgtcttgtaaattcatgctgtcatgtaggagtaggtcttcatggaggcctaaaaactnagccaaaaatggcccacatattgaatgtta

SEQ ID NO: 38679 - DNA, 101 bp, rice(Oryza sativa)
  misc_feature (71): n=a or g
acagactgctttgtaacctcacagttaattttgccggtaaggctttgtttagttcatcgcaaaaaagtttngattttgattgaaattaaagatgatgtgac

SEQ ID NO: 38680 - DNA, 101 bp, rice(Oryza sativa)
  misc_feature (71): n=t or c
cagtgaaggtgatcaggagcactaatcaactaagacaggaccatcaccttagagagcacatctgactaaantgcccttccaaccccacctgatgctgccgc

SEQ ID NO: 38681 - DNA, 101 bp, rice(Oryza sativa)
  misc_feature (71): n=t or c
gagatcgagctcgctaggttgctatgtgagggaggcgagacagcagatgatacaaattgatggggatagangcgccatggcctccttggctatggcggcct

SEQ ID NO: 38682 - DNA, 101 bp, rice(Oryza sativa)
  misc_feature (71): n=t or c
cggtcgacggcagcatggcgaagtagagatcgaacaggatgtccaggatgtgcaacctacgcatggtatgngtgacccggcggccattgttgtccgtcacg

SEQ ID NO: 38683 - DNA, 101 bp, rice(Oryza sativa)
  misc_feature (71): n=t or c
ggcgttgccatgccagacatcgagccagaaggatgatcttctcccgtttctaattattactctggtgattngcctgtactcggggagcttgtctgcgatag

SEQ ID NO: 38684 - DNA, 101 bp, rice(Oryza sativa)
  misc_feature (71): n=t or g
ctgactgatcgactgactgactaggagaaattatggagcttaattaaggaaactgaagcagctagaagatnccgagctccagttggtatatcgattataaa

SEQ ID NO: 38685 - DNA, 101 bp, rice(Oryza sativa)
  misc_feature (71): n=t or c
tatgtttttcatactatgtaaaactcgccaacaatattcacatgtagtagtagtttgaagttgaagctagnactactacggaattaattttttctgaacta

SEQ ID NO: 38686 - DNA, 101 bp, rice(Oryza sativa)
  misc_feature (71): n=a or g
tattattttgcttagaagggagagaaagaaaaacagtaggcacttactatagtaagggacgggggtgaacnatgttgaggaattgaccgaggaaaccatca

SEQ ID NO: 38687 - DNA, 101 bp, rice(Oryza sativa)
  misc_feature (71): n=t or c
gtatacaaattagtatttttttggcggacacaaagttgaaaaaagaacgggtgacggttgccatccggaancccctcgagagtcacgttcccttgtcgtgc

SEQ ID NO: 38688 - DNA, 101 bp, rice(Oryza sativa)
  misc_feature (71): n=a or c
gtgatgctctcgccatgatctgttgctgtagtttagctgatgcttagaggagaaagtactacgagtagctntacgtataaagatacattacttttgtgcat

SEQ ID NO: 38689 - DNA, 101 bp, rice(Oryza sativa)
  misc_feature (71): n=t or c
caatggagagaccaagtcatcagaggtgcccatcactgccacctacatcccccgtgatgtggaatacctgngcgaagccatggcgttggagtgggtcgccg

SEQ ID NO: 38690 - DNA, 101 bp, rice(Oryza sativa)
  misc_feature (71): n=a or g
tgacttatatatacagctcgctagtgatcacacatgcagacacactactccctccaatttccttttttatntagtactagttgactagatcaaaatagaat

SEQ ID NO: 38691 - DNA, 101 bp, rice(Oryza sativa)
  misc_feature (71): n=t or c
gcatggagaagaagaagaagaagatgtggcgaaatattgcagcttcacctgtttctctccaacttttatantacctcggctgcttcttttttctctgcact

SEQ ID NO: 38692 - DNA, 101 bp, rice(Oryza sativa)
  misc_feature (71): n=t or g
tacgtacttcacatccaccggtattatacgtacgtaccatatgcatgctccattctacgtatatacgtgcngtataatataccctccgtattttaatgtat

SEQ ID NO: 38693 - DNA, 101 bp, rice(Oryza sativa)
  misc_feature (71): n=t or c
ttgtagcaaccatacctgtagcaggcggttttgctgccgctatcattattgggcttagaattgcctttccnctttttgctgttcccacgttgctttttggc

SEQ ID NO: 38694 - DNA, 101 bp, rice(Oryza sativa)
  misc_feature (71): n=a or g
tcagtttctcaatgcctagactttattcatttgctgccaacaaaatatcatttgtgcatggctatctgtcngctcaaatgtcagacaattttcagctgcct

SEQ ID NO: 38695 - DNA, 101 bp, rice(Oryza sativa)
  misc_feature (71): n=a or g
tgcaatcatatacacttgtttgccaattatttccatctcattaaccttcgtgtctaactgttccatcaccnccattagtcgctcctccatgaaatttatca

SEQ ID NO: 38696 - DNA, 101 bp, rice(Oryza sativa)
  misc_feature (71): n=a or g
aatatttttgcataccttggtgagttaagatttcaacagacttgtgctcatgcctctcttgctccactttntttaattgcccaagagagcaggcaaattat

SEQ ID NO: 38697 - DNA, 101 bp, rice(Oryza sativa)
  misc_feature (71): n=a or g
gtattgctttagctcgtcgaatgttgcttggcattctggtgtccaactgaactttcctgtgccccgtaggntcttgaagaatggcagacctctttcggccg

SEQ ID NO: 38698 - DNA, 101 bp, rice(Oryza sativa)
  misc_feature (71): n=a or g
gctcttatatcagggacggagggagtatagaataggaatccattgatgaactagacttcgcatatggtacnaagtactccctccgtcctagaatatagcaa

SEQ ID NO: 38699 - DNA, 101 bp, rice(Oryza sativa)
  misc_feature (71): n=t or c
atagtcttccatggcgacggttgagttgatggtgcccagcgagaccggactactgtgaggtgtgacatcantgccgccgcctcggatgcaaacgacaactg

SEQ ID NO: 38700 - DNA, 101 bp, rice(Oryza sativa)
  misc_feature (71): n=a or g
ttttgggaattttcaatttgctcaaatttcatctaaaccatacagcggtaaaccattaccgtgccccggtnataagcgcggtaaccgcacgcgataaggta

SEQ ID NO: 38701 - DNA, 101 bp, rice(Oryza sativa)
  misc_feature (71): n=a or g
ctttgtgttcgcatctccctcacggatatgtgttactctggaggcttgctttttccttgcccgctcaatgnaagcgaggccaaggatcttacgcttgaggg

SEQ ID NO: 38702 - DNA, 101 bp, rice(Oryza sativa)
  misc_feature (71): n=t or g
attgacatgtgtagggctcctccatatttattagttgtttgttggcttggctcatcttagcttgagaggtnttttttttggggtgttcataacttgaaagt

SEQ ID NO: 38703 - DNA, 101 bp, rice(Oryza sativa)
  misc_feature (71): n=t or c
gatgttcgacagagttaagagttgttcagttttgcatccacacagcgtgagcatgagtgcgttttaccganggttatgtttcttttggtggaacctatcca

SEQ ID NO: 38704 - DNA, 101 bp, rice(Oryza sativa)
  misc_feature (71): n=t or c
catactatgatccaaaaacccgctccatgcgtgaagatccattgccagatgcagaccccaatgataaattntatgtggtaagtatgagacaccctacaagt

SEQ ID NO: 38705 - DNA, 101 bp, rice(Oryza sativa)
  misc_feature (71): n=t or g
cgattctctcctcaatggcgactatcgaatcgtcgcctacctcgcttctctcctcaatggtgaggatgganaactcgcttcgcctggaggaatcggagaag

SEQ ID NO: 38706 - DNA, 101 bp, rice(Oryza sativa)
  misc_feature (71): n=t or g
caattcgtgtctcgcccaaaggaggcaagcctgtcaggcacttcagcaaaatggcacgctgcctagcttcnccgtgtctgcatccttgcatatgcatgctg

SEQ ID NO: 38707 - DNA, 101 bp, rice(Oryza sativa)
  misc_feature (71): n=a or g
gtccttgacctgccggatcttctcctcgatgaaggtgaggttgtccagcatcgtgtccgggctccagtccntgtgctggatgctaaccgacggcagcagct

SEQ ID NO: 38708 - DNA, 101 bp, rice(Oryza sativa)
  misc_feature (71): n=a or c
ttgcaggcgagagcagttatagcccgtctgcaacttaaagagcatatcgtcctgaaaaatcatttcatatngtagtgcataaactctaacatgtgcctttg

SEQ ID NO: 38709 - DNA, 101 bp, rice(Oryza sativa)
  misc_feature (71): n=a or g
ttatattttccctgcaaaaaatatctcgtttaagatataactatcagatgatccgtcaccaatataagtcntctttatcggatcatagttctaacatatta

SEQ ID NO: 38710 - DNA, 101 bp, rice(Oryza sativa)
  misc_feature (71): n=a or g
aaaaacatgacaagatagattatactcggtatcatatacatattatgaccagggttggaaattccggaacnaaatttctaaaatttcggtcatttcagacc

SEQ ID NO: 38711 - DNA, 101 bp, rice(Oryza sativa)
  misc_feature (71): n=t or c
tttccctgagaaaaatatgttgactgaccagtgaccactacagtattaaggatgagttaatcattctcccncaaaaaggttgaattaattatggccaattt

SEQ ID NO: 38712 - DNA, 101 bp, rice(Oryza sativa)
  misc_feature (71): n=a or g
ctccatatataaccctctccttcctcaatccacgcacgttagcaatagggttctttcattttccccaaaanaaatccaaccctattaagttttttttttat

SEQ ID NO: 38713 - DNA, 101 bp, rice(Oryza sativa)
  misc_feature (71): n=a or c
tcggcttatagagaaactttttatgatgatgatagtaatagcttgatattgttggccacacacacagacanatacgtgtctcacatccgtggtccactgag

SEQ ID NO: 38714 - DNA, 101 bp, rice(Oryza sativa)
  misc_feature (71): n=a or c
cagctagcttgcagttaattaagggctctctggaactatagctagtacaagtactgaattatgttacttcntttgtcctaaaatataagagattttaggtg

SEQ ID NO: 38715 - DNA, 101 bp, rice(Oryza sativa)
  misc_feature (71): n=t or c
gtctttatattattattatactattacatatatggatcaggccaatagtattaagcaatacttctacgganatataatccatgtttaatttaccagtcttt

SEQ ID NO: 38716 - DNA, 101 bp, rice(Oryza sativa)
  misc_feature (71): n=a or g
tacagattggacgataagatgccatgcataacacccattttatgagcatcttcgattaaacagtcttgagnactccaaccagattaccaggctaatctaac

SEQ ID NO: 38717 - DNA, 101 bp, rice(Oryza sativa)
  misc_feature (71): n=t or c
actggtttttggagcttagggcattgaacaattctaggcaaccctgactacaaacctagggcaggatgtangatcgcctggtagtatctttatatgctttg

SEQ ID NO: 38718 - DNA, 101 bp, rice(Oryza sativa)
  misc_feature (71): n=a or g
tgtgcctgagaggttgtttcttgatgccttgaaataggtagtacctctgagttgagtagaaatatttggtngtatggacgagaaatgattgtttgagtaat

SEQ ID NO: 38719 - DNA, 101 bp, rice(Oryza sativa)
  misc_feature (71): n=a or g
ttactttcttaaggaaaaagagcagtgcctaggaatgcaaagcatcctgaaatatctctcttctcttttcntctctgaaaccagagaatggaaacaaagca

SEQ ID NO: 38720 - DNA, 101 bp, rice(Oryza sativa)
  misc_feature (71): n=t or g
gctcagattggtatagctctcgccgtggctccaaatatggcaaaagtgcaaggagcactactccctgaccntgatgggcaagctgcagggcccgtcccgtt

SEQ ID NO: 38721 - DNA, 101 bp, rice(Oryza sativa)
  misc_feature (71): n=t or c
aaaaagggatatttggatacacgtgaaaagcgtaagaagacgagattaattaacgtacggcgcgcagtctnaagtctcgacccgttgtgctggtttccatc

SEQ ID NO: 38722 - DNA, 101 bp, rice(Oryza sativa)
  misc_feature (71): n=a or g
aaccccaaaatgataaccatgtcttagccagtttgagaagaaccgtttgcaaagaacaatttaacaccatnaataatttcaccagcaatataataatttta

SEQ ID NO: 38723 - DNA, 101 bp, rice(Oryza sativa)
  misc_feature (71): n=a or g
cctttctctcatgtggaactgatgcgtgtcaaaacttgtttgtacatgtgcagataaaagaagcagagtcncaatctttggcaaacattaataagattaag

SEQ ID NO: 38724 - DNA, 101 bp, rice(Oryza sativa)
  misc_feature (71): n=a or g
ggggcaaggccgggaggcagatccggtcagtcaactagacaaacccagggcaatggcggcctcacatctanaagatgagtcgagatagaaaggtggcaggt

SEQ ID NO: 38725 - DNA, 101 bp, rice(Oryza sativa)
  misc_feature (71): n=t or c
caggcagagtgaatctgagaagttggcaatcaaccttcatcccaggcattggcacccaatcaacagcagtncctgtagccttggagaggaactctgtcagg

SEQ ID NO: 38726 - DNA, 101 bp, rice(Oryza sativa)
  misc_feature (71): n=t or g
gaagaagattgttttttttttttttactggaagaggatatggcgtggatagtcgaactggtgaaattggangaactacggattattgagctgtactccatc

SEQ ID NO: 38727 - DNA, 101 bp, rice(Oryza sativa)
  misc_feature (71): n=t or c
tatcacatgcaccgcctctattcgtctcatcattcctagaggggtcccttttcctcgggttccgctcccgnccatgccttaaaccggaagcattgtggctg

SEQ ID NO: 38728 - DNA, 101 bp, rice(Oryza sativa)
  misc_feature (71): n=t or g
ttccgtttacaaataatgttctgcttctttccaattgatgttcttctattcctttttaattttctgccttntttaacgtcatctgcttagtgacgattttg

SEQ ID NO: 38729 - DNA, 101 bp, rice(Oryza sativa)
  misc_feature (71): n=t or c
atttttagggtgcggggcttttgtgggcttagtggtcaaacaataacgggctaaatggcccggcaagaganaggctcgacatctaagcggcccagaacaag

SEQ ID NO: 38730 - DNA, 101 bp, rice(Oryza sativa)
  misc_feature (71): n=t or c
attgcaatcagggatgcttttgtgtcaacaaaaaggcatttaggtaaggaatgcgtgctgctttaatgcancacacaaattatcaagaaatagatatttca

SEQ ID NO: 38731 - DNA, 101 bp, rice(Oryza sativa)
  misc_feature (71): n=a or g
actccaaaagttattatattataagacggatgcagtaatatataggtatcggttgataccccgttcagatnagatgatacctctatacctaggtattaggt

SEQ ID NO: 38732 - DNA, 101 bp, rice(Oryza sativa)
  misc_feature (71): n=t or c
tgtagcggtttttgccaaacccgacccttcggagcttcactgccttaaatcttttactaaaattctccgcngaagtatcaggtttgcacacaaacatcagt

SEQ ID NO: 38733 - DNA, 101 bp, rice(Oryza sativa)
  misc_feature (71): n=t or c
gtgccgagcggcccatttggccttctatgtccaccccttaccgagacattattgaaaatagactgctaacnatatactactcgctctatctaatactatat

SEQ ID NO: 38734 - DNA, 101 bp, rice(Oryza sativa)
  misc_feature (71): n=a or g
accaccgctagaccaataaaggagctataactgggattgcccacaacccaatccttacaaccgacataaantcctactctatctacatctgagggatttag

SEQ ID NO: 38735 - DNA, 101 bp, rice(Oryza sativa)
  misc_feature (71): n=a or g
gaaattaagtgagagttattggttgaattggagaggtaggcgatgaaatgcataggaataagttcactccntgaccttcaaatgtgatcgaaatctaaacc

SEQ ID NO: 38736 - DNA, 101 bp, rice(Oryza sativa)
  misc_feature (71): n=a or c
ttaaggaacgacaacacccccactcattcatcgccggtttggtgagggcgtcagtttcttttttttttaangaaaaaataaattaaggctcaaatttgact

SEQ ID NO: 38737 - DNA, 101 bp, rice(Oryza sativa)
  misc_feature (71): n=a or c
cacctccccgcaaaacgaggcaagtgaaaccatctatcgaccctcttttaacttctaccctggatgtatgngtgctgtacaattctgaatttatctgcatg

SEQ ID NO: 38738 - DNA, 101 bp, rice(Oryza sativa)
  misc_feature (71): n=a or g
caccttcctggacgtcctgacaaaaccatcgatgaaagaagcaaacgacgaaaatagcacagtcgcacccnacatcagctcgagggcaacagaggcagaat

SEQ ID NO: 38739 - DNA, 101 bp, rice(Oryza sativa)
  misc_feature (71): n=a or c
actgcttcactgtcaggctggcgtcagcgaccaagctttgatgctccaagatggaagaagaaaactactanctccgtcccataatataagagattttagtt

SEQ ID NO: 38740 - DNA, 101 bp, rice(Oryza sativa)
  misc_feature (71): n=t or g
aacaggttagattagatgcatagacgaacgtcatgctgtggcatctccgccgaagagcgttatcaatccanatcgatactctgcatgttaaccacttttca

SEQ ID NO: 38741 - DNA, 101 bp, rice(Oryza sativa)
  misc_feature (71): n=a or g
tgacgggtgggtcccacaccgtttttcaccctaggttgccacattgccatgccatgtaggcaaaagtgacnaatagttaagagaccacatcttaaagaagg

SEQ ID NO: 38742 - DNA, 101 bp, rice(Oryza sativa)
  misc_feature (71): n=a or g
gatccaatcttttcaatgagcggtaagaagtccactttcctgagttttcgaaaatgcaaacgtaaaccaanatagcggcaaggaaagttttttgaagttcc

SEQ ID NO: 38743 - DNA, 101 bp, rice(Oryza sativa)
  misc_feature (71): n=t or c
aattgcttttggatgcatgcatgtatgatctgatccgtgtttgcagccgagccaaacctacttatcacctntttcccaatattcaagaggatgataattgc

SEQ ID NO: 38744 - DNA, 101 bp, rice(Oryza sativa)
  misc_feature (71): n=t or g
ttttagccgtgtgagtgcgtgacggctcagttcctcttttgatacaccaggaccagattcttatcttaggntgtgtttgagagagagaggattgggaagat

SEQ ID NO: 38745 - DNA, 101 bp, rice(Oryza sativa)
  misc_feature (71): n=t or c
tcttggttttgcaagttcgtaagaaagcatgcactgaccgatcgaccgacagacctcactcgatataactntgcaaagttgcatgcttgtagaccaagaaa

SEQ ID NO: 38746 - DNA, 101 bp, rice(Oryza sativa)
  misc_feature (71): n=t or g
gtataatcttatccctgagagtagatctggcaacatgggcaagctaatttataaccaggtaatatatacangaagtatgttgttcataaataatttaaaga

SEQ ID NO: 38747 - DNA, 101 bp, rice(Oryza sativa)
  misc_feature (71): n=t or c
gcatgtgggattcttccatctgggcttctaccgctgatcatttcttctgttgggaaggaatagtagtcacnggcacatgtgcatctcagtgttcagtgcag

SEQ ID NO: 38748 - DNA, 101 bp, rice(Oryza sativa)
  misc_feature (71): n=a or c
gaaaattcactctgatggtcatcctgtctgagacggtcttgtcattattagtcagagactctgaaagtganagtgacagtgttttcttctcattgcaaact

SEQ ID NO: 38749 - DNA, 101 bp, rice(Oryza sativa)
  misc_feature (71): n=a or g
gagcacccatgttgcaccatttgtgcatctttacaacactgctatttccttcaacagattctgaaaccgcnccatatcgctgcacaaaatgcagttcttta

SEQ ID NO: 38750 - DNA, 101 bp, rice(Oryza sativa)
  misc_feature (71): n=a or c
tccatctaaaaaaatcaacctatgtgacctgattctcacggatcaattgcatatggatggtttttctactnaactgagccagtgagatacaagcatataaa

SEQ ID NO: 38751 - DNA, 101 bp, rice(Oryza sativa)
  misc_feature (71): n=t or c
agggaggcgggctcggcatgagggcggagaccggatttgcttcaaggtggagcgcttcagctagtggtggnggcaccatcctcaggtgtaagctcggcaac

SEQ ID NO: 38752 - DNA, 101 bp, rice(Oryza sativa)
  misc_feature (71): n=a or g
ctaccgggctctcaacgacaagacaatcaaggataaatttcctatcccggtggcggaggagttgttcaacnagctgcgcggcgccaggttcttcaccaagc

SEQ ID NO: 38753 - DNA, 101 bp, rice(Oryza sativa)
  misc_feature (71): n=t or c
ttgggcgtaagcttctcgagcgtgatgatactaaggtggtgaggaagaacaccgatttcacctactgctanggctgtccgcagatgatatcccatcccaag

SEQ ID NO: 38754 - DNA, 101 bp, rice(Oryza sativa)
  misc_feature (71): n=t or c
acatgcaacaggagaaatttcaatccttacgctgtcattgccttgcagcgctcggcatcatccatcagatngcgcaggtgcgtcttctgaatcgccccgac

SEQ ID NO: 38755 - DNA, 101 bp, rice(Oryza sativa)
  misc_feature (71): n=a or c
gaagagtaacaaatgaagcaaacaaatgctcacctagaaggtctatttgttccccccaaaattttgacatnatgcatcctcaccctatgagttgaatacaa

SEQ ID NO: 38756 - DNA, 101 bp, rice(Oryza sativa)
  misc_feature (71): n=t or c
agtcattatttgacagggtggccatgtccaaaaaaattaagtcactgatacaggacgtacattccctatgncctcctatctctgacttgctccagaaatgc

SEQ ID NO: 38757 - DNA, 101 bp, rice(Oryza sativa)
  misc_feature (71): n=t or c
cgacgaggactcgatcggacgctagcatggacttgaccgagagccggcatgtttagtttagtacatgatgngaatcacgtgaacgaaagggatgagataag

SEQ ID NO: 38758 - DNA, 101 bp, rice(Oryza sativa)
  misc_feature (71): n=a or g
atagctaggaatgctaagtcaggactttgagtcattgtgcaagataccctatttagtgccctcacatgtcnccctatgtagttccctcacatatcgcatcc

SEQ ID NO: 38759 - DNA, 101 bp, rice(Oryza sativa)
  misc_feature (71): n=t or g
ttgaagaggaattagagggatgatgtgaaattaatcatctctaatcctcctcaacaattcctttctcgtanagattaggcgaacaagcttttccttgaaaa

SEQ ID NO: 38760 - DNA, 101 bp, rice(Oryza sativa)
  misc_feature (71): n=t or c
aacaattctcaccccgtatactactagtaatacccgtgagcgggagaaaaggaaaaaaaaaacgatgacgngtgcaagaaatgatcgggtgtcgacggcct

SEQ ID NO: 38761 - DNA, 101 bp, rice(Oryza sativa)
  misc_feature (71): n=a or g
ggagccaccgccgtcgccaccatcgtcttcgaccttatcggccaccactaccatctttgaccccatccatngcatcagtgacgtcattggcgagagaggca

SEQ ID NO: 38762 - DNA, 101 bp, rice(Oryza sativa)
  misc_feature (71): n=t or c
caacgcctagctaagttcctattcccgaccacccagttattccgctcgagacaacaacaatggcgacattntgcaaggtacggaaaagagatgatggtatc

SEQ ID NO: 38763 - DNA, 101 bp, rice(Oryza sativa)
  misc_feature (71): n=a or g
attcatgaacatgaagcaatctagatattccaaaaaacaacctgaaatcgactcccatctagagtttgccngtctgaccgttaggcaacccgattagaccg

SEQ ID NO: 38764 - DNA, 101 bp, rice(Oryza sativa)
  misc_feature (71): n=a or g
tggggggggggggggtgaggttactgtcaccgcatggtttggtggataccaaggtaatcacgtggttatcnagaaaaccacacggttatcgagagatatac

SEQ ID NO: 38765 - DNA, 101 bp, rice(Oryza sativa)
  misc_feature (71): n=a or g
catgctactaccaagcaagcactaggaaggggcaaccattgttaagctgaaaatgggaagaagaagaagangaagagtagtttggggtgatggagcttgtc

SEQ ID NO: 38766 - DNA, 101 bp, rice(Oryza sativa)
  misc_feature (71): n=t or c
ctaaccaaatgggcttctgctttagccacagctgattttccacagctgcttttccacagtccatagctcanagcagctttttcaaaagccacagctcaacc

SEQ ID NO: 38767 - DNA, 101 bp, rice(Oryza sativa)
  misc_feature (71): n=a or g
gttcagtatcacggagggggacaacttcgaggctgagaagtataccttccaggaggtccgtccgtgcaagnaggagcacagccacggccagcggagacgga

SEQ ID NO: 38768 - DNA, 101 bp, rice(Oryza sativa)
  misc_feature (71): n=a or g
aattctatttgccatgacctttgtgaataccttgaagcttacattaagtaaggaaatgggcttgtattgtntctattttgcctctttattctttggaagca

SEQ ID NO: 38769 - DNA, 101 bp, rice(Oryza sativa)
  misc_feature (71): n=a or g
cttccagggtggtgaaagaaggtgcctgctgtaattttattttcggttacctccacttggtgctgattgcnagatttctgctagtcaataggaaaggccaa

SEQ ID NO: 38770 - DNA, 101 bp, rice(Oryza sativa)
  misc_feature (71): n=a or g
tccaacatctcaagaagattagctggcgcactaaaaggctagttatcaatacaaaagacaaatcagtagtnatgatgggctgccagtaggataaacattga

SEQ ID NO: 38771 - DNA, 101 bp, rice(Oryza sativa)
  misc_feature (71): n=t or c
gtcgaccacttcatgtacaacatgcggagcataatcggtaaccatctcgaaccagaagcacatctttgatntcactaaaatcctactcccttcatgtctaa

SEQ ID NO: 38772 - DNA, 101 bp, rice(Oryza sativa)
  misc_feature (71): n=t or c
gggtgaagagggactactagtaggagtagagcttagcttagctgagctgagctttggctgtgtctctctcntcactctctcacctcctgctgctgctgctt

SEQ ID NO: 38773 - DNA, 101 bp, rice(Oryza sativa)
  misc_feature (71): n=t or c
ttgttttttattcttttgtttttttacccatggacttggctttagttggtaccatactaccatgtttgcgntgtattttcccctttcctggaagattctag

SEQ ID NO: 38774 - DNA, 101 bp, rice(Oryza sativa)
  misc_feature (71): n=t or c
caaacttgagaagtcaaatttggtcatatataaggaattttgtagtactatttttcccaccaatcacctcncatttaaattctctttattttgatatctaa

SEQ ID NO: 38775 - DNA, 101 bp, rice(Oryza sativa)
  misc_feature (71): n=a or c
agggctcagtttcttagaaatgatcaaactgcagaaaccggaagtgaaccaaaagaaagccgtccaaagcntcgaagtcgaaggttgttgtatgatcccac

SEQ ID NO: 38776 - DNA, 101 bp, rice(Oryza sativa)
  misc_feature (71): n=a or g
tgaaaggtttcttttcaagaaaagagtgatcatggaagggtgttgagggttaaagtatgctgccggaaaanctaaaactagtagctacgttttgattaagt

SEQ ID NO: 38777 - DNA, 101 bp, rice(Oryza sativa)
  misc_feature (71): n=t or c
gagagagagagagcgggggggggggggaggatgagattgagaaatgaatggtgagggatggcttgtatcangacactttgaatatgctacagttgtcgacc

SEQ ID NO: 38778 - DNA, 101 bp, rice(Oryza sativa)
  misc_feature (71): n=t or c
acattcggatcattgatcatcaaactattgacccggcttttgtattttttaggcttattgactcggttgtntgatgatcggcccaggttaggtccgcagca

SEQ ID NO: 38779 - DNA, 101 bp, rice(Oryza sativa)
  misc_feature (71): n=a or c
cggtttcatgattccatttgcccatctaaacgatacgatgcattccgagaatttgtatagctagtagatcntagtcctttcaaactatagtgtaaggcaaa

SEQ ID NO: 38780 - DNA, 101 bp, rice(Oryza sativa)
  misc_feature (71): n=t or c
gagcctacgaagaggaaagctcgtgggcctaatgggccggaaatatctactacacctttaaggaaaaagtncactttaactcccttaaatatacaccgaat

SEQ ID NO: 38781 - DNA, 101 bp, rice(Oryza sativa)
  misc_feature (71): n=t or c
aacgttcataagaattcacttcctcctcttcttccttctcctcagctacattgttaaccatagtgtttgcnaattgtcgaatagagctatggttagagtgg

SEQ ID NO: 38782 - DNA, 101 bp, rice(Oryza sativa)
  misc_feature (71): n=t or c
tcgagaaccaggagtaggcatctctcgatgacctgaagactattgatagttggcgagagatagctacaatngactggtcgagaaccaagagtagacatctc

SEQ ID NO: 38783 - DNA, 101 bp, rice(Oryza sativa)
  misc_feature (71): n=t or c
gcgttcagtttctcatgatgttaataggtactttcttcgcgaaacggaacggtcgaacggacgcaatacanaaggatacgattgctgtgcgagcttgtgct

SEQ ID NO: 38784 - DNA, 101 bp, rice(Oryza sativa)
  misc_feature (71): n=t or c
ccagatccctgatgaatttggacagggcataattctgtgcttggaaaaagaaatgggaacgggctctggcngattcttgatatgtagtaatgagatgtctg

SEQ ID NO: 38785 - DNA, 101 bp, rice(Oryza sativa)
  misc_feature (71): n=a or g
atttaatttactaatagtgttaactaggaaccatttgctaaagctaaccatcccccatgggttttcttgcncagtttgaggctgcatgggcactcactaac

SEQ ID NO: 38786 - DNA, 101 bp, rice(Oryza sativa)
  misc_feature (71): n=a or c
taaaacttaacactaagaacatcaatccaaagacatgctgaagggagctccaccacatggcaattctcttntgctccgacgcactcaacctcatcggcatc

SEQ ID NO: 38787 - DNA, 101 bp, rice(Oryza sativa)
  misc_feature (71): n=a or g
gatcaagttcttcccggaggtgtacgcgcggaagagcgcgcacctgcacgagacggactactgcaagtacnacaaccaggtgctgaccctcttcacctcct

SEQ ID NO: 38788 - DNA, 101 bp, rice(Oryza sativa)
  misc_feature (71): n=t or c
agtataccatttgaagcagttggagtgttttctttagagccgtgacactcttcgtcgtttcttcgaacaanacataacgacttggctctacccttgccccg

SEQ ID NO: 38789 - DNA, 101 bp, rice(Oryza sativa)
  misc_feature (71): n=a or g
actaatgatcttctcaaatatgctggtttctagatgtttgttctcttcgtgctgatgttgagagattggcnttctctgtcatttgggtgagtagttcacat

SEQ ID NO: 38790 - DNA, 101 bp, rice(Oryza sativa)
  misc_feature (71): n=t or c
tttccatgcttgttgttttctccgagttcctcatcaaacttgtcacgctagtgcacgaaattcatcgtctnccaagtgaagtttcagtcagtcattcaatg

SEQ ID NO: 38791 - DNA, 101 bp, rice(Oryza sativa)
  misc_feature (71): n=t or c
cacgatggtgccatgacaagcctgcaagatctaactcttgttaacctcagtggcttgacagaggttccatntggcatcgagttactttccaccctcaaaaa

SEQ ID NO: 38792 - DNA, 101 bp, rice(Oryza sativa)
  misc_feature (71): n=a or c
tgtggaccctagcaaaatgaacaatgacccaaagtcacctctgaacttgttccagctaaagcaagcacctntccatctacactactaccatatctgaatga

SEQ ID NO: 38793 - DNA, 101 bp, rice(Oryza sativa)
  misc_feature (71): n=a or g
ttggtgctgctttatgtagagcaggttcatcaccatggacaggtcttgttgctgtgtacatacatacagcncaggtagatcgagcatgtcaagaaacacaa

SEQ ID NO: 38794 - DNA, 101 bp, rice(Oryza sativa)
  misc_feature (71): n=t or c
gactgcctgcgattgatatgtcgttttgaccccatccccccctggggcttgttctagcgagaagataaatncgcgctcggtccatggaatctaagtggtga

SEQ ID NO: 38795 - DNA, 101 bp, rice(Oryza sativa)
  misc_feature (71): n=t or c
atgggacagaaggagtaggaggtatcgcccctatttttgctataagagtttgggcctgttcattttgatgncattttcaactgtacctttttttggtaagt

SEQ ID NO: 38796 - DNA, 101 bp, rice(Oryza sativa)
  misc_feature (71): n=a or g
aggacgcaagatgaaggcgggttaatggccgaggtgaagcttaggaagttgggaatctttttgttctttantgcgtggacatgatgctagtctgttcctgt

SEQ ID NO: 38797 - DNA, 101 bp, rice(Oryza sativa)
  misc_feature (71): n=t or c
taatttgtattctatagtcaaacacaccatcctgttttatatgaacacacatgatgatattgcaatgaccngtcctaaataaaatagatgtcttagttacg

SEQ ID NO: 38798 - DNA, 101 bp, rice(Oryza sativa)
  misc_feature (71): n=t or c
atggcggcgggtactgctatatagagtttagggtcatgcaactgtgtcttgacacaaccctaatgggttcnaatacgatacacggcccaaaggcccaaata

SEQ ID NO: 38799 - DNA, 101 bp, rice(Oryza sativa)
  misc_feature (71): n=t or c
atcgacttttgtacgtgagcctcttaagaagtcatatacggaaatggatgtcgatttttacagacgccgtnaattgcagtccgcatgcaacctagcggggg

SEQ ID NO: 38800 - DNA, 101 bp, rice(Oryza sativa)
  misc_feature (71): n=t or c
gaagtaggagtatatgtaggctgccaaaagttactcataagtcataaccaaagcgctacttcatctatttnaaaatataacaactttcaacatttaaaata

SEQ ID NO: 38801 - DNA, 101 bp, rice(Oryza sativa)
  misc_feature (71): n=a or g
ctagaaaaatgattttttcatggctgtaccctattttttctgatggcggttacatgagatctccgcgtgcnaaactgtaacgaggggtgaagggttggtga

SEQ ID NO: 38802 - DNA, 101 bp, rice(Oryza sativa)
  misc_feature (71): n=t or c
tacgtaaaccccttttaaaatctcaaatagctactgcaaactacaaagcttaatttgacacggacgattgnatttacggttaattatttttttatattaga

SEQ ID NO: 38803 - DNA, 101 bp, rice(Oryza sativa)
  misc_feature (71): n=t or g
tcaccatcgaggtaaactaaatatggccaaaattttcctgctacgacacaagattgcattgcatgtagatntcgctgaactttttaacccattcttgtgag

SEQ ID NO: 38804 - DNA, 101 bp, rice(Oryza sativa)
  misc_feature (71): n=a or g
agtggcacttactccagctgtccagcaatcagtacacctaccactttgactgactacaggaaaaaaaaatnccaaaaagaaacagtttacagagcattgtt

SEQ ID NO: 38805 - DNA, 101 bp, rice(Oryza sativa)
  misc_feature (71): n=t or c
cgttcggcgtcgggcggaggatgtgcgcggggatcaacaccgccatgttgcacctggagtacttcgtggcnaacatggtgagagagttcgagtggaaggcg

SEQ ID NO: 38806 - DNA, 101 bp, rice(Oryza sativa)
  misc_feature (71): n=t or c
tcatgtcggcccgtgtcacctctagacaacgatgcataatgcattagatcactctaaactctactacctcngccccaatttaagtgtagtcgtggtttttc

SEQ ID NO: 38807 - DNA, 101 bp, rice(Oryza sativa)
  misc_feature (71): n=t or c
atattatcgatgaatagaagcacgtcttgcttattaacatctcggaaatatttgtcacaccccaatctganaccgccgtacaacggcacctgataggagcg

SEQ ID NO: 38808 - DNA, 101 bp, rice(Oryza sativa)
  misc_feature (71): n=a or g
caaagcgttgcgcagtgagcataataagcctacttggctggatcaaagtattgcacttgtgagccaatggnccaccaggctgcatcacccactcttcctca

SEQ ID NO: 38809 - DNA, 101 bp, rice(Oryza sativa)
  misc_feature (71): n=a or g
tgattttggcaagaagaatcctggaaatagcactcctcgcattgctgtttggactaagaacatgatacaancttactctgatcttgacaaagttgatgatg

SEQ ID NO: 38810 - DNA, 101 bp, rice(Oryza sativa)
  misc_feature (71): n=a or c
tattgatgtatattttattttccatgggagatgtagccactttttccttctaagaagaatgtttaagggcntgtttagatccatttggaatggtaaatggc

SEQ ID NO: 38811 - DNA, 101 bp, rice(Oryza sativa)
  misc_feature (71): n=a or g
ccatgcaggaaggaccccattgttcctgctaccatgagcagccaatctagtccatcagcatagcgaagcancccaaagaatgggaactttttgtccgccgc

SEQ ID NO: 38812 - DNA, 101 bp, rice(Oryza sativa)
  misc_feature (71): n=t or c
gctcatcgcccggaaggggacttggattagtcgggtattggatcgatgcgccattgggtggttcctccaanaggcgtcgatggttggaaggcacaaggtct

SEQ ID NO: 38813 - DNA, 101 bp, rice(Oryza sativa)
  misc_feature (71): n=a or g
gatcattaacagtcatatgtaaccctagacagaaagagagatacacttggaagaacagtattacctcccanaatgtgctcactgtcaataggagctgatga

SEQ ID NO: 38814 - DNA, 101 bp, rice(Oryza sativa)
  misc_feature (71): n=t or g
gaaatgttgcagccacatgcacaggctagattatggagtgaagtagtagtagtaggagtacagaagtgagncactgtttggcatctttggatccctctctt

SEQ ID NO: 38815 - DNA, 101 bp, rice(Oryza sativa)
  misc_feature (71): n=t or g
gagtcaccaggtttttgcacagtggtcttcttcagctcagctcaactcatacacagaaaccctaagctctntagggtctgtttgggagccttagattctga

SEQ ID NO: 38816 - DNA, 101 bp, rice(Oryza sativa)
  misc_feature (71): n=t or c
tcacatttgtcaaacctcacttatctaagactgaacaacatgcatagcgcaaaaagattggttcttgacgnggcggctttcccatgcctgaagacacttgt

SEQ ID NO: 38817 - DNA, 101 bp, rice(Oryza sativa)
  misc_feature (71): n=t or c
gtctttttgcaacctcctcctccttcaccacctgtgcaacagatgtcaagtgactgtaccccatcgactanaggaagccaccatgttgaagaagaagaaca

SEQ ID NO: 38818 - DNA, 101 bp, rice(Oryza sativa)
  misc_feature (71): n=a or g
tagtactatggaatactggaatattgtgtcactttttcttgatgtgcaccttgaaccgtgtacgacctatntgtaaaatagctcatcaagaatccacattg

SEQ ID NO: 38819 - DNA, 101 bp, rice(Oryza sativa)
  misc_feature (71): n=t or c
atgccgaagcccgcccctcatggcaaggtaatcaagaagcagatcgacgacgccgatcctacaaagcttgntctgctcgggggcgatctaggcgaagagga

SEQ ID NO: 38820 - DNA, 101 bp, rice(Oryza sativa)
  misc_feature (71): n=t or g
aaaacgtaagaaccataaaaactagggttatatatctcttgccaaaatcccgatggttttgggtgacctgntccataatagatagggttttacgaaaatta

SEQ ID NO: 38821 - DNA, 101 bp, rice(Oryza sativa)
  misc_feature (71): n=t or g
cctgcgcttcattcgacgcttaatgtggctgcaccctctattttttttttgcagtgttgaccctcgatcangccgacgccgaagcccggaagatgatcggc

SEQ ID NO: 38822 - DNA, 101 bp, rice(Oryza sativa)
  misc_feature (71): n=t or c
catcgacagtggacagttcacttcaaggagtatattttggaggtaatagttcttctgctgctgctgctgcngccagccagatgtcgaaccaaattttgatt

SEQ ID NO: 38823 - DNA, 101 bp, rice(Oryza sativa)
  misc_feature (71): n=a or g
tgaaattgggattgctaagacacacgctgcaaccaagatcatcgatgtaaaagacgctaccctagagaacncggaagatgcccctaaagatctagagctag

SEQ ID NO: 38824 - DNA, 101 bp, rice(Oryza sativa)
  misc_feature (71): n=t or g
ctggcaagtggcaccaccaaaggctgcctcggcgtcccattcctgcaaaaaaaaatcactcactcttacantcttactactcaacaagttcaccgaatcct

SEQ ID NO: 38825 - DNA, 101 bp, rice(Oryza sativa)
  misc_feature (71): n=a or c
tgtaaactgcacaaagttaggggagtctaatccaatcgatagggatagaattatggtatcatccaaacttnatcgttgtttcactagaaaagctcagtttc

SEQ ID NO: 38826 - DNA, 101 bp, rice(Oryza sativa)
  misc_feature (71): n=a or g
actcatgatactaattatattcatagtttttgtctaatccgtttttaagtatggagtagctatattttagnatgagtgagtatataagtctaagagcaact

SEQ ID NO: 38827 - DNA, 101 bp, rice(Oryza sativa)
  misc_feature (71): n=a or g
agacatgttgtacagtgactgtgacttctccatgttgtactgtaattcaggttttcagtgttgtagcgtgnttgttcaggttttgttcttcgtgactgatg

SEQ ID NO: 38828 - DNA, 101 bp, rice(Oryza sativa)
  misc_feature (71): n=a or g
gaaagaccccaaatgaaatagccatacaagtacactaatcaccagctagacaggctacaccatagaacaangacaaagacctaggagggtgcagcacacct

SEQ ID NO: 38829 - DNA, 101 bp, rice(Oryza sativa)
  misc_feature (71): n=a or g
cgctcctgagtgacgagaagaattcagtccagaaagcattagatgttgagaaagttgaagcatgtaagctnaagtcaaaatttgaggaacttgagaattat

SEQ ID NO: 38830 - DNA, 101 bp, rice(Oryza sativa)
  misc_feature (71): n=t or c
taccactctcaaccagacatgaatcttgacatttgtgtcatcatcggtacaaaattggtatttctttttcncattcttccatatcctcttttgaacatatt

SEQ ID NO: 38831 - DNA, 101 bp, rice(Oryza sativa)
  misc_feature (71): n=t or c
gttggctgggtaattttgcaggtgtagttcgtcaatcgttatattttgggatgttttcctttgtattcccngtgtattttctttttctatcttccagggcc

SEQ ID NO: 38832 - DNA, 101 bp, rice(Oryza sativa)
  misc_feature (71): n=a or g
ttcttaagtaaaggagattatcatttagacatgtactaaaaagcagggagccagataggcatgattcaggngccttgcaaaatatgccagcgatttttttt

SEQ ID NO: 38833 - DNA, 101 bp, rice(Oryza sativa)
  misc_feature (71): n=a or g
agattactgaaagtagaaaggacagtttctgagggtgttaactccgatttcctattctcctgacagatcancatttttttttaatcagaacaacggatatt

SEQ ID NO: 38834 - DNA, 101 bp, rice(Oryza sativa)
  misc_feature (71): n=a or g
ccaccctataatttgtttgttttgggagagaaaaatctcggctaattaaactgaacagggttcgagaaggnagaagactatatataaaaaaatttttacag

SEQ ID NO: 38835 - DNA, 101 bp, rice(Oryza sativa)
  misc_feature (71): n=t or c
aatagccatgccattctcttgacaatttacatagcaatgacatgaaaaactgttcacgtcactgctgttanggtgtataggacttgtttgatttgcaacca

SEQ ID NO: 38836 - DNA, 101 bp, rice(Oryza sativa)
  misc_feature (71): n=a or c
aaattcgtaaaaagagcgtgtgaagcgcctcactcaccatggcgaacatgttgttgacgagggcgttgagntggctggtcagcgcggcggccgccatggca

SEQ ID NO: 38837 - DNA, 101 bp, rice(Oryza sativa)
  misc_feature (71): n=a or g
ccaccttacagtagggtagtaaaagtacttcccctagattaaagagtactcactccggcacatttcaaacnaagccataagttttcatgtccaattttaat

SEQ ID NO: 38838 - DNA, 101 bp, rice(Oryza sativa)
  misc_feature (71): n=a or c
atgcctagttaacaataaaacactcttatctaagggatattttttgagtacgcttactttcgatcgtccgntggagatcaaaatatcgaacacccacaaca

SEQ ID NO: 38839 - DNA, 101 bp, rice(Oryza sativa)
  misc_feature (71): n=a or c
gaccaatggcagattgtagctttgtaagatgaaacttgacacagcagagtgatttaacgcaggtaatgcgngaattgtgcgattcgtgcctacgtgcaccc

SEQ ID NO: 38840 - DNA, 101 bp, rice(Oryza sativa)
  misc_feature (71): n=a or c
ttctatcgtcgtaggcctcataggtgtcggttctagaacaggcaccaaaagcatttggcttatcctgtctnagatgatgaacatgatgacagtgctagtgg

SEQ ID NO: 38841 - DNA, 101 bp, rice(Oryza sativa)
  misc_feature (71): n=a or g
gtaacaaagggacaaaaaattgcatgcaactatatatacatgtatgcaagttgatttgatacttttggtgngcgtagctcggtagcttagccgctagagtt

SEQ ID NO: 38842 - DNA, 101 bp, rice(Oryza sativa)
  misc_feature (71): n=t or c
tttttttgcgctcccgctaagcccataaagtccagggcccagagagcagtacatagccttttagccgatgntggcttccgccagagctttgggattacagt

SEQ ID NO: 38843 - DNA, 101 bp, rice(Oryza sativa)
  misc_feature (71): n=a or g
ctccagagctcccgtggcgaggtcggcgttcccagagatcggctgcaagaaacggggcgagatcagagaanaggctatggcgtgcaagggtgaatcgggaa

SEQ ID NO: 38844 - DNA, 101 bp, rice(Oryza sativa)
  misc_feature (71): n=t or g
tcgttaggctcgtgtagccgtcgtccatatagatggcatgacattgtgctggacagaaaaaagggaactantctgaactctgaagcctctgtttgttcctg

SEQ ID NO: 38845 - DNA, 101 bp, rice(Oryza sativa)
  misc_feature (71): n=t or c
tctgattttacgagaagctacagcagctagaaactcttccaaatatgcaacaaatcggatggataatcatngaaactagaataataaattttattgtttga

SEQ ID NO: 38846 - DNA, 101 bp, rice(Oryza sativa)
  misc_feature (71): n=a or g
aagacaagccgttatggaagactagtgagctgtcgtgcgaagcgcttgctaaaaacgccgccttctctcgntgtaggaggtcgaaggcgaaggttccgaaa

SEQ ID NO: 38847 - DNA, 101 bp, rice(Oryza sativa)
  misc_feature (71): n=t or c
tgttgaatcatagatgggaggcacagtcaatagttgtggaaatatgttactccatttacctggtatagctnagcccgaatctttttttggttctcaggttt

SEQ ID NO: 38848 - DNA, 101 bp, rice(Oryza sativa)
  misc_feature (71): n=t or c
cacatgtctcctaggtcaagaacgttgttagccacatgcttcacaatgcaaagttgctagtagtaggtccnaccactaccatctttctcactttttccctt

SEQ ID NO: 38849 - DNA, 101 bp, rice(Oryza sativa)
  misc_feature (71): n=a or c
agaaagttgagttactgggttttcttcattttggtctatgctagcaatgagaattagcattgtaggagtanagtttgttgattgttcttatgttagtccta

SEQ ID NO: 38850 - DNA, 101 bp, rice(Oryza sativa)
  misc_feature (71): n=t or g
tcggtgggttcacatcctctacaataatggtactatcattataggcaccgacgtgtggtgcaatgggaggntaggatccacatactagtgactgtaatggt

SEQ ID NO: 38851 - DNA, 101 bp, rice(Oryza sativa)
  misc_feature (71): n=a or g
acagcttgttgggtcatttgaaagacttgttcccaaatcctaactctttatcaaccaacacatctctagcnaagaaactaatctttctagtttcgtttggt

SEQ ID NO: 38852 - DNA, 101 bp, rice(Oryza sativa)
  misc_feature (71): n=a or g
acgatcgagcaagccgcactagcacattgacacctatcagtgtcggtgaggtcaggtgacaacatagtganatgatgacagcaaaggagacatggaattga

SEQ ID NO: 38853 - DNA, 101 bp, rice(Oryza sativa)
  misc_feature (71): n=a or c
ccattaggtggtgataccatagatttggaccctgatactcgatcggaaatattgcgtgatgctaaagaacnagttgatggctgattctgaggcgtctttat

SEQ ID NO: 38854 - DNA, 101 bp, rice(Oryza sativa)
  misc_feature (71): n=a or c
agagcggagcagaatctgagggtcctgcgaaaatgacaattttacatagcgaactgatgaagcttgagtcncctaagcttccttgccttccttgagctgta

SEQ ID NO: 38855 - DNA, 101 bp, rice(Oryza sativa)
  misc_feature (71): n=a or g
tggtggcagtaagttcagaaaagtgacagtcacagacaggaacgactccgatatggtgtggaaaagtatantagagactaaaaatacatgaaaactcctcg

SEQ ID NO: 38856 - DNA, 101 bp, rice(Oryza sativa)
  misc_feature (71): n=a or g
acattcgatctatcccaacaacccacagtacatatatataattgatttgttttctttaactactacctatntcttaaaatatagcaatttttaactataaa

SEQ ID NO: 38857 - DNA, 101 bp, rice(Oryza sativa)
  misc_feature (71): n=a or c
tgatgcagcagcaatagcttatgtgtgggcccacaatccccaatgccattaacttgtctccttttgcaatncctgttctactatggtgggacttctttaac

SEQ ID NO: 38858 - DNA, 101 bp, rice(Oryza sativa)
  misc_feature (71): n=a or g
cgaggatttttgtgaaattcgttttgtttgtgtttttaagcgaagatgagaagatgagggagagcttgagntggattccagcttgggcagttggggatgga

SEQ ID NO: 38859 - DNA, 101 bp, rice(Oryza sativa)
  misc_feature (71): n=a or g
ttccgtaagttgggggacccgtcgtatccggttttgtgactaaacgaaaatcggacaggggcgacaaatgnagggccccaaagtgaacttattccttaagc

SEQ ID NO: 38860 - DNA, 101 bp, rice(Oryza sativa)
  misc_feature (71): n=a or g
ccatcttgtagtaaaatgctttttatcaatcaatgggccccaatccgattaacaaaaaaagtaggacacgnttattgtatttccacatgaccagtaaagca

SEQ ID NO: 38861 - DNA, 101 bp, rice(Oryza sativa)
  misc_feature (71): n=a or g
gccgaagggaaccttttgatctctagtcccggtttgttattttttcagtcccgatttaaaaagtcatcagncccccactgtctttagtcccggttattgtt

SEQ ID NO: 38862 - DNA, 101 bp, rice(Oryza sativa)
  misc_feature (71): n=t or c
tcgttagcccccgtcttttcaaacgtgtgttaggggtacactcatattgttatagtgtgatgtccgtgccngacggtgtgggtacatgtgcgtttcccgtg

SEQ ID NO: 38863 - DNA, 101 bp, rice(Oryza sativa)
  misc_feature (71): n=a or g
ggtccaaaccttgtaattcttcataaaatccatgctccactaagtggcccaaaattttacctcaaagcatntgccttagcctagtcaataaatttagatgc

SEQ ID NO: 38864 - DNA, 101 bp, rice(Oryza sativa)
  misc_feature (71): n=t or c
agttcggttggtagcaccaaccggggctaaagataaaaacatttataacattcttcttcctcttccaaccngagcaattgctgcaaagatttgtaggagga

SEQ ID NO: 38865 - DNA, 101 bp, rice(Oryza sativa)
  misc_feature (71): n=t or g
gctcatgcataaatggattgccatgactttgttccctagaggagatgttagacctattagggaggatgagntgattattctttatgccatggttagaaaga

SEQ ID NO: 38866 - DNA, 101 bp, rice(Oryza sativa)
  misc_feature (71): n=t or c
gttgatgccatcaacacgataagatcacctaaagccttgttgtgttaacaggatacatcaaccatcttaancttgagaaactcctgatcaagatggcttta

SEQ ID NO: 38867 - DNA, 101 bp, rice(Oryza sativa)
  misc_feature (71): n=t or c
atcgctgcttctcgttttcgtcgatcgataagcagcatatgctgtcttttcttttcttcttcgttcgagcnaaagcccaaattaaggcaaattatcaaagt

SEQ ID NO: 38868 - DNA, 101 bp, rice(Oryza sativa)
  misc_feature (71): n=t or c
ataccgcgtacccacatctcccctgtcgcgtcataaccggtctcacgatttcatattacgataccgacctnggtctcgcgcaacaaaactgtgagagcgat

SEQ ID NO: 38869 - DNA, 101 bp, rice(Oryza sativa)
  misc_feature (71): n=a or g
ttttcgggtagacctcttaagtggtttacctacaaaaatagatttttggtggacaacgatctcgccccacngttgtcattttcataggcggctatttagca

SEQ ID NO: 38870 - DNA, 101 bp, rice(Oryza sativa)
  misc_feature (71): n=a or g
gagagagtcacaaggatggaggagaggggaatctttggggatgggtacaaggttatacagggagagtgggngcaaatggctttctttttttttttttacct

SEQ ID NO: 38871 - DNA, 101 bp, rice(Oryza sativa)
  misc_feature (71): n=t or c
tactatcatcttcttcaaggccggtgcgcttgcatgtaagaatttcaggagcctagcttcgtactgtcgtntgtaagcgctggtaatctttatatcctgaa

SEQ ID NO: 38872 - DNA, 101 bp, rice(Oryza sativa)
  misc_feature (71): n=a or g
tagtggctatagccactgcaggtgatcccaattcccaattcctctagagttgcatatttaaccaattcagnccgggaacgataactaatttcttgcactaa

SEQ ID NO: 38873 - DNA, 101 bp, rice(Oryza sativa)
  misc_feature (71): n=t or c
tgtcattcaagttagtacttgttgaatggagcctactacgtactctggtatctcatcattggtcaccatcngtttctgctgtgagcttcaggcatatgaat

SEQ ID NO: 38874 - DNA, 101 bp, rice(Oryza sativa)
  misc_feature (71): n=t or c
ttaaattcatgcatatgtagcttttaggccttagctttaaaagcgattgttagtatttgatacagtaaccnacaccaatggctatatataattttattttc

SEQ ID NO: 38875 - DNA, 101 bp, rice(Oryza sativa)
  misc_feature (71): n=a or g
tgcgctaagagggagtgagttcctgggtatttgcctatataaatatgtggttatgtgggtaaattgaaccnacgacgaccttgggtcctttgagcaggata

SEQ ID NO: 38876 - DNA, 101 bp, rice(Oryza sativa)
  misc_feature (71): n=a or g
acacatccaactggagaagatccctgttgtctattcctaaagaggtataccatgaaagcaaacagtgacangtgtgatcgtgagactgcaggaccggatgg

SEQ ID NO: 38877 - DNA, 101 bp, rice(Oryza sativa)
  misc_feature (71): n=t or c
gccggcccactgcttttttttatatatatattttgcttgcctcacagttcctgcaggctgcagcgcttaanattgtactccctccgtcctctaatataaga

SEQ ID NO: 38878 - DNA, 101 bp, rice(Oryza sativa)
  misc_feature (71): n=a or g
ggaaaatatggagagaaattaaaatggttggggtttgaattgatgtggaattcagaagttttttatttttnggatataattgaatttggattcaaaggaat

SEQ ID NO: 38879 - DNA, 101 bp, rice(Oryza sativa)
  misc_feature (71): n=a or g
aaacctgttcagaaaccgggtgccagttctgtttgttgaatgactagtgaccagagataaatcttgcttgnttgcaatcactgtaaatgagctcgaactcc

SEQ ID NO: 38880 - DNA, 101 bp, rice(Oryza sativa)
  misc_feature (71): n=t or c
tttctcgagaaaaaaccacctgccatatggcattgctctttttttatatcttcatttttcgtctttaaganggattcacacttaataaaaagaaatccttc

SEQ ID NO: 38881 - DNA, 101 bp, rice(Oryza sativa)
  misc_feature (71): n=a or c
gcaccagcagaggagacgacttgctggctatgagcagaagaatgcttaggaagtctcttttcgcgcaaccncccccccctcccccctcttttgctgtaggc

SEQ ID NO: 38882 - DNA, 101 bp, rice(Oryza sativa)
  misc_feature (71): n=a or c
accaaaaggctgcatagtagatctagcgtcctcaaacactggagtctcccaattttctgaggcattatcanctggaaccctctgatcctcaagtgtttcaa

SEQ ID NO: 38883 - DNA, 101 bp, rice(Oryza sativa)
  misc_feature (71): n=a or g
caagaacaaggggatcgccgtaggccacgagcccatcccgaaccaatggatggcgttctcgtcggaggccncgtcgctggaccgggtcagcgcgtgggtga

SEQ ID NO: 38884 - DNA, 101 bp, rice(Oryza sativa)
  misc_feature (71): n=a or g
ctgctagctagagtagttctgaggaataacaagggtaagattttgggggcagcatatattagcatgccaangggctctgagtctggctataaaaatgggag

SEQ ID NO: 38885 - DNA, 101 bp, rice(Oryza sativa)
  misc_feature (71): n=t or c
cagatttatagggaagtatgtttcatttctgtcttcatcatcaactagtaaatggtgtactggaggttcantttcaccagaaactaattccgggatactgt

SEQ ID NO: 38886 - DNA, 101 bp, rice(Oryza sativa)
  misc_feature (71): n=t or c
tccacacatgcacccaggacattacaagatagtgtcgtgctcacatgagctgaaccagtcacatgagaaanagggtacagaaacagagtacataacagagt

SEQ ID NO: 38887 - DNA, 101 bp, rice(Oryza sativa)
  misc_feature (71): n=a or g
aagcttgttcataagcttcactagcttggtgataatacttagcaagtgttggtacaacatttgctaaatcntacagactgcatatcatacaacatgtacca

SEQ ID NO: 38888 - DNA, 101 bp, rice(Oryza sativa)
  misc_feature (71): n=t or c
tctcatctgaagtgcaagcaatctagaatgttcaacctgcatagcaacattgctgatccacagctccagcnatatatatagctacaaaattttggattgat

SEQ ID NO: 38889 - DNA, 101 bp, rice(Oryza sativa)
  misc_feature (71): n=t or c
aaacataagatattttaggtgcatatgacatatattaggacgataaatatgaacattttctatccagattnatagtcctaaaatatgttacatccgcataa

SEQ ID NO: 38890 - DNA, 101 bp, rice(Oryza sativa)
  misc_feature (71): n=a or g
tcggcggtgaagctcatcaagctgtcactgattagcgggactgattagcgggaattgattctaatctctcnagagatatccctcgttcacctttttttttc

SEQ ID NO: 38891 - DNA, 101 bp, rice(Oryza sativa)
  misc_feature (71): n=t or c
ttgacctaaaccttttctctctaacacaaactgccagcccttattagcttcatgcactggtagagaaatgntctttattcccggttgagaaccccctatag

SEQ ID NO: 38892 - DNA, 101 bp, rice(Oryza sativa)
  misc_feature (71): n=a or g
ttagcaccactagtctacgcaatctccaagagaaaaaaaagaccctaaagcatgccattgaggagagcacntggatccaagaccttaacttctcaaacatt

SEQ ID NO: 38893 - DNA, 101 bp, rice(Oryza sativa)
  misc_feature (71): n=a or g
taatgagttggctcagctcgttatcctagtgacttagaagtttgggtcgattcatttgaaagctcatgctnactcgttaagcttgcattctaagtatcaaa

SEQ ID NO: 38894 - DNA, 101 bp, rice(Oryza sativa)
  misc_feature (71): n=t or c
gaagcccgcatgcgaaaatctttttttttccatgtggcctcttaaaacaccacatgagaaaatatgctcanttttatatgcacacctgtgaaaatagattt

SEQ ID NO: 38895 - DNA, 101 bp, rice(Oryza sativa)
  misc_feature (71): n=t or c
aattttaccccaaaaatctgggaacaaaacacgatgtagcatccacttttgaatgggtgaagtacccaaangaattagttctgcttgttcaagattgtgtt

SEQ ID NO: 38896 - DNA, 101 bp, rice(Oryza sativa)
  misc_feature (71): n=t or g
cttgcttgtaaattttgatggaacaatagagagaagacacagggaccagctaagctgtgcatccttgttgntgatggttttttacaaatgatgaatagccg

SEQ ID NO: 38897 - DNA, 101 bp, rice(Oryza sativa)
  misc_feature (71): n=t or c
tatacaagttcaagtctaaaccactaagaacaagaacagtgctcagggggttatttgtccagtatgaatanttgagcgtgtaaaatatctggttttatggt

SEQ ID NO: 38898 - DNA, 101 bp, rice(Oryza sativa)
  misc_feature (71): n=t or c
aaaacacctcacctagtcacctagatcgtatccgttagatcaggatcgatgggtatataacagccgagtgnatgagtgcacgaggttagatgtgtgcatag

SEQ ID NO: 38899 - DNA, 101 bp, rice(Oryza sativa)
  misc_feature (71): n=t or c
agtgggataaccattccttagacttttggagtatatatagtgtgtataaatatcggtaacggtcaacgaangaacaactatgacaggtttacagtaatctt

SEQ ID NO: 38900 - DNA, 101 bp, rice(Oryza sativa)
  misc_feature (71): n=t or c
caaactaatatttcgcttttataagtctctcaaacttagtgtacgatgcatacctatgtgaatgcgcgggntaccttcctagtttttttaaatgttgtagt

SEQ ID NO: 38901 - DNA, 101 bp, rice(Oryza sativa)
  misc_feature (71): n=a or g
ggttataccgctcgcgtaatgccggtctgactgttgggatctagagaaacaccaaacaacaaaaagcctcnaagtaaaccctaaatttctctgccaaaaag

SEQ ID NO: 38902 - DNA, 101 bp, rice(Oryza sativa)
  misc_feature (71): n=a or g
actattatttccttgcataccttttttttgtttgtttgcaaggcctatctatatatgacatgggtcctttntgggttatttgttgcttatcattttctttg

SEQ ID NO: 38903 - DNA, 101 bp, rice(Oryza sativa)
  misc_feature (71): n=a or g
gactgatagggtggcgtgccgtatgttgggatggtaatgggcttaacatcttgacctacaaaatatgatgnttgggccaaaaagggttgtgctgaaattta

SEQ ID NO: 38904 - DNA, 101 bp, rice(Oryza sativa)
  misc_feature (71): n=a or g
cgggaaatgcacatgctaatgttattgcaaaattcacagcgctccattccattctcctaaaacaaaacacnaatattaggaaatgatttaatatcaaataa

SEQ ID NO: 38905 - DNA, 101 bp, rice(Oryza sativa)
  misc_feature (71): n=t or g
ggatcagcccctcccctatcttctctccaaccttccgtgcacgagcagcttaggtggtgtttttttttttnaagattaagtttattatgtaaaacgatgtg

SEQ ID NO: 38906 - DNA, 101 bp, rice(Oryza sativa)
  misc_feature (71): n=t or c
ggcagttatttgaaataagagaagttccctgtgcagtgtatatgctgtattagacctgctttggtcgcaanacatgtgcttttgtcaaaaccattggagat

SEQ ID NO: 38907 - DNA, 101 bp, rice(Oryza sativa)
  misc_feature (71): n=a or g
gactgagacagcacatgtatcacgattcttgatcacatattaggttgctacgagcatctttcccatccttnaatagttattatgaggtacgaggtactgat

SEQ ID NO: 38908 - DNA, 101 bp, rice(Oryza sativa)
  misc_feature (71): n=t or c
aatctgaacatgtgaaagatttgattcttttttatggagggtgtacctttttcagaatccatctgagaacntagagatcattttcatctgtattaaaacat

SEQ ID NO: 38909 - DNA, 101 bp, rice(Oryza sativa)
  misc_feature (71): n=a or g
cagaactggaacttcaccccatcgatgacaaacgtgacaacaatggaggcccataaatttccggcccaaancccatcaatcaccccatcgatgcttctcca

SEQ ID NO: 38910 - DNA, 101 bp, rice(Oryza sativa)
  misc_feature (71): n=t or c
ttttttctttagatacagtatagatgaaaagggtcgtctgaggaatttattttgggccgacagtcaatccnagcttgactatgaagcattcagtgacgtgg

SEQ ID NO: 38911 - DNA, 101 bp, rice(Oryza sativa)
  misc_feature (71): n=a or c
gagaactctgaaaaaaactaggctataccatgtataatttccttctcaaaacttgtaagcacatatcctgntctccattctcaattctcatgatccatttg

SEQ ID NO: 38912 - DNA, 101 bp, rice(Oryza sativa)
  misc_feature (71): n=t or c
caatcttcaaatcgctgggttggtcgttccaatctattgctgttagattaattttttgcatcagattgatncgttttattgtcttttggcgtgcatatact

SEQ ID NO: 38913 - DNA, 101 bp, rice(Oryza sativa)
  misc_feature (71): n=t or c
gtgatttgggagttgatgtagcaatactgacaacacaaggtgcatggtcggagatactctttggaagggcngttaactccgtatgaggatatttcaggatc

SEQ ID NO: 38914 - DNA, 101 bp, rice(Oryza sativa)
  misc_feature (71): n=t or g
ctaagaaaaactggggtagtgcaggtattccgtcgacagaaattatctcccaacatccaaattcaggaagncatgcaaatctcatcacagggagctgcacg

SEQ ID NO: 38915 - DNA, 101 bp, rice(Oryza sativa)
  misc_feature (71): n=t or c
aattaattgtgttaagtgtaaaccaaccaaaattggtgatgttatgtatgtgaaaatcaatatagccctcntatttacagttaggttagtataaatttggt

SEQ ID NO: 38916 - DNA, 101 bp, rice(Oryza sativa)
  misc_feature (71): n=a or g
accgtctgtgcactttactctattctctatgagctgcaactgtggttacatggagcaggaaagtttcatcnatctattcaaatttataagaatatataaat

SEQ ID NO: 38917 - DNA, 101 bp, rice(Oryza sativa)
  misc_feature (71): n=t or c
acctgtatcaggagcttgcgcaatttgtttcaggccatgaatgtaggatgatacatcaactaaacctgacnggagccgacaagacgactcgccatttgtcc

SEQ ID NO: 38918 - DNA, 101 bp, rice(Oryza sativa)
  misc_feature (71): n=t or c
atatgttgaatctaaagtcaagttttcacataggcgtggatacataggttgtgggaaaagactgggactgngcgaaagggccttgcattgcgtcccacagg

SEQ ID NO: 38919 - DNA, 101 bp, rice(Oryza sativa)
  misc_feature (71): n=t or g
ctacaaaggaatgtgaatgtcactgaccaaagtgcaagactggatacattagcatcagtctattgagaatngccaaccttaattaccatgatctatgtata

SEQ ID NO: 38920 - DNA, 101 bp, rice(Oryza sativa)
  misc_feature (71): n=a or g
tctcatttcttaaaatgaaaaacaaactgcagcacaagacaaagttagcgtcccaatgttatgcagcaatncgtttagagcagtggttataagctctgtct

SEQ ID NO: 38921 - DNA, 101 bp, rice(Oryza sativa)
  misc_feature (71): n=t or c
gttcctccactcaattcattatttgtaatgcagtttagcttcaaattatcataaaatggtcgtgaagcatnatggggcaaagattattgattatttgcatg

SEQ ID NO: 38922 - DNA, 101 bp, rice(Oryza sativa)
  misc_feature (71): n=a or g
ttaatcccagagctttttcacaagacaagatctttcaaatggttagcctcaaatatagcatatccatccantgcaaattcagaaaaacagagagaagaggt

SEQ ID NO: 38923 - DNA, 101 bp, rice(Oryza sativa)
  misc_feature (71): n=a or g
gtgatttgcgattttgcagagctatgctttgtgagaggtaaattagttttggcaatgctatacatcactcngtaaatttctgggattaaatcatggtctac

SEQ ID NO: 38924 - DNA, 101 bp, rice(Oryza sativa)
  misc_feature (71): n=a or g
ttgcaagttcggtcatcaccacttttccttcatgaacaagaggcgccatcaatatgtttttgcctacattnagagcacttacatgcaaatatgtttcttaa

SEQ ID NO: 38925 - DNA, 101 bp, rice(Oryza sativa)
  misc_feature (71): n=a or g
attgaatcctgctatccacgcagcatgcatgcatacaggccgatatatttcttaaaagaaaatacagacgntcaacttaataattttatctgcctccgcag

SEQ ID NO: 38926 - DNA, 101 bp, rice(Oryza sativa)
  misc_feature (71): n=a or c
acgtttaggttggtaatccaaatattcagatcaagtgacattgctctttagcaaagcggtcaacatatagntggatgaccttctaattaacctgcataaca

SEQ ID NO: 38927 - DNA, 101 bp, rice(Oryza sativa)
  misc_feature (71): n=t or g
gggcggatgtcatgtttgtcttcctccttggtgtccatggttttggccttcgggggcattttttttttttngacttttgcttcagcaaaatttgtttgggt

SEQ ID NO: 38928 - DNA, 101 bp, rice(Oryza sativa)
  misc_feature (71): n=t or c
ccaattttgcctaatcttaaaagtacaatatttttcatataattgtgtcgaacaagaccaaagaaacctancagatgtgggcgaatggtagggaaaaccaa

SEQ ID NO: 38929 - DNA, 101 bp, rice(Oryza sativa)
  misc_feature (71): n=t or c
gtagatgggtagcaaattgagtgaggggtggttggaggaacatattaaaagttgtgagtatctaggatgtnatttattatgggaaaaatttaaatcctata

SEQ ID NO: 38930 - DNA, 101 bp, rice(Oryza sativa)
  misc_feature (71): n=t or c
actctctccctatctctatccccaatttctcttctttcccaaagccccatgccactgcatgtcctctcttngcctatgatgcactgccgctccccacagag

SEQ ID NO: 38931 - DNA, 101 bp, rice(Oryza sativa)
  misc_feature (71): n=a or g
tttgtaccggttttaactaatgaaccggcacctatacttcgtaaagatgtcggttcattatttttacatcntccggacataggaaaaggcctataggtgtc

SEQ ID NO: 38932 - DNA, 101 bp, rice(Oryza sativa)
  misc_feature (71): n=t or c
gtttcatcgtttagtgtcttactccctttccgatggtcaacgtgacgtcagcagtgagcttctttggttgnccccaccccggcgggaggtgaataaggtag

SEQ ID NO: 38933 - DNA, 101 bp, rice(Oryza sativa)
  misc_feature (71): n=a or g
tacactgagagcttgaggagcgagggaggcgcctactccagcacatactacatcggctgcatgtcctactncaacaactcggcgagcgcgcaggacggcca

SEQ ID NO: 38934 - DNA, 101 bp, rice(Oryza sativa)
  misc_feature (71): n=a or g
acttctataatgtgttcttaacggtttaagagttcatgttgaaaataaagcacgttgaaaaaacctccaantcagcttcaaaattaaattttaacagtggc

SEQ ID NO: 38935 - DNA, 101 bp, rice(Oryza sativa)
  misc_feature (71): n=a or g
tccagtatttggtggatctgcttccacgtagcactgaactgggtcagtactttactaatcagctatcaggnccgtagtttatgggaaatgcagttatattt

SEQ ID NO: 38936 - DNA, 101 bp, rice(Oryza sativa)
  misc_feature (71): n=t or c
aatgcccttggtatcccgcattttagaaatacccatagcacattgtgataaaagcgtcgctgtgcatgctngcccaccagtgctcaagctctggtgcaggt

SEQ ID NO: 38937 - DNA, 101 bp, rice(Oryza sativa)
  misc_feature (71): n=t or g
tataatcggtagctcatgtgtccaacaagctgtgagaccttgttatgttttttcatcagtcttctccctcnaaaaaaatcacagaagattcagtacggact

SEQ ID NO: 38938 - DNA, 101 bp, rice(Oryza sativa)
  misc_feature (71): n=a or g
aaagcataatgccatccgtttccaaagaaacgggaaactgcactaaggccaccaacttcatatagaaaccncacagcagagaaggtgcacatcaacaggga

SEQ ID NO: 38939 - DNA, 101 bp, rice(Oryza sativa)
  misc_feature (71): n=t or c
ctgcctctccttgacgctcgccccctagcctatccacctcgcatggccggccaggatctgcatccccgatncgctcttcctcgtgggccctccatcgccac

SEQ ID NO: 38940 - DNA, 101 bp, rice(Oryza sativa)
  misc_feature (71): n=t or c
ctgcgggctttgatttagcacacattccttccttacacactgatgacaaagattccatatatgtgttcagnttctgattcatggcaatttagccataatct

SEQ ID NO: 38941 - DNA, 101 bp, rice(Oryza sativa)
  misc_feature (71): n=t or g
atgatacgaagaacatggaaagtagggggaaactcttttactcactcgagtagatatgcacccgtttattntatgtcatctaaataattatgaaaaaaatt

SEQ ID NO: 38942 - DNA, 101 bp, rice(Oryza sativa)
  misc_feature (71): n=t or c
acgagtacatagttgcagcctgcagctatcattctgagagtttgtgactgcacccattcaagattgttccnattaattacagtattagtatgtgattttcc

SEQ ID NO: 38943 - DNA, 101 bp, rice(Oryza sativa)
  misc_feature (71): n=a or g
ggtgcattactagttatatttgtgacttgttttaaacaatttttgttgaagctgggcctacaagtccaaanaaataatctcataaggcccaaaacaccacg

SEQ ID NO: 38944 - DNA, 101 bp, rice(Oryza sativa)
  misc_feature (71): n=a or g
aatttgccaaagtagatttctcctatgctcctcagtattgcaatactgctcatgaactagctcaaaatggngccacccagatcagtctgttgtttggactg

SEQ ID NO: 38945 - DNA, 101 bp, rice(Oryza sativa)
  misc_feature (71): n=t or c
gggattaaggaattgatgacgaggcttttccccccatctgtctcttctattgaaaaaactaggtgaaactncgtgcattgctgcggcaatttagtatgaag

SEQ ID NO: 38946 - DNA, 101 bp, rice(Oryza sativa)
  misc_feature (71): n=a or g
cttgcaccaattgttcgagtggtttcgacaggaggatgtctaaacgacgtcaaacgacagaaaaccgctgngtcatgactaatttttgcaagttgaggtcc

SEQ ID NO: 38947 - DNA, 101 bp, rice(Oryza sativa)
  misc_feature (71): n=t or g
gggggaggccatgcactgtagtaccttttatcttccaattaatcaacttttgtcagggttttgttcccctncaagtcagtaggcatgttgtattttattat

SEQ ID NO: 38948 - DNA, 101 bp, rice(Oryza sativa)
  misc_feature (71): n=a or g
cctgacactcttttatgaatccatctctctcacaaacaagatgggatcaacttgtgttgatgtgctgattnctttgaatcccccatttttccgtgacattt

SEQ ID NO: 38949 - DNA, 101 bp, rice(Oryza sativa)
  misc_feature (71): n=t or c
tttcttatgacctaccaacaccagaatatttggattagtaaacaggaacatccggtttcctcgggatgtgngaattttggatgccaaaacaacatggtact

SEQ ID NO: 38950 - DNA, 101 bp, rice(Oryza sativa)
  misc_feature (71): n=t or c
tctattgtgcattgcaatccaaatgccgtaaatttttagttgatgcatgttgtggccatggtaaaagaaanaaacagaaaatgatggcattggagtccgaa

SEQ ID NO: 38951 - DNA, 101 bp, rice(Oryza sativa)
  misc_feature (71): n=t or c
taagtgagttgcatatttgcagctagtacttgattgccaacactgatgtttggttatatgaatattggtanccactcaaactgaaattgcgtataattaag

SEQ ID NO: 38952 - DNA, 101 bp, rice(Oryza sativa)
  misc_feature (71): n=a or g
ttcgcgaggattgagttgaagatcgatttacaacgcaaactccttctaaaaccctgatttcatagggattnagttggtataaggttcatcgcatttgactt

SEQ ID NO: 38953 - DNA, 101 bp, rice(Oryza sativa)
  misc_feature (71): n=t or c
tcagtggggtactagggaagcttgaagtgcaaggaattgagctataactcatcggttgcagaggaatcganagggataacttgggatcagagccaaggaag

SEQ ID NO: 38954 - DNA, 101 bp, rice(Oryza sativa)
  misc_feature (71): n=t or c
tctaggtctacgaaaataaactacgacgggccaaggccgacgaaaatattgggattaagttcactggaggnccctcaacttaacagcgagattttttaagg

SEQ ID NO: 38955 - DNA, 101 bp, rice(Oryza sativa)
  misc_feature (71): n=t or c
cattacctccgagtacaacatgacatgcgtgtcagaaaggttcaccgatgaatggagctgccacggccatnagaaggacaacgacgccgacgtcagcgtag

SEQ ID NO: 38956 - DNA, 101 bp, rice(Oryza sativa)
  misc_feature (71): n=a or g
ttggctcgacgtgctcgccaaacatagcgagagcggcgaatggctatgatgccaagctgataggcgcacgncggcggtggtgttgtagcggcgaatgctcg

SEQ ID NO: 38957 - DNA, 101 bp, rice(Oryza sativa)
  misc_feature (71): n=t or c
ccactactatttacgcgctaacgaggcacattgttcttcgtgcacgagggagaatttttcaacactcctcncgaacacacctaaaagttgtcctgcgaagt

SEQ ID NO: 38958 - DNA, 101 bp, rice(Oryza sativa)
  misc_feature (71): n=t or c
agtcggaatgatggtttataggagctacctagtgtggctgtgcctaggcgtctaagtgtgtccaatataanggttaagtgcctcatgggggaacggatgtg

SEQ ID NO: 38959 - DNA, 101 bp, rice(Oryza sativa)
  misc_feature (71): n=t or c
taacgagaagatcaatctcatgttgcttgttatcctcataatctttgtctgttaggttccaaagtttcttngcaactgtgtcatagaccttttggacaatg

SEQ ID NO: 38960 - DNA, 101 bp, rice(Oryza sativa)
  misc_feature (71): n=a or g
gagatggagtctatctgtgtagggtggagataagatggagtccatgccatccgtgtgaaattttagtatantgaaaaaaaatttgcagtcggtgctcctta

SEQ ID NO: 38961 - DNA, 101 bp, rice(Oryza sativa)
  misc_feature (71): n=a or g
tgatgggaaactacaaagcagtagctagtcatgtaagctgtaagtgttctaatttgtaccaattaatttcntgtaattacatgctattttttagtattatc

SEQ ID NO: 38962 - DNA, 101 bp, rice(Oryza sativa)
  misc_feature (71): n=a or g
acgagcaatttgatgcatctcagcaagaggtgtttgggctacagacgactatagatgttctgagaaacaancttgaggctgctgaagaagcagcttcagag

SEQ ID NO: 38963 - DNA, 101 bp, rice(Oryza sativa)
  misc_feature (71): n=t or c
cacatcagccttttgggttgaaaggacttcggaatcggaattggagaagaacttgtgaagtgaagcccacntttttttttttttttggaaatgggagtttt

SEQ ID NO: 38964 - DNA, 101 bp, rice(Oryza sativa)
  misc_feature (71): n=t or c
tgcaacaaaggttttactgtttatctaatcttgaggattttaatgacatcgaatctctagccgatatatgntttaactatcggatcagtacttatcctatc

SEQ ID NO: 38965 - DNA, 101 bp, rice(Oryza sativa)
  misc_feature (71): n=a or g
tgatgcagactatggcgagtaactgacagatgtgatagaggaggcatatagagcagatcgagaggagcatntgcaggcatgcatcacatgccgtgctagct

SEQ ID NO: 38966 - DNA, 101 bp, rice(Oryza sativa)
  misc_feature (71): n=a or g
aatttattccccatttgggctcttggggagtttcgtcgtcgattggttctacgaaagaactgagcctcatnaaatgacataattatttgatgccgaacaaa

SEQ ID NO: 38967 - DNA, 101 bp, rice(Oryza sativa)
  misc_feature (71): n=a or g
ttcctcgacactgctcacccccgtcccctactatagttaggtgtctaatgtttctctctctcccttctacncaaaataataatcatcttattttggtaatg

SEQ ID NO: 38968 - DNA, 101 bp, rice(Oryza sativa)
  misc_feature (71): n=a or g
cattttcagaattaaagacgaactgtcccatattgttcaacatgtgacatattactatgtccgtctcaaanaaaatcaatttctggctacgaacttgatca

SEQ ID NO: 38969 - DNA, 101 bp, rice(Oryza sativa)
  misc_feature (71): n=a or g
ggtctagttctaactgaacccatactaggggagtaaaaatggaccgggtcagaggagtgagaatggtctgngtcaggtttgcatcggatccaatcacctta

SEQ ID NO: 38970 - DNA, 101 bp, rice(Oryza sativa)
  misc_feature (71): n=t or c
cattgtgaaatgaaggaaataagaaactataggatatggaagatatatataatatacttcctccgttttanaatataagtcattctagcattttctatatt

SEQ ID NO: 38971 - DNA, 101 bp, rice(Oryza sativa)
  misc_feature (71): n=t or c
cagcgtagctttgcgcgttgatacagtcgtatccttcggcgaacacaaaggacatctcgttgtacagctcntggcaccgcgcaagcaacggcttcgccttg

SEQ ID NO: 38972 - DNA, 101 bp, rice(Oryza sativa)
  misc_feature (71): n=t or c
caaggggggtgacggcgagcacattacgaagaactgcagagagaccatcatttctctgcaaaacagtcacngaattgcctgttaatggatgctgctgaacg

SEQ ID NO: 38973 - DNA, 101 bp, rice(Oryza sativa)
  misc_feature (71): n=t or c
aaatcagatgagacatatctggactcctgtgcagatacattgtacagaaaatatatctcgtttgattctanattattatgttttgggacgaaggtagtatt

SEQ ID NO: 38974 - DNA, 101 bp, rice(Oryza sativa)
  misc_feature (71): n=a or g
cagccatgcagttagatccgttcatacggtacatctgcagttcagctctagactgcagttcaaagtgttangatatatgtgtatataggtactactatata

SEQ ID NO: 38975 - DNA, 101 bp, rice(Oryza sativa)
  misc_feature (71): n=a or g
ttatgttgatcatcaatttacctttcttctctcttcgtcaacatatacttcaatcctctgacttgatgccngaattcaacctaatcacaccaacttaaaga

SEQ ID NO: 38976 - DNA, 101 bp, rice(Oryza sativa)
  misc_feature (71): n=a or g
ctatcactcgctctaccaaaaggcatcgcttgctcggagtcatgctaacgcgggaacgagcggattcggcnaggctagccaggggggtcaacgcgtcccgt

SEQ ID NO: 38977 - DNA, 101 bp, rice(Oryza sativa)
  misc_feature (71): n=a or g
gcgatctgcgccgtgacgacgtcgatggagtgcctctccagcacgtccacgatcatggtgagcacgccggngcgcctcgccacggacacgttgatgaaggc

SEQ ID NO: 38978 - DNA, 101 bp, rice(Oryza sativa)
  misc_feature (71): n=t or g
tggggtcggggccaatgcttcgttttggcttgatctatttcacaacaagtgaagtgggagattgacggttngtttacagactgcaatcagctcgggaaaaa

SEQ ID NO: 38979 - DNA, 101 bp, rice(Oryza sativa)
  misc_feature (71): n=t or c
caacctgttcaacaaatgcccccaatccagcaggtcacgcaaccaatccaacaaacaccaccaaatcggcnagttgtacagccgattcagcagacgccgtt

SEQ ID NO: 38980 - DNA, 101 bp, rice(Oryza sativa)
  misc_feature (71): n=a or g
gagtatggtaagtaggtttgaccaagttagtactatagtgtatggttctagccacaagttagtaatatgtngcaaagaggctaagatgtggcttcattttt

SEQ ID NO: 38981 - DNA, 101 bp, rice(Oryza sativa)
  misc_feature (71): n=t or c
atataacactgataaataagggcccgtctcgaatgcaagaaggaacaatttctccaagttttttttatctntaagggttgtattttctcctgctctattca

SEQ ID NO: 38982 - DNA, 101 bp, rice(Oryza sativa)
  misc_feature (71): n=a or g
ttcgaatgttcttcttctggaatttgcacctagtatcagctaattatgtgcgctgtattttgcccatgctnctgccatatgcaactggtgcctcttatccc

SEQ ID NO: 38983 - DNA, 101 bp, rice(Oryza sativa)
  misc_feature (71): n=t or c
atataatttttttgggccattttgtattagttttaatgtgtgtagttgaactaccgtgtcgcatgtgctcngtagttaatattttctaaaaccaaaggaca

SEQ ID NO: 38984 - DNA, 101 bp, rice(Oryza sativa)
  misc_feature (71): n=a or g
acaggatacaccctgcctcaaatcaaagcaaaaagggattcacgaatgaattatgttgtacttcaagcggntcaaatcaaaatgctcattataatgtactg

SEQ ID NO: 38985 - DNA, 101 bp, rice(Oryza sativa)
  misc_feature (71): n=t or g
caactacattgcctggagataattcaaccactggagaaaatttgtgatgctttttcagtttttcagtatantatggcagtaacctgtggcagcggtggagt

SEQ ID NO: 38986 - DNA, 101 bp, rice(Oryza sativa)
  misc_feature (71): n=a or g
cttaagcaaaacaagactttgtatctgcctcaattcacataaatacaaggtgctgttaaaataaaacgatncattgaaaatgttaatgaagaatacatgac

SEQ ID NO: 38987 - DNA, 101 bp, rice(Oryza sativa)
  misc_feature (71): n=a or g
aaaataatgaaaacgatgaaacaaatagcaataaaaaaagaaaatgtggggagagctagcgccagttggcncccgccatttctatgtgccaattaaaacga

SEQ ID NO: 38988 - DNA, 101 bp, rice(Oryza sativa)
  misc_feature (71): n=t or c
gttccctcaaagactttaggactaactgtagcaccagtcgtcactttttgtaggacttgataactgtcggntctgcatgtttctattctatggatgtttag

SEQ ID NO: 38989 - DNA, 101 bp, rice(Oryza sativa)
  misc_feature (71): n=a or g
tatttctctcacatacactagcgagcgaattagaaaacaccttatcaaagtagtggtggctcactactacnaaaaccatttttcgtggcggtcattttagg

SEQ ID NO: 38990 - DNA, 101 bp, rice(Oryza sativa)
  misc_feature (71): n=t or c
atacaggcaattaactattctgttttctttttttcacatactcgcgatcgatcgatccagtgctgaggaangagggaggcaacgagtacagtgtcgtgccc

SEQ ID NO: 38991 - DNA, 101 bp, rice(Oryza sativa)
  misc_feature (71): n=a or g
ttctccggcgacgccgccggtgccctggctgtcgtggctcgtcacatccaccgacagctcctgcttgaccnccgtgtcctgagacgacgggcacgccacgt

SEQ ID NO: 38992 - DNA, 101 bp, rice(Oryza sativa)
  misc_feature (71): n=a or g
aattacaaaatactgatactgtatcactgtaataacaaagcaagggccatgactacaacaatagtagtgtnattgtgagtacagtgtggtcactggtcagg

SEQ ID NO: 38993 - DNA, 101 bp, rice(Oryza sativa)
  misc_feature (71): n=t or c
agctatctatttaaattaaatctatcacttacaaaacgaagttatattcatatggcaagagtcagtacatnaatcaaaggcaaaatttgctacgggacatt

SEQ ID NO: 38994 - DNA, 101 bp, rice(Oryza sativa)
  misc_feature (71): n=t or c
ttgaaacgaatggatgtaatcaagtaagttggcttcggcacttgtcaatacgcaaatgctttgccgtacanggcaagcagtgcacgcacatgcagaatata

SEQ ID NO: 38995 - DNA, 101 bp, rice(Oryza sativa)
  misc_feature (71): n=a or c
tttgggctttttggcggtgttcatggaaagcggagctggtagattagctgtacgtagtaacgtaaaaggcngtaacgtaaggggctagaatagataggtgg

SEQ ID NO: 38996 - DNA, 101 bp, rice(Oryza sativa)
  misc_feature (71): n=a or g
caattattgtgattaaaatggttccatcaacttaattgattctgaattggactcatgcaagtattgttttnagcaagtttaattctgttcatatatttaat

SEQ ID NO: 38997 - DNA, 101 bp, rice(Oryza sativa)
  misc_feature (71): n=a or g
ctggttcgccgtctgggtgagcgccaacgccaacgagtccaggccggtcgtcatatggtacgcccacaacnacgaccactccgccgtggagggcgacgcca

SEQ ID NO: 38998 - DNA, 101 bp, rice(Oryza sativa)
  misc_feature (71): n=t or c
ttgcaatcctttttgttgttgagaaatggaggtcttacttgcagcatgccacttttgtaatactcactgancacaagagtttatctcatttgggggagcaa

SEQ ID NO: 38999 - DNA, 101 bp, rice(Oryza sativa)
  misc_feature (71): n=t or c
atccgactgagattatcgactacggtgacttcgactacgactacgacttcaacaactttgacgacttcgangatcttgatgaagacttcgacgacaactat

SEQ ID NO: 39000 - DNA, 101 bp, rice(Oryza sativa)
  misc_feature (71): n=t or c
ccccacgagcggtttttccgctcgttggcttgactcggacaggcgacggtgcaaatgtaaaaatgttaatnggaccggggaagtacttccctatgtaaaaa

SEQ ID NO: 39001 - DNA, 101 bp, rice(Oryza sativa)
  misc_feature (71): n=t or c
agctctaggtctagtatctttattttggagaatggaagtgctgttttgtagaaaaacttagcatcctgacnatgtaaaatatccagaagtggagctaactt

SEQ ID NO: 39002 - DNA, 101 bp, rice(Oryza sativa)
  misc_feature (71): n=t or c
gaaaataatctttcatcacttcacgaacaaaacaaagcttccttgcgctttaactctaagtaattattccntccgtttcatattataagtcgttttgactt

SEQ ID NO: 39003 - DNA, 101 bp, rice(Oryza sativa)
  misc_feature (71): n=a or g
aactcactccgccattaactccgtttcacctttttacggagagaagagcaagttcttctgctgctgcaatnctgtgtgcgccttccttgccgatgcgccat

SEQ ID NO: 39004 - DNA, 101 bp, rice(Oryza sativa)
  misc_feature (71): n=t or c
gtgttcacggccggggagtgctccttccacctacaacttcttcatccctgcggtgtcggtgttggacgccncgagatccatcgccatcgtaggaccgccgg

SEQ ID NO: 39005 - DNA, 101 bp, rice(Oryza sativa)
  misc_feature (71): n=t or c
aaataatagcgataaaaataccaaactaaaaccccttgaaatcaagggcagccccatcgtttggcatactngaggaaaaaacggaacggcatatttgcaaa

SEQ ID NO: 39006 - DNA, 101 bp, rice(Oryza sativa)
  misc_feature (71): n=a or g
accacccctacctgctgaaggaagaagaagaggcatcaccggcgccatccttttagccatgcagtttccantagcagtaaggaaggagaacagtggtggct

SEQ ID NO: 39007 - DNA, 101 bp, rice(Oryza sativa)
  misc_feature (71): n=a or g
ttcactaggaccattaactatagcatggcttttatttttcggtttttgctctgttcatgttctgcggtcangcattttagtaacttaacatgcagtttgta

SEQ ID NO: 39008 - DNA, 101 bp, rice(Oryza sativa)
  misc_feature (71): n=t or c
acctcgagcgtcttgacatttttaaatccgatggatagaaaataccgaaaaacctacatgaacgactgttnggatagaacgcgagaaaacattagaattag

SEQ ID NO: 39009 - DNA, 101 bp, rice(Oryza sativa)
  misc_feature (71): n=a or g
ttactgcccattccttccttccacttgcatacgaaaatgcattgccacaaaattttcttctagttgaaggnctatgaacattgattgacaaaactacagtc

SEQ ID NO: 39010 - DNA, 101 bp, rice(Oryza sativa)
  misc_feature (71): n=a or c
taaatatatctgaagttatgagaagctcgggaattgataccatcatgattgatcaaaaaacaagagggaanataaattagtcttgtaccaaaacaaccatt

SEQ ID NO: 39011 - DNA, 101 bp, rice(Oryza sativa)
  misc_feature (71): n=a or g
acgatgatgtacataggtgttttgattggagtacgatgtgtaaaaaattagggtggtgagatcagaagtgngtggtgcactttgcaaatgtgtatgtacta

SEQ ID NO: 39012 - DNA, 101 bp, rice(Oryza sativa)
  misc_feature (71): n=a or g
gttagtatcaactaaacctttttaaaacaataaaaaccttcttgtacttaggctgcgttcaggaggggttnggaacccctcatctccaacacgcaaaacga

SEQ ID NO: 39013 - DNA, 101 bp, rice(Oryza sativa)
  misc_feature (71): n=a or g
aatagagttgaaggcccaatatattcatatcaagttcaagtccagacctcattcggactccgttttcaacnttctatatatgtatggaaaactaacgagaa

SEQ ID NO: 39014 - DNA, 101 bp, rice(Oryza sativa)
  misc_feature (71): n=a or g
aagattgtaatctcacatgtacggttacggactatataaaccgaccaaaagcctgtagcaagacaggacanttttagataaagaaatattattcatcaaaa

SEQ ID NO: 39015 - DNA, 101 bp, rice(Oryza sativa)
  misc_feature (71): n=t or g
gttcttatgtgctcctaagacatctctcctctacagaggagaggaaaaaaagggcgtgggttgggagggcngtgctagcctcattggcgcgctcctctgcc

SEQ ID NO: 39016 - DNA, 101 bp, rice(Oryza sativa)
  misc_feature (71): n=t or c
gcaaaaaaaaagaatacaaaatggaagagggaattgctccttgaggggtgtttgtgaagtgaagtgagctnctctatttataccatccaaatgatggttgt

SEQ ID NO: 39017 - DNA, 101 bp, rice(Oryza sativa)
  misc_feature (71): n=a or g
tttttcaacttcagtccaccatgtgcagttatcccttgcatattatgtaaaggggctagctatatttaagncaccatattccatgtattctaataaaaact

SEQ ID NO: 39018 - DNA, 101 bp, rice(Oryza sativa)
  misc_feature (71): n=t or c
cttcccccccccccccccacgaaattctctctgatcgtcgcgttctagatgttttgggggggcgttttttnggaattacgcttggttttgggggggttgat

SEQ ID NO: 39019 - DNA, 101 bp, rice(Oryza sativa)
  misc_feature (71): n=t or c
tttattcataaattattttttatttgtaaatataccgttttcgcttattccaatgggtccgatagtactcnctctattccaaaattgatctacgtatttca

SEQ ID NO: 39020 - DNA, 101 bp, rice(Oryza sativa)
  misc_feature (71): n=t or c
aacttacattgtgaaacggaggaagtagtaaaacaatgcccaaaacgctgcagaaggtgaaccgatccatnttccatcgtattcccgtccaggcgtccgcg

SEQ ID NO: 39021 - DNA, 101 bp, rice(Oryza sativa)
  misc_feature (71): n=a or g
gtatttccagacattaggcaagcaaatcggagttattcagattagcattacttgagaagataggttacctnaagcagtttccggttgagcgtgaggtgatc

SEQ ID NO: 39022 - DNA, 101 bp, rice(Oryza sativa)
  misc_feature (71): n=t or c
gacaaggactatatatcatgtcattcgcgtcgcgtcacaatgacatagccagtgatgtggcaaattattgntgcctcactagtgtttacggcacacacaag

SEQ ID NO: 39023 - DNA, 101 bp, rice(Oryza sativa)
  misc_feature (71): n=t or c
acaaatacatcaatctgataataccagagaagaggatgcagtgtgaaacagaggtctgcatacattttcgncttatgaactcttatccatttttttaaact

SEQ ID NO: 39024 - DNA, 101 bp, rice(Oryza sativa)
  misc_feature (71): n=a or g
ctagctcggggcctaggactaggccgggctcaaggcagaccttagctcgttttcttaagatataggttttncaagtttctatgcccctcttgccaaggacc

SEQ ID NO: 39025 - DNA, 101 bp, rice(Oryza sativa)
  misc_feature (71): n=a or g
ctcttggtggaattggccaaactggtggaattggttgcaactctcttggtggtgcttttgacgttgcaccnaatttttggcatgccttacatgtcttaatg

SEQ ID NO: 39026 - DNA, 101 bp, rice(Oryza sativa)
  misc_feature (71): n=t or c
ttaattagtgctatcgaattgtgacaggactgcatctcctgagccgtagagtaacacaaagacaaaagtanatatgtagcagagcgtgcttaagctaatta

SEQ ID NO: 39027 - DNA, 101 bp, rice(Oryza sativa)
  misc_feature (71): n=t or c
aaaatcgaccaagaaaattgcagagattagacacttcttgtacgcgagcaaggtgttcgaccaatacttangagaaggcggaagccggtgaagttggtgag

SEQ ID NO: 39028 - DNA, 101 bp, rice(Oryza sativa)
  misc_feature (71): n=a or g
ggccacgtcaaaatagctatggtaattgttctgccttgccacatcatcttgaatagcgtgtgatgtgacantgttgttttgccatgttaggcggacgaaca

SEQ ID NO: 39029 - DNA, 101 bp, rice(Oryza sativa)
  misc_feature (71): n=t or c
ctttcagttgtaatcatactggttagtgtgcataaattttctagtgcattgccatgatagtttccagtatnactacaaaattgtaccaatcatgttctata

SEQ ID NO: 39030 - DNA, 101 bp, rice(Oryza sativa)
  misc_feature (71): n=a or g
tccactgttgtctagagggtcactagctagtctagaagctcggttatcattgctcctaggatcaagaggtntaggtcttgcgactaggtatcatctgcaat

SEQ ID NO: 39031 - DNA, 101 bp, rice(Oryza sativa)
  misc_feature (71): n=t or c
aaagcatcccgtattcacacagagcagaaccagcatcaccaccgtacactagaggtagaaatgaaccggcngtgttttggccgaaatacagcgaggtgccg

SEQ ID NO: 39032 - DNA, 101 bp, rice(Oryza sativa)
  misc_feature (71): n=t or g
aaacggcagatctctccaccatctgcctcacgattcccaaacaagaaaaaggtcaaccgtctaagagcagntacaatagcaggctataagccagctgcaaa

SEQ ID NO: 39033 - DNA, 101 bp, rice(Oryza sativa)
  misc_feature (71): n=a or g
cgttacaagatcactggaataccctcagctccaatgaatgaattgatgtaccttttttcttttgtgacccntttctgattttctgtcagcattacatttta

SEQ ID NO: 39034 - DNA, 101 bp, rice(Oryza sativa)
  misc_feature (71): n=a or g
cgtgacagcttcctaatgcagaatgctggaggaattcatcgtgataaaagatagggtgtgtttcgttcacnctaaaattggaagtttggttgaaattggaa

SEQ ID NO: 39035 - DNA, 101 bp, rice(Oryza sativa)
  misc_feature (71): n=t or g
ttacagtatatggtactgatgtggcattgcaacacgacccaccgatcagcaggtccaaagagataagggangcaaaatatattttgtttcagccatataag

SEQ ID NO: 39036 - DNA, 101 bp, rice(Oryza sativa)
  misc_feature (71): n=a or g
tatgttgatttgcttagctttaccatactgtgctgtcaccaactcaggtactggtgtagcctgcctcctcntatcacgtgcccatgagcacggctgcatca

SEQ ID NO: 39037 - DNA, 101 bp, rice(Oryza sativa)
  misc_feature (71): n=a or g
cgtcatgcatgcatatcctaagctggcagcgttttccatttcaaaacgcatgagacagttaactcttcatntaatgtttgatcattcatcgtctttgtata

SEQ ID NO: 39038 - DNA, 101 bp, rice(Oryza sativa)
  misc_feature (71): n=t or c
ccatcattccaaatttccattgcatatgcatatctctctaaatatatacagctagagaagactaatccaantgattgtaaaaaaaatgaatatggtcatct

SEQ ID NO: 39039 - DNA, 101 bp, rice(Oryza sativa)
  misc_feature (71): n=t or g
acttctgtgtggacaaacaaaagacagaaagttcaattagctactccgtaccatagtttgaaatgctccangattttgttaaaaaaaaacataaagcataa

SEQ ID NO: 39040 - DNA, 101 bp, rice(Oryza sativa)
  misc_feature (71): n=a or g
ggttcctccactgtccttggcatacaaaggataataatctaacagtcatcaaagtacaaagcaggacatcnaagtgcttagcaggacaaataatctaacgc

SEQ ID NO: 39041 - DNA, 101 bp, rice(Oryza sativa)
  misc_feature (71): n=t or c
tgagctgagacgtactgcgattgtgagtaggcgatagcaactctaatcatcttcatagtcgctcgtaaaangaagcatctaagagttgatactattttgaa

SEQ ID NO: 39042 - DNA, 101 bp, rice(Oryza sativa)
  misc_feature (71): n=t or g
gcttttatttcatgccaaaattcccttctcaagccaggctcaacagcacctcttgggccattttttttttnggggtttagcctaactagggcattacttgg

SEQ ID NO: 39043 - DNA, 101 bp, rice(Oryza sativa)
  misc_feature (71): n=a or c
attaaatgaagctggtatacaagtatgcttataaataaaagttcaacctaaaaataatttcctatacatgnaacgagcaaagttttgacagatagtgcata

SEQ ID NO: 39044 - DNA, 101 bp, rice(Oryza sativa)
  misc_feature (71): n=a or g
gaccacagctggactgggacatatatatactccctcgctccgtcctaaaataaaccatcctcgtattaagnggtgtttagatcaaagggtaaagggtgtaa

SEQ ID NO: 39045 - DNA, 101 bp, rice(Oryza sativa)
  misc_feature (71): n=a or g
gagggtgcacatgataggggcagaaggacaaggcagtaggagaggataatagtgaagacggacgtgtggancaggagctagagcaggtcaaccaagtgggc

SEQ ID NO: 39046 - DNA, 101 bp, rice(Oryza sativa)
  misc_feature (71): n=a or g
tcaaggatgaatgatctggtggtcccaatgtagaaactggcaccctccaaacccatatttggctctcaacncagtgacctccgggagacaacatgcatgga

SEQ ID NO: 39047 - DNA, 101 bp, rice(Oryza sativa)
  misc_feature (71): n=a or g
tcataacccacagaaaccggaaaagcataagaatctgaagcaccgtggtgacgccaggataatacacatcnatttcatcataattagcgttcttattacaa

SEQ ID NO: 39048 - DNA, 101 bp, rice(Oryza sativa)
  misc_feature (71): n=a or g
gtagcagcacttgctagaggtattaattgtgcaacaaacgtagcaaacatacaaatggctcctactctggngctccacctcactcaacctggacatgaacg

SEQ ID NO: 39049 - DNA, 101 bp, rice(Oryza sativa)
  misc_feature (71): n=t or c
caaaaatgttttcgaaattagatcaaacagatctggtgtgtgaccgtttaagttacagtcacactattgantgcatgagaccgaatccatcaattcatatg

SEQ ID NO: 39050 - DNA, 101 bp, rice(Oryza sativa)
  misc_feature (71): n=a or g
ggcttttcattgggaagttactcatcaaactatggtctaaaagaccaaaatgaaaggggtgaagtgaaccntccaaagaattttttctataatgggtaata

SEQ ID NO: 39051 - DNA, 101 bp, rice(Oryza sativa)
  misc_feature (71): n=t or c
tagtccattagctatcttcaatatgaaagatcttttggactgcttgcagttattcccaccagaagaatggntggttggagcatcactaccgtccaagtatg

SEQ ID NO: 39052 - DNA, 101 bp, rice(Oryza sativa)
  misc_feature (71): n=t or g
ggttcaaaatatcgatataaaagatggcccaaaatttacttttatagagaagtgatatgttcctaactttnaaagtcaaaacaacttttggtaggagtaca

SEQ ID NO: 39053 - DNA, 101 bp, rice(Oryza sativa)
  misc_feature (71): n=t or c
tcatgatgcagactcctcttttcaaccccgtgggttatatatgtactctcctaagcttgtctctttggatngctgctcagcttctctcctgttatagatgc

SEQ ID NO: 39054 - DNA, 101 bp, rice(Oryza sativa)
  misc_feature (71): n=t or c
gctcagagaagcaataaaggaataaaaatccaatgacatcaagccgtcaaagggcttcatctttttcttangcttatacttatcatccaagatttaaattt

SEQ ID NO: 39055 - DNA, 101 bp, rice(Oryza sativa)
  misc_feature (71): n=a or g
gaaactgcagagcaagaagataatggagtcagctaggaatgaatggttcaactcccagtaaaactaaacanctcatgtgtttccagaatggtctgacagct

SEQ ID NO: 39056 - DNA, 101 bp, rice(Oryza sativa)
  misc_feature (71): n=t or c
gaacaccactgctattaacattttttgtatagattgtataacccctagtatctcgagagtgccaggattcncctcactgtcggctcgaggtggggttggtg

SEQ ID NO: 39057 - DNA, 101 bp, rice(Oryza sativa)
  misc_feature (71): n=a or c
cttctagtcagagttttctttctattgcaataatagaaacgtaactcaaactggtacatccaccgataggngaaaattagtaaatttcacaaaactacaaa

SEQ ID NO: 39058 - DNA, 101 bp, rice(Oryza sativa)
  misc_feature (71): n=t or c
tgcaaaagcctacttgcaaaccaaccattctcgcgtgctcctctgatcctcacatgtaaattactcccttngtttcaggttataagatgttttaactttgg

SEQ ID NO: 39059 - DNA, 101 bp, rice(Oryza sativa)
  misc_feature (71): n=a or g
cacgtttttttgagtgtcatgtagtaaattttgccaattgaacttcataatgtcccgtaacatcagccccnaccggcctacatcaacacagatccaacggc

SEQ ID NO: 39060 - DNA, 101 bp, rice(Oryza sativa)
  misc_feature (71): n=t or g
actcactcagatgtgatgaatctcaagtcaacactactcaactcaactgacgagacgagacaactgctgcngttgagttgtttccttcttctatctatcta

SEQ ID NO: 39061 - DNA, 101 bp, rice(Oryza sativa)
  misc_feature (71): n=a or g
tatcaatcttttagtaagacacattgtcaagcgtttgaccgaaaatcaacagcgttatctacttaaaaaangataattctttttggaaagatattttttta

SEQ ID NO: 39062 - DNA, 101 bp, rice(Oryza sativa)
  misc_feature (71): n=t or g
aagtaaccgatatttatgttgatgctagctagggtatagtcttcacttttgggatttggttcaggtgcagnaccatccaagttgtatctaagggctgagat

SEQ ID NO: 39063 - DNA, 101 bp, rice(Oryza sativa)
  misc_feature (71): n=t or c
agcacaagttgcaagggtaatatacatggaattattgcatgagtggacgacgctacatatataatactatntctgtattttaatgtatgacgctgttgatt

SEQ ID NO: 39064 - DNA, 101 bp, rice(Oryza sativa)
  misc_feature (71): n=a or g
gtcctaaaataaattaatttaggaaatattttatctaaattcgttgttttagatactccatccatttcagnttataagacattttgactttggttaaaatt

SEQ ID NO: 39065 - DNA, 101 bp, rice(Oryza sativa)
  misc_feature (71): n=a or g
ctttgctcgataaataccataaagcacagaggtaggtattgcagtacggattttacttgttgctgtattantctccatgaaagtctcactttcgaaaatca

SEQ ID NO: 39066 - DNA, 101 bp, rice(Oryza sativa)
  misc_feature (71): n=a or g
tgttgaattttcgattgttaagtgtacaacatctaagttttttttaacgactcacgtaacatagtgcgaanttcatattgatacaaccctgataagtcgta

SEQ ID NO: 39067 - DNA, 101 bp, rice(Oryza sativa)
  misc_feature (71): n=a or g
tacattaggagattacccagaccagaaatatcaaatggtaactttataacaccgagggcaatggacaggangaggagccacagaggaaagatcttcatgca

SEQ ID NO: 39068 - DNA, 101 bp, rice(Oryza sativa)
  misc_feature (71): n=t or c
ttctgttgttaaccacaactagtagtccggttcaatcccttctgactagtaaggaagtactccttccgtcngtgaatataagggattctactatttgtttt

SEQ ID NO: 39069 - DNA, 101 bp, rice(Oryza sativa)
  misc_feature (71): n=t or c
aaaaaactcagataggtgccggatttttcaaccgacatcttacatgcgtcaccgatgtgaagaatcaaggntaccggtttgggaaccgatagctttaaggt

SEQ ID NO: 39070 - DNA, 101 bp, rice(Oryza sativa)
  misc_feature (71): n=a or g
ggacggacatgcatgataggtgcacacttaagtacctgacttggatcgagttgttttatgcatcaaccttncattatttgaggaaacttttttcatacctt

SEQ ID NO: 39071 - DNA, 101 bp, rice(Oryza sativa)
  misc_feature (71): n=a or c
cccccactttccccacggcaacatcccaatcccaatccaatccattcgtctccctcccccaatttcctccnattccaatcgaacgcctcgtctcctcacct

SEQ ID NO: 39072 - DNA, 101 bp, rice(Oryza sativa)
  misc_feature (71): n=t or g
ttttttttatgaaaaagatgagcgcccataataaaatacccttatttatgctgtacattgcagtgcagagntgtggtggacaaaaggtgagcgagttgctt

SEQ ID NO: 39073 - DNA, 101 bp, rice(Oryza sativa)
  misc_feature (71): n=a or c
tgacaaaccaataaaatatacacacatgcatgcaaccaataagtcctaagatgacttgttgagttgcagtnaacaatttaatttagcacatatacattaca

SEQ ID NO: 39074 - DNA, 101 bp, rice(Oryza sativa)
  misc_feature (71): n=a or g
catggtgttcttggcttgcaccatgaaggatttgaacatttgatacatgcgttctttagaaactcgctacnttccaggttgtggttggcacaggacggtct

SEQ ID NO: 39075 - DNA, 101 bp, rice(Oryza sativa)
  misc_feature (71): n=t or c
ttggaggggggccttctcccttctggtcgtaaaatccggtgagatggttaacaaatccagagtaattttgngccccccctccccccaaaaaaaatatattc

SEQ ID NO: 39076 - DNA, 101 bp, rice(Oryza sativa)
  misc_feature (71): n=a or g
ttaaattgagtatgatttattcctgttagttatctcatctattagttgagtgttaactgttagctgaattnctaggctctatctaagaagagaccattacg

SEQ ID NO: 39077 - DNA, 101 bp, rice(Oryza sativa)
  misc_feature (71): n=t or c
tcccagccgctatttcctcctctctatgtattcaaccataacactcttcgcggctgcttgaggcacttccntctctttcaattctatttatccaccacttg

SEQ ID NO: 39078 - DNA, 101 bp, rice(Oryza sativa)
  misc_feature (71): n=t or c
attaattatctttaaatatgagcacatgtgtcaactatagaagttaaatccggatgaactacttccaccangagaaacctaaccagttaagatacaattac

SEQ ID NO: 39079 - DNA, 101 bp, rice(Oryza sativa)
  misc_feature (71): n=t or c
tggcatgctaacaaaggactgtggtaagtccaattttgcattgtgtagtctggtctagcaattaaggtctncttaattctcctttaaggtgaacgttgcat

SEQ ID NO: 39080 - DNA, 101 bp, rice(Oryza sativa)
  misc_feature (71): n=a or c
tatcttttgtgtgtgtgcaaagtgaagtacttttaatactttgtgcctacttatggtcatgcacccccccnccttaccttcaagattgggatttttaaagc

SEQ ID NO: 39081 - DNA, 101 bp, rice(Oryza sativa)
  misc_feature (71): n=t or c
cccagaagaagtataaattagtaagcatatataatggaaggacgggtagcaatgctggaaaattatggganaatctattaaaaaaaatgaaagtaaaactt

SEQ ID NO: 39082 - DNA, 101 bp, rice(Oryza sativa)
  misc_feature (71): n=a or g
gcatggatatgatgcactcgatcgatcaggacgttgttactgccgggtccgacacttcggccgccatggtngagtggatggtggcggagctgatgaaccac

SEQ ID NO: 39083 - DNA, 101 bp, rice(Oryza sativa)
  misc_feature (71): n=a or g
tttctcttttttaccaatggatttgttgtgtttgtttgcaaacaattctcagcttcatcaacctcaggtangtccttctcctttggatcacttggtttcct

SEQ ID NO: 39084 - DNA, 101 bp, rice(Oryza sativa)
  misc_feature (71): n=t or c
tcctcataccatgcaaataccgtagtcaaacctaaaacgtccacacttgcctccaacactccttgttgtantggtaaagaaaatatcaatgattatattta

SEQ ID NO: 39085 - DNA, 101 bp, rice(Oryza sativa)
  misc_feature (71): n=a or c
agacaaaatggaagagaaagaacctgcgacatatgcatctgctttgattatctctctacttgtagcctaanaatgtccaggcatggcaaaagtgtcaatta

SEQ ID NO: 39086 - DNA, 101 bp, rice(Oryza sativa)
  misc_feature (71): n=a or g
ctgcacacgtccgagatctctgctattggtgccgtcgtactcgacacgtacaagattctacaagattcatnctaaaattaaaagtttagttgaaattaaag

SEQ ID NO: 39087 - DNA, 101 bp, rice(Oryza sativa)
  misc_feature (71): n=t or g
tttataaatataaccaaacaactttcattccccacgatccgatcatttgaaaatagcacacagttaaggtnagatggcaataatagaacagacatcttatt

SEQ ID NO: 39088 - DNA, 101 bp, rice(Oryza sativa)
  misc_feature (71): n=t or c
gatagagagagatcagacgggctagggtttcgcgtttcgttggaagaggcgggtggaaggggaggacgcgngagattggggatttttatctgccagtggaa

SEQ ID NO: 39089 - DNA, 101 bp, rice(Oryza sativa)
  misc_feature (71): n=a or c
taaaagtatgagcagatagttccagaccatagaggtaacggatattgtgtaattagcagatcatattcaantctgacatgaaaaacatatacaattgtgtt

SEQ ID NO: 39090 - DNA, 101 bp, rice(Oryza sativa)
  misc_feature (71): n=t or c
acctttgcatatctgaaatccaccctttctagtgcaaatgcttcgccggtaacccaaagaatggagtcgcngataccatcttcttcttcttcctcatcatc

SEQ ID NO: 39091 - DNA, 101 bp, rice(Oryza sativa)
  misc_feature (71): n=t or c
cctccttccttgcattgttgcctttcccaaaaactatttgcaaacgtattttcccaattgcatgtacttgntgtccaccaaaaccttgcagaggcactcct

SEQ ID NO: 39092 - DNA, 101 bp, rice(Oryza sativa)
  misc_feature (71): n=a or c
gcttcatctcttttagagctgaaacacaaccaaatagtttcagcttcataaaaaaagggcttcagcttcanaaaaaaaaaattaaactgattgaagtgctc

SEQ ID NO: 39093 - DNA, 101 bp, rice(Oryza sativa)
  misc_feature (71): n=a or g
agtgttatcaaagatgaggaggatggcatgaggtaccttaccggactatgggtggtgatcgtcatcgattngcaaagcaagcattgatagatctacaaaaa

SEQ ID NO: 39094 - DNA, 101 bp, rice(Oryza sativa)
  misc_feature (71): n=t or c
atccgcttatttgtattataattgggtttgcaggtctgtccacttgcatccttgatctaggttgatgattntagggtagagaccaaggtatcatccttgcc

SEQ ID NO: 39095 - DNA, 101 bp, rice(Oryza sativa)
  misc_feature (71): n=t or c
aagaagaaaaattcgggagttgtatatgaagtaaagcatggttagtatcaagtcaacataaagatcattantggaaattgttgttgaggtaaatttagtta

SEQ ID NO: 39096 - DNA, 101 bp, rice(Oryza sativa)
  misc_feature (71): n=a or g
ttttttaatataatggaatagaataataaaaaaaagctaactggcttgaaagtccagttagctaggattantatagttaattactagcctttaattgatgt

SEQ ID NO: 39097 - DNA, 101 bp, rice(Oryza sativa)
  misc_feature (71): n=a or c
atgatcagtgaaaaaactaaattttctttgggacagaggtagtaggtccgaatgcctaacatactcgtgancctgcatgcccacgtggtgggcgtgcagtt

SEQ ID NO: 39098 - DNA, 101 bp, rice(Oryza sativa)
  misc_feature (71): n=t or c
tcttctgactttttgtttgggctgacagttggactttttgtttgggctggacttgcctttatgttttcttngggcttaagttgggcttcttctaggttggg

SEQ ID NO: 39099 - DNA, 101 bp, rice(Oryza sativa)
  misc_feature (71): n=t or c
gctcgagaccccaccgccatcataatggatccgccctcctcgcgacgtggacctcctcgcctgctcttgcntcgctcgacacgccgacgccacgacaaaca

SEQ ID NO: 39100 - DNA, 101 bp, rice(Oryza sativa)
  misc_feature (71): n=a or g
taccaactttatatttctcacatacttcacaagcctccatttctaaaaagtgtaatgactaatgattcccntaagctaacagacaggtgcttccaaaatat

SEQ ID NO: 39101 - DNA, 101 bp, rice(Oryza sativa)
  misc_feature (71): n=t or c
tctgccatcctcatattattattacctttactaacaattcaacattgatctgcctccaaaatctttgatanttcctctcatatgctaatgctcagattcac

SEQ ID NO: 39102 - DNA, 101 bp, rice(Oryza sativa)
  misc_feature (71): n=t or c
tcggtaggcccggccgaaggtcctcgtggtatacctccaacaacaatagttgggtgatgactacttgtcangaccggaattaacccaacgggcattccttt

SEQ ID NO: 39103 - DNA, 101 bp, rice(Oryza sativa)
  misc_feature (71): n=t or c
gtctcccagtaaaaaaaaagtccgcttgtatttttagcacagggtatttttttttccgatttttgttgcangcgaaagagttttgtatgctcacacgcaag

SEQ ID NO: 39104 - DNA, 101 bp, rice(Oryza sativa)
  misc_feature (71): n=t or c
ccaactggatgagttgggcccaataccattttcagacctgggcgccagagtgaccttgaatttgctactcncagttatgaacagaagtatttctccacagc

SEQ ID NO: 39105 - DNA, 101 bp, rice(Oryza sativa)
  misc_feature (71): n=t or c
caccttgttgtatgtgcctcgatacacgccgacgctagcgaaatttatcttgtgatgttgtgattcccaangatctactcccgcgtatttctcacaccgta

SEQ ID NO: 39106 - DNA, 101 bp, rice(Oryza sativa)
  misc_feature (71): n=a or g
atattaaccacgaactatggattttaattgaaaccacgtgaattgcaaacatagaagaatgctccacgtcnctccaaaaggaaatcccaagccgcaaccga

SEQ ID NO: 39107 - DNA, 101 bp, rice(Oryza sativa)
  misc_feature (71): n=a or g
tttgaatataatagatcattgggttttctgaacctcgcaccaaatgtaaagaggttcaaaatgcttaaggnaaaaaaaagctgaatgtatacttctgctta

SEQ ID NO: 39108 - DNA, 101 bp, rice(Oryza sativa)
  misc_feature (71): n=a or g
tcaataatgacatcatttacaccagttcgtacgtcatataattcacagtaatgaactagcatgtagtctcntacaaacatagccaaaccatatgatcgagt

SEQ ID NO: 39109 - DNA, 101 bp, rice(Oryza sativa)
  misc_feature (71): n=a or g
ttgctatgctgaattgctgatgctgacacttgtagatgactagagaaacatcagcaacacatggttggcgnccaagaaaccctgcactgcaaagcagcttc

SEQ ID NO: 39110 - DNA, 101 bp, rice(Oryza sativa)
  misc_feature (71): n=a or g
atttcaaaaataaaaaatgcaagttgtttttaatttccctttgtgtatgctccctctttctatttgaatcngtgtcatatttatttttgaaagaatacaaa

SEQ ID NO: 39111 - DNA, 101 bp, rice(Oryza sativa)
  misc_feature (71): n=a or g
caaaagctgaaccaagcacacctcgctgcgaggaccaaacatgtcttttcgattgcccaagcaaaagatanagatagaactaaacaaactttaaaatatga

SEQ ID NO: 39112 - DNA, 101 bp, rice(Oryza sativa)
  misc_feature (71): n=t or c
gatgtggcattgtaagcaaaatataaagtaggagtataaattatttttaaaatatgggcccacatgccagncagacaaaaggaaaaataaaaataggaccc

SEQ ID NO: 39113 - DNA, 101 bp, rice(Oryza sativa)
  misc_feature (71): n=t or c
ctgtcaataacccaaatcggagtcgttctctctcttctcccagcaaccagttggaattggattctaacacnggtcctacaagaagcaggcgtgcagtctgg

SEQ ID NO: 39114 - DNA, 101 bp, rice(Oryza sativa)
  misc_feature (71): n=t or c
agtgagtggctgtttggtgcgggtaaactttgtcttggtgtgtgtagcaagacagacgggaacgtcgcaangacgtgggtggggggctttgcttgcgttca

SEQ ID NO: 39115 - DNA, 101 bp, rice(Oryza sativa)
  misc_feature (71): n=a or g
tcaggtaagctcaactctgaatctttcacatcatgttttttcatctcttgctcaggttcaacaggcagcanctcgaacgactttgatgaagctccacaaag

SEQ ID NO: 39116 - DNA, 101 bp, rice(Oryza sativa)
  misc_feature (71): n=a or g
cacaaaaataggtcatcaacaaaatgttactgccagtagcaaaccaaccacaaccagaagactgatctgangcagcagcatgagtaatcaggcctgtcctg

SEQ ID NO: 39117 - DNA, 101 bp, rice(Oryza sativa)
  misc_feature (71): n=t or c
tactactaccaagagcttggagctacatacagatatgacaagaaaacagattacatgcatgctaatgtganagtaatactgctcccacggcaaatgccagc

SEQ ID NO: 39118 - DNA, 101 bp, rice(Oryza sativa)
  misc_feature (71): n=t or c
tatatataaccatcatatgcggtgtcggaccatataattacttttaacagtagatttcagcttaataaggncttatttagttggggaaaatttttaggttt

SEQ ID NO: 39119 - DNA, 101 bp, rice(Oryza sativa)
  misc_feature (71): n=t or c
aaagagaaatgggactgacacaatccaagtgaggaggtttcattctctaacaaccatatacaatgagttgntttatgatggagagtatcagtcgaaccatg

SEQ ID NO: 39120 - DNA, 101 bp, rice(Oryza sativa)
  misc_feature (71): n=a or g
taggccctttatatagactgaagatttttttcttataaaaactcggaccttattgggccaaaactaagagntcataagataagacactatcaatcccatgc

SEQ ID NO: 39121 - DNA, 101 bp, rice(Oryza sativa)
  misc_feature (71): n=t or c
tgacctcgacattggcctgccttcctgtgagctggctcccgtgcaacatttggcctttttttttcttcttngttgcaattgatctagacttcggaccagca

SEQ ID NO: 39122 - DNA, 101 bp, rice(Oryza sativa)
  misc_feature (71): n=a or g
cctaggatggatctcatcccatcctaggttgctatattacgagtcatgtctagatacattgtcctataatngattccatcccatcctagattgctatatta

SEQ ID NO: 39123 - DNA, 101 bp, rice(Oryza sativa)
  misc_feature (71): n=a or g
gccatctgtttctgatggagttgttgggcgctgcatgcagcgttgagaggccggacaccatctggaagccnatcagcaagccgtcggcgccacgggaggag

SEQ ID NO: 39124 - DNA, 101 bp, rice(Oryza sativa)
  misc_feature (71): n=a or g
aaagcgcagaactcttcaaattaaatcaactttattgcttctaaatgaggaagctccgaacgccgctttcnagggataagacccacaccctgtgcaaggca

SEQ ID NO: 39125 - DNA, 101 bp, rice(Oryza sativa)
  misc_feature (71): n=t or g
attgagcagtcacttcgtaatcagcagcggttgaatgcttcttgtttttgtgtagaagtcgcctttttacnggacaaactcttctcgctagaaatcatctc

SEQ ID NO: 39126 - DNA, 101 bp, rice(Oryza sativa)
  misc_feature (71): n=t or c
atcgtttcccttcttgaaggcgtcgttctggcgttgacctctcctggcaccaagaaccttccctgtgcaangggtcattggtggactcctgcattgcctct

SEQ ID NO: 39127 - DNA, 101 bp, rice(Oryza sativa)
  misc_feature (71): n=a or g
accaaaatcaaataccttattaatgaaagaataaacagaagaagttagcaataaaataaccggaacgatcngatgccaagaaacggtcaaaagaggcccta

SEQ ID NO: 39128 - DNA, 101 bp, rice(Oryza sativa)
  misc_feature (71): n=a or g
gggttgcacgcttgcacggataagttgggctgtaaacctgtaaagtgtgtgtagggttttggatgggcccngcccataaagtgagcggtgggctcaacggg

SEQ ID NO: 39129 - DNA, 101 bp, rice(Oryza sativa)
  misc_feature (71): n=t or g
atctggaaagatgacaaacccaatacaggatgaaaacgctgtaccaccacgtaccaattcaactctctctnttccatgtccaccatcaaggctaaaacctc

SEQ ID NO: 39130 - DNA, 101 bp, rice(Oryza sativa)
  misc_feature (71): n=t or g
atacagtaattgtttaaatctgtatttatgctcttcggccacatatgacgaactggacatttaaacatganaatgacattagaaggtagggggtatgtttc

SEQ ID NO: 39131 - DNA, 101 bp, rice(Oryza sativa)
  misc_feature (71): n=t or c
gtagtatggatgcctgatttcgctgatttcgagagaaaaaacgcaacgcaacaaacagcggcgggaaaacnggaaaataaaaaaaaccgcgacggaagaaa

SEQ ID NO: 39132 - DNA, 101 bp, rice(Oryza sativa)
  misc_feature (71): n=t or g
taaagagaaagaatgagcaatctagtgaagtcatgtaaaaaagtggtacccctaccattaatttaatcaantgtctcctgataaataaccatatttttata

SEQ ID NO: 39133 - DNA, 101 bp, rice(Oryza sativa)
  misc_feature (71): n=t or c
gatattggagccttcgtgacattttaacaaaaccatggttttaaaactacggctatacaagccttaaatantttcattttaattcaacacaatgtgcagcg

SEQ ID NO: 39134 - DNA, 101 bp, rice(Oryza sativa)
  misc_feature (71): n=t or c
tacaggtagtggactgatgcgaacacacgtccggtcatccggtcaaggccggtcgcctcactattctttgngtacaagttaatttcgcagccgatatccct

SEQ ID NO: 39135 - DNA, 101 bp, rice(Oryza sativa)
  misc_feature (71): n=t or g
gtaaaactaaattatttttagctttgttttgtcagtgctaaatatggtgattgatgcgatccgtaactttngttattgcaatgtaagatagcaattgatat

SEQ ID NO: 39136 - DNA, 101 bp, rice(Oryza sativa)
  misc_feature (71): n=a or g
accggcgtcgttgatttttctatctttgagcatgtgttaggggtataatttacatacgtgtgagtgtggcnttacatctttagtgttgagcatttatgtgt

SEQ ID NO: 39137 - DNA, 101 bp, rice(Oryza sativa)
  misc_feature (71): n=a or g
tattcattaggagaggtcacatcccacatttttttcagagagagactagaggacaagatcctgttaggacnggatacttaaagtgactcctcccctttctt

SEQ ID NO: 39138 - DNA, 101 bp, rice(Oryza sativa)
  misc_feature (71): n=t or c
gtaatggtacaaaaccctaattaaacaatcacgatctcagaggcaccgtcccaactttcgtaccaactttngactctggccctgaaaaccacataatctac

SEQ ID NO: 39139 - DNA, 101 bp, rice(Oryza sativa)
  misc_feature (71): n=t or c
ttaattggataattccaaaggcgctccgatgtaaaccaaaaatcttacacattgatttcatgtattattgngaccatagatactgttgagagtttgtaata

SEQ ID NO: 39140 - DNA, 101 bp, rice(Oryza sativa)
  misc_feature (71): n=t or c
gtatcaaaatataagaacttagtagtattgaatatgacacgtcctaggactactaatctggacatgacacnaggatatgtcttatccagtattaggctaac

SEQ ID NO: 39141 - DNA, 101 bp, rice(Oryza sativa)
  misc_feature (71): n=a or g
ttgaccaccacatcattgcaaggggagctcgattgattcgcaaattggactgacttcaaacttttcaaccngattaatagtcaacgactttgatagccttt

SEQ ID NO: 39142 - DNA, 101 bp, rice(Oryza sativa)
  misc_feature (71): n=a or g
aatctacacatttatctcatctgttattttggtcattagttgaggcaattgagtcttctgattacggaacnctttttgtttcgttggcaccagattcccca

SEQ ID NO: 39143 - DNA, 101 bp, rice(Oryza sativa)
  misc_feature (71): n=a or c
aactttgaaatttcaaacctttgtacaaactaggggtcactatattgcacatgtcaagctgcaataatgcntgttatttttcttctcagaccacagtaaca

SEQ ID NO: 39144 - DNA, 101 bp, rice(Oryza sativa)
  misc_feature (71): n=t or c
aaacacttgtctaacatgtgaagttggacgtagccatgccactcaagattaacgtcgatcacaattttaangtctagctcactatctacaccattataaaa

SEQ ID NO: 39145 - DNA, 101 bp, rice(Oryza sativa)
  misc_feature (71): n=t or g
gtctttttcgtggaaattgtagctgatgcgtccgtctgccgctcgacaaattttcaatcagcaacaaaaangatttgatactactgaaattaaggaactaa

SEQ ID NO: 39146 - DNA, 101 bp, rice(Oryza sativa)
  misc_feature (71): n=t or c
tttcatgaagatttttacataatttgtggttatatatttcctctcaacaacatttgttgtatgcatgctanacccttttcgtcgttctcttctgtgaatga

SEQ ID NO: 39147 - DNA, 101 bp, rice(Oryza sativa)
  misc_feature (71): n=t or c
agacagagggattactacccatggggccttgcctgcccaatggcgagcgacgtgtacaccgtatttgccgnaggtgtagtactccctcgtctcaaaaaaaa

SEQ ID NO: 39148 - DNA, 101 bp, rice(Oryza sativa)
  misc_feature (71): n=t or g
agtatcttccgacaaattacaagtatttgcgatgtccactaccaaattacaaaaattcgagtatcctatanaaaattttgcctaattatgcccatacaaaa

SEQ ID NO: 39149 - DNA, 101 bp, rice(Oryza sativa)
  misc_feature (71): n=t or c
aaaacgacaagtattatcaacccggagggagtacttagtatagactatttgaactgatgctagtactttgngcagatatggagtcagctattcctgtacag

SEQ ID NO: 39150 - DNA, 101 bp, rice(Oryza sativa)
  misc_feature (71): n=t or g
tgtagcatctagtagctgacaaagccagtctggaccagaacaaaatgagcattccaggacatgtcacgttngttctagcatgaatctgcttcatgtattgg

SEQ ID NO: 39151 - DNA, 101 bp, rice(Oryza sativa)
  misc_feature (71): n=t or c
ttcaccctctccgtttgtccatcaatttggggatgataagaagtactaaacctcaattgcaccttttttgntttaaagatttcttgaaaaaactcactagt

SEQ ID NO: 39152 - DNA, 101 bp, rice(Oryza sativa)
  misc_feature (71): n=a or g
cctgccaagccagcattttgaagacatcatagctaggctgtcgtgcgtccaaaaatatagcaatgttggcnaaataaaatagtcacaaaccaacaacatag

SEQ ID NO: 39153 - DNA, 101 bp, rice(Oryza sativa)
  misc_feature (71): n=a or g
tgctccaaaaatttttacatgtttgaaaaatgagtatatggtattgccaccacaccatatttacatgtttnaaaattttgattttgaatttgaattgtgta

SEQ ID NO: 39154 - DNA, 101 bp, rice(Oryza sativa)
  misc_feature (71): n=t or c
aaaataataagctgaatacacaaagacacaaatgatatcatagaagtatcggaaaaaacatgtatatatgnctattattgtctgaaatatgacaaatagtc

SEQ ID NO: 39155 - DNA, 101 bp, rice(Oryza sativa)
  misc_feature (71): n=a or g
agtgctctttttaaataatgtatgattgagagttgaaggatggttgatgatagaatagggagaatatttgnttgtcagatgattaatatgataagttgtac

SEQ ID NO: 39156 - DNA, 101 bp, rice(Oryza sativa)
  misc_feature (71): n=t or c
ccgttgccagccgcccaggcgagctttgcctcagccgccgccgtcgcctgagcaagctccgtctcctcaangccattgtggctgccatggggacgccgcac

SEQ ID NO: 39157 - DNA, 101 bp, rice(Oryza sativa)
  misc_feature (71): n=t or c
tcaacctggcatctgtttgtgatgcattcaatcatatatttgtactgcaatgtgccattctgtcattcttntgggctcttatctatttgtgctgcaataat

SEQ ID NO: 39158 - DNA, 101 bp, rice(Oryza sativa)
  misc_feature (71): n=t or c
acactacagagtcgtactgtattcaaatacaccgtgctcccggttaaggagatatgtcatcaaggtgattnctactcctgaagtataagtagttttaaaat

SEQ ID NO: 39159 - DNA, 101 bp, rice(Oryza sativa)
  misc_feature (71): n=a or c
cattctcccctaacctttcgctttccggtctttcgagatgaaaacaaatttgaaattactacatccgtccnaaaataagtaacgtccgtcttattaaaaaa

SEQ ID NO: 39160 - DNA, 101 bp, rice(Oryza sativa)
  misc_feature (71): n=a or g
cccatgaggatatgatgtctgctctagaccgaatgcgccagaaatgcaaacgtattatgcgcgcggcatcntgcaggcatgcatcagacatgcaccgtccc

SEQ ID NO: 39161 - DNA, 101 bp, rice(Oryza sativa)
  misc_feature (71): n=t or c
ccaccaccccggggggggcttctgtacgcgggcgctgcgtgctttgagataggtgaaacggctgtggttgnagcgatgcggaggcgtccgcggccaaccaa

SEQ ID NO: 39162 - DNA, 101 bp, rice(Oryza sativa)
  misc_feature (71): n=t or c
ttttctgcatatttctatatgcattttttttcaaggcagcgtatcgtatgcacacagctaggtagatgcantcatgcacacacccatcctgagcctttgga

SEQ ID NO: 39163 - DNA, 101 bp, rice(Oryza sativa)
  misc_feature (71): n=t or c
cttcgtcagcctacaaagcacagtgtattagcgcgcctaatacaacatttgactcgttgatttggaaagtntgggcagctagaaaatgcaaactccatgct

SEQ ID NO: 39164 - DNA, 101 bp, rice(Oryza sativa)
  misc_feature (71): n=a or c
ttgttaaagtcatttttagtctgtagtgatgcacgaataataagtatcagtagaaaaatgactttaacagntgtgtttggggttggtaaacatgctgctgg

SEQ ID NO: 39165 - DNA, 101 bp, rice(Oryza sativa)
  misc_feature (71): n=t or c
tattgcccagcaccacaggatatgaaatatggtaactcacaacccgcaaatcgctgcctgctggtgtaatnaagtaatcgacatacttcctgtaagcacat

SEQ ID NO: 39166 - DNA, 101 bp, rice(Oryza sativa)
  misc_feature (71): n=t or c
ctgggtaaagtctttcactgatttccttgaatgcctcttaaaatgcgagggtttggttccaacaagaaganctcttaggatgcgttctaaagagctctttt

SEQ ID NO: 39167 - DNA, 101 bp, rice(Oryza sativa)
  misc_feature (71): n=a or c
gaaggtttattatgttatggttcactttcaaatgcttagtccctttaccataaagtacttagcagtttgcnatgttgattttgtaggagaatccatcagat

SEQ ID NO: 39168 - DNA, 101 bp, rice(Oryza sativa)
  misc_feature (71): n=a or g
gattgagatttaacatgttatattctgaaatgagtattaaatgttcgtatttgttccccgcaaaaaaaatnttcgaatttgttatattttaagatggtgta

SEQ ID NO: 39169 - DNA, 101 bp, rice(Oryza sativa)
  misc_feature (71): n=t or c
tgtcctgcactgaggccctgtttagttagtaaaaaaaaaagttttggctttatgtgccacatcgaatatanagacacacatttgaagtattaaacgtagtc

SEQ ID NO: 39170 - DNA, 101 bp, rice(Oryza sativa)
  misc_feature (71): n=t or c
caacaaaggaacacagacgagatcgcccaaaagaacactctcacaaccaacacaaagccaactcctagagngtgcttgcaccaatcgatcgagaggcttcg

SEQ ID NO: 39171 - DNA, 101 bp, rice(Oryza sativa)
  misc_feature (71): n=t or c
cgaccgcaccttccacctggtccatctcatccccggccaccgacgctcaagcggagatgttggccacaagngccctgattgcgactgtgaaccacgaactc

SEQ ID NO: 39172 - DNA, 101 bp, rice(Oryza sativa)
  misc_feature (71): n=t or c
attccaggtgacattacccttttacaacgatttgtgtttcaacctctcacgcaaccaaccttctagtgagnggttgaagttccttggtgctatggaattat

SEQ ID NO: 39173 - DNA, 101 bp, rice(Oryza sativa)
  misc_feature (71): n=t or c
gctgcttctcgccgccggcgctccgggcgtacttcgccgagttcttctccaccttcctctttgtgttcatngccgtcggctccaccatctccgcccgtaag

SEQ ID NO: 39174 - DNA, 101 bp, rice(Oryza sativa)
  misc_feature (71): n=a or g
ccctttacttccatagaaaaggttaattaagttttcttttcttttctatcgctgactataattagcacatnctccttctgttttaaaataaaccaacttat

SEQ ID NO: 39175 - DNA, 101 bp, rice(Oryza sativa)
  misc_feature (71): n=t or c
ttttttcttgctttccgatcaagtgttcttgaaaactgcatgcttggttgttagaccatagaggcatagancattgataggatgtatgatcaccgaccctt

SEQ ID NO: 39176 - DNA, 101 bp, rice(Oryza sativa)
  misc_feature (71): n=a or c
caagatagaacttgtgaggtctactgttattggggattctttttgggtggggtgggggcaatgttatgtantggagtaaaattttgttctttgtgcggcgg

SEQ ID NO: 39177 - DNA, 101 bp, rice(Oryza sativa)
  misc_feature (71): n=a or g
ggcccgttgtcaagcggcgtatggccggtgccgtctagtcacatcaccataataagaaatccctcgccccntgtgcaagccggagataatttcctactcta

SEQ ID NO: 39178 - DNA, 101 bp, rice(Oryza sativa)
  misc_feature (71): n=t or c
gagatcatcccaactatctgtctgtctcctcatttggaagaagattttttggcttggcacccagataaganaggccggttctcagtgcggagtgcctacag

SEQ ID NO: 39179 - DNA, 101 bp, rice(Oryza sativa)
  misc_feature (71): n=t or g
gggagtagtcaagttagatttgttacgataactttttcttgaatagaagatttgatgcataggtgggagtntgtgtgtgtgtgtgtgtgtgtgtatgcaca

SEQ ID NO: 39180 - DNA, 101 bp, rice(Oryza sativa)
  misc_feature (71): n=t or c
acttcgtcatcatagccggctatctctattgccgcaaatcatcatttccatcggatgtgtttgtcgtcgcngactattttcttcatcttcatgattgatag

SEQ ID NO: 39181 - DNA, 101 bp, rice(Oryza sativa)
  misc_feature (71): n=a or g
gacaaatccaccgatctgattacaagatctgcagacttttttgacttcatgataagctctgcgtttggccngtcattatacgagatctgattcacaagatc

SEQ ID NO: 39182 - DNA, 101 bp, rice(Oryza sativa)
  misc_feature (71): n=t or c
tctctcccatcagctctcctcgtgctgccttcaccgccgagacgaaatcccttgaatcaccggattttgtncccttccagatcccacccctcccaccgatg

SEQ ID NO: 39183 - DNA, 101 bp, rice(Oryza sativa)
  misc_feature (71): n=t or c
accaatataatttatttaaaaaagcctaatttcagatgtttgcatcattcaaaatttcaacgcttcaaagntagtactacgaatccagagaactgtaattg

SEQ ID NO: 39184 - DNA, 101 bp, rice(Oryza sativa)
  misc_feature (71): n=t or c
cagcacccggacggctcgacaactggcgatggcctgacttgtaaggcacgccggttttgacttggaggcgntgtcacggcatgtacgtagacggcgtcctt

SEQ ID NO: 39185 - DNA, 101 bp, rice(Oryza sativa)
  misc_feature (71): n=t or c
gcaaagaaaaaaagaaaagaataaatcctttatataaaaaaagagaaaaatcaaccgatttggattggctngcggcggtgatgctcctgcaggatgccacg

SEQ ID NO: 39186 - DNA, 101 bp, rice(Oryza sativa)
  misc_feature (71): n=a or g
gttcaacaccgatggagcctcgtctcaagttgaccaagacgagcacagcggcgctggtggatgccacccantaccgtagcatcgtcggctgtctgcggtat

SEQ ID NO: 39187 - DNA, 101 bp, rice(Oryza sativa)
  misc_feature (71): n=t or g
ccttttgctatgtaaacttagtcttattcagtttggcaaaggattacatttgccacattaactgatcaaanatattttccttttgcaacattaaacatgca

SEQ ID NO: 39188 - DNA, 101 bp, rice(Oryza sativa)
  misc_feature (71): n=a or g
tacactctcgcatgtcttagcccggttcaaccgatagcagtttattgtccgtttcacctcaaaaccagccngttcaagcggttcaaaccggttcgattaca

SEQ ID NO: 39189 - DNA, 101 bp, rice(Oryza sativa)
  misc_feature (71): n=t or c
gcaagagcgattatgttgtgttgttaccgtgctctctcatgtggtatgtagagcaccatccttttcaaaangatatctcactcatagaacataaaggtcgt

SEQ ID NO: 39190 - DNA, 101 bp, rice(Oryza sativa)
  misc_feature (71): n=a or g
cagccgtggaggcgcttgtggaggttgatggtgtactccctcgtcaccactagggctgggcaaaaagctcnaagctcgttagggctgggcaaaaagctcga

SEQ ID NO: 39191 - DNA, 101 bp, rice(Oryza sativa)
  misc_feature (71): n=a or g
cgatcaacactggcagacacgctacacatatgtatatatatctccatctaggttggcagctgttgcttcgntgttcgtcttattactttaatagtattttt

SEQ ID NO: 39192 - DNA, 101 bp, rice(Oryza sativa)
  misc_feature (71): n=t or c
tgaaccgtcgggcatctcgtccgcgtgggacggcgtttttggttttcgtggaagttctgagaaattgatcncgtgatgatagagttcttagaaattggata

SEQ ID NO: 39193 - DNA, 101 bp, rice(Oryza sativa)
  misc_feature (71): n=t or g
gcagcacgggattttgcagaaatgcaggtgattttttatcttattttgcaggatttgaagatgatttcttncttacctgtagttggtgtgagcaccggcgc

SEQ ID NO: 39194 - DNA, 101 bp, rice(Oryza sativa)
  misc_feature (71): n=t or g
gtatcggcttccaccctcctcgtggatcttcccgtgaccagatctgaggctggccataggaggaggggggnggggggggggagagctccatgaagaagagg

SEQ ID NO: 39195 - DNA, 101 bp, rice(Oryza sativa)
  misc_feature (71): n=a or c
aaactcgaccatagtgagaggacatgatgtgaactttttttcaacgaataatggttggacggcccagcagnttcagttcaggtgacaccagggacacgcac

SEQ ID NO: 39196 - DNA, 101 bp, rice(Oryza sativa)
  misc_feature (71): n=a or g
tttagaatggtcgaattgtttaagttttgtttagtttgttttagtatttactaagaagtttgatattaccnaaatttgataacgttacaagcttacaaatg

SEQ ID NO: 39197 - DNA, 101 bp, rice(Oryza sativa)
  misc_feature (71): n=t or c
cactactattcgtgtgttcgtaaccatgtcattgcaataactgcaaaattagatcataccattttatacgnataggattatcttttgaataatttttgcta

SEQ ID NO: 39198 - DNA, 101 bp, rice(Oryza sativa)
  misc_feature (71): n=a or c
agagaagttgttctggaagagaaacgaaattatattccaatgcctataattgaagaacccgttttctcaanacatactcatgttgcaccttcaatagaaag

SEQ ID NO: 39199 - DNA, 101 bp, rice(Oryza sativa)
  misc_feature (71): n=a or c
gcttgctgccattggaaaatctgaagagataaacaagtacaccctagtcccaaaataaaccaatttttcangtcctaagtacatttatactagtggttgcg

SEQ ID NO: 39200 - DNA, 101 bp, rice(Oryza sativa)
  misc_feature (71): n=a or g
tacacatccaaccactctggatggaacagaccaacaaccctagtaaaatgacttaaacgaagacatatggnctgtttggatacccaccttaatttaccaca

SEQ ID NO: 39201 - DNA, 101 bp, rice(Oryza sativa)
  misc_feature (71): n=a or c
tatttttcctgagaaatcagatttgccagctgttcaattattcgggaatgccatgttataaaataagaaanatatatacaagagaagatctgctgcaatta

SEQ ID NO: 39202 - DNA, 101 bp, rice(Oryza sativa)
  misc_feature (71): n=a or g
gggctttcaacgcagccgccggcgaggctactaatctgagttcagttggattaagaactaacaaaacgcanaaaatgattttagatcgataatgttctgct

SEQ ID NO: 39203 - DNA, 101 bp, rice(Oryza sativa)
  misc_feature (71): n=a or g
ctacggttttcaattctcacgaaccaaacaatatgagaaaacgggagaaactgaaccacacgttagacacntatcacaaacctggcaacgtacaaacttta

SEQ ID NO: 39204 - DNA, 101 bp, rice(Oryza sativa)
  misc_feature (71): n=a or g
attccattacatacaagtgaacaagaggagaccaccatcacaactaacctggtggaccgccgaaccttgcngacccctatcctcggtcccttggtcagacc

SEQ ID NO: 39205 - DNA, 101 bp, rice(Oryza sativa)
  misc_feature (71): n=a or g
gaaggtgatgactccgatggaggcagtggagaggcggaagctgaagagggaggagcagttcaggagggagntggagctgaggagggaggagaggaggaagg

SEQ ID NO: 39206 - DNA, 101 bp, rice(Oryza sativa)
  misc_feature (71): n=t or c
cctggagatcgccatggccacgacacacaaatcaacaaccaaattaagcaaagaatgttttgctgctcganctgctgatgctgctgctagctgctgatcta

SEQ ID NO: 39207 - DNA, 101 bp, rice(Oryza sativa)
  misc_feature (71): n=a or g
cgagaggctctgcacccgcacccggctgtgttcggggctccacggaattctgcctgattttagttaggccnggtttgacaggggtttcggcccaatccact

SEQ ID NO: 39208 - DNA, 101 bp, rice(Oryza sativa)
  misc_feature (71): n=a or c
agggtatagtaccgccacatatatatatactgttcgcatgcatgcatgcatgcatgatttttcatgcttgngcgcggcgatgctcgttttgatgcatgctc

SEQ ID NO: 39209 - DNA, 101 bp, rice(Oryza sativa)
  misc_feature (71): n=t or g
ctgtgataaactgatgattgatgaactatttatgtcaagaactcatgtgtcaatttatcatgtactcatgntcatgtatgaactatgaaaaaattatcatg

SEQ ID NO: 39210 - DNA, 101 bp, rice(Oryza sativa)
  misc_feature (71): n=a or g
ataacttataagctcttcgacgatgtaactcaactggatctcagagtaaataagtctcgatgagttcaaanccaggctagaataacttacagaaaagcaaa

SEQ ID NO: 39211 - DNA, 101 bp, rice(Oryza sativa)
  misc_feature (71): n=a or g
tgagaaatataatagaataaatgcctttaactcttcagtttcatatcggttaggattctcgccctccaacngatgatccaacgattaggatttctagggcg

SEQ ID NO: 39212 - DNA, 101 bp, rice(Oryza sativa)
  misc_feature (71): n=t or g
cctcctatagtagccatccaacacctgtccacctcctatcgggttgtgggtctcgccccactcatgttagnagagaaggtatccactaacccactgtggca

SEQ ID NO: 39213 - DNA, 101 bp, rice(Oryza sativa)
  misc_feature (71): n=t or c
caagtgtctaagaaaattggattttcgcatacatgtagagcaatcgtatgcaaaaaaaaactgattttcgnatgcgggcgcttaagccgtccgcatgcgaa

SEQ ID NO: 39214 - DNA, 101 bp, rice(Oryza sativa)
  misc_feature (71): n=t or c
acttgcagccaggaatgaatgttatacttaggatttaaattgaaactcacacgaaagttgtgtttagatcnaaagtttggatccaaactttagtccttttc

SEQ ID NO: 39215 - DNA, 101 bp, rice(Oryza sativa)
  misc_feature (71): n=t or g
ttgcttgtttatccatcggcgtaggtgccttctcctatcttattatacgactctcgtcttttattttatcntctcttgttcgttaagtttatatatctatt

SEQ ID NO: 39216 - DNA, 101 bp, rice(Oryza sativa)
  misc_feature (71): n=a or g
gaaaaactggaccggtatatcttgagactgacgaaattatcatgggcgtcttgctgacaatgggtacgtcncctaccactgaaagaataattaaccataaa

SEQ ID NO: 39217 - DNA, 101 bp, rice(Oryza sativa)
  misc_feature (71): n=t or c
cagatgcagagatggccaaattcaggaagacatgtttaatctgctataaaagagtatccatctcacaatgncactctaaactattgagtttagaacaatta

SEQ ID NO: 39218 - DNA, 101 bp, rice(Oryza sativa)
  misc_feature (71): n=a or g
agcacgccgccgcccatgcccgagctcgccgctcacgcctatcatgtggatggagggagagatggttgganggaggagataaggtaggtggagtgaacgga

SEQ ID NO: 39219 - DNA, 101 bp, rice(Oryza sativa)
  misc_feature (71): n=t or c
acagtacagtacacaccctctccacctgcagagatcgagcctctaatcctctataaatatcgttggagctntgcagccaggaagcaagctaagcatagctc

SEQ ID NO: 39220 - DNA, 101 bp, rice(Oryza sativa)
  misc_feature (71): n=a or g
gagcaatagccgataaacgctaggtttacctatgggctatggtataaacctatataatctttcctttgaantacttttaaacatacgcgatttgtactgtc

SEQ ID NO: 39221 - DNA, 101 bp, rice(Oryza sativa)
  misc_feature (71): n=t or c
cctggggatcggatatgagagcaactatggatcaagatcctagattgactgaacgtgccggaggcatattnaccatgctacctatgaaaggaatgcccgta

SEQ ID NO: 39222 - DNA, 101 bp, rice(Oryza sativa)
  misc_feature (71): n=t or c
catttgcctagtcaataataatccgtgcaacggacaggatggtgactaatcaatgtaatcttgatgcatanatcatgtcatatcatatcgtctaaaaggcg

SEQ ID NO: 39223 - DNA, 101 bp, rice(Oryza sativa)
  misc_feature (71): n=a or c
gtggcaggcaaaaaacaacgtccgatttttctctgccccgccagtcgttcgggtgtgagcattttcgcaanaagaacgatcaaaaacaagtaaccacctta

SEQ ID NO: 39224 - DNA, 101 bp, rice(Oryza sativa)
  misc_feature (71): n=t or g
cataagggacgcaaacaacaagaacaaaccaaggctagcatacagctcacaacgatgtggcttaagtttgnttctttccatctgcgcaaccatgacgaacg

SEQ ID NO: 39225 - DNA, 101 bp, rice(Oryza sativa)
  misc_feature (71): n=t or c
tgtgagtcttataggagggcccaaatgtaatgcgtcttcttctcgatgaagacaaagtccgtctgcacgcncgccaagtgtttgacgcgggtgttgacggt

SEQ ID NO: 39226 - DNA, 101 bp, rice(Oryza sativa)
  misc_feature (71): n=a or g
acagagccctacatattgcagaaagctcccagcaatataagtttacttttcttcttgtccacccctaacanccacccatcaaaaatatgagaaatgctagt

SEQ ID NO: 39227 - DNA, 101 bp, rice(Oryza sativa)
  misc_feature (71): n=t or g
tataactttagtaccgtttgctgtgactaaagatagcaatgtgccgttgagtgttttaaccggtactaaanaccttctttagcaccggttcgttaaacatc

SEQ ID NO: 39228 - DNA, 101 bp, rice(Oryza sativa)
  misc_feature (71): n=a or g
ccggagccatacctcatcaggggcggtgacgcaatggccgacaagggcctcatcctgcttttgcacccctntccctcacccttcttcatcaaccgcatccc

SEQ ID NO: 39229 - DNA, 101 bp, rice(Oryza sativa)
  misc_feature (71): n=a or g
tataccaccacgggtgacgagacatctaaaaattctcattttaatttctccttattgtgatgtcagttatntcaaacatttgagagtattttctgtattaa

SEQ ID NO: 39230 - DNA, 101 bp, rice(Oryza sativa)
  misc_feature (71): n=a or g
cgccaggcgatcatctgaacccttctcttccttttttttcagcacggattccaccgttgatcaagcacagntgaagtaatatggcctcttctcttcctttt

SEQ ID NO: 39231 - DNA, 101 bp, rice(Oryza sativa)
  misc_feature (71): n=t or c
actggagcattcggtaaggtatataacatattgggtgtgttacgacatataatgtcagggttatggatacngcatacccaatatagtaatcgactaaactc

SEQ ID NO: 39232 - DNA, 101 bp, rice(Oryza sativa)
  misc_feature (71): n=a or g
atgtttttcagaaattcagcatataccattccaaccacagtcatgaagtgtacaggcaggcaacttcgtcnatgggcttctaggcgacgaccaacataaga

SEQ ID NO: 39233 - DNA, 101 bp, rice(Oryza sativa)
  misc_feature (71): n=t or c
agcgtagcatcctaagaaatcacgcaatacactcaagtgtgatttacaaagttactccattataataagangttttgactttggtcaaagtcaaattacgt

SEQ ID NO: 39234 - DNA, 101 bp, rice(Oryza sativa)
  misc_feature (71): n=t or g
gcagttgtcaaatcatcatgtcataagtacaagttgagttcatcgtaacggtaagtttctcagttcctcanattggccctgtttggatccggagggctaaa

SEQ ID NO: 39235 - DNA, 101 bp, rice(Oryza sativa)
  misc_feature (71): n=t or c
taaagtgcactgtgttattttaggttccgaagtctcaaaatacattttcaggtctaagaacttgttaccanaacccttctgggatcctacgtgacgcttgc

SEQ ID NO: 39236 - DNA, 101 bp, rice(Oryza sativa)
  misc_feature (71): n=a or g
gggctgaaaggctgaaagcttgaaatggagtactacttaagccttccagcagaagacacaaatcacccttnataatgcagttaatgagatgatacacaaat

SEQ ID NO: 39237 - DNA, 101 bp, rice(Oryza sativa)
  misc_feature (71): n=a or g
agcaagtcaaaattataccagcaattagcagtgaaacgcaaaatggccgacttcaacatatttaaaaaagnaactacatgcacaaaagattatgcatatgt

SEQ ID NO: 39238 - DNA, 101 bp, rice(Oryza sativa)
  misc_feature (71): n=a or g
aaaaatatctttttgatcatttagtgaactgataagaaacatggaaggggctggctatttatttggcacangaaaaatgattggaaaattagataagaggg

SEQ ID NO: 39239 - DNA, 101 bp, rice(Oryza sativa)
  misc_feature (71): n=t or c
cctttataggttttaaagaaatgaccaatttgatcatttactttgactgccacttttccacccattaccancttcataatccaatcacaccactgatctgg

SEQ ID NO: 39240 - DNA, 101 bp, rice(Oryza sativa)
  misc_feature (71): n=a or g
cggccggaatggtgacgatacaagaaagagagcccgccattcatttgcaaagcagaaaaaataattgattngcaattcagcatactgcagcaaaacatgaa

SEQ ID NO: 39241 - DNA, 101 bp, rice(Oryza sativa)
  misc_feature (71): n=a or g
tcaccaagagtacaaatttaatttgctcctaggtttagtcgtaagtaaaaattttacccaaagtaattttngtgacgtggacaaacctaactcataaatct

SEQ ID NO: 39242 - DNA, 101 bp, rice(Oryza sativa)
  misc_feature (71): n=a or g
gcaagtaatcaaagacagtagttgtagtacgtacatattctctctgtacttgtgctgttaagtcgccgtantaccttgattgtttatttagccttatacag

SEQ ID NO: 39243 - DNA, 101 bp, rice(Oryza sativa)
  misc_feature (71): n=a or g
ggtgcgccttcacccgtaacccctgaatcccaatcgctcttagacttctgaaaatcggaacaaccaaatcncacccccctcccaaaaaaaaatcaaccaca

SEQ ID NO: 39244 - DNA, 101 bp, rice(Oryza sativa)
  misc_feature (71): n=a or g
aatagctctgtagaccgtatgcattgaaagtgtaagaactgccctacggaatgctagggtatgtactaagngcacgtgcatgagcctataatgattctaga

SEQ ID NO: 39245 - DNA, 101 bp, rice(Oryza sativa)
  misc_feature (71): n=a or g
cagagatgtgctttagcggctaagcctaagctaattacggcccacgaccacgagcccggctgaggcccagngcccagagcccagggcccatcctctgcgcc

SEQ ID NO: 39246 - DNA, 101 bp, rice(Oryza sativa)
  misc_feature (71): n=t or c
atcagttgaaaattaggcaagaagcatttggattaaccaatgcccctgcctatttcatgaatcttatgaanaagatatttatggaatatctggatcaattt

SEQ ID NO: 39247 - DNA, 101 bp, rice(Oryza sativa)
  misc_feature (71): n=a or g
aagagctgatgtagtcgaaccgtgaaggacgagatgtcacgctaggtttgccagacttggggacaactcgngacgaacgagcgcgccggtgttgccaatac

SEQ ID NO: 39248 - DNA, 101 bp, rice(Oryza sativa)
  misc_feature (71): n=t or c
agcaatgcaaaaaaaaagaaaagaaaagaaaattaagaagcgcattgactggaatctacctcctaccaccncgttacatattgttgagattcaaacaaaat

SEQ ID NO: 39249 - DNA, 101 bp, rice(Oryza sativa)
  misc_feature (71): n=a or g
agccaatccagccgttccacgtggcccaaggagatcattggctcggttggcatgaaggccaatccggcctntccagctcgggagctcggtcggcccaagca

SEQ ID NO: 39250 - DNA, 101 bp, rice(Oryza sativa)
  misc_feature (71): n=t or c
ttttaagtttctgcagttgttttagtgtgctgtacataacacctatctgtgtgcagttctgctcttgtttntgaagtaactatacatttataaacatgcta

SEQ ID NO: 39251 - DNA, 101 bp, rice(Oryza sativa)
  misc_feature (71): n=t or c
aggtccccctttagtgcataagaaccagcatattccaggcttagctcatctccatgttcaacccacactgngaaagtatgactacaatatatgtaaaccat

SEQ ID NO: 39252 - DNA, 101 bp, rice(Oryza sativa)
  misc_feature (71): n=a or g
tatatatttttatactgttatcaattacccaaaggttaatgattaggctgtatagtgtcttttggagaaanagatgcaatttacattctagatgaatcatt

SEQ ID NO: 39253 - DNA, 101 bp, rice(Oryza sativa)
  misc_feature (71): n=a or c
aatttatcaaactcattcgtacatgttaatacaggcaagtagcacctagatatactccctccgtcccatanaaaagaatctaggatcggatgtgatatatt

SEQ ID NO: 39254 - DNA, 101 bp, rice(Oryza sativa)
  misc_feature (71): n=t or c
aggggagaagagagatcgagcagggtggggagggcgccagaaaaaaaaaaggaggagcgcgcacaggagangtagggtgcgggaccggaggggagagggat

SEQ ID NO: 39255 - DNA, 101 bp, rice(Oryza sativa)
  misc_feature (71): n=t or c
actcgcttgccatttctcatttttgccgctgcgtcagattggtttgcggccgtagggatcatttctcgcanggcccgagcccacaagcatgcatgcatgca

SEQ ID NO: 39256 - DNA, 101 bp, rice(Oryza sativa)
  misc_feature (71): n=a or c
aaatactctcccatcatcttaaactcgtagaatatgacgtatcataaaaatagtactatactccctccgtnaaaaaaaaaagcaaactctgggtttttgtg

SEQ ID NO: 39257 - DNA, 101 bp, rice(Oryza sativa)
  misc_feature (71): n=t or c
ctctcccccttctataccggttatcctgcggcgacgaggatgtactagggtgacaacaagcggattcccgncgccgatgccatttgctcctaccccgacaa

SEQ ID NO: 39258 - DNA, 101 bp, rice(Oryza sativa)
  misc_feature (71): n=a or c
ctaaaacataggtagtataatacatacgtccaatacactatcaaaacctttttaaggtggatttaataaantaatctaatgttgtagattgatgtgttttt

SEQ ID NO: 39259 - DNA, 101 bp, rice(Oryza sativa)
  misc_feature (71): n=t or c
tggaggaggcggcatatccgacatgtgcggcctcgtgatgacggatccagctacgacgcccttgtgatagncggatccagtggcggcggccttaggatagg

SEQ ID NO: 39260 - DNA, 101 bp, rice(Oryza sativa)
  misc_feature (71): n=t or c
aaaaacataaagtggggcggggtgtatttcgcagtcacaaactcgtacagttccggcctggcagctggttntggtttttctggttttttaaattcgatgcg

SEQ ID NO: 39261 - DNA, 101 bp, rice(Oryza sativa)
  misc_feature (71): n=a or g
ttggtgctttagttcttgtactccttggaaagaaaatgcaaagggaaaaaaagcaataggaagtggggcancctggagttgccacttcaggcctgtttggc

SEQ ID NO: 39262 - DNA, 101 bp, rice(Oryza sativa)
  misc_feature (71): n=t or c
ttttttggacttattttttttatcaattttgctcacggcataataaaccctatgattttgtgtgtgtgtgngcgcgcgcgcgtgcgtgtgtggtcacgtgc

SEQ ID NO: 39263 - DNA, 101 bp, rice(Oryza sativa)
  misc_feature (71): n=t or c
aaaatgcagtatcctagacaacttgcaagcttcgttaaatttacattattgaagtagtagattattgttanaaattatctacttgactatagaagatggat

SEQ ID NO: 39264 - DNA, 101 bp, rice(Oryza sativa)
  misc_feature (71): n=t or g
gtgccagctcggtggtattgcttactgtggtccctttgagatgaactgtactgatctgtcgagggctgatngctggaccttgcggtccatgaacagtacgc

SEQ ID NO: 39265 - DNA, 101 bp, rice(Oryza sativa)
  misc_feature (71): n=t or c
gagacaattatggatacaatccgagtaatccttataatttccatgcaggactctccttctacttccttatntgggaataccttccgtatatgaggcatgac

SEQ ID NO: 39266 - DNA, 101 bp, rice(Oryza sativa)
  misc_feature (71): n=a or g
ctccaatgatttcttgagcagtgtggctcttaataaacatcaaagccatcctattggacttcacccaagcngctactttttcttcatgagaccacttgaga

SEQ ID NO: 39267 - DNA, 101 bp, rice(Oryza sativa)
  misc_feature (71): n=t or c
ctattggttaaaaagggagaggctaatgaagatcaaacagcccacattaaatcgataaccggaaataactngggactccgattaccacaaacttatagtct

SEQ ID NO: 39268 - DNA, 101 bp, rice(Oryza sativa)
  misc_feature (71): n=t or c
acagctgctacctttaattttccttttgcctcctgcaatggcaaatcaaagaggaacccttgtaaccaagngttttagattgtcctatggtgtattagtac

SEQ ID NO: 39269 - DNA, 101 bp, rice(Oryza sativa)
  misc_feature (71): n=t or c
cacacacaaatacatctcatatccaaataaaaaatataaaagaaaaaagaagaaggaaaaactcagacgcntgcacgcctgccgcgccggcccgtcgccgc

SEQ ID NO: 39270 - DNA, 101 bp, rice(Oryza sativa)
  misc_feature (71): n=a or g
accgctcgtcatccacgactatgtcgccgctgatccccaaccacacacggctctgtaccaccaatgtcctngacaatcgccatctgatgatctgaaccgtg

SEQ ID NO: 39271 - DNA, 101 bp, rice(Oryza sativa)
  misc_feature (71): n=t or c
tgtcaccgtcggcccgaccactgcgagaaaggagaggtggacaaaatgccacattaacaaaaacatctgcnaatactgctaagactttgtactggttttaa

SEQ ID NO: 39272 - DNA, 101 bp, rice(Oryza sativa)
  misc_feature (71): n=t or c
caaacaagtcaagcatagcgttctaaaactctcaggtatttcacggcttcgcttcaccagcagcttcctgntccccgctcccctctgccttaatgtcttca

SEQ ID NO: 39273 - DNA, 101 bp, rice(Oryza sativa)
  misc_feature (71): n=a or g
tgatccgatggacggctcataatcatccatcttaattagggtatggcagaaaaaaagactagtacctaccnagattgctaattcgcgcgtacgcgcgagat

SEQ ID NO: 39274 - DNA, 101 bp, rice(Oryza sativa)
  misc_feature (71): n=t or c
tgttcttcacttgtggagaacggatcttttacaccagtttgtaattctctttagtactggttctagcaacngtgaccaataaattgagactaaagatcgag

SEQ ID NO: 39275 - DNA, 101 bp, rice(Oryza sativa)
  misc_feature (71): n=a or c
acgtcttattttctctacgccaggtcgccagccttagagcatcaccaagagaatggctaaatcacatcccnaaaaatctgtttatgggaatcctaattaga

SEQ ID NO: 39276 - DNA, 101 bp, rice(Oryza sativa)
  misc_feature (71): n=a or g
ttggtctataatgaccatcaacatcctgggggttcacgggtttgaaccaaactgtgaacaccctaaatttngaccataataggtgaggttagataaaatct

SEQ ID NO: 39277 - DNA, 101 bp, rice(Oryza sativa)
  misc_feature (71): n=t or c
tcagcgcctgtcatcggaccgctagctagggtacgtaggacgaaagcaccagtgactggcggtaagtgagnacccgtcaccgatgatcctcatcagtgata

SEQ ID NO: 39278 - DNA, 101 bp, rice(Oryza sativa)
  misc_feature (71): n=a or g
catctacttcaacatattatcatcggtcgattggattgattgtctttatatcatatttatctaagcgttanaatttagatcgggcatataacctattgttt

SEQ ID NO: 39279 - DNA, 101 bp, rice(Oryza sativa)
  misc_feature (71): n=t or c
accgcacctggcaaaagtaggccccacctgtcagcgtcaccgcctattccgctcaggatcacatcgtgatnaaccctacgtgtccgtgtcgcgccgctccg

SEQ ID NO: 39280 - DNA, 101 bp, rice(Oryza sativa)
  misc_feature (71): n=a or g
tctggataaaatcatcaagatcaggtatttcatcgtgggacactgacattttctcccccctctgggaaccnttcttcccaatcaacttctccctcatcttc

SEQ ID NO: 39281 - DNA, 101 bp, rice(Oryza sativa)
  misc_feature (71): n=a or c
atgtgatttttgtgttgcacggatagatgggacagatatatatatcgtcagggcacaacaaaaatcacaanttaaagggagtgaaaagaagtatatatatg

SEQ ID NO: 39282 - DNA, 101 bp, rice(Oryza sativa)
  misc_feature (71): n=t or c
tgccaggggaagtgaggaaaagcaaaataaaaagttgaaccttaaaaaaactacgacggctagacacaaantccaagcagcgggaaggggtcgaaaaccct

SEQ ID NO: 39283 - DNA, 101 bp, rice(Oryza sativa)
  misc_feature (71): n=a or g
gtacgatgtatgtggcaaattcaaccaaataagtgaactgatcaggttatcacgcatgctgatacctaaanagcaacacaacaggagtgcaacacggaggt

SEQ ID NO: 39284 - DNA, 101 bp, rice(Oryza sativa)
  misc_feature (71): n=a or g
atgcatgtactatttcacatgtatacttttggtgctgatcatatagcatgtgacttcgcttgagtatatantttttgacatttagttatgtgaccccttaa

SEQ ID NO: 39285 - DNA, 101 bp, rice(Oryza sativa)
  misc_feature (71): n=a or c
tggttcacatatatgcggtcttaaaatttattcagctatgttgccagtgctttctacctatagaattgaanttctttggtttacctccaaggtaagtacta

SEQ ID NO: 39286 - DNA, 101 bp, rice(Oryza sativa)
  misc_feature (71): n=t or c
ctaaccaggctcgcattgaccaccgtgatgtgctccctgtggtgcagcgccttatcaatataaccatggcnattccattgtattacagcgatggaattgat

SEQ ID NO: 39287 - DNA, 101 bp, rice(Oryza sativa)
  misc_feature (71): n=t or g
gctttagtttgtatctcttgataagataagtggataactggacattcctcattgagtagatatttaaattnggtaatccatagtaatgcaactttcagagt

SEQ ID NO: 39288 - DNA, 101 bp, rice(Oryza sativa)
  misc_feature (71): n=a or g
atgggaaaagaaaaactttttatgaaatacatatcattttaagctacttcctccgtacatcaatatgaatntgggaaatgctagaatgacttacattgtga

SEQ ID NO: 39289 - DNA, 101 bp, rice(Oryza sativa)
  misc_feature (71): n=a or g
agtcaaagtagcttagtcaaacaattttttttttaaaaaagaaccatccggaaggtagcagaaaaaggcangggataaaaaacgagaagaagactatccaa

SEQ ID NO: 39290 - DNA, 101 bp, rice(Oryza sativa)
  misc_feature (71): n=a or g
gttttccacacgcgcctttgtgcgccgctgtgattggacccgcaacaccctcgctctcgtgattttcaacntgtccgattgggcctgcgatgccctcgtga

SEQ ID NO: 39291 - DNA, 101 bp, rice(Oryza sativa)
  misc_feature (71): n=a or g
cagggaggtgtggcagggagaagagagagagagggggaataaagagaggtagagagggttagaaacttacnggtggggtccatcgatttttttaaaaacaa

SEQ ID NO: 39292 - DNA, 101 bp, rice(Oryza sativa)
  misc_feature (71): n=t or c
ataggtattaattgcagtttttggatcaattgtacagatatataggatgtacgggcaaaaacagtttttangtgcggaggtggcgcccgtctgcccggaag

SEQ ID NO: 39293 - DNA, 101 bp, rice(Oryza sativa)
  misc_feature (71): n=t or c
acaaccatctggaaaagcaaagaatgatcaggaaagaaatgcatcaacgatgtacagtactccaagacaanactagagattagcagtaaaagctgctgatt

SEQ ID NO: 39294 - DNA, 101 bp, rice(Oryza sativa)
  misc_feature (71): n=a or g
aaacctacaacaaaggggacaaaattcaggtttataggatgaggcaaaatacacatgagttcacattaatngcttggaaattctgtagaagggaacaccac

SEQ ID NO: 39295 - DNA, 101 bp, rice(Oryza sativa)
  misc_feature (71): n=t or c
tatctacattcctacgaaccgaatgacattcataggatccttagaaatccaaatcctttgaaattcctccnaaacgaatacaccctaaaccaaacaatccc

SEQ ID NO: 39296 - DNA, 101 bp, rice(Oryza sativa)
  misc_feature (71): n=a or g
taaacgttgcagctaccggatgtaattgtccatgtacatgcatgtgggtccgggatagaagggtgacgggngatttagttttgatccaatggtcaatagta

SEQ ID NO: 39297 - DNA, 101 bp, rice(Oryza sativa)
  misc_feature (71): n=t or c
taaaaaaaaagaaagagaaatcatgcataaatctcatcgtcaactcagacgttttaaattggaaaaagtangaattacccccctgaactatcgaggtcgac

SEQ ID NO: 39298 - DNA, 101 bp, rice(Oryza sativa)
  misc_feature (71): n=a or c
aaccatattttattcaaccaattcgattcgtaccaccttctactcctcggcatcaacagcatctctctctntttaacgggacgcctccttttctagctcga

SEQ ID NO: 39299 - DNA, 101 bp, rice(Oryza sativa)
  misc_feature (71): n=a or g
cccccacaatgacttaggcaaaatctatgaccaattaaacagcatacctacacatagaaaatagcaccctngtttaagtatggctatcacattaagacatc

SEQ ID NO: 39300 - DNA, 101 bp, rice(Oryza sativa)
  misc_feature (71): n=a or g
ctactatagtataaatacctaattggcatactatctaatgaatattttaccaaaacatatataaaaaagantgtgcatctgtacacctcttgtcccatact

SEQ ID NO: 39301 - DNA, 101 bp, rice(Oryza sativa)
  misc_feature (71): n=a or g
accaatctttcgatgctgttataatgactgtaagaaaaaaattatctgtattcatctctttagaagcttgntcatttgacagccacaaattaaaatatttt

SEQ ID NO: 39302 - DNA, 101 bp, rice(Oryza sativa)
  misc_feature (71): n=t or c
aaaagaccggcccgcggtcgtgcctagtaaaggcttgagaatagctaaaaaaagaccaaaatttatttatnttttttggattatactcatccgtgacgggc

SEQ ID NO: 39303 - DNA, 101 bp, rice(Oryza sativa)
  misc_feature (71): n=a or g
aaatcgaagaaggaaaccctacatatactcgaaaaaggaaattgagcaagtccacaacattaccaatatancggacttggggggcatgtgttaatgaccaa

SEQ ID NO: 39304 - DNA, 101 bp, rice(Oryza sativa)
  misc_feature (71): n=t or c
cgtgtaaaatgatcaaaccagaagtgatacggttgaagggataagtctttataagttggttctactcttgntcaactagcaaggcagtattaatcaagtgc

SEQ ID NO: 39305 - DNA, 101 bp, rice(Oryza sativa)
  misc_feature (71): n=a or c
ttattcattggcttcgtacatggctatcctacagaagtctggttcgctggataaggtggttgcggcatgtntacatttggagaaggttgtcaagaagtttt

SEQ ID NO: 39306 - DNA, 101 bp, rice(Oryza sativa)
  misc_feature (71): n=t or c
aataacccttatgattacatacttatctttccttcctctcagatatagcttgaatcactattcaagtatangtgtaatatacaaaatcacaaataaaacat

SEQ ID NO: 39307 - DNA, 101 bp, rice(Oryza sativa)
  misc_feature (71): n=t or c
gaaaagtaagtagatgaatttgaggtcttccaatttacaaaactttggtagcctgactttatgaaaatcanggggcggcgcgggcgaaggcggcgcaagat

SEQ ID NO: 39308 - DNA, 101 bp, rice(Oryza sativa)
  misc_feature (71): n=a or g
cagtctaattccaagttaacccaacatttagggtctagaccgtctaaactatatggtctaggcgaacactnattttacgttaacctcagtaacaaatatta

SEQ ID NO: 39309 - DNA, 101 bp, rice(Oryza sativa)
  misc_feature (71): n=t or c
tttgtgaagcggaggttggggaaccaaatctactcacctgtgcatgcatgcactgtgacctttttcttccngcttgcatgaatattgaagtatatctaacg

SEQ ID NO: 39310 - DNA, 101 bp, rice(Oryza sativa)
  misc_feature (71): n=t or c
ggaattatagcgcttaagattaaggaaagtacacgttgtgatttttgccttactaggcccccgtgtcgccncgctccagggcaacacgggcggcgacgcca

SEQ ID NO: 39311 - DNA, 101 bp, rice(Oryza sativa)
  misc_feature (71): n=t or c
ggtcaacaaacatgaagcatggaactacaaagtcgtcaaaatttcagcaaatgatctttttgtcagagtgngcatagaagcttctttctttcagaaatttt

SEQ ID NO: 39312 - DNA, 101 bp, rice(Oryza sativa)
  misc_feature (71): n=t or g
ggtctggtagaggagggacggatctcatccggtcggcgaggatgcaggcccagatttgggggggaaatggncgagcgagggatgcgtgcggtgcgtaccac

SEQ ID NO: 39313 - DNA, 101 bp, rice(Oryza sativa)
  misc_feature (71): n=a or g
attaagaataaaaagaagattatcgagcatatagattttatcttgaattttattcgcacgcttttaaactnctaaatgttaaaaaactttttatatagtaa

SEQ ID NO: 39314 - DNA, 101 bp, rice(Oryza sativa)
  misc_feature (71): n=t or g
gatctcgagagatcgagttgttgacgacgatggttctgatctcatcgggagacatattttggtcgggttanatctccccacagcgaagtcatcgagtagct

SEQ ID NO: 39315 - DNA, 101 bp, rice(Oryza sativa)
  misc_feature (71): n=a or g
cggcgtcgaatccgtcttcgtcttcgaaatcaagctccccgaggtagtcgtcgtcggtgacgtcggcgtcngcgtcgggcgttccgggcgacggcgccgcg

SEQ ID NO: 39316 - DNA, 101 bp, rice(Oryza sativa)
  misc_feature (71): n=t or c
agggaccatataggcctcactgatttggccgggatgtcacatacacacccgctcaaaggacccgactcccngtcggttcaactcaccccctcttagcacac

SEQ ID NO: 39317 - DNA, 101 bp, rice(Oryza sativa)
  misc_feature (71): n=t or c
gggatgcaccaagttcacgctcaccagggtcaattggaccgactccgtcgacggccacccgcacacctacngccccgacgaggtctccggcgagctcatca

SEQ ID NO: 39318 - DNA, 101 bp, rice(Oryza sativa)
  misc_feature (71): n=a or g
tccccgtgccttcccacggtcgcggctctcggtgacccatctgtcatccagaacctcctcgtctcgctggnccgcggcagccacgctcgcgttcttgttgc

SEQ ID NO: 39319 - DNA, 101 bp, rice(Oryza sativa)
  misc_feature (71): n=a or g
ccgtcagggccggcccatttatatacctgtgcatccgtcgtcgaggtagggggttgctctcgtagcccttngagcaattgcaccggtacccctggccgtcg

SEQ ID NO: 39320 - DNA, 101 bp, rice(Oryza sativa)
  misc_feature (71): n=t or c
tagattatgataacaggagttagctcctgtcaactgtgacaagcctggagaggataaacactcgtttttcntttttcttttatgttttcattttgtgccaa

SEQ ID NO: 39321 - DNA, 101 bp, rice(Oryza sativa)
  misc_feature (71): n=t or g
agggttagcttggcttgtttcttgaaccaaggtcgaattaagtctaagataaatcgtgctcgagtggcttntgaacctcgagctgttataacaactctaac

SEQ ID NO: 39322 - DNA, 101 bp, rice(Oryza sativa)
  misc_feature (71): n=a or g
tcgtccaactcgtatgcctggcttgcggggaagtacaagcctgatgacgatttcagacaactgccgggganctgcacggtgtcaatgatcccggtgctggg

SEQ ID NO: 39323 - DNA, 101 bp, rice(Oryza sativa)
  misc_feature (71): n=a or g
caaaacatagctcttgctttcaagtggtgactggtacgcttcagttttcgtatctaaagtttatagaattntttttatggtgttttgttcttacttgaggt

SEQ ID NO: 39324 - DNA, 101 bp, rice(Oryza sativa)
  misc_feature (71): n=a or g
aacgaagaacgactttcgatccggaggcacagaagcccagctaccatcacgcaaagagatctcaaggccanaggtgtcgttggatcggagcaccgagatga

SEQ ID NO: 39325 - DNA, 101 bp, rice(Oryza sativa)
  misc_feature (71): n=t or c
cgatcatggcctatgaaaatatcgaagtgagagacctcaaaaacatggtagtccaggattgcctcgacatnattgtgacgtactagcactccgcgaagaat

SEQ ID NO: 39326 - DNA, 101 bp, rice(Oryza sativa)
  misc_feature (71): n=t or g
caaatataagggattttgaacggatgtgacattttttaagtgctacgaatcaggacagggagcatgtttancaatcccctcctatctcacttatattttaa

SEQ ID NO: 39327 - DNA, 101 bp, rice(Oryza sativa)
  misc_feature (71): n=a or g
tttacatgcacataaatgacgataacaaattttgtctccttcgactctcaactcagatctcctgagccatngacaacatatgttgaaactatgtagtcact

SEQ ID NO: 39328 - DNA, 101 bp, rice(Oryza sativa)
  misc_feature (71): n=t or c
ttggctggtttctcgcttccatcttgcaaatctggtacattgtcgtgttgcattgcccaacaaattcttgntgggatggtgctgttactcttagtttgttt

SEQ ID NO: 39329 - DNA, 101 bp, rice(Oryza sativa)
  misc_feature (71): n=t or c
cgtgaactcgatcttatgctgagaccatttcatcttggcagtagccgcctgcgatgtggaccagacttcgngttctacctttttgtactccctctttgagg

SEQ ID NO: 39330 - DNA, 101 bp, rice(Oryza sativa)
  misc_feature (71): n=t or c
attctccccttagaaatgtggcctaaacgacagtgccacaattttgaagatgtctcattatcattacaggnattcaatatattcataatatgatcatccaa

SEQ ID NO: 39331 - DNA, 101 bp, rice(Oryza sativa)
  misc_feature (71): n=a or c
gtatctatatccgtctatactaattgaacacttgagcttccaattcaatcggaaagatcttaacgttaatncatatcaagtttgatttcatattcgctcct

SEQ ID NO: 39332 - DNA, 101 bp, rice(Oryza sativa)
  misc_feature (71): n=a or g
acccacacggcatgtatatccgactgggaataggggtaccatattcggatagaatatctttaagggactcnggttaaattcctaacttgtttatcaaggaa

SEQ ID NO: 39333 - DNA, 101 bp, rice(Oryza sativa)
  misc_feature (71): n=t or c
gcaagctaagtcagtactcactactcagtagtcactatctacccatcttacacaacctattgagggcctgnttagatcccaccctcaaattttataacctg

SEQ ID NO: 39334 - DNA, 101 bp, rice(Oryza sativa)
  misc_feature (71): n=t or g
gttccctgccctccttccccaatgatgttcgctttgttgaagttatttgtggcagtctcaatctcttgtcnaccgtagagtgtaaaccctgcattgccctc

SEQ ID NO: 39335 - DNA, 101 bp, rice(Oryza sativa)
  misc_feature (71): n=t or c
ccggctgaacaacttgttgccttaatggcatctattgaatcggctgcaaaacctgccgtctctgtggcgtntgctgaattggttgcacaacctgttggact

SEQ ID NO: 39336 - DNA, 101 bp, rice(Oryza sativa)
  misc_feature (71): n=a or g
aagaatgtcttgtaccctatcataaattttcaagttgccaacaaagtctaacaaagttaagttacttccanaagaccacaactccacacgctcgatgttaa

SEQ ID NO: 39337 - DNA, 101 bp, rice(Oryza sativa)
  misc_feature (71): n=a or g
ataagtatgatctcaccaatggcctggcatactaaagggaaacatctggagcattgctattttctggtaangggaaaaatgagtacaaccaatgaactcat

SEQ ID NO: 39338 - DNA, 101 bp, rice(Oryza sativa)
  misc_feature (71): n=t or c
attcagcaaggcggttgccgaaccattgacaagcatcacaccctctatagtacttgaaaaaacaatttatnttgtgggccgattgatgagtaccacgaatc

SEQ ID NO: 39339 - DNA, 101 bp, rice(Oryza sativa)
  misc_feature (71): n=t or c
ggataatttgagttttccctttttctttgttaatatagggttttcacagtctgttactcctactagagtantagctacctactgcttgacagttaaatgcc

SEQ ID NO: 39340 - DNA, 101 bp, rice(Oryza sativa)
  misc_feature (71): n=t or c
aaccgatacaatatttaaccgatgcgcagtccaactccagattcaactcgattcaacaccaaattcgtttngatcttcttccttcttctccgaatctgacg

SEQ ID NO: 39341 - DNA, 101 bp, rice(Oryza sativa)
  misc_feature (71): n=t or c
ccaatctggtctcgtttttgagagattttgtttttttcttcggttggttggatattttagcgcttgggatngagaggttcgcgccggtggagagggtggtg

SEQ ID NO: 39342 - DNA, 101 bp, rice(Oryza sativa)
  misc_feature (71): n=t or c
tacccttggcacctagcttaatctcctcgtccggtccacgggtccttccctttgtttgcgactttggaggnggctgacagctgatttcaacgagtggtact

SEQ ID NO: 39343 - DNA, 101 bp, rice(Oryza sativa)
  misc_feature (71): n=a or g
accaatgacaagagttatgtcaacaatctcacctagctatgtacatagacaacatatcctatgcacacatnccctcacgtgtacacacgtgcacaccaact

SEQ ID NO: 39344 - DNA, 101 bp, rice(Oryza sativa)
  misc_feature (71): n=a or g
acagtgcatattgcacttatacgtgattggatggttacataacttacgactggttgaattagcgagttganctgtatcaagttgtactcatggaggcaaaa

SEQ ID NO: 39345 - DNA, 101 bp, rice(Oryza sativa)
  misc_feature (71): n=t or c
agataaggggaaaataatcagcatccgactactaatacaattaaattattgttcaatagtctttagtccgnattattgaagtaaatttaatcctcatacac

SEQ ID NO: 39346 - DNA, 101 bp, rice(Oryza sativa)
  misc_feature (71): n=a or g
gccatcccggagccccttctctccatctagctagcaaaatggaaccctcacaccccgtagatgctcccacncccatcaattcggtcagaaattatcgctat

SEQ ID NO: 39347 - DNA, 101 bp, rice(Oryza sativa)
  misc_feature (71): n=a or g
accaccgcccccggccgcccaaaccgctaccgataagacgtccgctgttcgtctcacatggatcgcgcgcntacaccccagcgctcgtacgtacgtacgct

SEQ ID NO: 39348 - DNA, 101 bp, rice(Oryza sativa)
  misc_feature (71): n=a or g
ctccgaagaagacccttgaagagagacaattggtctgtttgggagcttataactgctgtagcttcttccanaatcagaagctcctctaaacagtctagctt

SEQ ID NO: 39349 - DNA, 101 bp, rice(Oryza sativa)
  misc_feature (71): n=t or g
gcggtgatttccgttggcgtaggtggatggcgcgcggtgtttttttttggcacggggtgtgtttttttttnacgacgcgtgaaatttccattggcggggcc

SEQ ID NO: 39350 - DNA, 101 bp, rice(Oryza sativa)
  misc_feature (71): n=t or c
cattatggggatcataggtttttctttagccagcaggggatcataggttttgatatgtaggttccaacatncccaatgatgacaaccctcactgctagaaa

SEQ ID NO: 39351 - DNA, 101 bp, rice(Oryza sativa)
  misc_feature (71): n=t or c
agaaatttaaattttggtctgcaatttgaccatactaacagaagaaaaattaaaaccgcagttttaaactnaaaatcccgaattcaaattcaaatccaaat

SEQ ID NO: 39352 - DNA, 101 bp, rice(Oryza sativa)
  misc_feature (71): n=a or g
tttaaaggtggaccatatttttagctgtgattatccgcctactatgtggagagggatatgattttcctccncgtgcaaaaaggaaatttcgcaggcaaacg

SEQ ID NO: 39353 - DNA, 101 bp, rice(Oryza sativa)
  misc_feature (71): n=a or c
gcgtcgtaaaaacattcttttgttgttgtgcttgacaattctatttcaaatcttgaagttggtacttactntttgttttctaaaaggtggtgtatttttat

SEQ ID NO: 39354 - DNA, 101 bp, rice(Oryza sativa)
  misc_feature (71): n=t or c
cagcggcgaatccatcgatggggctggtcggggctctagccccaacttcagccagctatagcccatactcnctccgtcctaaaaaaagccaacctcatact

SEQ ID NO: 39355 - DNA, 101 bp, rice(Oryza sativa)
  misc_feature (71): n=t or g
accatttagaagcttagatagtgtgtcatattaatccaccatgtatctccttagttagtctccttacggantaataataattagatatatggctgtacgtt

SEQ ID NO: 39356 - DNA, 101 bp, rice(Oryza sativa)
  misc_feature (71): n=t or g
gaaatgaaagttacctgcgcgttagtagatgctatgatacggcaaagatagaccatttttttactgccaangctcccgccaataccttggcagttctagct

SEQ ID NO: 39357 - DNA, 101 bp, rice(Oryza sativa)
  misc_feature (71): n=t or c
tcttattttattttgcaatccatctcttaaaacaatttaaacatagtattgacgttattgattggaatccntatctctatgatagcattataatcattgtt

SEQ ID NO: 39358 - DNA, 101 bp, rice(Oryza sativa)
  misc_feature (71): n=t or c
ccactgccacacaatggagaggggagaaagagagagaaaagagacaagaaggaaagaggaagggcaatganatgtgggcccgaatgttgactcacccagtt

SEQ ID NO: 39359 - DNA, 101 bp, rice(Oryza sativa)
  misc_feature (71): n=t or c
gggtgtcatgcaaccttgaatagaatggaatggagatccagctaaatttctatgcttggtaagggaatgangatgcgagaaaagtgagatgagagtgtgag

SEQ ID NO: 39360 - DNA, 101 bp, rice(Oryza sativa)
  misc_feature (71): n=t or c
ttcatcattaagatttaagaagccatcttctaggccaaagaaggcttcacacttggcaccaccacctcaanggagacccttctccacacgaggcagctgat

SEQ ID NO: 39361 - DNA, 101 bp, rice(Oryza sativa)
  misc_feature (71): n=t or c
ggctaatgctagagtagtattcgatattatagacgtggtgtctataatatttgggtacctgtaattgttgngtatcccacaattaattagaggttggtgta

SEQ ID NO: 39362 - DNA, 101 bp, rice(Oryza sativa)
  misc_feature (71): n=a or g
tcaaatatttggctatcataaaatgcaccaaatgataccaagtgtgttgctacgggacattaatgtgtacnccgcaattgtaaaattgaagtggctaggcg

SEQ ID NO: 39363 - DNA, 101 bp, rice(Oryza sativa)
  misc_feature (71): n=a or g
ttcctgtggagatgctgaattcgtaacataaccgggtaaaaatgattttatttacaggggaggctacccanattgtggaaggttgaattccctagttgcat

SEQ ID NO: 39364 - DNA, 101 bp, rice(Oryza sativa)
  misc_feature (71): n=t or g
tttagctttctaagtattatttctgttttcgggactacatctcgcatttcaagttcaagaagtaccgtgtnctcaatttctgcttgttcgttcctatgcac

SEQ ID NO: 39365 - DNA, 101 bp, rice(Oryza sativa)
  misc_feature (71): n=t or c
tgacgagtttagatagaattaggctaagcttataaaatacttcctctgtcatattgttttcttttccagtnaaatcttttttttttgagaaacagtcaaat

SEQ ID NO: 39366 - DNA, 101 bp, rice(Oryza sativa)
  misc_feature (71): n=t or g
aaaattacagttcaaatgatctaaaagtccaaattatatagcattgcaaatttagacttagccacatgcanttacatatgactgaatctacaattttttcg

SEQ ID NO: 39367 - DNA, 101 bp, rice(Oryza sativa)
  misc_feature (71): n=a or c
agcacgaatccacaaagcatgcacattatgcatggacttttgaaacgaggcatattccatcggtttctctntctgacaaaggcatgcatgctactcgtagt

SEQ ID NO: 39368 - DNA, 101 bp, rice(Oryza sativa)
  misc_feature (71): n=t or c
ggcagacctcttaagcagcagcggccggcggtagcatggcttccctcccctccttctccctatcaaaacantaaccctagatccggtcggagctgctaggg

SEQ ID NO: 39369 - DNA, 101 bp, rice(Oryza sativa)
  misc_feature (71): n=t or c
acaaaccgactggatttctctaggtcgggatctgaccaagaaacaaaacgcgaaaatacaaaaataccccnacgcagaaagatgaaaagacaaatataccc

SEQ ID NO: 39370 - DNA, 101 bp, rice(Oryza sativa)
  misc_feature (71): n=a or g
aatgaaatgatcctaatgatcctacttttaaaaagatatcttatatatcagccagataaaaaaatggtttngaatagtccatcaatttaatccgaatcttg

SEQ ID NO: 39371 - DNA, 101 bp, rice(Oryza sativa)
  misc_feature (71): n=a or g
ctttgtacatgcccttaagagaaagagcatttcgatccttgtgctaaatacatagatgagaccatcctatnaataaaacgatggattctcacttgattcca

SEQ ID NO: 39372 - DNA, 101 bp, rice(Oryza sativa)
  misc_feature (71): n=t or c
atcgcgacatcatcaacgacgctggtaaaaaacccagtacaagtacacaaccttctcacatcgcaggagancaaccagacaaccaaccagccgggccagcg

SEQ ID NO: 39373 - DNA, 101 bp, rice(Oryza sativa)
  misc_feature (71): n=a or g
tccttctccggttctccctctcctatctctctctcaccggtcggcatggagcagcggtaactccacgaaanggcccggcggcggtgactgcaaagcgagca

SEQ ID NO: 39374 - DNA, 101 bp, rice(Oryza sativa)
  misc_feature (71): n=a or c
tggtctgcctttgaaattcagcggttgtggcatgaagttacaccaattctttgtgttttccgaacttgcanactgcttatattggttctgttttctcccta

SEQ ID NO: 39375 - DNA, 101 bp, rice(Oryza sativa)
  misc_feature (71): n=t or g
ccacccaaaatcccttatattataggacggaggtagtagacaacgatcaccttaacgataagatattgttnatgacaatttatcctttatgttgtccatcg

SEQ ID NO: 39376 - DNA, 101 bp, rice(Oryza sativa)
  misc_feature (71): n=a or g
agcagtccaattatccttggcccagatcaaagaagaggccagcagagcaaactggaccatctgatgaactnccagctgatagtgggctaaagcattggtct

SEQ ID NO: 39377 - DNA, 101 bp, rice(Oryza sativa)
  misc_feature (71): n=a or g
cgcgctcgcaagccttcccaccctatcgaccagattgaggtggcgggcctcctttcctccccttttcgtcnggagaccgtgccaaggcggcaggaggacga

SEQ ID NO: 39378 - DNA, 101 bp, rice(Oryza sativa)
  misc_feature (71): n=t or g
ggaaattaagaatgcaatgctcaaatcttagacggaagagcagagcaatttatgacggtgtttacatgcangtgtgtaaaattttgacgtgtcatatcgag

SEQ ID NO: 39379 - DNA, 101 bp, rice(Oryza sativa)
  misc_feature (71): n=a or g
ccccacgccagagagagccccttccccttctccggcgatgtgctccctgatggcgaggtgaggcgaaatanagaggcgatgtgctcctctctctctctctc

SEQ ID NO: 39380 - DNA, 101 bp, rice(Oryza sativa)
  misc_feature (71): n=a or g
gaatcccacccacccacccggtctctccctgcaacctcagtgcaagcttaggccttatttagatgggactnaaacttttaagtccctatcacatcggatgt

SEQ ID NO: 39381 - DNA, 101 bp, rice(Oryza sativa)
  misc_feature (71): n=a or g
agtttggcctggctaagtagatacatgtgtagctgtttggttggttgtattggtttagacaggatagagtnagattttgtttggttgcttgcatccaagat

SEQ ID NO: 39382 - DNA, 101 bp, rice(Oryza sativa)
  misc_feature (71): n=a or g
cgcatgaagtgaaggatttggcatgaattcagtggatgtcactgatctaattgcacatacacattattaanaatgcacatattgcattgagtaaatttcac

SEQ ID NO: 39383 - DNA, 101 bp, rice(Oryza sativa)
  misc_feature (71): n=t or c
agattcatcactcaccaccacatacaactactactactttttgaagaagtatagattttgaaagccaactnatatggtttaaatcgtctcttcttccttct

SEQ ID NO: 39384 - DNA, 101 bp, rice(Oryza sativa)
  misc_feature (71): n=a or g
aatttttctatcgagctatcgggaatctgtaaaataagccacatacatcatcagtctaagtctgatttganccttatgccttgtaattgtattgtggacta

SEQ ID NO: 39385 - DNA, 101 bp, rice(Oryza sativa)
  misc_feature (71): n=a or g
atcactgtttatggtggctgtctacaccaaaacaaatatactccctccttttttttttctaatagatgacntccttacccttttgttcaaagtttggctat

SEQ ID NO: 39386 - DNA, 101 bp, rice(Oryza sativa)
  misc_feature (71): n=a or g
ctcaatctgaagttagtccttcaatgatagcaaagcgattgtttacatacgaaatttcagttgaaaggacnggttatctatttttcttgcaagttttgtca

SEQ ID NO: 39387 - DNA, 101 bp, rice(Oryza sativa)
  misc_feature (71): n=t or c
ccgagttcaattttgttgtggtaggaatgctacactcttgaaccccaatcacaattggcaaaatttgctanagggcatcgaaaaaacgtgtaattagctcg

SEQ ID NO: 39388 - DNA, 101 bp, rice(Oryza sativa)
  misc_feature (71): n=t or c
aattatcgataccgatattcatagattctcacatccaacagacaagggccaattaatcaacttttcttttntctctctctctctctctctctctctctctc

SEQ ID NO: 39389 - DNA, 101 bp, rice(Oryza sativa)
  misc_feature (71): n=a or g
aaagaaaataaccaaagatgtaactattgcattgtttacaagaaaatataacagccctggacaaaccgacnaacacaattagacaattgcagttacagata

SEQ ID NO: 39390 - DNA, 101 bp, rice(Oryza sativa)
  misc_feature (71): n=a or g
ttggagagagggatgagctctaacatctataattgtgccagcatggtttgtctctgaataaggcccagccngagaaggcacatgtagacatcaagaccaac

SEQ ID NO: 39391 - DNA, 101 bp, rice(Oryza sativa)
  misc_feature (71): n=t or c
acctctgatctacttggcctccaagaaaaagaacaacacactgcaacatgcctcgactgcaaaccaatggntacttgacctggatctgcccacaaacgtag

SEQ ID NO: 39392 - DNA, 101 bp, rice(Oryza sativa)
  misc_feature (71): n=a or g
atatcgagccaccacctctatgcaacacacgcaaaaaaattatagggttttggatactcctctctaccgcntagttgctcgtagtctacttttcatgcctg

SEQ ID NO: 39393 - DNA, 101 bp, rice(Oryza sativa)
  misc_feature (71): n=t or c
ctctctctctctctctctctcctgtcctacccaattcccaatcttgctctcaagccgtagcactcagcatngcagcggccgggacaacggcgacgaggcag

SEQ ID NO: 39394 - DNA, 101 bp, rice(Oryza sativa)
  misc_feature (71): n=t or c
gttgatttaggcatccaatagatctcaagatccatttccaagaggaacagagcatttccagccttctaacncaggccggcagacaatgacgagtgtagcca

SEQ ID NO: 39395 - DNA, 101 bp, rice(Oryza sativa)
  misc_feature (71): n=a or g
atgatctcctttgccgaaagaacaccatgtactaccatttccttcaagctctcctcggtgacgtcggaggncgcccattggctcttgaagctttctctctc

SEQ ID NO: 39396 - DNA, 101 bp, rice(Oryza sativa)
  misc_feature (71): n=t or c
aaaatacttgagctgatcaagcatgcgcaaacctagtgtctccccaagcagtaggaacaaccagttgatangctccttctcggcggctatcactggacgca

SEQ ID NO: 39397 - DNA, 101 bp, rice(Oryza sativa)
  misc_feature (71): n=a or c
ctacactgcatttcgtcaattaatctgtcaacctttctttttctgctctcctctctcatgtgtatgtctgnactctgcagctttgctttcctctgaagaat

SEQ ID NO: 39398 - DNA, 101 bp, rice(Oryza sativa)
  misc_feature (71): n=t or c
tcagatcaataatgaactctatgtcacgatctggtggcatctgtcacgcccggaaattcatagtaatttcngaactaatttgtgcataaaatcctcgtcca

SEQ ID NO: 39399 - DNA, 101 bp, rice(Oryza sativa)
  misc_feature (71): n=t or c
gccagccgcgtagagggataaagggagggaggagatatgccatcggcgccggtgaccgtgagccttgcagngacatcgtcgtcgtcagtgtggagctctac

SEQ ID NO: 39400 - DNA, 101 bp, rice(Oryza sativa)
  misc_feature (71): n=a or g
tcccaaaattttgaatattcctgaaatttcgaaccaaaatttatattcctgcttgggacgaggagcgagcntccactctccatggtctgcatggaccatag

SEQ ID NO: 39401 - DNA, 101 bp, rice(Oryza sativa)
  misc_feature (71): n=t or c
tgaggcgacaacgaggagattaattggctggaagctttttagcttgttgctagcgttagctattgtgtagnagtatgtgctactccaacgtcgcatacggc

SEQ ID NO: 39402 - DNA, 101 bp, rice(Oryza sativa)
  misc_feature (71): n=t or c
atcgatcgatgcctcctaatcatgtgggagtactcagctcatctcaattgttacatccttgctacagctgntaattactgtaattactagcttgcatatag

SEQ ID NO: 39403 - DNA, 101 bp, rice(Oryza sativa)
  misc_feature (71): n=a or g
ggtagtgactgatccatttaatccagcatggccaactaacatccccttgttcattcaaagctttgtatgcnttttgatttttaggaaaacctaagaaatat

SEQ ID NO: 39404 - DNA, 101 bp, rice(Oryza sativa)
  misc_feature (71): n=a or g
tggagataactcatatgatacgtacctgttatctatatttttaaaagaagacgtcacaaggatcaatcgangtcagggagcgtcttttttccttgttaatc

SEQ ID NO: 39405 - DNA, 101 bp, rice(Oryza sativa)
  misc_feature (71): n=t or c
tattttttctgctaaattagaagtacaaatataagtttaactcatcttgactaattcctagttgacttaanattttccacagtctatacaaatcaaataca

SEQ ID NO: 39406 - DNA, 101 bp, rice(Oryza sativa)
  misc_feature (71): n=t or c
tcctccaccggtatgtattcaaacgttccaaccttcctcaaaacatgatttcgtctcttgttgaattgctngacatttatgctcaggagttcgcattgatg

SEQ ID NO: 39407 - DNA, 101 bp, rice(Oryza sativa)
  misc_feature (71): n=a or g
ccatgagtggcatggggattatttaaatcattgagcttgttatggattaaggacttcagtgaaggacacanttcacccttattcttgcaatcaccatgcgg

SEQ ID NO: 39408 - DNA, 101 bp, rice(Oryza sativa)
  misc_feature (71): n=a or g
taattatggtgagcctcagcaaacattagaattacttcctcaaatattgatttcgtcaatggtgtaacacnaaggatgaaatatgtatccacacagagttt

SEQ ID NO: 39409 - DNA, 101 bp, rice(Oryza sativa)
  misc_feature (71): n=a or g
taaattgaaaatgtttcagttagaaatatatttttttcattctaaatatagccacgtgtgatcttattttnaagatttatttgcaacaaatataattaata

SEQ ID NO: 39410 - DNA, 101 bp, rice(Oryza sativa)
  misc_feature (71): n=a or g
gttgatcatctactgtttgcagctgggttttggtttgatccatggttttgttatgttcagtccaccttganatacatctcatcaaattagcacgacattta

SEQ ID NO: 39411 - DNA, 101 bp, rice(Oryza sativa)
  misc_feature (71): n=a or g
caaaggcaagcttgtcaccaacactagtgaatgcactaatcagcccgtcatcttcattctcttgcgttttngatttttttggcttacttgcagatgacgcc

SEQ ID NO: 39412 - DNA, 101 bp, rice(Oryza sativa)
  misc_feature (71): n=t or c
atgagaacagactcagtggttgatctaattaaagcgttgacaacgactgatcggaaacaacaatgtgggcnaaatgctcctcggtggcgtgggttgagcaa

SEQ ID NO: 39413 - DNA, 101 bp, rice(Oryza sativa)
  misc_feature (71): n=t or c
ttataatcatatcattatcttaaaaaatatctcttaatcgtatacaacacggcaatggttaaagattcacnaaagatattctctccgtcctaaaataaata

SEQ ID NO: 39414 - DNA, 101 bp, rice(Oryza sativa)
  misc_feature (71): n=a or c
acgtacttttgatgggggagtatgtgcgtcatcaaccttcgatgatgtcttgaaagaaaataaaaactgangattattaaaagttgtatatataacagtta

SEQ ID NO: 39415 - DNA, 101 bp, rice(Oryza sativa)
  misc_feature (71): n=t or g
ttcactttgactatcgttgacttcttcctctctccctcagacttccaaccttaaaactatatatagccgangtcaatagataggatgaaaacacttagcac

SEQ ID NO: 39416 - DNA, 101 bp, rice(Oryza sativa)
  misc_feature (71): n=t or c
cgcgctactgagtttcctgcagaagagtcttctctaggggtcagtcagaacaacaaattgtgatatttgtnggcacgttggtgaaaggattcaaaagtaag

SEQ ID NO: 39417 - DNA, 101 bp, rice(Oryza sativa)
  misc_feature (71): n=t or c
gcacgtgcttaagtcatttgagttttgtgcttcgactccatcttcttaggtagcagcacttctctttcttnttttttttaacgaactgcacaagattttaa

SEQ ID NO: 39418 - DNA, 101 bp, rice(Oryza sativa)
  misc_feature (71): n=t or c
tttatagaggttagtacgattatgaaagggtgaacataaaaagtatcacagcttcatgtgtgtatgccgcncaagccttcaccaatcaccaacatcgtccc

SEQ ID NO: 39419 - DNA, 101 bp, rice(Oryza sativa)
  misc_feature (71): n=a or g
taaggatattttggttatttttactattcattaatttatctttggatattagaaatgtttttttacgaagngagtatatagtcaagctattaaacttattt

SEQ ID NO: 39420 - DNA, 101 bp, rice(Oryza sativa)
  misc_feature (71): n=t or g
ggacatagtaaatcttgcccatggagtcagaaaagcacggagaaaaggcatgagctgaaacgacaaaactnaggccccctttgattcaaaggaaattcata

SEQ ID NO: 39421 - DNA, 101 bp, rice(Oryza sativa)
  misc_feature (71): n=t or c
cgatggcatatatgtccatggaggagggtgaggggagtagtagggcgatggtcgaggaggagccagagatngccttctttgacgtggagacctccatgcca

SEQ ID NO: 39422 - DNA, 101 bp, rice(Oryza sativa)
  misc_feature (71): n=a or c
agatgcttgtctctaaaacatgaagtagaacaatgccatggtttctttttttttttcttacggagtggtanaaataattgaatagctagaaaatcatcaat

SEQ ID NO: 39423 - DNA, 101 bp, rice(Oryza sativa)
  misc_feature (71): n=a or g
ctccctctcctcacctcaccccttcccttctctagatcgacagagccaagcagccaacagggacagtaatngcggtggcggtggttgaaggtgttggtagg

SEQ ID NO: 39424 - DNA, 101 bp, rice(Oryza sativa)
  misc_feature (71): n=t or c
tcctcgtacacagatgggtcggcctcgacgctgtaagcatctgcaattacgcatcttactgattttttttntatgaacacgtaaaagaagtacacttcaat

SEQ ID NO: 39425 - DNA, 101 bp, rice(Oryza sativa)
  misc_feature (71): n=a or c
tgtcaaaaaaaattccctgtgtcctaaaactaccatgcctgtatgttttatccacacatctaactctcaanaagaaaaatctacaaaaatcaactttgatc

SEQ ID NO: 39426 - DNA, 101 bp, rice(Oryza sativa)
  misc_feature (71): n=t or c
gattttaatgggattgtttatatacatataatactaaaatatatcaatattaaatactactccctccgtcncacgatataagggattttgagttttttatt

SEQ ID NO: 39427 - DNA, 101 bp, rice(Oryza sativa)
  misc_feature (71): n=a or g
agtagctaagcaagaaagtatggcagatggcatgcaagggatcgatcttgaagtttgtcaacgaattttcngactttatcgatgccacagagtccaccaga

SEQ ID NO: 39428 - DNA, 101 bp, rice(Oryza sativa)
  misc_feature (71): n=t or c
atggtcaccgtgaagcttgtctcatgtatgttgccttggctgttgcaatctaaatttcccctttcaactanagtgatacagaaataacaaattactatatt

SEQ ID NO: 39429 - DNA, 101 bp, rice(Oryza sativa)
  misc_feature (71): n=a or g
gcagcattatttgtctttttaaaagttctaactgttctaatgattacctgctcagcgtcaaaaaaaaaaanaaaagaagatgacttgcttcttgttgtttt

SEQ ID NO: 39430 - DNA, 101 bp, rice(Oryza sativa)
  misc_feature (71): n=a or c
attggtcagattatttggattttggatctaatggatcaaattgtgtatccaataccaataagaaaaaaaanccaactacacctagataccttcaaattata

SEQ ID NO: 39431 - DNA, 101 bp, rice(Oryza sativa)
  misc_feature (71): n=a or g
tgaaatagatttttttaattcggtttactaaaagaatttggacaaagttgactgattttttttataccacnatcgatctttttgagaaatcgatttttaca

SEQ ID NO: 39432 - DNA, 101 bp, rice(Oryza sativa)
  misc_feature (71): n=t or c
taattatgcgcttaacacgccattcttgcctggtttttgttttccctagccgatgattaatttcttgctgnacctcctgaaaacgctccctgttcctcaac

SEQ ID NO: 39433 - DNA, 101 bp, rice(Oryza sativa)
  misc_feature (71): n=t or c
ctcccctgcacccacgttggatccgcccctacaggtgcatgcagtacatgtactattgttgacttgtaagntaattgggtcaaagtgctatatttgggcct

SEQ ID NO: 39434 - DNA, 101 bp, rice(Oryza sativa)
  misc_feature (71): n=a or g
taagaacgttcaaatgtttcaaaaaaaaaccctaacaacgtatactaatctatccatccaatatgtaaccnataaataaaaataaagtatttcaaaataac

SEQ ID NO: 39435 - DNA, 101 bp, rice(Oryza sativa)
  misc_feature (71): n=t or g
acagaaatttggagagagaggatgacttttggtgaagtttctcaatgctctaccttttgataaacatttantgtgagcagcaaaccgttttagatgtggtt

SEQ ID NO: 39436 - DNA, 101 bp, rice(Oryza sativa)
  misc_feature (71): n=a or c
agaaatcattgtttgacttttgcaaaatctaagtcttctatctaacttctgatcactaaagacggaaccgngacaaaaaagttaaggatgcacggaaggcc

SEQ ID NO: 39437 - DNA, 101 bp, rice(Oryza sativa)
  misc_feature (71): n=a or g
tcggtctaaccagtgtagtcgctttgatcggactgcgtaatcttcccaccgtcacatgtcgccgtcgtcantctgaccgacacgttaccgccgtttgaccg

SEQ ID NO: 39438 - DNA, 101 bp, rice(Oryza sativa)
  misc_feature (71): n=a or c
ttttaagttggaagatggcctatatccggtttcgcggttgaaaattgaaactggaccaatagctgaaggangtctaatggactttttccacgtttgattgg

SEQ ID NO: 39439 - DNA, 101 bp, rice(Oryza sativa)
  misc_feature (71): n=t or c
ggtcagacgtccctctaacgtagaaggacatgactacacagctagtgcagctaccactccatatatgatanagctaccactccatatatgatagatactat

SEQ ID NO: 39440 - DNA, 101 bp, rice(Oryza sativa)
  misc_feature (71): n=t or c
ttgcgcatgcatgactgcatggttcagcacttatctcaaccccactttttatttctttaaattaaatttcnttctaaattaattatccgatttatgattcg

SEQ ID NO: 39441 - DNA, 101 bp, rice(Oryza sativa)
  misc_feature (71): n=t or c
aaattggagagaattaaagggatagaggggagagcgtacatatctgatctcccgtacgcacggcaccaagngggatatggattttttttccaaaaatatat

SEQ ID NO: 39442 - DNA, 101 bp, rice(Oryza sativa)
  misc_feature (71): n=a or g
cctgatttatctctaagattacattaacaaaactcatctgtaaaataaaagtactttttgacacggatctntgcatatgatttttaactatatccacctaa

SEQ ID NO: 39443 - DNA, 101 bp, rice(Oryza sativa)
  misc_feature (71): n=a or g
aaaaaaggtctcacctatcctgttcttattcatattgacactttgcaagacctggtgtcccgacaggtccnctgcttccagtggcgttatggagtagcaga

SEQ ID NO: 39444 - DNA, 101 bp, rice(Oryza sativa)
  misc_feature (71): n=t or c
ggttggcgaggggcaggggcaagaatcgcggcagtgatgggtgaggggaacggacgagaatagcggagcgngagagagaagggtgtttacacccaaatttg

SEQ ID NO: 39445 - DNA, 101 bp, rice(Oryza sativa)
  misc_feature (71): n=t or g
aaacttggttttgtttgattgtcaggtgttgatataagctgtcttagtctcctttattatcttatgcactntgatgaactccatctacttattttagttgt

SEQ ID NO: 39446 - DNA, 101 bp, rice(Oryza sativa)
  misc_feature (71): n=t or c
gagcacagctgcacaggtgatcatcacccgagaatagaggtgaaaatggtcggaatcggtagcatatcttnggaaacgacggtcgatcgaccggtaattaa

SEQ ID NO: 39447 - DNA, 101 bp, rice(Oryza sativa)
  misc_feature (71): n=a or g
gtatttttgtttttgactttctttaattccctgcctataattcctaatgagtgttacttttgtttggagtntatggtgtccatggttctccatagtttaac

SEQ ID NO: 39448 - DNA, 101 bp, rice(Oryza sativa)
  misc_feature (71): n=t or c
ttttattttttacaaacagctttttgttgccactttttgagggaatcggacggatctttagatgttttttnggttttttaattctttttcggatttttttt

SEQ ID NO: 39449 - DNA, 101 bp, rice(Oryza sativa)
  misc_feature (71): n=a or g
ggtaaatgctccagcaactactaaaaagcctttcagcttcactgattcttaaggctattttgaaacgcaanattctaaaaatacagaaattaaataatttg

SEQ ID NO: 39450 - DNA, 101 bp, rice(Oryza sativa)
  misc_feature (71): n=a or g
tgaccgagaccgagaccaaggaattcggtcacaaattcggtccgcactttcaactaaccaaatttagtccngtcaatttggtcttagaattcggttaaccg

SEQ ID NO: 39451 - DNA, 101 bp, rice(Oryza sativa)
  misc_feature (71): n=a or c
gaggccagggaaaggtgggtcgcactccccaactgggccagaaaggacgatcgagcccatgtgcgttcagnccgcaaagcgttgaagttcgacccaaaatt

SEQ ID NO: 39452 - DNA, 101 bp, rice(Oryza sativa)
  misc_feature (71): n=t or c
caaagaccatgactttggaaagtttatggtacttggacgagcaccttcagatgctcctgcaaggtagatanttttttctcaaataatcatcctgtaagtca

SEQ ID NO: 39453 - DNA, 101 bp, rice(Oryza sativa)
  misc_feature (71): n=a or g
aggtacctcactgtaccatcagtatagctcttaggtttgcgtatgccttgctgcagccgagtcacaggacnttgtggaggaggtggcgacggaatgaccgg

SEQ ID NO: 39454 - DNA, 101 bp, rice(Oryza sativa)
  misc_feature (71): n=a or g
atttcagtttgtgtgctagtccatatatcaataatacaaaaaaaaatagtgagcctattctatcctttgcnaatacttttgaacccattgagactagctgt

SEQ ID NO: 39455 - DNA, 101 bp, rice(Oryza sativa)
  misc_feature (71): n=t or c
gaacttatattgtcatggtttgttgtcactaatgcggaatagatcatatgtatcagacgggaatcctcatntgtgtcggcaagaggccatcatggattatt

SEQ ID NO: 39456 - DNA, 101 bp, rice(Oryza sativa)
  misc_feature (71): n=t or c
aagagagctaagtttgacataatggatcttaatgttttacaggtttactttctgtatcaatatctcgcaancatagtattgtagaagttaacacaatgtaa

SEQ ID NO: 39457 - DNA, 101 bp, rice(Oryza sativa)
  misc_feature (71): n=t or c
gtcctgataaaatttattataatttatttacgggttgcatttgttatggcatttcccttgcctagatatcntttttttcttttcttttctttttttgaagt

SEQ ID NO: 39458 - DNA, 101 bp, rice(Oryza sativa)
  misc_feature (71): n=t or c
aaactttttaatacttaacaacttgggcacacacacattatccaatcaaaaaccccattctcaatccttcnatagcaaacccgtgccttctttacaattac

SEQ ID NO: 39459 - DNA, 101 bp, rice(Oryza sativa)
  misc_feature (71): n=a or c
ctcatcaaaggataaaaaatgctgataccacaaaatcaagttgacatgtccaaaaaaaaagtcatgcatanaaaacactaaccataaaaataaaatagcta

SEQ ID NO: 39460 - DNA, 101 bp, rice(Oryza sativa)
  misc_feature (71): n=t or c
ggcacaaatcttgcgcctctgatctctctctctctcacgatctctttcttgtccgactctggcactggcgncgctgctccaccatcgcccccatgcattgt

SEQ ID NO: 39461 - DNA, 101 bp, rice(Oryza sativa)
  misc_feature (71): n=t or g
caagtgatgaagaaataagaagattggagagagggcatacaatagaagggagagcgttgatgccaggttgngcccggcggccaccaaaacaaatcaataac

SEQ ID NO: 39462 - DNA, 101 bp, rice(Oryza sativa)
  misc_feature (71): n=t or c
gttattccccggagcgcaggtccgtttgagcaaataaatctctcctcacttctccgcccctgcagccatgntgacgccggtctccacggccatctcggacg

SEQ ID NO: 39463 - DNA, 101 bp, rice(Oryza sativa)
  misc_feature (71): n=a or g
ccgtgggacttcctccacaacccacctcttctcagcactcgtcatgcaggaattatgcagtaacgtgacantcattgtgcagtaacaccatgtattacttg

SEQ ID NO: 39464 - DNA, 101 bp, rice(Oryza sativa)
  misc_feature (71): n=t or c
caatatcttctatttgatccattatttagcacacaaaatgtttatttatgggagtatatatatatatgtgngcgcgcgcgcgcaacaaaattaattaaaac

SEQ ID NO: 39465 - DNA, 101 bp, rice(Oryza sativa)
  misc_feature (71): n=a or g
caagccatattgcttacatgacatccatgcacagtgcgtcctcatatccaatgaacatgtttgtcatgaancacgataaaggatgatactaagtaggcaat

SEQ ID NO: 39466 - DNA, 101 bp, rice(Oryza sativa)
  misc_feature (71): n=a or g
acatttaaaaatgtccattttaaccttacattttttataaaaaaggaaaaacaaagggaaaagcaagaacnaatcataaaactaaggaaaatgccaatttt

SEQ ID NO: 39467 - DNA, 101 bp, rice(Oryza sativa)
  misc_feature (71): n=t or c
gagattgggaataataacttgtatagtcaccctagttgtgatcaatggattagaatgataacaagaagtanatatatatttaccgatttctaagtcgatgg

SEQ ID NO: 39468 - DNA, 101 bp, rice(Oryza sativa)
  misc_feature (71): n=t or c
gtcttgtatactgactataatgctaattagtaaccaggtagctatagatttgttgttgttgttgttgttgntgttgttgttgttgttgttgctgatgagtg

SEQ ID NO: 39469 - DNA, 101 bp, rice(Oryza sativa)
  misc_feature (71): n=a or c
gatactaactgcagcactaacaacaactatatgaaacactaattgccaacgagcaaaacatacaaaaaaancatataaaaataccatattttgcaaaaaca

SEQ ID NO: 39470 - DNA, 101 bp, rice(Oryza sativa)
  misc_feature (71): n=t or c
acatttgagtaaaacttaaggttctcccatggctgaatgggcagaggcaaaccacgtacaaggtgtggccnaagcagtgcagtcatacctgaagtgcacga

SEQ ID NO: 39471 - DNA, 101 bp, rice(Oryza sativa)
  misc_feature (71): n=t or c
tgcatatatgaaataaagaataaagccatggtgttgaatgatactaaattgctatgtttgattaagacaantatctgagtgggaaaatggtgtcgttattt

SEQ ID NO: 39472 - DNA, 101 bp, rice(Oryza sativa)
  misc_feature (71): n=t or c
agacgagtgaccaacgctactcaacacgttcggcgtaccagatgttcttttatggccagccctcatttgcntgtgctgatcttctgtagcacgcgaagggt

SEQ ID NO: 39473 - DNA, 101 bp, rice(Oryza sativa)
  misc_feature (71): n=a or g
tgacttatggggcctccaatctgtgtaaatgtgtcctgaatacgtgaaggtgcattttgtcgcatgacagntgtgttttttcctcaaattacctgcatacg

SEQ ID NO: 39474 - DNA, 101 bp, rice(Oryza sativa)
  misc_feature (71): n=t or c
gaagtacagagagtttggagatggcggccgagaagacgcagattattccggtactctgccttggaaacggnggcagcggcccaaacagagcggtttcggag

SEQ ID NO: 39475 - DNA, 101 bp, rice(Oryza sativa)
  misc_feature (71): n=t or g
ggccgtgagcatctgaagaacgacatcattgacgccgatgggcaccacacactttcctagcgccgatgttncgacgcccctttccaccattcgtggcatgg

SEQ ID NO: 39476 - DNA, 101 bp, rice(Oryza sativa)
  misc_feature (71): n=a or c
ctggcaccttcttgcgaaggtagccgcactagtcgatgttagggataacctcgtcgacatgcaatgttgcngtaaaggagtcgttttacgagcgcatgttg

SEQ ID NO: 39477 - DNA, 101 bp, rice(Oryza sativa)
  misc_feature (71): n=a or g
gcatcgttcctcacttctagggagcgattttttttcccaatcgctggccgacgctttctcgcgcgtgcatngcaaaaatgttctcgcgctcctcttcgcga

SEQ ID NO: 39478 - DNA, 101 bp, rice(Oryza sativa)
  misc_feature (71): n=a or g
tcatgtccactctaatggtccaacatactcttcttggcacctaacataatggaataacgtgaagagaccgntaatgacaaaaataacatcaaacataagga

SEQ ID NO: 39479 - DNA, 101 bp, rice(Oryza sativa)
  misc_feature (71): n=a or g
gttgactctgtagacgtttcttccttaactattatttctccttgacatttaagcgtcttgtggacttgctntgcatattcagctttggcaatgatgtaatg

SEQ ID NO: 39480 - DNA, 101 bp, rice(Oryza sativa)
  misc_feature (71): n=a or g
aacttttcaaaaacttgcaagagatgaagtggctaccacatatagctggtgggaatgaggtcctgggttcnaaccccacccccacgcagaacacaaattac

SEQ ID NO: 39481 - DNA, 101 bp, rice(Oryza sativa)
  misc_feature (71): n=a or c
tttataactggattaagacaaacatttagcaaaacactctaaaataatttactcttcctcaattatcaagncatgtacacccatatgcctcatttatttga

SEQ ID NO: 39482 - DNA, 101 bp, rice(Oryza sativa)
  misc_feature (71): n=t or c
taattgtagtatacattttttttaccaaaactgtagtatatgttctgagtgactgaggctgtgtttagttntattcaaactttcaaacattctgtcacatc

SEQ ID NO: 39483 - DNA, 101 bp, rice(Oryza sativa)
  misc_feature (71): n=t or g
ccaatcagggtttacaattttggttcaaaattttgcccattccgacaagcaaatatattggccgaaatttnttggtttttccattttctatgtgaatcagg

SEQ ID NO: 39484 - DNA, 101 bp, rice(Oryza sativa)
  misc_feature (71): n=a or c
gctgactagctggatcgtcataattgtttcaacagtggtatccatattagatttagtttttgtatggtganccagaattatttatttaggagaatggattt

SEQ ID NO: 39485 - DNA, 101 bp, rice(Oryza sativa)
  misc_feature (71): n=t or c
ataagtcaataaattttaagtcctaaatttaatgatggagtcatatctctacctcacataatgagaaaagnttttccaacctagcttttggcttaatagtg

SEQ ID NO: 39486 - DNA, 101 bp, rice(Oryza sativa)
  misc_feature (71): n=a or g
agcctcatgcggctgggcgacaagcagacaaccacaacggccatgctgcccagcaatggagacgagcagcnatgacctcggtgcaaggacgcccggccaaa

SEQ ID NO: 39487 - DNA, 101 bp, rice(Oryza sativa)
  misc_feature (71): n=a or g
caggcagagccgctgccactacttggggagaggactagagtaaggactggggatgggattggtggatgccntcgcgccaatcctcctcctccactgtcacg

SEQ ID NO: 39488 - DNA, 101 bp, rice(Oryza sativa)
  misc_feature (71): n=a or g
cttgcatcttcttctattggttgtgttttgcacatattgtgtggattgaaactctaattcagtttgctacngcgaataagatttcaaattttccttatggg

SEQ ID NO: 39489 - DNA, 101 bp, rice(Oryza sativa)
  misc_feature (71): n=t or c
gccctcgtcctcctaagcccgacgatcaactcattcggtggggctacaagaagtaggggtgaaaacagatnggattcagacgaatagtggtcaaaccattt

SEQ ID NO: 39490 - DNA, 101 bp, rice(Oryza sativa)
  misc_feature (71): n=t or c
acacaatgtctacacatacagttccatgtctatatattattatattccaacagatatactccctccgtctntaaatatttgacaccgttaattttttagca

SEQ ID NO: 39491 - DNA, 101 bp, rice(Oryza sativa)
  misc_feature (71): n=t or c
gggcaccggctctctcctagtctaccaagctgagttaagcttgtagctctatgatgtaccaaaatatggangaatatgaaggacggacatggctgtcacca

SEQ ID NO: 39492 - DNA, 101 bp, rice(Oryza sativa)
  misc_feature (71): n=t or c
actacagcatgattacaactactgtagatcataggtctatctaaatttgttgcacaacttaggctgtgttngttgtagggggttgggaactaactcctgtg

SEQ ID NO: 39493 - DNA, 101 bp, rice(Oryza sativa)
  misc_feature (71): n=a or g
aagcacggccgctgcccaccaaccgttgccactcccgaggttggaggatgcggatccgcccaccgtcgtcnctcccgaaggtgggggcaacgctcaccccc

SEQ ID NO: 39494 - DNA, 101 bp, rice(Oryza sativa)
  misc_feature (71): n=a or c
gtgcaaacagtgaaaggtaattgtttccgagaatttcacagcttttttcaacaaagtttagcttggacaanatggatctaactagcttccaaatagatagg

SEQ ID NO: 39495 - DNA, 101 bp, rice(Oryza sativa)
  misc_feature (71): n=a or g
cacagcctaagagcatgtacaatagtgagctaatagcccgcttacgtaggattttagcacatgtggcaganagctaaactgcagagagagaaaagtgggcg

SEQ ID NO: 39496 - DNA, 101 bp, rice(Oryza sativa)
  misc_feature (71): n=t or g
gcgatgaccagcaaactcccccaagtacacaagtttactaagttactagccgtccgttcatccctagcttntccctgcagtccaaacacgaaaaaaatata

SEQ ID NO: 39497 - DNA, 101 bp, rice(Oryza sativa)
  misc_feature (71): n=t or g
ggaaagtatagcgtgagagccattaatatgtgcatttatttctccaagtcccattcactttcatgtttgcngcagcatctgctctcgctcgcttctcttgt

SEQ ID NO: 39498 - DNA, 101 bp, rice(Oryza sativa)
  misc_feature (71): n=t or g
catgattctacctttcttttcccttgaagtgaccctcttgtcaacttatttttttgtttgcatcagtaganacaagctgatctaacaaaggtcaagcagaa

SEQ ID NO: 39499 - DNA, 101 bp, rice(Oryza sativa)
  misc_feature (71): n=t or c
ttttgaccggaaaatcttgtgtatataagctcagaaaataatgcgtatgtaagcaaaaactgatcaaagantatatggaaaatggaaatattgagatagtt

SEQ ID NO: 39500 - DNA, 101 bp, rice(Oryza sativa)
  misc_feature (71): n=a or g
aaaattgttaccccacatgttagttacaacaaaaaattaataaatgatagtgaggcccacgtggacaactngaccccacatataattctcacccttcctct

SEQ ID NO: 39501 - DNA, 101 bp, rice(Oryza sativa)
  misc_feature (71): n=a or c
atgtgaaaaatccagcatgtgttgctgctgcgatgaattttctatctgtttccatctactccgtctatccnagtactaaattttttttcttggaaaaggag

SEQ ID NO: 39502 - DNA, 101 bp, rice(Oryza sativa)
  misc_feature (71): n=t or c
catagttttgcagctcgctgagtcagtttattgtacctgctctgataataagtacttacgatagcattcgngtgcgcaacggacgtccaagcctacgtggg

SEQ ID NO: 39503 - DNA, 101 bp, rice(Oryza sativa)
  misc_feature (71): n=t or c
tgagcttggggaagaagatgatttccttcatgatccaagatgcccgggttaagctccatgtggacgatggngagctcaagaacagtttcgcctcttggtgt

SEQ ID NO: 39504 - DNA, 101 bp, rice(Oryza sativa)
  misc_feature (71): n=t or c
cgatgtacgtcacatatcgatatggtatgtttgcgcgtatacagatgttctcagcataagttaaggaagtncatcatggagtctatagatggaaggagtcc

SEQ ID NO: 39505 - DNA, 101 bp, rice(Oryza sativa)
  misc_feature (71): n=t or c
tttcgcattttatatgagggtgagaaaatatatgttcgcgtgtttgaggcagcgatgagggcaaagctcgncgacaacttgtcttcaatctcgtcggtgac

SEQ ID NO: 39506 - DNA, 101 bp, rice(Oryza sativa)
  misc_feature (71): n=a or g
aatcttcttggcattctgatagcctgatattgttctgttgcatcttttcatcctttactgcatcaattggntagcttacagagtacaacccatttttggaa

SEQ ID NO: 39507 - DNA, 101 bp, rice(Oryza sativa)
  misc_feature (71): n=t or c
gtggattctagtgacacataggcatcactatgacatgccacgtcagcatacgaagcgggttgaaatatgtntgaacctatataacacccaagataaattca

SEQ ID NO: 39508 - DNA, 101 bp, rice(Oryza sativa)
  misc_feature (71): n=a or g
agtggctcttcaaaaggtaacctcaagatttgccccattaattcgcgctgttataattgtatcctcaactntctggaatcaaaacagtgcaagctgccaag

SEQ ID NO: 39509 - DNA, 101 bp, rice(Oryza sativa)
  misc_feature (71): n=a or g
aggtggcattaaagttaaaaacatatatatgtgaatcatttgttattcacaaaaaaaatatgaggcacacntgtcatcctttatctctttcttcttcctcc

SEQ ID NO: 39510 - DNA, 101 bp, rice(Oryza sativa)
  misc_feature (71): n=t or c
cctttgatatttaatagatatattgatcttctaaaaatcgtactaccttatgacgccgttgactttttgtncaacgtttaaccattcgtcttattcaaaaa

SEQ ID NO: 39511 - DNA, 101 bp, rice(Oryza sativa)
  misc_feature (71): n=t or g
agcaaccatcattccgaggagaaaagagctatttatagccacaacctcaaatatgcccgtcggaggctaanattctatttttagaaattacgaaaatcatt

SEQ ID NO: 39512 - DNA, 101 bp, rice(Oryza sativa)
  misc_feature (71): n=t or c
gctttcacttaatagctcgttactacggtatgtttacttcacatcaaacttcttcccaactcctaactttncatcacatcacatcacatctaaaactttcc

SEQ ID NO: 39513 - DNA, 101 bp, rice(Oryza sativa)
  misc_feature (71): n=t or c
atgcttgcactggtccataaaaaaaatcttgatattttcacatcatgcttgcaagaacactacatcatcgngccattgttcgataagttgaattttttttt

SEQ ID NO: 39514 - DNA, 101 bp, rice(Oryza sativa)
  misc_feature (71): n=a or g
acggccgaccggaggagtcgtcgacgaggacgaacggtaaagatgacgacggggacactggcggggtaggngaggcgaggccgagggtgaccttgccgctg

SEQ ID NO: 39515 - DNA, 101 bp, rice(Oryza sativa)
  misc_feature (71): n=t or c
taagactggcggctgatatagtgtaccgcccgtgaaaattcagctaccgccaatcactggcctttagtcgntgacggcgctgttggacgccagcaaaaatt

SEQ ID NO: 39516 - DNA, 101 bp, rice(Oryza sativa)
  misc_feature (71): n=a or g
aagaatggtatgtgttgataggacaaagtcctcaaaggagaactgcttgggaaggagtagatgcatagaanttcaggagttggttcatatgctgtaaatgt

SEQ ID NO: 39517 - DNA, 101 bp, rice(Oryza sativa)
  misc_feature (71): n=a or g
aacattggccttgtcctaaagccacgtataatggagaccccatgtaaaagtgttcttagattttccctccntcccataaaaaaccaatccagtatcggatg

SEQ ID NO: 39518 - DNA, 101 bp, rice(Oryza sativa)
  misc_feature (71): n=t or c
ttgtccgcaacattccaagtccaacacacaacaaatcatccagaatccgcatcaaataacacttcaccttngcttacccaaaagagaacgaacggtaaatt

SEQ ID NO: 39519 - DNA, 101 bp, rice(Oryza sativa)
  misc_feature (71): n=t or c
ttccagaacaaggaaaaccaaaccaatccaatccaatccaagccggaggggtctccagtccacgccacgcngggcacgtgaagcggcggagggagacgagg

SEQ ID NO: 39520 - DNA, 101 bp, rice(Oryza sativa)
  misc_feature (71): n=t or g
atggaatgcctgcaaggaaagagaggggaagaaataggagagagagatggggtgctgggccactggtaggnggggtccagggtgcttgggcccattgatca

SEQ ID NO: 39521 - DNA, 101 bp, rice(Oryza sativa)
  misc_feature (71): n=t or g
gacgactttaaggatctgaaaaccaggattgaaaaaaaaaccctggcgaaataagaaaacacaagattttnccataaatgcaaatacaaaacaaaaaatta

SEQ ID NO: 39522 - DNA, 101 bp, rice(Oryza sativa)
  misc_feature (71): n=t or c
aacactttataaatggcctcccacaataaatatatatcagatatcgtccctagctgactacactatacaanaaagaaatgtcaaaatgatttgttcttgct

SEQ ID NO: 39523 - DNA, 101 bp, rice(Oryza sativa)
  misc_feature (71): n=a or g
actatacacatctaatttagataagtttattagagacggatggatgttgcttgtatgtataaagattcaanttagaaaacagtgcatagtatgtatgtacc

SEQ ID NO: 39524 - DNA, 101 bp, rice(Oryza sativa)
  misc_feature (71): n=t or c
ctccattcaatcagatgttcctgttgtttttctgtgttttttcatccatagaatttaacgtgccacggcantcgaatactacgtttttcctatcactgtat

SEQ ID NO: 39525 - DNA, 101 bp, rice(Oryza sativa)
  misc_feature (71): n=t or c
tataagatctaaaaatgccatggatccaccactctttagagtatttttttctctttaattagtacttcttncgtttcatattataagttgtttgacttttt

SEQ ID NO: 39526 - DNA, 101 bp, rice(Oryza sativa)
  misc_feature (71): n=t or c
taagtccaaactagcataataaaaagaagcgatgcacaaactaatgaccattaacactagacaaagatccngtaattacggtatcctacttgtaaatctta

SEQ ID NO: 39527 - DNA, 101 bp, rice(Oryza sativa)
  misc_feature (71): n=a or g
gggtttccttgtcgcattctgacggagtagatggcatgcatgctgatggagatggtagcatggtacaatgntactccatccgtcccataatataaggaatt

SEQ ID NO: 39528 - DNA, 101 bp, rice(Oryza sativa)
  misc_feature (71): n=t or c
taatgccaagtggcagcctaggagcgtttgtaggatgccatgtggtacaggagaagacatcgtataaaccngtacatacatgacaacagtagtagcgctta

SEQ ID NO: 39529 - DNA, 101 bp, rice(Oryza sativa)
  misc_feature (71): n=a or c
ggaaaagaatcaaatgttagatattaatgcctgaaactaatgatgcttcagcagcggggaagtggccaagntttatccgtgaccgggagcagttggaagag

SEQ ID NO: 39530 - DNA, 101 bp, rice(Oryza sativa)
  misc_feature (71): n=t or g
ggtggcatagccaagagcgacgaggtagcacgacgatggttgacaactaacgagacgatgtggaggagcanttgtcggcgccttcttgccaccatttgcct

SEQ ID NO: 39531 - DNA, 101 bp, rice(Oryza sativa)
  misc_feature (71): n=a or g
ccggctgcacaccctcggtcagaccggcctcggaggaatttttccataaattctaaaattgattttgcacntggatatatgcctattggatcttctggtcg

SEQ ID NO: 39532 - DNA, 101 bp, rice(Oryza sativa)
  misc_feature (71): n=a or g
caaggggaaggagggcggggcggcccttgagagacagagtgtcacgccctaaagtttcaaccttttccttnctttaaaaatttgttaagtaaatcgtccgg

SEQ ID NO: 39533 - DNA, 101 bp, rice(Oryza sativa)
  misc_feature (71): n=t or c
ttgccaaagaagcacaatgcacatactaaaacacccaattggggcatattcaagaatcattggaacacatnatgaagaatctcactacaaagcaatggaac

SEQ ID NO: 39534 - DNA, 101 bp, rice(Oryza sativa)
  misc_feature (71): n=a or g
tgcaattctcaggaaaaaaaaattgaacgaaggcctgataatctcagaatgatatactgtattagatggtntaatagtagattctgaatacaccgagattt

SEQ ID NO: 39535 - DNA, 101 bp, rice(Oryza sativa)
  misc_feature (71): n=a or g
gtgtggttaattcgcacatacgaaagagcacacgacctcttgcattcagtgagaaggagacgtaaggacgncaactatgtttttgaagcagtagagatata

SEQ ID NO: 39536 - DNA, 101 bp, rice(Oryza sativa)
  misc_feature (71): n=a or g
cgcgggccaccacgcggtccatctgggcctccaccgcccgagaaatgctctcaagaaggcggtggcattcnaccaccatattagaccaattggccacttcg

SEQ ID NO: 39537 - DNA, 101 bp, rice(Oryza sativa)
  misc_feature (71): n=a or g
catttatagtatgttctaactcaagcatgaaaaggctaaagcaaaaatatctttttattttctctagattnaaaataattatcgttttagataaagacatt

SEQ ID NO: 39538 - DNA, 101 bp, rice(Oryza sativa)
  misc_feature (71): n=a or g
gtaagataagctaaaacaacttataatatgaaataaatagacggagttttctggataagaggttaaggggnaaaataatgaatttgcatgcgatagaactc

SEQ ID NO: 39539 - DNA, 101 bp, rice(Oryza sativa)
  misc_feature (71): n=a or g
tccctctcgaatcccgtgctaaagatcgtgagtcgcacgcaagtggccaggcatggattccggcgatgtcngcgcgcggcggccaccaatgcgacagcgcg

SEQ ID NO: 39540 - DNA, 101 bp, rice(Oryza sativa)
  misc_feature (71): n=t or c
ttgttgtgaatgtgaatgttaatctgaatgtgaatgttttatttgttgtgaacgtgaatgtgaatctgaangtgaatgtgaatgaatgtgttgtatggatg

SEQ ID NO: 39541 - DNA, 101 bp, rice(Oryza sativa)
  misc_feature (71): n=a or g
ttggcatcgcaatttgcttagacaagaggtccaatgttgactcgaatagagaggtagtgatctctctagcnttgctcaacagcttgaccatcttggagtcc

SEQ ID NO: 39542 - DNA, 101 bp, rice(Oryza sativa)
  misc_feature (71): n=a or c
tgaacaattagtacttttttttgttcaacaacttcaatctatgatcaattttaagaacatataaactcatnctgaattatgtgctatatttgttatatatt

SEQ ID NO: 39543 - DNA, 101 bp, rice(Oryza sativa)
  misc_feature (71): n=t or c
tgtttctttagccgtggagggagtacacgacagacgcacacacattactacagacgtaatactatactcanctacgaatgcactccctccgtcccaaaaag

SEQ ID NO: 39544 - DNA, 101 bp, rice(Oryza sativa)
  misc_feature (71): n=t or c
gcaatggagatagggtgggtggtctcgccattcgcgtgcggtgctactttagcctcctaccccggccccantaacaaaagcttgcggcccggccttagctc

SEQ ID NO: 39545 - DNA, 101 bp, rice(Oryza sativa)
  misc_feature (71): n=t or g
tgcatgcagcagtgcagtagtaggcagtagccaactggcaaaatgtgcgtacgctggcttcttcaattcgnttcatccgcccgtccgccgcccaatcgccg

SEQ ID NO: 39546 - DNA, 101 bp, rice(Oryza sativa)
  misc_feature (71): n=t or c
gaagataagcaccagtaccgatgcatacctagaactaatactaaaaataattatacccttctccatctctntatgctcttactactgaagtactgtataag

SEQ ID NO: 39547 - DNA, 101 bp, rice(Oryza sativa)
  misc_feature (71): n=t or c
tggattttaaactcttgagagtcgagagaacgtccccacgttgcttgcatgctatttaaatagttatgaanttttttaaaaaaataataagaagactatga

SEQ ID NO: 39548 - DNA, 101 bp, rice(Oryza sativa)
  misc_feature (71): n=a or g
ccggtggtccaatggaaccatcgccctggacggcagactctggtcagtgcgactatctgagcacacactcntctggaccaccacacgggacgtaggagtat

SEQ ID NO: 39549 - DNA, 101 bp, rice(Oryza sativa)
  misc_feature (71): n=t or g
cctttgacaagatggctcgtgtcaatgtgttatgtgtgatttgcaagtacaacattcgatcaacgtaacanggagtctagtagaaaaactcgaatacaata

SEQ ID NO: 39550 - DNA, 101 bp, rice(Oryza sativa)
  misc_feature (71): n=a or g
ccttcggggaggctttctctcaactgctcagctttgagcagtgcaacaatctccgtcacggcggtgagtcntcagcaaacctggcgaatcgagggtgcggc

SEQ ID NO: 39551 - DNA, 101 bp, rice(Oryza sativa)
  misc_feature (71): n=t or c
ggtccctgtacaattgggagccaatactgtttgcctcactagtttcttcttcctgttacgtgttttcttanatgtcgaaggccaaaaagctctcaccaaat

SEQ ID NO: 39552 - DNA, 101 bp, rice(Oryza sativa)
  misc_feature (71): n=t or g
tcgagcttccaaaattcatatctctcaatctgtagctccgattgactacgttcaacttcctataattccgnaaaattgagatctatctaatggcactatta

SEQ ID NO: 39553 - DNA, 101 bp, rice(Oryza sativa)
  misc_feature (71): n=t or c
ttttgctccatccattgctgtttcgttctattggtccgtctggtcgttcgtcgtattttgtttcttttatncctttacggaattactaaaattgtgtctcc

SEQ ID NO: 39554 - DNA, 101 bp, rice(Oryza sativa)
  misc_feature (71): n=a or g
cctggcctccctgacggtgatggcttcgtcttcttccccatggccggcaccattgctgccgccatcctccnctgccttgacgccgccaccgtgctctggcc

SEQ ID NO: 39555 - DNA, 101 bp, rice(Oryza sativa)
  misc_feature (71): n=t or c
tgccgatctcgtgggcttctgtaatcgccacggtgagggctattctcaccatatattaatgcgtaagcaangcactgaaacgtgcgattgtttcctgccaa

SEQ ID NO: 39556 - DNA, 101 bp, rice(Oryza sativa)
  misc_feature (71): n=t or c
ttacaccatcctctgaactcataattacacagtattcgtcacctctatggtctggaactatctgttcatanttttatatatgaagccgtcaatgctccttc

SEQ ID NO: 39557 - DNA, 101 bp, rice(Oryza sativa)
  misc_feature (71): n=a or g
aaatgtcaaaaatcccttatattaggggacggatggagtaatttttaagtacatgaattgatcgagtttancttagaaaaaaagtcaaaatgatttataat

SEQ ID NO: 39558 - DNA, 101 bp, rice(Oryza sativa)
  misc_feature (71): n=t or c
atacaatactagccactccctatgtgaaatatagtattattttcttcgtaaattaggggtctgtttggtanagcttcagctctagctccatctctcctaga

SEQ ID NO: 39559 - DNA, 101 bp, rice(Oryza sativa)
  misc_feature (71): n=t or c
tgcatttggttcgagtgtttatgaggccacagttgcccatgcaggtagtgtgattttgagtttcatggacnaggcggtcaaggtgctctgcctcctcccgc

SEQ ID NO: 39560 - DNA, 101 bp, rice(Oryza sativa)
  misc_feature (71): n=t or c
tcactccccttcgtccggccggatctaggagcggggaaggagggagtagccgccactgtcgcttcctccancgtcgtcaccgtcgccgcgtctgcgccacc

SEQ ID NO: 39561 - DNA, 101 bp, rice(Oryza sativa)
  misc_feature (71): n=a or c
acgtgttttagtgatcctccatttccttttggagaaaatcccttgtatacggtatacctctgaaattttanctaatcccttctatgcccctaaattttgct

SEQ ID NO: 39562 - DNA, 101 bp, rice(Oryza sativa)
  misc_feature (71): n=t or c
gtttcaagtcatagaattccactctattggtcaagcacacgatggagaactaaccttaaagctaaaaaatnccaccataattattgcttttgttgcagctc

SEQ ID NO: 39563 - DNA, 101 bp, rice(Oryza sativa)
  misc_feature (71): n=a or g
tacttatttaattagttatatcttaagtatttattaaaatttaatgggttcttcattaaattgttcatccnatttatggtttaattacattgttgcattca

SEQ ID NO: 39564 - DNA, 101 bp, rice(Oryza sativa)
  misc_feature (71): n=a or g
acgcatccttcaacttacaaaaccgtgtaaacaaggtcccttggcagtattagagcaggtacaatagcggncaataagccagttataaacatattttaaag

SEQ ID NO: 39565 - DNA, 101 bp, rice(Oryza sativa)
  misc_feature (71): n=a or g
taaaaaatatcattgtatgttgggtttacgattacgacaggctcttctgtttcgggcaccggcgaaattcngaatttcgtgaaatccggtaaaaaaccggt

SEQ ID NO: 39566 - DNA, 101 bp, rice(Oryza sativa)
  misc_feature (71): n=t or c
atagtccattcggtgctgccatggcccaaatctgtgcctcctctttgatctttgcaaccaagtatgttgcngatagtttttttttgtcttaactgatttcg

SEQ ID NO: 39567 - DNA, 101 bp, rice(Oryza sativa)
  misc_feature (71): n=a or g
ttgagaaactgagtatctctataacaaatgtagaaaacatcacatatcatatttcaagtttctcctataancatgtttgatcaaaatactcacagtggaac

SEQ ID NO: 39568 - DNA, 101 bp, rice(Oryza sativa)
  misc_feature (71): n=a or g
aagattagtgctagcacgttggtggaaaaaatccgcatgataactataatttgcatgctgcgtggggttcnaacccaggacctcattcccaccagctatgc

SEQ ID NO: 39569 - DNA, 101 bp, rice(Oryza sativa)
  misc_feature (71): n=t or c
ccgagacatgcgaggacgcgtttggcgaggctgacggtgagccgtccgccgacgaactgttcgtcgccganctcctaccgccgctgccgccttctgcggat

SEQ ID NO: 39570 - DNA, 101 bp, rice(Oryza sativa)
  misc_feature (71): n=t or c
gtgggccgctcaagctcctccttcggccacctctaccattgctaccccctcctcgccaaccactgcctccntgtggacgagctggcaagctcaccgcccgc

SEQ ID NO: 39571 - DNA, 101 bp, rice(Oryza sativa)
  misc_feature (71): n=t or c
acaagccgggtcccactgggttccatcaaagaagaaacataccaccaattcacaaccatatgctgataggntccattatatatcattttttaatctcttaa

SEQ ID NO: 39572 - DNA, 101 bp, rice(Oryza sativa)
  misc_feature (71): n=a or g
agatataatatatatatataataggtaaagaaatacaaatattacatattcaactggtgaatctgtcaacnggtgatacccgtagaccggatatagaggat

SEQ ID NO: 39573 - DNA, 101 bp, rice(Oryza sativa)
  misc_feature (71): n=t or c
attagtatactggaacatgataagtggccctgcagcctgcaggccacccggaccccggaactaagtactcncctataggagtacctagccaaacaataaca

SEQ ID NO: 39574 - DNA, 101 bp, rice(Oryza sativa)
  misc_feature (71): n=a or g
ctagaccgacatggattgctaggctgaacataggccatttttgaggataaattgcctttgttctcttcctngaagcaacttcttaagggagatttgcttct

SEQ ID NO: 39575 - DNA, 101 bp, rice(Oryza sativa)
  misc_feature (71): n=t or c
cctctaatggatttcttcaggtgaaaaccacgtcctgtcgcaggacgggtgatgatggtggcattctcggngtcgtatcctccatggaggcatcgtttgag

SEQ ID NO: 39576 - DNA, 101 bp, rice(Oryza sativa)
  misc_feature (71): n=a or c
ttttcttcatatgtagatcgaatttagactggcatgtgttgtgtagtgacttgtattatcataatttatantgttacaattttctctataattttttaaga

SEQ ID NO: 39577 - DNA, 101 bp, rice(Oryza sativa)
  misc_feature (71): n=a or g
ccacacgaatacagtggggcccaagttggcggtagattagaattggtggattactcttttttctacatctnatctaatggttgtaaaggatggacccacca

SEQ ID NO: 39578 - DNA, 101 bp, rice(Oryza sativa)
  misc_feature (71): n=t or g
gtggtgggaagagctagagatagaagaagcagtagggtcggggaagccgatgtcgtggacggcgccaacgntgttgaagaagaggcgcttgttgagctcct

SEQ ID NO: 39579 - DNA, 101 bp, rice(Oryza sativa)
  misc_feature (71): n=t or c
aatcctgcagaaaaatcaaggtggaggggatcaacgtcaaggcagtctctcggcaacgtcaagggctccgncggcgtcggacactaagatgggccgaggtg

SEQ ID NO: 39580 - DNA, 101 bp, rice(Oryza sativa)
  misc_feature (71): n=a or t
cgcacgtacaccgtgtgcgttctcgagttctcccgcgcacagcgcagagagatcgatatggggcagcagcngccgcaggacgccgtggcagcgaacggcaa

SEQ ID NO: 39581 - DNA, 101 bp, rice(Oryza sativa)
  misc_feature (71): n=t or c
catgcatactccgtgtacatcatctagcaaatatcacagaaaattccataaaagcatggacacatacttcnaataatattacacttatgtgtaaaatctta

SEQ ID NO: 39582 - DNA, 101 bp, rice(Oryza sativa)
  misc_feature (71): n=a or g
attgtgataaaaattcacctcaaaaactgtgaaaaaagacataatttcttactttgaaggcatttattctnaagttttatgtaatttactcaaagataaag

SEQ ID NO: 39583 - DNA, 101 bp, rice(Oryza sativa)
  misc_feature (71): n=t or c
cggcagcggcccaccctccccttcgctagattcagcgggctcccgcgaccgacggcaaactacccacgagnggtggcgttgggctcccctccactagatcc

SEQ ID NO: 39584 - DNA, 101 bp, rice(Oryza sativa)
  misc_feature (71): n=t or c
gttgcacgtagatcgttaccaacggcctccacctggggcacctgttccatcgatcccgcattgccaccatnactgcaagctcgagcttggcaatcaccttc

SEQ ID NO: 39585 - DNA, 101 bp, rice(Oryza sativa)
  misc_feature (71): n=t or c
atatatatatatataattaaccatgcagaacgaacagggccatgcaaattaaataaaaaaaatggtagatngatctttagtcccggattcatagtcccggt

SEQ ID NO: 39586 - DNA, 101 bp, rice(Oryza sativa)
  misc_feature (71): n=a or g
tcatacctcttctcaacccattccatctctctcacgctggggctaggtggcggacgaccattggtgggcgnctgaggcggagcgggcggccggcggtggag

SEQ ID NO: 39587 - DNA, 101 bp, rice(Oryza sativa)
  misc_feature (71): n=t or c
ttaaaatgtggaggatatgtttgcgatatgtcatagtacagtacttatcaattttttaaactattttcgcngagtgttaatatatggcctattattaatat

SEQ ID NO: 39588 - DNA, 101 bp, rice(Oryza sativa)
  misc_feature (71): n=a or g
acactaactattattttaggacaaaatatgttacgtctggatttgatcatgcgatcagtcagtatggaccnagacgacaacgaaaaaacatgtggtttttc

SEQ ID NO: 39589 - DNA, 101 bp, rice(Oryza sativa)
  misc_feature (71): n=c or g
tgcatctatgcatggagagcaagtgtatatatagcagtatatagcattgtggagctagctagaaatttagngtctgttcactttgatgcattttcaacctt

SEQ ID NO: 39590 - DNA, 101 bp, rice(Oryza sativa)
  misc_feature (71): n=a or g
taaatagaggtaagtgcatgaaagtagtgattagtggtaccaaaaaaaggatacttacgatgaaatcgtcntcgtaatgttaggacacacgaagcatcttt

SEQ ID NO: 39591 - DNA, 101 bp, rice(Oryza sativa)
  misc_feature (71): n=t or c
agaaatttaaggttgagctctaaagtgtttatcagattggctctgactcatttatcttgagtatgttctcngaatttttgcaaatactttctatatttttt

SEQ ID NO: 39592 - DNA, 101 bp, rice(Oryza sativa)
  misc_feature (71): n=t or c
gcagccagctgcagatgcgccatctctgctccatcggccatactctccacggcatcggcaacggcggcggncgggcggcgccaagcttcagctcgggccag

SEQ ID NO: 39593 - DNA, 101 bp, rice(Oryza sativa)
  misc_feature (71): n=a or g
ggcggcaacgaattcggcaggagtcgacagccatcctccacacagatccggcggtggcaggaggagaacgnccgctgcgacgggtggagactggcggcggc

SEQ ID NO: 39594 - DNA, 101 bp, rice(Oryza sativa)
  misc_feature (71): n=a or t
tttgagttaccatttcgccaaccggttcccattcccagaaatatagtttctaggatttttttatttttttnaaaaaatgttgcatgtcttaatctctttga

SEQ ID NO: 39595 - DNA, 101 bp, rice(Oryza sativa)
  misc_feature (71): n=a or t
gtgccctaaaaattaggacagcccagccacaatccccagcatttggaattccagccagtagccctcctttnaaaaaaaaaaaaacaaacatctatattctc

SEQ ID NO: 39596 - DNA, 101 bp, rice(Oryza sativa)
  misc_feature (71): n=a or t
ttggcgttgtgcttgctttaagatttgtgctttttggtatctgcacatccaatatttgggttttttttttnaggaataagttcatccgaggtcccttgact

SEQ ID NO: 39597 - DNA, 101 bp, rice(Oryza sativa)
  misc_feature (71): n=a or t
ggaagcaaaggaaagctgatgaggtgcgtgttttttggaagtgtgagcgagttgtgttttttggagtgagngcgaagtggaaagggaatgatgatgatgaa

SEQ ID NO: 39598 - DNA, 101 bp, rice(Oryza sativa)
  misc_feature (71): n=c or g
gcttaccgagtgcccgatattgctcaactcacggtaacactaaaaaacttaccgagtgatactgtggacgnacggtaacaaacaaactgttaccgtgtgat

SEQ ID NO: 39599 - DNA, 101 bp, rice(Oryza sativa)
  misc_feature (71): n=a or t
atgttatctctactttgaatatgccatgcatgtagagtactaggcttgcttggtgcttgtcagtacaattnatttgtgctgactcttgcttgtattgttgt

SEQ ID NO: 39600 - DNA, 101 bp, rice(Oryza sativa)
  misc_feature (71): n=a or t
tcatcttatcccatttcatcccaaccatccattcgtcttctttttttattcccgcccttaataatccatanaagttccaaaacatcctctgagataaaata

SEQ ID NO: 39601 - DNA, 101 bp, rice(Oryza sativa)
  misc_feature (71): n=a or t
ctgcaatatagcatctagaggggttgtttgtacaaatatggattctcactaacaaatggccccgcagaaangtggcttctcagtgagccgttaattggatc

SEQ ID NO: 39602 - DNA, 101 bp, rice(Oryza sativa)
  misc_feature (71): n=a or t
acaaatgtacagcaaatcgttttacaaagcactaacccctttggtcaaaattatttgatgctggaagcatngaccattcatgactagagatatagatgacc

SEQ ID NO: 39603 - DNA, 101 bp, rice(Oryza sativa)
  misc_feature (71): n=a or t
taatggttcttcatttgtaaaccatgtgtttgtgttgtcaaatttactcgggacatccgaaacgtaaaacntcatgttttgtgatttgtttaatgaaacct

SEQ ID NO: 39604 - DNA, 101 bp, rice(Oryza sativa)
  misc_feature (71): n=a or t
gttggcatctcttaaaaaccgatcttatcaaataccaaataaactgaaccgaagaaaccggaaaaaaccgnacgcccatccctactcacgggagttcgatc

SEQ ID NO: 39605 - DNA, 101 bp, rice(Oryza sativa)
  misc_feature (71): n=a or t
cagatgtagttgttattttgaacgggacctaatatttcgcatggatgttcagttcctcagccgatggaaangaataaaattctcttctctgaagaacagcg

SEQ ID NO: 39606 - DNA, 101 bp, rice(Oryza sativa)
  misc_feature (71): n=a or t
ttttagcagtttagtggctacattgagatgtgcactcttgtttcacaaacttccaaaatgccatttttttnaaaaaaaagttatgagcatccgtctacatg

SEQ ID NO: 39607 - DNA, 101 bp, rice(Oryza sativa)
  misc_feature (71): n=a or t
tggcaacgcgtgatacactcgttgtgataccctatcgcatcggaggtacttgcaacgcctgccaacgaaantttttcattgcgatatctccatattgcaac

SEQ ID NO: 39608 - DNA, 101 bp, rice(Oryza sativa)
  misc_feature (71): n=a or t
ccttggaatgtctaagggtaactttctgagcccaaagtttacatagtccaagtaattgacctaaaaaaatngtgtgaatggagtaaatatattacagtaaa

SEQ ID NO: 39609 - DNA, 101 bp, rice(Oryza sativa)
  misc_feature (71): n=a or t
cagtgcatgtccttctgttcctagttcctactgggctagagggagatcttgtgccttcgattttttttttnaaaaaagggaaaaaataagcatcaattctt

SEQ ID NO: 39610 - DNA, 101 bp, rice(Oryza sativa)
  misc_feature (71): n=c or g
aaacaactggttttatcacacaactctctccaagaaagccaaagaaaatgccacactgttttctttttctnatatttttctttttgttccttttttctaat

SEQ ID NO: 39611 - DNA, 101 bp, rice(Oryza sativa)
  misc_feature (71): n=a or t
aacacgaataggatcttgtttttttttccttcacttcaattttttgctccactggcatagtttcaatctanataggccttaccaaattttgtcagtgccaa

SEQ ID NO: 39612 - DNA, 101 bp, rice(Oryza sativa)
  misc_feature (71): n=a or t
tttctccatcgaaaacgacttgaatgaatatatcaagaaatcacttaaattgccggccattgaaaaaaaanatatgtatacttccttgcgacctgcaagtc

SEQ ID NO: 39613 - DNA, 101 bp, rice(Oryza sativa)
  misc_feature (71): n=c or g
ggcatctcagagaattgatcctctgttgccatccaaggttcatatagatgctactcgatcttttacgaagntctcccagacagagatcaagccggaagtac

SEQ ID NO: 39614 - DNA, 101 bp, rice(Oryza sativa)
  misc_feature (71): n=a or t
tacgaaggtctcaagcatatcctcctgctgttctggatactggtttagagttctacaacgtcactgatatntccctttggaaggctatgatttttcagcac

SEQ ID NO: 39615 - DNA, 101 bp, rice(Oryza sativa)
  misc_feature (71): n=a or t
gtattgattttttatatctattgtcttgctgcagccttaccttctctatataattgaattgaagttttttnaaaaaaatggaacataggatgggaatatta

SEQ ID NO: 39616 - DNA, 101 bp, rice(Oryza sativa)
  misc_feature (71): n=a or t
gtttgaaaatctggcgacacatttatagcaaatgtcattagaaacaacggacattctgtactttttttttnaaaaaaagaaacaagtttcaactgggtaat

SEQ ID NO: 39617 - DNA, 101 bp, rice(Oryza sativa)
  misc_feature (71): n=c or g
tttgtctaatttaattttgtgctcttctaaattcttgtctaatttagctatgtgttcctcttattttcttntaagtttttgtctattttagttctcttctc

SEQ ID NO: 39618 - DNA, 101 bp, rice(Oryza sativa)
  misc_feature (71): n=c or g
aagcagctaggcaagcaatagggggcatgcgcttgaatatagcacgcttgcacatagcaccccatctctangttattagctctcccgtgccccttcccccc

SEQ ID NO: 39619 - DNA, 101 bp, rice(Oryza sativa)
  misc_feature (71): n=c or g
cagcgatctcatctgctgctgctgctccggcaggattgcagtaaccaccacggcaccaccaccaccaccancagcaacagcacgtaccgtgtggcgtcagg

SEQ ID NO: 39620 - DNA, 101 bp, rice(Oryza sativa)
  misc_feature (71): n=c or g
ccccttaaataggacagcataacaaccactaagctagctcaagtgtacgttgaatgtgaaattaaattttngttatattttacttacgctttaattaacta

SEQ ID NO: 39621 - DNA, 101 bp, rice(Oryza sativa)
  misc_feature (71): n=c or g
gacaatatgatccatgagtgtccattcgatccattgagcatttgcaggcagctggtgcttaatatatttgncttttcatcatcatcgtccgatcgatcgac

SEQ ID NO: 39622 - DNA, 101 bp, rice(Oryza sativa)
  misc_feature (71): n=c or g
taattgcttagtattggacccctacacaatgcctggtcttctgcttgacaatttgttctcgttttcttggntaggttatcctccacaaataaaattctata

SEQ ID NO: 39623 - DNA, 101 bp, rice(Oryza sativa)
  misc_feature (71): n=a or t
agtcctatcatataacggtattggtagtggcggtatgtcactgctactgcagctgtctatggacgctatgnaatacttcatccgtttcacaatgtaagtca

SEQ ID NO: 39624 - DNA, 101 bp, rice(Oryza sativa)
  misc_feature (71): n=c or g
ctaaaacctctaaaatggtgggaagtgagaataccctaactagtttagccaacccatccaggtttaagtcntaggcttaacctaaatgcttgtatttacgg

SEQ ID NO: 39625 - DNA, 101 bp, rice(Oryza sativa)
  misc_feature (71): n=c or g
tcttttaagaagatactctttccgctggacctgtcctttttttttatattaacaagggctgtgtttagttnacgctaaaattagaagtttggttgaaatta

SEQ ID NO: 39626 - DNA, 101 bp, rice(Oryza sativa)
  misc_feature (71): n=a or t
tccgtgacgaaccgtgtgccatgagaatctagcacttcaatttatttttatttcaaatcttctatctatcnatctatctattatattattaaatcagcttt

SEQ ID NO: 39627 - DNA, 101 bp, rice(Oryza sativa)
  misc_feature (71): n=c or g
aacatcggttagattatccaatcaccaatgaaagttggaaatatctaaagctgttgttatcggtatcatantaacaaatagatgatccaatctccaatgag

SEQ ID NO: 39628 - DNA, 101 bp, rice(Oryza sativa)
  misc_feature (71): n=c or g
aatagaaatgaaattaaacacttgttttagactggggccgacggtaagattgggtggtatctgggaaaggntagtaccgtccccggtcaattgaggaccga

SEQ ID NO: 39629 - DNA, 101 bp, rice(Oryza sativa)
  misc_feature (71): n=a or t
acagcgtcaaacattttgtgatgagggagtaccagaaaccatgcaatagagaactgagatttatttttttnaaaaaaaaacatactagtatacttataggg

SEQ ID NO: 39630 - DNA, 101 bp, rice(Oryza sativa)
  misc_feature (71): n=c or g
tgaaatgtactgtactacagtaaaattcaccgactcatctgttgttgtcgtggttcatcggtactcccttngtcccataaaaaactaacatagtattatat

SEQ ID NO: 39631 - DNA, 101 bp, rice(Oryza sativa)
  misc_feature (71): n=a or t
atgtcgagggcggcgagcgcctcgccgtcgggggacaggctgagcagctgctgattataggcaggcatgangaggcgtggatgggaattgttgacgacgac

SEQ ID NO: 39632 - DNA, 101 bp, rice(Oryza sativa)
  misc_feature (71): n=c or g
cctggcgtggcgcgcggtcagtttctgaccctttagtctctcctctctactacatgtatatacgtatgtantagtagcatgcccgtgctaacgctacggta

SEQ ID NO: 39633 - DNA, 101 bp, rice(Oryza sativa)
  misc_feature (71): n=a or t
ctatattgttcttggagatcaaatgctcatttctgaaatgccgccgctgtttgtggaagtttagggagtgntttttttttgtgtggggtttttggttatcg

SEQ ID NO: 39634 - DNA, 101 bp, rice(Oryza sativa)
  misc_feature (71): n=a or t
ttaattctcagccgattttgtctaacacttgtctcttttagcctccttctcctccttctctttctgtacancaatcatcaagtgaccagactccatcggct

SEQ ID NO: 39635 - DNA, 101 bp, rice(Oryza sativa)
  misc_feature (71): n=c or g
taggagtacccctacaacgccatcgtgctaagtgcaaacaaaacacgaggacacagatcagatcagtcttnaacctcctcgctgagaacacagagaaaggc

SEQ ID NO: 39636 - DNA, 101 bp, rice(Oryza sativa)
  misc_feature (71): n=a or t
atcctttactaggataaagggaatagtacgcatggtcaaattgtgattccccatgttgcttccatcatacngggtctgtttggttcccggccaaacattgc

SEQ ID NO: 39637 - DNA, 101 bp, rice(Oryza sativa)
  misc_feature (71): n=a or t
tggttcggcgttgctgatcagtgcacacctcccgttctcaaccacaacaaagtggtcaaaactcatcaacntgattaattaaataaaaaaataaaaataga

SEQ ID NO: 39638 - DNA, 101 bp, rice(Oryza sativa)
  misc_feature (71): n=c or g
tggcacatgttcagaaacgcttggagacaaagatcgctcttccttaaaaattgccaaagaaaacagaaatnaatcataggaaagaaacatcgcgataaaat

SEQ ID NO: 39639 - DNA, 101 bp, rice(Oryza sativa)
  misc_feature (71): n=a or t
tattcatctctagaaattgatttttttaaccaaaaatagggctcaatcactttccgtctgtctaaaggccncattgtttggcttattcaccaaacgaacga

SEQ ID NO: 39640 - DNA, 101 bp, rice(Oryza sativa)
  misc_feature (71): n=c or g
tgtttgggacgaacggatcatgaaatttctgcattgcaaatagggcctaataagatgattgccttttcacnggatatgaacaagaaagcattgtaaccgtt

SEQ ID NO: 39641 - DNA, 101 bp, rice(Oryza sativa)
  misc_feature (71): n=c or g
acaaataggggtcacaacttgataaaatactgcggtcaagaatagtgctttaaagaaaccaaagattacancaacctcaaatccgactacgttttccacaa

SEQ ID NO: 39642 - DNA, 101 bp, rice(Oryza sativa)
  misc_feature (71): n=a or t
aaaaaagaaaaagacaaacaagtggtatgcgcactagatacaatgaccatattccctccggttccattttnattgacgttttggacaatgacacggtatac

SEQ ID NO: 39643 - DNA, 101 bp, rice(Oryza sativa)
  misc_feature (71): n=a or t
ccttccggtcaggcagcggcgtcgtcctcgccatccctaaacccatcagcgcaaaaaaaaaaagtcaaaanttttttctcaacaaaaaggcagtggtaaat

SEQ ID NO: 39644 - DNA, 101 bp, rice(Oryza sativa)
  misc_feature (71): n=c or g
ttacactgcatcagacattcagaactatctcatttcgcaagccaaatcatgaaaattgaggctgaacaagnatcccgcttacggatcataccatttaactt

SEQ ID NO: 39645 - DNA, 101 bp, rice(Oryza sativa)
  misc_feature (71): n=a or t
tctcccccaatctcatttttaatttcaaacctcttaatgaacattgtggtcgtgggtcacgtctttttttnaaaaaaaaaaactggagacatgagtcttga

SEQ ID NO: 39646 - DNA, 101 bp, rice(Oryza sativa)
  misc_feature (71): n=a or t
cagatcccacctttgcaaaagctaccagggttgcctcagaatttccctgttcaattgcagaataatcagcngggacaacccttgcagggtcctgctcaaca

SEQ ID NO: 39647 - DNA, 101 bp, rice(Oryza sativa)
  misc_feature (71): n=a or t
gtgatatatcgtgtcacagtacgaggaacagatggagaggtaagtttaaaggtgttgcctcttcttgaagncttgtgattttttctctggaagcttcactt

SEQ ID NO: 39648 - DNA, 101 bp, rice(Oryza sativa)
  misc_feature (71): n=a or t
tacatagattgcgatacatcaaatacactattgcaggccggcgctcccaacggtgagctctccatccctcnactcattttttttttcatttctctcttttt

SEQ ID NO: 39649 - DNA, 101 bp, rice(Oryza sativa)
  misc_feature (71): n=a or g
aaggtccgtgaaaatctaactttttcatgcaggtggtgtaccctcacgcaaaaatcgatttttcgtgtttnggtgcttatgtcgtctgcacgcgaaaacaa

SEQ ID NO: 39650 - DNA, 101 bp, rice(Oryza sativa)
  misc_feature (71): n=a or c
tatcaaagccaaagagaaaccaaagagctggggagatcgagatacacacaaagagcgatgtcatgccgtangaaccccagcgcaactgcaggctcctggcg

SEQ ID NO: 39651 - DNA, 101 bp, rice(Oryza sativa)
  misc_feature (71): n=a or g
tattcatatgctagttgttggtcgagattggtacttaacggtcgtcaacatgcattatttagtcttcattntggctctcgagaaggcacacaagaagggtc

SEQ ID NO: 39652 - DNA, 101 bp, rice(Oryza sativa)
  misc_feature (71): n=a or c
ccattgaactcaattttgagcagtacatgacatgcaaattagattggattaatgtggacgcttggaagtgnttttgtcactggtggacatcagataagtac

SEQ ID NO: 39653 - DNA, 101 bp, rice(Oryza sativa)
  misc_feature (71): n=a or g
catttcaaggcaagggtatactgggagcaagccctgaagagaataagaagattgaagaaaagcccaagtgngaagagaggtttgattcactcaaggcagct

SEQ ID NO: 39654 - DNA, 101 bp, rice(Oryza sativa)
  misc_feature (71): n=t or c
tgcaatattttgaagttccaaattaatgattcccaagccacctttgctctttggcctgcatacaagatccnaggctgctagggagtgagaatttgcactta

SEQ ID NO: 39655 - DNA, 101 bp, rice(Oryza sativa)
  misc_feature (71): n=t or c
gaacattgccaatcagattagttgtagatctcgcacgaaactgtacacaagctatctatcgatactatcancagattagttgcaaaatcccgatgcatgca

SEQ ID NO: 39656 - DNA, 101 bp, rice(Oryza sativa)
  misc_feature (71): n=a or g
acaggacttaccattgtgtctggtttgaccgctcccttaagcagtgagacatgaacaactggatgaatttngctgtcagctggtaagtcaagtctgtaggc

SEQ ID NO: 39657 - DNA, 101 bp, rice(Oryza sativa)
  misc_feature (71): n=a or c
gaccatccgaattctgatcagatcgaccagaaattggagggcatatgtccttcatacaagatcatgattgntaagtaatactaactgccaggggattcttg

SEQ ID NO: 39658 - DNA, 101 bp, rice(Oryza sativa)
  misc_feature (71): n=a or g
cctgaggtcttcttcaaccacgtcgactgttccatctagatccacattgtacagtactatatataagcacnattaagaacatttgcaacaagcacatatac

SEQ ID NO: 39659 - DNA, 101 bp, rice(Oryza sativa)
  misc_feature (71): n=t or c
ggttctttctgtagaacaatttcatgtccttactttcttgaagataatggaggatgtccttgatgcccttncaatgcctcttggtgggctctgtgttgtac

SEQ ID NO: 39660 - DNA, 101 bp, rice(Oryza sativa)
  misc_feature (71): n=a or g
atgacctcgccccaccccgacatcgtctgctcctgctaggactgatggggcttcatctggctctggttccngatcatcctaggaagaggaaggggagggcc

SEQ ID NO: 39661 - DNA, 101 bp, rice(Oryza sativa)
  misc_feature (71): n=t or c
gttttccccacaacaccccctccacccctcgtctcctcccgaagcaaaacaccagcgccataaatcacttngctgctttctcgcgtggcgattcccaagtg

SEQ ID NO: 39662 - DNA, 101 bp, rice(Oryza sativa)
  misc_feature (71): n=a or c
ttttcttggtatatatagcatcgttggggaaaaacatcacaaagaatgattggcgagcttgaagaaagatnatttacatgtgagcaccttacaagtgttaa

SEQ ID NO: 39663 - DNA, 101 bp, rice(Oryza sativa)
  misc_feature (71): n=a or c
ttggcatagtacttggatatgtgatggtgacattactatctttgctgaaggtgaccccaaaggcagaaccntatatatatggggaatcattctcccatgaa

SEQ ID NO: 39664 - DNA, 101 bp, rice(Oryza sativa)
  misc_feature (71): n=a or c
gatacggagggtttccgaccaaattggtgagggcgtgagcatttatggcgcatgagggttccgtttttctngaaaaatcgaagggagagcccccgggatgg

SEQ ID NO: 39665 - DNA, 101 bp, rice(Oryza sativa)
  misc_feature (71): n=a or g
gcttttagtagatctagcatatttatgaaggggacacggtcggtctaatccaaacaaatcggctaaaatcnaaggaagggaggagaagacaacctagccct

SEQ ID NO: 39666 - DNA, 101 bp, rice(Oryza sativa)
  misc_feature (71): n=t or c
cctgcctcaaactcagcttctccggtagatctgagagcttctctcctttttggcttaaacagcagctttgnttcgaacgaaatttgttcagctgaggctcc

SEQ ID NO: 39667 - DNA, 101 bp, rice(Oryza sativa)
  misc_feature (71): n=t or c
tatacttgtggcataaagattatttttgaaaatcagacatcatgatggcttcgtagatcctagaatcaganaacgggtatgtagtcatcttcctttagtct

SEQ ID NO: 39668 - DNA, 101 bp, rice(Oryza sativa)
  misc_feature (71): n=t or c
tattttttagtatataatgccttgggtttaaatcacctcttgagtctcactttcgtttggatttgagtacncttggtggattttttgttgttgatatctag

SEQ ID NO: 39669 - DNA, 101 bp, rice(Oryza sativa)
  misc_feature (71): n=t or c
tgctattgctactactaccacgcagcgggtgacacacacacacacaaaaagtcacaaatctctacgttttntttcctcgcgaggcgtagggcgcgcatacg

SEQ ID NO: 39670 - DNA, 101 bp, rice(Oryza sativa)
  misc_feature (71): n=a or c
gttgacatagcgccacatcctgagtaaagatcaagcagagaagctgtctctgtttgttcactatatggtgncacaatatcagccgacaattttcccttaga

SEQ ID NO: 39671 - DNA, 101 bp, rice(Oryza sativa)
  misc_feature (71): n=t or g
agcttcaaagaatgggaaggaggtgaacaaaccaaaacaaattcagtgaaccacaagaacaggccgagccngatcaacgtcgtcgtcgacaaccggagaaa

SEQ ID NO: 39672 - DNA, 101 bp, rice(Oryza sativa)
  misc_feature (71): n=a or c
aatatttgatttatgctgttgcttactcgttggaagtaagatggagtggatgaagacacataacttccctnagggttagtacaagaagcagcagtagaacc

SEQ ID NO: 39673 - DNA, 101 bp, rice(Oryza sativa)
  misc_feature (71): n=a or g
acttgcaaccgcattctgaccttgaagagctggatattataggattctctggcactaggcttccattctgnataacagactcctatcttgtaaatattgta

SEQ ID NO: 39674 - DNA, 101 bp, rice(Oryza sativa)
  misc_feature (71): n=a or c
gatctggagcagggacgcccgacgaacagcatcgtccggccatccagtgagggtgcgtcgtcgtcttcctngggttgtgccattcggaacaccttgaacgc

SEQ ID NO: 39675 - DNA, 101 bp, rice(Oryza sativa)
  misc_feature (71): n=t or c
caaagcagaggactggcatcaaggaggatccaatgcggcctggagaggaggcaagggtggcaccggtcggngaggtggagtgtcgcggatgagtcggggta

SEQ ID NO: 39676 - DNA, 101 bp, rice(Oryza sativa)
  misc_feature (71): n=t or g
cgaaatgccgaagaccgacgatgtgacatggcaggtgcctgagttccagcatcaccatctcaagcatctgnagttcagtggcttcaatgaagaagaaatgc

SEQ ID NO: 39677 - DNA, 101 bp, rice(Oryza sativa)
  misc_feature (71): n=t or g
gccagcaccgtccattgcatcacctctttctgtaagaactgaaacagttggtttgcctactgagaaagcanctggaaatgcatcatccaaagcgcctgcac

SEQ ID NO: 39678 - DNA, 101 bp, rice(Oryza sativa)
  misc_feature (71): n=t or c
gtcgggccgacagtttttccacagtatatgaagcgttctagccacatgttgaggaatgcaacgtgatcccnatcagtgacggtgcttgtcttcatgtggtg

SEQ ID NO: 39679 - DNA, 101 bp, rice(Oryza sativa)
  misc_feature (71): n=a or g
aagggagaccggttaataatattgtaagcatgcatattaatcgccataaaagcaataactagtacacgagnctagacatgacttaatttgaaaacaatcaa

SEQ ID NO: 39680 - DNA, 101 bp, rice(Oryza sativa)
  misc_feature (71): n=t or c
cggatctggagaggctggcgccttcaacggtaggagagcaattccaaggtgggcagggctgcagcagccanaggcttcgcagtggccgataggtcacggcg

SEQ ID NO: 39681 - DNA, 101 bp, rice(Oryza sativa)
  misc_feature (71): n=t or c
aacttaattgattgtggttatttctctacatggcttcctagctgtttggagaacgtcacttccctggttanactgagaataattaaatgtcggggtataac

SEQ ID NO: 39682 - DNA, 101 bp, rice(Oryza sativa)
  misc_feature (71): n=t or c
acatggtccggaacatcgtcatccttcttctttctcttcctctgcgatgatgctttctctaagccaccaanacgtctagctgaaccatggatgcccttttc

SEQ ID NO: 39683 - DNA, 101 bp, rice(Oryza sativa)
  misc_feature (71): n=a or g
caagttcttcttaatcatcattctcagcaacatagaaagtgttcgattcaccacctccatttgtccgtcantttgggagtgacaagtcgttgaaaacaaca

SEQ ID NO: 39684 - DNA, 101 bp, rice(Oryza sativa)
  misc_feature (71): n=a or g
gcaaacctttaatttatccaggtccatctcggggatacaccacacaacttaaatgaaagtgattttgagancttggctcgtcgaacagacgggttttctgg

SEQ ID NO: 39685 - DNA, 101 bp, rice(Oryza sativa)
  misc_feature (71): n=a or c
ctcttcaagcagctccttatgagaaggactagtcaaactctcgagcatactggacattccaggatcctgtnatgcgtagcagaaaacttgaagcgaagaaa

SEQ ID NO: 39686 - DNA, 101 bp, rice(Oryza sativa)
  misc_feature (71): n=a or g
ctacaccatcctacaaggccagacaagtcaatttgatggagagcgatgtcgatgtcgagcagattcatgcnccctcacctggagccgacccattatatgct

SEQ ID NO: 39687 - DNA, 101 bp, rice(Oryza sativa)
  misc_feature (71): n=a or g
ttctgtttgctcgcgttgccgtgataggcgctagaattagcgtccgacagacgaaccatgactgctttgcngtgctcaggacgacctaccagattgaacct

SEQ ID NO: 39688 - DNA, 101 bp, rice(Oryza sativa)
  misc_feature (71): n=t or c
tgaacctggaatgagctcatcccaaggtggtaaagctaaaggtgttgcagatggttcgggtgataaaggtnaggggcttcaagatggtgtggtcgaggatg

SEQ ID NO: 39689 - DNA, 101 bp, rice(Oryza sativa)
  misc_feature (71): n=a or g
ctctctttttttttattaacatggtgattttataccttcacgacgatatcgatggctcctattaaccctcnctttatattatactccatctgtttcacaat

SEQ ID NO: 39690 - DNA, 101 bp, rice(Oryza sativa)
  misc_feature (71): n=a or g
agccgacacaccaagaggaaatgggatggcattactagaatctgaagcacattgccagcaatggaaatctnatggtgcaaaaaaaggaactttcagcaaaa

SEQ ID NO: 39691 - DNA, 101 bp, rice(Oryza sativa)
  misc_feature (71): n=a or g
cgtagcagctgcatcagacaatgaatccctctcatcaatggactcaatatcctgattgctttgcttctccnccatatctttatcagaagcttccttctgct

SEQ ID NO: 39692 - DNA, 101 bp, rice(Oryza sativa)
  misc_feature (71): n=t or c
gtgaaaaggcctgataagaaatcaatgattgcatcaagtagcagctcttcaacatgtcgcacaaggaagcnggtcgcacgtaaagcacctagtaattcgag

SEQ ID NO: 39693 - DNA, 101 bp, rice(Oryza sativa)
  misc_feature (71): n=a or g
cccacaataagaggttggtgatttactcccaggtagaatatgcactcacgacagttagcaatacaaatccntttagcagctgcaataatatgaactctttc

SEQ ID NO: 39694 - DNA, 101 bp, rice(Oryza sativa)
  misc_feature (71): n=t or g
tatcagagagagattcttttgccacgagtttgacaaccatgctcatctaatgcaaatagtatcagctcatnaaagccgattacaagaagcaaaggaatatt

SEQ ID NO: 39695 - DNA, 101 bp, rice(Oryza sativa)
  misc_feature (71): n=t or c
atctcctctttccatggcggctgctggtcacatcgtcttgaaactctcttgattgcttgcttgcttagggnatgtttagttcaaaaatatcacatcgaatc

SEQ ID NO: 39696 - DNA, 101 bp, rice(Oryza sativa)
  misc_feature (71): n=a or c
aacattggtgctggtggtggtgataagactgctacaattgaccctcgtttattcacgcggtacacggatgngaaagagcttgttggcatcggtgagacgag

SEQ ID NO: 39697 - DNA, 101 bp, rice(Oryza sativa)
  misc_feature (71): n=a or g
ccgccctgtgtgctcctcactcagcatgacaacctgggccacgggtcattgggattgggaggaaaagggtnggaagacgcagggagggagggcacctactc

SEQ ID NO: 39698 - DNA, 101 bp, rice(Oryza sativa)
  misc_feature (71): n=a or g
cacttgggcttccaaatcagctaccaacatatcgattatgttgtcttcctcatctgtgtagtttccagccnatgacccactcgtgatatctgaagaagtgc

SEQ ID NO: 39699 - DNA, 101 bp, rice(Oryza sativa)
  misc_feature (71): n=a or g
ccagccacagggtggggtgatggggaaacaagcaacacacctggtcagcaataccctacgaactggaatantcacgtgaaacagccgactgaagcaaattg

SEQ ID NO: 39700 - DNA, 101 bp, rice(Oryza sativa)
  misc_feature (71): n=a or g
aggcctatcacgctgaggaataattgcaggcttagatgggtgtctgaacttatgcgagaggatggaagctnggatgtgaacaggttagaaagtatcttcct

SEQ ID NO: 39701 - DNA, 101 bp, rice(Oryza sativa)
  misc_feature (71): n=a or g
aacctcacatctgtgattacagatgttgcgtatgttggtttctcctctgcaactggcacaatcaacgtgcngcattgtgtactcggctggagctttgcgat

SEQ ID NO: 39702 - DNA, 101 bp, rice(Oryza sativa)
  misc_feature (71): n=a or g
aaggccgatgaatttgagagacgatggtgtgcctttaagaacagggataatgtgccggagaaggagttatngctagccatgatgtatgcgctaagggaaaa

SEQ ID NO: 39703 - DNA, 101 bp, rice(Oryza sativa)
  misc_feature (71): n=a or c
gagctcaaccgtgcaaaggggaatggatggatggatgaaaaaaaacaaaggatatcacgagaagaagatgnaaaaattgtgatcttttgagaggaaaaaat

SEQ ID NO: 39704 - DNA, 101 bp, rice(Oryza sativa)
  misc_feature (71): n=a or g
agaagcaaacctgatcctgaactcacaacacgtgaaatcaagtcatcccacttctttgcaggttttgaacntgtaaccgcttcttcctgatcactatccca

SEQ ID NO: 39705 - DNA, 101 bp, rice(Oryza sativa)
  misc_feature (71): n=a or g
gggtttatagttgaaggtatagaaggcaaggtgtgcaaatttgatagaacattgatattgtcagggttacngataaggtagaccctctatccttggatgta

SEQ ID NO: 39706 - DNA, 101 bp, rice(Oryza sativa)
  misc_feature (71): n=t or c
tcaaaccaacacgtctgtgcctgcgaggacatccgtcagcttccagaacagtcccatattggatcggtcancaatgctgccagtatcgttcgtcctccacg

SEQ ID NO: 39707 - DNA, 101 bp, rice(Oryza sativa)
  misc_feature (71): n=a or g
cagctgtcggttgacgagctcgttgaagtagctctcggccgtctcccataacgtgacctgctcctgctttnggactgggatgaacctttcggctatccacc

SEQ ID NO: 39708 - DNA, 101 bp, rice(Oryza sativa)
  misc_feature (71): n=a or c
acccactcctccccattcccccgcaggcagaggtagtagtagtactagcccaagaagaggaagagcaagangaagctggaggtggaatcctcccgccggcg

SEQ ID NO: 39709 - DNA, 101 bp, rice(Oryza sativa)
  misc_feature (71): n=a or g
tcaggagcaaaagataccgaagcaactatactggattctggcaaccttgtcttgaggagtgtcagtaaccngtcgaggctgagatggcagagctttgacta

SEQ ID NO: 39710 - DNA, 101 bp, rice(Oryza sativa)
  misc_feature (71): n=a or g
tgatgcattggtttggaaaactcttctcggcgcttgtaggagccatgacaatattgaggtaggtgaaatcnctgctaagaatgtcatagagcttgagccac

SEQ ID NO: 39711 - DNA, 101 bp, rice(Oryza sativa)
  misc_feature (71): n=a or c
atgtgtaatccccataaatataatatgtgcatatgccaaggccattatatataacaagccatgagtagaanttgcgaaatgaatattccatttcattcagg

SEQ ID NO: 39712 - DNA, 101 bp, rice(Oryza sativa)
  misc_feature (71): n=a or g
ggagcagtcgaagtcgtccccttcacggggttggccgaaagaactgtacgccagatgatcacccttcttcntcttgccacccaggaagctctgggggtcct

SEQ ID NO: 39713 - DNA, 101 bp, rice(Oryza sativa)
  misc_feature (71): n=a or g
cgccgccggggatgctgcgtttggaggaggcaagaatgagatggtggtggggcgctcgtctcaccggccangtaccaactactaccaaggcggcgcgtagc

SEQ ID NO: 39714 - DNA, 101 bp, rice(Oryza sativa)
  misc_feature (71): n=a or g
ccaacggaaataataaaacaatgtgaccagtatccaccatctaacgagtatatttttatggcgtcgatganaagatatacattttttttgtctcatataaa

SEQ ID NO: 39715 - DNA, 101 bp, rice(Oryza sativa)
  misc_feature (71): n=a or g
tgacggtgcatatatatatacacacacacatctgccatgtcctactactgagtactgactgatggagcttnttaattgtaagcccctgcatgtatgatcag

SEQ ID NO: 39716 - DNA, 101 bp, rice(Oryza sativa)
  misc_feature (71): n=t or c
agtaatgactgattaatgtaggtgcttgaagagcatgagctatcatgtgaggatcttttgcatgtgaaatnggagggcattattttgacaaaacaaagtga

SEQ ID NO: 39717 - DNA, 101 bp, rice(Oryza sativa)
  misc_feature (71): n=t or c
agttcttccttgagatgtgacgcagaaaatatttagcagatgcaacgccggcagtaaaaagcaagggtgtncaccaacccctgagaacaaggcaatatttt

SEQ ID NO: 39718 - DNA, 101 bp, rice(Oryza sativa)
  misc_feature (71): n=a or g
tttaaacgatgctggttgtgttgtgcaaacaaatgaggttgcaggccagagccacctattccagagatgcncatttcgcagcaggttgtgaatgaagtggc

SEQ ID NO: 39719 - DNA, 101 bp, rice(Oryza sativa)
  misc_feature (71): n=t or c
ttgattccaaggccatgtcagatttgtttgcttgccttcgctttcgtctcataatcccatttccttgctgnactctcttcttttctctccctttctcctct

SEQ ID NO: 39720 - DNA, 101 bp, rice(Oryza sativa)
  misc_feature (71): n=a or c
aaaaaaaggtggtccgcgaaaaaatatgatgcaccatatgcacatcatcaaggtgatgatgaacaccaacntgtccatacgaccaccattggtcagtaaga

SEQ ID NO: 39721 - DNA, 101 bp, rice(Oryza sativa)
  misc_feature (71): n=a or g
aactcattcttgccactagggatcgagtctttcggatatgtatcggaagccagctgcggaaaaatctgatnatacttctgatgatgatgaggagcctgaca

SEQ ID NO: 39722 - DNA, 101 bp, rice(Oryza sativa)
  misc_feature (71): n=a or c
ggccacctaaatccagtcaacgaaatcgggccacaggtacatttggcccattaattttcccaaacagtttnggcccaataacgaattctttccgctaatta

SEQ ID NO: 39723 - DNA, 101 bp, rice(Oryza sativa)
  misc_feature (71): n=t or c
agctgcctaacaagtgagagtcttcctagctcaacaaataggctcatgcttttcgtcggagtgcatacaancacccaccctattttttaatcttgctctgt

SEQ ID NO: 39724 - DNA, 101 bp, rice(Oryza sativa)
  misc_feature (71): n=t or c
aatgccccttttactgaagaagaggtgtgggcatcaatcaaaaacataccaaatgagaagtcactaggccnggatgggtatacatgcctattttatcaaaa

SEQ ID NO: 39725 - DNA, 101 bp, rice(Oryza sativa)
  misc_feature (71): n=a or g
ccctaattacctatcagcgtcatacataaataacgagtatgatgcctccggatcggttccaacaccgtcanttttggacgaggtaccggtggcttcagatg

SEQ ID NO: 39726 - DNA, 101 bp, rice(Oryza sativa)
  misc_feature (71): n=t or c
cctgcatcttgattggcgccttcgttcgaagaatgcatgccatttgacagcctttcgttcgatgatctccngttcatcatctccacgacatctatcttgaa

SEQ ID NO: 39727 - DNA, 101 bp, rice(Oryza sativa)
  misc_feature (71): n=a or g
agagaaggatagggaaggaggagctgtgggtcccacatatcggtgggcctcacaaatatgtttttgtgtgnacgactaatagggcccacatatatgttttt

SEQ ID NO: 39728 - DNA, 101 bp, rice(Oryza sativa)
  misc_feature (71): n=a or g
cgaagttactaaatgcctcgtccttcggatggtgagaaatatggatcacctgggctctccgctcgatggcngcacggatccacgcatcgacatcgcaagtg

SEQ ID NO: 39729 - DNA, 101 bp, rice(Oryza sativa)
  misc_feature (71): n=t or c
tcactggaacagacaggtcagaacaaatagttgcccgagctttcatcatctggacagcaaatgtgtggacnaagtttgctgtagcaagtttccgctgaggg

SEQ ID NO: 39730 - DNA, 101 bp, rice(Oryza sativa)
  misc_feature (71): n=a or g
ttgctacccgccgcgcccaggatgtacaccgatgccttccacagtgaacactgcggcggtgtcggtcttgncgcggtgtggaaggaggagacagagagaga

SEQ ID NO: 39731 - DNA, 101 bp, rice(Oryza sativa)
  misc_feature (71): n=a or g
agctccatggtcaggccatcgtagtctatccacacttgcatcgccttgcgactaatcaagctcaggttgcngaacaatcccatgtcctcgtcgtcgtagta

SEQ ID NO: 39732 - DNA, 101 bp, rice(Oryza sativa)
  misc_feature (71): n=a or g
ttgtaagatgtagtctttaatccccccaaaacttatttctcgatacagggattttgtagaaaacatcccanttttgtttaaattccaacacatggaatctt

SEQ ID NO: 39733 - DNA, 101 bp, rice(Oryza sativa)
  misc_feature (71): n=a or g
ctgtggccatcactgcttgtggtctttggtgcgtcaaggaatccaccacatgcaaatattatacttttaanaaagaaaagaaaataaaagttgcaagaatg

SEQ ID NO: 39734 - DNA, 101 bp, rice(Oryza sativa)
  misc_feature (71): n=a or g
aatgtacacatcatgtgttccaagaaccacttgtggtacaatgataagaagcaaacacgcgagctcaagcnccttcatcttcagcaatatccgaattgcca

SEQ ID NO: 39735 - DNA, 101 bp, rice(Oryza sativa)
  misc_feature (71): n=t or c
aaagaaggagcaaattaagccaccatctgatctgtgcatgctatggtgatcaatctctcttctcctccaancttcttgttgttcttcttgtggtgtgttgt

SEQ ID NO: 39736 - DNA, 101 bp, rice(Oryza sativa)
  misc_feature (71): n=a or g
gaccaaggacttttttatctataagcaatttgcggagcagtatgtgtcccaactcaataaaccatatgacngagaggttggcccctcaggacagaaaaagg

SEQ ID NO: 39737 - DNA, 101 bp, rice(Oryza sativa)
  misc_feature (71): n=t or c
agtactgtacatgaatgatcttttgatgtttcttctctcatttttcagcacgcccatggtgaaggtgtcgncggccatgacggtggtcgggagtggggtgc

SEQ ID NO: 39738 - DNA, 101 bp, rice(Oryza sativa)
  misc_feature (71): n=t or c
gtcggagtggtcatttcactgaagccattggaagatgaggatcccatggcagaatatgtttttgcagggcnaccaatctacagtgttgaaggtaagcatta

SEQ ID NO: 39739 - DNA, 101 bp, rice(Oryza sativa)
  misc_feature (71): n=t or c
ctgtcgaatatgtcggcggagtttctcatcgcagcgatgaacatgggcgactcgttgttcttgttcacggntcgtgacagtgccggctctgcagctatcag

SEQ ID NO: 39740 - DNA, 101 bp, rice(Oryza sativa)
  misc_feature (71): n=a or g
gaaacctcgataggagttaattcttgtttccagtcaggtaataccatcaccttctctgctgcaagtgattnaaggattgcaatccagtattcttcacgatg

SEQ ID NO: 39741 - DNA, 101 bp, rice(Oryza sativa)
  misc_feature (71): n=t or c
tctacatcggcaatagtgttgatcgtgtcggaaaaagaactggatgtgcaagttgtgccggaaaatgaacngaaggtgcaagaaccaaaggtgcaagttgt

SEQ ID NO: 39742 - DNA, 101 bp, rice(Oryza sativa)
  misc_feature (71): n=t or g
gcttcgacatgaactcgtaagcctcatggatcatcccagccttgcctagcatgttcaccatgcaggtatantgttccatagtagggggaattctgtactca

SEQ ID NO: 39743 - DNA, 101 bp, rice(Oryza sativa)
  misc_feature (71): n=t or c
gataaggttaacgtttcttgcccggactgatatctctcccaggacattattaactatattgatgagttccnctggaccttccttgtcaggtgttacacggg

SEQ ID NO: 39744 - DNA, 101 bp, rice(Oryza sativa)
  misc_feature (71): n=t or c
gtgcatgccgaatcgcacattgcacggttgtcttcatgctttacattcatggcaagcatccatgatccaanagtaacatcttcgtaatcaaacatccttaa

SEQ ID NO: 39745 - DNA, 101 bp, rice(Oryza sativa)
  misc_feature (71): n=a or g
gagctctaccaaacaggtccagagtgtatggtttggcgtcagattcgttggtgccataaaacatggaagtngattcagaggatctcgttagtgccttcaca

SEQ ID NO: 39746 - DNA, 101 bp, rice(Oryza sativa)
  misc_feature (71): n=t or g
gacacaaaaaccgttgcaccacaaaaggacaggcccaacggccaccttcctgggttagccaacctcttggnggggcctactggcccaggatttcgtggtgt

SEQ ID NO: 39747 - DNA, 101 bp, rice(Oryza sativa)
  misc_feature (71): n=t or c
gtggtgaatgccttgtcagcttgcgtatgcttggcagatctgcatattggtaaaggttttcatacttatgngataaaatatgcatttatgtccaatatcta

SEQ ID NO: 39748 - DNA, 101 bp, rice(Oryza sativa)
  misc_feature (71): n=t or c
attttgaagttgaagtagattttgtcactccaccaggcctagaatgtgcgctaactgaattgttgacaganttaccaactgtctgcctgttgaccacacct

SEQ ID NO: 39749 - DNA, 101 bp, rice(Oryza sativa)
  misc_feature (71): n=a or g
tctgttaagtggttccgttgtatacgcagtctactgttactgatattggaatctttaaactagctgatccntgatgctttctcaaatctcattgtattatg

SEQ ID NO: 39750 - DNA, 101 bp, rice(Oryza sativa)
  misc_feature (71): n=a or g
ctactcctcattttctacattcttttctctgctcttctctacttttctccactcttttgctataggggctngggtggcaggcagcgcacggatctgcctag

SEQ ID NO: 39751 - DNA, 101 bp, rice(Oryza sativa)
  misc_feature (71): n=a or g
gctcatccttctggtgttgggcatagcggtatggctggactgccatggggcgggtgtccggtagcagatgnatgtggtggtcgcgtgatcgcggcggtggc

SEQ ID NO: 39752 - DNA, 101 bp, rice(Oryza sativa)
  misc_feature (71): n=a or g
aagaataaatgcattcttctcaaacatacctacagctttcagtgcatgagtcatgtcagcttctgtaaacncaatctcacttttgttatcagagttgcagc

SEQ ID NO: 39753 - DNA, 101 bp, rice(Oryza sativa)
  misc_feature (71): n=a or c
atagcctcctgtctctgatccaggagactggtggagtgcccgcaataagtacaacgaacacaagaagcagnctccttctgccccttcacagctatgactac

SEQ ID NO: 39754 - DNA, 101 bp, rice(Oryza sativa)
  misc_feature (71): n=t or c
tcgaaagaataaatgaacttctcagctcatatcttcctaaaggatcaaatctataggtgcggcagaatggntccaagcccaacgacgaactgtattagagc

SEQ ID NO: 39755 - DNA, 101 bp, rice(Oryza sativa)
  misc_feature (71): n=a or g
caccggagggcttgaagggatatcaaaatctgccttctgcttgttggccttttccttatcaatctgaagcnaggagcgggctgttggcaagctcacagagt

SEQ ID NO: 39756 - DNA, 101 bp, rice(Oryza sativa)
  misc_feature (71): n=t or c
aaaaaagaatgttctagtattaattaattatgagataattcagcgaaggaacggccagctactagttggtnggaaaaaaacactgcctctattaaaaatgt

SEQ ID NO: 39757 - DNA, 101 bp, rice(Oryza sativa)
  misc_feature (71): n=a or g
tcttggagaagatttcccgtgttttttcaaccgaacaggagttgtaagttgtaaccatgtgaacagctacncgaaaaaaacgcattccaatgctcttgccg

SEQ ID NO: 39758 - DNA, 101 bp, rice(Oryza sativa)
  misc_feature (71): n=a or g
ctccgtagactttctagtccatttttcgtgcctcggtgttgccacgtccatctctggttctatttcttgtncgatagattattgttgacttttggacagat

SEQ ID NO: 39759 - DNA, 101 bp, rice(Oryza sativa)
  misc_feature (71): n=t or c
tgaagactgtttattgtttgccatttcggtcgtaacatactctatgttcccaacctaggtgtgtttagatnctaaaaatttttggccaaaaatatcacatc

SEQ ID NO: 39760 - DNA, 101 bp, rice(Oryza sativa)
  misc_feature (71): n=a or g
attcagaaattataactttaaccccatgtaatgctctagcaaaatacaagattcggatgggattgacaagnatgtgaatcggagctcctaaaattaattga

SEQ ID NO: 39761 - DNA, 101 bp, rice(Oryza sativa)
  misc_feature (71): n=t or g
tggttctcacctaatcccaagctcagcgacatggctttgagtagcacttcacagagattcatcagatcacncccgtaatcctccgtgatctccctgcaaca

SEQ ID NO: 39762 - DNA, 101 bp, rice(Oryza sativa)
  misc_feature (71): n=a or g
caaaaaacacggcatgattcacaaaaatctgactacctggttctaaaatatggactgaggtggaagcgtcntgcatgtcgaaagtcatctaaaggtgactt

SEQ ID NO: 39763 - DNA, 101 bp, rice(Oryza sativa)
  misc_feature (71): n=a or g
cctaagattgagctacctagctcctaaatgatcttatgtgtaatgtgtgcttcgtgttgggatgtgtgccntaagaaggtaaataaagagagtgccctact

SEQ ID NO: 39764 - DNA, 101 bp, rice(Oryza sativa)
  misc_feature (71): n=t or c
agaccattagaaagcggtccaaactatagatcgagttgacgattgatgagagagtgaattacgctttggangaccatcttttattatataagtttcacttt

SEQ ID NO: 39765 - DNA, 101 bp, rice(Oryza sativa)
  misc_feature (71): n=a or g
cctgcatcaccacgaaaagcttgccttgcagagctttatctatgatatcccatcccgaattccagatccanaaaaacgtaaaatattactccatcagttct

SEQ ID NO: 39766 - DNA, 101 bp, rice(Oryza sativa)
  misc_feature (71): n=t or c
acacccctgaaaaaaattacaaacaaaaccgagaaattacaaacaggtccctccccttcccctctcgctgncttcttctcctggccgttgctagtgtgcta

SEQ ID NO: 39767 - DNA, 101 bp, rice(Oryza sativa)
  misc_feature (71): n=t or g
ctctccctttacagtacgtttagcttttgaagaaagtagatgactagaaacctgagatggcacgggcactngcttaatcaagttaagcttagtaggcaatg

SEQ ID NO: 39768 - DNA, 101 bp, rice(Oryza sativa)
  misc_feature (71): n=t or g
tacgtgttcaagcagtgccctagagcatcaatcagtctgtttgcctctgccttttcaaaagtccaaccaantccggactcctcgtagggattgtagtgctc

SEQ ID NO: 39769 - DNA, 101 bp, rice(Oryza sativa)
  misc_feature (71): n=t or c
tttgattttgtgggtccctaacaaaacataatattgggcaaaagccagctggagcatgtcaagaccatccnggccctcggctgccttcatctcagactgac

SEQ ID NO: 39770 - DNA, 101 bp, rice(Oryza sativa)
  misc_feature (71): n=t or c
cttataccactgcatatctagacacttgtacattgatctaatggcggaatactaattttttgcatcaaccngcccctggtgatctaaccctccgtgccatg

SEQ ID NO: 39771 - DNA, 101 bp, rice(Oryza sativa)
  misc_feature (71): n=t or c
cagcctaactcgaaagaaaaagaaaaaaaagagagaaccgttggtttcgtacaagagttaactcttcccanatactcttaggtaaatgcatttattacaaa

SEQ ID NO: 39772 - DNA, 101 bp, rice(Oryza sativa)
  misc_feature (71): n=a or g
aagcagatccagccaaataaattaatgtcttgtacttagctgcatactcaggcccagcaatgtccgaatantacttcttaaaaaattcatagaaaccaaac

SEQ ID NO: 39773 - DNA, 101 bp, rice(Oryza sativa)
  misc_feature (71): n=a or g
ccagcaaatgcgtctctccgttttcaaaatataacagtactctccccgtcccctgatataaaggctaattngtgaatatgatatgtcctaatacaatgaat

SEQ ID NO: 39774 - DNA, 101 bp, rice(Oryza sativa)
  misc_feature (71): n=t or c
gggagtggtgggatgacatgtggggccatatggcctcaccattttttgttgtttaactaacatgtggctcncacgggtgttattatttttcgggatcgaat

SEQ ID NO: 39775 - DNA, 101 bp, rice(Oryza sativa)
  misc_feature (71): n=t or c
tattcgatgaccacagtgttggcatcatacgctaccaaccccacatcgaccatcctgccttgtacgtcatncccgccctcactaacggatcagtgcctggg

SEQ ID NO: 39776 - DNA, 101 bp, rice(Oryza sativa)
  misc_feature (71): n=t or c
caagcaaagtcctctatgcacgcacatagctctattgagtgacaagtgaacggtggcatgtatgtgagcangaactgtcaatttgtgtccttataacttaa

SEQ ID NO: 39777 - DNA, 101 bp, rice(Oryza sativa)
  misc_feature (71): n=t or g
tgtgccactgcctacctaggtccaatataggagtacgtacgtgatcgatctctgcaagtatagatcctacngcctactgtagctaccacagaaaaaagaaa

SEQ ID NO: 39778 - DNA, 101 bp, rice(Oryza sativa)
  misc_feature (71): n=a or g
tggagtgtgatgttgcagttggatgatatatatatgggccggcaatattaagattgcgaattaagaatgtngtaatgttgtgttgtattattttcaatatt

SEQ ID NO: 39779 - DNA, 101 bp, rice(Oryza sativa)
  misc_feature (71): n=t or c
ataagatcagtaaggagagtaagagcatcagtgtactcctgattctctaacagaagggctgctagccttgnctccacacgctgcctaaggaatgtccgctt

SEQ ID NO: 39780 - DNA, 101 bp, rice(Oryza sativa)
  misc_feature (71): n=t or g
agaatctgccgaggcacttgcgcatcttcactcgttgccacaccctataatccacggcgatgtgaaaccanccaatatcctacttgctgagggattgatcg

SEQ ID NO: 39781 - DNA, 101 bp, rice(Oryza sativa)
  misc_feature (71): n=a or g
ctgcacattcatctacctgacgagaatgattccttcagaaagctgtagagttcctccgcgactggtgatgngaattcctcctgcggcagaagggcacctgg

SEQ ID NO: 39782 - DNA, 101 bp, rice(Oryza sativa)
  misc_feature (71): n=t or c
cagagggatcttttaggtacattattccgcctaattgtattgttctactgtaacaagttgtaaggttctgncttgattgtacttatttaccaagaatttat

SEQ ID NO: 39783 - DNA, 101 bp, rice(Oryza sativa)
  misc_feature (71): n=t or c
tgccaaatcaatatggacacttgttgcaaccaaagaccatttggagtgcagaagagacacctgagaaccantctttgctagaacaaattttgcacttagag

SEQ ID NO: 39784 - DNA, 101 bp, rice(Oryza sativa)
  misc_feature (71): n=a or c
ggtgactggtttccgattgcatcggacagggtggcgctcaatgtactgccgcatggagcctgatgcattcngcggcactgcaccaatcaacctcactgagc

SEQ ID NO: 39785 - DNA, 101 bp, rice(Oryza sativa)
  misc_feature (71): n=a or g
cttgttttgccttttgtgacaggcaacttgttatccttcattcatggataaacttccttcagaggtcaatnctgtagaatcgagggtgcagattgatggga

SEQ ID NO: 39786 - DNA, 101 bp, rice(Oryza sativa)
  misc_feature (71): n=t or c
tgctgcgagtatactgagagcctcatatcatctagtcatccggcactgcacgaatcttagagctctactantcttcttcttccgcagcggcagccgcctcc

SEQ ID NO: 39787 - DNA, 101 bp, rice(Oryza sativa)
  misc_feature (71): n=t or c
aagtctacttgtagcacgtgtgttttgtggctgaattaaggatttatcctcttggctcacgcaatgacganaatacatgtcaataacaactcaagaccatg

SEQ ID NO: 39788 - DNA, 101 bp, rice(Oryza sativa)
  misc_feature (71): n=a or g
gtatcctatgcccatagctgacatgctaattaatgatgcatcgggacatagagtgattagctttttagatngtaatgctggttataatcaaatatttatgg

SEQ ID NO: 39789 - DNA, 101 bp, rice(Oryza sativa)
  misc_feature (71): n=t or c
aagcccatagcccaatctattgagggttgtccatcttcttacagattgatagtcataaccagtttttccanaagcaagctgaagagaattcagaaaatcat

SEQ ID NO: 39790 - DNA, 101 bp, rice(Oryza sativa)
  misc_feature (71): n=t or c
cgctctgcctcaaaaaagaagaatgagacacctattgtgcccacaaatgataatactgctgttcaacgagntgcgaagaaaaggaaaagaagcaaaccctt

SEQ ID NO: 39791 - DNA, 101 bp, rice(Oryza sativa)
  misc_feature (71): n=t or c
ccgatcctacccataccggaacaaacggcagatttgtactggtactgagcggtactagtaccaagcggtanaatttgctggaccataaaaaaatctcttct

SEQ ID NO: 39792 - DNA, 101 bp, rice(Oryza sativa)
  misc_feature (71): n=a or g
aagtaatcacttgtactgaacataagaaaatagacaactcggtgccgctagagtaatactggcatcagcanagacattccatgggcttaatttaattttct

SEQ ID NO: 39793 - DNA, 101 bp, rice(Oryza sativa)
  misc_feature (71): n=t or c
tctcgatctcccagttttcatacacctttcctctcttgtgactaacatggatttcaccggaaggccgaagnaggcatcttgcattgcggaagaatcctctg

SEQ ID NO: 39794 - DNA, 101 bp, rice(Oryza sativa)
  misc_feature (71): n=t or g
aacatgccctcttgctgcgcgatacacccttgtctcctcacttaatttcctatctaattggcccgccgttngcgcgttagctattttgaaaccagcgtaaa

SEQ ID NO: 39795 - DNA, 101 bp, rice(Oryza sativa)
  misc_feature (71): n=a or g
gttaaccttatatttctgtggagtctaaacatatttgtgcttttttggaggaaggtgtcttctggtggccngactttaaagttacgaacaagaagttcttc

SEQ ID NO: 39796 - DNA, 101 bp, rice(Oryza sativa)
  misc_feature (71): n=a or c
cctcttcattggcactttcttcttttatacagttctcttcagattccacggtcctcttgtcaccaagccantgaggttttggaatggagaatgcaggtttg

SEQ ID NO: 39797 - DNA, 101 bp, rice(Oryza sativa)
  misc_feature (71): n=a or g
ggcctagattactaggaacagtacttagccctaaagtggctttggctatgtgaatgatccatcagtgtcgngaggaactgagatcggtgctgtagtagtaa

SEQ ID NO: 39798 - DNA, 101 bp, rice(Oryza sativa)
  misc_feature (71): n=t or c
ctgaaaccgctccaatccacctccacgcgccggtaacgctaccaaatttaggtaatactacttgtaggaangatctgagtgctcagattataagggtatat

SEQ ID NO: 39799 - DNA, 101 bp, rice(Oryza sativa)
  misc_feature (71): n=t or c
gctagctaccatccttattccaaatttcaaacatctcttcctccatttccttctccatatatgtttgcagnggtgtcggtttttttcctgctttattatat

SEQ ID NO: 39800 - DNA, 101 bp, rice(Oryza sativa)
  misc_feature (71): n=a or g
ggcttgtagatgcacgcctcaacatcgtcaatgatcaactccagaagctccacgagcagggcctcctaccngcgtctatttcactgccaaccatgggggta

SEQ ID NO: 39801 - DNA, 101 bp, rice(Oryza sativa)
  misc_feature (71): n=t or c
cacgtacgtatacggtatacactggcatatatacgtatgtatatgtatttctagagcacgccgcagtcggngatgacgacgggcttcaccgtcttgccgct

SEQ ID NO: 39802 - DNA, 101 bp, rice(Oryza sativa)
  misc_feature (71): n=a or g
ggaccctgggatttagtaccagccatgtctgtattaaaacccgtcgccgcttgcgagttcatcatctcctnaagaaaatcatgcttcgtcgacccctctgc

SEQ ID NO: 39803 - DNA, 101 bp, rice(Oryza sativa)
  misc_feature (71): n=a or g
tgtactacaccagaattgacatgtcgtcagagttagcccacgacccttctgcggaaaacctattatacttngagtgttctcactgctaattataattgaag

SEQ ID NO: 39804 - DNA, 101 bp, rice(Oryza sativa)
  misc_feature (71): n=a or c
agcttaattagttatcgtcgtcgtctttggttgcttcatcaagttcggttctagatatcgatctggggtgnatgcatggtaatgtgctttggttaatatta

SEQ ID NO: 39805 - DNA, 101 bp, rice(Oryza sativa)
  misc_feature (71): n=a or c
agcgccacgtcgccgccaccgtcgtcgaacaccagcgagtcgtggatcatctgcgacacgtacccggcggngtccgccttcgcctgcgccgcggcatcctt

SEQ ID NO: 39806 - DNA, 101 bp, rice(Oryza sativa)
  misc_feature (71): n=t or c
ggcgagcacgatgatggcagtggtggcagcggcgatgacatcaacttgggagctagggtttcgctggttgnaggtagggggctgtgctcaggagcaaagcc

SEQ ID NO: 39807 - DNA, 101 bp, rice(Oryza sativa)
  misc_feature (71): n=a or g
ccgcaagggaggcaaaataacataccgcggcatttgatgcctggttttcagaggatcatcatgttcttccngtacctttttctttgctgagacaggcagca

SEQ ID NO: 39808 - DNA, 101 bp, rice(Oryza sativa)
  misc_feature (71): n=a or g
gccgcttcaccaatgagaggtgtggccgcttatctgtaactggcaaggaatgacagatttttccaaaacancatctggctggcaatcgacatcagagagtg

SEQ ID NO: 39809 - DNA, 101 bp, rice(Oryza sativa)
  misc_feature (71): n=t or g
tcccatatctttcatcttcatgcgaacaagctagagcatgactatatattaacatctcttgaccgattatnacctgaaaacccccaccgtagtctcggtcc

SEQ ID NO: 39810 - DNA, 101 bp, rice(Oryza sativa)
  misc_feature (71): n=a or g
tagtactagtcgtctccagctcactcgtccatgatataacatgggctcactattcactaacatgatactantaatgtagcacatgcatatttaaaaacatt

SEQ ID NO: 39811 - DNA, 101 bp, rice(Oryza sativa)
  misc_feature (71): n=a or g
agcagattattaaaaaatcaatgcttttcctccttatagtacttcaagggatatcaaaacccgcgtgtacnatacgctcatggcctacgacacaaaatggg

SEQ ID NO: 39812 - DNA, 101 bp, rice(Oryza sativa)
  misc_feature (71): n=t or g
cctcaatgctatcccccttgctcgcaggcgtgggacatcgtcaacgctaccagggatagagacggagccanaggtggggaagggcaacagaaagggcacga

SEQ ID NO: 39813 - DNA, 101 bp, rice(Oryza sativa)
  misc_feature (71): n=t or c
ccatttccaaactccacatagtcatggggtattttgtagggtaatccattaagaacttcctcgaatacctnaatgcagagtcctgtgaaattatatttttc

SEQ ID NO: 39814 - DNA, 101 bp, rice(Oryza sativa)
  misc_feature (71): n=t or c
gtgagattagggacgtgccgctggttttcatttcttaaagtacgtgtcatgtgtctcaaaatttttttatnagcttagactagtttgtactccctccgtcc

SEQ ID NO: 39815 - DNA, 101 bp, rice(Oryza sativa)
  misc_feature (71): n=t or c
ttgaagtgggagaacagggttgaattacagcattaaagagtttggatactgttaggcaccgtttggatgcnagaattgaattgtgtagttatcccaaaaaa

SEQ ID NO: 39816 - DNA, 101 bp, rice(Oryza sativa)
  misc_feature (71): n=a or c
gtattaaggccaggcgggcgggctttgcactcttccttcactgatatgtcggttacttttaaaataccatnactggccaccatcttttggaacattacagt

SEQ ID NO: 39817 - DNA, 101 bp, rice(Oryza sativa)
  misc_feature (71): n=a or c
taacctgtgagcaccattcccgtccaatgtgcgttccattgtctactctctataccctttctaacgccacnaagattgatccatttggtgcagccgatcgc

SEQ ID NO: 39818 - DNA, 101 bp, rice(Oryza sativa)
  misc_feature (71): n=t or c
tgcacacaacaccttagacgcttccaagatgaaagataagggttatcattaccgagcttgtcatacctggncaagtagatccgactccatccgaactcatc

SEQ ID NO: 39819 - DNA, 101 bp, rice(Oryza sativa)
  misc_feature (71): n=a or g
gagaagatggaggcgctactagcgtacagtggatctccgctcagattcaacataagtcaacatgtttacantttccacagtttccaaaataaaactcaatt

SEQ ID NO: 39820 - DNA, 101 bp, rice(Oryza sativa)
  misc_feature (71): n=a or c
tacaaaacgaatattattttcgagcaggagggagaagggagtagttttaggtgactgaaaatttgtaaatnttttcagccgcatgaaaatctaccttatta

SEQ ID NO: 39821 - DNA, 101 bp, rice(Oryza sativa)
  misc_feature (71): n=t or c
acggtcgcagcaagccaacattctcggccttcgcaaggatagaactcaacacatccattgctaggatgaanatcatcggggagatgggatctccctgccga

SEQ ID NO: 39822 - DNA, 101 bp, rice(Oryza sativa)
  misc_feature (71): n=t or c
atgccaccttctggtattggaccatgtaggttattgaatgaaaggttcaagctagagagatcagtaaaatntgctaaatattgtggaattgtccccgacag

SEQ ID NO: 39823 - DNA, 101 bp, rice(Oryza sativa)
  misc_feature (71): n=a or g
cctctacctcctcaccaccgcggcgtgaatccgtgacaaatgccgtgaaccaaccccacccaacccaaccncatcgcacgcaccagtcgcgtagcgttatg

SEQ ID NO: 39824 - DNA, 101 bp, rice(Oryza sativa)
  misc_feature (71): n=a or g
atggcttaacttagtcgtcatgaaagctgtgaatcagccagccctatcagagtcctagtttccaagtctanagccgatcgccaatgaagatgggggagaac

SEQ ID NO: 39825 - DNA, 101 bp, rice(Oryza sativa)
  misc_feature (71): n=t or c
attataatttagacatattcttttcttagagtatagtagtaatgtacattagtccatataattaattttcngatacaataggaataatttttatcttcggc

SEQ ID NO: 39826 - DNA, 101 bp, rice(Oryza sativa)
  misc_feature (71): n=t or c
ttaagacgtccacctgtgaaaatggatttttataaacgggtctatattgggagtttttcgaatccttttanatatgggctttcttttagtccgcctaaaaa

SEQ ID NO: 39827 - DNA, 101 bp, rice(Oryza sativa)
  misc_feature (71): n=t or c
ctagctgaaacaatttgcaattcagtattcgttgctcggtgcatgccctattcagaatgcatttcgttcancggggccgggccggcgaagatattcaaaag

SEQ ID NO: 39828 - DNA, 101 bp, rice(Oryza sativa)
  misc_feature (71): n=t or c
taaaaaggagggagttcttcaaaaggaagaactgcaaaataacccctacccttaggccttggttagatttnaactttttttctttaaaatttcaacttttc

SEQ ID NO: 39829 - DNA, 101 bp, rice(Oryza sativa)
  misc_feature (71): n=a or c
aacgcacacaaaacaacacaaaatcctgcacaacaccacccgaatcgaccgcccaggcgtaaaaaaaaaanaccacacaaatcttaccggaaacgagggag

SEQ ID NO: 39830 - DNA, 101 bp, rice(Oryza sativa)
  misc_feature (71): n=a or c
tcctagctgttggctttccacacatctccaactctcaaaaacaattcaggtacttatgccaagtttagttntaaactttttcttcaaactttaaacttttt

SEQ ID NO: 39831 - DNA, 101 bp, rice(Oryza sativa)
  misc_feature (71): n=t or c
gcaattttgtaataaaccaactgcaatgatttaggagggtgtaggtaaaaagattttttttatcccaaganaaataaatattatgttacattcaaattaca

SEQ ID NO: 39832 - DNA, 101 bp, rice(Oryza sativa)
  misc_feature (71): n=t or c
tacattaacggactttacatgaatagtgctgctgggaccagtagtagtgttgctggagcaattccgttgangcccattaaacttaactccagcatgatatt

SEQ ID NO: 39833 - DNA, 101 bp, rice(Oryza sativa)
  misc_feature (71): n=t or g
ggtgatgataatgttgtgctcgtgttgattcaggttgggatcctccctattcgcgcgcgtctttgatttgncgcgtaaagttgtaatccgtactccggatg

SEQ ID NO: 39834 - DNA, 101 bp, rice(Oryza sativa)
  misc_feature (71): n=a or g
acgatatgatatttctaagctattatctgatatgatacgtgttagatatcggtttataactatttaaactngataatatctctaagtgatacatatctatt

SEQ ID NO: 39835 - DNA, 101 bp, rice(Oryza sativa)
  misc_feature (71): n=a or g
aagcaatcctagttttagagctaggcatgcctcatcatcatcatatccattttggagctttggatccattncctcaagaagtgatccctcgtgccaacgat

SEQ ID NO: 39836 - DNA, 101 bp, rice(Oryza sativa)
  misc_feature (71): n=t or c
taagattgatagtaacgacctccactttatgacacatcacccattgtacaacgggtacccccatgtgccanaggcgccacccctacgcacatggtacgact

SEQ ID NO: 39837 - DNA, 101 bp, rice(Oryza sativa)
  misc_feature (71): n=t or c
tgaaataaaattagtcactagtacaacgagaaaaatactaaacaatgttggggaagaacgttttcttgtgngatgaatgacactttttcttgaaggaatta

SEQ ID NO: 39838 - DNA, 101 bp, rice(Oryza sativa)
  misc_feature (71): n=t or c
ccatgtcatggactgcaatgatatcggggtatgagaaaaatggtttcccagataaagcccttgaagtttangcactgatggaattgcataatgtaagtcct

SEQ ID NO: 39839 - DNA, 101 bp, rice(Oryza sativa)
  misc_feature (71): n=t or c
cctaacatagcaatgcactagatctaattttactcttccatctgaaccagcactcaccacagacgactctntatctctcttagcttggagctcctgatttc

SEQ ID NO: 39840 - DNA, 101 bp, rice(Oryza sativa)
  misc_feature (71): n=t or c
ttctgaatgccatttgatggttcttcttgtgattatctccatcttgacatgtgttagagcggttcgtgaantgtgctagtcactttcttgcaacacccttg

SEQ ID NO: 39841 - DNA, 101 bp, rice(Oryza sativa)
  misc_feature (71): n=a or g
tgggatgatgtttggtgtggagaagtgcctttgagcgtgattttccctaagttacataacataagcagaantcagggggtgtctgtaagtgaaatgtggtt

SEQ ID NO: 39842 - DNA, 101 bp, rice(Oryza sativa)
  misc_feature (71): n=t or c
gtgttaacaagcggtactaaaatgcatctaaaaagatccactagtattagtcttggttggtgctaccaacnggaagtaaacatgtatttctaataccggtt

SEQ ID NO: 39843 - DNA, 101 bp, rice(Oryza sativa)
  misc_feature (71): n=a or g
tcctcatgattaaatgaattttgctgaatacgtttgtgtacgtgtgtgcagctgttcgagtttgccgacangtacagagggaagtatgacagcagtatcgc

SEQ ID NO: 39844 - DNA, 101 bp, rice(Oryza sativa)
  misc_feature (71): n=t or c
gccaaggcgatgggagctgttcagttcagccacggccggtgatgactagcgcgtactgtattttgtcatgngtaagtactccctccgttttaaaatatttg

SEQ ID NO: 39845 - DNA, 101 bp, rice(Oryza sativa)
  misc_feature (71): n=a or g
caactgttggttaagataggcgaaaaccttctcaagaagccactaagcaaggaagagtgtgagaagaacancattgagccagagccaaaccttcatggtga

SEQ ID NO: 39846 - DNA, 101 bp, rice(Oryza sativa)
  misc_feature (71): n=t or c
cgaagctctgcttggggaagactctgcagaactttttgcaggctactttcaccatcaacaggagggagttngctgctatcctcagcattggacttcgatcc

SEQ ID NO: 39847 - DNA, 101 bp, rice(Oryza sativa)
  misc_feature (71): n=t or g
gatggctagctagcttgaaagaattaatgatctcaaacgccatcgatcgctacaaatggatgaaaccagcnaggcaacaataatcaaagctttaatttcct

SEQ ID NO: 39848 - DNA, 101 bp, rice(Oryza sativa)
  misc_feature (71): n=a or g
taatgaaggaaaaggtgggggtcttggaagtggtgtagatgtggaatgcttgtgaagttcatcttgttttntcgtggggatgaggctgcatgtgtcagcac

SEQ ID NO: 39849 - DNA, 101 bp, rice(Oryza sativa)
  misc_feature (71): n=t or c
ttgttattaaactttcatacatatggttgttgtttacctaggtagggggtatcagccatgttactgaattnggtaatagtgtgccagtagtgtgggctagg

SEQ ID NO: 39850 - DNA, 101 bp, rice(Oryza sativa)
  misc_feature (71): n=t or c
tacactcatgatctatcaaccattcaacaagcccataattaccgagctcttacaggcacgttggcttcctngctccagtatggtcctataggctcttgcta

SEQ ID NO: 39851 - DNA, 101 bp, rice(Oryza sativa)
  misc_feature (71): n=t or c
cagtatcacagctcagccatggtagagtcaccagaatgtgttgctgaaagtagccagtccatcgatgattngacaataactcagttatgttcttttgatat

SEQ ID NO: 39852 - DNA, 101 bp, rice(Oryza sativa)
  misc_feature (71): n=t or g
actccacttcactatcctttattatttactacagttgaaaactgcagacagctgctagtcgctagcaatanatatagagaggagtactgccttgaaattac

SEQ ID NO: 39853 - DNA, 101 bp, rice(Oryza sativa)
  misc_feature (71): n=a or g
tgaactaagtctattttaggtctctcaactatttttctctcctgctcataggaccatgccgtaacgagccngcccaccgtgccaaggcgtcggcccagaca

SEQ ID NO: 39854 - DNA, 101 bp, rice(Oryza sativa)
  misc_feature (71): n=t or c
caacattttggattcacgtatttcatacaggaatgctgcatacatcacacgacaaaaatttactgctgttngacataaggcgggagtgctcccctcaggaa

SEQ ID NO: 39855 - DNA, 101 bp, rice(Oryza sativa)
  misc_feature (71): n=t or c
cctgaagctatgaaaagtttaccaccacctggatcccatggcatttgcaaaataatccttggtgaacatanagcttgctccatccaaaaaagaatagccca

SEQ ID NO: 39856 - DNA, 101 bp, rice(Oryza sativa)
  misc_feature (71): n=a or c
attttcggacatggatttgtaccttttccgcaaaaacctacagcgcggcacaattatgcgcaggataatgngacaatatcaacatgtttgcattgtcgtag

SEQ ID NO: 39857 - DNA, 101 bp, rice(Oryza sativa)
  misc_feature (71): n=a or g
ctactatcttttacggggaatgcaattaaaacgtagaagctcatggcacctgcaaactcactcccacaatntaagttattttaacgtgtgtacgcttcgta

SEQ ID NO: 39858 - DNA, 101 bp, rice(Oryza sativa)
  misc_feature (71): n=a or g
caaagagatgtgatcgttttgtatcattgtgtgtgtgtgtggagtgtacaaggctaaggtcatcaccaatncggtgcttcagcccgtgcccctagcgatgg

SEQ ID NO: 39859 - DNA, 101 bp, rice(Oryza sativa)
  misc_feature (71): n=a or g
ttggacatgggaattacaatccttcttatacatgttcctgtccgcattgtctacatggacagagaactgcnccacaagaagagcacattccaatggcgaga

SEQ ID NO: 39860 - DNA, 101 bp, rice(Oryza sativa)
  misc_feature (71): n=a or g
tgtcatttgccatattgatcagcacatcctgctcatttcctagtggtcaggatggaaaaagaagaagaacnaaagaaagatataatacgtaggattcatat

SEQ ID NO: 39861 - DNA, 101 bp, rice(Oryza sativa)
  misc_feature (71): n=t or c
agctgctggccttcagtttttgcctttttgccgtgatcgaacagtgccatgtaacatcagcatctcttttncctttcaaaatggaatatggcaatttcaat

SEQ ID NO: 39862 - DNA, 101 bp, rice(Oryza sativa)
  misc_feature (71): n=t or c
tttttgtttggttttttttaagtcataagccactctcacactaatattaaaccaaaatctaatagctaagntagagatgtttttttttcttatatgaggta

SEQ ID NO: 39863 - DNA, 101 bp, rice(Oryza sativa)
  misc_feature (71): n=t or c
tttgcttctccttgaacttactaaatcatctcactgttgacacccatttcctctctttcttcaggtcttgngcgctgattgttttgagaatggttgggatt

SEQ ID NO: 39864 - DNA, 101 bp, rice(Oryza sativa)
  misc_feature (71): n=t or c
acacatcacacagtgcaatggcaatgcaactgcaaggcagccaaaaagggaggaggaaacagaggagaagngatggtggtggccgactggccgtgcgagcg

SEQ ID NO: 39865 - DNA, 101 bp, rice(Oryza sativa)
  misc_feature (71): n=a or c
gatcattaccttactaaactgcagtcgggatacatgtgtagaacctttttcaggtaagacaggccaccatnaacccttaaaaacttgtctgattccccacc

SEQ ID NO: 39866 - DNA, 101 bp, rice(Oryza sativa)
  misc_feature (71): n=t or c
agccatcgggtaaaactgcaaatggatcgaccgaccaattcacttatagcataaatataagcgggtaaccnacacgtcaacctacttaattactccctccg

SEQ ID NO: 39867 - DNA, 101 bp, rice(Oryza sativa)
  misc_feature (71): n=t or c
acccctataaaagaattacttcaacctacgtattcacaaaacgtgatccacgatggaaatcaaatcaaacncaacattcatgagacctccgttcaaaaaag

SEQ ID NO: 39868 - DNA, 101 bp, rice(Oryza sativa)
  misc_feature (71): n=t or c
ggcggcaataccgatttgccgtcctccatggtggctacgtcttgatgaagattgatcgatctcgccggatngaaaatttgacaatgatggttccgatctta

SEQ ID NO: 39869 - DNA, 101 bp, rice(Oryza sativa)
  misc_feature (71): n=a or g
caccttcacatatcttcctcactggttcattgaaagcacgaagcatttgttctactttggtttgctctccntttaatttttaattgtttatggttgtgcat

SEQ ID NO: 39870 - DNA, 101 bp, rice(Oryza sativa)
  misc_feature (71): n=a or g
tttcctttttaataaaagggccatattcggcccaagaaaataagggcctaaattgtaggccttttgtatangaataagtccaccttgactcccttaaaagt

SEQ ID NO: 39871 - DNA, 101 bp, rice(Oryza sativa)
  misc_feature (71): n=a or c
catgctttcatcctggaggacctggtccctacctaatctttaaaattgtagatttagacccctaatcttgntaaatataagacgaaaggtccaaatttacc

SEQ ID NO: 39872 - DNA, 101 bp, rice(Oryza sativa)
  misc_feature (71): n=a or g
tataaatgatcaaacatcgataaaaaatcaacgacatcaaaggagagggcatgcccaaggatattgaaatncacatattggatattaaaattatcctaaag

SEQ ID NO: 39873 - DNA, 101 bp, rice(Oryza sativa)
  misc_feature (71): n=a or g
acaaatagaattcaataattttgtggactttttatgctgtggacgtctttagtagttggtgcgtgctcctntttttttagcgtgtgtttttatgtcttttt

SEQ ID NO: 39874 - DNA, 101 bp, rice(Oryza sativa)
  misc_feature (71): n=a or g
gctagtagcattttgctatagtaaatatatagtaccagcagaggaaccgtttgcatcggcgggagtgccangttttgtccgtacctcgcaccccgagagcg

SEQ ID NO: 39875 - DNA, 101 bp, rice(Oryza sativa)
  misc_feature (71): n=a or g
gacctcaccatctctacaagggaattcaaaaacctcaggttccttttcattgagggcccagacattgtcancatcagtttcgatgagggtgcagctcctag

SEQ ID NO: 39876 - DNA, 101 bp, rice(Oryza sativa)
  misc_feature (71): n=a or g
tgtcttgccccaaaatcatctcgtggtttttttctcaaacagtaggaacaggtaagcgatgcgcccagcgnctgctcatggccgccgtccttcccaggcgg

SEQ ID NO: 39877 - DNA, 101 bp, rice(Oryza sativa)
  misc_feature (71): n=t or c
ctgccacgtggacggcacatcagcgaaaaccgtcttaataaaaaggagagagcgattttaatagttggggntatcgttataccccgagttttatgatcgag

SEQ ID NO: 39878 - DNA, 101 bp, rice(Oryza sativa)
  misc_feature (71): n=a or g
ggctctctgtttcaccttcaacttcaatctcgctttgaacctgtattgttgtcctcagtgtggcctcatcngccgcttgagcaccatcctccgctgcatcg

SEQ ID NO: 39879 - DNA, 101 bp, rice(Oryza sativa)
  misc_feature (71): n=a or c
gtatgggcccaagcccaaaactgcccatgggctacaaacgaaggcccaatttggcctatacgatccacacntgaagcaacaagaaccagaggagacgacgg

SEQ ID NO: 39880 - DNA, 101 bp, rice(Oryza sativa)
  misc_feature (71): n=t or c
cagcctccaccaaaagcattccacttaaagcatctccaactgcctgattaattagctgacttgtggccaanaatctcatagcagcttggtgttgtgaagaa

SEQ ID NO: 39881 - DNA, 101 bp, rice(Oryza sativa)
  misc_feature (71): n=a or g
ggagtggaaatgagttgaaaatggtatgaaccccttctctcggccataccccttatgtagtgtatatcaantagctgtaactgtgaggtgggacccactag

SEQ ID NO: 39882 - DNA, 101 bp, rice(Oryza sativa)
  misc_feature (71): n=a or g
gagatgagatgagtagtggtgttcgtggatgcacaaatgctccttagtcgttgtacatatatttggcgttncctcggttttgttcatcctgtacagtgtat

SEQ ID NO: 39883 - DNA, 101 bp, rice(Oryza sativa)
  misc_feature (71): n=t or c
ccgagtaccgcgagcaactacagatataaatgagtgagacgacaccaacctctcgtcattaatggtcagcnaatgctatccccctcctattatctcttcac

SEQ ID NO: 39884 - DNA, 101 bp, rice(Oryza sativa)
  misc_feature (71): n=a or g
agctcttaaaattcccacgctgctaatctctatcccggaaaaaaacatagtgtgcttacatcgtacgatcntctccctaccaagaaaacaaaacttaaata

SEQ ID NO: 39885 - DNA, 101 bp, rice(Oryza sativa)
  misc_feature (71): n=a or g
tacttacattttaggacggaggaagtaggctttctttgggttgtaatgcaggccaaatggcaacttgtagnatggtttcagatccttcacgccgcgtttgg

SEQ ID NO: 39886 - DNA, 101 bp, rice(Oryza sativa)
  misc_feature (71): n=a or c
tgtggaatataacattcctccaaaaataacttttccggcacttgaggctacaacctttgaagaagtcaganatgaaatttttcaagcccttgggtacactg

SEQ ID NO: 39887 - DNA, 101 bp, rice(Oryza sativa)
  misc_feature (71): n=a or g
ccatctacagtttccaaattacaaatccccttcacaaattccatttgcagttctacagaatattcctattncaactgggcttttcttttccctctcagccc

SEQ ID NO: 39888 - DNA, 101 bp, rice(Oryza sativa)
  misc_feature (71): n=a or g
gttcttaacggagttttggctaaaagaaatcactcgtttaatgtgatcacgctttccatactattaaatantgtatttcgtctaaaaattttctatataaa

SEQ ID NO: 39889 - DNA, 101 bp, rice(Oryza sativa)
  misc_feature (71): n=t or c
aaacaaaatagcacaattgcatcctctttttgtcaattcttgcagtggcagacatgttgacttcatcggcngcccgtacgtcctcacggagcgtgtgggag

SEQ ID NO: 39890 - DNA, 101 bp, rice(Oryza sativa)
  misc_feature (71): n=t or c
gagaagagaggaaagagaggggtgtggtgggtcccacggcatttcttgttttgaagcgtacactcgctganatgtgggtcccatatttttttttgataagt

SEQ ID NO: 39891 - DNA, 101 bp, rice(Oryza sativa)
  misc_feature (71): n=a or g
gcgctcccaaagtacctcttcatctccatcagccttatctacaattagaaccacaggttctttgacagatnaaggtaatgatccaggaagaattctttcca

SEQ ID NO: 39892 - DNA, 101 bp, rice(Oryza sativa)
  misc_feature (71): n=a or c
ccaacaccaggcacgcctcttctgtgtccccaacccgacaaagagccctgatcaaattgttgtacacatcnttgttagggttaaccccaagctccatcctt

SEQ ID NO: 39893 - DNA, 101 bp, rice(Oryza sativa)
  misc_feature (71): n=a or g
attttctggtttttttgtggactgtaggtaaaaacaacaaaggattgaaaaatctctcaccgagcaacttnagctctgataccacttgatgcagcaacggg

SEQ ID NO: 39894 - DNA, 101 bp, rice(Oryza sativa)
  misc_feature (71): n=a or c
tagtagcacaaacctgtaatatgtgttacagagaaatattgcagtagcacaaaacatgtgttacacggatngattgtaacacgtactaaaagctagggcaa

SEQ ID NO: 39895 - DNA, 101 bp, rice(Oryza sativa)
  misc_feature (71): n=t or c
acggtaggaccgcctcgacgccgtacaccaggaagaaaggggtttctcttgttgcacggctcggggtagtncaattggcccacagcaccacaggtagttcc

SEQ ID NO: 39896 - DNA, 101 bp, rice(Oryza sativa)
  misc_feature (71): n=t or c
tgctattgtcaaagcgttctggcttaaacatctcggccatgtcccaatatttggggtccctgttgattgcncacacgtttataaaaacggtagtgtatttc

SEQ ID NO: 39897 - DNA, 101 bp, rice(Oryza sativa)
  misc_feature (71): n=a or g
ttcaatcagaaaactaagattgcggggctagctatatatttgttaactaaaaaatttgacagatgtaaatntagtataatcgtgatgtgaatatattatag

SEQ ID NO: 39898 - DNA, 101 bp, rice(Oryza sativa)
  misc_feature (71): n=t or g
acacaggttgtgttcatactgatcagccagcccaagtcttaaaaaccagatatcttgttctagcctaagcnttgtttctagctccatttcatttctactac

SEQ ID NO: 39899 - DNA, 101 bp, rice(Oryza sativa)
  misc_feature (71): n=t or c
tcccaacacatgaccaaaatcatcaataaccacatcgacaaatattgcgcacacgcacgcacgcttaatgncttgtttacatcaatcccataattgggggc

SEQ ID NO: 39900 - DNA, 101 bp, rice(Oryza sativa)
  misc_feature (71): n=a or c
aagaagggaatcctccaatggccataaaagttagaaatatcgtcatatacattatcacattgcatctagtntgaaaagtttaagaacaacatttgtatcaa

SEQ ID NO: 39901 - DNA, 101 bp, rice(Oryza sativa)
  misc_feature (71): n=a or g
agttagactgagcgaaaccatgattcgttacacgttcgttcggccgggcgttcggtcgaaaccacgattcnttatgcaaaaaatttcatatgcctaagtat

SEQ ID NO: 39902 - DNA, 101 bp, rice(Oryza sativa)
  misc_feature (71): n=t or g
aactgaagttttgaccatcttgtcgtgcaaatataggtcaatctccaaagtagcgacttcatccggtaaanttgcatcaattaacagaacaaattcagagt

SEQ ID NO: 39903 - DNA, 101 bp, rice(Oryza sativa)
  misc_feature (71): n=t or c
ctcctcttcttctccatcccatctgcacctcctcatactcttcttcttcgccatagccgcctcctctctantgtccaccgcgacctccacgcgcgcctcgc

SEQ ID NO: 39904 - DNA, 101 bp, rice(Oryza sativa)
  misc_feature (71): n=t or c
acctcgtgcgcttagtacaagacatgatgaaatagggatatcattaaattagcctaatcctcctttcatantataaaccgcttaacattttttctagtcaa

SEQ ID NO: 39905 - DNA, 101 bp, rice(Oryza sativa)
  misc_feature (71): n=t or g
aatggtgtgaactataaagagggcaagatagccgggctaaagagccatgaccttcacatacttctccaaanaatacttctaattggaatgcgtgggttttt

SEQ ID NO: 39906 - DNA, 101 bp, rice(Oryza sativa)
  misc_feature (71): n=t or g
ccaaataatgcgaacccaacatatataccgtaccgtactcaattaaaagcaggtacaaccaagagcaactntgtaacaacagtttagagatctatattacc

SEQ ID NO: 39907 - DNA, 101 bp, rice(Oryza sativa)
  misc_feature (71): n=a or g
taaaataaaaaaatggtaagatttatccgtttatcatgggaaagataaccctttacccgtctgtaagaganagcttgtactcgactatgcacattcagttt

SEQ ID NO: 39908 - DNA, 101 bp, rice(Oryza sativa)
  misc_feature (71): n=t or c
acctcgtcgctgttgatgccgaacgtgtcgtcgctgttgatgaaggtgaagacgtcctcggtgtcgatgtncgtggcgatgtccaagttagcggcgaggtc

SEQ ID NO: 39909 - DNA, 101 bp, rice(Oryza sativa)
  misc_feature (71): n=t or c
cccacgaggtctgactacgccgcgatgatgcggatggcattggccaagttccaagacgacgatgctgctgncgacgacgaggaggcggcgtccgcggtgat

SEQ ID NO: 39910 - DNA, 101 bp, rice(Oryza sativa)
  misc_feature (71): n=a or g
aaacactttgtgaccttgatatgctgcattgtgattagaaggatttggcggtggtgctgcgtcttgcattnacaaagataggtcttcagaaacatttctat

SEQ ID NO: 39911 - DNA, 101 bp, rice(Oryza sativa)
  misc_feature (71): n=a or c
ggcctaatcatttactatgatgcattgtatcgatatggcgacatctatcaatttgattttctcccaagttntagtgcattgcaagttcatccattactttt

SEQ ID NO: 39912 - DNA, 101 bp, rice(Oryza sativa)
  misc_feature (71): n=a or g
atgaaggaaggcattcttcacatcaagttgatggatgggccagtccttggagactgcaagactcagcacgntgcgaacggtggccggcttcacgaccggac

SEQ ID NO: 39913 - DNA, 101 bp, rice(Oryza sativa)
  misc_feature (71): n=a or g
tggatgcaacaacagagcatgacatgacactacaggtcagatgggctccacagaagaggtgcgagacgtgncctggctgctgggggtcgacgtaacgtcgg

SEQ ID NO: 39914 - DNA, 101 bp, rice(Oryza sativa)
  misc_feature (71): n=t or c
aggcatacatggatctccattccaatcatcaggtatattttgaaggcttctcttaatagcttccagggcangtgctgcagaaattgtggagtaattaatac

SEQ ID NO: 39915 - DNA, 101 bp, rice(Oryza sativa)
  misc_feature (71): n=t or c
cgcgcctcgttctctctcacacctctaagtctctaactcctccactcctcctctagctaactcctccgatncactcccctctcgatccctcctcctccctt

SEQ ID NO: 39916 - DNA, 101 bp, rice(Oryza sativa)
  misc_feature (71): n=a or g
atctcacgcatgatatcatggatctggcaagaatcagcccctctactgctgtaagttgaattttgagttgntaggatcatgcttctgtctatgagttcaaa

SEQ ID NO: 39917 - DNA, 101 bp, rice(Oryza sativa)
  misc_feature (71): n=t or g
atctatcaaccagactatcaagtttgagaacagtggtcgtcttgttgagcaccagaagaaccaagcgcatnatgtagcttctaccaagcggtcagacgcag

SEQ ID NO: 39918 - DNA, 101 bp, rice(Oryza sativa)
  misc_feature (71): n=a or c
tgggaagttttcggccgagatgccacgcaggcggtgtcggcaaccttttcatgtatatttgttgactaaanaaatacccgtgcattgcgacgggtgaagcc

SEQ ID NO: 39919 - DNA, 101 bp, rice(Oryza sativa)
  misc_feature (71): n=a or g
ttttggtggtgctgcaataagcatacatgcattatccaacaaatgtggcgttgtgttgagatgcaatgtcnatctgtgaatgtgatgatggggccacgaca

SEQ ID NO: 39920 - DNA, 101 bp, rice(Oryza sativa)
  misc_feature (71): n=t or c
tcaacctgcacaatatgcggaaccataggtgatatggaagcagggatagatggtgttggcagcttggtggngcatggccttgggcgtttctcttgtggctt

SEQ ID NO: 39921 - DNA, 101 bp, rice(Oryza sativa)
  misc_feature (71): n=t or c
tgaggttgaggtgaaatcttgcacccatcttctccggtggatattgatggtgaagccagaacgtggacgangggagccactgccaccaccggagcacacac

SEQ ID NO: 39922 - DNA, 101 bp, rice(Oryza sativa)
  misc_feature (71): n=t or c
tcgacgacgaaggagcgcgatatcgaaattgcagtgttagatctagaggcaatagaggcggggactggcangagagtaggtcgctgtggaccccccctcca

SEQ ID NO: 39923 - DNA, 101 bp, rice(Oryza sativa)
  misc_feature (71): n=t or g
tcgtccactatatatgtataatggttaattatgcccatggatgcatgcgtgatcacttgcaggattacaangggaatgacgtgaataagaacaacttcctg

SEQ ID NO: 39924 - DNA, 101 bp, rice(Oryza sativa)
  misc_feature (71): n=a or g
gcatacaagaggataagttcgtctttacgaactatctggacatcggctctagggaacaaagtaaaaccaanccacttatgcataagcctaagagtaggatt

SEQ ID NO: 39925 - DNA, 101 bp, rice(Oryza sativa)
  misc_feature (71): n=a or c
ctcaaacacgtcccgaacagtttctttgagaaatgaccggaaaccactgccagaatcagaaggctcttcgngttcacgggactgggtttgattctgcctgg

SEQ ID NO: 39926 - DNA, 101 bp, rice(Oryza sativa)
  misc_feature (71): n=a or c
gcagacatgcagtggacgatagcctttgtctaaatggctaactgcttgtgttagagtggccgggtgattangatggttcttgaacttgatacagtctttca

SEQ ID NO: 39927 - DNA, 101 bp, rice(Oryza sativa)
  misc_feature (71): n=t or g
ctggcaacttggtgtgtttgctgaagaactgacaagcttcacatcgttgcactatttcacatgcgtttttnatcgcagttggctagaaaaaaccttgtttg

SEQ ID NO: 39928 - DNA, 101 bp, rice(Oryza sativa)
  misc_feature (71): n=a or g
ttttgtctgccttgaataaaactattatagatatctagtgcacctgtttgcaccggctcgtgcgactgtcnttccttcttactctctccgtccaaaaaaaa

SEQ ID NO: 39929 - DNA, 101 bp, rice(Oryza sativa)
  misc_feature (71): n=t or g
aaaaatcggtttgattcttgcaagcatttcaatggcgatcgatcgagctttgcatatcattacgttgatgnagacgacgggcttctggttgtggctggcgc

SEQ ID NO: 39930 - DNA, 101 bp, rice(Oryza sativa)
  misc_feature (71): n=a or c
tagcgctaagcaaatagaatgtaccttatataatgtatggagttgactgcatatatagtccatagcctatntatgagaagggatgcaggtgtacagtccta

SEQ ID NO: 39931 - DNA, 101 bp, rice(Oryza sativa)
  misc_feature (71): n=a or g
agttcctttctgcaaaatttgccttcgagcatcttctaactttctaccaatttgttcgtatggagcctacntgagcaaatacagaaggtaagaaacagtag

SEQ ID NO: 39932 - DNA, 101 bp, rice(Oryza sativa)
  misc_feature (71): n=t or c
gctgtacaagcgtcgtatgatggatctggatgcagagaagagaaccattgccagcgaaaatggaccattgncagcggcccgcataagacaactgccagcga

SEQ ID NO: 39933 - DNA, 101 bp, rice(Oryza sativa)
  misc_feature (71): n=a or g
ctccaaaagtcttttaaaaagcaccacaaaagtctttaaaaaaacaccagcgcactgcactactccatccnttccataaaaaaccacctaatactgaatat

SEQ ID NO: 39934 - DNA, 101 bp, rice(Oryza sativa)
  misc_feature (71): n=a or g
aatgaaagcaatgtacactggaaatcgccatgagttattgcattggaagaacgtgttcttgcagtccatanaattaaggagcgctacagctacttgacatt

SEQ ID NO: 39935 - DNA, 101 bp, rice(Oryza sativa)
  misc_feature (71): n=t or g
gttcaatgcatgtaactatatcagatctcatgcacaatcttatcattaacctgcctcagcaggcatgtttnctctaaatttcattttaccacagtttgatg

SEQ ID NO: 39936 - DNA, 101 bp, rice(Oryza sativa)
  misc_feature (71): n=a or g
atcctcccattatgtgtaatcagaaggactaatggttttgcgacagtaggtgacagagtgagggggactgncagagagcttgcctgttagcattataatta

SEQ ID NO: 39937 - DNA, 101 bp, rice(Oryza sativa)
  misc_feature (71): n=a or c
acagtagatcactaagctaagtgataaaacgtcaccctacatgctcagttggaggcaaggttaaatccctnatcaataattagatcggtcatctcggcgtc

SEQ ID NO: 39938 - DNA, 101 bp, rice(Oryza sativa)
  misc_feature (71): n=a or g
cataacaacatgattggtctttgtcaagtttgtgtatgataatgagcagaaattgcatattgccccaaaanaaaactaacctgaaatgttcataaccttca

SEQ ID NO: 39939 - DNA, 101 bp, rice(Oryza sativa)
  misc_feature (71): n=a or g
atgccttatttcatagctagatagacacacatagcgttgtctattgcataccaccacctatagcaatactnatccacatcaaggattatgataataaccac

SEQ ID NO: 39940 - DNA, 101 bp, rice(Oryza sativa)
  misc_feature (71): n=a or c
gaaagccctatgcaattaaaaagaccccccttccttatttgcatattttgatcctcatcctgttcaataantacgcataagaaattcactagcctttatat

SEQ ID NO: 39941 - DNA, 101 bp, rice(Oryza sativa)
  misc_feature (71): n=a or c
ggatgacaacgagtcatggttttgatcacagtggagcacgaatcacgaggcaggatcaaatatataattgnctctcctgcaatcacatggccgtgtaccct

SEQ ID NO: 39942 - DNA, 101 bp, rice(Oryza sativa)
  misc_feature (71): n=a or g
caagaagtctgtctctgctttgtcagtaactagcaaccttggtgttctcatggctcattctcatgaaatgncgagtaggaaacctcctggtattcgattat

SEQ ID NO: 39943 - DNA, 101 bp, rice(Oryza sativa)
  misc_feature (71): n=a or c
acctaacatgctgacctacacagcataaaacatatcgactcgatcgatgatgccaaagcaactgaagaaanggaaaggaaattgcaagatattattctcgt

SEQ ID NO: 39944 - DNA, 101 bp, rice(Oryza sativa)
  misc_feature (71): n=a or c
ttcctcctcctccccatgatcatggccaccattgccatccccatccttggagcagcagccgtagcgatctngtcgatctctaccaccaccttcttcccgac

SEQ ID NO: 39945 - DNA, 101 bp, rice(Oryza sativa)
  misc_feature (71): n=t or c
ttttttttaattattatcatactaaattcccacaataatgcgtagggtttcacctagtttgtaaggttagngcggaattcagtgaaaaaatgaccgatgtg

SEQ ID NO: 39946 - DNA, 101 bp, rice(Oryza sativa)
  misc_feature (71): n=t or c
tctagggctagccacgatttgggttgggttgggaacttggggacgacttatggactattgattctatgtgnctttttaacttcggaattccgaaaaaaatt

SEQ ID NO: 39947 - DNA, 101 bp, rice(Oryza sativa)
  misc_feature (71): n=a or c
ctcatcaattcatcaaggccgtgatgcgctcaagaaagccaccgacattttcaaggtggtcctcgacactntcaccgtggcatagcgcaataccccagggg

SEQ ID NO: 39948 - DNA, 101 bp, rice(Oryza sativa)
  misc_feature (71): n=a or g
tatatttatgtatacgcgaaattctcatgcatacagaggtcagaggagtggacgagaggaagagcggaagngctgaaggtgcaagttcgcagcaagctgtt

SEQ ID NO: 39949 - DNA, 101 bp, rice(Oryza sativa)
  misc_feature (71): n=t or c
tgctttatattatgtacataccttatcagttagcaacctctgtatacagctctattatactccctccgtcntaatatgtagcaaacctagaacgagattag

SEQ ID NO: 39950 - DNA, 101 bp, rice(Oryza sativa)
  misc_feature (71): n=a or c
gcggttctgcgcttctttgagctctgctgctagtctctgccagtgcatcatacttttagattttggaaagnagttcctcaatgattttagagatgcggttt

SEQ ID NO: 39951 - DNA, 101 bp, rice(Oryza sativa)
  misc_feature (71): n=a or g
actggctggctggctgctgctttagacttgaagctgcttaagagaggctgaactgggtgcgctcgttcccncgggccaccgctcctgccacccgcacgctt

SEQ ID NO: 39952 - DNA, 101 bp, rice(Oryza sativa)
  misc_feature (71): n=t or c
taaccactcttgcgaagaaagctcttgaatctcttgactattaaggccatctcctcatcctcactttcttnaccacctcttgagtcttcctcttgtttagc

SEQ ID NO: 39953 - DNA, 101 bp, rice(Oryza sativa)
  misc_feature (71): n=t or c
tggcccgtgattgcttgcaacgaccagcagtactggagggaaagtattctaattcctcgagtggatgtttnctcgtttgctcaaaaaccatttaaacggtt

SEQ ID NO: 39954 - DNA, 101 bp, rice(Oryza sativa)
  misc_feature (71): n=a or g
cctcgtctcactcgattttacactttacagacgctcactcctactccctcagtttaaaaaaaaaaacctgntttctgtattgaccgtccgtcttatttaaa

SEQ ID NO: 39955 - DNA, 101 bp, rice(Oryza sativa)
  misc_feature (71): n=a or g
tttctggttttgaaagttgagtgtgagaaatgactgggttttaagttaacggtaaaaaatggaatccaacnagttttgagtgccaaaaatggactttacct

SEQ ID NO: 39956 - DNA, 101 bp, rice(Oryza sativa)
  misc_feature (71): n=a or g
aagtgggataggcatgatttgaacctgcgtataaaatcttcaccagatttacggcatgtcgcttttgaccnctcggccacactcccctcctcagggatgta

SEQ ID NO: 39957 - DNA, 101 bp, rice(Oryza sativa)
  misc_feature (71): n=a or g
cgtcgtcccatagctagtcataccgatccatgctatcttcataatggcgattgtgccacgatcgaacaganggaaacaaagaaggcctagagccaataagg

SEQ ID NO: 39958 - DNA, 101 bp, rice(Oryza sativa)
  misc_feature (71): n=t or c
gttggaattatttttgtttacacatatcatctatccacatggcctccttcctgttaggacttctgaagcantgccaaactaaaatcttcaggatggccata

SEQ ID NO: 39959 - DNA, 101 bp, rice(Oryza sativa)
  misc_feature (71): n=a or c
ttttccctcttctttctccctttttttttctttgtttcggttgagggcgaagcaactggccaagaataggntgtgaagcttttgggaggatgatgtgattc

SEQ ID NO: 39960 - DNA, 101 bp, rice(Oryza sativa)
  misc_feature (71): n=t or c
taagtgctgaatagaaatgccccttcaaaaatgtgacatgagggccgttgagcaagcaagaaatcaatganatggtaaaccttgtaccatcaatgtcacga

SEQ ID NO: 39961 - DNA, 101 bp, rice(Oryza sativa)
  misc_feature (71): n=a or g
aggagttgttgtcgacgacgtcgcccgtgggatccccgtagtccaccggagcaagcgacagtttcagccanttgtcgtcctccccgcggccgtcgtcgtcc

SEQ ID NO: 39962 - DNA, 101 bp, rice(Oryza sativa)
  misc_feature (71): n=t or c
tatattagagaatccaatttaacagcacaattttttggagcaatgcagcatagagttgggctgaaataaanagctgttacaagctcaaattacaaagcaaa

SEQ ID NO: 39963 - DNA, 101 bp, rice(Oryza sativa)
  misc_feature (71): n=t or c
tgacatggtatggcctgaacattcctgatgttgggaagctgacatctctccgagctctgtatcacttctangtgaggaaggagaaaggatacgagatacag

SEQ ID NO: 39964 - DNA, 101 bp, rice(Oryza sativa)
  misc_feature (71): n=t or c
agaggacccgtttggacaggggcaactgtccactaacaaatcacagcctgaacataatcatagctgtttgnagtagcatatgcatcaacagaagcaatgac

SEQ ID NO: 39965 - DNA, 101 bp, rice(Oryza sativa)
  misc_feature (71): n=t or g
atgtacaatatgacatgcttgattttctctcaaaagctttcacacaatctgaatagaggtgcatatatagngataagagcaagtttaatagtatagcccac

SEQ ID NO: 39966 - DNA, 101 bp, rice(Oryza sativa)
  misc_feature (71): n=t or g
gctttgatggttaaggcccaaagaacctcacaagaatggagtccaacttgagcaggggaaaaggtacgganaaagtccaccttgactcccttaaatatcgg

SEQ ID NO: 39967 - DNA, 101 bp, rice(Oryza sativa)
  misc_feature (71): n=a or g
caatacaagggaatgggagtactttgcaactcacagagcagggcaatacgagttcacaggaacacatgagngaactcgaagcctatctgcaagatgaaacc

SEQ ID NO: 39968 - DNA, 101 bp, rice(Oryza sativa)
  misc_feature (71): n=a or g
tacttgacgagcacggcgaagtacaccgggttggacccctcctaaatgtggaagtttatcttgagccccgngtagttgcacggcacacgcctaaagtggat

SEQ ID NO: 39969 - DNA, 101 bp, rice(Oryza sativa)
  misc_feature (71): n=a or g
tagggagtcgaaacatttacaaagatgttccggttggcaggtcctagaagtcggtcatcaaatctaaagcntgcaaccgcaagaacaaagggtgaggtcag

SEQ ID NO: 39970 - DNA, 101 bp, rice(Oryza sativa)
  misc_feature (71): n=t or c
cgataaaggtccaatttgtttagtacaaatacaactttcttcttccactgctgaacatactggagaaatcngacctagaagtcaagaacgtttttagctcc

SEQ ID NO: 39971 - DNA, 101 bp, rice(Oryza sativa)
  misc_feature (71): n=t or c
ctatacgaagaaggtacttgaaatgttcaatatggacaagagccaccctctgaaaacccccatggtcgttngatcattggaggtagataaagatccgtttc

SEQ ID NO: 39972 - DNA, 101 bp, rice(Oryza sativa)
  misc_feature (71): n=a or c
acttccaaatcagatcaatagcgtgcctgagcatgattagaagaaatcacaattacctagggccagaaganagtcgcaggactgcggggtctccatagagc

SEQ ID NO: 39973 - DNA, 101 bp, rice(Oryza sativa)
  misc_feature (71): n=t or g
tttatgtacccgtaccaaatcttgatcttcactgaactcaaacgagccttcgtgatgagattatgagaatncaagttctgtctatgttacctctaagttat

SEQ ID NO: 39974 - DNA, 101 bp, rice(Oryza sativa)
  misc_feature (71): n=t or c
atggtctcatggttcgtggatatcgtccagtaataaatactctggcaaaaggcctagatatacgccttggncacaggtatgcatatccatttagtttttcc

SEQ ID NO: 39975 - DNA, 101 bp, rice(Oryza sativa)
  misc_feature (71): n=t or c
aggctatggcctttgcatggtcgaaactttggagcatgtccaccttgtgatacacggattttgggagccancgaatcccatgtaagcttgtctaagctcaa

SEQ ID NO: 39976 - DNA, 101 bp, rice(Oryza sativa)
  misc_feature (71): n=a or g
actactaccccatctcactatgcaaactgcccactgattaccacatagagatttttcttctttgttccccntaagagaagaagggacctcaagtacaagac

SEQ ID NO: 39977 - DNA, 101 bp, rice(Oryza sativa)
  misc_feature (71): n=t or c
tgaaacttgtcacaactgcagagcatggacaccgatgtgcgaacatggaagaattgagtgcactttgcacngctagctccgtcggcgtcgagatcgcagac

SEQ ID NO: 39978 - DNA, 101 bp, rice(Oryza sativa)
  misc_feature (71): n=a or g
aacatctgacaagtcatcatcctgatgtgcacggttttccttatttgttggtctacccctgccttcttttntgcatgaagtacctaaccacaccacaaaaa

SEQ ID NO: 39979 - DNA, 101 bp, rice(Oryza sativa)
  misc_feature (71): n=a or c
caaacatatagagatgccatattcttctggatggcaaacagacactaaatcagatgcaaaacaacctccanaaatcaaggaaacaaaggaagaaaacaact

SEQ ID NO: 39980 - DNA, 101 bp, rice(Oryza sativa)
  misc_feature (71): n=t or c
ccatgtcgccgacgatggcaaactcgtctttcagaagattcctagagaggaaatggtgtaggaagaaccanacatggcattatacgctcctaaatggagta

SEQ ID NO: 39981 - DNA, 101 bp, rice(Oryza sativa)
  misc_feature (71): n=a or c
ggataatgaagtatatttagaaaccacagctacgttacgcgtcaccaccagtcatctattgctattagaanaaaaaagttttcacaatcgtgtaaagtttt

SEQ ID NO: 39982 - DNA, 101 bp, rice(Oryza sativa)
  misc_feature (71): n=a or c
gtgagtgctactttagagtagcatttctgataatcatcaaagaggattcaaaagtacagcttccagtgganttctgataatctaatggcattgcttgattt

SEQ ID NO: 39983 - DNA, 101 bp, rice(Oryza sativa)
  misc_feature (71): n=a or g
gcatacgccaagatagggttgcctaccctagcccttacccaaacactggcctcgcttcatggttttggcgnagaagcagttcaagtcctaggccaagcaca

SEQ ID NO: 39984 - DNA, 101 bp, rice(Oryza sativa)
  misc_feature (71): n=t or g
aaagattcagtcattgactccgaacattggagttgtctacaggtaaccttttacattggcttcattgttgnaatacatttctattttgtatatattatggt

SEQ ID NO: 39985 - DNA, 101 bp, rice(Oryza sativa)
  misc_feature (71): n=a or g
cgcgtgatatgttgtagtgtactacgtgagaagctggcaagatcaacagccccaaacgttccacttatttnggaaataagctaaacaacatatttgtaatt

SEQ ID NO: 39986 - DNA, 101 bp, rice(Oryza sativa)
  misc_feature (71): n=a or g
atactaacatcatatatgggttgtcccactagtgtcatttcaccttaatagtcggtcagtcggagcatttnccttataactcatatgtatttattcttcaa

SEQ ID NO: 39987 - DNA, 101 bp, rice(Oryza sativa)
  misc_feature (71): n=t or c
agtattctacttatttgatgggccaaaaggccgcaaattcgccgccgtgaagctctggatgctgtttctcnctctccttcctcggcgcacccggccgccgg

SEQ ID NO: 39988 - DNA, 101 bp, rice(Oryza sativa)
  misc_feature (71): n=a or c
gttagaattaaacctgtatttccttataatattagttctgtttattcctgtacagaggcaagaaagctcancagagaagcaagcagacaagctaccaattc

SEQ ID NO: 39989 - DNA, 101 bp, rice(Oryza sativa)
  misc_feature (71): n=t or c
acgacatactaattgtgaagttctcgtgaactgtgccaaggtgccaaataccatcatcctcagctaattcntccctatgaagattcgcggaaaccttggcc

SEQ ID NO: 39990 - DNA, 101 bp, rice(Oryza sativa)
  misc_feature (71): n=t or c
tgctttaaactagtattatcccacagtgttatactgttgcatagcagtagagctactgtccttttcttttncaataattgttcagaaatcagatggaaatg

SEQ ID NO: 39991 - DNA, 101 bp, rice(Oryza sativa)
  misc_feature (71): n=t or c
gttagttcacttcacagaagggcattattacatcagactttacagaaagaatcgattcaactcttctcatnagttattacagatcgatcgatcgagatgat

SEQ ID NO: 39992 - DNA, 101 bp, rice(Oryza sativa)
  misc_feature (71): n=t or c
cgcggttttttccattggtttttttttctgatttcggtttttttctttccgttttttgcggttttccattngttttttttctttccagttttttctttttg

SEQ ID NO: 39993 - DNA, 101 bp, rice(Oryza sativa)
  misc_feature (71): n=a or c
ccgacaactgagtaatttgagcaaatgggaggtacattaattcagttttcatttttcttttgatcctcttntcttgcatgctgcgttaatctattgctaat

SEQ ID NO: 39994 - DNA, 101 bp, rice(Oryza sativa)
  misc_feature (71): n=a or g
cctgcagtgtaagcccaagcccaactttgagaagcgggatcctggagtagcaatacatggtctgctcatcntcgcaggtgctgctgccatagaagggttct

SEQ ID NO: 39995 - DNA, 101 bp, rice(Oryza sativa)
  misc_feature (71): n=a or g
gagaatatgaagcatttgaattagggggcacaaaatttctcagaagttgggaggaacaaacgtcagtgatntgagatggtggtggcaccactgctaatatt

SEQ ID NO: 39996 - DNA, 101 bp, rice(Oryza sativa)
  misc_feature (71): n=a or c
gtcttgtttgggccttttttttatgagcacaagatcaaattgatggacgtttatgtctgataggatccatngattttttccatctccttcacggcttttgt

SEQ ID NO: 39997 - DNA, 101 bp, rice(Oryza sativa)
  misc_feature (71): n=a or g
gatcaagcgaattgaaggagttggcaagtcggtgagggagattgagtggcttgaccagcgggtgatgatgncgtcacccatcccccctcttggtaggggca

SEQ ID NO: 39998 - DNA, 101 bp, rice(Oryza sativa)
  misc_feature (71): n=t or c
gcttgttcaggcttcagccccaaagtctcagtcccaactagccgttccacttttggcacaaatttcttagnaggcaagcgcttcatagaaggggaagaatc

SEQ ID NO: 39999 - DNA, 101 bp, rice(Oryza sativa)
  misc_feature (71): n=a or g
tgcatttctcagtacctttttgtcttgtgctgttttcagagagtgttctcagaagctgaggaaatggcagngaggtaccgggagcagcttccagctgactc

SEQ ID NO: 40000 - DNA, 101 bp, rice(Oryza sativa)
  misc_feature (71): n=a or g
actttaacaatatgatatatgcaaaactggttggaaggctaaaacaatctgttatgagtataaacatgatnggactactaacagacaatcttctcttgttt

SEQ ID NO: 40001 - DNA, 101 bp, rice(Oryza sativa)
  misc_feature (71): n=t or c
ggcatctgtgacggcctttagtttaagcccaattgggattgtagtcatccgtgatgggcattaattgtggnccattgagattaggtcatcggtgacgggtt

SEQ ID NO: 40002 - DNA, 101 bp, rice(Oryza sativa)
  misc_feature (71): n=a or c
gccgtcatccgccggcacggaggtcaccctcacttgccttttcctcttcgttctctttaccttcttgtctngcgttcgcgttaatctgatctgttcgtcga

SEQ ID NO: 40003 - DNA, 101 bp, rice(Oryza sativa)
  misc_feature (71): n=t or c
acgagccagcgaacacccgccgaagtttattaagaggggtagaaacagagtttacagagcttccagtatcngtgtctttaaacactggcaacaggccaagc

SEQ ID NO: 40004 - DNA, 101 bp, rice(Oryza sativa)
  misc_feature (71): n=a or c
ccgttccccggaacccccttcctcgcctcgccgtgccagtggtagttctgctcttccctcttttttgactngcgattgtttggggactgtcgctggtgatt

SEQ ID NO: 40005 - DNA, 101 bp, rice(Oryza sativa)
  misc_feature (71): n=t or c
tatagaggcctccaagggcccctaatgtttgggactgtctatatgacagtacatgttgggatgtttagatncagaggtgtaaagttttagcgtgtcacatc

SEQ ID NO: 40006 - DNA, 101 bp, rice(Oryza sativa)
  misc_feature (71): n=a or g
attaggaccggagttatccaaatccagatatcctaatttaagtacaagcatggactgaggacttgacgacnctgctagtaattaattacactgaaattaat

SEQ ID NO: 40007 - DNA, 101 bp, rice(Oryza sativa)
  misc_feature (71): n=a or c
caaaccaacctcaacgcgtcttcttctcttcttcgccccaatctctgatccgtccagttgacccaaagctngagtctttcttgcttctcctgagtcctgac

SEQ ID NO: 40008 - DNA, 101 bp, rice(Oryza sativa)
  misc_feature (71): n=a or g
tgtttagaagggattatgagtttagagggatgattaggatacatgggaattttagtggggataggatgggnaattgaggaaggaactccctccttttcaat

SEQ ID NO: 40009 - DNA, 101 bp, rice(Oryza sativa)
  misc_feature (71): n=a or c
gtccaaagaagctgaaatcgagaactatcacttggacgccctcatcaagctcaattcctgtgaccacatcntccttccttaccttgctcaataagtgaata

SEQ ID NO: 40010 - DNA, 101 bp, rice(Oryza sativa)
  misc_feature (71): n=a or c
gctgctgtggctgtggctgttcttgcataactgtagtaggcagcctcgtttgatttcccatctgcccttgntgctgcatacctgaagaagactgcggtcgc

SEQ ID NO: 40011 - DNA, 101 bp, rice(Oryza sativa)
  misc_feature (71): n=t or c
tgtatttttcacaataaatttctatgggaaagttttttaaaagattatatctgatgaaccgtgagttcctntcgacactcaaggcagttgtttggcccgat

SEQ ID NO: 40012 - DNA, 101 bp, rice(Oryza sativa)
  misc_feature (71): n=a or g
ggcatatataaggaactacgatcgctaatcgatcgcttaatcagggcaggtgataaattaagctttcacanaagaacagaaaatgccgtcctcgatcgact

SEQ ID NO: 40013 - DNA, 101 bp, rice(Oryza sativa)
  misc_feature (71): n=t or c
gacacacttcgtctgaaaaaggttatgccactggttctgctccgctttgcccatttgtgcacttaagacangttgcacaataagactctcatattggtccg

SEQ ID NO: 40014 - DNA, 101 bp, rice(Oryza sativa)
  misc_feature (71): n=a or g
tttcttatagatggaaacaatgcctcgaagtaaggaatgagccgcgacctcgaccgacctattataacttngacaaggaatttcaattacacaatagcaaa

SEQ ID NO: 40015 - DNA, 101 bp, rice(Oryza sativa)
  misc_feature (71): n=t or c
tggttaagattgcttcaagcagagagtctggaaatctgtcgcctggttttgttcccaatgaagaaataaangaataccatgtaggcacaacaggagcgaaa

SEQ ID NO: 40016 - DNA, 101 bp, rice(Oryza sativa)
  misc_feature (71): n=t or c
gagtacctctgtccttccactattttgcagacctgaataagcataaaagttaagtatgcaccccccccctnccaaaaaaaaaatagaattgaaaattttgg

SEQ ID NO: 40017 - DNA, 101 bp, rice(Oryza sativa)
  misc_feature (71): n=a or g
aaataatccaatatcacgacgcttattcttgaatccaaataaccaagcttcgtcatcatcagtaaaatagntataattttccttgagatgtggatattgtt

SEQ ID NO: 40018 - DNA, 101 bp, rice(Oryza sativa)
  misc_feature (71): n=t or c
tgtttgaaatatgaggaagttttccgtttctcacttaatcgaaccatttcgctctgaattttccacaaaanttcagtgattcaaacaggactactttaaat

SEQ ID NO: 40019 - DNA, 101 bp, rice(Oryza sativa)
  misc_feature (71): n=a or g
ctcaactataaaatcggatattgaaccctctcaactctcaaatccatttaaattcactccctcagagcaancataggtgacactttcctacatgatgctta

SEQ ID NO: 40020 - DNA, 101 bp, rice(Oryza sativa)
  misc_feature (71): n=a or g
cgacctcgtcgaccggggaaacctcgacggggcatgtgaagggatgcggagcgccgttttcatccatgtcnccatgagcccgacgcggagcgccgcatcca

SEQ ID NO: 40021 - DNA, 101 bp, rice(Oryza sativa)
  misc_feature (71): n=t or c
aggggtgaaggggggagggaggaggagcagaacgaaggatcttggggctcgggttggtcggggtatggatnggctcggcgcgggtgtcctaatgccgagct

SEQ ID NO: 40022 - DNA, 101 bp, rice(Oryza sativa)
  misc_feature (71): n=t or c
gacttgtaggcgatgaatccgtcaatgcgatgacatgacagtaagacgtctatagttccttcgtcaatctnaaaatatgatggtccagcctattagagatg

SEQ ID NO: 40023 - DNA, 101 bp, rice(Oryza sativa)
  misc_feature (71): n=t or g
agtcttagattctgataatgaatagatctatcctgtggagtattcaggctctgcgtagccctttttacccngactctatagggctgtaaagtttattttcg

SEQ ID NO: 40024 - DNA, 101 bp, rice(Oryza sativa)
  misc_feature (71): n=a or g
gagttgcctcagcgaagaatgaaaacttagggatcatttggaggagcttctatcaactatagcttcccacntaatcttcagcttacccaaacaatccaatt

SEQ ID NO: 40025 - DNA, 101 bp, rice(Oryza sativa)
  misc_feature (71): n=t or c
cgtgttgtagcacctacagtagcaaatggtggttcttctaaccaggcaattcatactctggtatcagcagngccacctaaagctgctcatcaagcagatga

SEQ ID NO: 40026 - DNA, 101 bp, rice(Oryza sativa)
  misc_feature (71): n=a or g
aaaaatcgtgctgaaaatcgctaaaaaaatcacacaaaaaaaagagaaaaatcgggaagtcgcaaaaaaanaaaagccacgtggccggtggaggggcgcgc

SEQ ID NO: 40027 - DNA, 101 bp, rice(Oryza sativa)
  misc_feature (71): n=a or c
atctatcttctgattagatgttctaactaacgaatcaacacacatagcttcactagaacgcaacgcgatangttatttatttttttcagtacgtaattata

SEQ ID NO: 40028 - DNA, 101 bp, rice(Oryza sativa)
  misc_feature (71): n=a or g
ataattaacttatctccaattcattttttattggcattcataggttgaagatggcttctgtcgaggagtgntcctctctagcgggagatcgtgagatcccc

SEQ ID NO: 40029 - DNA, 101 bp, rice(Oryza sativa)
  misc_feature (71): n=a or c
gccgaccccccactgagggagaaagtggactacttagagctgacctttccaagggaataacggacgaaaangcaaggtgcaaaggacttcatttgatttgt

SEQ ID NO: 40030 - DNA, 101 bp, rice(Oryza sativa)
  misc_feature (71): n=a or g
ggggtgttcgagatggcgattgcggcagaggtagtagacgacggccaccctctttgaggaggacggggaanggggcgggggcggcgagcgcaggtgatgag

SEQ ID NO: 40031 - DNA, 101 bp, rice(Oryza sativa)
  misc_feature (71): n=t or c
ttgatgtaatatatatctcaaaagtgcatattaattagataggtgagattgatgttgctagctatctcagnaagctgtccacatttaatattttttctttt

SEQ ID NO: 40032 - DNA, 101 bp, rice(Oryza sativa)
  misc_feature (71): n=a or g
accgatgaaagcatcacggcgatcgctatattcaggagtgcaggatcttcgctcctcatcatgttctttantctgtcgtgatgattttgtttgctgctcct

SEQ ID NO: 40033 - DNA, 101 bp, rice(Oryza sativa)
  misc_feature (71): n=t or c
aatgccatgttttatttgttttaattttgcaggtgacaaagtttactaatcatcacacgtgtacatctagnggtagaaggaagactaccacaccaaccagc

SEQ ID NO: 40034 - DNA, 101 bp, rice(Oryza sativa)
  misc_feature (71): n=t or c
cttgtaagtctatccttttataaaactgaattgtgacctcatgaactccttttgtcctgcaaatttaagangcccaaaatttcagttaaaattcacagatg

SEQ ID NO: 40035 - DNA, 101 bp, rice(Oryza sativa)
  misc_feature (71): n=a or c
gatagaccagaagttattcttaattcttccctagagaaaggatatcccggtatccaaacattgatatattnctcgcaaaatgaagatttacagaatttatc

SEQ ID NO: 40036 - DNA, 101 bp, rice(Oryza sativa)
  misc_feature (71): n=a or c
gcattgggaggaccgatccggacatgcatcaccggttaaagccactgtcaactgggcgagggacgctgggnttcctactgcacatgacgggacagggcata

SEQ ID NO: 40037 - DNA, 101 bp, rice(Oryza sativa)
  misc_feature (71): n=t or c
gggagacacattgcgagggtgagtgtcccttggccaccactcctacacctagagttcctcttccacccctngcctcgtcgtcgtcctcacgactcgtgaga

SEQ ID NO: 40038 - DNA, 101 bp, rice(Oryza sativa)
  misc_feature (71): n=t or c
ctgttactgtctgaggaataaatttcagccaattcagcgtgttcagggaaatcaccacctgatttactttntgctttatttttttcagcattttctttttc

SEQ ID NO: 40039 - DNA, 101 bp, rice(Oryza sativa)
  misc_feature (71): n=t or g
gcgtccagaacaacgctcttctcgacccacacaaacgagaacgatggcgtcaatgcctctgcccgtacgtnttactcagtaagaacaccacagccatgcct

SEQ ID NO: 40040 - DNA, 101 bp, rice(Oryza sativa)
  misc_feature (71): n=a or g
catgttgtatagggtaatagatcaaagtgttcgtttggtgggaatagacccacatgaaaattttagataanttttgactagtttgtatgctcacttcactc

SEQ ID NO: 40041 - DNA, 101 bp, rice(Oryza sativa)
  misc_feature (71): n=t or c
attccgtgctgccgtgctacgtatactactgtatccgtggtagatatagaccatgtttagtgaatctacangaagtattcaatatgagctaataaataaat

SEQ ID NO: 40042 - DNA, 101 bp, rice(Oryza sativa)
  misc_feature (71): n=t or c
actcaatggtgaacacatggtggaggacgtgcgtctccaacaacccaagcctccagttcctcgacattgtngaccgtgccaagacaaccattgatgcaagg

SEQ ID NO: 40043 - DNA, 101 bp, rice(Oryza sativa)
  misc_feature (71): n=t or c
cgaggacgtatgcgatattttgtgcaagtacggggagctttttgcaaaaaaagcctaacacgcgtaaaccnctcagaggagaaaaaaaatctgaaaaacga

SEQ ID NO: 40044 - DNA, 101 bp, rice(Oryza sativa)
  misc_feature (71): n=t or c
cccgccggccatcagctcccgcttcttctgacttttcctcctcttgttccagacttccagtgcatgcagangtgtttggtttcgcactctcactttcaacc

SEQ ID NO: 40045 - DNA, 101 bp, rice(Oryza sativa)
  misc_feature (71): n=t or g
ttagcaatgtctagctgttggcaccattaggtgtcgcttcaaaaccactcattcttatagatcttgtagancctaccaactattagcttcctcgtcgatag

SEQ ID NO: 40046 - DNA, 101 bp, rice(Oryza sativa)
  misc_feature (71): n=a or g
tttacttgttcttgtcatgattttggtattagtttgcattgtcttgagatgtgtttgtgtggatgaggggntcagaattttggccttctcttttgtttgat

SEQ ID NO: 40047 - DNA, 101 bp, rice(Oryza sativa)
  misc_feature (71): n=t or g
aagtgtaaagtacgtaaacatcacatgagaacgtatcatgcatccagtgaccgtgttggcttggacacttngaccggccaagatgtccaactcgtgcagcc

SEQ ID NO: 40048 - DNA, 101 bp, rice(Oryza sativa)
  misc_feature (71): n=t or c
actaaccacctcttatcaccaatcatgacagttctgaaacagaacaacacattgccagataagccacctcngtcaacagctcctctgtcagagcaaccatc

SEQ ID NO: 40049 - DNA, 101 bp, rice(Oryza sativa)
  misc_feature (71): n=t or c
tcatcagccttgacaatgcctgttatgttctttgcaatgtcatcagcaccttggcctccattatgcagctnattgcctaccacaacatctttatcttcaga

SEQ ID NO: 40050 - DNA, 101 bp, rice(Oryza sativa)
  misc_feature (71): n=a or g
attgttatatcttaaaagtgacaaatagttaaatgtcccccgaattcaagtgtccactgctcctgcaaagnacttactaatttaccaagaagcacttcagt

SEQ ID NO: 40051 - DNA, 101 bp, rice(Oryza sativa)
  misc_feature (71): n=t or c
ctccatatcccaaacattttgtaaccgcaatcatgcgggactagcaaaaacttgtgaaacacgctactccngccaggcacaaatcaaaaaacgccctgtct

SEQ ID NO: 40052 - DNA, 101 bp, rice(Oryza sativa)
  misc_feature (71): n=t or c
gtctttacctttgcaataggagccatttctactgcaatgtgcacaatatgcataggaggttcttttgcaanggaatcagtcacaggactatgatagtccat

SEQ ID NO: 40053 - DNA, 101 bp, rice(Oryza sativa)
  misc_feature (71): n=a or c
agtagcagtgaacttggccctacaagtaaagatctgtcaaaagttgaggcactgtcactggatgactcacnacatgcatctggttcaactgattggtacaa

SEQ ID NO: 40054 - DNA, 101 bp, rice(Oryza sativa)
  misc_feature (71): n=a or g
gctaaaatttacatataattgggtgcaattctacctcaaaaaagacactatagtcatggttcctttttccnattgttattttttctttacctgatgcaatt

SEQ ID NO: 40055 - DNA, 101 bp, rice(Oryza sativa)
  misc_feature (71): n=a or g
tcttagtctagcaataccatcaaataagcctgtatcaatgaaggactgcttagatttatataccactgagnagatagatgattgggagtgtaaggaatgtt

SEQ ID NO: 40056 - DNA, 101 bp, rice(Oryza sativa)
  misc_feature (71): n=a or g
atgtactccgcttcttttctctctaatcttctctcttatccacataagcataaatatgatgtggcagcctntatagcctacttacatcatcttattatact

SEQ ID NO: 40057 - DNA, 101 bp, rice(Oryza sativa)
  misc_feature (71): n=t or c
gaacttcatccatagggcctccatgctgggaagctcaaagaatcaacaaaaccacataataatggcacatnactaagctctaacctcgtcaagcgctggga

SEQ ID NO: 40058 - DNA, 101 bp, rice(Oryza sativa)
  misc_feature (71): n=t or c
gctttagagggataacaacgctgttgtaagctgtgttcgcaattccttgttcccaaccggaaacagcacgnacgaaaaacggagcggtccattagcacgta

SEQ ID NO: 40059 - DNA, 101 bp, rice(Oryza sativa)
  misc_feature (71): n=t or c
cttcccattcctttctgataacctttcgatcattggatgtaaaggtctgaagaggatctctaatcttccanagctgagggatctgcgtgtagcccgttgcc

SEQ ID NO: 40060 - DNA, 101 bp, rice(Oryza sativa)
  misc_feature (71): n=t or c
ctggcccacttatggaggtacaaaaaatagagttattcaccgcagggctgcagggcaagcttcgcatcgangttgagctggaggcacccgcattgctggac

SEQ ID NO: 40061 - DNA, 101 bp, rice(Oryza sativa)
  misc_feature (71): n=a or g
tatttccaaaccatccacatcggttaggtttaggtgggctgaaaatccaaatatcctgaaaccaaataccngcccaatgaaactacatattcactcgtgac

SEQ ID NO: 40062 - DNA, 101 bp, rice(Oryza sativa)
  misc_feature (71): n=a or g
ctcgatgaaacagcatcccatcccattacaaggccctcctattggtgccttttcaccatcacatctactcntgcaagaacctatgaggtcctccgtgccat

SEQ ID NO: 40063 - DNA, 101 bp, rice(Oryza sativa)
  misc_feature (71): n=a or c
aaggccggtcagccccgggtcttcaatctcatcgatggaggtgttgctgccaacaatccggtaagcaattnattaatccgtccgtcaaaaccatttttcgg

SEQ ID NO: 40064 - DNA, 101 bp, rice(Oryza sativa)
  misc_feature (71): n=t or c
tttaagacaatgaattcagaactatctgcatgcagcaggctccacttgtgatgctgacaaagttacactantgtactcccctttacttcctactttctccg

SEQ ID NO: 40065 - DNA, 101 bp, rice(Oryza sativa)
  misc_feature (71): n=t or g
aattaatactacgtgtcagaagaacagtactattacctccctcccattttaattacagatgtgagtttcgngttatttatttttttcttaaaaaatagtca

SEQ ID NO: 40066 - DNA, 101 bp, rice(Oryza sativa)
  misc_feature (71): n=a or g
acgtgatgcatattcaagctggcagcaggagcaggagatatcattgattgctcaaaatgtgcaaaggaaangcagcttgaaaacatttcagaatttctcat

SEQ ID NO: 40067 - DNA, 101 bp, rice(Oryza sativa)
  misc_feature (71): n=t or c
ttcgccctctttttcgctgacgatgaatcggagatccatccctcaaccatgtggttgatgtgatcgtgcancctctgatttccaccgtcgatgcgcatctc

SEQ ID NO: 40068 - DNA, 101 bp, rice(Oryza sativa)
  misc_feature (71): n=t or c
tggccatcatcggcctctttattctacgtcctgccatcagcgtcccatctccaaatcatgcattgtcgttngtaagatctcgtttgcaccggttttaaaag

SEQ ID NO: 40069 - DNA, 101 bp, rice(Oryza sativa)
  misc_feature (71): n=t or c
ggaagatttacgtgtttgcctacctttattgtcctacgcctacccgtaaagcgagttcctgaagataatanatttttttcaactatccagagtttagagcc

SEQ ID NO: 40070 - DNA, 101 bp, rice(Oryza sativa)
  misc_feature (71): n=t or c
aatctatattggcttaccgtgtttcgtttcctctcgaggcaaactactactctttttagtttgcagttctnaaaaaaaaaaaaagggtttcctgatactga

SEQ ID NO: 40071 - DNA, 101 bp, rice(Oryza sativa)
  misc_feature (71): n=a or g
tcatcatctagtggctttgcttgggctaaaaaaccaccagaagatcgttcattcgctagatctcggaccanatctagttcaaggggccaatttactgctga

SEQ ID NO: 40072 - DNA, 101 bp, rice(Oryza sativa)
  misc_feature (71): n=t or c
ggtaggtatggtaatagaggttggaaacggaatgggggaaatggttgtgcatagagccacccaagacagtnctgtagcttcgtgttaccatttctattata

SEQ ID NO: 40073 - DNA, 101 bp, rice(Oryza sativa)
  misc_feature (71): n=a or g
gcccgttcatcgacgaccaccagaactgcatgaagttcggcaagccgagcctcgagtacgtgagctggagntggaagccggacgggtgcgagctcccccgc

SEQ ID NO: 40074 - DNA, 101 bp, rice(Oryza sativa)
  misc_feature (71): n=a or g
gcggtgctcttaactcacgcacatgcaaaaatgcacctcctcttcccactcattgttttatgaataaattntgctcgtggtatataaacttttatggtggg

SEQ ID NO: 40075 - DNA, 101 bp, rice(Oryza sativa)
  misc_feature (71): n=t or c
caaatattttctgttcacctgttacacacttttcatgagtatattcctgaatactttgtagcatgtggttnttcgtcctggctaaagcagtcaaacctttg

SEQ ID NO: 40076 - DNA, 101 bp, rice(Oryza sativa)
  misc_feature (71): n=a or g
tggaagctactgcaagtaattaactgaagtgaccatggtttgaattttcatgtgtgcagggtacagtgagnctactgttccagccagccgaggagtcgggc

SEQ ID NO: 40077 - DNA, 101 bp, rice(Oryza sativa)
  misc_feature (71): n=t or c
gctggctcacaacggtggcacagtaacctccgctaggtcgggttcaacaatatgacacagatggggtcganaaccttcgtatgacagatggacacatcagt

SEQ ID NO: 40078 - DNA, 101 bp, rice(Oryza sativa)
  misc_feature (71): n=t or g
ctgaagcttttgacctccattaagacagaaatggcggcgaagattgagtcctttgaagccgagctctccanggccatggctaggagttcggaattggagtc

SEQ ID NO: 40079 - DNA, 101 bp, rice(Oryza sativa)
  misc_feature (71): n=a or g
aggtccatattatagcataattaatatgtaagtgagttggaaaaaagataagtacgctgagagaggtcggngatcgaattctggtgtaaaaataaaaaatg

SEQ ID NO: 40080 - DNA, 101 bp, rice(Oryza sativa)
  misc_feature (71): n=a or c
aattacattaacccggaggaacacgcaagtataatatccacaaaggacacaacctttaggttccttgtganacttcattatgacatacatatagaaggaat

SEQ ID NO: 40081 - DNA, 101 bp, rice(Oryza sativa)
  misc_feature (71): n=a or g
ggggatctcaaacacagctgggactttggcaggaatagttggtgttggtctcacaggaagaattctggagncagcgaaggcatctaacatggacctgacaa

SEQ ID NO: 40082 - DNA, 101 bp, rice(Oryza sativa)
  misc_feature (71): n=t or c
agatgacttatattgtgaaacggaggaagtagaaaaaaatgtcaaaccaatggcctcgtacgttcccttcntctctgtgctctctacggcagcggtggcgc

SEQ ID NO: 40083 - DNA, 101 bp, rice(Oryza sativa)
  misc_feature (71): n=t or c
ctgatagctctctagcctagctcttatgcagttctatcagcaattctacttcttcttggtagctctctttncaggaccatcacctgcagcctttctttttg

SEQ ID NO: 40084 - DNA, 101 bp, rice(Oryza sativa)
  misc_feature (71): n=a or c
aaagaccagcaagcagtcacgcgagccgtttccaaaaagctaattatcgtcttctcccgatacagaatgtngaaggacgaaggttccaagaggggaccttt

SEQ ID NO: 40085 - DNA, 101 bp, rice(Oryza sativa)
  misc_feature (71): n=t or c
ctcttcatcctactcaattattgcggagagaagtatgtagcaggggagtagatgaatagaagaaaagtagngatggttgtgatatataggaaatatagaag

SEQ ID NO: 40086 - DNA, 101 bp, rice(Oryza sativa)
  misc_feature (71): n=t or c
cacatgtcgataatggttttggactcacaaccaatggcaatcctatcatttatttgaagtcatctaaggtntatttggatcaatgctcgcgcaaaccatac

SEQ ID NO: 40087 - DNA, 101 bp, rice(Oryza sativa)
  misc_feature (71): n=a or g
gatgcacagttaccattacaaattaataatcccttaattagctttgttataaataaaatagaagtcttacnttggccaagagtggaactgtggaagaaact

SEQ ID NO: 40088 - DNA, 101 bp, rice(Oryza sativa)
  misc_feature (71): n=t or c
aaattttattcttcttgtttactccttaggatgctttcctctgaactgcagtcaccttgagacaatcaatnaattgactggtgcattgccaacctctttgg

SEQ ID NO: 40089 - DNA, 101 bp, rice(Oryza sativa)
  misc_feature (71): n=t or g
actataacatgttcaatggatcgtttgacaacacaacagcggagtggaatatacagtttgtgagaaatgancgttctgctgagctcaggagtgtcacaaag

SEQ ID NO: 40090 - DNA, 101 bp, rice(Oryza sativa)
  misc_feature (71): n=t or c
aggaggagaaggccacaagaggtagatgtagagagaaaacccatcatcacctcgccgctcctcatagtgangagaaccacctcgacggcgttgagcagcgc

SEQ ID NO: 40091 - DNA, 101 bp, rice(Oryza sativa)
  misc_feature (71): n=t or c
agtgctagacatcaagcaggcaacacccatcatagatattgcgtccattggtgacagaacgagccctctcngcatcgcagcttgaccggaaccacacggaa

SEQ ID NO: 40092 - DNA, 101 bp, rice(Oryza sativa)
  misc_feature (71): n=a or g
ggtggcaggggtaaagcagagcgacgagttaggaagtggtgaccagtggtagcggattcgacagtgagganccacttgagacgagaaaaatggctgggtag

SEQ ID NO: 40093 - DNA, 101 bp, rice(Oryza sativa)
  misc_feature (71): n=t or g
tgtcagttaatcaaagcgcatgtttcatagctgaattgcctcctaaggatttgatccttgctgcagctaangagttttctcatgacctttccaagatatct

SEQ ID NO: 40094 - DNA, 101 bp, rice(Oryza sativa)
  misc_feature (71): n=t or c
ttgacacggccagattcgttggtgcattggatttgcacatatggcgtgctgtctcctccatccatatgtcngctgcctggaacgcaagatgcggttttctc

SEQ ID NO: 40095 - DNA, 101 bp, rice(Oryza sativa)
  misc_feature (71): n=t or c
ctctctctgtctctctcactcatcctctctctcgcgcgtgaggtgttcgtcttcctgttcgagcttttgcnggcggctggccaaggcgagatcgtccttgt

SEQ ID NO: 40096 - DNA, 101 bp, rice(Oryza sativa)
  misc_feature (71): n=t or g
acccactttctgggaattgccttcctttcccttctagctagcaaaagtagcatccacgcgattctaccganttctttgagatcaccacggcgagatgtgga

SEQ ID NO: 40097 - DNA, 101 bp, rice(Oryza sativa)
  misc_feature (71): n=t or c
ttgagccggaaggggtaggacgacaggttgaggttgatggacgccgtcctcccatagctgggcaactcganggttggcagctggtggccatggtcacgcgg

SEQ ID NO: 40098 - DNA, 101 bp, rice(Oryza sativa)
  misc_feature (71): n=t or c
ccgttgtcgccaatcatcgccgcaggtgacatggaagggacagaggactagctccatctctgcccaatggngccgacgcccaccaacttcaccggtgacag

SEQ ID NO: 40099 - DNA, 101 bp, rice(Oryza sativa)
  misc_feature (71): n=a or g
acaaagcttgccgatcctacctcgaggtagctagtagttgttacacttacacatcaatcacaacttcacangtagatacatatactcctatatagtaatat

SEQ ID NO: 40100 - DNA, 101 bp, rice(Oryza sativa)
  misc_feature (71): n=a or g
cttgttgatggtcctcagaaaatggtcagaagggttcatcagagacggacaagggaatccgctcagagcgnagaactaataaacagtgaaatatagtcaat

SEQ ID NO: 40101 - DNA, 101 bp, rice(Oryza sativa)
  misc_feature (71): n=t or g
gacacagcttgtaagtttttcattctctttgctgtgctaattgattcactttgctttagcttcttgcatcngcattactctagttgcaatttcattcgata

SEQ ID NO: 40102 - DNA, 101 bp, rice(Oryza sativa)
  misc_feature (71): n=a or g
ccagagttattagttacattacaatgctatggtttttcttgtttgagcctcagataccgacaagaacaggnagctagattgggggaaaagattcaagatta

SEQ ID NO: 40103 - DNA, 101 bp, rice(Oryza sativa)
  misc_feature (71): n=t or c
gtttctgggcatggacttgaatgctctacttctgtcagacctgaaatgccttctggtctaaaggtatcttnttcggtgcgaagaccgaagaagcggaaatt

SEQ ID NO: 40104 - DNA, 101 bp, rice(Oryza sativa)
  misc_feature (71): n=a or g
tgagttagtaggacatctacgagaccactacgaagtaatggatggcacgcttcttcactggttggtgcctnggggagagctagatgatgggcttcgggcat

SEQ ID NO: 40105 - DNA, 101 bp, rice(Oryza sativa)
  misc_feature (71): n=a or g
tgcacagacaaaattatgtctgctgtccaaaattagacctgccatgaaagcacaaccaaaaatgatattgncatcatcaactaggtatagattatcacttg

SEQ ID NO: 40106 - DNA, 101 bp, rice(Oryza sativa)
  misc_feature (71): n=a or g
acattgtggcccaatatcattaactcagcttgtcctatatcccatcatcacgagtgtcaacattatcaaantggcaacaaatacaatgtcaaattagcaat

SEQ ID NO: 40107 - DNA, 101 bp, rice(Oryza sativa)
  misc_feature (71): n=t or c
tgttgagctgagtgtccatgtgttggaagagaagtacaatatggcatatgtagacgtgctagtacatcganttgacaaaggttatgggtgattttttttta

SEQ ID NO: 40108 - DNA, 101 bp, rice(Oryza sativa)
  misc_feature (71): n=t or c
caatggccagggcataattcttgacgaactccgcggggttggagtctccccggtacttagagagcttaggnggtcggaagcctggtgggtacagctcctct

SEQ ID NO: 40109 - DNA, 101 bp, rice(Oryza sativa)
  misc_feature (71): n=t or c
atcagggaatgacttctgctcatacacatgcaccggcacagccgtgccgattcccaagattgttggcttgntgctctcccgccggcacgaggattgttgct

SEQ ID NO: 40110 - DNA, 101 bp, rice(Oryza sativa)
  misc_feature (71): n=t or c
ttcggtatccaaaagttacatgcattgtttagcgccataatgtttgattcctttttctggcgctttcattntttttattgtggactttatttattttaatt

SEQ ID NO: 40111 - DNA, 101 bp, rice(Oryza sativa)
  misc_feature (71): n=t or c
tttttgtattttttatagtacgtcttcagacattagcactgtgctcacccaaatgtgccctctataggtangacagagtgatgagtccactgcttgggaag

SEQ ID NO: 40112 - DNA, 101 bp, rice(Oryza sativa)
  misc_feature (71): n=t or g
gcagtgtacccacaagcaagctagcacactccaccaccatgtccagcagcaagccatcgccgcagcagcancagcagcagcgggcaaacgagtggtggagc

SEQ ID NO: 40113 - DNA, 101 bp, rice(Oryza sativa)
  misc_feature (71): n=t or c
tcccgctcaggggtcgccgcgacgcgatcggcatttcatcaaacaccccactggcatcggagcaatgaganagctaaaactggacccagatccacccacac

SEQ ID NO: 40114 - DNA, 101 bp, rice(Oryza sativa)
  misc_feature (71): n=a or g
tcgtcgaaaagaaccagatgcatcaagagtgtcataatgtgctgatgcattgaacagctcagcagatacancaggttctacgtccacatccaggcttgctc

SEQ ID NO: 40115 - DNA, 101 bp, rice(Oryza sativa)
  misc_feature (71): n=a or g
ttttgggagggtttagagaacaaaagaaaatatcacatgattaagtgggaagcgttgtgcaggcctaaagnatttgggggattaggttttatcaatagcaa

SEQ ID NO: 40116 - DNA, 101 bp, rice(Oryza sativa)
  misc_feature (71): n=a or g
ccctagccacgttgtcgtctctatcaactttcctgtgccacgtagatgccattggggcattgtcttcttcncttttcggggctctgccgacgccacttcat

SEQ ID NO: 40117 - DNA, 101 bp, rice(Oryza sativa)
  misc_feature (71): n=t or c
agcgaatcggctatccatcaaaggggataaagccaaacttgatgagatggaggccggcccgagctctactnaggtcaacttagatcggctcagggctaggg

SEQ ID NO: 40118 - DNA, 101 bp, rice(Oryza sativa)
  misc_feature (71): n=a or g
taaataaaattataagatttggctaacttatttttgaacaaacgggaggaaccaaaaataaacttattctnagatgaaggtaataatgacatttttgacaa

SEQ ID NO: 40119 - DNA, 101 bp, rice(Oryza sativa)
  misc_feature (71): n=a or g
atatatccagttaacacttggcatggaggatggatgggatggacgaagtttgtatctccatccagttctcntggcatgtttaagggtgtgagttgagggag

SEQ ID NO: 40120 - DNA, 101 bp, rice(Oryza sativa)
  misc_feature (71): n=a or g
agaggctgctgtttaggggcaaggaaagggaggataccgatcacctccacatggttggggtgagggacaangacaaggtcctcctcctcgaggaccctgcc

SEQ ID NO: 40121 - DNA, 101 bp, rice(Oryza sativa)
  misc_feature (71): n=a or g
gtcggtccttcttaattaattaattcatcctgtcgatcaattacatacagcacagcagtacacatcctctnctagctaattgtgttgaactgaacgagaca

SEQ ID NO: 40122 - DNA, 101 bp, rice(Oryza sativa)
  misc_feature (71): n=t or c
gagggcctcgcctccatcactagctgcgaaggagaacctccaaatcagctctcgcctctcgccatagcagnatccaacaaaacaattaacagcggcggcgg

SEQ ID NO: 40123 - DNA, 101 bp, rice(Oryza sativa)
  misc_feature (71): n=t or g
aacagctgctgcgtggtggtttccgctcacctttattttcgacaacgaatgatcgatgaaacgtccccccngaatgaacgtactttacgacgtaagcatct

SEQ ID NO: 40124 - DNA, 101 bp, rice(Oryza sativa)
  misc_feature (71): n=a or g
tagacaagcgaatcggagttattcagattggcattgcttgagaagatgggttacctgaagaagtttctggntgagcgcgaggtgatccttgccctttatct

SEQ ID NO: 40125 - DNA, 101 bp, rice(Oryza sativa)
  misc_feature (71): n=t or c
tccatcctgaaacgtagcaccatgcatgcccatgcattcgtacggtctatcttactagtttgatcaaatgnattcgaaattttcatttcagattacttcgt

SEQ ID NO: 40126 - DNA, 101 bp, rice(Oryza sativa)
  misc_feature (71): n=a or g
cttcagcttgttgctgctcggcagtagagtaccaaaattcgggacagcaatgacattttctagggctttcnccattgctgcctgctgctgctgcaagttgt

SEQ ID NO: 40127 - DNA, 101 bp, rice(Oryza sativa)
  misc_feature (71): n=a or g
gcaatttggtcattttgtgtagaaatttgggccccatatcgactcgtcagcacgaatacactattttaatngacacagtgtcctctggcaaataaccaagg

SEQ ID NO: 40128 - DNA, 101 bp, rice(Oryza sativa)
  misc_feature (71): n=a or g
ctcacagatcacgagcagaggtgcatcaagcgaaggaagaagaacgacttgatcaagctgcccagcaaaantccatgccggtacaattggcgaatactgca

SEQ ID NO: 40129 - DNA, 101 bp, rice(Oryza sativa)
  misc_feature (71): n=a or g
atcatctagcagtatggaaaaggttgtgactgtatttgattcctcgcgtactgcacttttcaagcttgatntgaactgtagatagaacggaaataattaat

SEQ ID NO: 40130 - DNA, 101 bp, rice(Oryza sativa)
  misc_feature (71): n=t or c
gcaaatacaagtactaacctgcagagcattcgaaacattgaccatctctaagcaaaagttatccttctctngtgtcattactacttctaacactgcacagc

SEQ ID NO: 40131 - DNA, 101 bp, rice(Oryza sativa)
  misc_feature (71): n=t or g
cggagatgatacagccgaagacgacgtagttgccatcgaaccagggcacgcgggtaaagaactgtgagatnttgttttcggcggagccgttgggtaaccac

SEQ ID NO: 40132 - DNA, 101 bp, rice(Oryza sativa)
  misc_feature (71): n=a or g
cggttaggagtagcggttcagcacccgtatcctccatcggcacatcggcggatgaccgatcacttgactcntgttgttgacggctggattgagagccgtac

SEQ ID NO: 40133 - DNA, 101 bp, rice(Oryza sativa)
  misc_feature (71): n=a or c
tcagggctgagcatgcctaatggaagcatggccctcgaaccccctgaaggaattacttcaatatcacagantagcagcgccatcgagcttgcagaaatggg

SEQ ID NO: 40134 - DNA, 101 bp, rice(Oryza sativa)
  misc_feature (71): n=a or g
cttttgtcgaattgtgtgccacttcgcactctggatggccaccgtgcagagcagcttggaataaactaaangtttaatcttccataagcacgctaaaatcc

SEQ ID NO: 40135 - DNA, 101 bp, rice(Oryza sativa)
  misc_feature (71): n=a or c
tggctggacgtcctcctctgtcatctctttgtacaaggtgattgcatcttgcgcaaagccattcagtgctnggcctctcatcatggagttccaggttatga

SEQ ID NO: 40136 - DNA, 101 bp, rice(Oryza sativa)
  misc_feature (71): n=t or c
ctgagaatacacaactactttaaggttgcgttcaggagtgaggtttccctccctggcacgtaaaacggagnagcttttatctcatgattaattaagtatta

SEQ ID NO: 40137 - DNA, 101 bp, rice(Oryza sativa)
  misc_feature (71): n=t or c
cctccatcttctgttgttgctgcagttgttggtcctcctccatcttcatctttagcttctgaatcaacatnactttgttgttgttcttgtccaccatctat

SEQ ID NO: 40138 - DNA, 101 bp, rice(Oryza sativa)
  misc_feature (71): n=t or c
gtgatgctgattcttttcagtgtcacatggaattggatcttcttccattttgttggtttaagccgattttngttattgtcaggagtgatttcatttgttac

SEQ ID NO: 40139 - DNA, 101 bp, rice(Oryza sativa)
  misc_feature (71): n=t or c
ttttttcgcgaactaagagtttgtaattgtattcttgttaaccttatcatggatttataggtattctatcngtttaatattataagtcgtattgacttctt

SEQ ID NO: 40140 - DNA, 101 bp, rice(Oryza sativa)
  misc_feature (71): n=t or c
acgtccagagtccgcagatgtttgagctccccgatctgcgacgggagctcgctgatccgcgtgttcctcangtccagagtccgcagttgtttcaattcccc

SEQ ID NO: 40141 - DNA, 101 bp, rice(Oryza sativa)
  misc_feature (71): n=a or c
atcatcatctttgcaattcaatttgcaaagaagaaaaatgaagttaatgtggtgaaggcaatggcgtgagnatggcgaggctgacgcagaggaagacgaag

SEQ ID NO: 40142 - DNA, 101 bp, rice(Oryza sativa)
  misc_feature (71): n=t or c
aagaaagtttcatatccgtggagcactttgcttgccacacaaatttcaggagaggggagatttcacaccanacaagttgagtaatcttgtagtttattctt

SEQ ID NO: 40143 - DNA, 101 bp, rice(Oryza sativa)
  misc_feature (71): n=a or g
gaaagaattggaactcgttttcaaagaacgtcagggattaactggaacatgatggatttgctctccctggnccttggcgatttagaataagacatcacaga

SEQ ID NO: 40144 - DNA, 101 bp, rice(Oryza sativa)
  misc_feature (71): n=t or c
tatcccaagtaaagtcgttagagcaaccacaagagaggcacaaattcctagcgaggagaaggtaaaaatgnttaagccaaatatatatgtacagggaattg

SEQ ID NO: 40145 - DNA, 101 bp, rice(Oryza sativa)
  misc_feature (71): n=t or g
aaccttaatggaccgcctactatcaatagacacgttggcacttggcagagatgattgaccagacaggtctngtctctaatggcccttgcatggtagtattt

SEQ ID NO: 40146 - DNA, 101 bp, rice(Oryza sativa)
  misc_feature (71): n=a or g
ttaataaatatcaaaactaaatatgttttcaaattagaatgataaaaaaaaaacctaaagtctacttgctntttattcagaaaatacatgcactatagtac

SEQ ID NO: 40147 - DNA, 101 bp, rice(Oryza sativa)
  misc_feature (71): n=a or g
aatattattttttattcggacacatgagggttttcttgcagtgaatccgattgttcatgtagtccatatgnttgcctcataagtcacagaatgtttttgca

SEQ ID NO: 40148 - DNA, 101 bp, rice(Oryza sativa)
  misc_feature (71): n=t or g
gtatcaatataatggcatgtaatccaggcatcggacttgccactgttttttgagcgaacaatcgcaaggtnctcatcgatgtaacgagcaaccaacgaaga

SEQ ID NO: 40149 - DNA, 101 bp, rice(Oryza sativa)
  misc_feature (71): n=a or g
tgaaatgtgatctacttcaatggaacgtactacaggtacctcccaggttcgaacatgcttgtgtacatgtngcaccgatgtttcttacgcacagatcacaa

SEQ ID NO: 40150 - DNA, 101 bp, rice(Oryza sativa)
  misc_feature (71): n=a or g
ggtagacaggcccaaaacctccttcaccaatgcactccgagaaattgtttgttatcttcaccagctcctcntatgtgaattcatggtcatcggacatcagt

SEQ ID NO: 40151 - DNA, 101 bp, rice(Oryza sativa)
  misc_feature (71): n=t or c
ccaaaaggcccaccttttaaagcttgtacttcccctctatagtttttacaagaccttatttcgtaagaccnatcttgtggtcttgttttcgtgccatttat

SEQ ID NO: 40152 - DNA, 101 bp, rice(Oryza sativa)
  misc_feature (71): n=t or c
acacttcattcagaaaattattcagaagcaagcaaatacattacacttacacagacagggccaagcagcangcagagattcttgtgagcgaacagtagatt

SEQ ID NO: 40153 - DNA, 101 bp, rice(Oryza sativa)
  misc_feature (71): n=a or g
cgccatggcctcgccttctgcttaatgattctagtgagcgacggcttctgacgaaatcgtgttggctcctngagatcgtagggttcgacgtggctaaaaat

SEQ ID NO: 40154 - DNA, 101 bp, rice(Oryza sativa)
  misc_feature (71): n=a or g
gacaaaggaaatgcataccagccgcaggaaaacagggaacaccatctgtaccacttgacaaatcaatatgnctgcgagataccatggcataagctgatgcg

SEQ ID NO: 40155 - DNA, 101 bp, rice(Oryza sativa)
  misc_feature (71): n=a or g
gcactttttggcaaaatttgctaccatggactagctgttggcaacttttttgacaaagttgacaagcacantcacagcacctaacgctttgcggtaatctt

SEQ ID NO: 40156 - DNA, 101 bp, rice(Oryza sativa)
  misc_feature (71): n=a or g
acatgtatcttccctgtctggacaaaattgggagatggtagcatgtaactacgtatgaactggtgagacgnacgcatcgcctgtactgtaatgcgcagtac

SEQ ID NO: 40157 - DNA, 101 bp, rice(Oryza sativa)
  misc_feature (71): n=a or g
attgagccagcggctggaagcgccgttgttgctgacgagcattctaggaagggcggatgagcgcgaggggncgggaacagatgtgcgtccgtgtcagccct

SEQ ID NO: 40158 - DNA, 101 bp, rice(Oryza sativa)
  misc_feature (71): n=t or c
aacatggcaccgggcaatttgaatactgcattaacaccaaagaacgataggtggagaatcaaagtagaagntattaggctatgcgaggcggttaatcctac

SEQ ID NO: 40159 - DNA, 101 bp, rice(Oryza sativa)
  misc_feature (71): n=a or g
acatgttcaacatgttgaaccaactcctactttggcgaacagaaaaaagttgttacgctcctaagtagtcntaacatcctttaaggaccttgtgttacgta

SEQ ID NO: 40160 - DNA, 101 bp, rice(Oryza sativa)
  misc_feature (71): n=t or c
ctgtattgacaaaggttagcttctccatcattgtcgcttgggaccttaacaccagcattagtagaaggtcnggaatgccttcaccgctggaggatggaata

SEQ ID NO: 40161 - DNA, 101 bp, rice(Oryza sativa)
  misc_feature (71): n=t or c
tgaatcatggaccatgtccttgtggtccaactctattttcttcgatgacatggttcaaagctgtagtgtgncacaacctctaagtcctccacaattctgca

SEQ ID NO: 40162 - DNA, 101 bp, rice(Oryza sativa)
  misc_feature (71): n=t or c
tgtgacactgctccatatgcatggaccaggttggtggccacgatgacaaatccatcaagcccacgccgcanggcaacgccatgggcagcaccaactggtgc

SEQ ID NO: 40163 - DNA, 101 bp, rice(Oryza sativa)
  misc_feature (71): n=a or g
ttaagatcaaccgttgcacatcagacaagagacaaccctactgatctcccctcacaacaacctcaccagcnaacccgccgctcccacctccctgcccccgc

SEQ ID NO: 40164 - DNA, 101 bp, rice(Oryza sativa)
  misc_feature (71): n=t or c
tcttctcccggatgacttgtgtgtatgtgcatgctgagactaggccagtacaccccaaaattttacactcnatcacatcgaacgtttgaacatatgtatgc

SEQ ID NO: 40165 - DNA, 101 bp, rice(Oryza sativa)
  misc_feature (71): n=t or g
aaacacttgaaactttacttggaaaaactgattcttcagctcagtaaatcatctggaaaccactattaccnttgcaaaagtgatttcttcctctgcaatta

SEQ ID NO: 40166 - DNA, 101 bp, rice(Oryza sativa)
  misc_feature (71): n=a or g
gataaatctcaaaattaagatgaatgaggaggtatttatagcttagaggggaatctgaaactgagatgagntgatggttttgcaattttcaatttagggcc

SEQ ID NO: 40167 - DNA, 101 bp, rice(Oryza sativa)
  misc_feature (71): n=t or c
gatgtatttatttgtaaggaacttattgaccctttccactttttttcatttgatctagcatcacgacatgnggctacattgtcatacaacttttccaagtg

SEQ ID NO: 40168 - DNA, 101 bp, rice(Oryza sativa)
  misc_feature (71): n=a or g
agggaggtgcccaatgagcccctccgagctcgagctcgccggcattcgtgcaaggaagcaggagacagganagggatagggaggcagtcggagagcccctt

SEQ ID NO: 40169 - DNA, 101 bp, rice(Oryza sativa)
  misc_feature (71): n=t or g
aggcaatatcagttgtaagctctttgccactgtcggaggatgtaatctgaaatgcaagaatgggaaaggancataagtgaaatcatatatatacaagtact

SEQ ID NO: 40170 - DNA, 101 bp, rice(Oryza sativa)
  misc_feature (71): n=a or c
cacacatgcaaaaggaggtaataaggcaccttcagtagacgagtctaactctattatccattcctcctgtncttcaatggaatatttatcatgcaaagcac

SEQ ID NO: 40171 - DNA, 101 bp, rice(Oryza sativa)
  misc_feature (71): n=t or c
taagtttatctaaggtgagccggactcctcctcagagtctgcaactatcatttcacgatcatcttccgagnctgatagagaaaactgctttgagatagatg

SEQ ID NO: 40172 - DNA, 101 bp, rice(Oryza sativa)
  misc_feature (71): n=t or c
tgtttgaatgtccattgaggtattagagaagatcacccaattaataatctaggcatagttaatgtggctgnggataccaggtaaccgaaagttaccatgcc

SEQ ID NO: 40173 - DNA, 101 bp, rice(Oryza sativa)
  misc_feature (71): n=a or g
atgtgtatatgtacttataatcctggcttccttttcatgaacagaagacacatattgctcttgcttttgangtaccaggtggatggtttgaagagaaaact

SEQ ID NO: 40174 - DNA, 101 bp, rice(Oryza sativa)
  misc_feature (71): n=a or g
attgtcatattttgagcaagttagccatacatcttgcctgcatatcaacgtcatatgtccaagtaacatcntggtttcctccctgggctacggttcgagat

SEQ ID NO: 40175 - DNA, 101 bp, rice(Oryza sativa)
  misc_feature (71): n=a or g
agtccaatgcagtagatgcaacgacagtgtccccaacaatagatacaagctcaggtgcaagcccggagtcngagtcagagtcaacgccattgttgtccaat

SEQ ID NO: 40176 - DNA, 101 bp, rice(Oryza sativa)
  misc_feature (71): n=a or g
tatatagctaagacgtgtgctggtggtaactactactctctccatttttaatgtatgacgatgctaatttnttgagatatgtttgatcattcgtcgtattt

SEQ ID NO: 40177 - DNA, 101 bp, rice(Oryza sativa)
  misc_feature (71): n=t or c
cacgacaggcatttttcctctaagattgccaatgactgccgttctcctttatctggcaatgctttgtgtangcttggttgtgagcccttggggaaggtgtt

SEQ ID NO: 40178 - DNA, 101 bp, rice(Oryza sativa)
  misc_feature (71): n=a or g
gtgttttctttgcactctcgctctgcagcctctgctagtaaaactattttctgcatccaactttctcaacnttgaatcgaaatgcactctccgtacttata

SEQ ID NO: 40179 - DNA, 101 bp, rice(Oryza sativa)
  misc_feature (71): n=t or c
cgcacacctcatctctatgaatactttcgaaagactacgacggcacatgttgagattcacgaagttatcangtgcgcctcgctgtcgacgggtacaccgac

SEQ ID NO: 40180 - DNA, 101 bp, rice(Oryza sativa)
  misc_feature (71): n=t or c
caggccactcatgtcatccattgtgttcatgttagagaacgagacagctgctcttcctaccccaaaggagnctgcttatttgacagctagggtctatggaa

SEQ ID NO: 40181 - DNA, 101 bp, rice(Oryza sativa)
  misc_feature (71): n=a or g
gccaactaataatcttgttaatgagcccatcactaacacttccatggtctaggctgtgcagaaaaatgtcnatgcagtcctcaatgtcataggatagctcc

SEQ ID NO: 40182 - DNA, 101 bp, rice(Oryza sativa)
  misc_feature (71): n=a or g
ggggtcgatgtaaacgtttttgccgttgagagatacagaaaaagatacgacctgtatttgagagggagtgnaataagaccttttcctaagagacctaacca

SEQ ID NO: 40183 - DNA, 101 bp, rice(Oryza sativa)
  misc_feature (71): n=t or c
atattctaaacatgttgaccagcagatctagatgcattaaacaacacatatctagacgaattcaggctaanaacaagcagtcaagaagagattgcccaaca

SEQ ID NO: 40184 - DNA, 101 bp, rice(Oryza sativa)
  misc_feature (71): n=t or c
ggcactgttgtacagggattcagtgaaactaatgaggaggagctggaaacacggtcaaatacccaactgtngagattgtcttctatggaatcttttaagaa

SEQ ID NO: 40185 - DNA, 101 bp, rice(Oryza sativa)
  misc_feature (71): n=a or g
gggctcatataagtagacgcggttccaattggatattgaaatgttggacacaaagaatgacgtgtcttcgncatcttccaccttggagcaccatgaattct

SEQ ID NO: 40186 - DNA, 101 bp, rice(Oryza sativa)
  misc_feature (71): n=a or g
tttcaggtcatctggttcctgatttggcttatatgtcttctgtaggtccttaggtcaggcaacaccatcantaacagcttttgcagaaggtcaaggagcag

SEQ ID NO: 40187 - DNA, 101 bp, rice(Oryza sativa)
  misc_feature (71): n=a or g
aataaaaattttaaataagacggataatcaaacatttgacacggaactcacaactgcacttaaaattaaantgcattggcggtccttaatcttgtagggtt

SEQ ID NO: 40188 - DNA, 101 bp, rice(Oryza sativa)
  misc_feature (71): n=t or c
ctaattcatatccttcaaccgtaatagactctctcagcagttttttctaacatgactcgttgacccaatcnatctggctaactcagcatgtggcgccaact

SEQ ID NO: 40189 - DNA, 101 bp, rice(Oryza sativa)
  misc_feature (71): n=a or g
atctgcttcagtgagatatagagaggtagtactaaggtaaaggcatgcaagaatcttgagaagcttcagangaaaattatggaggtgagaagatgaagctt

SEQ ID NO: 40190 - DNA, 101 bp, rice(Oryza sativa)
  misc_feature (71): n=t or c
aagaagataattactgtgcggattggattaagaaattatggggccaacgtgggttatcagttttggatctnctatggcatttcttcctgtgaaatcaaagt

SEQ ID NO: 40191 - DNA, 101 bp, rice(Oryza sativa)
  misc_feature (71): n=t or c
tatgtgactattataaatcatactctttgagggtctgattgcaaaatgcctcctctgaaaatggcgacaangctcccgggcgccctatctccgaaatttaa

SEQ ID NO: 40192 - DNA, 101 bp, rice(Oryza sativa)
  misc_feature (71): n=t or c
taatacctaatcctgtcatgcacacattacatctctgagtttgtgctacagctggctagtaccttcgtccnaaaataattagcatatattaaggtttgaga

SEQ ID NO: 40193 - DNA, 101 bp, rice(Oryza sativa)
  misc_feature (71): n=a or g
actaccgcctctccctcaggatgctggagctatattagctatccacccggagcggatcccgggcagccaangctacaaaatgaacaccatcgaggtgctga

SEQ ID NO: 40194 - DNA, 101 bp, rice(Oryza sativa)
  misc_feature (71): n=a or g
taaggacccaaatcctgcaaaggaccctgttgaggagaccctcgtgaatgacacggccaaagataagtctnaagtgcctagagtactcagaagccacgact

SEQ ID NO: 40195 - DNA, 101 bp, rice(Oryza sativa)
  misc_feature (71): n=t or c
ctgggaggagcaaaggagggggcaattggagctccgctcggttccaattcagccccaattttgagcccccnggctgcggggttcggccaggttagctcctg

SEQ ID NO: 40196 - DNA, 101 bp, rice(Oryza sativa)
  misc_feature (71): n=a or g
tgagtggacagagagtgaaagcgagcgaataaataagcgtcaactgctcacacgctccaaggtgaaaactntctatgctaccatatctcctattagttcca

SEQ ID NO: 40197 - DNA, 101 bp, rice(Oryza sativa)
  misc_feature (71): n=t or c
ccattttaaattttataataattaatacttaattagtgggacaatagccattttgctccatgaagtttcgntctgagatcattttagtccatgacctttca

SEQ ID NO: 40198 - DNA, 101 bp, rice(Oryza sativa)
  misc_feature (71): n=a or g
ttgttattataaaacatggcttggatcaaaggagtggcagcattggcgacttcatctcgcgccccttcaancttcttaatcttattaatcaagacgtcaaa

SEQ ID NO: 40199 - DNA, 101 bp, rice(Oryza sativa)
  misc_feature (71): n=a or g
taatgtatgttctctgttagaaatcttgcatactgagccttgtccaaggaaaggagctttgttgttccaanaccagcaatctttgccggaaatgtactagt

SEQ ID NO: 40200 - DNA, 101 bp, rice(Oryza sativa)
  misc_feature (71): n=t or g
cgtctcatttctgtgactctcataccaccaacaccttcttttgagtcaatggcgcaagccgattggggtantccaggcaccaacctccataaccaacaacc

SEQ ID NO: 40201 - DNA, 101 bp, rice(Oryza sativa)
  misc_feature (71): n=a or g
gtcagcatagcggcaacgctggtgaggctctcgtggttggtcaccagggcgcacaccatggccatgatctngctggtgatctgccacttggcaagctccga

SEQ ID NO: 40202 - DNA, 101 bp, rice(Oryza sativa)
  misc_feature (71): n=t or c
catcatacatgcacttggggtactatgtaacacatggaagaacatgtcttttgactaccagacatcactgntgtatgcataggccaaaataacacaatgat

SEQ ID NO: 40203 - DNA, 101 bp, rice(Oryza sativa)
  misc_feature (71): n=t or c
gattccaaacatgttactttagcaaagatgcatttctcaaatagtgaatacatagcaggcatgtatttctngcataaaggcatgctaccccaatccatcaa

SEQ ID NO: 40204 - DNA, 101 bp, rice(Oryza sativa)
  misc_feature (71): n=t or g
aaagctcaaaacattaatgatccaaaaaatggaaccctgaattcctattcactttgtctacttgttctctntcattttcaggtgttatttcttactttaca

SEQ ID NO: 40205 - DNA, 101 bp, rice(Oryza sativa)
  misc_feature (71): n=t or c
agtacagtacgtagctgcagggagatggatcgatgatgagcttagctagccatgcacgtggcggcatatanagttagggatcgagagaaattaaagcggcc

SEQ ID NO: 40206 - DNA, 101 bp, rice(Oryza sativa)
  misc_feature (71): n=a or g
gttttgtcaggtttcgtttattgtgccatttgccaacatgtacttttgtcagacattgtacagtgcttttnttaatttgtgtttctactatgcgaaagaaa

SEQ ID NO: 40207 - DNA, 101 bp, rice(Oryza sativa)
  misc_feature (71): n=a or g
atgttaacaatcttgtttatgtgcattttacatatcactgtgccgatcgagctttgcatgaaagcttgtgngggtttgtatttaacatacaacaattggca

SEQ ID NO: 40208 - DNA, 101 bp, rice(Oryza sativa)
  misc_feature (71): n=a or c
gggcaactgaaataccacaaatcctagttgaacaagtcctgggaagttcatagttctggaatttctcatangccgtccaaccgtaacatccactccaacct

SEQ ID NO: 40209 - DNA, 101 bp, rice(Oryza sativa)
  misc_feature (71): n=a or g
cagccattggtctgaccaaaataccccttcggtgataggcgccagcaatgggcagcgaccactaccaaacnttggggctgcggcgggacgccaccacggcc

SEQ ID NO: 40210 - DNA, 101 bp, rice(Oryza sativa)
  misc_feature (71): n=a or g
accttgcccaacaccacatttggatcattaggaatgtagagagggagcaaatcagtgttggcaggaatttnaagattatgcaggtcatcaaggttgaacaa

SEQ ID NO: 40211 - DNA, 101 bp, rice(Oryza sativa)
  misc_feature (71): n=t or c
tggcgatacggtcagccatgccttcctcgattgtgatagggttttatcaacgtcgacaacgttccacaggncattggtggcgcgaaagagctccggtgccg

SEQ ID NO: 40212 - DNA, 101 bp, rice(Oryza sativa)
  misc_feature (71): n=t or g
agcgagagaaactttgctagttaatcaagtgattagccgctcatggttatcctccaaaccgtggctaattncacggtttggcacctaaacccatcaaaagc

SEQ ID NO: 40213 - DNA, 101 bp, rice(Oryza sativa)
  misc_feature (71): n=t or g
tgcgcaggacaagaagaagaacaaggggagatggagatcacctgaggagcctccgggcctgagggaatccncgcagcatcgcgccgtcgaccggcgagagg

SEQ ID NO: 40214 - DNA, 101 bp, rice(Oryza sativa)
  misc_feature (71): n=t or c
cgtatgtgcgcgcaaacagcactcattataagttcataacagtgacggatgcaggtgatcaatcgatggcngatgtcgttgtactatatggtatagtagca

SEQ ID NO: 40215 - DNA, 101 bp, rice(Oryza sativa)
  misc_feature (71): n=t or c
tcaattagctggttctttacatgttcgtcatctaaaaagaaattaacttacagactgtacacacagaaccnctaatacaagtcggcactatagacgctgga

SEQ ID NO: 40216 - DNA, 101 bp, rice(Oryza sativa)
  misc_feature (71): n=t or c
aatgtaagtatcgatgggaccatttgccatatcattgttaattcaatcttaccttgtcaccggagcaagangctccgcgtaacatgaagttaaaattttca

SEQ ID NO: 40217 - DNA, 101 bp, rice(Oryza sativa)
  misc_feature (71): n=t or c
aatatggtttctacaattgtagggctcgaaaatggaagcagttgtaagcggtgagctggctacaaggtttnaaaatattttgattgtaggacggaactaca

SEQ ID NO: 40218 - DNA, 101 bp, rice(Oryza sativa)
  misc_feature (71): n=t or c
tactcctttttagagaaggccccacctcctctgccctagtacatttcttttatcagctgctccttaaagtntttcaagattaatactaacacttttataga

SEQ ID NO: 40219 - DNA, 101 bp, rice(Oryza sativa)
  misc_feature (71): n=a or g
aaaaatatctcttatgttgtacatagtctcttcctcaattcttaaaactcccaattctgaatcgtctggtntgctgcaagtagggatggcaatggagacct

SEQ ID NO: 40220 - DNA, 101 bp, rice(Oryza sativa)
  misc_feature (71): n=t or c
ctatcatatactctaacatctcaaattgggtgatatatattgtgatgtcttcacgcatgagttggttttgntgcttggaatatattgtactcctgtttttt

SEQ ID NO: 40221 - DNA, 101 bp, rice(Oryza sativa)
  misc_feature (71): n=t or c
gggaaacaaattggtttcaattatagctcctgttgcaaaagtgtcaagaagagaaataaatgatgtactcnctccatttcataatataaaactttctagta

SEQ ID NO: 40222 - DNA, 101 bp, rice(Oryza sativa)
  misc_feature (71): n=t or c
cagtgcattgtggcaggaattattcagacttgctaatgtgaagcttaatatgagttcctcataccatcctnaaactgatggacaacctaagaggctgaatc

SEQ ID NO: 40223 - DNA, 101 bp, rice(Oryza sativa)
  misc_feature (71): n=t or c
caggtgaaagagaaaacacagcaggacacgggattacaggaagtcacccaagagcattaaaccctaatctngcgatacaatgttgcgacctgagcgctcta

SEQ ID NO: 40224 - DNA, 101 bp, rice(Oryza sativa)
  misc_feature (71): n=t or c
agctacggtggtcgtaattgacgacggcgttggtgcgagcgaaggtggttctcggcatgctaaggcatgtngagctccggctcgtttctatgcgaatgggt

SEQ ID NO: 40225 - DNA, 101 bp, rice(Oryza sativa)
  misc_feature (71): n=t or c
ggccagtatattatctcctcatccaggaacctcatgatgttggagtgatctgcctgattcagatttgaccncatccaagtcacaatgtccacaccatctcc

SEQ ID NO: 40226 - DNA, 101 bp, rice(Oryza sativa)
  misc_feature (71): n=a or g
ctctttgtttgagtagggatcggagttttgttctccgaccaacaccccagtttgcgtgggctttgtaatantggcgcccttcgatcatctctgatcgagcg

SEQ ID NO: 40227 - DNA, 101 bp, rice(Oryza sativa)
  misc_feature (71): n=t or c
agaagcggggtagctattatatccttgtgttgcctttggtggatcctcaatcatttaaagcatatgaaagnctcttgaaaaggtcggactgcgggagttct

SEQ ID NO: 40228 - DNA, 101 bp, rice(Oryza sativa)
  misc_feature (71): n=a or g
ctttcctctgccctgcttgactttattactctttgtgcacgttaatagcatgatttgaaaggggtatattngattataaacacacactttaaaaatattta

SEQ ID NO: 40229 - DNA, 101 bp, rice(Oryza sativa)
  misc_feature (71): n=a or g
gagatctcctcttctgttaaatcgctgcataaagcctcattcatctgtgctgaaactttcgactggaaganacttgacactatactgtgatccagactagg

SEQ ID NO: 40230 - DNA, 101 bp, rice(Oryza sativa)
  misc_feature (71): n=a or g
ctcggaagttcgcagggcgagtccggttaatggcccgtcacaagcagctgtcacatacggcggagtatgcnacctccggcatcaccagacccgcgtcggct

SEQ ID NO: 40231 - DNA, 101 bp, rice(Oryza sativa)
  misc_feature (71): n=t or c
aactgcttccttctcaggcaatcctggatctcgactaaatccccttgcaccatcctggcatttcgaccgtngacaggtgtggacttcgggagcttcagtgc

SEQ ID NO: 40232 - DNA, 101 bp, rice(Oryza sativa)
  misc_feature (71): n=t or g
aaaacagagaaaggagaactttttgccataaatggctcaggagtaccagacaatgccttcttctgctcacnacaagaggtactcaggactgtcgaatggtg

SEQ ID NO: 40233 - DNA, 101 bp, rice(Oryza sativa)
  misc_feature (71): n=t or c
ccatgcaagcaggcaccgaacaggggcggagtcagaaagtagcatgagtaggggccaaggatctaccgctnaggtagactaattaaggaagtaaaaagtgt

SEQ ID NO: 40234 - DNA, 101 bp, rice(Oryza sativa)
  misc_feature (71): n=a or g
tcgcaatcaccatgggagcttgaaaagatgccgctacctaagagaaccatgggagcacaaatcgttgagtngtactccctccgtctcataataatataagg

SEQ ID NO: 40235 - DNA, 101 bp, rice(Oryza sativa)
  misc_feature (71): n=t or g
tcagctcggggattccctcgtagagcggcacactggcagtctggtacacggacacgcctttgctatttttngaaagcaatgggcgggtcggcaacccgtgc

SEQ ID NO: 40236 - DNA, 101 bp, rice(Oryza sativa)
  misc_feature (71): n=a or g
atgcatgtgtgtatcatacgtgggaacagacattaattatgcataacatgtttattgataactattatatnaattaactattaaattgactatagttgatt

SEQ ID NO: 40237 - DNA, 101 bp, rice(Oryza sativa)
  misc_feature (71): n=a or g
agtttgtttttgtctgaatttgtcaggatttgtacgtgaagagtctgaaactgttggattttgttggaagntagtggtgatcgatgatggagtcggcgagg

SEQ ID NO: 40238 - DNA, 101 bp, rice(Oryza sativa)
  misc_feature (71): n=t or c
agaagcatcaaatgatttcttctggtatggttgacatgatcagcaacagattactctcctaccatgagctngtccgtgctactgataatttcagttatgat

SEQ ID NO: 40239 - DNA, 101 bp, rice(Oryza sativa)
  misc_feature (71): n=t or g
gtcagacgagatgccgtagcttgttaaataagtgtctggttgatcactgtaactatgatccgaaaccatgntagcgacaccacaccggtcgtgctgctcta

SEQ ID NO: 40240 - DNA, 101 bp, rice(Oryza sativa)
  misc_feature (71): n=t or c
aacagtacaacttgaaatctcccgaaacaatctgatttgttcaagtaaatggagacaatgattactagcantatttgacagctttcgtcatacttatccat

SEQ ID NO: 40241 - DNA, 101 bp, rice(Oryza sativa)
  misc_feature (71): n=t or c
gttgtcaatcatttcaatttcaccttcagtatctttatgcttatgaagtgtctcctggtaatcaagattgncaatttgataaatatttttcctcgcggtca

SEQ ID NO: 40242 - DNA, 101 bp, rice(Oryza sativa)
  misc_feature (71): n=a or c
ccttctggtaactcctttccaaacatatcgaatggtgcaccgctggcaactgcaaacagatcactgcaacntcttgagtcgagcaatcagcaacaccttag

SEQ ID NO: 40243 - DNA, 101 bp, rice(Oryza sativa)
  misc_feature (71): n=t or c
tgatgagggagtggctatgcacggttgcttgctttgctttgctttgagtgatgtccagcttggttaattgntgtgattaaccagttgatgagttgcttaaa

SEQ ID NO: 40244 - DNA, 101 bp, rice(Oryza sativa)
  misc_feature (71): n=t or c
attcttttgctttaatcaaaactattggtgactggtgagcatatctgtctcaccgaatcctatatatctangctatagttcaacaaatgatttcactcatc

SEQ ID NO: 40245 - DNA, 101 bp, rice(Oryza sativa)
  misc_feature (71): n=t or c
aattctgattcctaatgtttcggtaataactttgacatggttgccaatgataatcaggtgcacatttcganggtgggggagaagaacatgaggatttcatg

SEQ ID NO: 40246 - DNA, 101 bp, rice(Oryza sativa)
  misc_feature (71): n=t or g
gctatccgtcctttggggttttactttgaccttcttgtgggttcgttccgttcttgatctaccccatggantaatgctccatccttggtctccttgtggac

SEQ ID NO: 40247 - DNA, 101 bp, rice(Oryza sativa)
  misc_feature (71): n=t or c
caaaatatggatgaaattaaatgaggttccagaggatggcccggtgctgcaggtgcttgcggaggcgatancagtcgtgggcgaagtccggcacgaaggcg

SEQ ID NO: 40248 - DNA, 101 bp, rice(Oryza sativa)
  misc_feature (71): n=t or g
gatgccatccaatctatgtatatgtgtttcccagttgggatccatagcatggatatccttttatccaaatntctaacttattctttttatttattggcaga

SEQ ID NO: 40249 - DNA, 101 bp, rice(Oryza sativa)
  misc_feature (71): n=a or g
ccaggaccgtaaggcagcagcagttgcacgcagcttgaaatgaaggctgctgagtgcattggagccagccngcgctgcctcccacgcctgacagaccacat

SEQ ID NO: 40250 - DNA, 101 bp, rice(Oryza sativa)
  misc_feature (71): n=a or g
tccttacattttttctttggattttcatggcacatattttcgctaatggcgaacaagtttatgatcccctntctttccatcttcctatttcatttgtttgt

SEQ ID NO: 40251 - DNA, 101 bp, rice(Oryza sativa)
  misc_feature (71): n=t or c
agaggtggctttgcctgcatgattcggtttgggcacttgcacgtttgtagctacaggttttctattttccncttctctttgctctcttttctttcactcat

SEQ ID NO: 40252 - DNA, 101 bp, rice(Oryza sativa)
  misc_feature (71): n=a or g
tgatcttgcgcttcgccttcggcttcgcacttcgcccttggcttcgctcgggatattgacgatgtgtttcngcgggctcagtcaaaggccctcgtgtcatt

SEQ ID NO: 40253 - DNA, 101 bp, rice(Oryza sativa)
  misc_feature (71): n=t or c
tcttaaaaggaaaagtgctggctatatatccagccagtcatccgagttcccacttctgctaacttcaaacntcttgaccgagatattttaatatttaccac

SEQ ID NO: 40254 - DNA, 101 bp, rice(Oryza sativa)
  misc_feature (71): n=a or g
aaaatttatcgataaatgtatagatagtctctatagggtaatatcacgcaagaaatatcaagtttgcacantttagatattcttttttacaattcaaaaca

SEQ ID NO: 40255 - DNA, 101 bp, rice(Oryza sativa)
  misc_feature (71): n=a or g
cgatttggcacgttttatgcaaatcccgtacagaagaaacttgatacgaggaatggtgtaaagttcagacnatttaagtataattgaacaaatggaacgag

SEQ ID NO: 40256 - DNA, 101 bp, rice(Oryza sativa)
  misc_feature (71): n=t or c
aatagtaacaattttctttacaagcgcaccataataatatatgcacagcacaaatgttatatgaaccttgnccttatgagttatgagttcaaactaaataa

SEQ ID NO: 40257 - DNA, 101 bp, rice(Oryza sativa)
  misc_feature (71): n=t or c
tttcgtggattagctgtcgcttttaatgggttcgatgttttggcaggcggagctcttaaggtaacgcttgngaaaatcattttttccaggcgaaccactta

SEQ ID NO: 40258 - DNA, 101 bp, rice(Oryza sativa)
  misc_feature (71): n=a or g
ttgcagggtaggcaaagtggatgatgctatgtcccaattcgacaggctcatctctgaaggactaactcctnatggtgttgtttttagaaccttaattcatg

SEQ ID NO: 40259 - DNA, 101 bp, rice(Oryza sativa)
  misc_feature (71): n=t or c
agcctttcatgacctaattaacagaattgtcttttttcccgtgggtcaggtcattgtatgaaatgagatgngaaatttgaacataagtaatctgtttgatc

SEQ ID NO: 40260 - DNA, 101 bp, rice(Oryza sativa)
  misc_feature (71): n=t or c
gtcgttcgcgagggtcggggacgacaagcagtggcactggatcaccacctcctcctactactggtctcccnactccgacatcgcctaccgcgacggcgcct

SEQ ID NO: 40261 - DNA, 101 bp, rice(Oryza sativa)
  misc_feature (71): n=a or g
tacttcatgcttcttatactgttatgcagcgatcaactttttaaaccaaagcacaatggcagtaccaggcnctagcatcctagagcataataaggtgaggt

SEQ ID NO: 40262 - DNA, 101 bp, rice(Oryza sativa)
  misc_feature (71): n=t or g
tttgaataattactcctacaatgcaacacaaagaaatagaagactccttccgttttcaaatttctcgtacnagacaatattcattttcaaacattgatcac

SEQ ID NO: 40263 - DNA, 101 bp, rice(Oryza sativa)
  misc_feature (71): n=t or g
tttttcttcttcttatcgttcaaaatgatgttctttttttttatgttatggattttttttcatgctgttgngtggtgaggggactgttgcatctgttgggg

SEQ ID NO: 40264 - DNA, 101 bp, rice(Oryza sativa)
  misc_feature (71): n=a or g
tctccgagtgtcttccccttcccaaaagaaagaaaatctcccgctccttgcgccgccaacgccaagacgantggcggctgaacaggggaggggcggcgatc

SEQ ID NO: 40265 - DNA, 101 bp, rice(Oryza sativa)
  misc_feature (71): n=a or g
agataatgccaaagacgcgcatccggcgcacgctctacgaatgcacacacaaatccttgcgtgttctaacncatgcatcttagctctacctaaaccatatg

SEQ ID NO: 40266 - DNA, 101 bp, rice(Oryza sativa)
  misc_feature (71): n=t or c
aggaaaccaatcgagaagacgaatgtgacgtgtgggcccaccactgatgacatccaccggtgatcacttangggacacggatcggaacagggaagctgcat

SEQ ID NO: 40267 - DNA, 101 bp, rice(Oryza sativa)
  misc_feature (71): n=a or g
agaagtcaacaaggaccgggtggccatcaggcaatagtagtagcaatccttttctctccacgctaaaattnaaagtttaaagaaattaaaatgatgtgaca

SEQ ID NO: 40268 - DNA, 101 bp, rice(Oryza sativa)
  misc_feature (71): n=t or c
gggcataacttgggccaaaaagcagagagccaagatgcaatttctcaaatttctgctgcaccatctcttcngggcgccacccaattgcagaatactacatc

SEQ ID NO: 40269 - DNA, 101 bp, rice(Oryza sativa)
  misc_feature (71): n=t or g
catagaacactggtcgattaagccggtcatcaatcgaagcacacgagacagagtaaataagaacagaacantggactctctaactacttgcaacaacagaa

SEQ ID NO: 40270 - DNA, 101 bp, rice(Oryza sativa)
  misc_feature (71): n=a or g
cgactaaggccattcacagtgcaagcagccaagcacccactgtgagttaccacgagatgacagctagaatnaagaccctctcttcacagtgcaagcactgc

SEQ ID NO: 40271 - DNA, 101 bp, rice(Oryza sativa)
  misc_feature (71): n=a or g
aaccccatccagctcgcccccatgaacacccagtacctgaccattacacagccgcgtgccgttcaattcgntcgttgtcgtcgagcccttccgatgcatgt

SEQ ID NO: 40272 - DNA, 101 bp, rice(Oryza sativa)
  misc_feature (71): n=a or g
tctctccctcctttctctcttctctcttctccggcgaggtgagtggcagtgcgaccaccagagccgcagcngcacagggaaccactcctcacggtgccacc

SEQ ID NO: 40273 - DNA, 101 bp, rice(Oryza sativa)
  misc_feature (71): n=a or g
ctccctaccacacgcagcttgtgcaaagtcacactgaatgcacttctcagtccaaagaagcactaatcacnaatcgatttcatatcctgaagactgagaat

SEQ ID NO: 40274 - DNA, 101 bp, rice(Oryza sativa)
  misc_feature (71): n=a or g
caagcaacagaggaaagcctaggattcgacaagtttcctgttgttggcatgggacacatgtacaggagaanaacctctgtttcgtacagtacggggttgtc

SEQ ID NO: 40275 - DNA, 101 bp, rice(Oryza sativa)
  misc_feature (71): n=a or g
ggagcaaccccatgagcaagaagaagcacagtagacagtagacactactcagagagagaggaaagagccangaacggcccgtacggcggcgttgtcggcgg

SEQ ID NO: 40276 - DNA, 101 bp, rice(Oryza sativa)
  misc_feature (71): n=t or g
aagagctcgcaacagagtgcttttgccacatcctggaggtcccaatagaagagtcaatctacaaacatggnagcatgtcggatcaccttaactggtaacac

SEQ ID NO: 40277 - DNA, 101 bp, rice(Oryza sativa)
  misc_feature (71): n=a or g
ccgaagggattacctcctaggagagaatgtgatcacactattaatctaaaagcaggatcagaaccacctantctcagaccatatagggtcccacattacca

SEQ ID NO: 40278 - DNA, 101 bp, rice(Oryza sativa)
  misc_feature (71): n=a or g
ccccggtcgccgattcccctcagcggtcgtcctcctgggctcaccgtcgtccatgccggagaagcttcctngccgctgattcccttgacgacggcagcgag

SEQ ID NO: 40279 - DNA, 101 bp, rice(Oryza sativa)
  misc_feature (71): n=a or c
ctctaagaaaatattgaagattaagaaagaccgcctctgtgatgatacagcatcaatgtattaatttcaanctgttaagattaataagcagaaaaatgtat

SEQ ID NO: 40280 - DNA, 101 bp, rice(Oryza sativa)
  misc_feature (71): n=t or c
taaccttttattttgcttcaaattaatcgcaggacacctctacccccaactctgcagtccaaaattacaanggagaattacagcatgaagaaaactaataa

SEQ ID NO: 40281 - DNA, 101 bp, rice(Oryza sativa)
  misc_feature (71): n=a or g
tagcaaattttgccgaaaatctattagcagtacgtacggcatgtcattgccattgatccacaaaaccatantactagcacgatattactacgggtagcaac

SEQ ID NO: 40282 - DNA, 101 bp, rice(Oryza sativa)
  misc_feature (71): n=a or g
ggttgctctgcctcttcccgctaattgtagttgtgtttaaccgtcgtagtagtctcttccttttttcttantttttttttctctttttccttagcataagt

SEQ ID NO: 40283 - DNA, 101 bp, rice(Oryza sativa)
  misc_feature (71): n=a or g
gtcacccatgtgagcaacaatgtaatggttacgttatgtagcatctaagggttcagttggacagacagagngaatatagtactacctctaacccaaaatat

SEQ ID NO: 40284 - DNA, 101 bp, rice(Oryza sativa)
  misc_feature (71): n=t or c
aactcaacaagcaataaaaaaggggaatgctaaatagttgtcgacgtcgcatgatttttgatagctaaatnattgatgtttcaatatatttagaaccgttg

SEQ ID NO: 40285 - DNA, 101 bp, rice(Oryza sativa)
  misc_feature (71): n=t or g
agttttttgattgtgctaataatttgattctcatcccatgcgtcggtctggacatattcttgattgcaganttgggataacaaagatttcaaaatgcttct

SEQ ID NO: 40286 - DNA, 101 bp, rice(Oryza sativa)
  misc_feature (71): n=a or g
ggcagcggcttcagcgttgagttggcgttgagaagtaagaaaagtagtggatgctctaaaaagacagtganagaaaacaatcatgttatgatagtggatcc

SEQ ID NO: 40287 - DNA, 101 bp, rice(Oryza sativa)
  misc_feature (71): n=a or g
agagttccatttctggaaagcatgccgtcattaattgcagcatttgtcagaccccaccgagatagtgatgncttgtgtagtaatacttactctggtaactg

SEQ ID NO: 40288 - DNA, 101 bp, rice(Oryza sativa)
  misc_feature (71): n=t or c
tatatagttacgtgggttttgattaaacccagcccacaaaactaactaaacgcagagattaaaccaagccnacagaattaaaactaataaaggcatatcac

SEQ ID NO: 40289 - DNA, 101 bp, rice(Oryza sativa)
  misc_feature (71): n=t or c
tagaatagtttattccctatggactacttttgtagtacattatggatgccctaagatgctactcattcgtnccacaatataagggattttgagtttttgct

SEQ ID NO: 40290 - DNA, 101 bp, rice(Oryza sativa)
  misc_feature (71): n=a or c
gcccatattcaaccattccggccgattagggttttacaccacctctctccgtgctcctcctctccacactngcctcccctataaaagtcctggacgccgca

SEQ ID NO: 40291 - DNA, 101 bp, rice(Oryza sativa)
  misc_feature (71): n=a or g
ataaccatatatggacggttacagtgaaaatggtgtcgaaactgtatacctgacataatagtagggaaaantggaggacttctgaggcacagatcatcaca

SEQ ID NO: 40292 - DNA, 101 bp, rice(Oryza sativa)
  misc_feature (71): n=a or g
ccataaaggaagtatacggctaagagcgaaagcaaaaactcactttcaaccccggcggggagagcaaggcngggaagcccgaaaacttcttcgccctcgtt

SEQ ID NO: 40293 - DNA, 101 bp, rice(Oryza sativa)
  misc_feature (71): n=a or g
ccttagagggcattagagaagaaaatgaagtgccaaatacactgcgctacatagaaagagcacaagaaatngagcgagggtactctattgtactgcatgtt

SEQ ID NO: 40294 - DNA, 101 bp, rice(Oryza sativa)
  misc_feature (71): n=a or g
tttagccagatgcacaaatttggcaaaactaaacctttctagaaattaccttagtggaagcattccatcanaactattttccatttcgacactttcagaag

SEQ ID NO: 40295 - DNA, 101 bp, rice(Oryza sativa)
  misc_feature (71): n=a or g
acatctattttcatattctacaataattttcaagttttcattataataggtggaccctgtgtgttgatgcnggagtttagtatgataacactgagtaaaaa

SEQ ID NO: 40296 - DNA, 101 bp, rice(Oryza sativa)
  misc_feature (71): n=t or c
atcataataactaaaaccccaccaccgggggtgaggatatctaccataatgtcacgttctaccataaaatngaaatcgggtataaagtgttactccctccc

SEQ ID NO: 40297 - DNA, 101 bp, rice(Oryza sativa)
  misc_feature (71): n=t or c
aggagtactgtttttcttctttttcgctgggtccacagttttttttagaacgggtccacatgatttgctanattgatgctacagtaaacatccgttaaaca

SEQ ID NO: 40298 - DNA, 101 bp, rice(Oryza sativa)
  misc_feature (71): n=a or g
gcagataatcgagaagctctcagtgaaggccccatcagctgaatcaaagctgaaggttctgaaagctattnctcaagagtatggccttgaatgggactcat

SEQ ID NO: 40299 - DNA, 101 bp, rice(Oryza sativa)
  misc_feature (71): n=t or c
atcctacatctagtgagcgaaacaaaaagggaaatactcacagtgatatacagcgtctccaagcatggganacatttgaggaaatcaacaactgcatccag

SEQ ID NO: 40300 - DNA, 101 bp, rice(Oryza sativa)
  misc_feature (71): n=t or g
ctcccgccgctcttcacacggctaacgcctgcttggctgcgagacaaaccgaaccttttgctcttgcaccncctgctagcgaactacgtgtgctcccgtga

SEQ ID NO: 40301 - DNA, 101 bp, rice(Oryza sativa)
  misc_feature (71): n=t or c
acacacacacaaaaaaaggtacaggaaaagtggtggggacaaaattaagtgaagtgcttgtaacttgtganatttgaggaagaagcaagccatcagccatg

SEQ ID NO: 40302 - DNA, 101 bp, rice(Oryza sativa)
  misc_feature (71): n=a or g
agataggagcttcgaccgagaccagatgaaaaccatgcggtatggatatgaggttggcggtatgtggtganacccttctaccagactagctgaaaccatgc

SEQ ID NO: 40303 - DNA, 101 bp, rice(Oryza sativa)
  misc_feature (71): n=t or c
atatatcaaatccttaatttgtcctatactgactctaatgatcagcaatctgtgcacctgacgatcgacangcgttttctgaatgaacgaaaatatgtatt

SEQ ID NO: 40304 - DNA, 101 bp, rice(Oryza sativa)
  misc_feature (71): n=a or g
cgtgacgtcgtgtcaattgttaccagcacgtactcgtggacatccatggagtttgcaattgtaatcggccncggcaaacgcagaattctacaacgcatcaa

SEQ ID NO: 40305 - DNA, 101 bp, rice(Oryza sativa)
  misc_feature (71): n=t or c
aagaacaaaattataattgctgagctgaacaatgaattggacaccaacagaactatgctagataatgaggntgaagctcataagaaattatcagagattct

SEQ ID NO: 40306 - DNA, 101 bp, rice(Oryza sativa)
  misc_feature (71): n=t or c
ctacaaacataatcagtttattcctactcctctagtgatcgtgattttcttccgcgccattgcccctgtanaggaactacagcgagcgcacacacgaggaa

SEQ ID NO: 40307 - DNA, 101 bp, rice(Oryza sativa)
  misc_feature (71): n=t or c
gcgtggaagatgaagtgtgaaacatatttccgggttagtggagttagtccagaagtttgggtaggtgtcgntgcgttgcaattcataggtggggcgcttac

SEQ ID NO: 40308 - DNA, 101 bp, rice(Oryza sativa)
  misc_feature (71): n=t or c
ttttaccttaaagaaatgcagccagaagggattcctgaaatgcaaaggtctaaccttgtttcctgcataanacaggtgtccttcctttccaaattatctcg

SEQ ID NO: 40309 - DNA, 101 bp, rice(Oryza sativa)
  misc_feature (71): n=t or g
tacacaacacctcggacaattcatcactatatttcaaaacaaaccaaaccaaacctgctgcttttgctttngttaattagctgagagagaaattaagagag

SEQ ID NO: 40310 - DNA, 101 bp, rice(Oryza sativa)
  misc_feature (71): n=t or c
ctggcgggttaagttgttatcaattaaccaaatgatgtaagagcatgcccaacagtctcctaatatttaantcccaaaaattctaaattgggaatatgaaa

SEQ ID NO: 40311 - DNA, 101 bp, rice(Oryza sativa)
  misc_feature (71): n=t or c
gttctcacccatgtaatcaatggttacatgccgaagggagtggaggttctccaaacctaaatcatttaagncacccctccttagtctggtcccaatacgaa

SEQ ID NO: 40312 - DNA, 101 bp, rice(Oryza sativa)
  misc_feature (71): n=t or c
tagaagtcgttgtaaaagctttgaaatggcttgaaattgacatggacgtggatgaggttctctttgacagnacacacatttcattttcgaactgaaaccta

SEQ ID NO: 40313 - DNA, 101 bp, rice(Oryza sativa)
  misc_feature (71): n=t or c
aagaggcagataggagcctaggaaggttggacttggtgtggtacctttattgatgcctcatctaaagaatntctttgggaagggagctttaacctctcttc

SEQ ID NO: 40314 - DNA, 101 bp, rice(Oryza sativa)
  misc_feature (71): n=a or g
tctcccatatctcctatttctgtgtggaacagcacgcaatattctaatttctacacacaacaaacctttcncatgtcttgtatttctatgtggacaacacg

SEQ ID NO: 40315 - DNA, 101 bp, rice(Oryza sativa)
  misc_feature (71): n=t or c
ctgcttctaggatttggcacccaattcacactactttcagaatatatgtcacaggagtgcgaattttcttngttccatgccactccgttccctagcgtctg

SEQ ID NO: 40316 - DNA, 101 bp, rice(Oryza sativa)
  misc_feature (71): n=a or g
attcacaaaaggacataacatgtgtgcatcatgaggaaaagtatgttggactctggtacacgaaatttganttcttcttgagcagtccattcattggctgg

SEQ ID NO: 40317 - DNA, 101 bp, rice(Oryza sativa)
  misc_feature (71): n=t or g
ggaatctcacccgaaatagaattgttcgatgcattcaaagaaaccagttgaagagagccaatctctgatgntaggtgcccagagaggcggttgccatcgag

SEQ ID NO: 40318 - DNA, 101 bp, rice(Oryza sativa)
  misc_feature (71): n=a or c
aagcaaaatcaagccactatttatggtctaaagtactgcaccatctgtttacctttccacgctgagcccangagcattggacaaaaaggggaaaaaaaatc

SEQ ID NO: 40319 - DNA, 101 bp, rice(Oryza sativa)
  misc_feature (71): n=t or c
cgaatttaaaaacgactcaaatacgcatatgtatttcgacaaaagatccttctgtattttgtaaagcgaangaacttaaaaaccaactcatacacggatga

SEQ ID NO: 40320 - DNA, 101 bp, rice(Oryza sativa)
  misc_feature (71): n=a or c
gttgggttccatcatgtatatgattcaattgactgaaggcagaccagaggaacatcagaatgtacctgctncagtgcaaaagattttacaagaatttgcag

SEQ ID NO: 40321 - DNA, 101 bp, rice(Oryza sativa)
  misc_feature (71): n=t or g
agctgctatctgtcagaaatctgctaagtacacagtcagctctaattcgtggtctatctgaaggggttcanattgattccttgactacagggtctgaaggc

SEQ ID NO: 40322 - DNA, 101 bp, rice(Oryza sativa)
  misc_feature (71): n=t or c
gatgaagaaggtgtggttgtgtcagccacctcctccagtgctggacatcgtgtagggaatgatgtgagcanggctaggctcatccggaagccccccgcgcc

SEQ ID NO: 40323 - DNA, 101 bp, rice(Oryza sativa)
  misc_feature (71): n=t or c
ttaaaatatttaatttattcctatatgcaagtatatgctcctatccgttgcataatccgttcaatgactanatccgtctcaaaatacagtaacttttagct

SEQ ID NO: 40324 - DNA, 101 bp, rice(Oryza sativa)
  misc_feature (71): n=a or c
ggctcctctcctacttcaccgggatcaagcagaagtgcgtttcggtggccaagtctacgctgccaaagtantcccttcttccctaaatatttacgcagttg

SEQ ID NO: 40325 - DNA, 101 bp, rice(Oryza sativa)
  misc_feature (71): n=t or g
aaatggttaataaaacacaaatcaaaatgtaccaaaacttcatatgataacaacctcagtgtagccgatcngcacggtcttctcctggagcgacttgatgt

SEQ ID NO: 40326 - DNA, 101 bp, rice(Oryza sativa)
  misc_feature (71): n=a or c
agattggctgacatgcatgaagagatgtcaagctgacatctcactcttctcccattgagtcaaattgttanttacagattttttatgaaccttttaggcga

SEQ ID NO: 40327 - DNA, 101 bp, rice(Oryza sativa)
  misc_feature (71): n=t or c
accctctctagagcaacacatgacttgcactgttgtggtgcgggtacgcaaaacgagaaatccattagcgngtgattaattaagttttaattattccaaac

SEQ ID NO: 40328 - DNA, 101 bp, rice(Oryza sativa)
  misc_feature (71): n=t or c
tcttcaggaaactaagattgcttccatcaataatcgtattattcttaacactttgggtcaaagatttgtgngacactatgttgccctgccggctgatggca

SEQ ID NO: 40329 - DNA, 101 bp, rice(Oryza sativa)
  misc_feature (71): n=t or c
caagccgccaaaccggtgtcgatttctccgccaaatccgccgccaaggccactcaaccacgaaagttggcnaggagaggagggccgccggttggggagatg

SEQ ID NO: 40330 - DNA, 101 bp, rice(Oryza sativa)
  misc_feature (71): n=t or c
acaagttgtgtttccaggttgcttgccctcgtgatgctctccctataatcatggtgttctagttcatcgtnattagtagtaaacacaagcagtgggcaccc

SEQ ID NO: 40331 - DNA, 101 bp, rice(Oryza sativa)
  misc_feature (71): n=a or g
caagacaaaacagctccattggccacctttacctgtgctatagtaggaattaactgcactcctgacagctnatctgctaccttggaactgagaaaactagc

SEQ ID NO: 40332 - DNA, 101 bp, rice(Oryza sativa)
  misc_feature (71): n=a or g
tctcagtagttgactttcagtaaggaaatcaaatgtttaaagccttattcggttttgagggattgaagagnattggaggggattgaggaggaataattcca

SEQ ID NO: 40333 - DNA, 101 bp, rice(Oryza sativa)
  misc_feature (71): n=a or g
ttgaggaagtgcaacgtcgcatgccttgtgttcttcgggcgatgtgggcatgcaaggggttgcgtgtaccntcacgccccccaaatagcgtatgagttgta

SEQ ID NO: 40334 - DNA, 101 bp, rice(Oryza sativa)
  misc_feature (71): n=a or g
ctacttctcatgagcgtcctccgctggtggcagcataccatggatctggccgacggtcgtcgatttctcangcgagccgatttgctcgaactagtagcctt

SEQ ID NO: 40335 - DNA, 101 bp, rice(Oryza sativa)
  misc_feature (71): n=t or c
ttaaagcgcaagtgatgtggtgttgaagttatgggatgatttcatctaacaaggtttaaacatcagtgacnacaaatattgcgcatatgcagatacatttt

SEQ ID NO: 40336 - DNA, 101 bp, rice(Oryza sativa)
  misc_feature (71): n=a or c
ttatcaattgaaatgtgaccattctctacgcgaactgttgcagtcttactaaactcccttggtcttcctgntaccttagctggtgtaggaatcatgaagaa

SEQ ID NO: 40337 - DNA, 101 bp, rice(Oryza sativa)
  misc_feature (71): n=t or c
gccttccgcatggccgccgactccgccatcaaccacatcgccttcgtcctcctcccccgcaactccatctncaaggttctctggatggccaccctccaccc

SEQ ID NO: 40338 - DNA, 101 bp, rice(Oryza sativa)
  misc_feature (71): n=t or c
aagtctagatttgttgatcttgtctgataataaccacatagccatcaaggtgaattctacctgggttcctnctttcaagcaaataacagatattgaacttc

SEQ ID NO: 40339 - DNA, 101 bp, rice(Oryza sativa)
  misc_feature (71): n=t or g
aagacgatgagaacgagcacaaaaatgctcaagccactaattccatacttagcgccttaagtggatgcganttcaaccgagtagatgatattgagaatgcc

SEQ ID NO: 40340 - DNA, 101 bp, rice(Oryza sativa)
  misc_feature (71): n=a or g
ttgactggtgccaaaaaaaaaaatgatcacatgggcttgagtgtaaactagtactgcaaataccatattgngtgaaaaagggaaaacagatgaagagtgta

SEQ ID NO: 40341 - DNA, 101 bp, rice(Oryza sativa)
  misc_feature (71): n=t or c
gccggtgccgacaatcacgatagtcgaatccacctcttcctgggcccgtggctgttgaattgttgattcancacctccccgagcacatcgctttgattgcc

SEQ ID NO: 40342 - DNA, 101 bp, rice(Oryza sativa)
  misc_feature (71): n=a or g
atcactccaagcaaattttgtagtttcgttaacgtgaggcacatatttttaggtactatcagaccggacgnctaactgagagcagtgatgtttatagcttt

SEQ ID NO: 40343 - DNA, 101 bp, rice(Oryza sativa)
  misc_feature (71): n=a or g
caagaccatcaaagtatggtaatgctgcaaaacttgtgcaaacttgtgcttctgtgttggctactaaggantattatgttagtactagtatttgaccataa

SEQ ID NO: 40344 - DNA, 101 bp, rice(Oryza sativa)
  misc_feature (71): n=a or g
accatatacgttccgatatacgaaacccatgatctctattctactcctcccaaattttccatcctaaaacntgatgaacatgcatcctaattaagagcctg

SEQ ID NO: 40345 - DNA, 101 bp, rice(Oryza sativa)
  misc_feature (71): n=t or g
cctcctctttgatgggggagaagaggacacaacctcctctgagctcacagcagttgtcgccgtcgtcgtcntcgtcgccattgttatctctgtcgattctc

SEQ ID NO: 40346 - DNA, 101 bp, rice(Oryza sativa)
  misc_feature (71): n=a or g
cccggagaacaatgcagtggagaggtcaccccagttagtgaaatgcttagtgaactcgtaaggcaccatcncatcacttgatgctgtagctgtacagttct

SEQ ID NO: 40347 - DNA, 101 bp, rice(Oryza sativa)
  misc_feature (71): n=t or c
ccctgggcatctcgcacacgcaataatcacataggttcgtcaagctaggttgcttataacactgcatacanaagtggacacgtcagaagtaagaagtgaca

SEQ ID NO: 40348 - DNA, 101 bp, rice(Oryza sativa)
  misc_feature (71): n=a or g
gttcaactcagtggtaactctttacgcggtattgttcctcccaagattggaaggttaagcaatatcaattngctgcagctttcgaacaatttgcttcaagc

SEQ ID NO: 40349 - DNA, 101 bp, rice(Oryza sativa)
  misc_feature (71): n=a or g
ctggtggtgatatgcagctggagaaggttgccacaatcatgttttttcctacaagaactactgctacaaangctatccaacactagatggctaataaaatg

SEQ ID NO: 40350 - DNA, 101 bp, rice(Oryza sativa)
  misc_feature (71): n=a or g
gatcacaaaaccccaatcctcacctctaattaggattccaagaagccaatttccctctgaagaaagcaagnaactcctctctcttcctctcccaagcaagt

SEQ ID NO: 40351 - DNA, 101 bp, rice(Oryza sativa)
  misc_feature (71): n=t or c
ggccgatgagaattatcaagtcgctaatagtcgtattcttgctagcctaatagtcctggatgcggcatganagtttatctattaattaagaagagtatgtt

SEQ ID NO: 40352 - DNA, 101 bp, rice(Oryza sativa)
  misc_feature (71): n=t or c
aaaaaaaagaaagtctaaagtaatgtgtgcgtattacaaaactttagggtggaaaaggccaataccagtgnttttgcgctcccaaagtcacagagcttgac

SEQ ID NO: 40353 - DNA, 101 bp, rice(Oryza sativa)
  misc_feature (71): n=a or g
atcaaatatccaatattctatacagccaaaggatgctgttgagatttctctgaaggatattgaccaactgnctaaaacttctttccctctttgtatgcgcc

SEQ ID NO: 40354 - DNA, 101 bp, rice(Oryza sativa)
  misc_feature (71): n=t or c
gataagaaagcagaagtgcaggtgctctcaagtcaggagttagacattaagaattatgtgaaaaataggcnggcaaccttgctaagagaagaggaaatcaa

SEQ ID NO: 40355 - DNA, 101 bp, rice(Oryza sativa)
  misc_feature (71): n=t or c
caccctactttctcattgccccgcttggcataaccgcaaacaaactcgctaggttattgctagttttatanttcatttatattgttcaaatatatttaaaa

SEQ ID NO: 40356 - DNA, 101 bp, rice(Oryza sativa)
  misc_feature (71): n=t or c
tcaaaaaaaaaaaggaaaaatagtttagtgtggttggttgtattgtcacttgattggctatgggtcaaagntagttcctggttttggggagttaaagagca

SEQ ID NO: 40357 - DNA, 101 bp, rice(Oryza sativa)
  misc_feature (71): n=t or c
ccttgaatccagagctgcatctcatcagagtactaattaatttattacttgattagttaattactacctcngtcccagaataaatacagtcgtgagtactc

SEQ ID NO: 40358 - DNA, 101 bp, rice(Oryza sativa)
  misc_feature (71): n=a or g
acgactaccaagcaacagtaaaacgacgactgacgggatgtacacaatgaaactaaaaatgccggggaccnggttggtagctgtagccggtgatcgagaag

SEQ ID NO: 40359 - DNA, 101 bp, rice(Oryza sativa)
  misc_feature (71): n=a or g
gtgttgcctactcgcttcccaccatcggttgtctcatcctctcctgcgtaccgacgagagggaagaaggcngttcatggcgacgacactagagcgacgtct

SEQ ID NO: 40360 - DNA, 101 bp, rice(Oryza sativa)
  misc_feature (71): n=a or g
ccattcaaattaggaagcggtggtggagttggtggtgtcgatgacgtagaagccgtcgatggagtttgcanaatcggagccttgccggggcgagtcgaggt

SEQ ID NO: 40361 - DNA, 101 bp, rice(Oryza sativa)
  misc_feature (71): n=t or c
aacccagccaaaaaaatataggcctatacctgacattggcaagaaaactcagctccgactccccactctcnttgtgatgggtcaagctttttcaagtattt

SEQ ID NO: 40362 - DNA, 101 bp, rice(Oryza sativa)
  misc_feature (71): n=t or c
gtgtgagtgtgtgtggatcttggttgtgttgtgtggtagggtatatatagaggatctttttctgggtttcntattgatttctttcttggatgctggtggtt

SEQ ID NO: 40363 - DNA, 101 bp, rice(Oryza sativa)
  misc_feature (71): n=t or c
tgcgctggggtcacgcttctgggctctgggtgatgagagctcggaggatgaagttgaccgtgaggagcatngatcagaggaggaggtgcaaggtggttcgg

SEQ ID NO: 40364 - DNA, 101 bp, rice(Oryza sativa)
  misc_feature (71): n=t or g
caagcaaatacagtcacattctgatctctctattcattggttcttcttcagattacagctccactttgctncggttcggttaagagtagtagtttgttttt

SEQ ID NO: 40365 - DNA, 101 bp, rice(Oryza sativa)
  misc_feature (71): n=a or g
agagtaacacttactatcgagaaggttcttccctgctctttgcatctctttggatggctcaaccaaattanccttctctatagactttggccacactgccc

SEQ ID NO: 40366 - DNA, 101 bp, rice(Oryza sativa)
  misc_feature (71): n=t or g
tttctactagaaaaattagtcgctcaaaattccgtgaatacagccagccgcaccacagcctcattttgcanagaccttctatatctgtgctgagagtttaa

SEQ ID NO: 40367 - DNA, 101 bp, rice(Oryza sativa)
  misc_feature (71): n=t or c
ttgggccatcctgctgttcctatcgtgtccagagtccttagcaaaaataatttaccgtgttctagtgttgnaaataaagactcaatttgtgatgcctgtca

SEQ ID NO: 40368 - DNA, 101 bp, rice(Oryza sativa)
  misc_feature (71): n=a or g
gtcgtttttttttatagaacagacacctattaccacctaaaggtaccggttttttgtatttccggatcacngaggtgggaaaatgcctatatgtgccggtt

SEQ ID NO: 40369 - DNA, 101 bp, rice(Oryza sativa)
  misc_feature (71): n=a or c
ttttatcctgtatgaatgcatcacaggacagagaacttcataacaacaaaaatgagaatatcaaagctcanaaagaaatgaaacaaagcaacacttcacta

SEQ ID NO: 40370 - DNA, 101 bp, rice(Oryza sativa)
  misc_feature (71): n=t or c
gggaatatacctaatgctttggaccgatgccaaaacttagtgaccatccaaatggaccaaaactttctcanaggaaccattccaatttctcttggcaacct

SEQ ID NO: 40371 - DNA, 101 bp, rice(Oryza sativa)
  misc_feature (71): n=a or c
actagttgcagttatctgatgcttgcatattaagtgcagaactgtgcacaagtgcaatttatttaatgttnaaaaaaaagtgcaatttatttagctcactg

SEQ ID NO: 40372 - DNA, 101 bp, rice(Oryza sativa)
  misc_feature (71): n=a or c
cagtccacttacgaacctaaccatatctctatactaaaatagaaataagcagttatactctttgctaatcnacccaacaaaatgtaaacaaaaatcctcct

SEQ ID NO: 40373 - DNA, 101 bp, rice(Oryza sativa)
  misc_feature (71): n=t or g
tggactcgcccatctggtcgaggtccttggccaccttcttgctaccggacgaagtgatgggaggcagcggntacaacctgccggtgacggcctcgagcagg

SEQ ID NO: 40374 - DNA, 101 bp, rice(Oryza sativa)
  misc_feature (71): n=t or c
tatgaactatgatatatgataacgatggtcacggtaaaaagactaatacatctaagcgacataatagcccngatagcgcaagccatatagacaagttacct

SEQ ID NO: 40375 - DNA, 101 bp, rice(Oryza sativa)
  misc_feature (71): n=a or g
tggctcataccttttttcagtggctgggtgtaggttgatcagaaggatcagactgatgacttttgagaagnttgtaaatatggagattgaatggtttgatc

SEQ ID NO: 40376 - DNA, 101 bp, rice(Oryza sativa)
  misc_feature (71): n=a or g
acagtacaagagagaaacttaccctaataatgaagtaattggggattttgatgcagtagcttcaacctcgnacagggatttggttgctggagttgccggag

SEQ ID NO: 40377 - DNA, 101 bp, rice(Oryza sativa)
  misc_feature (71): n=t or g
ccatctcggtcaatcgactagaacatcgtgaatttccgtgcgatctgtccgagagattaactaggtacgtncggcgttgcacctgtggattttctctcaga

SEQ ID NO: 40378 - DNA, 101 bp, rice(Oryza sativa)
  misc_feature (71): n=t or c
accatctcgaaaggctatagctcatgtgttccattttctgcttaataaaattcatatcactacatcaaganatatttttttccaaccttccttaaaaggag

SEQ ID NO: 40379 - DNA, 101 bp, rice(Oryza sativa)
  misc_feature (71): n=t or g
atcccattcatcttcatgaacttggggctcaatctccgctagcatgtaggcttcatgttgtttttgtggancaggcactgtgatgtctgccctaggcagac

SEQ ID NO: 40380 - DNA, 101 bp, rice(Oryza sativa)
  misc_feature (71): n=t or c
cagaacacgcttaattatcagctcaagagacgtacaaagcgacgttaactttttatgtttaactattgganttgtttaaaaattttatataaatgtataag

SEQ ID NO: 40381 - DNA, 101 bp, rice(Oryza sativa)
  misc_feature (71): n=a or g
tcactatccacagaggtgcatgtgcatttcggagtttaaaagattttcagttttatagctccatgatgccntcgtttcaaccaggagctatgccccacctt

SEQ ID NO: 40382 - DNA, 101 bp, rice(Oryza sativa)
  misc_feature (71): n=t or c
cctccccttcactgtaatccgtgaaacgttgatgatgttccgtaatccacagggaataaacatcacggtanatagaggttttgcgcaccctagcatgcaac

SEQ ID NO: 40383 - DNA, 101 bp, rice(Oryza sativa)
  misc_feature (71): n=t or c
caaatcattgctttggttcagtaatttgaggcccttggcaataactaaagtcccacacgactaaagcaccnaatacatcatttcactggtgagcttgtaca

SEQ ID NO: 40384 - DNA, 101 bp, rice(Oryza sativa)
  misc_feature (71): n=t or c
tcccctgatgtttagcgatattggccgcggtagtgttcttttttcttatgagattagtaacattttatcangatttttgttagcacgatttttaaactatt

SEQ ID NO: 40385 - DNA, 101 bp, rice(Oryza sativa)
  misc_feature (71): n=a or g
aaatgtggcgatagcattttagcacaatatttcgtcttttatactaaatgagctagtgtcagccagtgtcnatcctcaaattataaatccacaaccccagt

SEQ ID NO: 40386 - DNA, 101 bp, rice(Oryza sativa)
  misc_feature (71): n=a or g
gtcgtacatccatgcccgatccatctcctgaaaaacatctccgatgggtcgaattgaactttattaaatcntatagaaaacgatactacttaaacgaacat

SEQ ID NO: 40387 - DNA, 101 bp, rice(Oryza sativa)
  misc_feature (71): n=a or c
caacatattttcaatcctctcctccactcctctcttcctctcctctcaaaatcctctcctcaatctctctntctctctccctccgagtgggcggcgatggg

SEQ ID NO: 40388 - DNA, 101 bp, rice(Oryza sativa)
  misc_feature (71): n=a or g
ttctccaaatttgtgagcttcgatagccagacaggcatttttccatacaacgaggacccacttattgaganatgctgtagattttcaaaaccatcaattgt

SEQ ID NO: 40389 - DNA, 101 bp, rice(Oryza sativa)
  misc_feature (71): n=a or c
cgagaaaatgaccggcactaattggtcatcaaagttaagtggacgatgcatggatggtactacctccgtcncatattacttgtctttttgagtttttattt

SEQ ID NO: 40390 - DNA, 101 bp, rice(Oryza sativa)
  misc_feature (71): n=a or g
gctgtgttcgttcagtggagttggtaacacattctctccacacgaaaaacagagcgacgtattttcttatnattaattaagtattattattttttaaaaaa

SEQ ID NO: 40391 - DNA, 101 bp, rice(Oryza sativa)
  misc_feature (71): n=a or c
tacgtatggaggaggaccgaagctgtcacgacctgagaagggatggcaaaggatcagctgtagaaatggangcaacggagcccctccctgagcccgagagc

SEQ ID NO: 40392 - DNA, 101 bp, rice(Oryza sativa)
  misc_feature (71): n=t or c
aaatacagagatagtacgattatttatcaaatggtcacatattacctgagataatggtgcaccctgcaaantcttaagtctaccatagaacaacaaatgct

SEQ ID NO: 40393 - DNA, 101 bp, rice(Oryza sativa)
  misc_feature (71): n=a or c
attcggttcaagcttagccctgtcaagctcccgaagcaagtgctctaccttcttcatcttcccttcattgnaaagcccaagaatgagcgcattgtatgtca

SEQ ID NO: 40394 - DNA, 101 bp, rice(Oryza sativa)
  misc_feature (71): n=t or g
ggtggtattcgtgattcccatgttactaattcaaaatcgccatctggaattgcagcacatccagctattangtctctaaataacaaacttggttttttcct

SEQ ID NO: 40395 - DNA, 101 bp, rice(Oryza sativa)
  misc_feature (71): n=t or c
aatgagggtgctgggcaagcatgtatcatacacaggaggacactctaatgtgatgagatcgccccatacgncggcctgcgacgagtagagcgaagcgtaga

SEQ ID NO: 40396 - DNA, 101 bp, rice(Oryza sativa)
  misc_feature (71): n=a or g
ctcttttctcatcttcttgaccacttcacgaatgggaatcatatcatcatcactactctcgatctctgtcncgactacatgagcaccatcgacaccatcct

SEQ ID NO: 40397 - DNA, 101 bp, rice(Oryza sativa)
  misc_feature (71): n=t or g
aatactatcagctcatacaattccaaaatgcctcatcaagtgcttccttagagctcccctagagcacaacncgctcagcaactcttgagcctcctttgcta

SEQ ID NO: 40398 - DNA, 101 bp, rice(Oryza sativa)
  misc_feature (71): n=t or c
ctatttctgtggagttgaaatcccggcctccaaaccaaacaagcctgcgctgttttgagtatctttatacnttacaggttcttatatatgtctatatctct

SEQ ID NO: 40399 - DNA, 101 bp, rice(Oryza sativa)
  misc_feature (71): n=a or g
gcccaatagtgacacccccttctcttggcaaagctcccccttcatcttcttcagctctccagtgttttttnttttattttctgttgatattccacttgaaa

SEQ ID NO: 40400 - DNA, 101 bp, rice(Oryza sativa)
  misc_feature (71): n=t or c
tatacttctcacgacaggtttgtgaagtagatggttttgaaaactgcatggattcgagagaataggagaanagttgcctgacaaatagttggttcagtccg

SEQ ID NO: 40401 - DNA, 101 bp, rice(Oryza sativa)
  misc_feature (71): n=t or g
atgtggagggcggtgtccccctggtatgtgagccgtgtcaatggcgatagtatgtgctcgtcgccgtcgcngggtatgatctgcaggccgcgtgggcagcc

SEQ ID NO: 40402 - DNA, 101 bp, rice(Oryza sativa)
  misc_feature (71): n=a or g
ggactgggactaaaagcccatgggcctcaatcaattttcaccatacttttattatgcgacaaaacagggcngggcggcagggatggttccacccctgatag

SEQ ID NO: 40403 - DNA, 101 bp, rice(Oryza sativa)
  misc_feature (71): n=a or g
cactgagaattgctcaattggatgttactgtgcacagaggaatggcggtgagtttgcatatgacaagctcngtgctcttttacggggcaaaccactggtat

SEQ ID NO: 40404 - DNA, 101 bp, rice(Oryza sativa)
  misc_feature (71): n=t or c
ggatttgctaaaaaaatattaaaaaatcgagctaactttttataagggcatccacattgttgctttttagncggtaataagcaatacatgctctcttccta

SEQ ID NO: 40405 - DNA, 101 bp, rice(Oryza sativa)
  misc_feature (71): n=t or g
agcccgacgggcctgttaattgctcctgatcgtggattcgcttctggcctcctagagaagagaagcacaanaagatcgctgctcgcctgcttgtggtcgtg

SEQ ID NO: 40406 - DNA, 101 bp, rice(Oryza sativa)
  misc_feature (71): n=a or c
agtaggtagagctaaagctactggttcacaccagcctaccatggcataatttacccataggtcatagttgncatcgttgtctgcatcctttttgcatcata

SEQ ID NO: 40407 - DNA, 101 bp, rice(Oryza sativa)
  misc_feature (71): n=t or g
gagatcttggccttgtcggtgccatctctccgcagctcagcaacctcacctatctccaagcccttgatctntcaaacaacaggttacaaggtgagatcccc

SEQ ID NO: 40408 - DNA, 101 bp, rice(Oryza sativa)
  misc_feature (71): n=t or g
ccctagtagtaagaacctataatggggctataaacatgtaatagggggatcccccaagaaaaattctcaanttaatacacttcttttccaactactgttga

SEQ ID NO: 40409 - DNA, 101 bp, rice(Oryza sativa)
  misc_feature (71): n=a or c
tgacctctccaaagtcattgggagggatgggtttcagggatttcgtcatcttcaaccaagcgatgttgagnaaacaaggatggcgcctcctcactgatcca

SEQ ID NO: 40410 - DNA, 101 bp, rice(Oryza sativa)
  misc_feature (71): n=t or g
cgtctacaaaagggagggtattatccaaataggcgcaggccaatttaaccaaggttcttcaagagatgacnccccaccaaatccctccaagatctggcttt

SEQ ID NO: 40411 - DNA, 101 bp, rice(Oryza sativa)
  misc_feature (71): n=t or c
tgcattctgccgaccaaatgttaccttcaaataggttaaaaatcggggcaaaacccacggatcgtgagttnaatgattgtcccctcgggtgttcgctcata

SEQ ID NO: 40412 - DNA, 101 bp, rice(Oryza sativa)
  misc_feature (71): n=a or g
gcccgtgttcagcaatgctatgcagggacatggaaaggttgaatcttcacatcatccaccaaggctctctnacaaccttggaggtgaagcctctgctacta

SEQ ID NO: 40413 - DNA, 101 bp, rice(Oryza sativa)
  misc_feature (71): n=a or g
ggtagagctcttgggtggatgaacaaatatggatgaaacaacagagagggaagtgagagggtttagggatncgactggttgacgttgaggaggaggaagag

SEQ ID NO: 40414 - DNA, 101 bp, rice(Oryza sativa)
  misc_feature (71): n=a or g
gtagacttcctggctcctcaacagtttcgtccaacatatattaagggggtgtttagatgattagatccagngtgtaaagttttggcgtgtcatatcgggta

SEQ ID NO: 40415 - DNA, 101 bp, rice(Oryza sativa)
  misc_feature (71): n=a or g
catgtcatcatcgataggcaccatgatgaagtgccgatgagcaccaccaccaacgttcaaccttccctgcncacgaatgctgagcatcgtaggcacccacc

SEQ ID NO: 40416 - DNA, 101 bp, rice(Oryza sativa)
  misc_feature (71): n=a or g
agagatgtactatacttaaactgaaagcaacttacctgaactacgggccctgacattctcactggatgagnaggacgaagaccttacttctggtccgcttg

SEQ ID NO: 40417 - DNA, 101 bp, rice(Oryza sativa)
  misc_feature (71): n=a or c
ccattaaccacgtacgttaacactggaggtaactaaaggtaccacttaacttttgccattatcatacatanaaacaaatcagctgcattaccatccggata

SEQ ID NO: 40418 - DNA, 101 bp, rice(Oryza sativa)
  misc_feature (71): n=t or c
aacggctagaattgcatcgagatttgtgcattcttctctccccctatgtcttctcttcctctcccagtcangcacacacgcattagaagtcaccgctgctt

SEQ ID NO: 40419 - DNA, 101 bp, rice(Oryza sativa)
  misc_feature (71): n=t or g
ggccttcatttttagcaggtggattccttgttgggctttgttcccaatggcatgagagttgtgcttgtttncacgtgttaactttgtgttgtcagcccatc

SEQ ID NO: 40420 - DNA, 101 bp, rice(Oryza sativa)
  misc_feature (71): n=t or c
tataaccttgcaaaacgaataagcttagagttaacacgacccttcctctaaggatgctaaatggtaaagcnacgcacagcctaacaaacagatatagaaat

SEQ ID NO: 40421 - DNA, 101 bp, rice(Oryza sativa)
  misc_feature (71): n=t or g
tcagcgttgcgtgacatgatgcagcagtttgcatcatctgtatgactatattcgtctagaaaaaacgtgtngtttgttcattaataagcagtgtagcgcct

SEQ ID NO: 40422 - DNA, 101 bp, rice(Oryza sativa)
  misc_feature (71): n=a or g
atccattgtgtcacccatggcaccattcaagtcaatggtgagccgacgaatcttgtcttgaacttctatcnccgctcgtggatcttgtatcacactgatga

SEQ ID NO: 40423 - DNA, 101 bp, rice(Oryza sativa)
  misc_feature (71): n=a or c
gtccctctcaaatagtacctatgagacaattttttatgttgagacccttagaaaatccggatatttcatanaaagaagaggaaaaacgcgaattaggaccg

SEQ ID NO: 40424 - DNA, 101 bp, rice(Oryza sativa)
  misc_feature (71): n=t or g
tacagccattcgctttatgctctccatcaacctggatagcgagcttatctgccacggaagcaaaataaaanctaatcacagaaccattcgaagtaaatgat

SEQ ID NO: 40425 - DNA, 101 bp, rice(Oryza sativa)
  misc_feature (71): n=a or g
tgcatggacgaggaatagggccaccctcgctaaacaccaaactccgcatctccaccatggatgactcggcntctctatttactatttccttggctgcctca

SEQ ID NO: 40426 - DNA, 101 bp, rice(Oryza sativa)
  misc_feature (71): n=t or c
gcgctgaccacgcctcgctcctcctcgctgattccaacagcgatagcgattccactgattccaccaattcngccgctgttggatctccactgattccatca

SEQ ID NO: 40427 - DNA, 101 bp, rice(Oryza sativa)
  misc_feature (71): n=t or c
tcaaattacactaaattggtcgcgtgcatcacacctgtcctatatgcttcgagcatatacattaggggtgngtttggataatggtaaataagggatgggat

SEQ ID NO: 40428 - DNA, 101 bp, rice(Oryza sativa)
  misc_feature (71): n=t or c
acatttaatgactgcagaagatggttcctcatacctaataacctgatgacctcgaagacataacctgcaangttctcatctaacagatgacagtaaatgga

SEQ ID NO: 40429 - DNA, 101 bp, rice(Oryza sativa)
  misc_feature (71): n=t or g
ctacaggaagataactcggctgggatgcggccatcgagcgaattgacactcaggttgaggtgtcgtagttnttccaggcggctaagctcagctggtatacg

SEQ ID NO: 40430 - DNA, 101 bp, rice(Oryza sativa)
  misc_feature (71): n=a or c
gccatcaaagggtggattcttgcgccatggccatgacaacctcatgtcagcaccgtgtgtagttattgaanacacgattgttcctttccttctaaatggcc

SEQ ID NO: 40431 - DNA, 101 bp, rice(Oryza sativa)
  misc_feature (71): n=t or c
caccggaaatgaaataggaaggtgggacaccttgctagatctcaggaagaagtagtttgttggtccacgangagaagtagtaatccgaagccatgatgagt

SEQ ID NO: 40432 - DNA, 101 bp, rice(Oryza sativa)
  misc_feature (71): n=a or c
catttgaggctgtaacgtagacgatgaaccgttcttattacatctatctcataatagtatatagcaatttntatatatatatatatatatatatatatata

SEQ ID NO: 40433 - DNA, 101 bp, rice(Oryza sativa)
  misc_feature (71): n=a or g
gagttgatgcaaaatccaaagtccatgtctagagtttgtgatgagctttcacaagttattggcttaggaanaaatatcaaggaatcagagattggtcagtt

SEQ ID NO: 40434 - DNA, 101 bp, rice(Oryza sativa)
  misc_feature (71): n=a or g
gtttcttcacagctacaggccgcaaggtcttggtgaaataaactctctcagctatgccaatttaccacatntttgtcattccttctaacaaatggctttac

SEQ ID NO: 40435 - DNA, 101 bp, rice(Oryza sativa)
  misc_feature (71): n=t or c
agattgacgcggagatcagagaagtgtgcgcgatcggatcgaggccggtacctcctcctctcctttaactnctctcctcaaccttatctcctcctctcatc

SEQ ID NO: 40436 - DNA, 101 bp, rice(Oryza sativa)
  misc_feature (71): n=a or g
tactgccaaaatgatgtaatggtacagtagttggcagagcataaacggcggaaattgacaactgaaatgcnaaaagggtgggcaacggtaggggctccttt

SEQ ID NO: 40437 - DNA, 101 bp, rice(Oryza sativa)
  misc_feature (71): n=a or g
attttttgtcacatctacactatactctccattcttgtgtttggaagagatgtcagcagattgttcaactnggggaggtggcggtggtggtctagtcttta

SEQ ID NO: 40438 - DNA, 101 bp, rice(Oryza sativa)
  misc_feature (71): n=a or g
tttcaaaggtgaagtcagtgccagtatctcatagcccacagattcatggtaggtcaacgacttgtcagttntcatttcctaattctcctagataattactc

SEQ ID NO: 40439 - DNA, 101 bp, rice(Oryza sativa)
  misc_feature (71): n=a or g
aaccaggagcagttttagccgataagcagttacctcaggaaactcagccgccgaaacacttgagggattgncggccatcaccggaataccaagcgccgtcg

SEQ ID NO: 40440 - DNA, 101 bp, rice(Oryza sativa)
  misc_feature (71): n=a or g
aaagaagagtccttaattagcaaatgaacaagtaaataaatggtggaggagcaaagtgaaggggatgagcncctaccgtccaaagtgtgcaggtcggcccc

SEQ ID NO: 40441 - DNA, 101 bp, rice(Oryza sativa)
  misc_feature (71): n=a or c
tccaacaaattgcctaacactaacaagcaacgatgaccgtcgtcgtcgttgccgatgacgccgccgccgcngcagcggcggcgcagcagcaggaggagctg

SEQ ID NO: 40442 - DNA, 101 bp, rice(Oryza sativa)
  misc_feature (71): n=t or c
tggagagagtttttttttctagatgggacaagatcctgttcatggtagtgatctggttaaggggcaatttngttcttgcccctactttcatcttcaatatt

SEQ ID NO: 40443 - DNA, 101 bp, rice(Oryza sativa)
  misc_feature (71): n=a or g
atagcacatgaacatacaaatgccgtcgataatttgtccctttgttaaagattggtatgtatgcactatcntcgtacagagtttatgaaaataactttacc

SEQ ID NO: 40444 - DNA, 101 bp, rice(Oryza sativa)
  misc_feature (71): n=t or c
tcaatctctcactctgtctccatctcctttgtcagaagcccctctatatttccacccattggaggggcgangacaacaacggaggacacagtgactaccgc

SEQ ID NO: 40445 - DNA, 101 bp, rice(Oryza sativa)
  misc_feature (71): n=t or c
atccaatcgcccaaagtgcatgtcaatttttagcctcttactaattaactagtattgtggcccgcgcaaantgcgcagctagctaccaatattccttattt

SEQ ID NO: 40446 - DNA, 101 bp, rice(Oryza sativa)
  misc_feature (71): n=a or g
aattttctagatccagcacacgtagaacctggaagcttgaaagagatggtaataaactaacaccagaactnctgaatatagaaagcgacctcacttgtgac

SEQ ID NO: 40447 - DNA, 101 bp, rice(Oryza sativa)
  misc_feature (71): n=t or g
gagtcggcatttccaggtattgtccctgcattttgccgttttgttttgttttgccctgaattcgggtgatntgtttggtggcatggtgctcttgttcttca

SEQ ID NO: 40448 - DNA, 101 bp, rice(Oryza sativa)
  misc_feature (71): n=a or g
tgcagctacaagtattgccaccatgatccatcgatacgatcagcctgagccacagacataaactagtacancgaacttttcgtctgtgtggccggtttcac

SEQ ID NO: 40449 - DNA, 101 bp, rice(Oryza sativa)
  misc_feature (71): n=t or c
aaaaaatatctcctataatcaagcattgatcaaccctcgaagaatctccaattttcatcgattaggtgatngatgcgagctatgaggtgttagagggagac

SEQ ID NO: 40450 - DNA, 101 bp, rice(Oryza sativa)
  misc_feature (71): n=t or c
gggacgaggttggacgcgtcactcttcctcggattcagaatccgcgctctggagccactccacgaatggtntggcattcttcaccacctgggactccttgc

SEQ ID NO: 40451 - DNA, 101 bp, rice(Oryza sativa)
  misc_feature (71): n=t or c
tgtttctgcatcagggccaacacaaattattctgatgggctagggggtttttccttgggatgctttgatcnatagtgatcaatcaattgtttctcattggc

SEQ ID NO: 40452 - DNA, 101 bp, rice(Oryza sativa)
  misc_feature (71): n=a or g
tttgttcaggttctaccccggccagattaggtactaggtatacagaaaagaaagaggactgctacaaaatngaattccgttgcaacggtatagacatatta

SEQ ID NO: 40453 - DNA, 101 bp, rice(Oryza sativa)
  misc_feature (71): n=t or c
agagttttgtgatccccaaacgaccaattacttccatggactccctatactgctatctcccatcttatccngggaatctctctttctttatttacaagata

SEQ ID NO: 40454 - DNA, 101 bp, rice(Oryza sativa)
  misc_feature (71): n=t or c
cttacttctttcagtagggaggaatcagaccatcgctgatgattgcaatcagaacctgaatcagcaaccanaagcacatcggtcgcatatgaagtattgca

SEQ ID NO: 40455 - DNA, 101 bp, rice(Oryza sativa)
  misc_feature (71): n=a or g
agctgggacaaactcccccaaacagggcctttgtcttggcaccgtcgctggttgcaacttgcaaggttgtnttcttctcgtagaattttaacatgacgttc

SEQ ID NO: 40456 - DNA, 101 bp, rice(Oryza sativa)
  misc_feature (71): n=t or c
caactccacaaccatgactctacacaacggtttctcccacaagcaagatgcaacaatggcgatgaagctgngacaactctccatcatttcgtagcggtatc

SEQ ID NO: 40457 - DNA, 101 bp, rice(Oryza sativa)
  misc_feature (71): n=a or g
ttgggaggcaagaaatgatctcttgcatacttctcgagtgtcccaaaagattctggcatatactacctccntcccatattacttgttgttgctttgttttt

SEQ ID NO: 40458 - DNA, 101 bp, rice(Oryza sativa)
  misc_feature (71): n=t or c
cactcccaatatgggtgagctgatgctttgggacgcaattataacctctacctgtcacaaggtccttggcngtagaatggggttgtgtcagtccccttgtt

SEQ ID NO: 40459 - DNA, 101 bp, rice(Oryza sativa)
  misc_feature (71): n=a or g
gccgagtgcactccgactccaacttggtcaggagatggatggagtagccgttaactttacgcgggccaaantttccaaatgggaaatcttttctgcgcgca

SEQ ID NO: 40460 - DNA, 101 bp, rice(Oryza sativa)
  misc_feature (71): n=a or g
gccaaccacacggccttgctatgtgctgctgctacggtgcaactagtactacacgtcttgggttcatcctntcatggcattggtggcactcggtactctga

SEQ ID NO: 40461 - DNA, 101 bp, rice(Oryza sativa)
  misc_feature (71): n=t or c
catggattttcatcgtgctagctagttaatgcgtgcgatcgaattattgttatcgtctgaaaatgcgctcnccaagatgaggcatggccatgagatctgcc

SEQ ID NO: 40462 - DNA, 101 bp, rice(Oryza sativa)
  misc_feature (71): n=a or c
cattttttacgggtaaaacaacaggagaggctcttactgtgctttgttaagaaaccaagggaacaatttanaaaaggagaaaaaaacagaagagaattaca

SEQ ID NO: 40463 - DNA, 101 bp, rice(Oryza sativa)
  misc_feature (71): n=a or g
agcggaggcgagacgggctccctctaccggaaggagatggcgtgtcactgcaaacggggcccacttgtcantgccccacccccaccttcctctcgcttttc

SEQ ID NO: 40464 - DNA, 101 bp, rice(Oryza sativa)
  misc_feature (71): n=t or c
tcctgcagcaggaaacattccatgtggaagctacgacctgctgcccatccacctcggcaagaaaagtcttnaacttatgctgataccgtgccccaatggac

SEQ ID NO: 40465 - DNA, 101 bp, rice(Oryza sativa)
  misc_feature (71): n=t or c
ccaaagtacaaaacagcctacacttcttcagcccatttctccttcggtatctcaccagagtcggtgattanaactttcttcctaggcttgccattgtaagt

SEQ ID NO: 40466 - DNA, 101 bp, rice(Oryza sativa)
  misc_feature (71): n=a or g
gggccctggttcccactaagactgatgatgataccatgaattcccaggcccaagatgctatggaagtgctngaagtcatgcctttgtctgttcagccttcc

SEQ ID NO: 40467 - DNA, 101 bp, rice(Oryza sativa)
  misc_feature (71): n=t or c
tgtggcttcgctagtgttagcaaagcccatcatacattctctccctcgtccccgcctatcctccttaaccnggtggtgtattcctgttgtcttcctcatct

SEQ ID NO: 40468 - DNA, 101 bp, rice(Oryza sativa)
  misc_feature (71): n=t or c
ctgtgggggtgcccccagcaaagaacaatatcaggacttgttgaccccttatagtcacatgcctacagggnttgggaataataatggagttagattttaca

SEQ ID NO: 40469 - DNA, 101 bp, rice(Oryza sativa)
  misc_feature (71): n=t or c
gattttgagatggatactgtttctttttctcttcctttggccgaaaaacagtagcgcatacctggctcaanccctgcttcagaatctatagtatgtacgca

SEQ ID NO: 40470 - DNA, 101 bp, rice(Oryza sativa)
  misc_feature (71): n=a or g
gcatcatcatttaagcatatagtggatgcaatggaaagttaattgtgttgggcacaaccaccactgacagncagtcaggcatatatacagaggtcaccagg

SEQ ID NO: 40471 - DNA, 101 bp, rice(Oryza sativa)
  misc_feature (71): n=t or c
cacctagggctttgcgactcagctaccgagctacgggcagcgaaccaaccatgaagacgttgcgggagagnggtggcggcgatggctaaggctgcggctca

SEQ ID NO: 40472 - DNA, 101 bp, rice(Oryza sativa)
  misc_feature (71): n=a or g
ttaacatataagtaggttcgcaggttgacccgcttttattcctagtttgaaccaattcccccactagttcntaaaagatcgccaccattttggcggagccg

SEQ ID NO: 40473 - DNA, 101 bp, rice(Oryza sativa)
  misc_feature (71): n=t or c
cctgacgacctccttgatcttccgtagaggcttgatgatcctcccgtcatggttttgataaactggcgaanagtcaccactgcacgccgcagccggtgcca

SEQ ID NO: 40474 - DNA, 101 bp, rice(Oryza sativa)
  misc_feature (71): n=a or c
tagaaagagttaataaaatgatgtttcaatggtaccttttcaaatcaaatatacatacactatttttacantccctccatcctaaaataagttacttttca

SEQ ID NO: 40475 - DNA, 101 bp, rice(Oryza sativa)
  misc_feature (71): n=a or g
gtgagaggatctcatgttggttcatacctaccaagttctggtgtttggcatcgtacacaaaggtacataangagaaagaacaatgatactactatagtgaa

SEQ ID NO: 40476 - DNA, 101 bp, rice(Oryza sativa)
  misc_feature (71): n=t or c
tgagttgagggaagcaaaatagacttattcctacatttgttttgttggtctggcccgcaaaccagtccacngcggaaaagaggatgggccgtgtgtccagt

SEQ ID NO: 40477 - DNA, 101 bp, rice(Oryza sativa)
  misc_feature (71): n=a or c
caggcacctcaccaccggtgaggattccggtgcagatgtggatgagattgagatgcggcgaggcttgaagnctaaggcgcgggggtcactcaaggccctcg

SEQ ID NO: 40478 - DNA, 101 bp, rice(Oryza sativa)
  misc_feature (71): n=a or g
actgatgcaaaactctcaacattcttgtttgaaagtgaccttattgtattcatttctacaggtgaatccantgaattaaaatgggacatgcgcttcaaaat

SEQ ID NO: 40479 - DNA, 101 bp, rice(Oryza sativa)
  misc_feature (71): n=t or c
tagccagtgcgccattataagcattcgttacctccgtatttccatgcactgcactgcactctcaccagctnttagttctccttcccctgccgctggtcacg

SEQ ID NO: 40480 - DNA, 101 bp, rice(Oryza sativa)
  misc_feature (71): n=a or c
cggaaacaatttgaaccaatcgagccctccattgacgcagaatcgacgatgcctcggataactccagagcnacgacatggtgcacctggcgcgcctcgtcc

SEQ ID NO: 40481 - DNA, 101 bp, rice(Oryza sativa)
  misc_feature (71): n=t or g
accaatttaagaaatcatcataacttttgattctcaaaagctatgaaggtgaatgagcactttttgaaaancttattgagtctagtttcacacaaaaccac

SEQ ID NO: 40482 - DNA, 101 bp, rice(Oryza sativa)
  misc_feature (71): n=a or g
gtgttgcgtgagaaatctgctctcaccagatacacaacaatgagtgggatcgaacagatcgagatccagcngcagctgggtgcaccggctgaggggcagat

SEQ ID NO: 40483 - DNA, 101 bp, rice(Oryza sativa)
  misc_feature (71): n=t or g
tttgcctctcaattctcacgtgaataatggaaaatttcgacgtcctcgcccgagcgccattgtacttaggncatccacaatgtgttgagaaaccaggtaat

SEQ ID NO: 40484 - DNA, 101 bp, rice(Oryza sativa)
  misc_feature (71): n=a or g
gcctgcgcaggaaaaattgaagcactcggatttatcattcttgggcaagttacttgactgcaaaggtctcnggggctactgtggagattatggatacccca

SEQ ID NO: 40485 - DNA, 101 bp, rice(Oryza sativa)
  misc_feature (71): n=t or c
ccaattacaagattgttcgtgcatggtttcctgtcgctagtgatatcagcggtcggcaactatataattcntcttctaacaagtcacagcgagcccgagca

SEQ ID NO: 40486 - DNA, 101 bp, rice(Oryza sativa)
  misc_feature (71): n=a or c
gtgatggctggagaggtcatcacttctgcaatcttcgtctttgactgttacaagaagcaatagatcagcanttatttttgttgttgagtatgtgcgtgagt

SEQ ID NO: 40487 - DNA, 101 bp, rice(Oryza sativa)
  misc_feature (71): n=a or g
cagatcttttgtctgaatgctgaacaaaacgtgccttgcagcatgacagttgtcacatccctgctgaaaanatacaaggtcgatccaaagctgattggtcg

SEQ ID NO: 40488 - DNA, 101 bp, rice(Oryza sativa)
  misc_feature (71): n=t or g
tgatggtttcccgaagaacgctagagtctggttcgcatatgctgattcggctagctttcaacttccttcgnattttagatttgatgagatcaactctgaga

SEQ ID NO: 40489 - DNA, 101 bp, rice(Oryza sativa)
  misc_feature (71): n=t or c
tattattttttcaagaagcttccctagctaagaatgacaggacaaacacaaaccaaattctgtttgagtanagtaagaaatccaagatttaaacatatgta

SEQ ID NO: 40490 - DNA, 101 bp, rice(Oryza sativa)
  misc_feature (71): n=a or g
tgagatggcccagacgtgcgagattacacttcctcgggatgagatccgactggctacattaaccgccaccncaggagaagtgcctgcacccaaggtaccaa

SEQ ID NO: 40491 - DNA, 101 bp, rice(Oryza sativa)
  misc_feature (71): n=t or c
cactcaccggtgaatggcaccatgttggctactggacgatgccgttttatggcagagctcagtatgtgccngacctcaatctctggtttggactctctgcc

SEQ ID NO: 40492 - DNA, 101 bp, rice(Oryza sativa)
  misc_feature (71): n=t or c
tcgaatgtcatttgaaaggtctttgcattgtgacctcaagctttacctgctagtttgccattgatgtaganctgaagaacatgtccaagtgagttgacaag

SEQ ID NO: 40493 - DNA, 101 bp, rice(Oryza sativa)
  misc_feature (71): n=t or g
ttgatatagacctccaggatgatcaggagcagacagaggcagatgtctccccggttcgtcaaccaaagaanacatcattcaaggtactactcagtgtcaat

SEQ ID NO: 40494 - DNA, 101 bp, rice(Oryza sativa)
  misc_feature (71): n=t or c
aatttcgcatttaaactacacagtaacatagctggctcatgctcgtgtgacctatgaaaactattccgagnttacaaagctaagctatatgatactacctg

SEQ ID NO: 40495 - DNA, 101 bp, rice(Oryza sativa)
  misc_feature (71): n=a or g
gctgcagagccaagtccaagagcttcaaggtgattatccacgcaagcggaagcacatggataatgatgaanaggacaatgatagtattgatgaggtatgga

SEQ ID NO: 40496 - DNA, 101 bp, rice(Oryza sativa)
  misc_feature (71): n=a or g
tatgatgtacttctctcctattctgtatggaaggatggtatatacctcaatgtgatttgagtggcttttcntaaagcagagatacctacagaacatcttag

SEQ ID NO: 40497 - DNA, 101 bp, rice(Oryza sativa)
  misc_feature (71): n=a or g
tcccacactaatattttttttcttctagaaaagtagagagttgatgggagtagttgatatatgaacctacnaccccacatgccattttccctaaaaagtag

SEQ ID NO: 40498 - DNA, 101 bp, rice(Oryza sativa)
  misc_feature (71): n=t or g
ttggtatcttacctatactgtctgttgaaatattgaaataggcatggaagttgtggtcagaggaaagatgncttgaacttcttgatgcatcattggttaca

SEQ ID NO: 40499 - DNA, 101 bp, rice(Oryza sativa)
  misc_feature (71): n=a or g
ccccagtcttcaattgttaaagcaagcaggcctcctcaactaacttctgaaacaaccttaaatcaattaantagtgccaataacatggtaaaaaagatgaa

SEQ ID NO: 40500 - DNA, 101 bp, rice(Oryza sativa)
  misc_feature (71): n=a or g
ttagctagctagcttaattggcttctcttgctcttcttctgatcagtggctactgagagagtgagctgagntagctagctagctagtgagatttgcttgat

SEQ ID NO: 40501 - DNA, 101 bp, rice(Oryza sativa)
  misc_feature (71): n=t or c
tgtgcagcttgacttgaccacgacaatataaaaaggacagagaacaaaagaccgaaaataaaaccaagtangggtgtgtttagttcacgctaaaattagaa

SEQ ID NO: 40502 - DNA, 101 bp, rice(Oryza sativa)
  misc_feature (71): n=t or c
cattccgcccttcatctccaccgatccctcgccaggaagatcagcaagttgggagcaacgacgaagcatancatcacggagttagcaaagagcccgatgtc

SEQ ID NO: 40503 - DNA, 101 bp, rice(Oryza sativa)
  misc_feature (71): n=t or g
gtagctggcactgtcaggcaacctcaaaataaagtcatgtactgcctccgtcgcagcaggttatgtttttnactttgatcgaagttaaactacttcaagtt

SEQ ID NO: 40504 - DNA, 101 bp, rice(Oryza sativa)
  misc_feature (71): n=a or g
ggcacaaaagagcatataaagacaaatctgatcgatgggccatactggcttttttttgattgaatggactnacacataggataaaaacctcttcggattat

SEQ ID NO: 40505 - DNA, 101 bp, rice(Oryza sativa)
  misc_feature (71): n=t or c
gcaaggcgggaaaaacgaggagtctcgtccgacgtgctcggcgccattactagccatctcgtcaactgccngaccgccaggcgcgtggggacgcgggattg

SEQ ID NO: 40506 - DNA, 101 bp, rice(Oryza sativa)
  misc_feature (71): n=a or g
ggggggaaaacatgggtcgaggctcatagatatcagaaaagcaacgtgccatacatatctgatggacctcngagtgataagtgggcatgggttctattcga

SEQ ID NO: 40507 - DNA, 101 bp, rice(Oryza sativa)
  misc_feature (71): n=a or g
gggcctcatcctggccaacggcgaggattgggagcgccatcgcaaggttgtgcacccagcgttcaaccacnacaagctcaaggttaattagttactccctc

SEQ ID NO: 40508 - DNA, 101 bp, rice(Oryza sativa)
  misc_feature (71): n=t or g
ggaagagatttgcgcatgttgcatggtgaaggcgggggtcatggaggatgaggtcgcgccaggacctacanaagatggcgaggcacatgagcaccgagaag

SEQ ID NO: 40509 - DNA, 101 bp, rice(Oryza sativa)
  misc_feature (71): n=t or c
gccaagtcatctgtattgctgccttcatccaccttcttctgacgcttactgtctagtgatgttgaactgtnctcttccttactgtttgactcatcaacttc

SEQ ID NO: 40510 - DNA, 101 bp, rice(Oryza sativa)
  misc_feature (71): n=t or c
tgccttccaaacctcagttatgtacaggttgaatacatctgatggcgtacaaaatagtgaacgctctccanggcacatccataaaccagagttttcaccat

SEQ ID NO: 40511 - DNA, 101 bp, rice(Oryza sativa)
  misc_feature (71): n=a or c
tgaatggttgaaggagaaagatctgccgttgggtgtttcgctggaggaaaaaactttgtgcaggctagcanatggcccaactagccttgtgatctcatggc

SEQ ID NO: 40512 - DNA, 101 bp, rice(Oryza sativa)
  misc_feature (71): n=a or g
gctgtcgctgaattggtgggggaattagaagaggtggatgggacttctgtggctaagggggaatttgtganaatgaagattgagtgttcttgatccttttg

SEQ ID NO: 40513 - DNA, 101 bp, rice(Oryza sativa)
  misc_feature (71): n=t or c
actaaacacaaccctagccaacctaggttgactttttttttggggagtattgggccctgtttagttctganataaaaattttacaccatgtcacatcgaat

SEQ ID NO: 40514 - DNA, 101 bp, rice(Oryza sativa)
  misc_feature (71): n=t or c
acatgctgtcttctaagaaattaatgatcaggagagctcacgggaaaggaagtttaatcttgaggaaattngggctaactttgcagttacaaaaatccaag

SEQ ID NO: 40515 - DNA, 101 bp, rice(Oryza sativa)
  misc_feature (71): n=a or g
ctacgtgtcaatcgaacctaatgattgatcgatcgatggagatccacttaataagtggcaaggggtatgcnataagtggcaaggggtatgcgatttcaatc

SEQ ID NO: 40516 - DNA, 101 bp, rice(Oryza sativa)
  misc_feature (71): n=t or c
acgttaaagttcgttagcttgtcgagaatcgcaaatgatgttcctgttactggaaggccatttgttggaangaaaactcagggtgtttctacctatcaatt

SEQ ID NO: 40517 - DNA, 101 bp, rice(Oryza sativa)
  misc_feature (71): n=a or c
acatatgtaagcgtgggatagtagactccgtgatcaatgaggatactgagaatgctgaggcggaaaccacnaaggaaataatcaacaatcttagtgaagag

SEQ ID NO: 40518 - DNA, 101 bp, rice(Oryza sativa)
  misc_feature (71): n=a or g
atgcttccagatgagggatgagcccttatgtacatgcaaaagtaagaacaacatccctaattaagcttatnttcttgattgtaattgctcatagaggaagt

SEQ ID NO: 40519 - DNA, 101 bp, rice(Oryza sativa)
  misc_feature (71): n=t or g
ccaaaataaaccctccagtcacttacaggcagagtggaagactcactgacaagagcctaaattgaatcacngattagactcttccctcaagaaaagtctta

SEQ ID NO: 40520 - DNA, 101 bp, rice(Oryza sativa)
  misc_feature (71): n=t or c
ctcgccacacattccagcctgaaattttcaccaactaccaaagagttgctagtactaatagcacccagttncactgcagaatcgctccagtctctagtcca

SEQ ID NO: 40521 - DNA, 101 bp, rice(Oryza sativa)
  misc_feature (71): n=t or g
cttggtattttatgagaaagatttatctttcacccgaacgtttgtcgcaaaaatgatcttgctagttaccntgatggacgacacatttgattcccatgcta

SEQ ID NO: 40522 - DNA, 101 bp, rice(Oryza sativa)
  misc_feature (71): n=t or c
tgagtggtcaaccgggatggcggcggcgggactaaaccatggtggtgcctcgccttcagcgcgaggaaagnggcttggtgcgtggagcatagggaagacga

SEQ ID NO: 40523 - DNA, 101 bp, rice(Oryza sativa)
  misc_feature (71): n=t or c
tctgtaaggccctcaaggaattctggcttcaaatctgcagaaagagatccacgactgaatatcaagaaaanaggagaatagaggaggaggtagctacttga

SEQ ID NO: 40524 - DNA, 101 bp, rice(Oryza sativa)
  misc_feature (71): n=a or g
agcattctagttacagatgggaattgagatggcacctgcaaatcgcgcatctgcacaagtggctgaaagtnaactgtcgggctttccaccgtcggaaacct

SEQ ID NO: 40525 - DNA, 101 bp, rice(Oryza sativa)
  misc_feature (71): n=a or g
ctgaaatctactagacagagtaacaactttccaggcctagacttgtaagcatggactttacctggcatagnatgcattccgttttgcataggagccaatgg

SEQ ID NO: 40526 - DNA, 101 bp, rice(Oryza sativa)
  misc_feature (71): n=a or g
tttttaaattagcccattcaccccccccttaggcctaattgaccgtttcaatgggagattgtgtgcgtatnaaaagcggagtcaaacttggaaggagtcta

SEQ ID NO: 40527 - DNA, 101 bp, rice(Oryza sativa)
  misc_feature (71): n=t or g
aattggacatatgcagtgaaacactgaaagatggtaataagcaaggtgataataagaaaggaaagaagaantgagtcgtcgacgacgacctctgcatatat

SEQ ID NO: 40528 - DNA, 101 bp, rice(Oryza sativa)
  misc_feature (71): n=t or c
ccttcccttcagttgtgtaaacagtcttctctcaagcgtaattagtcgttgctagtgtaggagcccatttntgttaactgtaatccttctcatcttgagca

SEQ ID NO: 40529 - DNA, 101 bp, rice(Oryza sativa)
  misc_feature (71): n=a or g
tcagtggccgacaagaaagcacgacagcgtggcaacacggtgaagagtcgacgaccgacgagaaggcacanagacgcagagaagaggaggtgaggagccgc

SEQ ID NO: 40530 - DNA, 101 bp, rice(Oryza sativa)
  misc_feature (71): n=t or c
ggtgggtgatgctcggcggcggacacgaggtcgaggactccttcgacccctgcttcaccgacgcccacacngtgtcgccttcccgcacctccactccgcgc

SEQ ID NO: 40531 - DNA, 101 bp, rice(Oryza sativa)
  misc_feature (71): n=a or c
gcttgtccacttccagttcaactatgggacaactgatgcggttgctatcgtcgcactgagtagccaaaacnctggggtgatcactgtagccaatgcggtgt

SEQ ID NO: 40532 - DNA, 101 bp, rice(Oryza sativa)
  misc_feature (71): n=a or g
cgcaacgagctcactaggggaaagttgggagggggagcagccaccttgcgaccacggcccacggccttctncctcgccacctccgtgtatgcaccccatgc

SEQ ID NO: 40533 - DNA, 101 bp, rice(Oryza sativa)
  misc_feature (71): n=a or g
agatgatagggagggtttgggatcgcctaatactcgtattctgaatttctggatgcttagcaactgtggtngtgtggttgatagggcagttggtaccaact

SEQ ID NO: 40534 - DNA, 101 bp, rice(Oryza sativa)
  misc_feature (71): n=a or c
tcatgaaaccagtactcgaaggaggaggctgttgattaaaccccatgctaggcggctgtgattgcattccnctctgcgttgcaaactgagttggctgcaga

SEQ ID NO: 40535 - DNA, 101 bp, rice(Oryza sativa)
  misc_feature (71): n=a or g
tgacagttgcgaccaaggagaagaaggtgatcggatgatttccgcgatcgcttcgatccttactaatggcntgacatcgcactcgattacgaggcgaacgt

SEQ ID NO: 40536 - DNA, 101 bp, rice(Oryza sativa)
  misc_feature (71): n=t or c
aattgcaccctcccatatactttcacgtatcataggaagagtagttgccatattatgcacagtagagtcangattcagcacattttcagtagttgtttgtt

SEQ ID NO: 40537 - DNA, 101 bp, rice(Oryza sativa)
  misc_feature (71): n=a or g
gttcaagagaggaaacacaatagcaggacaggttcagaagaacgcacctctatactgtgaagtcaagattntctgtgatggcaaggaggttacaactgtgc

SEQ ID NO: 40538 - DNA, 101 bp, rice(Oryza sativa)
  misc_feature (71): n=t or c
ggatcgttttgaacggaaactaatcttgcacgtctatatataacactttgtctctggcacgtggatctgcnagacggaacccaaaacctgcgtgtctatat

SEQ ID NO: 40539 - DNA, 101 bp, rice(Oryza sativa)
  misc_feature (71): n=a or g
tttaactataaatctgcactcacacttgtccagattcaaaactgaaaatgtttaaattttgggaagggggnagtaatatttatagaaaaagttattttaaa

SEQ ID NO: 40540 - DNA, 101 bp, rice(Oryza sativa)
  misc_feature (71): n=a or g
tacatgttatctccacaatctacaataagtaacaacatagctttcttagatacatatatgctaaacttganaacaacataagctgcataacatttttaaac

SEQ ID NO: 40541 - DNA, 101 bp, rice(Oryza sativa)
  misc_feature (71): n=t or c
acctgtaacaccttaggcaatagagaaacaaactagcattttattcacacatgaagtttttgagaaactcngagaaaagattgtagcagctagagacattg

SEQ ID NO: 40542 - DNA, 101 bp, rice(Oryza sativa)
  misc_feature (71): n=a or g
tgtttggcactaggacttcttgagaagtatcagaatcatgtgaaaatatatatttctccagcgaatcgttnggcatgtattcgtaaatgagagcccgcctt

SEQ ID NO: 40543 - DNA, 101 bp, rice(Oryza sativa)
  misc_feature (71): n=a or g
tttagttaccggagtacaaagttacacacgatatctaatgccagtcgcctctgtacattgtttacagacancaacaaaaatatgagtgaaggtggagatct

SEQ ID NO: 40544 - DNA, 101 bp, rice(Oryza sativa)
  misc_feature (71): n=t or c
tcccctccaaaatacgaagattttgtggatatttactcgatttttggaggggaggagagagaggggagggngccgccccttctcagccgagaggagcgagg

SEQ ID NO: 40545 - DNA, 101 bp, rice(Oryza sativa)
  misc_feature (71): n=t or g
tggctaggatgatacacatgcaactgtttggttggttgcattagttcatcctggctagtatgagattttgnttggttggttggatgagatatacggtttgg

SEQ ID NO: 40546 - DNA, 101 bp, rice(Oryza sativa)
  misc_feature (71): n=a or g
tagtgatagtccaactcctgtgttccatagaatctacgtatgccttaatgcttgtaagaaaagattccttnctggttgtagaagagttgttggactagatg

SEQ ID NO: 40547 - DNA, 101 bp, rice(Oryza sativa)
  misc_feature (71): n=t or c
tccggtattctcagaggtgaagggagcctgcagtggtaacaacgacggcgcgtggaggtggatccggcganggggaggagcataggcgaagctcgtggtgc

SEQ ID NO: 40548 - DNA, 101 bp, rice(Oryza sativa)
  misc_feature (71): n=a or g
tccaacgtgctccggcaggcagtgtgacagtgtttgatcggcaagaacgaacactacatggcagtgcctcngttgcatgataattgtaacgagcttaagtg

SEQ ID NO: 40549 - DNA, 101 bp, rice(Oryza sativa)
  misc_feature (71): n=t or c
ccctctccagacgctattgtaatactgggtctatccgatggaacaggacaatccgccagtacttcaacatntgaacctacatccaagatagcaggtgctcg

SEQ ID NO: 40550 - DNA, 101 bp, rice(Oryza sativa)
  misc_feature (71): n=t or c
gtgtccacctcgctaaggttgtgttgttccccctcctttcctaacttagctccttagttttctatgcgcangctttccaaactactaaacggtgctttttc

SEQ ID NO: 40551 - DNA, 101 bp, rice(Oryza sativa)
  misc_feature (71): n=t or g
catttaaggtgtagaatctgaccattattgggaagctgaacatgagctggcgccaatgtgttatatgaggngggtgtgctaggcacagccaacccatgtta

SEQ ID NO: 40552 - DNA, 101 bp, rice(Oryza sativa)
  misc_feature (71): n=t or c
gaatgggttctacctctacccatatctatgccttacggacatagataacctagtgggtacctgatgggttnttaataacataatgaataatatctctataa

SEQ ID NO: 40553 - DNA, 101 bp, rice(Oryza sativa)
  misc_feature (71): n=t or c
agatttttgagatcccttaaccacaaagccagaaacgtatacctctaaacttacacaaacactcaagatcntatggcagtatatatatatatatatatata

SEQ ID NO: 40554 - DNA, 101 bp, rice(Oryza sativa)
  misc_feature (71): n=t or g
ctccgtaggaaggctgcgaccttgacaattcagacctattaccgtatgcattttgcaaggaaaaattatanagatctctgttctgcatcaactactgtcca

SEQ ID NO: 40555 - DNA, 101 bp, rice(Oryza sativa)
  misc_feature (71): n=t or c
tatgtgaaaataaggatttaaatcttggtgtgcaaagtcatacacccacgacgttgtgcagctcatagatnccatctcatcttccaccaccctccacccat

SEQ ID NO: 40556 - DNA, 101 bp, rice(Oryza sativa)
  misc_feature (71): n=t or c
ttaaccatggaacacagcctcctacctgaagttctgcccactatccacgccctcactcatcacagtgccanggggacccgccccaatccacctcgccgccg

SEQ ID NO: 40557 - DNA, 101 bp, rice(Oryza sativa)
  misc_feature (71): n=t or g
tgaacttattcctacaaggattggaagcgtaccaaacccaaaggcctggaaattctgaagatctggattangaagcctcgtagcgaagtggttccaccatc

SEQ ID NO: 40558 - DNA, 101 bp, rice(Oryza sativa)
  misc_feature (71): n=t or c
gttttgattttcgttggtcgaattttcagggtgttacatacggcaacacatgcttgcggctcaaagtaganagaagagctacgccgatgtcagaagacggg

SEQ ID NO: 40559 - DNA, 101 bp, rice(Oryza sativa)
  misc_feature (71): n=a or g
aagtatatatggtgtagagggaaagaaaataaatgaaatctggttccgacttagaagtcaataggaaatcncagtcagtatgttttattttaaaacatagg

SEQ ID NO: 40560 - DNA, 101 bp, rice(Oryza sativa)
  misc_feature (71): n=t or c
catctgctaccatgtcgaggaccaggatgaactcccaataacggttgtgggtggttgccgccttagtaacngtcataactgccctataaaagttgtccatt

SEQ ID NO: 40561 - DNA, 101 bp, rice(Oryza sativa)
  misc_feature (71): n=a or c
catattatcctgagggattgcacaagtgggctactgcactgtccaaaaagtcatggtgatgcaaaaccaanctccataatattttcatcttcagaagattg

SEQ ID NO: 40562 - DNA, 101 bp, rice(Oryza sativa)
  misc_feature (71): n=t or g
acgaagtcaatatatatatgctcctatatatgcatggtagaagagcaaagaaaaaacagttaataataccnagcaaattgctaccacgggtaaagctttta

SEQ ID NO: 40563 - DNA, 101 bp, rice(Oryza sativa)
  misc_feature (71): n=a or g
aaagttcagcggcaccggatctaagatccacattgccgcataagaggatgatgacattattagatcagagnttggcagcgatcctgagttgggagggatga

SEQ ID NO: 40564 - DNA, 101 bp, rice(Oryza sativa)
  misc_feature (71): n=t or c
cgcgtagcgggggcaatggggacctcgtggcgaggctgcagggcggaacaatgcagtggcgatgacttcgnggtggggcgcacatgcgaggtctgccggat

SEQ ID NO: 40565 - DNA, 101 bp, rice(Oryza sativa)
  misc_feature (71): n=a or g
aagtctgttagcatcctcgtgttaatcttgctggggtctatgcaccaagtattgaaagtaccctccctacnggccttttgaatctccattctacaacaaga

SEQ ID NO: 40566 - DNA, 101 bp, rice(Oryza sativa)
  misc_feature (71): n=t or c
ggctaccggtcgcgctactgccgaggaagtgatcccagtactcctccgggtcaacatcttctgaggccacnacgaaggtgaacgtaggagcagtcccctcg

SEQ ID NO: 40567 - DNA, 101 bp, rice(Oryza sativa)
  misc_feature (71): n=t or g
aagaaagtccttattctgctcaattgcgaaggtgagacggccaagcaggttgaagaagtggtggtggcatnggagcataccgtccatgctcaccccaaccg

SEQ ID NO: 40568 - DNA, 101 bp, rice(Oryza sativa)
  misc_feature (71): n=a or g
agatggatatgggtgtggtcatggccgtgtttccggtttgcattcaacgatcgagcctacaaacgttgccnctgctagccgcggacacggaagtccattga

SEQ ID NO: 40569 - DNA, 101 bp, rice(Oryza sativa)
  misc_feature (71): n=t or c
gcttggtacgtacgtatgttgtattgttgttcctcctatgtagagctctgctctgcttccttcgtagtgantgctctgccgtatccttcgatggaagtaaa

SEQ ID NO: 40570 - DNA, 101 bp, rice(Oryza sativa)
  misc_feature (71): n=t or c
accatggaggcgaagaaactagtcggcatcataaaagataggtattagtgaagataaaggtgtccagcagngacgacggagttgtgcagccatggtggcga

SEQ ID NO: 40571 - DNA, 101 bp, rice(Oryza sativa)
  misc_feature (71): n=a or g
aacatgtataatgcaacccttagccaaaagcctgaaacataaactcacctttctctccagttgcttgtcanaagaaagccatgccttcgctgtgagaaggc

SEQ ID NO: 40572 - DNA, 101 bp, rice(Oryza sativa)
  misc_feature (71): n=t or c
cactcacctcacctctgcctctgctcttcctccaagaacctaaccacgcccaccgcccaccacggtggctngccggcgccggccgccgcggatcacgttcc

SEQ ID NO: 40573 - DNA, 101 bp, rice(Oryza sativa)
  misc_feature (71): n=t or c
cataaggcacgatgggttgttcggggttattctcaacaacatggcattgattatgatgagacgtttagccnggttgttaagccagctactattcgtgttgt

SEQ ID NO: 40574 - DNA, 101 bp, rice(Oryza sativa)
  misc_feature (71): n=t or g
ttggtggagctgcagctttggagttgatctttcaagagttattaagaagccactggctagtggccgctaanggagtgagcatcttggaactgcaggtttga

SEQ ID NO: 40575 - DNA, 101 bp, rice(Oryza sativa)
  misc_feature (71): n=t or c
ggatcagtgttggatgcagaaatggggctctacatcgacaacccttataccgccaagtactccgacaacgngggccggctccgctttcgctgtcttcccat

SEQ ID NO: 40576 - DNA, 101 bp, rice(Oryza sativa)
  misc_feature (71): n=t or c
actggactggatatcctcttcttttgggtagcacggatggtgatgatgggaatgctacttggtggtgatgngccatttcagaaggtaatatttaggttatt

SEQ ID NO: 40577 - DNA, 101 bp, rice(Oryza sativa)
  misc_feature (71): n=t or g
tttcttttccgggatagacgtcggcttgccattcagggtcgtggattcgtgtgcaaacttttcgttgaggncggcaagcatgagtgctagcttggttgcat

SEQ ID NO: 40578 - DNA, 101 bp, rice(Oryza sativa)
  misc_feature (71): n=t or g
acctacacaaattgttgtcacacagataattatcatccatatatatccatccatccaaacgtacatagaancatgaagctcgactcgttcatggtgacacg

SEQ ID NO: 40579 - DNA, 101 bp, rice(Oryza sativa)
  misc_feature (71): n=a or g
tattatatgatatatatatggttcataggtagcgggttagaatggtcaaaattttgaattggatgtgattnatgttacaaaatgtacttcaaaatgacaaa

SEQ ID NO: 40580 - DNA, 101 bp, rice(Oryza sativa)
  misc_feature (71): n=t or g
gcagatgagttcattcgatggttgagatcattctatgcgtatatggctccccacgtgtctaaaaaccctcnagctgcgtatgtgaactacttggaccttga

SEQ ID NO: 40581 - DNA, 101 bp, rice(Oryza sativa)
  misc_feature (71): n=t or g
aaagtgaataactcaacaggaaattacagaaaaaaattctaaaatggaaggaaagagtgtcatatgaaaantttccttgaagctactaccaaaaagggaag

SEQ ID NO: 40582 - DNA, 101 bp, rice(Oryza sativa)
  misc_feature (71): n=a or g
acgctcgtcctcaattttctccgaggtttgaatgaaaaataccacaatctgcagaccattcttcctatgcnacgcccgttcccgacgttcctggaggcatg

SEQ ID NO: 40583 - DNA, 101 bp, rice(Oryza sativa)
  misc_feature (71): n=a or g
cgaggccacgtatggattgtcatacggcatgggttgttaggcagaacgaatgacttcatgtgtcttacttngtcccaccattttccacatactctgcctag

SEQ ID NO: 40584 - DNA, 101 bp, rice(Oryza sativa)
  misc_feature (71): n=t or c
gctacggtagctctggtgtgtcccatggaaatgctggtgactacagaagctctgatgtttacaatactacnaacacctatggcgctggcaacttcagccat

SEQ ID NO: 40585 - DNA, 101 bp, rice(Oryza sativa)
  misc_feature (71): n=t or c
agatatctttgcctctatatctattataaaaattgataattttttggttcgtcacatcttttcttttgtcngtctttcatttccgactctattccctgttc

SEQ ID NO: 40586 - DNA, 101 bp, rice(Oryza sativa)
  misc_feature (71): n=a or g
tccatttaaaggttcttgtaccaatagaaaccagtaatggttgttcttattatgattttattacctcgatntaattggttaagttcaataaagtgttttca

SEQ ID NO: 40587 - DNA, 101 bp, rice(Oryza sativa)
  misc_feature (71): n=a or c
atgccccatcctcttgtttttattggtgagggaaattctcgatggcacgccatcgtcatcatccctcgcgngtcattgccatcctcccccaacctcccagc

SEQ ID NO: 40588 - DNA, 101 bp, rice(Oryza sativa)
  misc_feature (71): n=t or c
gactgggggtgatatgggctcctctgctactgctgcagtgctgaacctctgaaggattcccggcaacaatncttgtgtcccatctgcaagcagaaaatgca

SEQ ID NO: 40589 - DNA, 101 bp, rice(Oryza sativa)
  misc_feature (71): n=a or c
agtggtcacatgaaaactagagttaacctcccttggtagtgtaaaacaaggtcgtcttttgccgctccagnactactacccgttgtgtgaccagaccttaa

SEQ ID NO: 40590 - DNA, 101 bp, rice(Oryza sativa)
  misc_feature (71): n=a or c
tgaactatgtccgccatatgttgcttcccgctggtgcttccaagtttggttaattttccttcacattctgnatgtatgtaatattcatatggagaatttgt

SEQ ID NO: 40591 - DNA, 101 bp, rice(Oryza sativa)
  misc_feature (71): n=t or g
tcagtctcaagtccaacatcagaaggcatgacattgtctgctaggaaattctgaaccaatcagacccaaanaacaaacggtttaatgctaaacatactaca

SEQ ID NO: 40592 - DNA, 101 bp, rice(Oryza sativa)
  misc_feature (71): n=a or g
gtgcattgaaaaattgggatggtgagggctcgaacaatgtagaagttgtgtcggggtatatataaagaatngcaatgaattgaacaagatagaattcaata

SEQ ID NO: 40593 - DNA, 101 bp, rice(Oryza sativa)
  misc_feature (71): n=a or g
gagcaggaacaagagatggtttcggcagcaaaatcagcatctgcaaatgatgaggagcataaggtgcatgnagtacatcaaataattgctgatcacaatgc

SEQ ID NO: 40594 - DNA, 101 bp, rice(Oryza sativa)
  misc_feature (71): n=t or c
aggcacacatcaaacaggagtaatatttctattgaccttaatttctatctccagtttaggattgaacggantggcgcatgactgcattgacatgtaaaccc

SEQ ID NO: 40595 - DNA, 101 bp, rice(Oryza sativa)
  misc_feature (71): n=t or c
caggcttgcagttgttgcatggtttccaagaatttgcctttggtactagctctctcttccttgggttacanacatacttgtgggagggagtacgttcagat

SEQ ID NO: 40596 - DNA, 101 bp, rice(Oryza sativa)
  misc_feature (71): n=a or c
aagaaaagcccagaaggccgagagtatggttatacgctagcacagtgacatccacacaaaggaataagttnatctgaggtcccttaacttgtcaatgaatc

SEQ ID NO: 40597 - DNA, 101 bp, rice(Oryza sativa)
  misc_feature (71): n=a or g
gttcgtggtcaactatatattggccagtaaacggaaacgtgaaaattgcacttagaagaacggctcatgcntgtgagtaaatctttagtcccgtcatccca

SEQ ID NO: 40598 - DNA, 101 bp, rice(Oryza sativa)
  misc_feature (71): n=a or c
tgagggaaaaggttcatcatccgaggaaaaattcatgtcactgtcccatctagagaggttacacatacaanactgctacaatctactggagatcccaatgc

SEQ ID NO: 40599 - DNA, 101 bp, rice(Oryza sativa)
  misc_feature (71): n=a or c
agagagggaggaaggagatgatgtattgaccggtggcccccgccatttttattttttaatttttgcgtagntgacaggtgggctcacggttattattattt

SEQ ID NO: 40600 - DNA, 101 bp, rice(Oryza sativa)
  misc_feature (71): n=t or c
ggccttgggagagtaagagttgctgtttttgctgttgatggctgcatcaagggcctcagttaggtgcttgngacaatcggagccatcagaatcgcctcgac

SEQ ID NO: 40601 - DNA, 101 bp, rice(Oryza sativa)
  misc_feature (71): n=a or g
atgcctcaaaattgcatagagccgttgtagacttgtgatataatctatagattcatatggtagcacttggnacatttaaaccagcagaacgtaaagagtgg

SEQ ID NO: 40602 - DNA, 101 bp, rice(Oryza sativa)
  misc_feature (71): n=t or c
aattctcatccccatgaaaagcttggaggattttttttgaaagatttgtgagatagttgactgtttatgcntagctatgttatagagacaaggataatgat

SEQ ID NO: 40603 - DNA, 101 bp, rice(Oryza sativa)
  misc_feature (71): n=t or c
aaaacaattttctcgatatatgatggaaccttgcgttgaccactccagctataactagaaaaaggacttgnattatttttgttctccttgttttcaccaga

SEQ ID NO: 40604 - DNA, 101 bp, rice(Oryza sativa)
  misc_feature (71): n=a or c
gtcatggggatgtcagtgttgaatctgtaggagaaggtgaacatgtctctcggattgatcttctccttcgncttcgacttgttgccataggaaggagtctt

SEQ ID NO: 40605 - DNA, 101 bp, rice(Oryza sativa)
  misc_feature (71): n=t or c
tgtctcaggtcatatatgcatgttagtactccagacgtcctaattagatgtcattttaaccttttacttancacgtttggccatttattttatttaaaaaa

SEQ ID NO: 40606 - DNA, 101 bp, rice(Oryza sativa)
  misc_feature (71): n=a or g
gtcatataaaaactgacattttctagctagttttaacaagctaccattttcaagtaacagagcataactcnctggttctaacaaaaatttggttcactaca

SEQ ID NO: 40607 - DNA, 101 bp, rice(Oryza sativa)
  misc_feature (71): n=t or c
tgcacgccaatatattagaagaaaatagagttttagttatacgacataaccgactaggtggccattgctanaggacaagaaaacagagttttagttatatg

SEQ ID NO: 40608 - DNA, 101 bp, rice(Oryza sativa)
  misc_feature (71): n=a or g
gttgtcgtatgtataagtagttgtaaggtttttgtagtgtgtcgacggcatgaaaccaaaagaaaagtgcncaaaagattacaagatgtggataactactg

SEQ ID NO: 40609 - DNA, 101 bp, rice(Oryza sativa)
  misc_feature (71): n=a or g
agagggagaaacgacaacgacgagctctagtggtgaacacaactggatgagtgtgtcaaaactagttcccngacgagaggattctgttttccttgaacacg

SEQ ID NO: 40610 - DNA, 101 bp, rice(Oryza sativa)
  misc_feature (71): n=a or g
agacgatcggcccccttgagctccggatcctcagaaagggaaccttcaaggagatcctagatcatttcctnagccttggtggtgcggtgagccagttcaag

SEQ ID NO: 40611 - DNA, 101 bp, rice(Oryza sativa)
  misc_feature (71): n=t or c
tgtgcgtgacttcttaagacgaacatcatctgggtttttctcgctgtcaccactgattctacctttatccnttgtgccatcattattgctcacaatgccat

SEQ ID NO: 40612 - DNA, 101 bp, rice(Oryza sativa)
  misc_feature (71): n=a or g
actcccctttcaattatcttcatttctgcatcaccaaccttagtatgtattgttccccattctaccatgcntttcagttccgcagtagaagtaaaaatagt

SEQ ID NO: 40613 - DNA, 101 bp, rice(Oryza sativa)
  misc_feature (71): n=t or c
cttgtgtggatgtggtggtgcatgcgcggtttaatctgcaggttgtatctgtaagcgaaacaatgatgaanggataatgaaagttataggtgaagtgaata

SEQ ID NO: 40614 - DNA, 101 bp, rice(Oryza sativa)
  misc_feature (71): n=t or c
aacgccgacatgggcaaggaggaggagaacccgttatgtggtgcatcgaggcctgaggaccctctcgatcnggcagcaacattactctatggcgcttgatc

SEQ ID NO: 40615 - DNA, 101 bp, rice(Oryza sativa)
  misc_feature (71): n=t or c
gcggtctgcctcgtcggagcggcacagcggttcgagctcaccggaccgtctattgcgtggaatgtgctagngccgcagtacccgcacgccgatctcttcct

SEQ ID NO: 40616 - DNA, 101 bp, rice(Oryza sativa)
  misc_feature (71): n=a or g
cttaactgtgggagtcgttccacatgcatcctccaatccagctgatctggattgaataggtttctttttcncagtatctctctttgaaccaggttctctgg

SEQ ID NO: 40617 - DNA, 101 bp, rice(Oryza sativa)
  misc_feature (71): n=t or c
ctacgtttttcctattcttttttttttcattcttacggttcaagagtccttagattggtttttcttactanggagggagtaggttactatgtctggataga

SEQ ID NO: 40618 - DNA, 101 bp, rice(Oryza sativa)
  misc_feature (71): n=a or g
cttatatacttcgttgagctctgcgagattatgcaaatgaggtgctgatgaattcgtggctagtgatttcnttacttgtttatgataataattgattaatg

SEQ ID NO: 40619 - DNA, 101 bp, rice(Oryza sativa)
  misc_feature (71): n=a or g
actatactttaagcatgagctgagcagaaacatgagccagagagatccaacaaggattacctttacaaatngcagcctcagcatctttttgcagtccacac

SEQ ID NO: 40620 - DNA, 101 bp, rice(Oryza sativa)
  misc_feature (71): n=t or c
tggacattaagacatgtgcttcactggttgcctgacatgcccgctctgttatggcccataggatatatagncttcctcatatcctctttccaatttgcaca

SEQ ID NO: 40621 - DNA, 101 bp, rice(Oryza sativa)
  misc_feature (71): n=t or c
tttgaagacaatagaaagaatttcataagaaataaaattagacgcgatttctgcattaatcagggatatanatagcctagaaaagaaaataaaaacctaaa

SEQ ID NO: 40622 - DNA, 101 bp, rice(Oryza sativa)
  misc_feature (71): n=t or c
ggaggtgttttctagaattcgatctagaatcacctttgcttcaggcggagttttgtgcatgaatgatcctncggcaatgacatctagatagaatgcagatt

SEQ ID NO: 40623 - DNA, 101 bp, rice(Oryza sativa)
  misc_feature (71): n=a or g
ttgaagtctgttggagctttctgtttaaatagctgatactgctgaaggtacctgccaaatgaactacgtgngggcatgatgagcttttctctgggactggc

SEQ ID NO: 40624 - DNA, 101 bp, rice(Oryza sativa)
  misc_feature (71): n=a or c
agatcagttggttttgagttttaccgatcaggtgagacggtcagtaggtacttcaatgctgttctggattnacttgtttcaatttctaaagaactgatata

SEQ ID NO: 40625 - DNA, 101 bp, rice(Oryza sativa)
  misc_feature (71): n=a or g
atcataggactaattaaaagcactcgcataactactaattaagtagtaagctcctgccacaagctatgccnattcgatgagcccgctcaacatcatatcga

SEQ ID NO: 40626 - DNA, 101 bp, rice(Oryza sativa)
  misc_feature (71): n=t or c
gtctagcgagttcatagattagagatcaatcgattgctgaagtggtgatggatcaccattcttgctcaacngcacaacgagcaaatccagatgaacaaggg

SEQ ID NO: 40627 - DNA, 101 bp, rice(Oryza sativa)
  misc_feature (71): n=a or c
tttcaggtctattctgccaccagtacacacaattaagcaactctgatctggtccgagcaaatatactctgnactggtccaccaccaacaggttcagggtcg

SEQ ID NO: 40628 - DNA, 101 bp, rice(Oryza sativa)
  misc_feature (71): n=t or c
tgctagggcatcgctaccgaggtatacaaaccagataaaggatctgaggtaggatcggataggaaacttangccgggaggctgtaatgaaaaggaagtact

SEQ ID NO: 40629 - DNA, 101 bp, rice(Oryza sativa)
  misc_feature (71): n=a or g
cctcaaggtaagctatgactaagccgtgctcgaatgctgctctgcttccccgtgcgttcgagtgcgacacncgaggctgacttttttgagggtgcgtgtgg

SEQ ID NO: 40630 - DNA, 101 bp, rice(Oryza sativa)
  misc_feature (71): n=a or g
caacttaattcttctaagagaaagtacaagctagctggttaatcatattgttaattttggcctcaattagntctagaattaatcaaggcacagctagcggc

SEQ ID NO: 40631 - DNA, 101 bp, rice(Oryza sativa)
  misc_feature (71): n=t or c
aatatatctgcaggtagaccaattttgctgaacactcatgccgccgcaaatttgttgaacagcaatatttncttttatagtaaaaagtacgaatttaccta

SEQ ID NO: 40632 - DNA, 101 bp, rice(Oryza sativa)
  misc_feature (71): n=t or c
tattaaaaagactgagatgtgagtgttgtatactgcagaaactaaggagattaaggtgatactactactantactactatatataatccgtgcccattgtg

SEQ ID NO: 40633 - DNA, 101 bp, rice(Oryza sativa)
  misc_feature (71): n=a or g
tacacgtactactcttaaatataaggtgttagagaaaggtacataaggagattatcgccctcattggatgncaaatgctttggctgataagccatttaagc

SEQ ID NO: 40634 - DNA, 101 bp, rice(Oryza sativa)
  misc_feature (71): n=t or g
agcaaattttcgttttgttaaaattttagttgcatttgtgcagatggaagtcactgaaacgtcagttggtnaatatgagaacacacagcgatgccaagggt

SEQ ID NO: 40635 - DNA, 101 bp, rice(Oryza sativa)
  misc_feature (71): n=a or g
cggatgcagcgtcgccgtcgaggatgatgacgaagaattgctgaagtttctgcaggcgatggtgaggggcnaggaggtggagggtgatggcgaccacgcca

SEQ ID NO: 40636 - DNA, 101 bp, rice(Oryza sativa)
  misc_feature (71): n=a or g
gagcgtcagtttgaagttggtgatatggtctttctgaaacttcagccctatgttcagatgtcagtagttcnacgctcttgtcaaaaactctgttttcgata

SEQ ID NO: 40637 - DNA, 101 bp, rice(Oryza sativa)
  misc_feature (71): n=t or c
agtgaataattccatagcgggccatctatttttatccggcctatacccagcctgtaagctgtaagtcgtanccgctaacctatctgatatgagcaattcta

SEQ ID NO: 40638 - DNA, 101 bp, rice(Oryza sativa)
  misc_feature (71): n=a or c
gctcctcttcctaaccaatctcctctccctctttcctttcttcccttttcctcctctctcaccatccaacngtcggctgttgctgcttcgatgttccagtt

SEQ ID NO: 40639 - DNA, 101 bp, rice(Oryza sativa)
  misc_feature (71): n=a or g
cagtttggccagccatatggcttagctatccatttagtaaaattgttggagtttgtttttgtctataattnttaaattttaatttgaaaagtgaaatagtc

SEQ ID NO: 40640 - DNA, 101 bp, rice(Oryza sativa)
  misc_feature (71): n=a or g
gacctcctcggggctgagttggaaccaatgcttctgtgctgttgcattttcgatggcatggccaaaggcancacggtttaggatcacggcttgctctggcc

SEQ ID NO: 40641 - DNA, 101 bp, rice(Oryza sativa)
  misc_feature (71): n=a or g
cctaggccgtcttctttgtcctattttcccaatttacctttttctttttcactttcttattttctaaaccnctaaatggtgaattttttcaaaaagaaatt

SEQ ID NO: 40642 - DNA, 101 bp, rice(Oryza sativa)
  misc_feature (71): n=a or g
agtagttcattaacacagtttggtcagattgatgcctatgcgaacacctaacatgctacagaaatctggangcaaacgtctcacaaataattccagataat

SEQ ID NO: 40643 - DNA, 101 bp, rice(Oryza sativa)
  misc_feature (71): n=a or g
cctagatttgggttggctaatctgaaaggaattctattggtctggccaatgatgaactcagtaggatcaangttgccgattgggccgagaaagtaatggtt

SEQ ID NO: 40644 - DNA, 101 bp, rice(Oryza sativa)
  misc_feature (71): n=a or g
actatccgagcggatcgaaacggcgaggtcttggttgtggatactcaccatgggaaagaggggaagagatncgtgctagggttttcgtcggagacgcctcg

SEQ ID NO: 40645 - DNA, 101 bp, rice(Oryza sativa)
  misc_feature (71): n=t or c
aaagtatttaaagcgaatgtttataagtcatagaatgaaagatgagtattactgtattaggggggagggangggtgatcgctaggtggagagggaagcaat

SEQ ID NO: 40646 - DNA, 101 bp, rice(Oryza sativa)
  misc_feature (71): n=a or g
gcgtttgattagagtgacaattatatgtcgtcgaaagtacgttttgtgatggaagtaacatcatccagtcnctataagtgggacccatatgtcatcagttt

SEQ ID NO: 40647 - DNA, 101 bp, rice(Oryza sativa)
  misc_feature (71): n=t or g
tctaaaatcctcaaatcgtcattctcattttaaagtgaacgtttctcttttcttatagagatagagatagnccagaaaacaaatgcaatatatataagtaa

SEQ ID NO: 40648 - DNA, 101 bp, rice(Oryza sativa)
  misc_feature (71): n=a or g
tgcatttatgttcaatctaaatctagttttatgatcgttattttatacgacttatagccgattcgatccancatcggctgatacgatacaacatcggccat

SEQ ID NO: 40649 - DNA, 101 bp, rice(Oryza sativa)
  misc_feature (71): n=t or g
cgacaaggaggccggcgagatcccgatggcatatgtggtcaagaaacaaggcagcggccatcttcaggaanatgaagtcatttcctttgtacagaacaagg

SEQ ID NO: 40650 - DNA, 101 bp, rice(Oryza sativa)
  misc_feature (71): n=a or g
cctgaggttctgcttgctagagagattagttgccatgcgtacgaatgacctcgctcactctgtggtatctngcgaagtgcaagactccagccgccgccgga

SEQ ID NO: 40651 - DNA, 101 bp, rice(Oryza sativa)
  misc_feature (71): n=t or c
ctagccccaatgatgccaaatctagccaccgatgactgtcacttaaagctctccctccggtcttagccacnactggagaaaccgtttgtaatcccggttgg

SEQ ID NO: 40652 - DNA, 101 bp, rice(Oryza sativa)
  misc_feature (71): n=t or c
cgctttcgcccccaacacattaatgcatggttgctcaatcggaactgcttgcatcgccacctctctcatangggagagaaaacccacacgggatccctcgc

SEQ ID NO: 40653 - DNA, 101 bp, rice(Oryza sativa)
  misc_feature (71): n=t or c
gtccttcaaccaatttgcaaaatcggtgtaaccgaggtcacatgatagtataacatccagttttaactaangtgacgagttgactattatcaatctggttg

SEQ ID NO: 40654 - DNA, 101 bp, rice(Oryza sativa)
  misc_feature (71): n=t or c
aaaaaggagggtattccaaaaaattcaatcacattgcatctcacacacgccacaagccaatggctgtgttnagttccacgctaaaattagaagtttgaaga

SEQ ID NO: 40655 - DNA, 101 bp, rice(Oryza sativa)
  misc_feature (71): n=t or g
agaaccaggttagtcatagcttagccaataaagcctggtctgaggttctaaatgaattctggctggaaggnggttgtaattgttggaaatatggtcatgaa

SEQ ID NO: 40656 - DNA, 101 bp, rice(Oryza sativa)
  misc_feature (71): n=a or g
cgtgcatgcaggtggatgggatgccatcggggactactactacacccgtctaaaattaggatatctttttnagtttttacttataacatttgactattctt

SEQ ID NO: 40657 - DNA, 101 bp, rice(Oryza sativa)
  misc_feature (71): n=a or c
gtcgtttatggggaactggtactctaagaaccagtgttattgtggtgaccccaatgagtggaattctattntgtagtttgcagtcaaagtttatcaatcaa

SEQ ID NO: 40658 - DNA, 101 bp, rice(Oryza sativa)
  misc_feature (71): n=t or c
acgacaagtagatgacagtagtacataacccagaaagcacgcgacatcacgtatgaagaacatcacatgancaacaatttcatagatgaagatcgaacatc

SEQ ID NO: 40659 - DNA, 101 bp, rice(Oryza sativa)
  misc_feature (71): n=t or c
agcaccgtaatgggtccctaacacgtttgatgttgtacagtttgatgacagttccaatgataaggaaggtncaagacgtggcagaggtcgtggacgtggtg

SEQ ID NO: 40660 - DNA, 101 bp, rice(Oryza sativa)
  misc_feature (71): n=t or c
gactcaagtttgctgtgctggagtctcatgtgctccagaaatgcatacatcagcatagtgaaccactgaanagtttgttttattgtgtcatttcgggtctc

SEQ ID NO: 40661 - DNA, 101 bp, rice(Oryza sativa)
  misc_feature (71): n=t or c
ccctaggtttcccgctaaaatccatgcctcgtccctttgttaacatcttcttttacgttgatgaataccantcaaggtaaagaaaccaaacgccttgattg

SEQ ID NO: 40662 - DNA, 101 bp, rice(Oryza sativa)
  misc_feature (71): n=t or g
cccggccgacctgtacggcactttagaagggaaactggcgaggaagaaagccatgccatcacctctgcatntaccgttgccttcgatgggcctgatggcga

SEQ ID NO: 40663 - DNA, 101 bp, rice(Oryza sativa)
  misc_feature (71): n=a or c
aaagttttaatggaacggaaaagtcggatgtttggtgaaaaattttgcaactgaacagggccagaagcggngcacctgcacgaggcgaggacagaggaatg

SEQ ID NO: 40664 - DNA, 101 bp, rice(Oryza sativa)
  misc_feature (71): n=t or g
ttctttaatgtgataacagcagttgtaaaaatgccctttctgatgcctttttgtatttgtgtattgaggantagacaatcttcaagtgccaatgtttccca

SEQ ID NO: 40665 - DNA, 101 bp, rice(Oryza sativa)
  misc_feature (71): n=t or g
gtcggacctttctggatataataggattctttttcttaccgcgtcgcatataattcatttttctttgtaancagacttttttttatttttttcgccctttt

SEQ ID NO: 40666 - DNA, 101 bp, rice(Oryza sativa)
  misc_feature (71): n=a or g
ttgaaatgtggagtggaagcgctcgagtcaggggcaaaaccttgtgacctaatgaaactcattaagtatcntcccctagatcctttcacatttacaaagtt

SEQ ID NO: 40667 - DNA, 101 bp, rice(Oryza sativa)
  misc_feature (71): n=t or c
tctgaacacattgtccatgcaccaattatgctgtacattcagactagaaaaaagatagaccgaccgagcangcagttctcgtctaggacaggacccaggag

SEQ ID NO: 40668 - DNA, 101 bp, rice(Oryza sativa)
  misc_feature (71): n=t or c
tgttgtgcaagttccaattcagaattacaattcgctacaacacggacatctcagtaactagaaggtgattntgttcagcttttttcaaggtcagctgtatg

SEQ ID NO: 40669 - DNA, 101 bp, rice(Oryza sativa)
  misc_feature (71): n=a or g
atgaccaagctattaagttaataaagcagtttattcagcaaggcaaggaaaaaaaaacataagaatgatgntcaatatgtaattcaaactcttgaaaaact

SEQ ID NO: 40670 - DNA, 101 bp, rice(Oryza sativa)
  misc_feature (71): n=t or c
gcgccggagatagagcaattaggaggtggccaaagggatttacctacttagagaagtttaatagtatagcnaactattagctttaaataatttaaagtcaa

SEQ ID NO: 40671 - DNA, 101 bp, rice(Oryza sativa)
  misc_feature (71): n=t or g
agcttatttcttgatcaggtgtaattgttgacattgtgacatgtcagatcttcaacaatgcctgaatgcanttcattcagccatctttaacaacctttcaa

SEQ ID NO: 40672 - DNA, 101 bp, rice(Oryza sativa)
  misc_feature (71): n=a or g
ctgagaatagaagcacatgcaagggaatcctatgacatagatactgtatctaaagccactagacaaagctnccaagtatactttgattctgcagaacagag

SEQ ID NO: 40673 - DNA, 101 bp, rice(Oryza sativa)
  misc_feature (71): n=a or g
gttggagacatcaagtttgggcacttgcctctcttcccaaacctcaagcgccttgtaatagaggaactgtntggatttgccatggacggcggcttgtcggc

SEQ ID NO: 40674 - DNA, 101 bp, rice(Oryza sativa)
  misc_feature (71): n=t or c
cctatcatacatgcggaatatgagttgtcagattgtctaatccaatggctcatatcgcttccgcaacgctntgatcctgcagagcgcagacgcgcaagcgt

SEQ ID NO: 40675 - DNA, 101 bp, rice(Oryza sativa)
  misc_feature (71): n=a or g
aagtacttcagagattcacggagcctcctgatatctcttctcacaaataatgtcttcacaaattcctcccncagtatcccaaccagcttttctaaacattt

SEQ ID NO: 40676 - DNA, 101 bp, rice(Oryza sativa)
  misc_feature (71): n=t or c
tacaactgcgatgagctaaccattcctctgcagatgatagaggaatttcatgcaggtgcttctcacagggngacacgaaacatggcaggagaagaagtcga

SEQ ID NO: 40677 - DNA, 101 bp, rice(Oryza sativa)
  misc_feature (71): n=a or g
aaacactatcagccctacggatgctactggtctagccaagcatttggtgattgtatgcagaaaggcagcanacgcattcctgacgacagctggtacacgat

SEQ ID NO: 40678 - DNA, 101 bp, rice(Oryza sativa)
  misc_feature (71): n=t or c
acatgatcgtggttgacgcgacatagtataagtagctcctgtccaaattccattctcctgctttcatccanccctttgcatctttttattgcaacaggaat

SEQ ID NO: 40679 - DNA, 101 bp, rice(Oryza sativa)
  misc_feature (71): n=t or c
ggggcaaggagagaattggcttggcaagtcagtgaaggagtttctagagagattaagggagtgtaatgtancaagaaggcatatagatgcaaggatggtgg

SEQ ID NO: 40680 - DNA, 101 bp, rice(Oryza sativa)
  misc_feature (71): n=a or c
catacgattcttccatgctttctccactggtctttcatttacagttgtacttctattcttccggactttcnttttgcgcttagaacggttggatgtttgtg

SEQ ID NO: 40681 - DNA, 101 bp, rice(Oryza sativa)
  misc_feature (71): n=a or g
ggtgtggcatcagttgcttgtgtatcctcactcctcctatcagcttcggctcatccacggtgacgatgatnatgacgacgacgatgatgatagagttttgc

SEQ ID NO: 40682 - DNA, 101 bp, rice(Oryza sativa)
  misc_feature (71): n=a or g
cagtagactaacttccacacaacaaagtgtagtctgttatacattccctaacgtgccatgtagaaactaanatcatgatgcagctgcatcctggaaataca

SEQ ID NO: 40683 - DNA, 101 bp, rice(Oryza sativa)
  misc_feature (71): n=t or g
tgttggactaatgttattaacttatgtctaaaatgtagatacgaggacaagagatggataccgaggaatgngtcatcaagaccatcatctggtgctagaga

SEQ ID NO: 40684 - DNA, 101 bp, rice(Oryza sativa)
  misc_feature (71): n=a or c
tgagtagaggcggcgcgaggagaaggagaaccaagacccctatgcaacttaaaaaaaagttactacttacntgtgtgccacaaaaaagtttagagtcacct

SEQ ID NO: 40685 - DNA, 101 bp, rice(Oryza sativa)
  misc_feature (71): n=t or c
ttgaagaataactttgcaactaaacacggcgttaatgtaaaactgcttaaacgtttcgctgaaacctgaanagattttccctcactaaaagcacacagctc

SEQ ID NO: 40686 - DNA, 101 bp, rice(Oryza sativa)
  misc_feature (71): n=t or c
tgccagaattggagcatgttccagcggtcaaagcaagcacgaaaaggctaaacaatcactgctccaaatangtggatttgcgttaagcttgatcattttca

SEQ ID NO: 40687 - DNA, 101 bp, rice(Oryza sativa)
  misc_feature (71): n=t or c
gagtccagggccctagcagaaattttctttgccctgctaaataagcacaacataaacagctacgaaagcgngaaataaaccgaatggatgcgctatattgt

SEQ ID NO: 40688 - DNA, 101 bp, rice(Oryza sativa)
  misc_feature (71): n=t or g
ggtagcttgagctgcttggtgaagacaagcttcaatggaggtgagacccctacatcttggatttgtaatgnaagagatctgatagagatggttttattgtc

SEQ ID NO: 40689 - DNA, 101 bp, rice(Oryza sativa)
  misc_feature (71): n=a or c
gagttcacggattggctcacttattgggatacacccgcaccaattctctagcttgttctccacacatgtcntctcttcttggcactccatccccactccct

SEQ ID NO: 40690 - DNA, 101 bp, rice(Oryza sativa)
  misc_feature (71): n=t or c
ctaaaccctttcaaaacttatttacaaaatctaaatctttggccacgttagtcggattaacgtggcaaaanaatactgtcacattggtctatctagcgcga

SEQ ID NO: 40691 - DNA, 101 bp, rice(Oryza sativa)
  misc_feature (71): n=t or c
aattacgctctaaataattgcagcagtatgaattatatcccctaaactacaaaaccatacatattacatcncaaactttttaaaccggacgaataaccccc

SEQ ID NO: 40692 - DNA, 101 bp, rice(Oryza sativa)
  misc_feature (71): n=a or g
ttttggatggggcaccattgttcgttgattttttcgttggacttctttatcagcgacttacccacgaggcnaattggaaggctcgacatttctggagccat

SEQ ID NO: 40693 - DNA, 101 bp, rice(Oryza sativa)
  misc_feature (71): n=t or c
atcacgattgagtgctccgattacgatgatcacacgtatatacaccatccgtcccacaaagactagatatntgtgtttaacatttaaccgttcatcttatt

SEQ ID NO: 40694 - DNA, 101 bp, rice(Oryza sativa)
  misc_feature (71): n=a or g
atgctgtgccttcttgtcagtcagctagaaaacaagagtcagctgtgcttgaaaagaagttgcgtggcttnagcactgatctgcaggtatggttggaaaag

SEQ ID NO: 40695 - DNA, 101 bp, rice(Oryza sativa)
  misc_feature (71): n=t or c
aagcagctggttagtagctggcttctgagagtctgaaaatgctgggtttttcggtttatgatttctaaatnattttctagattctacgactacatattatt

SEQ ID NO: 40696 - DNA, 101 bp, rice(Oryza sativa)
  misc_feature (71): n=t or c
aaaacccaacttttccagtcaaaatacagcagtatctgaaggcactaacattggctagagaacaaggccgngtttagttccaaaataatttttcaatcttt

SEQ ID NO: 40697 - DNA, 101 bp, rice(Oryza sativa)
  misc_feature (71): n=a or g
catatattttttaaaaaaaaccttaataaataatatatctccctgctatgtgtggctcgcggctatatcantatcggtaaaaaaaaacaatatagtgcaag

SEQ ID NO: 40698 - DNA, 101 bp, rice(Oryza sativa)
  misc_feature (71): n=a or c
ctgttggaaaaaggttggccaagaaaaatctttcccatgcagctcggagcttggttgcttcacctccagcncgtacaaaagtaaccaattattttttattt

SEQ ID NO: 40699 - DNA, 101 bp, rice(Oryza sativa)
  misc_feature (71): n=a or g
atgcacccatccacaaaaaaatcaattagtatacccggcgcatactatcagctttatacaaatgacaatcnaatattgtgttactgtgttcccaaatcaga

SEQ ID NO: 40700 - DNA, 101 bp, rice(Oryza sativa)
  misc_feature (71): n=a or g
cctcctcctgttaagcggcagcacctatgggtacggccctaaggtttgcaccggccgtggcgtcttctttngccccacgatcgctctcggcctcctgctga

SEQ ID NO: 40701 - DNA, 101 bp, rice(Oryza sativa)
  misc_feature (71): n=a or g
ctcggttgacatgtggttcctccaatcgccagccaccccctttcggaaaaagaaatcgttcccaaaagtgncacccaggttcaggacaccaatcttgttga

SEQ ID NO: 40702 - DNA, 101 bp, rice(Oryza sativa)
  misc_feature (71): n=a or c
ttttacattgtgaaacggagggagtaatttaactgctcgttgtaaggctacattaaaacgagacaaatacntaaaataaaagtcaaatatgagatatccct

SEQ ID NO: 40703 - DNA, 101 bp, rice(Oryza sativa)
  misc_feature (71): n=a or c
ggtcctgctgaaaccgtgcaaccaatggagggttgaagctcaagacatcgagtctgtgggggcgaagcccncatggcgaagactatgaagcaaagatggcg

SEQ ID NO: 40704 - DNA, 101 bp, rice(Oryza sativa)
  misc_feature (71): n=a or g
aaattaattattattggtgctaattaattactcatctagctagctaattaactagagagagagagagaganagatgggttgcaagcaattgctttgcaaaa

SEQ ID NO: 40705 - DNA, 101 bp, rice(Oryza sativa)
  misc_feature (71): n=a or g
ttttttcaactcctcgtcgtgttgccgcagtacctcctgccgttgatcctcagataaatcaagcgtgacancgatgatgttctttgggtcaacagcgcttc

SEQ ID NO: 40706 - DNA, 101 bp, rice(Oryza sativa)
  misc_feature (71): n=a or c
gatctgtggaagcttgtagatgctctttcaactctctttcttcacgttctagttcacggatttccacatcnctcccgctttgggttgagctactcacactg

SEQ ID NO: 40707 - DNA, 101 bp, rice(Oryza sativa)
  misc_feature (71): n=t or c
tttctccggagatgaaataaataaacaaatgaaggcaggcaacgaatcgaaggaaaatatgtagtgcaaancatatatgtagtggaaaattgaaaactact

SEQ ID NO: 40708 - DNA, 101 bp, rice(Oryza sativa)
  misc_feature (71): n=t or c
aatctaatcacatcacaatcactgaccattgaaatctgaacatggtgcatcaaattttgcccttagaaaangtaggttgcgtttttttttcattttgtaat

SEQ ID NO: 40709 - DNA, 101 bp, rice(Oryza sativa)
  misc_feature (71): n=a or c
acttcgagggttctaagggtggttataccccagaaccagttagtagcaagtggtccatagaagttgttggnagaaagaacgagcttctcaagaactgtaag

SEQ ID NO: 40710 - DNA, 101 bp, rice(Oryza sativa)
  misc_feature (71): n=a or g
tacgcggaggcttagaatttcacacgtgggcctatctaaacattttcatggatcatgcatacattcgcgcncatattagacacacgtaatagttaaaaatt

SEQ ID NO: 40711 - DNA, 101 bp, rice(Oryza sativa)
  misc_feature (71): n=a or c
atgagctcagagctatgcagttttttgattggtgtgctttggcaggtttacaacagagcaggttcgtaatnttgataggaacaagcagtggtctagagctc

SEQ ID NO: 40712 - DNA, 101 bp, rice(Oryza sativa)
  misc_feature (71): n=a or g
gatcgcagaaggaggggtggatccatggcgatgagggagaaggcgccgcaagcttttcgatggaggagctncccagccaccttatcggggaggtcctgacc

SEQ ID NO: 40713 - DNA, 101 bp, rice(Oryza sativa)
  misc_feature (71): n=t or g
atggagagtctttaacaaatttgttgcagagtccagttcattctaacgcacataacaatagtgagaaaatnggtggtaaatttgatgatactgagtttgtt

SEQ ID NO: 40714 - DNA, 101 bp, rice(Oryza sativa)
  misc_feature (71): n=t or c
acgacagatgctatacagattgatggtatggatgcacagatgttcgaggctctacttatctttatctacanggatatgttgccaaagatggaccaagaaga

SEQ ID NO: 40715 - DNA, 101 bp, rice(Oryza sativa)
  misc_feature (71): n=a or g
agactcctattgtatttttgatatagggactgtgtaaccatcgtttgcaagtttttagcccctaaaacacncgatcgattttgtacccattggattgaaaa

SEQ ID NO: 40716 - DNA, 101 bp, rice(Oryza sativa)
  misc_feature (71): n=a or g
cctgcagattcatctcggccttatggactttgtgatggaaatctctggcacaacgggcatgtgggtcagtngaatgagtaacgtcctacgatcactcaaga

SEQ ID NO: 40717 - DNA, 101 bp, rice(Oryza sativa)
  misc_feature (71): n=a or g
atcaattgctatcattgaggttgttttgatatatcagagttgtgcttttattgtgctatcttgtggtatcntttgtgtctaggctcgcgtctctagtacgt

SEQ ID NO: 40718 - DNA, 101 bp, rice(Oryza sativa)
  misc_feature (71): n=t or c
gtttgcatagagttcttgtgttgaacatcagaaaaggttgatatactgtttgacagctgagccataccccntccataaaaaaaaatctaatcgtagcatcg

SEQ ID NO: 40719 - DNA, 101 bp, rice(Oryza sativa)
  misc_feature (71): n=t or g
ttcaaattgctcacgttgccgcagtaaatttgccgctgtcaagagaacccttatgaccaatgcgaaaatgntatgtaaaatgactttgttgcttcatgtag

SEQ ID NO: 40720 - DNA, 101 bp, rice(Oryza sativa)
  misc_feature (71): n=t or c
accaacagtaatgagaacagcagcaccaattgcgacaagggctgagatgcttagtatagttttcttgtgangtaggccatttggtgtaggctcgggttgtg

SEQ ID NO: 40721 - DNA, 101 bp, rice(Oryza sativa)
  misc_feature (71): n=t or g
gatcttggtcaaatgtaacctcaaggaaacataaagttttgtaagtcgtaactgcaggcggtgaagtgtcnagagctgatggctggcggtgattcccatgc

SEQ ID NO: 40722 - DNA, 101 bp, rice(Oryza sativa)
  misc_feature (71): n=a or c
aagattttaggaaatatgaatttacctttgtgcccctagggaatggataaggccctgagtctatcctcccncgcccgtgcggcaacgacgtgcgccctagg

SEQ ID NO: 40723 - DNA, 101 bp, rice(Oryza sativa)
  misc_feature (71): n=a or g
ctgctacttcggcgtgaaccgacggtgatacagtaaacactgtcggttctacatctttttcttacgcctanacccgcccaaaagcacgcttactcgctatt

SEQ ID NO: 40724 - DNA, 101 bp, rice(Oryza sativa)
  misc_feature (71): n=t or c
acatctatcttaaaaatggaagctaaagatgggcgtcgacctcatctaggtgctagtgcttggctagtttnccaaatgtttttcttcaggaactttgccgt

SEQ ID NO: 40725 - DNA, 101 bp, rice(Oryza sativa)
  misc_feature (71): n=a or g
aactctcgcctgatcttatactctcaccggtccatcaataccgatttattgtctttttaataatggaatgnaacattctggcatataaaatgaaagatcaa

SEQ ID NO: 40726 - DNA, 101 bp, rice(Oryza sativa)
  misc_feature (71): n=a or g
ctctctaccttctctatcttttctctccttttttctcttccccatcggacggtagtgccggtgaaggacgnggggcggcggtgccggcgtcggggacacgg

SEQ ID NO: 40727 - DNA, 101 bp, rice(Oryza sativa)
  misc_feature (71): n=t or g
tgcctaatatttttcaaatttatcagataagaaagggtagtcaaaatgaaaaacaccgaagtatgtcccgngtttgtgtcctacctaccacacgcttgtgg

SEQ ID NO: 40728 - DNA, 101 bp, rice(Oryza sativa)
  misc_feature (71): n=t or g
cactagggcaacagatcacatcacagggcagctggacaagctgaccacaagggagaagtacaaaggaacanatctgatccacacggtcagtggcgaaggta

SEQ ID NO: 40729 - DNA, 101 bp, rice(Oryza sativa)
  misc_feature (71): n=a or g
tggggtaagcataattccttcttaccaacttctttaatctatgcagtttaacacgctaaaaataaaatgcngtacttaatttaccacaaaataaatataga

SEQ ID NO: 40730 - DNA, 101 bp, rice(Oryza sativa)
  misc_feature (71): n=a or c
aaccttgacctccttgtcacccgtttggtaatcgtttggtacatcttcctcgagtcctatcagttctttancttcatcttctctgattggcacaaggtgaa

SEQ ID NO: 40731 - DNA, 101 bp, rice(Oryza sativa)
  misc_feature (71): n=a or c
gtctttgatgcgtatatgtaaagtttggagacagttaattatttctgtgctttgtgttatcaggtcaaccnaaaagacatttacttactactggttggagc

SEQ ID NO: 40732 - DNA, 101 bp, rice(Oryza sativa)
  misc_feature (71): n=t or c
ggatggcagaagaaaaggatttgccattaccgacctgacttgtcttgattataatggtatgaaattcgtanagaatagtagctttacctccaagtcctcca

SEQ ID NO: 40733 - DNA, 101 bp, rice(Oryza sativa)
  misc_feature (71): n=t or g
atagaaatcgtgtgatacctgattggaattgactgatacctgataagtaccaccgtttggacagaaacatntataaggtcctgatatcttctaggtatcat

SEQ ID NO: 40734 - DNA, 101 bp, rice(Oryza sativa)
  misc_feature (71): n=t or c
ggagtagttgtgtataaatttatccctggtgtcattcggctgtcagtttttgcaggcattacagtgtattntgatgcttggttgtttcattgtaaatttga

SEQ ID NO: 40735 - DNA, 101 bp, rice(Oryza sativa)
  misc_feature (71): n=t or c
taaacgaatatagaacgcatcctcaagaactcgcatttgtgtacgtagtatacctgttgaggatgtgaggngggcttggtgtgctcagtgaagatgacccg

SEQ ID NO: 40736 - DNA, 101 bp, rice(Oryza sativa)
  misc_feature (71): n=a or g
aacttttcttccaaaatcctcaaacccccttgctagatcgtaacatttaagaaatattttctcttcatatnaagacagttcatggaaaaacttttccaacc

SEQ ID NO: 40737 - DNA, 101 bp, rice(Oryza sativa)
  misc_feature (71): n=t or c
tttgaacctgttgtatctgctattgtggcacgcaatgagacggtcacaatgtcagaagtttgttctcaacntcttaattttgagaccaggtgacctattcg

SEQ ID NO: 40738 - DNA, 101 bp, rice(Oryza sativa)
  misc_feature (71): n=t or c
ggtgttgttttttatcggggttctgaatttgatttggatcaatgcagggctcaggtgttgtgctacatgancttggcattgctggataagggacatgaggc

SEQ ID NO: 40739 - DNA, 101 bp, rice(Oryza sativa)
  misc_feature (71): n=a or g
cttataatgcacaattcctgggttcctgctcaaagcctgaatttgacgccatttggaaatcaacagctcancctaaacagattttccttggatggttaatt

SEQ ID NO: 40740 - DNA, 101 bp, rice(Oryza sativa)
  misc_feature (71): n=t or c
tcagaactaacagctgactcagagtgatgcccatcttcaagatgtggtacattttcggttaaccgcgtaangactccactctgaatctcatcattctcagt

SEQ ID NO: 40741 - DNA, 101 bp, rice(Oryza sativa)
  misc_feature (71): n=a or g
ctcgagctctctaagtaaaggcaggctatgtggctcaagattgattaacttcatggtatcagacgaaattnacaattcttccagctttaagtgtaaattca

SEQ ID NO: 40742 - DNA, 101 bp, rice(Oryza sativa)
  misc_feature (71): n=t or c
tttttcaagtatgtcattaaacctctctaagcaattgtgattagtaaaaaactagtggctaacccgttgtngaaacatgaattcggcaataataaaagggg

SEQ ID NO: 40743 - DNA, 101 bp, rice(Oryza sativa)
  misc_feature (71): n=t or c
tcattcactcccacaacaactgaattatttgtttggtggctgggtgtccttcttcaaccgtgcatattttnattgtgctaaaaatgttatatttcctcttg

SEQ ID NO: 40744 - DNA, 101 bp, rice(Oryza sativa)
  misc_feature (71): n=t or c
cccttcgtcgaactcattcagctcggtgaataggctcagagtgccgacaggagagacaaggttgcttaccncctcaacaaagggaataagttccgcccggg

SEQ ID NO: 40745 - DNA, 101 bp, rice(Oryza sativa)
  misc_feature (71): n=t or g
ctttacgcacgtatgtacgtgcctcctctctctcctcctgcatgtctctcccttcttccttttttcagttntaaaattaaaaaaataatgaattttaaata

SEQ ID NO: 40746 - DNA, 101 bp, rice(Oryza sativa)
  misc_feature (71): n=a or g
ggatttaagccagtggaggcaaacaggagacaccaccaccactcttttttttttttttttgcgatcagtgnaagttagtattatgtatagtttctctaaaa

SEQ ID NO: 40747 - DNA, 101 bp, rice(Oryza sativa)
  misc_feature (71): n=t or c
ggtagtccatcctcccttattggaaaacaaggagacgccatagctttcaacaaagcagatgcttcaccaanatcattgttcacagaggccagtacatcctc

SEQ ID NO: 40748 - DNA, 101 bp, rice(Oryza sativa)
  misc_feature (71): n=a or g
actgcaaaaagaaattttgccaacttttttcccaaaatccctagttcataagaaaccgctgccgtccactntcgacaccacatctattccctgaaaaatgg

SEQ ID NO: 40749 - DNA, 101 bp, rice(Oryza sativa)
  misc_feature (71): n=t or c
cgctcatttcgctttatgccatacctttcttttctttcgcctattattattatgtaaattgtgttttgccntttctgcactgtctactagggtgttagccg

SEQ ID NO: 40750 - DNA, 101 bp, rice(Oryza sativa)
  misc_feature (71): n=a or g
ttttctcactatgtagctatcaactggatatcaatgtcgacaaagctgaagacgtcttagtccatcagaangtcttggcagaagcaaaagatcctgatagg

SEQ ID NO: 40751 - DNA, 101 bp, rice(Oryza sativa)
  misc_feature (71): n=t or c
cactaggtatccaaatacccacagtctacacaacacacacgagaaacgtacatccaatatttacaataatnataagattgcctactttctattttagtaca

SEQ ID NO: 40752 - DNA, 101 bp, rice(Oryza sativa)
  misc_feature (71): n=a or g
agtacagtacgccacagcacattactaggaatagtacattacgtacgttgtcatggtgaccatgcacgagngagaagtgagaaggaggagatgggcagcca

SEQ ID NO: 40753 - DNA, 101 bp, rice(Oryza sativa)
  misc_feature (71): n=a or g
atttgaaccgcattctgccccagaatatcagaggatgttcatgtagattcaccaccgactaaatgacggcngccggcggacgtttacctcttcctcttccc

SEQ ID NO: 40754 - DNA, 101 bp, rice(Oryza sativa)
  misc_feature (71): n=a or c
ggcaactagtgcaggaacgcttccgtggcatcggcaattcggcaatgaagctgtcgtaccgagacatgttnttttcagtgctcgggaaaaacaaggagcgg

SEQ ID NO: 40755 - DNA, 101 bp, rice(Oryza sativa)
  misc_feature (71): n=t or g
ccttccacaccgaccagttctacataccagagatcacttcaagctgatttggaagaggagaaggggccatnggcataatggccactaggaagtgtggtggt

SEQ ID NO: 40756 - DNA, 101 bp, rice(Oryza sativa)
  misc_feature (71): n=a or c
gaatctgagattgatacgaagaaggataacctgtgaaagatcgatacgtatggtcggccagatgggctaanaagaggcccaatacattttttttctcaaat

SEQ ID NO: 40757 - DNA, 101 bp, rice(Oryza sativa)
  misc_feature (71): n=t or c
ttggatgtctttccactttgtccttgcaggccaatgatcgatgcttccactgattataacaggggactcgngtaaaaagtaatcacatataaattcctcca

SEQ ID NO: 40758 - DNA, 101 bp, rice(Oryza sativa)
  misc_feature (71): n=a or g
actagttccattaagtcaaattattaagagtgagacaaatcacggcgagtctggttgattgcccataaccncgggcacggctattcgaatagttttactct

SEQ ID NO: 40759 - DNA, 101 bp, rice(Oryza sativa)
  misc_feature (71): n=t or c
ctcaaaattttaagctcccccaaatagagctggagattctaggctacgttgcagtagccagaaactccccnaaataggctagcatggatatacatgaagca

SEQ ID NO: 40760 - DNA, 101 bp, rice(Oryza sativa)
  misc_feature (71): n=t or c
agaaaagctgaaaaggaatttgagcagaaaattgttccagtggcatcacagtaccctggaattcagaaggntactaaggttagaggggcgcgtatgggtaa

SEQ ID NO: 40761 - DNA, 101 bp, rice(Oryza sativa)
  misc_feature (71): n=t or c
tggttattctttgaagtgtagcagggtagaatcatgaaacaaactcaaagtggtctatgagtattttaccngggaatatgaataatgatctagtctcagaa

SEQ ID NO: 40762 - DNA, 101 bp, rice(Oryza sativa)
  misc_feature (71): n=t or c
agagggagggacagaaatagagagttggaaggatctaaagaacattgggggagtcgtcaaaggcatgattngaaggagcctaacgactatgatgttggtgc

SEQ ID NO: 40763 - DNA, 101 bp, rice(Oryza sativa)
  misc_feature (71): n=t or c
aaggtcaaccattgtcatccaactgtcatcaattgttacgcctccgccagtcagcctagcccattggcacnggaatagagggaccttgagaggtccatagt

SEQ ID NO: 40764 - DNA, 101 bp, rice(Oryza sativa)
  misc_feature (71): n=t or c
caaaagaatgctcaagttctgatggaactacattccgagtttccgatatcgttacaaaagcaagcgagatngacatcatttgattgcaaaagaagacaatg

SEQ ID NO: 40765 - DNA, 101 bp, rice(Oryza sativa)
  misc_feature (71): n=a or g
attgttttctgccgctgtcgctgtggttgccaagaagcagaacaatttggaaggttatttgctgggtggcngagctcttgcagccgctttatgagttcggc

SEQ ID NO: 40766 - DNA, 101 bp, rice(Oryza sativa)
  misc_feature (71): n=t or c
gtcaggcgcatgcttctgttcgatctcatcaacgaggtcctgatggatatctatgattcttccttggtcancggcccatggcactcgcgcttcgactcgcg

SEQ ID NO: 40767 - DNA, 101 bp, rice(Oryza sativa)
  misc_feature (71): n=t or c
agcagcagccgcagatcgctgtgaaaacattctcttgaaggaattaggcatgtgagacattgcaacaggcngccgatcagttgcagatgacaacggtagcg

SEQ ID NO: 40768 - DNA, 101 bp, rice(Oryza sativa)
  misc_feature (71): n=a or g
aacgatctcgttgcagtttattatcacaaaagctagcatgcgtgcatgcagtggtgcttctagacaagtanttaaactttcacatgaattgtgcagcaaaa

SEQ ID NO: 40769 - DNA, 101 bp, rice(Oryza sativa)
  misc_feature (71): n=a or g
cagtcctatggtgctggtttatgtacttgtttgcagattttggtccaacatgcatcagcctgaggcctatnctccagacgtacgaggcacccgcactactt

SEQ ID NO: 40770 - DNA, 101 bp, rice(Oryza sativa)
  misc_feature (71): n=t or c
catttagtaatttaagaacgttggtactcagtgattataatttggacggtggcttccatgcactactttgntttcttcagcagacacctgttgtacagaag

SEQ ID NO: 40771 - DNA, 101 bp, rice(Oryza sativa)
  misc_feature (71): n=a or c
tattcaagttatttttattcctaatttaccttttatgatcaacggtgaatatttattagacatgaaggtanccaggataccttccaagcaccgtaaaatgt

SEQ ID NO: 40772 - DNA, 101 bp, rice(Oryza sativa)
  misc_feature (71): n=t or c
tagatacatatatttacttctgtttaagtcaaacaatactatgtcacgagatagatggatacgacgcattncgtatctctaacatttatgaaacaaaacgg

SEQ ID NO: 40773 - DNA, 101 bp, rice(Oryza sativa)
  misc_feature (71): n=a or g
tataaatccaggcatcatacccctttaaattctaaaattattttccaaaatataatgcaagccgaccgccnctgccctcctccctcatctacgctaacaaa

SEQ ID NO: 40774 - DNA, 101 bp, rice(Oryza sativa)
  misc_feature (71): n=t or g
aaggagtggtcataatacaatgttactgcttgtggaaatgtcatagcctcctagacgaatcacgtctcttntccctacgtactgattattttgggtcacat

SEQ ID NO: 40775 - DNA, 101 bp, rice(Oryza sativa)
  misc_feature (71): n=t or c
tatttaaaaaaatcttggaattattattattatttgacttactatccaatgtgctttaagcgcaacttttnattttttatatttgcaaaagttttttaaat

SEQ ID NO: 40776 - DNA, 101 bp, rice(Oryza sativa)
  misc_feature (71): n=t or c
ggcatgcatctaactgtaacttcctgatgcaggggcaccaattccaatatctgcagatgataaggctgaanagatgactggttatgttagtattggcctgt

SEQ ID NO: 40777 - DNA, 101 bp, rice(Oryza sativa)
  misc_feature (71): n=a or g
agaaggtattctcgtgcgcggtacatgccatgtttctgagaggttagggcttgtgaattcttctgatgcanaaactacaattggcatcgacggcagtcaat

SEQ ID NO: 40778 - DNA, 101 bp, rice(Oryza sativa)
  misc_feature (71): n=a or g
aagtctctttgcgacctggaatattcttggtaacctcaggtgtacagtaccaggcggaagacatttctctnaccacacatcgacttgaccacgctcattct

SEQ ID NO: 40779 - DNA, 101 bp, rice(Oryza sativa)
  misc_feature (71): n=t or c
agcgcgtggatgcccatgtccaagtaaccgagcacggtgagctgcggagcgtagcctatctcgatcttgangggttcttcctcgcaggggtacgtccccca

SEQ ID NO: 40780 - DNA, 101 bp, rice(Oryza sativa)
  misc_feature (71): n=a or g
atagctaattaagtgaaatggtatttataaaagaaaatctgagggcaccaaaataattcatactaccttcngtttttaatagatgtgtttaattgtagatg

SEQ ID NO: 40781 - DNA, 101 bp, rice(Oryza sativa)
  misc_feature (71): n=a or g
ttattttcactttcgttttccggataacttttttgtgattgctaaaagtagctgaaaaagttatctcgcgnaaaagttataacttttttggcacgacgcta

SEQ ID NO: 40782 - DNA, 101 bp, rice(Oryza sativa)
  misc_feature (71): n=a or g
aatgcatggacccctccatgtttggagtcagtatgccactattgcttctgtggtaattaattaaataacanttatcatgggacttgagggcgcaaaattta

SEQ ID NO: 40783 - DNA, 101 bp, rice(Oryza sativa)
  misc_feature (71): n=t or c
cttctcctcatcacaatttcaaggaccaacacaccaaagctaaaaatgtctatcttggttgacacatttcngtctgctacgtactcgggtgccatataacc

SEQ ID NO: 40784 - DNA, 101 bp, rice(Oryza sativa)
  misc_feature (71): n=t or c
gtatgcagctgattacatccttcttttcgcatacagagtaccttacagtttcccattccctagaagaattntgataccttggttggctggctcctatattt

SEQ ID NO: 40785 - DNA, 101 bp, rice(Oryza sativa)
  misc_feature (71): n=t or c
catctaaagcttaaatacaagcataatatttacttactagcactactagtatctccatgtaagcataccanatcaacccatcgaacatataaagctcaaca

SEQ ID NO: 40786 - DNA, 101 bp, rice(Oryza sativa)
  misc_feature (71): n=a or g
cctgtagaatttttttttctatttagactgagaaaactgcaagttgatatttttaattcgtctaatttgtnttgttcttttaattcatttcatggattttt

SEQ ID NO: 40787 - DNA, 101 bp, rice(Oryza sativa)
  misc_feature (71): n=t or c
gaagatgaatgacgtactgtacatggcaagattagtatttgagacggggtcaagtcagggccaccacggtnttccattttgctccggcgagacacggtgcg

SEQ ID NO: 40788 - DNA, 101 bp, rice(Oryza sativa)
  misc_feature (71): n=t or g
ccattctagtaagatataaactacacataggtagggaagatcaccggtgtagcgagaccgatttagttacngttgttgacaggtgtagaaaaagtttttta

SEQ ID NO: 40789 - DNA, 101 bp, rice(Oryza sativa)
  misc_feature (71): n=a or g
tctatgatttccgagtgggaatccgagttggggacaaagggcgatatagtggagatcgagctgagccgacnattcgaggagcttaccgctgatgtgatctc

SEQ ID NO: 40790 - DNA, 101 bp, rice(Oryza sativa)
  misc_feature (71): n=a or g
gggtggagcaaagattttgggggagaaagaggtgacaagaaggtggagggtgggtgtagagcagttcggcngtactttggcattctcaatgtatgtttatc

SEQ ID NO: 40791 - DNA, 101 bp, rice(Oryza sativa)
  misc_feature (71): n=t or c
atggcaatcttctctctctcctcttctctccccttcaacatatatcaaaaatcatgcgtggcatctcctcntatacgttgacatcacaccattgttcaagc

SEQ ID NO: 40792 - DNA, 101 bp, rice(Oryza sativa)
  misc_feature (71): n=a or g
cgtcactgattgcctccgtgctcaccactctcattgttcatagttgtcttcatgcttcaagccagtatganaacaagcttgagtcgaactcacctcacagc

SEQ ID NO: 40793 - DNA, 101 bp, rice(Oryza sativa)
  misc_feature (71): n=t or c
gcggaaacaatttttttgtcaattaggaagctcagaatgcctctcagacaccagatgaaacaaactatcanacatccccaccagatcagaaggcattgcaa

SEQ ID NO: 40794 - DNA, 101 bp, rice(Oryza sativa)
  misc_feature (71): n=t or c
attcattcaaaaataaaacataacagggttcacatgtcagtgacacctattgcctgtggatcaaccctctngtattttggcaccggagtgccgatatggaa

SEQ ID NO: 40795 - DNA, 101 bp, rice(Oryza sativa)
  misc_feature (71): n=a or c
gatgattgaattcaccaatgtctcgctcaacgtgttacgtgtggtttgtataaacgcaggagtagtatccntttaaagcagcttctacttctcagccgatg

SEQ ID NO: 40796 - DNA, 101 bp, rice(Oryza sativa)
  misc_feature (71): n=t or c
aaacggagaaggttactacctacttacaatgagtctattatcttttgcgcgtgtgtcggcgacgtcggtgnggggacacaggcaagacgtacaggatccga

SEQ ID NO: 40797 - DNA, 101 bp, rice(Oryza sativa)
  misc_feature (71): n=a or g
gcgcaagctcttaacacaacttctagtgtctgatttaatctctctatctgtcctccagtttgcggatgaantgctgtgttaaaatccaaataacttcccag

SEQ ID NO: 40798 - DNA, 101 bp, rice(Oryza sativa)
  misc_feature (71): n=t or c
atatatatatatatatcagtttttaaattttgcctatatttgttagtaacatgtgagtcctctaagcccanattttttttccttttccaaaatagtggtgg

SEQ ID NO: 40799 - DNA, 101 bp, rice(Oryza sativa)
  misc_feature (71): n=t or c
atgcatcaagtataaaaatcagttgttctgaatcgacagatttagttcaaaagttcaaggtggagaatatntatttacctcgtcgcgatcacaatcacctt

SEQ ID NO: 40800 - DNA, 101 bp, rice(Oryza sativa)
  misc_feature (71): n=t or c
cattgatgtaattaatcactgattttgaaaagaataaacttttatgtgtggtcttccttgttgtgattcgngcgtgttggcggcgatggatttgttggcgc

SEQ ID NO: 40801 - DNA, 101 bp, rice(Oryza sativa)
  misc_feature (71): n=t or g
caaaagacgaaaaactctagggttagctgacttaggataggactctattcccaacttgatacgatgcggtntgctccgattcttaggaaaacggaaagaga

SEQ ID NO: 40802 - DNA, 101 bp, rice(Oryza sativa)
  misc_feature (71): n=t or g
tggaggcaaaaatattctacaagcaaactagccgttgtaaaactagccattgtgaagcttgtctacaaaanaagggtgcagatcccttccatcccaccaaa

SEQ ID NO: 40803 - DNA, 101 bp, rice(Oryza sativa)
  misc_feature (71): n=a or g
tgcctttcggttaatgttttcatggtatcaggcagtattttgctatcgtctacattactgtgtaccctggnccgcctccaccttctggaacggtccattcg

SEQ ID NO: 40804 - DNA, 101 bp, rice(Oryza sativa)
  misc_feature (71): n=t or g
tgtccgtatacttaaaacaaattttggccaaacaattaaatacggccttagctgccaaacatcgcctgcanattagatggtgcttctgaactaaacacgta

SEQ ID NO: 40805 - DNA, 101 bp, rice(Oryza sativa)
  misc_feature (71): n=a or g
tgtactctctgtgaagatattgtcctcagatgttggctatcctatcaatttgtatgggactgtgatagtcngagacatattagattttaattgcatcacca

SEQ ID NO: 40806 - DNA, 101 bp, rice(Oryza sativa)
  misc_feature (71): n=a or g
cccttcgatgtcataccagtccgtaacactctccagctcatcgctgtcgacattgaccttaatgaaaaccncaccagcgaactccttcgcatactcggtga

SEQ ID NO: 40807 - DNA, 101 bp, rice(Oryza sativa)
  misc_feature (71): n=a or c
acgcaggaattcaggcgtagctgaggatgatgtgctacagaaattcctagactccaaatacatcaacggcngctgcatgaccgagaatgagatcgccgggc

SEQ ID NO: 40808 - DNA, 101 bp, rice(Oryza sativa)
  misc_feature (71): n=t or c
agtgttggctggtgcttatcatggtaagctaatcaaagcttttgcatgcagatgtttcctcaggaagttcnacctctgatatcaagtgctcttcaggtact

SEQ ID NO: 40809 - DNA, 101 bp, rice(Oryza sativa)
  misc_feature (71): n=a or c
ttcccttcagaagcattcataccctgaacaacagcagtaagaattttattgacttggtcttggtcaacagnttctggagaaacttcttcacataagtagcc

SEQ ID NO: 40810 - DNA, 101 bp, rice(Oryza sativa)
  misc_feature (71): n=a or g
ataatattcagggtaagcctgggtatagcaagctccgaaagaggctgcaacagcaggagaaaaagccaatngtcgtgcaggccccacttgcaaaagtggag

SEQ ID NO: 40811 - DNA, 101 bp, rice(Oryza sativa)
  misc_feature (71): n=a or g
gatatggtgggaagcggagtgcaaggtaacagcttgacttttgtttgcttgctgaaatcatgcggcgagcnttgcgatgctaagctagggcagcaggtcca

SEQ ID NO: 40812 - DNA, 101 bp, rice(Oryza sativa)
  misc_feature (71): n=t or c
acagttatattgggatggagacccgccacctcttcttctcccccattgtcttccttgctgataatgccccnataagctgtggccgacgacactatggtgga

SEQ ID NO: 40813 - DNA, 101 bp, rice(Oryza sativa)
  misc_feature (71): n=t or g
acttctatacaccatcacatcatgagcgaaaaaagaactaaggagtaggagtagctggctttacttacccntgtattggttgttgtctgcatcgatgcatt

SEQ ID NO: 40814 - DNA, 101 bp, rice(Oryza sativa)
  misc_feature (71): n=t or g
ttaaaacaccccaagaaccaactaaccaagatgatttcaccatcagtcgggcaaaagtttgacgaagtgangttcgatcaacagagatatcaaaattttag

SEQ ID NO: 40815 - DNA, 101 bp, rice(Oryza sativa)
  misc_feature (71): n=t or c
ccctagttcgttgacctgagccctttctctggcgatctccgatcgacgatggatcttggcaaatcatcctncaccagcgcatcgctgaagaagcttcagaa

SEQ ID NO: 40816 - DNA, 101 bp, rice(Oryza sativa)
  misc_feature (71): n=t or c
tagatggatagggacagagacaggccctgtgtggatcatcacaacaaaaagagaaaggctgcgtttagttncacaacaaaattaaaaatttaaataaatta

SEQ ID NO: 40817 - DNA, 101 bp, rice(Oryza sativa)
  misc_feature (71): n=t or c
tttaggtttgcaaactttatcccatgctgccaatggaacggccctagcatccatctcatttgactttcttnagaggcagtgtcttcttgtcctgtctatgt

SEQ ID NO: 40818 - DNA, 101 bp, rice(Oryza sativa)
  misc_feature (71): n=a or g
cccaggatcaacgtctctacaagccgaagatacgtttgacagtctgcattcatcagttgactgttttgtanacacacatatggctgtgtttagttcgtgca

SEQ ID NO: 40819 - DNA, 101 bp, rice(Oryza sativa)
  misc_feature (71): n=t or c
gcaaacttacttccccagattgtttccacatgcttatgtgagaaattagatcctaactcatacgtgcaaantgtatgaataagtgcatgccatttatatat

SEQ ID NO: 40820 - DNA, 101 bp, rice(Oryza sativa)
  misc_feature (71): n=t or g
cggtgctccacgcgtagaagaaggtgacgcttgacccgttgttcgggatcgcctcgccgtcgccgacgagntagtagcccttctcctccccgccggcgatc

SEQ ID NO: 40821 - DNA, 101 bp, rice(Oryza sativa)
  misc_feature (71): n=t or g
ttggccgtcagcaaaatagatgggggccccaacgctttctaaaattttcttaatagaatgccacgtaattnccacattagcatggtggacaacgtcaacgt

SEQ ID NO: 40822 - DNA, 101 bp, rice(Oryza sativa)
  misc_feature (71): n=a or g
tgccatggtctccatgtggcaccagaacaagaaggagaagaagaataggttgacgttcgaggagatgttcnacatgttctgtgaaggacggtgtgttgtcg

SEQ ID NO: 40823 - DNA, 101 bp, rice(Oryza sativa)
  misc_feature (71): n=a or g
aggcgccgtcagggaagatcctgagaaaggaactgaggaagcagctgcaacatcttcaacaagaagcttantttacaaccggcctcagacatgaaaagaat

SEQ ID NO: 40824 - DNA, 101 bp, rice(Oryza sativa)
  misc_feature (71): n=t or c
gccctgccaataagtttgcaactcttgaagagttgttgccgagcgttgtcgagttcctgaagggcagaggnagttttttcttcttcagcttgtcgagcaaa

SEQ ID NO: 40825 - DNA, 101 bp, rice(Oryza sativa)
  misc_feature (71): n=a or g
cggaagtgaagggcccctgccgccaccaactatgacgctgatgacgaagacactatgcatgacaatgacgncgaagaggaagggtaggacgaggaggaggt

SEQ ID NO: 40826 - DNA, 101 bp, rice(Oryza sativa)
  misc_feature (71): n=a or g
gtcgaaggcaaattgtactggcccattataatggttgatatatatagaataagtccacttgttgtccctcntctttacgtcgagtttagtggtatccctaa

SEQ ID NO: 40827 - DNA, 101 bp, rice(Oryza sativa)
  misc_feature (71): n=a or g
gataggtaccagcaacaccttgaggaactagatggtcatagccaaatgggtagtgtagaagagtattacancaagtttgaagagcttatgcataaggtgct

SEQ ID NO: 40828 - DNA, 101 bp, rice(Oryza sativa)
  misc_feature (71): n=t or c
attcttcagttttgataaaagaaacggtaatctgcaggctggatgcatgcaatgtgtatggacatacagangggtgatatagaaaactaaattttacttgc

SEQ ID NO: 40829 - DNA, 101 bp, rice(Oryza sativa)
  misc_feature (71): n=t or g
tttccagccagccatggcaaatatgagttttctaggtggtctaactagcgaagaggaacagggtgattttntgactattgcggtcaccatgccctcgcact

SEQ ID NO: 40830 - DNA, 101 bp, rice(Oryza sativa)
  misc_feature (71): n=a or g
taaaggacaggtgccccaccagacatcctgccagaagctgatactctcaccattacccaaaacccattcanagccaaaactcatccacctcttgatattaa

SEQ ID NO: 40831 - DNA, 101 bp, rice(Oryza sativa)
  misc_feature (71): n=a or g
tggtgcgtgtccaaagtcatcgatgccacacttaactcttgcttgacctcaagcaagtttttctgggggcngtaatgtcatacccatactagataaatgta

SEQ ID NO: 40832 - DNA, 101 bp, rice(Oryza sativa)
  misc_feature (71): n=a or c
gcataccaatatgaggggtatcctttcctgggagtataacttttgttgggaacctctacctcttctatgtnttcttgaggatgtagcccacgatgatgccg

SEQ ID NO: 40833 - DNA, 101 bp, rice(Oryza sativa)
  misc_feature (71): n=a or g
cgatggtgtctcagtacctttagtgatcctgtattcacgggaagcacatcgtcgtggagaatcacctggcntcttgtatggatatggagcttatggagaag

SEQ ID NO: 40834 - DNA, 101 bp, rice(Oryza sativa)
  misc_feature (71): n=a or c
gcaccgagtactacctagtagtacaatacacgtactgggagtaccagcgtttgtttgttggtgttgaaagntttttttttcttttttttaagagagttcgt

SEQ ID NO: 40835 - DNA, 101 bp, rice(Oryza sativa)
  misc_feature (71): n=t or c
atgctactgtactggatttctaccatatgaatcagtctccccatgtggctaagcatcattccaggataagnaagcgagtgagatccagacatccatggact

SEQ ID NO: 40836 - DNA, 101 bp, rice(Oryza sativa)
  misc_feature (71): n=a or g
tactacgtactggctgattgacttttgacataacgcaattcagtttcactatcgcacgctaatagtactcntacatcattcaccacaataaattgtacagt

SEQ ID NO: 40837 - DNA, 101 bp, rice(Oryza sativa)
  misc_feature (71): n=t or g
ctagaagaacatgggtttatggcagagtttatcttgtgaagcaagggcatccaaggaagcggaaatggttnaaagactaaattgccagtgctagatgctga

SEQ ID NO: 40838 - DNA, 101 bp, rice(Oryza sativa)
  misc_feature (71): n=a or g
ccctcagtctttcacacatagaagtcacaaaaatattgaaaaaaatattttttaccggttttacatgattntaccgaaaatgctcacaccccggcgaccag

SEQ ID NO: 40839 - DNA, 101 bp, rice(Oryza sativa)
  misc_feature (71): n=a or g
ccccatggccgagaaactgccagcatcgccgtcctcggctggtcctggctctgttaaagaaaagatcccgnagctaggtttatctgagattgatgaagcca

SEQ ID NO: 40840 - DNA, 101 bp, rice(Oryza sativa)
  misc_feature (71): n=t or c
tccgtcggcacaaagtggaagctaggacttaactgtagccgtgacaccagctcatgcttccagctcaccantagcaccgccgacccatcaccgtcgttgcc

SEQ ID NO: 40841 - DNA, 101 bp, rice(Oryza sativa)
  misc_feature (71): n=t or c
aggggaactagcctttatgccagttgccaaatgtgtatggtgtgcttcgacacaaataacttactcccttngtttctaaatatttgacaccgttgactttt

SEQ ID NO: 40842 - DNA, 101 bp, rice(Oryza sativa)
  misc_feature (71): n=t or c
gctgtctcgaggagcaaccgggatgggtagctgtcgagcatgaggtagtcgacggagaacacctaccactncttctcgacgacgactgtcactactggaga

SEQ ID NO: 40843 - DNA, 101 bp, rice(Oryza sativa)
  misc_feature (71): n=t or g
atgtagaagttcagtgtcctcatagtgttccccccaccttctctgaggagtttcctcaaagccttttgtantactcaccaaaactattggtaatttttttt

SEQ ID NO: 40844 - DNA, 101 bp, rice(Oryza sativa)
  misc_feature (71): n=t or g
acattttcctatgtccttttcatcatcaacaacttcaggtggaagcctcagagatgtatttctaaagcatncattgtcagcttacttatgtgggcatcttc

SEQ ID NO: 40845 - DNA, 101 bp, rice(Oryza sativa)
  misc_feature (71): n=a or g
gcagatcagctacgagcacaatggacacgagcggatgaagagaagcacgcaagcaagaaaaaccaccggcnccgagaggttctccgccggcggcgagaaaa

SEQ ID NO: 40846 - DNA, 101 bp, rice(Oryza sativa)
  misc_feature (71): n=a or g
ttggaaaattatgaggagaagctgaagagcttctattgtgagcacattcatgctgatgaagagatccggtnctgcttggagggtagcggttactttgatgt

SEQ ID NO: 40847 - DNA, 101 bp, rice(Oryza sativa)
  misc_feature (71): n=a or g
gtggatttatctgtattcgtaataaataccaatagtgatgatagatgcttgatagggtggctaaagaaacnggaaactagggaaacagagtcactctgaca

SEQ ID NO: 40848 - DNA, 101 bp, rice(Oryza sativa)
  misc_feature (71): n=a or c
ctagacctgtccaacaaccatctcactggtacaattccagctgacctgaacaacctgaacttcctctctgnactcaacgtctccaacaatgacttgcaagg

SEQ ID NO: 40849 - DNA, 101 bp, rice(Oryza sativa)
  misc_feature (71): n=t or c
acttcaagcatactatttttcttccgaggacatatctatatagtccaagtttgaaaaaaaaattatgtganggtgtaataaagcttattaccagcgtttct

SEQ ID NO: 40850 - DNA, 101 bp, rice(Oryza sativa)
  misc_feature (71): n=a or g
ttctgaagaacagatatcaccgattgtgttgtgatttttttttcttgtgtgcagtgtgtttgagaggtgcncctatctaggagggaatcaacgtgtacagt

SEQ ID NO: 40851 - DNA, 101 bp, rice(Oryza sativa)
  misc_feature (71): n=a or g
attatcataagcagtttgactttgatcttgatcgatcgatcacctgaaggatggaggatgagcaggccagngggccatgttcctggactcgccggggcgga

SEQ ID NO: 40852 - DNA, 101 bp, rice(Oryza sativa)
  misc_feature (71): n=t or c
aattgatttaaatggatcaattacccaattaaatctaacaactatgagttaaaatttagaatttagctccnagtaaattttaactcatgagtgaatttgca

SEQ ID NO: 40853 - DNA, 101 bp, rice(Oryza sativa)
  misc_feature (71): n=t or c
atttattcttatgttggtaccaaatccatgttatgccctaccttattgtttctgcagaggaggcgctcttnggttgctagagaacagagtgcatcagctgg

SEQ ID NO: 40854 - DNA, 101 bp, rice(Oryza sativa)
  misc_feature (71): n=t or c
acagaagatccggccgaagaaatccatccggaattcagtgcagctgcaaaagaatcggcgtcgggatcgcngcctgcatcagatgctgccgccagccattc

SEQ ID NO: 40855 - DNA, 101 bp, rice(Oryza sativa)
  misc_feature (71): n=a or g
cacaatcagaaagatcaagatatgcaccaccgaacgatgcgcaggcttatcggaagattgaaatgggcatngcgggaaatgaaagaacatagggcctccac

SEQ ID NO: 40856 - DNA, 101 bp, rice(Oryza sativa)
  misc_feature (71): n=a or g
atggtatacactatcatggtttatataaactgcatttcattacttggctcaaaagaactgcaacaattttncaaagtttgagatataccatcggtatctca

SEQ ID NO: 40857 - DNA, 101 bp, rice(Oryza sativa)
  misc_feature (71): n=t or c
gcaacaatactagatagagcaaaatgcggacgaagaggtgggacagtcacggcatagatctgatctgatcngctcctctcccctcacgcggactagcacga

SEQ ID NO: 40858 - DNA, 101 bp, rice(Oryza sativa)
  misc_feature (71): n=a or g
taagagaaagatgccatatataagaacggtgctagctactcccttcgtttttcgttttaggttataagatntttttgactttggtcaaagtcaaattgctt

SEQ ID NO: 40859 - DNA, 101 bp, rice(Oryza sativa)
  misc_feature (71): n=a or g
agagagatgaggaggatgagtggataagaagcgagcggttcggtttggctcggcccaattttggggtgccngtgttttttaaaaaaccgatacctatgata

SEQ ID NO: 40860 - DNA, 101 bp, rice(Oryza sativa)
  misc_feature (71): n=t or c
catcaagtgagtatgccatgcggctgaccaccatgatgttagctgacacatcgccattgcttggatgccgntgtgtttatttagtgttactctaatatctt

SEQ ID NO: 40861 - DNA, 101 bp, rice(Oryza sativa)
  misc_feature (71): n=t or c
acagtacactgtgtacccatgtatgtacctgcactgtacaaacacagtacacacacatagatgcacttacntgtaagcaaatttaacaagcttagagcata

SEQ ID NO: 40862 - DNA, 101 bp, rice(Oryza sativa)
  misc_feature (71): n=a or g
ctttgtacgaataaatactcaaaacttgtactgattcaaactgattcgatgaaccaagtatttatttactntcatcaaacttatccggggtattcgatcat

SEQ ID NO: 40863 - DNA, 101 bp, rice(Oryza sativa)
  misc_feature (71): n=t or c
gaattcagattattttttttgtaaagtttcatagttcaacatataccagaaaaacagcagaatgacagttngatcgatctacttaatattaaaacaaaata

SEQ ID NO: 40864 - DNA, 101 bp, rice(Oryza sativa)
  misc_feature (71): n=t or c
ggactacatctccatgttcctcgtgctcgacgagatcgtcgtcaggaacgtcaaggctcagttccagattngcttcgccggccaggttgagaagcaggcgc

SEQ ID NO: 40865 - DNA, 101 bp, rice(Oryza sativa)
  misc_feature (71): n=t or c
gccacatttgggaggaaattggacaaaccaaataatatgttttgtattcctgccctgctaactaacctggnctgtaccggcctctccctgtccctccagag

SEQ ID NO: 40866 - DNA, 101 bp, rice(Oryza sativa)
  misc_feature (71): n=t or g
aatatggataaaaggaatatgcaagagatattattttgaaggatatgcacaaataaggttttgaaggaaangtagtaagttctgcatctcaaggctaacgt

SEQ ID NO: 40867 - DNA, 101 bp, rice(Oryza sativa)
  misc_feature (71): n=t or g
aggaagcaggaatggccatgctcccatctttttgtggtatgcactgaagcgtatagggtacaatggtcttngcaagacggttgaaaattgcttaaaaaatg

SEQ ID NO: 40868 - DNA, 101 bp, rice(Oryza sativa)
  misc_feature (71): n=a or c
ccttccagctcaactaatgttgatgatccatcagggactactctcagtagtgagaatcctttggaaaacanagatccaggctcgagttctgcacctgatga

SEQ ID NO: 40869 - DNA, 101 bp, rice(Oryza sativa)
  misc_feature (71): n=a or g
gcagtgacgatagtgtaaggagaggcataggcgtgaagaaaatgagggatttagggaatgagaagggaagnagagggagaaggagaggggaaggaggttaa

SEQ ID NO: 40870 - DNA, 101 bp, rice(Oryza sativa)
  misc_feature (71): n=a or g
ggatgcctcggataccgtggaggcaattaagcaagaggatgatcatctcaaggtgcttgctgaggagaganctgatgattttgtggatgcaagttcatccc

SEQ ID NO: 40871 - DNA, 101 bp, rice(Oryza sativa)
  misc_feature (71): n=a or g
ccccccccccccggctgtttttagcgtggtttttgacatgtcggatccaagtcagcccacaaaataatatnggccaagtccatattgtctctctctctctc

SEQ ID NO: 40872 - DNA, 101 bp, rice(Oryza sativa)
  misc_feature (71): n=t or c
aggaagaacataagattcttgaacccttctttcctctattgtgtcacaaggtattagtgtgctcacctgtntctgctgctgatgtgctccaggcagtgatc

SEQ ID NO: 40873 - DNA, 101 bp, rice(Oryza sativa)
  misc_feature (71): n=t or c
tacgatagcaatagtcctacgatgaaaagataaatcagcgtggtccaagatggagtaccatatactgtacnatatactctacacagtcagttagtcacgta

SEQ ID NO: 40874 - DNA, 101 bp, rice(Oryza sativa)
  misc_feature (71): n=t or c
tcaggtatccatctttcacattgctggcaggccgagtgtatgatctggagattttcatctccaattttgcnggaaaattgtacagtccccctacagcaaac

SEQ ID NO: 40875 - DNA, 101 bp, rice(Oryza sativa)
  misc_feature (71): n=a or g
cttctcaaggtgcattacgtcgatggcatgctgaacctccaggtctttctagtaatcaagatacctgaaanaaattgagtgcttcttgaagggcaggttac

SEQ ID NO: 40876 - DNA, 101 bp, rice(Oryza sativa)
  misc_feature (71): n=t or c
acttcctgtatgataaagtttgcttgttcaaattgcagcttgcgtacctaccttacaaaagacgtgatatngtgttggataatgaaagcaatgaattactt

SEQ ID NO: 40877 - DNA, 101 bp, rice(Oryza sativa)
  misc_feature (71): n=a or g
gttgaatgggccgtgctaatgaaatggatccttctaggcaaaaattgaggtgatccgtggaacacccctanaactgtcactggttaatctattatgtgtac

SEQ ID NO: 40878 - DNA, 101 bp, rice(Oryza sativa)
  misc_feature (71): n=t or c
ccacagtgcaagctaattgaaatggctccaccaacatcactttttcatctttcacctatctctctctctcntctttacctttcccatccatcccctcccaa

SEQ ID NO: 40879 - DNA, 101 bp, rice(Oryza sativa)
  misc_feature (71): n=a or g
gtgtagattttgactgaaattacatctaccaatgggtctagggaatttggccaatacattcgggctaatgngaaatatatgaaggaggtttttttaacagt

SEQ ID NO: 40880 - DNA, 101 bp, rice(Oryza sativa)
  misc_feature (71): n=t or c
gccttttaatgcagttcgatttttctctcaaattttgaggttcccctaaaagagaaatgaggtctaccccnaattatgtaagatcttaaaaatacatttaa

SEQ ID NO: 40881 - DNA, 101 bp, rice(Oryza sativa)
  misc_feature (71): n=t or g
ggcatgcacactctagctaagaactgaggctccatgatgagctaattaagttcgtatcatggagattaatnttatgacatgcatgcatgctatcaggtagt

SEQ ID NO: 40882 - DNA, 101 bp, rice(Oryza sativa)
  misc_feature (71): n=t or g
cggtgggggaagaaaaagagaggagacagatgggaggggaagatgaaaaggtaaagaagaaagaaagaganagaggggaagatgaaaagtaaaaagagatg

SEQ ID NO: 40883 - DNA, 101 bp, rice(Oryza sativa)
  misc_feature (71): n=a or g
tcttcttctttggcaacgtcggcatgggaaagggagcagcggtcacaagagagaggagaaggttgaggccnttgcagtggcaagagaaagacagttgaagg

SEQ ID NO: 40884 - DNA, 101 bp, rice(Oryza sativa)
  misc_feature (71): n=t or c
aacactcgacctaatttgaaagtacatccaaagaaacggatgaagtacatccaacgaagacaaacgctacnagaaaagtgattttttttacgagacctcat

SEQ ID NO: 40885 - DNA, 101 bp, rice(Oryza sativa)
  misc_feature (71): n=a or g
cctaaatttttttttcctggatccgcccctggtcccaatcaaacacgagataaaacttctttaacaacaanagatggacttagttgagggacctcagatgg

SEQ ID NO: 40886 - DNA, 101 bp, rice(Oryza sativa)
  misc_feature (71): n=a or g
gtaagtacttttttgtatgaatgatatcacatgcaaccaaatttctctcctacttctttctgatggtttcntactatattgactttcttctcaaatttaaa

SEQ ID NO: 40887 - DNA, 101 bp, rice(Oryza sativa)
  misc_feature (71): n=a or g
aaaacttcctccaaaaacagatctgttatcttttctctctcctcttcctcgcgcaagagaaacaagcacgnccgaatacagacgacaaacccttgatgtaa

SEQ ID NO: 40888 - DNA, 101 bp, rice(Oryza sativa)
  misc_feature (71): n=a or g
caagatcggccgccccgccggcatcgccatgaagcagaccccgctgttcgatctcatgtcctccttctggnccgcccacatccttcgctcccatagtgtca

SEQ ID NO: 40889 - DNA, 101 bp, rice(Oryza sativa)
  misc_feature (71): n=t or c
ttttggacggagagagtatataataaaggacaatacttgactgttaatccaaatactaccaaaatgcaagncaagaatttcacttgaaaaacattgttcca

SEQ ID NO: 40890 - DNA, 101 bp, rice(Oryza sativa)
  misc_feature (71): n=t or c
tcgctcttcagcttctccattggtcgatgactatttaatttcctgctggctggtgtacgttcttggttgcngcgttcgtgcctgcgggcctccgcatttat

SEQ ID NO: 40891 - DNA, 101 bp, rice(Oryza sativa)
  misc_feature (71): n=t or c
acaaccgggcgaggtgcgactatacatctagtccttgaccaacatagtagcgatcctctcaccacctctgngattgtttagtatatccactcggttctcgc

SEQ ID NO: 40892 - DNA, 101 bp, rice(Oryza sativa)
  misc_feature (71): n=t or g
ttccgtcgtatgtacagtactaccgtacatggtagcaacggcttattgaaacttttctccaacgagtgagncattgagggggtgtttggcccctttcacag

SEQ ID NO: 40893 - DNA, 101 bp, rice(Oryza sativa)
  misc_feature (71): n=t or c
ttctcatgaaatattatttcaaattaagagggtgtcggacagtcggaaagaataaatctatttcaaggatnagagtgagattttaccaaactaacaatgtt

SEQ ID NO: 40894 - DNA, 101 bp, rice(Oryza sativa)
  misc_feature (71): n=a or g
taatgtttatccaaggaatagacatattgacagtatgcctgctcttttcagtgacttggagctgaaaccanttggactattagaagtaaaacttgtggaag

SEQ ID NO: 40895 - DNA, 101 bp, rice(Oryza sativa)
  misc_feature (71): n=t or c
ctaatttctattttggtggactcatgtccgctttgcttatcaggagattgcctccatttcacatcgatttngggccaagtgacaatatggatgaggaaatt

SEQ ID NO: 40896 - DNA, 101 bp, rice(Oryza sativa)
  misc_feature (71): n=a or g
ccagcttctagccatgaatcaccaatcacttccgttgatgcaggttcatgttcccaacatatttcataatncagacacttcttgcgattcgcatgagaagt

SEQ ID NO: 40897 - DNA, 101 bp, rice(Oryza sativa)
  misc_feature (71): n=t or c
cgatggcggctttgaacgattgcacgtacgcgaacgcacaacgtcgactcgggctctgttagttttcacgnaaaaacttttcactatgtgacattgaatgt

SEQ ID NO: 40898 - DNA, 101 bp, rice(Oryza sativa)
  misc_feature (71): n=a or g
ggggtcaacgagtcaagaccatgtgattgggatcccggtgagcaacaccgcctatggcatagaggagccgnacttcgcagcggaggagacgaccacccctg

SEQ ID NO: 40899 - DNA, 101 bp, rice(Oryza sativa)
  misc_feature (71): n=t or c
gacatagagggattagaggctttagctcgtgaacttggtgccactgtcggtgttgccattgccttgttcgnggttgcagatcctcgactacggcttgcagg

SEQ ID NO: 40900 - DNA, 101 bp, rice(Oryza sativa)
  misc_feature (71): n=t or g
tatgccagcattgctgcagctcaaggcgttgtcattcccattggggcagccatattccagtctctacccancatccagccgctgctcttcatctcctctcc

SEQ ID NO: 40901 - DNA, 101 bp, rice(Oryza sativa)
  misc_feature (71): n=t or g
tagtcaatggggacccgaggcattcagatgacaggctggtgatcatcacaacctgtggggggagaaaggangacaatcgaaggggtgtggggggttttccg

SEQ ID NO: 40902 - DNA, 101 bp, rice(Oryza sativa)
  misc_feature (71): n=a or c
taatctgcgcattcacgcatcttgatgattcattcatttaatttagaattcattcggagaagttaagatgnatgcatggagagaatctacagtactacata

SEQ ID NO: 40903 - DNA, 101 bp, rice(Oryza sativa)
  misc_feature (71): n=a or g
agtacaaacaggaaaatgtccctgccatatatagccactggctaatattgcaggcactctactggccacanaatgcttgcgcgcgtccttccagtcgcacc

SEQ ID NO: 40904 - DNA, 101 bp, rice(Oryza sativa)
  misc_feature (71): n=a or g
ccgatagctggttaagtgatgatgccatttcagcccaatccggcatcctatacgagcagaacaagatatcnatagagcatataggatcatcaattaagtga

SEQ ID NO: 40905 - DNA, 101 bp, rice(Oryza sativa)
  misc_feature (71): n=t or c
ttcaccatcctctttatgtctaacatcatacagccaagatcaaactcaagattcatccggctccaatcccnaacaccaccaccaacagacatccaccgaat

SEQ ID NO: 40906 - DNA, 101 bp, rice(Oryza sativa)
  misc_feature (71): n=a or c
gccgccttcaaggccaacgaggagctactactgcttgcgcccaagaagaggaagaaaaaacatgagggtgngtcctcatcgcatgatgcggttacggaggc

SEQ ID NO: 40907 - DNA, 101 bp, rice(Oryza sativa)
  misc_feature (71): n=t or c
catacgagatgaggactacagtcgagatagggaccgagcaagagatagggatggcagggaaagagaacgcngggacagagaccgtgggaggcgcaggagcc

SEQ ID NO: 40908 - DNA, 101 bp, rice(Oryza sativa)
  misc_feature (71): n=a or g
caattgaatcaattgtatgcaggactggccaaccgaggatatgggcattaaacctcacttgctccaatgcngtttatgtggaaccaagttgtgccttgttg

SEQ ID NO: 40909 - DNA, 101 bp, rice(Oryza sativa)
  misc_feature (71): n=a or g
cctaggtttgccgctttctcttggaaagcttaccaaggcagacctacagccaatggtagagaagatagctngctgtctcctctcttggacagctggacaat

SEQ ID NO: 40910 - DNA, 101 bp, rice(Oryza sativa)
  misc_feature (71): n=a or g
ggaataacggtgttacctttcctagtaagacgataatccagaaaggcaacagggacactcaaagaatctanaggcgaaggtaatgagtgctggattgtcgg

SEQ ID NO: 40911 - DNA, 101 bp, rice(Oryza sativa)
  misc_feature (71): n=a or g
gcatttatatatacattatgtgagggcgtttcagacgctgcattgttcaacttggagtatgagcggtggcnggaggcacaccaccaagtgatcagccggct

SEQ ID NO: 40912 - DNA, 101 bp, rice(Oryza sativa)
  misc_feature (71): n=t or c
tgatgcacggtttttctgtggaagtactaaacaaatatttggatgcagaaacctaccattgggtgtggcantgagatcaacaacccaattaatgaggtgga

SEQ ID NO: 40913 - DNA, 101 bp, rice(Oryza sativa)
  misc_feature (71): n=t or g
tgaagtaagaagttcattctcatctctaggtttcgattcatccgtcgttgagttgaacacaacagatagtngtatcatattccaggtttggttatcggaaa

SEQ ID NO: 40914 - DNA, 101 bp, rice(Oryza sativa)
  misc_feature (71): n=a or c
ttaagtaccaccaagtttttgcaagttactaatgatttaggtagtgtcccttcaatccaattatagctganatccaatgcctcaaatgcacagtcttcctt

SEQ ID NO: 40915 - DNA, 101 bp, rice(Oryza sativa)
  misc_feature (71): n=t or c
cgtaccagattaatcagcgataaaaaaaagaaaagaagaagacgaccacagtgggagtcgaacccacgacnttctgatccgaagtcagacgcgctaatcca

SEQ ID NO: 40916 - DNA, 101 bp, rice(Oryza sativa)
  misc_feature (71): n=a or g
tgcaggtacagctggaaaaacaatcaaaatgaaattataaagccctgccactttcttcgccacgctacctntagcagtgtttgggctatgctgcgtaccaa

SEQ ID NO: 40917 - DNA, 101 bp, rice(Oryza sativa)
  misc_feature (71): n=t or c
ctactgggaccaaccgaagtgtgtccagggaaagagggaaaaaaaaaccctcgggtgagcacaagcgtatngttcgacgctcgcgggcagcatgcccaccg

SEQ ID NO: 40918 - DNA, 101 bp, rice(Oryza sativa)
  misc_feature (71): n=t or c
gctcacggccacacatttctccatttctaatcaccttggatgcatgctctgccgccaccaaccatgtcagnaatagtaatcttgtattgtcttgtgtgctc

SEQ ID NO: 40919 - DNA, 101 bp, rice(Oryza sativa)
  misc_feature (71): n=a or g
tttaatgtacaacatcaaactgtatgataatactgaacttggaactgtgtgggaagtggggcactttgtanctggactgaaggatgctctaaagactcatg

SEQ ID NO: 40920 - DNA, 101 bp, rice(Oryza sativa)
  misc_feature (71): n=t or c
cgacacaccatgatctcgggtgccggcgatgtacctcagtatgtgcttgaatgcagccatatgatcctcgngcggctccgccatgaaacggctcacatagc

SEQ ID NO: 40921 - DNA, 101 bp, rice(Oryza sativa)
  misc_feature (71): n=t or c
acgatctccatttgagctcaaacccctaggtgcttctctaattatgtgcatgcagaggtaaaggagaggangatgtaaccaaaacaccattacttactgat

SEQ ID NO: 40922 - DNA, 101 bp, rice(Oryza sativa)
  misc_feature (71): n=a or g
cacctcctggagtgccctcattcatcgaggaagtccaaaactttacaaacaacgccccaaaatccataagntaatataaaatccccacccatgtcttgcct

SEQ ID NO: 40923 - DNA, 101 bp, rice(Oryza sativa)
  misc_feature (71): n=t or c
aaaaaagcttcacaaatcaggaccggttcgtaggttttcaagtagtagcaggaaggaagcgtacgttgcanacatacttcctccgtcataaaaaaaaaaaa

SEQ ID NO: 40924 - DNA, 101 bp, rice(Oryza sativa)
  misc_feature (71): n=a or g
aaacaatcatgttgagtctaagatttaaactcgagtagttagattctattattggctggaactccaactanttaagatatattctcaattcgcttatgaca

SEQ ID NO: 40925 - DNA, 101 bp, rice(Oryza sativa)
  misc_feature (71): n=t or c
ttttattagaaacacggtataaaagtagatgctaacaatacacgtacgctcgtatctatgaacacgcacangcgcatcctacttctataagcacctccaaa

SEQ ID NO: 40926 - DNA, 101 bp, rice(Oryza sativa)
  misc_feature (71): n=a or c
acaactgcccggaagttccttggaagaaagagaggaagttgagcaagaatgaggatcttgctcataagttnttcaaatccaccaaagagggacactttgcc

SEQ ID NO: 40927 - DNA, 101 bp, rice(Oryza sativa)
  misc_feature (71): n=a or g
aacctaacggcgaacatcaatgtcgagatgctgaaaaggcagcacaaagctttgactttgacttcacgagncacgtgtcatcgttgcggagcttgccgccc

SEQ ID NO: 40928 - DNA, 101 bp, rice(Oryza sativa)
  misc_feature (71): n=a or g
aagccctgctttcttatagtacctaagtcatgtttaatctaccagatcaatttcagtgaagtacatgaagnaaaaaagaaggattgaaggcatcagatgga

SEQ ID NO: 40929 - DNA, 101 bp, rice(Oryza sativa)
  misc_feature (71): n=a or g
accttgtatattttgagacgacataatcttccaaggcccaattgcaatttgcaaaagaacacaaggacagncgggccttcagggaaaggccacatttaatt

SEQ ID NO: 40930 - DNA, 101 bp, rice(Oryza sativa)
  misc_feature (71): n=a or g
gttcatacctgggcatatcctccgaccagttccgaatggcaagaaattgaaattatttccattgtacccanccattgtgttgctaaggaacctctctggca

SEQ ID NO: 40931 - DNA, 101 bp, rice(Oryza sativa)
  misc_feature (71): n=a or g
agtactagcttaccttggagaatcagaacattcagatgctttatgaagaagctcagcagctttctcaaggnatgatttgtactcctcagagtatggaacaa

SEQ ID NO: 40932 - DNA, 101 bp, rice(Oryza sativa)
  misc_feature (71): n=a or g
gatacagagtgagtattaatgttgcttggtttctagaactatgatacccataggaccccgggtcattgacntgtataggcctcatcacagcccataggacc

SEQ ID NO: 40933 - DNA, 101 bp, rice(Oryza sativa)
  misc_feature (71): n=a or g
ataggctccatatccttttgatatatctacagtggggctaagagatggattgttgtctcgtttgcatacgncggaggcaagccccattgttcggccagcct

SEQ ID NO: 40934 - DNA, 101 bp, rice(Oryza sativa)
  misc_feature (71): n=t or c
gaggtgttttgtagatatatgttgttcttgtccatggtgagagagataaagggcttgcttgagccatcacnatactactagtgctactctactactgccat

SEQ ID NO: 40935 - DNA, 101 bp, rice(Oryza sativa)
  misc_feature (71): n=t or c
accgtggtgtagagtgctggcggtgtactaatgtagtggaaaaggcatttaaccgtcttgatgatgccaanatgtagaagtaggttgtcactcgtgatact

SEQ ID NO: 40936 - DNA, 101 bp, rice(Oryza sativa)
  misc_feature (71): n=a or c
acacacaagctctccaatcccatgtactacaatacaaaccaccactactacaccaccaactacttgctgtntctgtagtttgcttgtataaatccacacct

SEQ ID NO: 40937 - DNA, 101 bp, rice(Oryza sativa)
  misc_feature (71): n=t or c
aattggcgagaagctcaagctcaatgatagtgtcggatgactagagctttaggatgggaatggttagggtngatccatttatccactaaatctattcgtaa

SEQ ID NO: 40938 - DNA, 101 bp, rice(Oryza sativa)
  misc_feature (71): n=t or c
tgcaaattgtaagcacaatgtagcctcacagtcatgatgcaatcacatttgggcacaacatatgaaaaganttgcatttaacaaacataatggttctggat

SEQ ID NO: 40939 - DNA, 101 bp, rice(Oryza sativa)
  misc_feature (71): n=a or g
aagcggctactttatatatgagacagccaaattaaatttggttccaaactagccaaattaaatcacccgcncatatatatgagacggccggaagcacaact

SEQ ID NO: 40940 - DNA, 101 bp, rice(Oryza sativa)
  misc_feature (71): n=t or g
atcaccaattctctttaacttaattggagatgcattagatctgattcttgagtcagcaaagaaagctgggnttctggtggggttatctcctgatctgattg

SEQ ID NO: 40941 - DNA, 101 bp, rice(Oryza sativa)
  misc_feature (71): n=a or g
ccgcagggataccaagggaaggatcaactgaggcaacgagctggaagttcttgactgatgctactgtaacncgccctcggaagttgaggcaccagcactgc

SEQ ID NO: 40942 - DNA, 101 bp, rice(Oryza sativa)
  misc_feature (71): n=a or g
tgaggctgcaaacaaggcagtttcaaagattggagagcacatgcaacaaggtggcggtggcggcagtggcngcggcagcagcagcagcagtggtggtgacc

SEQ ID NO: 40943 - DNA, 101 bp, rice(Oryza sativa)
  misc_feature (71): n=a or g
cttgatcaccgccatagcaccaaacggaaaaacaagttgcaacttgcaacgcgagcgtatctatgtttgcntataaatattgttctaacctgcatacataa

SEQ ID NO: 40944 - DNA, 101 bp, rice(Oryza sativa)
  misc_feature (71): n=t or g
cttccaaagaaactcttgcctcagcagaaacattgcagggaacggagaattcattgatctgtgggggagtntacccataaagtgccttgaatggggtcatc

SEQ ID NO: 40945 - DNA, 101 bp, rice(Oryza sativa)
  misc_feature (71): n=t or g
agagaaaaaagttacaacgaattgtgatcactgatcagcacagaaaaggatgatccattccatatttccanccgtcgtctgcatttcgtctctgttatgtg

SEQ ID NO: 40946 - DNA, 101 bp, rice(Oryza sativa)
  misc_feature (71): n=a or g
aaaaaaaaaaaaacataacctagtatggaattggacataatcgtatttcgaatctggtcactcctattcanattcgttatactaaattatgtctcatcaat

SEQ ID NO: 40947 - DNA, 101 bp, rice(Oryza sativa)
  misc_feature (71): n=t or c
gtaatccctgatcatgacattgtaacagatccatgctatgctgccttccatgaccatgaatggggagtccnggtgcatgatgacaagtacgtctaaaccca

SEQ ID NO: 40948 - DNA, 101 bp, rice(Oryza sativa)
  misc_feature (71): n=t or c
ggagggagcactatgtctattttaaaatatagcaatctagtatgcgataagacatatttgctgctccctgngggaatcccttcggatattatgatgctata

SEQ ID NO: 40949 - DNA, 101 bp, rice(Oryza sativa)
  misc_feature (71): n=t or c
aaatgagtaaaggaggggactgaaagagcattattctagaaaccatcgctagcggactactactgggtggntctgtcccaaaataatcgggattaataaat

SEQ ID NO: 40950 - DNA, 101 bp, rice(Oryza sativa)
  misc_feature (71): n=t or c
ccaattctccattgattttatagtaattagaacttcacataaaaatgctgatgtcatgcaatttcaatttngtatacaactagcaaattgcctcgaatatc

SEQ ID NO: 40951 - DNA, 101 bp, rice(Oryza sativa)
  misc_feature (71): n=a or g
ttggtggcggaggcatccccacagtcctggagcaacactttgaccggttgccacaaaaatttcagaaaggnaacatctaaaaggctgttgcatacttggct

SEQ ID NO: 40952 - DNA, 101 bp, rice(Oryza sativa)
  misc_feature (71): n=a or c
ttcagctcttgaaaaagatacagatatggaagaaatgaaaaggatattgctccttagttatgatgatcttncttaccatttgaagacatgtttgctatatc

SEQ ID NO: 40953 - DNA, 101 bp, rice(Oryza sativa)
  misc_feature (71): n=a or g
tatagaagatgatgaggcagaaaccttaagagattacaggctacagcaagagagcccatctctctcccttngtttctttccaaagcactccaagaccacca

SEQ ID NO: 40954 - DNA, 101 bp, rice(Oryza sativa)
  misc_feature (71): n=a or g
atgatctcagatcgacctttatgtctcatgtattggtgttatcacgccctgttccaacatttcgaagttanttaacactcactacctatatgctttgtttc

SEQ ID NO: 40955 - DNA, 101 bp, rice(Oryza sativa)
  misc_feature (71): n=a or c
tggcaaatgcgatgggcgctatggagacaaactgatgagatggtgatcgatatatatcttcttaatttcancaggaaccaaccacacgcacaaacctagat

SEQ ID NO: 40956 - DNA, 101 bp, rice(Oryza sativa)
  misc_feature (71): n=t or c
tgatctacaccaacgcccgtctcaactgcgacgatagcattatcgtcaacacacatcggatctccaccccngccttcacagccaccttcaccgtcagtgtt

SEQ ID NO: 40957 - DNA, 101 bp, rice(Oryza sativa)
  misc_feature (71): n=t or g
tgacattcagggagggaaatacgaacattgtacacctcctcatcaaatcaaagattgtgttgagctctggnagcatcttgtcaagccaaatattcatgcgc

SEQ ID NO: 40958 - DNA, 101 bp, rice(Oryza sativa)
  misc_feature (71): n=a or c
gctatctaatgatccattatcttattatctagaagaaaaggtttctaataatcgtgtccattgttcaaatnattatgtggctaaaatttaaatttgaaatt

SEQ ID NO: 40959 - DNA, 101 bp, rice(Oryza sativa)
  misc_feature (71): n=a or g
cttatttccatttaatttttctagttgcacttcagaccgtacattgtcttcgtggtggtaagtcaattcanggcctgtttagatccatttggaatggcaaa

SEQ ID NO: 40960 - DNA, 101 bp, rice(Oryza sativa)
  misc_feature (71): n=a or c
cctaataactctgaggaattcacatgtgtaatacccacagaggaccatggcttttgtacatttgtgatgcntgtatcgtcgaagcttgttcgatgttctat

SEQ ID NO: 40961 - DNA, 101 bp, rice(Oryza sativa)
  misc_feature (71): n=t or c
acgaattcaaactgaactgtggggagactacggtgaagtggcctgacgagagcataggcgtagctggtatnagtactcagtgttgtgatgctaacttgtgc

SEQ ID NO: 40962 - DNA, 101 bp, rice(Oryza sativa)
  misc_feature (71): n=t or g
caattttagtaggtaatctgagccatgcagagaacataagggactcataaatagttacatttggtgaatgnatgtcattctgttcacaatatcctgaaact

SEQ ID NO: 40963 - DNA, 101 bp, rice(Oryza sativa)
  misc_feature (71): n=t or c
gccctccaagaacctttcaccgaggatgaggttcggcaagcaattaatcaaatgccaggagataaggcgcntgggccggacggcttcacggggttgttcta

SEQ ID NO: 40964 - DNA, 101 bp, rice(Oryza sativa)
  misc_feature (71): n=t or g
aaataagaatgctcaaagaactgatcaacaaagagtgatgaaggttatactcagcacaacctcaccttagntttagctcaataggatttaggtttcaaaat

SEQ ID NO: 40965 - DNA, 101 bp, rice(Oryza sativa)
  misc_feature (71): n=a or c
tcctcatggaacggtcaggatcatctcggtgagattccaacgctcaggatcgctcccacatcccacctcgngatccacctcccacctccctcgcgctcctc

SEQ ID NO: 40966 - DNA, 101 bp, rice(Oryza sativa)
  misc_feature (71): n=t or c
ctgactgttttcttcttcggcagagcagcctttttaggctgcttgccggccgactcattatcactgtcatngtcatcatcgcatatcattttcctcttccg

SEQ ID NO: 40967 - DNA, 101 bp, rice(Oryza sativa)
  misc_feature (71): n=t or c
ctcaatgggggacgcaatgcttgcagtcttaagcttcaagcattcccgaagggctataacaactttaaaangacctctatacttaaatgtggtgagattag

SEQ ID NO: 40968 - DNA, 101 bp, rice(Oryza sativa)
  misc_feature (71): n=a or g
ctataactactgtactctgcaaaaatcgcttccctatgatcggttcatgggcctgttaagtgaccaacatntgaaattagccacatgcgagcttctctctc

SEQ ID NO: 40969 - DNA, 101 bp, rice(Oryza sativa)
  misc_feature (71): n=t or c
aaagacaaaggaggccaaatcaatcttgttgaaagtgaagcagccacaagaatgagggtatattctggacncttctgaccgtgctggcctaactgacctcg

SEQ ID NO: 40970 - DNA, 101 bp, rice(Oryza sativa)
  misc_feature (71): n=a or g
tgtgtgaactcagatctggtgacttagggaacgagatggcttgcttaccatggcggaaagagagtgttgcntcagcgggcggtcgcgtcggagaggtcggt

SEQ ID NO: 40971 - DNA, 101 bp, rice(Oryza sativa)
  misc_feature (71): n=t or c
gcaggtgagcagtcgaagaatccatctggctggagtataaccaaaacaatatgggttccattgttcagagntgtaatgttatctggagcaatgtacgacaa

SEQ ID NO: 40972 - DNA, 101 bp, rice(Oryza sativa)
  misc_feature (71): n=t or c
tgcaatgctcccatttgtacgtaatcctaataaaaataagaaaacacaagaaaggaaattttcaagttctncttttctttttctttggagcaatataattc

SEQ ID NO: 40973 - DNA, 101 bp, rice(Oryza sativa)
  misc_feature (71): n=t or c
ggcgtcattgaagcagccggtgctctcggtcatctcgaggaagccttccttggagatcttgtgctggtcgnccggcttgtagcaggcgaactcgacgaggt

SEQ ID NO: 40974 - DNA, 101 bp, rice(Oryza sativa)
  misc_feature (71): n=a or g
taaatcttgcttggaaattggaacgggtttgacatctagctacttcaggcgacttgttttgctgggcctcntcttgaagatggcaagatgtgttcttggtg

SEQ ID NO: 40975 - DNA, 101 bp, rice(Oryza sativa)
  misc_feature (71): n=t or g
ttaataatccggacaaaaatctgtttcagacagggctgaaagtatccggattagaggcaatgaaaagtagnagtgttctgttcaatgaggccatcaactgt

SEQ ID NO: 40976 - DNA, 101 bp, rice(Oryza sativa)
  misc_feature (71): n=a or c
aaaaaatttggaacattatgatcttcaaactagttatcttcttcattctgaaaaaaaaaagaaagaacacntaggatatgtattttttttaattcacctgc

SEQ ID NO: 40977 - DNA, 101 bp, rice(Oryza sativa)
  misc_feature (71): n=t or c
gcatgtgtgttattcatagaaacggaggtagtatttgtaagaagtacggtatcgaatttccaaaaagttcngaccttgtgcgataatatacacacacatta

SEQ ID NO: 40978 - DNA, 101 bp, rice(Oryza sativa)
  misc_feature (71): n=t or c
ccgcgaatcttccgcgtcgggcacccgataggggagaaaaatcaagcgccacgcctccgcgcccccaccangtgcgcccattgcaacattcgcccggatat

SEQ ID NO: 40979 - DNA, 101 bp, rice(Oryza sativa)
  misc_feature (71): n=a or g
cagttcacaatttgcacttgtgcagtacgaacatggaaaggaacaggaaataactcctgaaaaatgaaaanaaaaatatagttcctcattttctctgtttc

SEQ ID NO: 40980 - DNA, 101 bp, rice(Oryza sativa)
  misc_feature (71): n=a or g
ttcatacatatggcgaaagtcctgcatatatatggaatcaagtctcatgtattctattcatgttcttatcntgttaattgaatgtacatgtttgttgtatt

SEQ ID NO: 40981 - DNA, 101 bp, rice(Oryza sativa)
  misc_feature (71): n=t or g
ctgatccgcggtccggtcctgaccacgctggcggggagagaagggaggagtgacgaagtgagagtggaaangaaaaataaaaacaagaaggaaaaagagag

SEQ ID NO: 40982 - DNA, 101 bp, rice(Oryza sativa)
  misc_feature (71): n=a or c
tcggagtaaattaaaggaggttgattagattaacaactgaccatgtgttttgctggtgatcagtactgtgngtagctaatgtcctttaatttgatcgatcg

SEQ ID NO: 40983 - DNA, 101 bp, rice(Oryza sativa)
  misc_feature (71): n=t or c
attgattgggtgattgggtgattgggtgggattatgttccggatggtcactactagaaaaagcatttttgncgatgttgggtatttattttcgcagtcaaa

SEQ ID NO: 40984 - DNA, 101 bp, rice(Oryza sativa)
  misc_feature (71): n=t or g
cacccattttgttaattgttataaaggaaatggaaagatgcccatgccattgccatcccaagtgcaccggngccaccttctcccagcgccaccacactctc

SEQ ID NO: 40985 - DNA, 101 bp, rice(Oryza sativa)
  misc_feature (71): n=t or g
gctgcagaagtgtagagctgtgcatgtgctagggcctctagtactccctccgtcctttttttttttttttngagggagtatgcgttggaaccacaatgtga

SEQ ID NO: 40986 - DNA, 101 bp, rice(Oryza sativa)
  misc_feature (71): n=t or g
tttgagaaataaaagaaaaataaaagagagatgagtagatgatgttttggctgcggctgagttatagattnccatgtgggccgcccggcacggcacggccc

SEQ ID NO: 40987 - DNA, 101 bp, rice(Oryza sativa)
  misc_feature (71): n=t or c
cgcgaataaacgaaacgatggtccgtcaacgtgccactagtgattaatttacacctctcacgccttccctngcaccacgtgctcccccatgcgaagggaag

SEQ ID NO: 40988 - DNA, 101 bp, rice(Oryza sativa)
  misc_feature (71): n=a or g
gcatagagaatatgtgcctcatgacagaagatacttgtgcgtgttctcaatcaatcgttgacgctatcatntcctagcagtgcaaacattatggtattgct

SEQ ID NO: 40989 - DNA, 101 bp, rice(Oryza sativa)
  misc_feature (71): n=t or c
agcacttccatggtagtatctgccttcagattggtgttgcgaaggctcagcttttgtagaattttaagatncttaatccattctggtaaagtcaccagatt

SEQ ID NO: 40990 - DNA, 101 bp, rice(Oryza sativa)
  misc_feature (71): n=a or c
tatgtgaaaaatgaacttattttgggacggatagttactagcagaagccgagaataacacctatcttagcngtggatctacaagttttagggccaggtcat

SEQ ID NO: 40991 - DNA, 101 bp, rice(Oryza sativa)
  misc_feature (71): n=t or c
aaagttattattatagagaactgcaactgataatccctccgtttcatatcgtttcatattgtaagactttntagcattgtctatattcatataaatgttaa

SEQ ID NO: 40992 - DNA, 101 bp, rice(Oryza sativa)
  misc_feature (71): n=a or c
aaaagatctattctcacatacgtactctgtatctctagtcaaattcggcacatgtggcacaatacgttttntttgacctagagtacatgtatacggaatta

SEQ ID NO: 40993 - DNA, 101 bp, rice(Oryza sativa)
  misc_feature (71): n=a or g
ttttcttcaaagagcatatacaatcatcagtgttttctcatctgaaacgaaagggggctacaaccaaaccncacgtattgagtattgacactatagttgta

SEQ ID NO: 40994 - DNA, 101 bp, rice(Oryza sativa)
  misc_feature (71): n=t or g
ccacgtcaccagagcaactgtagcaggcatgacatcatatcacaaaggcgtgtgggcaggaagacaagttngtccgattggctacaactaacttgcccgtt

SEQ ID NO: 40995 - DNA, 101 bp, rice(Oryza sativa)
  misc_feature (71): n=t or c
gcacggaacgaccgctatctgtcggcgtgccagcaggagagggtagtgggaatgggaagaacgactcgcangcatggccagctcagcggcttaccgcagag

SEQ ID NO: 40996 - DNA, 101 bp, rice(Oryza sativa)
  misc_feature (71): n=t or c
atttcaatcttcaatataaattcctcgtataccattgaaatctcgatccctctcattctcttgaaatttgnccgatcctttccatacccctgaaatttcaa

SEQ ID NO: 40997 - DNA, 101 bp, rice(Oryza sativa)
  misc_feature (71): n=a or g
cccctgtttaatctgcaaaatgggatttatagtgctccaatgggagtagaatgctggaccttcttatttcnggaaaatatactgtgaaaacaacgtatata

SEQ ID NO: 40998 - DNA, 101 bp, rice(Oryza sativa)
  misc_feature (71): n=t or c
tctcgtaaaaattctcctagaccgtgacaacatcatattgttcagagtagctacagcagtaattctagagngtctatgtgccaattacaccgaagacgatg

SEQ ID NO: 40999 - DNA, 101 bp, rice(Oryza sativa)
  misc_feature (71): n=t or c
tcgtgatgccggttggcaacctgacatatctggcacctatgctggattcccaactggcaccaatggctttntctgtggtagtgtttgaatttaatgttttg

SEQ ID NO: 41000 - DNA, 101 bp, rice(Oryza sativa)
  misc_feature (71): n=t or c
gacacctatgattttacccttagtagttaagtacctgtaccaatacttcaatatttttttacatcgtgccnatcactcaagagcgttggatttttaccttt

SEQ ID NO: 41001 - DNA, 101 bp, rice(Oryza sativa)
  misc_feature (71): n=t or g
atatatacatgggaagtgccagaacctacgagcaatggccatcgtcctggactgccggcctccactatgtntagcccatcatcattgtcgacgctgccact

SEQ ID NO: 41002 - DNA, 101 bp, rice(Oryza sativa)
  misc_feature (71): n=t or c
tgcgaatcgaggcggaggtaggagaggggtcgtggttcaggttcctgcttgactatagtcccactgccacngccgtcgcagtcaccaagccacagcctggg

SEQ ID NO: 41003 - DNA, 101 bp, rice(Oryza sativa)
  misc_feature (71): n=a or c
tctctcttgctcctgtaatcctgtccggagaggcggagaggcggacgacaatggaattttttttattttcnattttttttattaaaagttttacaaaaata

SEQ ID NO: 41004 - DNA, 101 bp, rice(Oryza sativa)
  misc_feature (71): n=t or g
cagtatatgtccattggaaatttgatcacaaatatttaggtatatattgatcggtcattgagctgctactntagttgagatcgccaagccgagctccaccg

SEQ ID NO: 41005 - DNA, 101 bp, rice(Oryza sativa)
  misc_feature (71): n=a or g
gtagggggcggacaacgggtgtaaacctagcttgggattggtcgggccggcaacgacggccactttgggcntcgctttccctcctgagagtgttgttgagt

SEQ ID NO: 41006 - DNA, 101 bp, rice(Oryza sativa)
  misc_feature (71): n=t or g
ttgggcgctgatctgcaaattaacttacagaaccactgcgaccaagcttgcagttcatatggagtatattnatttgttttgcaatgcttgcgtgattcttg

SEQ ID NO: 41007 - DNA, 101 bp, rice(Oryza sativa)
  misc_feature (71): n=a or g
ctcaccactatttatttttcagctacccatatttctttttcagcttcggttgaacaaaaaccgactaatangggttttccgacctccaaacatgcaaacac

SEQ ID NO: 41008 - DNA, 101 bp, rice(Oryza sativa)
  misc_feature (71): n=t or c
acctaacataatctatatcacccggttttcggtaacattttacgcccattactttctacccattcttttcntcgtgtttccatctagcagttggtgtcata

SEQ ID NO: 41009 - DNA, 101 bp, rice(Oryza sativa)
  misc_feature (71): n=a or g
gacggagggagtatctatctatatctgtaaacgctcaagcgaccagaacactttaatctcttggatgaccnaagggaagttatgccagagccagaagtagc

SEQ ID NO: 41010 - DNA, 101 bp, rice(Oryza sativa)
  misc_feature (71): n=a or g
gcttcaccttggaccgtaaacagtttaaggctatgtttaagagagagcttatactttctatatactattgntacccactaacttctaaaacttaatacgca

SEQ ID NO: 41011 - DNA, 101 bp, rice(Oryza sativa)
  misc_feature (71): n=a or g
tgagggtttcaagcctttccatgtctacctcaaccgtatcctgagaaggaccctcactcccaaagatggtnatgctagcaacatcaaccatcactctcgta

SEQ ID NO: 41012 - DNA, 101 bp, rice(Oryza sativa)
  misc_feature (71): n=a or g
gcgatggtgccacggcaatgagggcatgcgcgcctgaatctggcctagggagcggcaactttgggtcgatngtgcctggtgtgtgttaccgtcttcccgtg

SEQ ID NO: 41013 - DNA, 101 bp, rice(Oryza sativa)
  misc_feature (71): n=a or c
ggccgcctcgtcggcgtcctcctcgtcgtcgctttgctttagctttttggggtcgccctcctctctctgcntcccccaaaccaacccctcgctgtcccaga

SEQ ID NO: 41014 - DNA, 101 bp, rice(Oryza sativa)
  misc_feature (71): n=a or g
aacatgtgacatgcagattagattcaaaagagatgtgaggatcattgacccaggctcatatggagaaatancatggggtcatattctgacccatctacctt

SEQ ID NO: 41015 - DNA, 101 bp, rice(Oryza sativa)
  misc_feature (71): n=a or g
tggatttgtttcaggaaaagttggatttgttccgttggttcatgggagaaaaatcttgatcgctcgttcanttggaatttgttcaaatgaggtcggtctag

SEQ ID NO: 41016 - DNA, 101 bp, rice(Oryza sativa)
  misc_feature (71): n=t or c
cgctcctcttggtcgccattcatggaggtgatctccataaaggtggcattcctggacaactgcaaatcaangccaccatggaaatgcagcgttatagtggc

SEQ ID NO: 41017 - DNA, 101 bp, rice(Oryza sativa)
  misc_feature (71): n=a or g
ctaatggacaagtcacagcgtcactagtgggcagtgtagcaggttacacagtacaacttgtgtgtgtctcnttgctaatactcgggacccatagtaaatta

SEQ ID NO: 41018 - DNA, 101 bp, rice(Oryza sativa)
  misc_feature (71): n=a or g
gccaaatctaccgcagtatccaattcgataggtctatgtaaaataacagcagctctgatctctgctcgcancccatcaataaattgagtaaaaaaaaaaga

SEQ ID NO: 41019 - DNA, 101 bp, rice(Oryza sativa)
  misc_feature (71): n=t or g
tggagataccagatgcgcttgatgagggattcagtatatctccatttggaaacaatgctcctgctaccgangtagataaaccactcttcaatgtaaaagtg

SEQ ID NO: 41020 - DNA, 101 bp, rice(Oryza sativa)
  misc_feature (71): n=t or c
atgaaacacagtggtaaattatatctaggactgacaccagagtagaacgggtatttatttcctactgctgnatttctcagttctcagttctcactgtctaa

SEQ ID NO: 41021 - DNA, 101 bp, rice(Oryza sativa)
  misc_feature (71): n=t or c
ggtctgccatttgaatttgaagatactcctgataggccagatctgacaaaggaaggaataacatctgaganagatcctttaaagaagtctgcagcattgag

SEQ ID NO: 41022 - DNA, 101 bp, rice(Oryza sativa)
  misc_feature (71): n=t or c
catggaagcaggcagggtggatcagcaagtggcaatgactacgagtctgatgaggatgagactaacagtgngattgattttggcaatcttttgccccgagc

SEQ ID NO: 41023 - DNA, 101 bp, rice(Oryza sativa)
  misc_feature (71): n=a or g
aattgaatttgaataaattttatcaaaccgtaccaatattttaccgtactctacagtaagcacagttaccngtggttaggaaaaccctaggtttggctcgt

SEQ ID NO: 41024 - DNA, 101 bp, rice(Oryza sativa)
  misc_feature (71): n=a or c
tttatgtttataatagttaatacggaattaatcatacgctaatatatttcttattttacttgcctgcaccnaaactaagccaaaccattcgaaagaacgta

SEQ ID NO: 41025 - DNA, 101 bp, rice(Oryza sativa)
  misc_feature (71): n=a or g
tgaatggtgttctttcttcttcgcacattcactttaaggtggaagaactttgtgtttgcgtcgcctttgcngatgtgggttaccttggaggcctgcttttt

SEQ ID NO: 41026 - DNA, 101 bp, rice(Oryza sativa)
  misc_feature (71): n=a or g
cacctttctatgcgaaaggcagctaatagatgtctgagccagtaatgtcctcatcagtgtactaatagatntttcataattttgtttatttcagttgtttt

SEQ ID NO: 41027 - DNA, 101 bp, rice(Oryza sativa)
  misc_feature (71): n=t or c
ctttctgccttttagtagcattatatttgtaaagagattttggtatccctacctctggaccaattacctcnttttttaatatatgatactcttcacttttg

SEQ ID NO: 41028 - DNA, 101 bp, rice(Oryza sativa)
  misc_feature (71): n=t or c
agagccctgattgaaagcctcgcgcgatccatgagcaaaatcagagacagagacgcataacgtccgcaggngcggcatcctgctgaagtagaccaatccag

SEQ ID NO: 41029 - DNA, 101 bp, rice(Oryza sativa)
  misc_feature (71): n=t or c
atcataattgactcgttgagtcagtaggttgagtcggcagatggctcaccccactgtcgaaacaagatttnggcaataataaaaggggtggctatcaagct

SEQ ID NO: 41030 - DNA, 101 bp, rice(Oryza sativa)
  misc_feature (71): n=a or g
accccttaaaaatatggcttcgtccatacacacatacacacctaaacgatgtggtttttctatagacaccnccaaaaatattttatcatttctagctaggt

SEQ ID NO: 41031 - DNA, 101 bp, rice(Oryza sativa)
  misc_feature (71): n=t or g
ggattattcgtctctggaaatccttatttgcactggcatggtcagccgctagttcggaggaaacgtaatcnggtagaccggcgtcttgtcagggtagaaga

SEQ ID NO: 41032 - DNA, 101 bp, rice(Oryza sativa)
  misc_feature (71): n=a or c
gaagacaactcctttgatatacctcctcctccaattttctctctttggaaatttgagactgcatggctatntcttttcttcttttttttcatcatgcccca

SEQ ID NO: 41033 - DNA, 101 bp, rice(Oryza sativa)
  misc_feature (71): n=t or g
tactcagcggtagtagactagtagtaagttgtacgtagctatagagcttacctacagctaaactaataagnccattcccaaccccagacactaaacatagt

SEQ ID NO: 41034 - DNA, 101 bp, rice(Oryza sativa)
  misc_feature (71): n=t or c
ggacaaacatcagtacattgatgcaaataaggaagcacccaatacatgctgtttagctccacacaaatagntagaaaatgaatcattgtcttgtagtatcc

SEQ ID NO: 41035 - DNA, 101 bp, rice(Oryza sativa)
  misc_feature (71): n=a or g
gggtgaagactgaagagtcggactccgactccgactcggggttttcaatttcaaaatttaattttatgtcngggtcaccaaaattttagaaatttctagcc

SEQ ID NO: 41036 - DNA, 101 bp, rice(Oryza sativa)
  misc_feature (71): n=a or c
gtctccattattttattacaataaaggaatttattcatattgttcgagatgaaatgatgaatatggacacnaaagtatagtttaatttgattgctactttt

SEQ ID NO: 41037 - DNA, 101 bp, rice(Oryza sativa)
  misc_feature (71): n=t or c
agaaagggaaatatttacagggcaagccaaaagagctaaacccgcaagaattggccaagagactaagtganatctccaaaaattccaaactcttgaagctt

SEQ ID NO: 41038 - DNA, 101 bp, rice(Oryza sativa)
  misc_feature (71): n=a or c
atatatacatacaaattataaactgcggatatcacttccattcatacaaaggccaggtcacacaaacacanacacacataagtgatgtccgcagtttacgg

SEQ ID NO: 41039 - DNA, 101 bp, rice(Oryza sativa)
  misc_feature (71): n=t or c
catgtgtgtgtgcatccatagtggtgggtgtgattcttttttatggcatgtggtgatatggcttcaacttnctctgtggtttaatatcattccgtctaaag

SEQ ID NO: 41040 - DNA, 101 bp, rice(Oryza sativa)
  misc_feature (71): n=t or c
gccatcttctgctggaccaattggtgctcctgctacacatggaaaatgtgcatcatctgctgttacctttngctacccacggggcaaacttcttgatatat

SEQ ID NO: 41041 - DNA, 101 bp, rice(Oryza sativa)
  misc_feature (71): n=t or c
ccaggtattgaaaaggagggagttccttccacaattccccattcccatcctaccaaaactcccatgtctcncaaccaaataaaacacttaatagcctcatc

SEQ ID NO: 41042 - DNA, 101 bp, rice(Oryza sativa)
  misc_feature (71): n=t or c
cagtttttgggggatgttctgtgttttgtcctcttctagaaattaggtgtttgatacacattattgaggcngagttagttttttttttttggggattgagg

SEQ ID NO: 41043 - DNA, 101 bp, rice(Oryza sativa)
  misc_feature (71): n=a or g
tggtgaaagatggcaagtaaagtttgcaagaatatgagatcacgcgaaagtggaagaggtagcataattcntatcacggtgcaaagagttgacttcctttt

SEQ ID NO: 41044 - DNA, 101 bp, rice(Oryza sativa)
  misc_feature (71): n=a or g
tcatgactgctgccgctgggcttgctgctggcgacagttgttgctcctccttcgtcatgacggatttcttngacgcgtccatggcttctgactgcttccag

SEQ ID NO: 41045 - DNA, 101 bp, rice(Oryza sativa)
  misc_feature (71): n=t or c
tcaattttccttagttttctgaaatgaagaggtagtccaagatatttgcaggggaaatattttgtttggcncggccatccagcaagaagattttgcagatc

SEQ ID NO: 41046 - DNA, 101 bp, rice(Oryza sativa)
  misc_feature (71): n=a or g
caaaggagagaggccaccatggtggtctgatcagctattagctgttagaaccaagctcaattatcttcatngattttctgatgaagccatgcttctttgag

SEQ ID NO: 41047 - DNA, 101 bp, rice(Oryza sativa)
  misc_feature (71): n=a or g
tcgaggaatctctccccctgctcaaataacactagccccttttcctcgtggacaaaaccttcagctatccntctccaaatcaattggtatttctcaatcca

SEQ ID NO: 41048 - DNA, 101 bp, rice(Oryza sativa)
  misc_feature (71): n=t or c
tgaacgccacggaggcgcattgttaacttcatatttcttaagatgaagttaatatataaacttgcacaganaatgcaaaatgtacttatttgtaaactgcc

SEQ ID NO: 41049 - DNA, 101 bp, rice(Oryza sativa)
  misc_feature (71): n=t or c
acaatctaaatttccaatattattcccacacctataagaaaaaatcccattcacacctcacacgattgaanaggatttgaaaaccttaaaatgcttataat

SEQ ID NO: 41050 - DNA, 101 bp, rice(Oryza sativa)
  misc_feature (71): n=t or g
atcagagagtcaattcctttgagtatgttaatatcactctgttccatccttgagatgcacagttgtaagtntgtgagattgtcaaatatactcatccactc

SEQ ID NO: 41051 - DNA, 101 bp, rice(Oryza sativa)
  misc_feature (71): n=t or c
atcaatcatccataacctggctctcgtgctgattttgttaagttgtgttggttgttgctatgctggtaatnttttcgcttatgcttatgcttatcagccaa

SEQ ID NO: 41052 - DNA, 101 bp, rice(Oryza sativa)
  misc_feature (71): n=a or g
gttgaatggtaaaaacacctctctggatctaatgattcgatcgattgtcctaatcccttctttctataaanttaagacccaaagctgagatttggtgaagc

SEQ ID NO: 41053 - DNA, 101 bp, rice(Oryza sativa)
  misc_feature (71): n=a or g
gacctcggcgttccaggtgttccagcgagaagaccagaaagtcaaaagcatcaacgacatcgacggcgtgnttcgagttgagcactcctggatcaagctgg

SEQ ID NO: 41054 - DNA, 101 bp, rice(Oryza sativa)
  misc_feature (71): n=t or c
gtcgaaagcgatcgaaagatttgttcttttcgccccccttttttcctcctcctttcttcctctttggtggngagttgtagagcgagagagatgtgtgcgtg

SEQ ID NO: 41055 - DNA, 101 bp, rice(Oryza sativa)
  misc_feature (71): n=t or c
caaagaaggtacctggtgcaaaatcaaatggcagtgctaatggcactcctccgaataggagactttcggtnagcggtcaccagaacggaaggtctggagga

SEQ ID NO: 41056 - DNA, 101 bp, rice(Oryza sativa)
  misc_feature (71): n=a or c
gttagattactgatccaaatggtcattggatggaagctcagatgggcactccaatcacttgattgactganatgatagttggttgttttttggattcctgt

SEQ ID NO: 41057 - DNA, 101 bp, rice(Oryza sativa)
  misc_feature (71): n=t or g
ttctctaaaactcccatgaatcaagccattccacgagaactttataggaatctgaagtgcccatttctttnttctaaaggagcacatgggaaaaattctat

SEQ ID NO: 41058 - DNA, 101 bp, rice(Oryza sativa)
  misc_feature (71): n=a or g
cgccgccatgtctgcctgacgagaacacgcaggcggattgcacgccaatgtgccgattgtttaaccagtanagatcgtagagcgcgcagaggaccctgaag

SEQ ID NO: 41059 - DNA, 101 bp, rice(Oryza sativa)
  misc_feature (71): n=t or c
cactcctctctttgaaatccccgacgatgccgattttgagtacacatccatgctcgccgctgacgacttcnccctcatggacggcgactttcttgctgacc

SEQ ID NO: 41060 - DNA, 101 bp, rice(Oryza sativa)
  misc_feature (71): n=a or g
cccttttacatacatgtcatcagaaatgccacaaaaaatacgaaatagttcaacaaacacgggacaggttncatcatcatacattgtttttgcaaacatac

SEQ ID NO: 41061 - DNA, 101 bp, rice(Oryza sativa)
  misc_feature (71): n=a or g
cttatatggcaatatggttgctaataattagtgggaagaaacagacctgtactgcagcggagggaagagangtgggggcattagggaggggaggaaggcaa

SEQ ID NO: 41062 - DNA, 101 bp, rice(Oryza sativa)
  misc_feature (71): n=a or g
atcttagttataaagagaaggcactgacaacaaatttgggatataactacatctcatatactacacggatntgatcttatcacagcacacctaatatcagc

SEQ ID NO: 41063 - DNA, 101 bp, rice(Oryza sativa)
  misc_feature (71): n=a or c
ggctggttacctaactacgatagttgagtatacaagattcagcttataaggtagacacgagtgagaaatgncagggtcttctggctagctccacaaggtgg

SEQ ID NO: 41064 - DNA, 101 bp, rice(Oryza sativa)
  misc_feature (71): n=t or c
ggaaggataaggtattttggtacagcagttatgttcctaaactctaccagtagtcaccacaagagcagacnccatcttcaaagtggtggaaacgatttagg

SEQ ID NO: 41065 - DNA, 101 bp, rice(Oryza sativa)
  misc_feature (71): n=a or g
cattagcagcaagacctgagtcagcaagatactgaaccaattgtgtgctcttcccagaaccagtttccccnatcaaaatcatcacctatggaaaacaaagc

SEQ ID NO: 41066 - DNA, 101 bp, rice(Oryza sativa)
  misc_feature (71): n=t or c
atgtaactttcttgtatgtacatatataccttctcgagatgttatcattaaattctctccttctctatttnagagaagcatcgaatgagtatgaatcaagc

SEQ ID NO: 41067 - DNA, 101 bp, rice(Oryza sativa)
  misc_feature (71): n=a or g
tagcccaggcttaggtaggccttgattttgtctgaactgagagctttcctttccggaaaaagtccaatttnactcctttaattgtacgccgaatctaattc

SEQ ID NO: 41068 - DNA, 101 bp, rice(Oryza sativa)
  misc_feature (71): n=t or c
tacggctgccagtcctgcaaggccggtgttcttggcaacctgaggagcagctggaagaagatcgccttcgncaacgccgccttcgtcgccctcctcctcgt

SEQ ID NO: 41069 - DNA, 101 bp, rice(Oryza sativa)
  misc_feature (71): n=a or g
ttatagtaatgtatagtagggcatacatattgcaacgggtatagataactgtagaattcacatcttccttngtgttagtgtatagataactgtaaaattca

SEQ ID NO: 41070 - DNA, 101 bp, rice(Oryza sativa)
  misc_feature (71): n=a or g
cacccaagcgtagaaattcaggttagactaagaactgctagtggaacctagctttaatggtgaactcgtcntctctaacatccggcgttgctgctgcagtg

SEQ ID NO: 41071 - DNA, 101 bp, rice(Oryza sativa)
  misc_feature (71): n=a or g
cggattctacatcaaacatatagccaattgttgaaaaccctatctttatcggcaggtatcgacatcagctngaattactccatcggcttgtcagccgatcg

SEQ ID NO: 41072 - DNA, 101 bp, rice(Oryza sativa)
  misc_feature (71): n=a or g
gtagggaagaaacttgcaattgggaaatgtatgctttatatctctgtttttaagttccaatgtggtcactnatattaggtgactaatgattatgcagaaag

SEQ ID NO: 41073 - DNA, 101 bp, rice(Oryza sativa)
  misc_feature (71): n=t or c
ctatcgagactctttccatcccggtaactacagcaatcacaccctagcatcggtgtagtgacacattcatngctcaatttcacattattatataccaattc

SEQ ID NO: 41074 - DNA, 101 bp, rice(Oryza sativa)
  misc_feature (71): n=a or g
tgttgattaggagatcctttgtttctcaccttgattgtctttactcagtttaatcgtcggcttcctcttgnttattgtcatcaggttagagcaagggacga

SEQ ID NO: 41075 - DNA, 101 bp, rice(Oryza sativa)
  misc_feature (71): n=t or g
ctctcatcctctggcatggggcaatttaggaacccaaattgattcatttgcgaaacaagctgatcaatctnttcaactatctgctggagtttctttcctat

SEQ ID NO: 41076 - DNA, 101 bp, rice(Oryza sativa)
  misc_feature (71): n=t or c
actcatacccgccatgacctcaggtgtatatgcattatatatcctgctgccatatcttgagatttgcatcntccgatctaccgctgaatttctcttggttt

SEQ ID NO: 41077 - DNA, 101 bp, rice(Oryza sativa)
  misc_feature (71): n=a or g
gctcttgattttggattgatgtcaaatataaattgttttgaatttggcgggtggagaattttgaatttggngtaggggatttttggcggggtgggttgatt

SEQ ID NO: 41078 - DNA, 101 bp, rice(Oryza sativa)
  misc_feature (71): n=t or c
aataacactgtcttgatccatactatattactatgtcgatcagttaaggtgtttgtgtcaatgttgaatgngaccagctgaacatggactgatatagatgg

SEQ ID NO: 41079 - DNA, 101 bp, rice(Oryza sativa)
  misc_feature (71): n=t or g
agagaacctggaggaggtgtttgtgctgcgaaacgactcctcgaatggacctgggagaagctgctctggcngaccaggcaccacaccttcaggatcaactg

SEQ ID NO: 41080 - DNA, 101 bp, rice(Oryza sativa)
  misc_feature (71): n=t or c
cttcagtgtttttcagcaaattacatgttttttaagtgtcttgtagtcaattcatgattttacgatgtcanatagctaattacacattttttgagtgtcct

SEQ ID NO: 41081 - DNA, 101 bp, rice(Oryza sativa)
  misc_feature (71): n=t or c
cagttcgtttactgctgctgctgagagcctgagagttggtctgaatctgtgatttactgctgatgagctgngttgctcctgcaaaccttcgctgcaggcaa

SEQ ID NO: 41082 - DNA, 101 bp, rice(Oryza sativa)
  misc_feature (71): n=a or c
gctaatcacacacggtacaacggcatagtgcacagcctgttgccatcactaatcagtcacaagctgagtanatgacacaaaatgccatatagttgttggca

SEQ ID NO: 41083 - DNA, 101 bp, rice(Oryza sativa)
  misc_feature (71): n=t or c
tcaaagaatctggatggtaaaatatgcactgacctgggacatcatctagccctgaaaacacatcatcttcntcattcggtactgtgctacgatcactttca

SEQ ID NO: 41084 - DNA, 101 bp, rice(Oryza sativa)
  misc_feature (71): n=a or c
aacaaataaggattcgcttgcccaacatatatacagatgccctgcaatatttacatcttctaggtctaggnatattagcaaattagcaaaacaggtggaag

SEQ ID NO: 41085 - DNA, 101 bp, rice(Oryza sativa)
  misc_feature (71): n=a or g
ctcacacaagaacgcgatccgattgaaaattgaatcgggtgattttgttcgacagaaatgaaaacgttccntgctttttaagtagtagagaagagaagata

SEQ ID NO: 41086 - DNA, 101 bp, rice(Oryza sativa)
  misc_feature (71): n=a or c
gttcttaaaataagacaattttggctatgtacatggacactgtccaggttgtctaggtgcaaagttaatanttatagtattatttttctagacggagttag

SEQ ID NO: 41087 - DNA, 101 bp, rice(Oryza sativa)
  misc_feature (71): n=t or g
tgcttatgccacacctttggttattagcaggggtgtccatgaaataaccaaaccttggaagggcacatgcncatttctaccagcatctttttgcatccgcg

SEQ ID NO: 41088 - DNA, 101 bp, rice(Oryza sativa)
  misc_feature (71): n=t or c
gcttattgatgtcacttggtcattactcaatgatcttctggctccgtggtatggcgtttcatctggttgangctgttctcctattgaacttgcgcgtgagt

SEQ ID NO: 41089 - DNA, 101 bp, rice(Oryza sativa)
  misc_feature (71): n=t or c
taacagcattcatgggtttagctggttggtgcagtaacagtaggttcaaccattatagaagaggtaaaatntgctacaggacgtctaaattttgagtagtt

SEQ ID NO: 41090 - DNA, 101 bp, rice(Oryza sativa)
  misc_feature (71): n=t or c
taaggcgtttgttcacgaacaacgcgcatgctagaacgatgtgctgtcgcgcagaagaatgtaaacatganaggatgctgagacaccccgccaatgggtcg

SEQ ID NO: 41091 - DNA, 101 bp, rice(Oryza sativa)
  misc_feature (71): n=t or g
caggagatctgcgcatcacccaccaagccacacggcattcttcttgaattgctccctgaatttatttaatnttacagaatattccatatgttatctttttt

SEQ ID NO: 41092 - DNA, 101 bp, rice(Oryza sativa)
  misc_feature (71): n=a or g
gggccctcggcggtggcgagctagacgcagcagcggagcagcccccattttttgtgactccgttgagcgangcgctgccgcgcagcacccgacggcaccca

SEQ ID NO: 41093 - DNA, 101 bp, rice(Oryza sativa)
  misc_feature (71): n=a or g
ccagacccggtcatgcctgggccgtgtcagggcgagcaacccactgagccatctatagcaacaggatccanacgtaatccggcctccaaaaaccgtgaaga

SEQ ID NO: 41094 - DNA, 101 bp, rice(Oryza sativa)
  misc_feature (71): n=t or g
gaacatttgcttcggtgcatatcaatagccggaggcgaagaagtggtgaaggaaatccaccaaggattgtntggagcccatcaggcagcaaggaccgtagc

SEQ ID NO: 41095 - DNA, 101 bp, rice(Oryza sativa)
  misc_feature (71): n=t or c
tgtcgaacaggatcaaagtatgcacaaaactagccattctcgacatagccatcgctactactggttatagngagggttacctttttctttttgctcgcgcg

SEQ ID NO: 41096 - DNA, 101 bp, rice(Oryza sativa)
  misc_feature (71): n=a or g
catgctacttactccgttgatataagaaatttcagcatcgttatcactatatgacattttagttatcctgngcaggaatatttctgttatcatgtaattaa

SEQ ID NO: 41097 - DNA, 101 bp, rice(Oryza sativa)
  misc_feature (71): n=t or g
attaaaagtttttttatataaaatttatatgtgtacactttatacgtataaatacgtatagagttgtcttnaataacttttcgtattggaccagttacact

SEQ ID NO: 41098 - DNA, 101 bp, rice(Oryza sativa)
  misc_feature (71): n=a or c
cttcagagttcagctagagaccatcacatcacgtgcactgttcctttcaacgatcggctgctactactacncgatggtgaacatgcacgtctcccgtcgtc

SEQ ID NO: 41099 - DNA, 101 bp, rice(Oryza sativa)
  misc_feature (71): n=a or g
gagaggctgaaatgcagttgcacagctcaatggattaactggaatgcgaattacaagccaattgggagtangcactaacctaggaccctcttcacatgcag

SEQ ID NO: 41100 - DNA, 101 bp, rice(Oryza sativa)
  misc_feature (71): n=t or g
atcttgagagtttatgggtcaggaactcgggatagtttagatctctagtgtcctttggtcacttttttctnctgtggcgtgtctgttttaatggaatgtag

SEQ ID NO: 41101 - DNA, 101 bp, rice(Oryza sativa)
  misc_feature (71): n=a or c
acctcttgtttcacccggctacaacccctgtaacttagccccaaggcatagtgacagcagagaagataatnttctgacaactagaactggtttgttgtgac

SEQ ID NO: 41102 - DNA, 101 bp, rice(Oryza sativa)
  misc_feature (71): n=t or c
ccctgctgtgaaaagaaaagaaagggtaacgttggacgagaggactcacatgtaatgtaagcaacaaatanacttgcttcgtcttgctcttgcgtgtttgg

SEQ ID NO: 41103 - DNA, 101 bp, rice(Oryza sativa)
  misc_feature (71): n=t or c
acttttctataaaaaaaacgaatttggcagcattttgacacaaatccttagctttggaggtctggtctagncatagaagaacatggctacatttgctacgg

SEQ ID NO: 41104 - DNA, 101 bp, rice(Oryza sativa)
  misc_feature (71): n=t or c
aaaacctagcaagaatcttatcaggggagaggagaaaatgtagaagctggttcagtgtaggtagctagtgngtgcccccttgccaaaagcccaaaacttct

SEQ ID NO: 41105 - DNA, 101 bp, rice(Oryza sativa)
  misc_feature (71): n=a or c
aaaaagtattgaagacccacagcaatttctagatcggagtctgacaactcagccccgtatctcatgaaacnaactcgtcatgggcaaatggggcttggcct

SEQ ID NO: 41106 - DNA, 101 bp, rice(Oryza sativa)
  misc_feature (71): n=a or g
attccagtttggggctttgggcaatttggttctgtaataagcttgcataagttaaggatggaatagggtcntccctagcccaactggagtagcaattgcat

SEQ ID NO: 41107 - DNA, 101 bp, rice(Oryza sativa)
  misc_feature (71): n=t or c
agttgttcggtcatcagtcaagaatgcatcttagccgtttggtggctgtagccactgctagttatctactntctccgtcctataatataagggattttgag

SEQ ID NO: 41108 - DNA, 101 bp, rice(Oryza sativa)
  misc_feature (71): n=a or g
tgagggaagaaaggttccctaatgatggagggatgttccctacaagtttgttccttgctaaaataaaagtnctgagataagggagtccaccaagtgatggc

SEQ ID NO: 41109 - DNA, 101 bp, rice(Oryza sativa)
  misc_feature (71): n=t or g
actatgtctaactatggaagaggtaattaatcggcataaagatggcatttgtagcttgtgcttaggcaatnaataaatttgcgtatttctggatcttatac

SEQ ID NO: 41110 - DNA, 101 bp, rice(Oryza sativa)
  misc_feature (71): n=a or g
acagcagcagcaacaattcttagcacaggcccaagcacaaggcaatcttagcaactcaagtaactatgggnatttggatccccggagatatacagcactaa

SEQ ID NO: 41111 - DNA, 101 bp, rice(Oryza sativa)
  misc_feature (71): n=a or c
attgcagccacctgaattatgattctcttcaccacagtgtttgcaatgaatgatcactccatgctttgacnacttaggtccatttttcccttgcacctcat

SEQ ID NO: 41112 - DNA, 101 bp, rice(Oryza sativa)
  misc_feature (71): n=t or c
ccacaagcatcaggggaagatccacaagcacatgtagaagtggagttctaactagtgaatccatccttacngtggagaagacatgtgagagcgcaaaggat

SEQ ID NO: 41113 - DNA, 101 bp, rice(Oryza sativa)
  misc_feature (71): n=a or g
gagatgctagtcgttgccccagtgcccgcgaatctagccggcatttcgattgttttgccacgtcattatgntcccgtttgagttcactgaatataaagatt

SEQ ID NO: 41114 - DNA, 101 bp, rice(Oryza sativa)
  misc_feature (71): n=t or c
cattgggccggccggtgccgtgataatgtgacatgacatgccagtgaattatgccaagctgccgaccttgnactgaatattccccctttctcccctcgaat

SEQ ID NO: 41115 - DNA, 101 bp, rice(Oryza sativa)
  misc_feature (71): n=a or g
gtgacgataacaatattacaccaccaacaacttaaagactggaaggtaaacgaaaagggagttactgaaanagaagagttatttttaattacataatggta

SEQ ID NO: 41116 - DNA, 101 bp, rice(Oryza sativa)
  misc_feature (71): n=t or g
cggggccgggagacccacatcggcgtttcttctcgacaaacagctcttccagtcttcttcttcttgttttnttgaatggtttagcgaggtttcagatgaac

SEQ ID NO: 41117 - DNA, 101 bp, rice(Oryza sativa)
  misc_feature (71): n=t or g
atggattgggtggccaggtgtacaccggggtactggcccctacaacttatatctgaaaatctagtaagtgngtccggggtctagtttctggtcactttcac

SEQ ID NO: 41118 - DNA, 101 bp, rice(Oryza sativa)
  misc_feature (71): n=a or g
cacgaggggtggcccgatcttcacggcagtaggttcaagacaaaagagcgccggtgtaaaccgaaaacaanagggtaactagctgcgagcagcaagaggat

SEQ ID NO: 41119 - DNA, 101 bp, rice(Oryza sativa)
  misc_feature (71): n=a or g
atcgcaggcgcccatcctagtgctaagcaacggctaacgcgggatttttggagcaggcactagaacggatnccctcatcttaatcgggcggtaagtcccat

SEQ ID NO: 41120 - DNA, 101 bp, rice(Oryza sativa)
  misc_feature (71): n=t or c
gatccaccattgctgttgaagaggtggcgaggagcgatggcggcggcttctagagcgatctcgacgataangggagcagacaacgacgtgggaatgggagc

SEQ ID NO: 41121 - DNA, 101 bp, rice(Oryza sativa)
  misc_feature (71): n=a or g
ttgtctttcttgcgccacttgacatgtatcttcttggcaaggtcgtaccagacgtccttggagccgtcgcntgtgcagtactgcaacatgttgtgctgcca

SEQ ID NO: 41122 - DNA, 101 bp, rice(Oryza sativa)
  misc_feature (71): n=a or g
gactagggtggctagggcgacggtgatgatgacggaggcctcaagagcggcggatcaagcgccaaggaggngcagtctcagaatcgacaaggtgtgcggtg

SEQ ID NO: 41123 - DNA, 101 bp, rice(Oryza sativa)
  misc_feature (71): n=t or c
gtccactgccaccgctgaaacgatcgcaccctatgtcacgtaactttattacagatatgtgtggtaaatcntgaacccatatatcaatgataaaaatacat

SEQ ID NO: 41124 - DNA, 101 bp, rice(Oryza sativa)
  misc_feature (71): n=t or g
atgattttctaagtttaaacaaaccgttgttgttggctgttcgtaaggcttcattgaccatctatacgtcnatattttatttttctttataactttagccg

SEQ ID NO: 41125 - DNA, 101 bp, rice(Oryza sativa)
  misc_feature (71): n=t or c
cagtcttcttaaaattttacaaactactcccatctataagatattttgattttctttcataataaaagttntttaggtttgaccaagtttgtataaaattt

SEQ ID NO: 41126 - DNA, 101 bp, rice(Oryza sativa)
  misc_feature (71): n=t or c
acaatagacaggccattgaatcttgatctaatggtattcatcagtcaagagatgagcaacaaaggtggaanagttatagaaattctgacaatagattattg

SEQ ID NO: 41127 - DNA, 101 bp, rice(Oryza sativa)
  misc_feature (71): n=a or g
tctaattctcttgggcaattcttacgatgataccctgcttaccttcaacaaaggagagtttcccaagctcnaccttcttattgttgagtgccctaccatca

SEQ ID NO: 41128 - DNA, 101 bp, rice(Oryza sativa)
  misc_feature (71): n=t or c
tcatgccctcggggcccaaacgtacgtattactctctccatcttggtacacaaaacaaagataagtaattntacttatcatctatttaaacatactactag

SEQ ID NO: 41129 - DNA, 101 bp, rice(Oryza sativa)
  misc_feature (71): n=a or g
acaagttcgatttcacttgtaacctgttctgagttctgacgaacggccttgaacatcacaagtagtcatgngaaaattaggaaatggagtactactcaatt

SEQ ID NO: 41130 - DNA, 101 bp, rice(Oryza sativa)
  misc_feature (71): n=t or g
tccgagaatactactacaataacaggcttatgcaacttaatttggacctgcaaattcccacgacacaaccnttcatggagtctcatcagcacttccttgct

SEQ ID NO: 41131 - DNA, 101 bp, rice(Oryza sativa)
  misc_feature (71): n=t or c
tgtcatgcatgcagtaatgtgcagtggcacacatcttgaataaacagaaaagatatccggcaaaagttttntgcgaacgcgcaaaaggattgcacgtcaat

SEQ ID NO: 41132 - DNA, 101 bp, rice(Oryza sativa)
  misc_feature (71): n=t or c
gcggtatgaattgctcggtgcccaattccatgctttttttttctacaaacatgtactccctcttctgtctnattttaagtgcaatcgtgagtatttgtgct

SEQ ID NO: 41133 - DNA, 101 bp, rice(Oryza sativa)
  misc_feature (71): n=t or c
acaaaaaaaaggaattcttgctgcctccatcaaaacattaaacgaccatccatgtccatgaacccttgtantaacggtacaccacacatttatatcattta

SEQ ID NO: 41134 - DNA, 101 bp, rice(Oryza sativa)
  misc_feature (71): n=t or c
cctaggcggccatttagctctgagggtcaaatccgcttggaaaaataatctcccaacatctgcaaaaatgntttttctagtagtgatgggtattaagaaag

SEQ ID NO: 41135 - DNA, 101 bp, rice(Oryza sativa)
  misc_feature (71): n=t or c
ttggacaaagacggtggaagttgagtaacaaatacggtgattaggattagatgctcgcagtataatatgcnacttattatgcagagattagagagcatccg

SEQ ID NO: 41136 - DNA, 101 bp, rice(Oryza sativa)
  misc_feature (71): n=t or g
tgaacatctaaggtaaaactgaataataagttagtaaaacaccacaggaacaatgcaacttgcaagcaganattggtagaaagattttgtacacacacaca

SEQ ID NO: 41137 - DNA, 101 bp, rice(Oryza sativa)
  misc_feature (71): n=a or g
aggccagtggaaaaagacatgacagcacccaaagcaaataatgaggaaaaaggagtggattttgaaggagnagctatgggcagcaagtaaaatgccttgag

SEQ ID NO: 41138 - DNA, 101 bp, rice(Oryza sativa)
  misc_feature (71): n=t or c
gcgccccgaacaggttgtccatgtacgtctgcttcaggttcgtcatgatgttgggcagcttcatcagcctnccgtcctcctgtgcggccggctcaggcgcc

SEQ ID NO: 41139 - DNA, 101 bp, rice(Oryza sativa)
  misc_feature (71): n=t or c
ttcatttttacatgaagtggaaatatttcttcctaagcatgcatgaaaatcgaacgagtccttaataaagntccccaaaatgccctcacgcttcccctccc

SEQ ID NO: 41140 - DNA, 101 bp, rice(Oryza sativa)
  misc_feature (71): n=a or c
caatttaaaccctcaactctttaatccggacaaattacacccgagcactattttgggctaggctggctganatgacatttctaaagtggctaaaaaaatat

SEQ ID NO: 41141 - DNA, 101 bp, rice(Oryza sativa)
  misc_feature (71): n=t or g
aaacaagaactgaatgaatgaggatgatgccgcctgccgtttctatccttttatgcatcctgttttgtacncagcggtgaatgcgtttcgtgacatatcag

SEQ ID NO: 41142 - DNA, 101 bp, rice(Oryza sativa)
  misc_feature (71): n=a or g
tgaggtctgattatctgattctatcctatgtgcatttctcacattgttcacccaactacctgtgtctaccnttctttgtgtagggaatactccattgtgaa

SEQ ID NO: 41143 - DNA, 101 bp, rice(Oryza sativa)
  misc_feature (71): n=a or g
ttgtagatcaaatgtggagatctgtttgagaacactgtggtcgatgagttcaacgagtgtgctgtttcgcncaagaaatgcgtcccacaaaagtccgacgt

SEQ ID NO: 41144 - DNA, 101 bp, rice(Oryza sativa)
  misc_feature (71): n=a or g
tttagaggaggagaagggggagacagcggcggggccatcatacccggattcgcagtctgcccacaagaacnccagctcctgacgtcgacgccacacgctcc

SEQ ID NO: 41145 - DNA, 101 bp, rice(Oryza sativa)
  misc_feature (71): n=a or g
agaggcactcccagagtcccaggtattgaaacggacccagtgatcatgtgtatacaaggagcacaaatgtncagcaagttaggcttggacttcagattaag

SEQ ID NO: 41146 - DNA, 101 bp, rice(Oryza sativa)
  misc_feature (71): n=t or c
agatcacgagaaagcatagcctagtgcacaataaagcttgttcgggcaagctcgtctcaacattttttagngtccaaatttatcttggtaatgctagttga

SEQ ID NO: 41147 - DNA, 101 bp, rice(Oryza sativa)
  misc_feature (71): n=a or g
gtttggtttttggggggcgaattgaacacggggcgtgaggggggcattaatagtttgtcagccgcaacggnggaagagaagaagggtcagcgtggcacggc

SEQ ID NO: 41148 - DNA, 101 bp, rice(Oryza sativa)
  misc_feature (71): n=t or c
tatgaaaagtttaaacattcattgacgatatggacttatgttcacctgattgaaagtgggtttacgttttngtcaaattgactctgataccgtatcgagtt

SEQ ID NO: 41149 - DNA, 101 bp, rice(Oryza sativa)
  misc_feature (71): n=t or c
gcctacctcggcttcacggcgtccaccggcgtcagcttcgagctcaactgcatcctcgactggaacctcangatcgagacgttcccggccgacaagaagag

SEQ ID NO: 41150 - DNA, 101 bp, rice(Oryza sativa)
  misc_feature (71): n=t or c
tatccatatcagttctggagcggccgcaatcttcattttattaccaagtccttttctatccacggtgctgngtcacctctttgggcccaatgggccgtgta

SEQ ID NO: 41151 - DNA, 101 bp, rice(Oryza sativa)
  misc_feature (71): n=t or g
aaggggagcgtgcatacgaagtgcttgcatgatcaatgaagttacatgtactactacaaaacatcaaacanatgtgagcgctataggtgatggaagtgcta

SEQ ID NO: 41152 - DNA, 101 bp, rice(Oryza sativa)
  misc_feature (71): n=a or g
ggcaaattaaagcgtgtaatgatgcatctaccaaatgctaaattgctaatggtgggatattccagataacnctagaatgattcagacaggccaagcctccc

SEQ ID NO: 41153 - DNA, 101 bp, rice(Oryza sativa)
  misc_feature (71): n=a or g
aatgggaggggtcaatctagcaaagcccacattgacaagtatttctttccagatcagtaccgtccacgcanccgtgacagcaacagaaagacgccatgtcg

SEQ ID NO: 41154 - DNA, 101 bp, rice(Oryza sativa)
  misc_feature (71): n=t or c
actgcaatcattttgtgaaattcagacatatttcaaaatgagcccagttgagacttgagagcaacgagtgnatactgaatttgcctgaaagagtgtcacta

SEQ ID NO: 41155 - DNA, 101 bp, rice(Oryza sativa)
  misc_feature (71): n=a or g
cgtactttttctatttttaattaaccgatacctatataggctatatgtgtcagttttttcttagaaaaccngcacctatactatattaaagatgtcgggtt

SEQ ID NO: 41156 - DNA, 101 bp, rice(Oryza sativa)
  misc_feature (71): n=a or g
tgttggagctactgcagtcactggcatgaaagatacatacttcatcagctgcaattacacttgcaagatcntgaactatatcatgcatcttgagtacattt

SEQ ID NO: 41157 - DNA, 101 bp, rice(Oryza sativa)
  misc_feature (71): n=a or g
tcgtccatggcagagaggtcagcaacagcaaagtggccatcgttgggagtgaagccaaaccagagcttganctcgtggacatactcaaacttgccttggaa

SEQ ID NO: 41158 - DNA, 101 bp, rice(Oryza sativa)
  misc_feature (71): n=a or g
ctatagtagtgggttgtactagtgatccaacgattcgttggcataataagcctggcctaaggtcatgcctntaactcgcctggcatctgtttggttgctac

SEQ ID NO: 41159 - DNA, 101 bp, rice(Oryza sativa)
  misc_feature (71): n=t or c
ttagtggcattggtcttccttctatatgccaacgtgataacacagtgcatacaagtgtatatgtgatattnagtcttgtcattgtccttctatggggaccg

SEQ ID NO: 41160 - DNA, 101 bp, rice(Oryza sativa)
  misc_feature (71): n=t or c
ttaatttttgtaagttcagattatgcatgtatctgtttatgattatgaaggctaatctgatatttgatttnggttttgctataattatgtcgccataaatc

SEQ ID NO: 41161 - DNA, 101 bp, rice(Oryza sativa)
  misc_feature (71): n=a or g
tgctactaattcagtgatgaattggggtgcatgacgcaggtacgtgtggcgggtggcgcgcgcatatgtcnccgggaacccaaaggccgtggcggcgattg

SEQ ID NO: 41162 - DNA, 101 bp, rice(Oryza sativa)
  misc_feature (71): n=a or c
aatatttaattggatggactattaaattgattcatgtacgttatcctcctagaaacaaggaggtgtcgatnatgcatgcacaagttatcagggtgcagaga

SEQ ID NO: 41163 - DNA, 101 bp, rice(Oryza sativa)
  misc_feature (71): n=a or g
gcatacctgagggataacaactagaaagaggtctatcctgtacatggaagctgatttatggaatagatgcngtttccattcaccccaccatctgtcaatgg

SEQ ID NO: 41164 - DNA, 101 bp, rice(Oryza sativa)
  misc_feature (71): n=t or c
gcgcgcgcgagatatgtatgcaagcattttacttactgatccagtacgtcttttacttgccccgccccggncgcatgcggcatgcatgcattcatacgcat

SEQ ID NO: 41165 - DNA, 101 bp, rice(Oryza sativa)
  misc_feature (71): n=a or g
cggccggcttgctcccatccatcacctccttggacaggtgagggcgcagcgtgacgtggtaatccgggtcncggatccgtttcagcgtgtaggcttggcag

SEQ ID NO: 41166 - DNA, 101 bp, rice(Oryza sativa)
  misc_feature (71): n=t or c
ggttgtcaccccctgaatcctgctttagaatgtctaacagctccacagggtcctgaagatttagaagtttncttgagcctatgtgatagatatccttccca

SEQ ID NO: 41167 - DNA, 101 bp, rice(Oryza sativa)
  misc_feature (71): n=t or c
gccatggattgccgccttcggatggaaagggaagacgagaggtttccacgcttttcggggtttgtatttcngatgccgttggatcccccacctcctcacta

SEQ ID NO: 41168 - DNA, 101 bp, rice(Oryza sativa)
  misc_feature (71): n=t or c
tggctactaatatctattgaattgatatgttctaagggctgggcgtgaaatccacatgtaggtaggctganttgtagtaacaaataacgaggagagtatat

SEQ ID NO: 41169 - DNA, 101 bp, rice(Oryza sativa)
  misc_feature (71): n=a or g
gatgatacaattttctctccataaagcaaaattcaaacaggtaagacagatcgcaacgccgcgagacattncggatcacaacataagacaaatcttatctt

SEQ ID NO: 41170 - DNA, 101 bp, rice(Oryza sativa)
  misc_feature (71): n=a or c
aagtggaacgaggtttcgttctctgaatttaagtgcggggtactaatttaaactttgttcatgcgtagttnttaggaggctcggcttccttggttcctgca

SEQ ID NO: 41171 - DNA, 101 bp, rice(Oryza sativa)
  misc_feature (71): n=a or g
tggtagaaacaagtttaggaatgggacgagtttatgattggacgtttgtgcaactaacctatctgtgtttncaaaataaggaagtatttttccttctccaa

SEQ ID NO: 41172 - DNA, 101 bp, rice(Oryza sativa)
  misc_feature (71): n=a or g
aagcagcatcttgtcaattggtataaatactcctcgctttcaagccaggagccatcacagctttatcaccngcatccaatccacacatatagttacctcct

SEQ ID NO: 41173 - DNA, 101 bp, rice(Oryza sativa)
  misc_feature (71): n=a or c
atgaaaaaaaaaggtggctcgatgcatcagcttcattagcaacacagaaaccccgttcggtgcgttcgagncaaaaaatttctcggattgctcaatcaatc

SEQ ID NO: 41174 - DNA, 101 bp, rice(Oryza sativa)
  misc_feature (71): n=a or g
gggaaaacggttcttctgtttctttagaaaggagcattacgcgtatgatcgtaatgtagatgaggggaatngatagatggatgcgctttcagtaataaaaa

SEQ ID NO: 41175 - DNA, 101 bp, rice(Oryza sativa)
  misc_feature (71): n=a or g
ccggccgacccgacagtctgaccggcaagatcctgatcgttgtcgatttcgggttgtcttgttagatttgnatgtttccttcggggatttgcttctacatg

SEQ ID NO: 41176 - DNA, 101 bp, rice(Oryza sativa)
  misc_feature (71): n=t or c
atgtgtttacctcgggctctatctagaattagaaaacggcacatgctcccacagttcaccttttgtaaccnttattttggcttaaaatatattgtcaccgg

SEQ ID NO: 41177 - DNA, 101 bp, rice(Oryza sativa)
  misc_feature (71): n=t or c
ttttttttactatactcaccatgtgaatgctctctgctagacacccttctctatagaacaaagcacattgnaagctgatggccgccatattttgctgatat

SEQ ID NO: 41178 - DNA, 101 bp, rice(Oryza sativa)
  misc_feature (71): n=t or c
gcgagaaaccacagaacgctgggcataaggttgcagcttcagaagcaccaaatcccccacttgatattgangagcagtgcgtttagaatcagccaactgct

SEQ ID NO: 41179 - DNA, 101 bp, rice(Oryza sativa)
  misc_feature (71): n=t or g
ataaatttcaactagaatatttgacatggagattttggaaagcgggatattttgggccggaaaacttatgngcttgtggtgtggcccgtagttgcgcttgt

SEQ ID NO: 41180 - DNA, 101 bp, rice(Oryza sativa)
  misc_feature (71): n=t or c
cctttcgaaagatgcataggtacccctttttaatttacgtccccattgtttggctcggcatatttacaaangagaagtaatttataaataaaatttttata

SEQ ID NO: 41181 - DNA, 101 bp, rice(Oryza sativa)
  misc_feature (71): n=a or g
ttatcctttcctaattctctcttcagatacaatgattcaacgatagaaccttgaaactcaaccgtcaccgntggatacgcttgccggagaagacgttgcag

SEQ ID NO: 41182 - DNA, 101 bp, rice(Oryza sativa)
  misc_feature (71): n=t or c
aggcccatgggcctccgcgaaacccgagtcttgaattggaatcgtaaatatactcttaaaccgaattagancatgaaccatccaagctagccctaaaaacc

SEQ ID NO: 41183 - DNA, 101 bp, rice(Oryza sativa)
  misc_feature (71): n=a or g
gttttaaagaattaaatttaatggtgaagttctacatccacttcaaacaagaaaaaaaaaagtacctcgcnacctagattttgcttagggcatctttgttt

SEQ ID NO: 41184 - DNA, 101 bp, rice(Oryza sativa)
  misc_feature (71): n=a or g
catccacctatccgtcgaagaaacatacccacacacatgccgaagccgaattggcaaacgaaacaaggtcnttgccgagccaaaaccagccgaccagccac

SEQ ID NO: 41185 - DNA, 101 bp, rice(Oryza sativa)
  misc_feature (71): n=a or g
gacttactccccaagtttcttatggttgatgcaacagccgagtcactggcccaacaagattagggaaaagngatcacaagaatacattctgatttctcaat

SEQ ID NO: 41186 - DNA, 101 bp, rice(Oryza sativa)
  misc_feature (71): n=t or g
gattggacgactgctgattgggtgatcatccccttaacactttatacccctacgttgtataatctgattanaaacaaaaaattctttcgtgagtgaagtgt

SEQ ID NO: 41187 - DNA, 101 bp, rice(Oryza sativa)
  misc_feature (71): n=t or g
aaaaaaatgctctttctaaaactcatttccttggcaaacgcatatccacctagtcttttgcatgcaaaacnaaacacaaacaaagctagtaagaaattttt

SEQ ID NO: 41188 - DNA, 101 bp, rice(Oryza sativa)
  misc_feature (71): n=t or g
acactgctataaaatctggtctccttttgaaatccaagctctgggagaccactgattttattactggtggntacgtcgttggaccaaataaatgatataat

SEQ ID NO: 41189 - DNA, 101 bp, rice(Oryza sativa)
  misc_feature (71): n=a or g
gcgtagcttcacgcgggagtcttggaaaggaacagagacaagctgaccaataagtgttatcgacccctttnccatgactgagagttcatatctatggtcgt

SEQ ID NO: 41190 - DNA, 101 bp, rice(Oryza sativa)
  misc_feature (71): n=t or c
aacctttgaggttaacttgctttggacgggcgtcggcagtcatgagttcactgtgcggttgtacatgcggntggttgaccacgcgcgagctcgtccagccc

SEQ ID NO: 41191 - DNA, 101 bp, rice(Oryza sativa)
  misc_feature (71): n=a or g
gcgcggattactttctactgcaaatagaaagcattggagtggggctctttcttctttcgtttctattcatntacagtttagaaatgattttttaaatttga

SEQ ID NO: 41192 - DNA, 101 bp, rice(Oryza sativa)
  misc_feature (71): n=a or g
tcgacacgtcacactatttgtcaaaaactctcttttgcatactcccccgtccaaaaaaaaaataaaccctnggttttcgtgtccaactttgactgtccgtc

SEQ ID NO: 41193 - DNA, 101 bp, rice(Oryza sativa)
  misc_feature (71): n=t or c
aaccgatgcggggagggaggaaagaaagagcgcagcgagggaggaaagcggcggcgtgtgactccggaatngttccgcttctatttgttgttttccaatcg

SEQ ID NO: 41194 - DNA, 101 bp, rice(Oryza sativa)
  misc_feature (71): n=a or c
taataattactctttctcctttttaaatagctggctacggtattatattcatttatgtaccttgaccactnattttttctatgaaaatatatacatatgtt

SEQ ID NO: 41195 - DNA, 101 bp, rice(Oryza sativa)
  misc_feature (71): n=a or g
cttcgggattctctgcgtacttcatagtcaatctttttctgctttttcatttctggagaatatgatgctcngaatattatccctgtacattttcattaggt

SEQ ID NO: 41196 - DNA, 101 bp, rice(Oryza sativa)
  misc_feature (71): n=a or g
cttggcggcggaactccacagacgacgacagcgtgcatcgagcggagatggcaaaccggttggaagtcacnaggactcgccgtggataataagggcatgtt

SEQ ID NO: 41197 - DNA, 101 bp, rice(Oryza sativa)
  misc_feature (71): n=a or g
tccttttcgagtgtctgattagctttgtaatcattgaaatggtaggagccatgaaaatcagtacatgaatncttatattataatacttcctccatcccgta

SEQ ID NO: 41198 - DNA, 101 bp, rice(Oryza sativa)
  misc_feature (71): n=a or c
ccagctgacaacatcttgcttatacgtactaacgtagtacttgcagccaatcaatcatcagtatgccatcnccgattcaccggaataacctgcctaaagcc

SEQ ID NO: 41199 - DNA, 101 bp, rice(Oryza sativa)
  misc_feature (71): n=t or c
agccataaatagtttttccaggcgggggaaatgaccacttgtacacaaaggcctgtgaaaatcattttcgnaggcaacatctccatcttcgtagtggtaga

SEQ ID NO: 41200 - DNA, 101 bp, rice(Oryza sativa)
  misc_feature (71): n=a or g
tggcttgaaggcaaaagcacatagccaagtcatcctacctatgatatttgattgcgccaccattttggtcngtgtgcattggtcaaatctgccggccccca

SEQ ID NO: 41201 - DNA, 101 bp, rice(Oryza sativa)
  misc_feature (71): n=a or g
ctccatgttggtaatgtgacatgtccttctacatatgcaaaattggcatttgcaaagaattattctctccngtggcatctcaatagtctagttgtaaaaat

SEQ ID NO: 41202 - DNA, 101 bp, rice(Oryza sativa)
  misc_feature (71): n=t or c
ttcaatattttcagggtgttgcgcatttgcatcaggaattttgctatgcttcttgcctcctttcccaccancgttaccagttggatccaagacacataagc

SEQ ID NO: 41203 - DNA, 101 bp, rice(Oryza sativa)
  misc_feature (71): n=a or c
ctccggccggaagacatggaagaaaatgggagggaaggcccaagagtaagaagcccatgtcaagttttgtntcttgctcctgattgaattgcctccctcaa

SEQ ID NO: 41204 - DNA, 101 bp, rice(Oryza sativa)
  misc_feature (71): n=t or c
acaaacgcacacgatccccagacacagacatcatgtaccatgaagaaacgcagagcagaaatgggtacggngctaactcaacaggaccatatattaaatgt

SEQ ID NO: 41205 - DNA, 101 bp, rice(Oryza sativa)
  misc_feature (71): n=t or c
caaataagtccggttaactgaatgactgacaatacttgaactccttgcttcgacacactctgatgttactnagcaatttgaaatccagctgtgtaaacatg

SEQ ID NO: 41206 - DNA, 101 bp, rice(Oryza sativa)
  misc_feature (71): n=a or g
agctggtggtgactggtgaggatgcagctcgagatggtggtggtgtacgaagaagaggaacttcttgttgncaacttttttttttgtcatgccacacgatt

SEQ ID NO: 41207 - DNA, 101 bp, rice(Oryza sativa)
  misc_feature (71): n=t or c
accggcggctgggccgtcatccgcttcgttgcagacaacccaggtatatatttgcacaaaatcatatactntctccatcccatcatataagacacacatgt

SEQ ID NO: 41208 - DNA, 101 bp, rice(Oryza sativa)
  misc_feature (71): n=a or g
gtggaccccacgatcctatgggcccacatgtcatttgctaatctagtgggtacattgaatcgctgggttgntggagctaactgtactcggaattaacgtaa

SEQ ID NO: 41209 - DNA, 101 bp, rice(Oryza sativa)
  misc_feature (71): n=t or c
aagagaaatacccaccatgggcacacggaccaggatatgtggtatcacaagacattgcaaaggaaatcaanagttggtatgaaacaagtcatttgaaggta

SEQ ID NO: 41210 - DNA, 101 bp, rice(Oryza sativa)
  misc_feature (71): n=t or c
gatcggaggaaggacgacgacaaagacgtacggctaccgccgtgcgcgtgccgttatacatacatatatanatatatacatatatatatatatacatatat

SEQ ID NO: 41211 - DNA, 101 bp, rice(Oryza sativa)
  misc_feature (71): n=a or c
gtatacattccgagaatcggggtgagaatctagactgtttgggagagctagagcttttagaagaagatatngggcctgtttagttggtgacctgacacaca

SEQ ID NO: 41212 - DNA, 101 bp, rice(Oryza sativa)
  misc_feature (71): n=t or c
tcccggtgaggctattcttgacgccttacgagctgaccccttcgtatcggaacataaacaacaagttcagngtcaagtactacctgaatctggtccttgtt

SEQ ID NO: 41213 - DNA, 101 bp, rice(Oryza sativa)
  misc_feature (71): n=t or c
tgtatatacttcctagtaggagtagtagttatcaaagctgacgtcatacgagctgttaaggaatttttctnctcaggggagatgccggagggtgttaatga

SEQ ID NO: 41214 - DNA, 101 bp, rice(Oryza sativa)
  misc_feature (71): n=a or c
attgtaaagtcaaactgtccctcctgaagatgcaagaattccgaataagcctcatctgataggggaagggnaaatgagtcttctaggggtcttgaacacat

SEQ ID NO: 41215 - DNA, 101 bp, rice(Oryza sativa)
  misc_feature (71): n=t or c
aaaattattaaagaatgaattattacattaagcaattttcagagtgtgacagctgccgccagctcgccatnatcattgctactgctgaggtggcaaatcct

SEQ ID NO: 41216 - DNA, 101 bp, rice(Oryza sativa)
  misc_feature (71): n=t or c
tgggcctcgtttttctttgagaagaatatgggccatattttggggaaaaagaaaaaaggaataagttcacnggaggtccctcaacttaacagcgagatttt

SEQ ID NO: 41217 - DNA, 101 bp, rice(Oryza sativa)
  misc_feature (71): n=a or g
ttaatgaaatttggccggcctgatctttggccagccccccaaaaaaaaacaactttagagagaggggaganaaagcttagctttgtttaagatatagatta

SEQ ID NO: 41218 - DNA, 101 bp, rice(Oryza sativa)
  misc_feature (71): n=a or g
cctgaactccttaatggaatgacacaccatgcttttgtgtgtctgtgtctgaactccttaatggaatgacncaccacacagacacacagtacacacacacc

SEQ ID NO: 41219 - DNA, 101 bp, rice(Oryza sativa)
  misc_feature (71): n=t or c
atgaaaggagcagtagtcagtagtggcgaagacagcgtgggggctaggggccccttaccccctaatagacnattagagcccccgttataccccctaaaatt

SEQ ID NO: 41220 - DNA, 101 bp, rice(Oryza sativa)
  misc_feature (71): n=t or g
tacatctatcttggtacactccatcgagatatgctcaatctacatcacccaggaaatttatcaatcgggancatattaattggcgtgctatacacgtcata

SEQ ID NO: 41221 - DNA, 101 bp, rice(Oryza sativa)
  misc_feature (71): n=a or g
ctgggacgagatacaaatcatataacggtgggccgtgggctgctccaccgttggataaatagtctattttncctcccttaactcttgcccctgaataaatc

SEQ ID NO: 41222 - DNA, 101 bp, rice(Oryza sativa)
  misc_feature (71): n=t or c
gatgtaggctagttttaaatttataaatagatgatgtagacaaaggtagaggtaaccctcacctataaaanattttatgctcttaaggatgtgttcttttt

SEQ ID NO: 41223 - DNA, 101 bp, rice(Oryza sativa)
  misc_feature (71): n=a or c
aaggaaggaagggaaacagactttcctgattgggctaaaagagggaacttcggcccaaattaaacagtagnctttaggaattttacaaggagggttttaaa

SEQ ID NO: 41224 - DNA, 101 bp, rice(Oryza sativa)
  misc_feature (71): n=t or c
ttccacgtgcctttacttacaggcggcacgcccgcggcccgaccacctcaaaaagaaaaaaaaaatactcnctccgtattttaatgtataacgtcgttgac

SEQ ID NO: 41225 - DNA, 101 bp, rice(Oryza sativa)
  misc_feature (71): n=a or c
gagaaaaccttttggtccacttgcttttcttgagaaggtgtacaatggttgggtcgagcgtgtgatgtttnttttccacaatgagttctagctctaaacaa

SEQ ID NO: 41226 - DNA, 101 bp, rice(Oryza sativa)
  misc_feature (71): n=a or c
gactttaggaaggagacgagaatgacagttgtccaatctgtcacatgttcatttggtggatgcggtcgcgnatagtgcttcaatgtagatgctatcaagaa

SEQ ID NO: 41227 - DNA, 101 bp, rice(Oryza sativa)
  misc_feature (71): n=t or c
ttggcgtgggcacagggaggaacgatggacagcaacaacgattcaaggggcgcagcgacgaggcacggacngcgatgacagcggaggggagcgatgcggcg

SEQ ID NO: 41228 - DNA, 101 bp, rice(Oryza sativa)
  misc_feature (71): n=t or c
attcaaaaagagcatcttccatagatactagatttagcgttggcgccatgaaaatggcactgacaagaganctcttaaaacatctataggatgacaaagct

SEQ ID NO: 41229 - DNA, 101 bp, rice(Oryza sativa)
  misc_feature (71): n=a or g
acttctgcttttacccccattaattaattttgcaggatcttgcatcatcatttccctcaaggaacaaaagnaagttacattgggggtacaattctatcatt

SEQ ID NO: 41230 - DNA, 101 bp, rice(Oryza sativa)
  misc_feature (71): n=a or g
tgagattccaaatcccaacatatgaacggggaccttctcataccgagccatgtgtcaaacatatccttagngttctcagaaatatagaacttccttttaca

SEQ ID NO: 41231 - DNA, 101 bp, rice(Oryza sativa)
  misc_feature (71): n=t or c
aaatttccttcaatccaaaggagcaaaggatcctactggcaccctacatgctacgtagcacttatgtatangcattcgtcataactaatggattatggcca

SEQ ID NO: 41232 - DNA, 101 bp, rice(Oryza sativa)
  misc_feature (71): n=a or g
tccagctctcctttttcaaacttaaaaattttgttactaactcaatattggtagtaggctagtagcacctnagatcctgggttcgactccccatgggagcg

SEQ ID NO: 41233 - DNA, 101 bp, rice(Oryza sativa)
  misc_feature (71): n=t or c
tatgtccatgccgccgtcacccacatacacacagaaaaaccataaattgccaaatttacagaaccaacagnatgcactacctcgctggaatggctcaccac

SEQ ID NO: 41234 - DNA, 101 bp, rice(Oryza sativa)
  misc_feature (71): n=t or c
ctattatatcccctaagatagaaaggcatcaaaatcacccttgactacagcccctattcttgaggctctangccacagtccctatacactattcattagcg

SEQ ID NO: 41235 - DNA, 101 bp, rice(Oryza sativa)
  misc_feature (71): n=a or g
tttgtgatagagaggacaagcctatgtagtatgattgatgcaatatctcttattacactcgttccaaaatntaatgatttttagcaaacactttatctctt

SEQ ID NO: 41236 - DNA, 101 bp, rice(Oryza sativa)
  misc_feature (71): n=t or c
aggatacatgggttgattgcagccgagaagatttccgtggatgattgctacacttcgtggttgatgtcttngaatctgaagtccactgggtgctcaagttg

SEQ ID NO: 41237 - DNA, 101 bp, rice(Oryza sativa)
  misc_feature (71): n=a or g
tgccggactccgtggttatgggatgtggcactggggccacgtcgtcaatagctcgtacctcgctggcgtcngcatcgactggagcaacgtcaggaacgtca

SEQ ID NO: 41238 - DNA, 101 bp, rice(Oryza sativa)
  misc_feature (71): n=a or g
gccagtatcctgttgtcaagacagtcacattcaagtctatcagaggatttgactctggattgttgcttacntactcctcaaaacttgactgatgttctttt

SEQ ID NO: 41239 - DNA, 101 bp, rice(Oryza sativa)
  misc_feature (71): n=a or g
ttctgacgtgcatatgctctgagaattgttgaaatatctcaacacctggaagcactgaactatgcagaaanttgcagagggattaggcactagagtggttc

SEQ ID NO: 41240 - DNA, 101 bp, rice(Oryza sativa)
  misc_feature (71): n=t or c
ggtgtcctctagcccgaaggatattggctgcgacaagtatcttggaaccccatcacctgctgagacaatantgtgcacggctcgaagttgcatcttctttt

SEQ ID NO: 41241 - DNA, 101 bp, rice(Oryza sativa)
  misc_feature (71): n=a or c
gctccgtgtcttggcattggtgttgtgccttgagtgacttgtgctcttcatcttgatacttctctaatgcnttctcttcttcttcttcttcttcttctttg

SEQ ID NO: 41242 - DNA, 101 bp, rice(Oryza sativa)
  misc_feature (71): n=t or c
cacagtaaccaagagcagcatgtatcgatccggctaaatccaagtggatttttctctctgaatttcctgancacctgcttcctcataaaaatataccaaca

SEQ ID NO: 41243 - DNA, 101 bp, rice(Oryza sativa)
  misc_feature (71): n=t or c
tagacattgtttgttactaggaaatcctatctacccttttcctatcattgttttgtgtctttgaataaacntggagagagctgagcacacatgttcattgt

SEQ ID NO: 41244 - DNA, 101 bp, rice(Oryza sativa)
  misc_feature (71): n=t or c
ccttttcttcagccgcatcgctagatggtgcttccctattgttgttgccagctcctacaaggttaggatangtcagatcgcaagtggacttacctcccctc

SEQ ID NO: 41245 - DNA, 101 bp, rice(Oryza sativa)
  misc_feature (71): n=t or c
ggtgctgaggattaggtttcgacaccactttatttgacgctgagaccattcaacttcagctccaaataccnttggcaccgagctatgtatctatttttttt

SEQ ID NO: 41246 - DNA, 101 bp, rice(Oryza sativa)
  misc_feature (71): n=a or g
tgcgtgcctcatcctatatctcaggtatagatctcaaaggctagtgtgatcgaacaattgtttcaccatcncggttggtccattctttcaaaatgcataac

SEQ ID NO: 41247 - DNA, 101 bp, rice(Oryza sativa)
  misc_feature (71): n=t or c
aaccttttatagcgtggccaaataactctatcacaccacccatagctggtgcggcagtgttgccctgtcangccagcctcttgtcacgcctccactgcttg

SEQ ID NO: 41248 - DNA, 101 bp, rice(Oryza sativa)
  misc_feature (71): n=t or c
tgatttactacgtatgggctctactgcatttatatatgtgcgccggagatgatgagcatacctgagagttngacaaggcgaagaggaggatgattgccaat

SEQ ID NO: 41249 - DNA, 101 bp, rice(Oryza sativa)
  misc_feature (71): n=t or c
aacttgctaaacaggatcatcataatacactgcattgtgaaattgtcagtccccccccccttcgttaatcntatccagaatggataaactagaaattttct

SEQ ID NO: 41250 - DNA, 101 bp, rice(Oryza sativa)
  misc_feature (71): n=a or g
cctgagggcattaattgtactgtccctgctatggtcctggaaggtggaggctgacatagagtaattttcanttttataccaatagaaaggtactgacaaat

SEQ ID NO: 41251 - DNA, 101 bp, rice(Oryza sativa)
  misc_feature (71): n=t or c
ctcctgaagcgggaaatgcatgcccaactgccagcatgaattgcattttactagtaggatttaagaacatncctaccaaaagactctctaccctccggtaa

SEQ ID NO: 41252 - DNA, 101 bp, rice(Oryza sativa)
  misc_feature (71): n=a or g
ttctgacatttataggtacaacaacaaatggttaacgacaagcacaagagccaaacatttcaatctctccnggtgctggtgcaatccaagaaatgcccact

SEQ ID NO: 41253 - DNA, 101 bp, rice(Oryza sativa)
  misc_feature (71): n=t or c
gtatccccgtcattctcatcatcgtcgccgttgttagcatcgacatcatcgtcacaatcctcgtcgtcgtngtcctccatgccgtcgacacagctaaacaa

SEQ ID NO: 41254 - DNA, 101 bp, rice(Oryza sativa)
  misc_feature (71): n=t or c
acaatagtgcagtttaataatggaaagatctctaggttgcatttgtagagttctttttctcaaagaagctngtcgattctcgggtggtgtttggatgggac

SEQ ID NO: 41255 - DNA, 101 bp, rice(Oryza sativa)
  misc_feature (71): n=t or c
tttgtaatttaccttttcctttgctttaattggtcaaagccaatgggcaacggacttgtgttcctctcgcnggaaaaatctgtgaaggcatttccttattt

SEQ ID NO: 41256 - DNA, 101 bp, rice(Oryza sativa)
  misc_feature (71): n=t or c
gatgcacgatgtcgaatagcacgatcattgaggggaagaaaatcacccaagtcagaggctttgcggagcancgcattgagcacatccatgactagaatgaa

SEQ ID NO: 41257 - DNA, 101 bp, rice(Oryza sativa)
  misc_feature (71): n=t or g
tgcaacttgcaggctttgcagctagctcgcctccaaaccaaccgaactctaatttgttttgttccttgctncaatatttgctgacttatatggtatttttc

SEQ ID NO: 41258 - DNA, 101 bp, rice(Oryza sativa)
  misc_feature (71): n=a or g
taccacatggtcaaaaggttcatctgactattctctgatgaacagtctactatacggtatgttgttatgtncgaaaactttttatataaaaatcgctttaa

SEQ ID NO: 41259 - DNA, 101 bp, rice(Oryza sativa)
  misc_feature (71): n=t or g
cttgctaaaaagaacaggggtattattagtttgagggaaggtctgaatttccagcgatatatggttgaccnttctaaacatgaaattcacacttgtcatgg

SEQ ID NO: 41260 - DNA, 101 bp, rice(Oryza sativa)
  misc_feature (71): n=a or c
aaggtccatacagcatgtgttactctgcttttgagaacccttgcatgaggttaaaaaaaaaagccaattanaagctctgaaacaacaacggaaaggacaaa

SEQ ID NO: 41261 - DNA, 101 bp, rice(Oryza sativa)
  misc_feature (71): n=a or g
aatctcatataagacttctatatgttgattcatcgggcatgcatccatgcgttgaggaccttaaagagatnttggtgtattatgtaggcaattgtcagtac

SEQ ID NO: 41262 - DNA, 101 bp, rice(Oryza sativa)
  misc_feature (71): n=a or g
aaactccccccgaacaatccctgatcgatgctgcaatcgcaccatcatcgctcctctggccatgatccgtncatgcagcacagctgcatttcgtcggtttc

SEQ ID NO: 41263 - DNA, 101 bp, rice(Oryza sativa)
  misc_feature (71): n=t or g
aggggtagaaaaagaggcacccgaaaacacccataaatatattgctccctaaaccctaggcgctaaatggnctagacctaacatctggcccaactaattac

SEQ ID NO: 41264 - DNA, 101 bp, rice(Oryza sativa)
  misc_feature (71): n=t or g
taaggacgaggcagtgcgcgcggttcggggtagggattttagcaattttttttaattttggtctcggttgntataaacaaccggcactaaaaataataggg

SEQ ID NO: 41265 - DNA, 101 bp, rice(Oryza sativa)
  misc_feature (71): n=a or g
ctcgactcgaccgattcgacaccgacgaaagagggcgaaaaccatgggctcctcctcgagcaacggccggnccgcgcccgcgccgccgcctccggctgcgc

SEQ ID NO: 41266 - DNA, 101 bp, rice(Oryza sativa)
  misc_feature (71): n=t or c
tcgaactgctttactttaatctttgtcctaagctaggacaaacaagaacaatgcgaaaccaaagcgagcanatcaagacgaatacacatcacttctctctc

SEQ ID NO: 41267 - DNA, 101 bp, rice(Oryza sativa)
  misc_feature (71): n=a or g
acgtgtttgtgtttgtgtcaactgaagtctgacattagttgttgttaaccaatgatagttattggttgtgncagttctttataatttttgtttcattctac

SEQ ID NO: 41268 - DNA, 101 bp, rice(Oryza sativa)
  misc_feature (71): n=t or c
cccatgtatactagacataccgtactgtttgtctatcttcttcttgccttggcaacaacaaaattactatngtagatgtctcattttcgcatttatcgcgc

SEQ ID NO: 41269 - DNA, 101 bp, rice(Oryza sativa)
  misc_feature (71): n=a or g
gtcggaacagggaatccccccggcgtgcagctcttcttttccccgagcaagtttaatagcaaagcccactnctagcttcaaatcatttatagccaatgtaa

SEQ ID NO: 41270 - DNA, 101 bp, rice(Oryza sativa)
  misc_feature (71): n=t or g
ttcaagttcccagatacacaaaaacactatccaaaaccgttgataaaatggtattgcaaagtttagatgantggttatccagttttaaagtttagggtgct

SEQ ID NO: 41271 - DNA, 101 bp, rice(Oryza sativa)
  misc_feature (71): n=a or g
tagttaaatttggaactttgactttgatcaaagtcaaaatgtacctgaaacggagggagtactaaggcctntttacttctcaaacaaaattttttcaccct

SEQ ID NO: 41272 - DNA, 101 bp, rice(Oryza sativa)
  misc_feature (71): n=t or g
tccgtggctgattcggtcgatttgcgcggcgatggtaggtgtcgaattggttcataaacgctcgagttcgnctatggaagccaatgatcgaggagatgtgc

SEQ ID NO: 41273 - DNA, 101 bp, rice(Oryza sativa)
  misc_feature (71): n=a or g
aagtttcttgtactgctgtgtggggttaacctggtgaaagatttggatcatcggcaacctcgtaacacttntgtatttcatgttgtatctctcaatagatg

SEQ ID NO: 41274 - DNA, 101 bp, rice(Oryza sativa)
  misc_feature (71): n=a or g
ttttgggtgcttgcagttattgtcattatatggagtcaattgccttcatggaaaaggttttgtgagtaggnctgtgtttagatccaaagtttgtatcacat

SEQ ID NO: 41275 - DNA, 101 bp, rice(Oryza sativa)
  misc_feature (71): n=t or g
attattgttagcacgcttgcacgtttctcctggttctgagcacagggtgtgatgtgcggttttttgcacgnaccgtagccgaggaggatggagttcatgga

SEQ ID NO: 41276 - DNA, 101 bp, rice(Oryza sativa)
  misc_feature (71): n=t or g
accatcaagcgcttaccgtgtgttagagatgactcacgggaacaccggaatccacctactttccgtctgtncgcgtcaaactctgttggcgcgagtagtat

SEQ ID NO: 41277 - DNA, 101 bp, rice(Oryza sativa)
  misc_feature (71): n=t or c
gtgccatacaaactcctgggaacatgaaaaagcttggcgccatataaagtagggtgagtggagataagtgnaggcatacatcatgacagattgaaataaac

SEQ ID NO: 41278 - DNA, 101 bp, rice(Oryza sativa)
  misc_feature (71): n=a or g
ctagtctagtttttttaatatgcttataaagatatggtgtgtgtatatgttcatatcggtaagtgtttgcnttgtactgtgtaattctaaaaaaaagtgag

SEQ ID NO: 41279 - DNA, 101 bp, rice(Oryza sativa)
  misc_feature (71): n=a or g
agatcatcactcaacttagctactacgacctagctaggtagggtcttctacctaataagctactccctccntcacataatataagagatttttagtttttg

SEQ ID NO: 41280 - DNA, 101 bp, rice(Oryza sativa)
  misc_feature (71): n=t or c
aaagtgatacaacaacttcgctgagtcaacaggagtgatggcaatcatggacaacacaaacctggaggacnggcggatcttccgtgcaccgattcgaggcc

SEQ ID NO: 41281 - DNA, 101 bp, rice(Oryza sativa)
  misc_feature (71): n=t or c
aaaacaaaaaaaaactacaaagacgatgcaaatgcggtaaatcttgttgacggatctaatgagctactccntccgtcccaaaatataagaacctagaatcg

SEQ ID NO: 41282 - DNA, 101 bp, rice(Oryza sativa)
  misc_feature (71): n=a or c
tggatctaaacaagagcatactgtaggagtttgttactcgttccgtcaaaaaaaatccattcctaacaatntaaggtggaattagtggagagtgagaatga

SEQ ID NO: 41283 - DNA, 101 bp, rice(Oryza sativa)
  misc_feature (71): n=t or g
tccttgcgccacgagttttctcatcaccttgtccttccgcccgtatttattcctgctgaatgcgatgtgangtttttggtagggatgtttaattagtgtta

SEQ ID NO: 41284 - DNA, 101 bp, rice(Oryza sativa)
  misc_feature (71): n=t or c
tgcccttcgcggcaaggcttttgccccgcagtcttcgcccgtatggccctcgaacaaggtccatctttggngaagcccatgtgcttcatgccacgactttc

SEQ ID NO: 41285 - DNA, 101 bp, rice(Oryza sativa)
  misc_feature (71): n=t or c
cgtctcacctccaaaagtgatgtttatagttttggaatagttcttcaggagcttatcaccaagaaaaaggnggcaagtctggctcaagctcttgctgaagg

SEQ ID NO: 41286 - DNA, 101 bp, rice(Oryza sativa)
  misc_feature (71): n=t or g
tttcagtttggaccatcttcagggccagagttgcaagatcattgcagcttgaaaaatcagcagtatttctnacatggataatgaacatgtgaagttgttct

SEQ ID NO: 41287 - DNA, 101 bp, rice(Oryza sativa)
  misc_feature (71): n=t or c
tcgacgcgtgcagcagaaaagcaaagtaggagtagtatactctcagttcaatgtatgcccatgggacccanataaaagttttcaaaaatgagcattatctg

SEQ ID NO: 41288 - DNA, 101 bp, rice(Oryza sativa)
  misc_feature (71): n=a or g
aatcgaatatgcagcttatatcggtgatcgaacgtgcatggtgttgacgccggtgatacgatggagtagancgatttggctttgtgagtggtgtaatctga

SEQ ID NO: 41289 - DNA, 101 bp, rice(Oryza sativa)
  misc_feature (71): n=t or c
tcagctcctcctcctctcgcatggcagccatggccaccaccgcgtccagcctcctcaagacctccttcgcnggcgcgcgcctccccgccgccgcccgcaac

SEQ ID NO: 41290 - DNA, 101 bp, rice(Oryza sativa)
  misc_feature (71): n=t or c
aatgtaagaggcataaattctgatgatgggtggttggctattaggaataagatagaggaaagcggatgtgnatttttttttgtttacatgaaactaagaga

SEQ ID NO: 41291 - DNA, 101 bp, rice(Oryza sativa)
  misc_feature (71): n=t or c
gaccttagtataacagcagacatggaagttatctgctactagtttctactcgaaaatatgcattgttgaanctgaaatagtattattttcccataagtaag

SEQ ID NO: 41292 - DNA, 101 bp, rice(Oryza sativa)
  misc_feature (71): n=a or g
cagtgtctttggaaagagtggtggcaacataagagattataacctgcctcatctaaccttctctccacaantacccatgggtaataggcttattgaagagg

SEQ ID NO: 41293 - DNA, 101 bp, rice(Oryza sativa)
  misc_feature (71): n=a or g
tcaccgttgtcaaggctcattgcactaccgttaggagtggtttgcttccctaatcccttggagctatgctnaaccttggagacaggttcaatgatttttca

SEQ ID NO: 41294 - DNA, 101 bp, rice(Oryza sativa)
  misc_feature (71): n=t or c
gctggctgttggatttcccctagtcttccattggctcccttatctgtgtggattggctttcttgctcgttngctctccttctctctctcatttattttgcc

SEQ ID NO: 41295 - DNA, 101 bp, rice(Oryza sativa)
  misc_feature (71): n=a or c
ctatatatgttttcaaaagaaaatttttaataaagcagcaccgggacaagagagtgtttaggctatgagcntttttttccaggttcttctaataaacctga

SEQ ID NO: 41296 - DNA, 101 bp, rice(Oryza sativa)
  misc_feature (71): n=t or c
tatttttacatgttatttgttctattattatacagaacttccgctgcgatgcgcgggcccaatctaactcncatctccttgcagaactcgatcgataaaaa

SEQ ID NO: 41297 - DNA, 101 bp, rice(Oryza sativa)
  misc_feature (71): n=t or g
aaactgggactgggttgcgatcgggcagaatagtcgagcggcaccacgccaaatgcaaacgatcgatcaantacataatcaaataaacttattcctaatgc

SEQ ID NO: 41298 - DNA, 101 bp, rice(Oryza sativa)
  misc_feature (71): n=t or c
ggtactagctaatactccctccgtctcgaaaaaaagcaagcaggaagggtacaacgaatctggacaacctnctatccagattgttcagattagttgtacta

SEQ ID NO: 41299 - DNA, 101 bp, rice(Oryza sativa)
  misc_feature (71): n=a or g
ccagagctcagcctgccaccgaccaccttgcactgatggccttcaagtcgcaaataacccgtgatccgtcntcagcaatggcctcgtggggtggcaaccaa

SEQ ID NO: 41300 - DNA, 101 bp, rice(Oryza sativa)
  misc_feature (71): n=t or c
ttttgcccatgacagcggataaattgcgcatgcttttaggtatagtacgaggtaatatgctagcgttgggngcagcacaggtcgaagggaacatggtattg

SEQ ID NO: 41301 - DNA, 101 bp, rice(Oryza sativa)
  misc_feature (71): n=a or g
ttccactccaaacctatttggaagactcccccccctcgagatgcaggttctttgcctagctggtcacaatnaggcactgttggacggcggactgcctgcgt

SEQ ID NO: 41302 - DNA, 101 bp, rice(Oryza sativa)
  misc_feature (71): n=a or g
ttgtggacagctatgacacgggattaacttaagagcaattgccgtacgatacacttaactaggctccagancctggaagtaaacccagcacgatcgagcaa

SEQ ID NO: 41303 - DNA, 101 bp, rice(Oryza sativa)
  misc_feature (71): n=t or g
ttaaccaaatggagagttggtgatgactccgaatccaaatcagatgggtcggtgacaacacgcacaacaangacaggtagccggtggggaactcattgaga

SEQ ID NO: 41304 - DNA, 101 bp, rice(Oryza sativa)
  misc_feature (71): n=t or c
tggatggatttatattagccagtatcttgatcatatatgcacatgcagccagtacgtacgtggccctcgcngccgccgtcggccggctgctgctgttcgcc

SEQ ID NO: 41305 - DNA, 101 bp, rice(Oryza sativa)
  misc_feature (71): n=t or c
cgatgacccgcgttatacgggtctgaggcccatgagcttgtagatagtgtaaccgctgccatacaagactntgatgacgatgatacacacacatgaaatat

SEQ ID NO: 41306 - DNA, 101 bp, rice(Oryza sativa)
  misc_feature (71): n=a or g
cagagaagtccgttgccgttctcaagggtaagggttggatgttcaagaacttcctccgcgcgtaagcaatntttcggctagtgtactcgtgatgtttttct

SEQ ID NO: 41307 - DNA, 101 bp, rice(Oryza sativa)
  misc_feature (71): n=t or c
gactttgtcctagaaatgccatcaccattaatgttccgtccatcctatctcattaaatgcgtcgttaatcntatagaatttttttaactgaatcctatata

SEQ ID NO: 41308 - DNA, 101 bp, rice(Oryza sativa)
  misc_feature (71): n=t or c
tggccatttggtttggtagaagtttaattgtttgatactataagggagagagtaaaggcttcgttgaaacntgtctacataaatgaacaaagattctacat

SEQ ID NO: 41309 - DNA, 101 bp, rice(Oryza sativa)
  misc_feature (71): n=t or c
ttatgccaagcgttggatctaatatccatcgatatcgtcgtcttttcattcaagcagttgcaaagaaaacntgtcacgtccggaaattcactagtaatttc

SEQ ID NO: 41310 - DNA, 101 bp, rice(Oryza sativa)
  misc_feature (71): n=t or g
gaacaacaagaatccggtgcccccgatcagggtttaattgacatttcggactaaaatttcggtcatttttnaccccctccgatacaatattatttcggctg

SEQ ID NO: 41311 - DNA, 101 bp, rice(Oryza sativa)
  misc_feature (71): n=t or c
tacactatccacctactcaaccacacgtggtcgaggtagaactatcaatgtcgtatcgccctgttattgcngccagctatcgctaggcttcctcctcccat

SEQ ID NO: 41312 - DNA, 101 bp, rice(Oryza sativa)
  misc_feature (71): n=a or g
ttctagctagcagagcaatttacagaacaacatctgcggtagttgcctatatgctgttcactagatggacngatggattagttttgtcattccaggctttc

SEQ ID NO: 41313 - DNA, 101 bp, rice(Oryza sativa)
  misc_feature (71): n=t or g
agctcccctctgtcgctgcctccgccccgtcgccgtactcggctaccctccccattgcttaagtgatatanagagagagagaggaggtgagggagagataa

SEQ ID NO: 41314 - DNA, 101 bp, rice(Oryza sativa)
  misc_feature (71): n=a or g
ctggggactggggaatggaccaccctggttccgtttccggccgacatgaggcacaaatgaggcaggggtangcggcaccggcggcgaggtggagaggagac

SEQ ID NO: 41315 - DNA, 101 bp, rice(Oryza sativa)
  misc_feature (71): n=a or g
aggaaatcttgaaggagagaaattaatcaaagagcacttcgtcctgaatcctgatgaattgaccatgcgtncctgcagaagtgtacatcaataatagggat

SEQ ID NO: 41316 - DNA, 101 bp, rice(Oryza sativa)
  misc_feature (71): n=t or g
cacaccccttaccactgcactatcaagtgcatttcaacaagcattttttctcacctgtgtgacgaactganagtgccccccgcgctgattattcttgccat

SEQ ID NO: 41317 - DNA, 101 bp, rice(Oryza sativa)
  misc_feature (71): n=t or c
tgtatggttttttctttttcgatatagtgcaaagcttgcatgtatgagcaatccttttgctgtaatgtggngaagtagactgtcatgtgctgagcctgaga

SEQ ID NO: 41318 - DNA, 101 bp, rice(Oryza sativa)
  misc_feature (71): n=t or c
agatagcgtagtatgttcatgcgaatgcgaaaagtagctgtttgcacttacaaaatcttctccatccaacngtgtgaaccttagcatagcagatgttgttt

SEQ ID NO: 41319 - DNA, 101 bp, rice(Oryza sativa)
  misc_feature (71): n=a or g
tggagacatgagtgacaagttgctacaagagcttgaacccctcaacttaggaattgtagaacacgggtacntggctgcccttgaggcacagcccatgctcg

SEQ ID NO: 41320 - DNA, 101 bp, rice(Oryza sativa)
  misc_feature (71): n=a or g
tttgtgtggttaagggtataagtaccaaaagatctcaataagccccttcttggtatcaaaacctcatcccncaaattttataatcatggttcgaattttga

SEQ ID NO: 41321 - DNA, 101 bp, rice(Oryza sativa)
  misc_feature (71): n=a or c
gggtaatcatggcaatttatacacgattagtctcactagcatcgttaccctgtcaatttcattttggaacnagatatgatcctggcagaatggcacagggt

SEQ ID NO: 41322 - DNA, 101 bp, rice(Oryza sativa)
  misc_feature (71): n=a or g
actcatcgaaataattaatttcacgtcgatcctactcctgagaaaaatatagctccttgagaaatcttttntgtattctgaagttcatgataaatcttgtc

SEQ ID NO: 41323 - DNA, 101 bp, rice(Oryza sativa)
  misc_feature (71): n=a or g
ttagtccgggtgttttccgccccattggctggatgtagagctcggatctagatttatgttttctgatttcnccggtagattcttgtgttcgattcgggacc

SEQ ID NO: 41324 - DNA, 101 bp, rice(Oryza sativa)
  misc_feature (71): n=a or g
caaccaattattccttaaaattctaaactcccacaaacaaacagaaaaaactaatacacggaatcccatcnggggcacaaggacacgtgataaaataggtg

SEQ ID NO: 41325 - DNA, 101 bp, rice(Oryza sativa)
  misc_feature (71): n=a or c
ctctaacatacgctccaagagacgaaaatcagcggcacatctctgatctcactaaaaatctattaaaagcntgtctgcatatgcgtaatattcgtaagatt

SEQ ID NO: 41326 - DNA, 101 bp, rice(Oryza sativa)
  misc_feature (71): n=a or g
ctactgctagcctgcgactactgaagagcaagtaattatcggaaagtaagaaattatacttggcgaggccnagcgcgagggcgaggtggaggcgggcgcgg

SEQ ID NO: 41327 - DNA, 101 bp, rice(Oryza sativa)
  misc_feature (71): n=t or c
ttcccaagttgatacttgccttactgtgtgtaggtatggggaaaataagaattactgtgccctttattatnaacatttgctttcttgctcttacttccttt

SEQ ID NO: 41328 - DNA, 101 bp, rice(Oryza sativa)
  misc_feature (71): n=a or g
ctggagattgtattccgatccgattttttggatctgatacagcatttttctgctccccctgttctggatcnttgccactccatatgttggtagaactctga

SEQ ID NO: 41329 - DNA, 101 bp, rice(Oryza sativa)
  misc_feature (71): n=t or c
aggagtaggggatggcgattgggaaattagggtttagattttataatactcacttattgggccaaccgggnttgtattgttgaaatgggctatattttaag

SEQ ID NO: 41330 - DNA, 101 bp, rice(Oryza sativa)
  misc_feature (71): n=a or c
attctgctgttggtcatcatcctcctccctttgatggacgagcttggcatacagttcaacaaaatcatgcngaggagaattgcgagggacaaaaattttta

SEQ ID NO: 41331 - DNA, 101 bp, rice(Oryza sativa)
  misc_feature (71): n=a or c
aaatgggctcacatgcatgataagatggctgtcatcagtagcacctatgagagttctgtaggtttggcaanctatatacagtttgcacattatgttgacag

SEQ ID NO: 41332 - DNA, 101 bp, rice(Oryza sativa)
  misc_feature (71): n=t or c
ctctcgagctcccctgaaactagtatcaacagaagactgaagtggatccgtttgacgttttaccatcaganccgaaatctatctattatattattaaagga

SEQ ID NO: 41333 - DNA, 101 bp, rice(Oryza sativa)
  misc_feature (71): n=t or c
attagaatacggtttcttgggctgaatacacccctttttaattatttcatacacctatgcatcacatccanagaattcaataatttttgctaacttttttg

SEQ ID NO: 41334 - DNA, 101 bp, rice(Oryza sativa)
  misc_feature (71): n=t or c
gggggatgtagattatgatccattcatatcttttcctgcatgtatggttggtgcactgcattttggctgcnatcctcaacctttgattttcttctacttgc

SEQ ID NO: 41335 - DNA, 101 bp, rice(Oryza sativa)
  misc_feature (71): n=t or c
ttgtcatggaagaaagtctctctcaatgtgtctctaaactctctcgcaaagttcttttgaggaggacaccngaccttgtacacacgcggttcttcagatga

SEQ ID NO: 41336 - DNA, 101 bp, rice(Oryza sativa)
  misc_feature (71): n=a or g
tttttgtgaactcgagcacggtgcgtctctctattttgttaggtcactgttggtgttgataggtacactgntgttattgtggtttaggtcgtgtatctaac

SEQ ID NO: 41337 - DNA, 101 bp, rice(Oryza sativa)
  misc_feature (71): n=t or g
gtaattaatcctcctcacaatccgatttcttcgaaaccaagagtgattcgtaaaatgaaccagtagacagntcatgtgacattatatcctgtgttctgaca

SEQ ID NO: 41338 - DNA, 101 bp, rice(Oryza sativa)
  misc_feature (71): n=t or c
gtgtgtgctggcccgttccacatgctgaaattgcaaaagcgtggcatatactgttgttgcttgcttagcanagtacgataatgtcacaacagcacggcgca

SEQ ID NO: 41339 - DNA, 101 bp, rice(Oryza sativa)
  misc_feature (71): n=t or c
atttttcttcttaccatcgatcgagagttgtgtcaccttaaaagaaaacacttcgaataaacaaattcaanacacaaacatgttgagttgtgattcaaatt

SEQ ID NO: 41340 - DNA, 101 bp, rice(Oryza sativa)
  misc_feature (71): n=t or c
gggcgtgccaactcgtttgatcctgcaaccaacaaggaaatcaagaaaatagagttaaatgacgaacagtngatcaaccaataatccgatgacgtatcgat

SEQ ID NO: 41341 - DNA, 101 bp, rice(Oryza sativa)
  misc_feature (71): n=t or c
tccctaaacttatataaaccgtgcacacaaggtcctatgatagtatacatagatggtttcgctgacatggnatcctagtcagcaaagaaaaattaaaaaga

SEQ ID NO: 41342 - DNA, 101 bp, rice(Oryza sativa)
  misc_feature (71): n=a or c
gatcgattcaccgctcatcagtattaccagggtctgttaaagcggtatagataaaattactctctccattncaaaatataaggcataaccacccctaaccc

SEQ ID NO: 41343 - DNA, 101 bp, rice(Oryza sativa)
  misc_feature (71): n=t or c
aaggggaaggtatggtggacctcgttggcacgattgactcgtttccgatgctagcaaggctgggtagtgangtggtgggcagtggcggatcgggaggagga

SEQ ID NO: 41344 - DNA, 101 bp, rice(Oryza sativa)
  misc_feature (71): n=a or g
ttcacctcagatttgtttatttactcccaaatagcatgtcatagtgctagatccgcctgacatagcctacncaatagttaatacgtgatacaattataata

SEQ ID NO: 41345 - DNA, 101 bp, rice(Oryza sativa)
  misc_feature (71): n=t or c
taaaagtaaaaaaaacaaaagtcatccagattctagagtcttccgaaccatcctcccccttcaagtaaacnatctgccccattcaatcaaaccaaatacaa

SEQ ID NO: 41346 - DNA, 101 bp, rice(Oryza sativa)
  misc_feature (71): n=t or c
aatacagaaaacgagtatgcagttatgcacagcggataggttgacagcaacttttgaactcatgtagacanatgtttatcaagaaaattgctcaatggcat

SEQ ID NO: 41347 - DNA, 101 bp, rice(Oryza sativa)
  misc_feature (71): n=t or g
taccgttgatgttgcttcgagattcgtgcaaagcatggaaaagaatggaacgtgaaggcctatatatatgngtggcttttattatcatagcagcagtattg

SEQ ID NO: 41348 - DNA, 101 bp, rice(Oryza sativa)
  misc_feature (71): n=t or c
atttttttctagtaaaataaaaagtttataaactacaatagtatatcccgtcgagctaatgtagagcacgntttcatcagaggtcgtttcaatcataggtg

SEQ ID NO: 41349 - DNA, 101 bp, rice(Oryza sativa)
  misc_feature (71): n=t or c
cacgttttaaactagatttgagctgaactaatatctcatttatcgtgaatatgtttatcaaattgttaaanagtatgttttattataaaactagtatgttt

SEQ ID NO: 41350 - DNA, 101 bp, rice(Oryza sativa)
  misc_feature (71): n=t or c
taccgtttgcattgcaccaaacaagatttgccatacaacatattgtaataccaaacggagcgacattcgantgacaaagatcaacctatgattttggagat

SEQ ID NO: 41351 - DNA, 101 bp, rice(Oryza sativa)
  misc_feature (71): n=t or c
accagtagtggatggaacgttccacaaacatgggagaaagccacggcccttttgggccaaattagccagangttccgatccaggtttggcagccgaagggc

SEQ ID NO: 41352 - DNA, 101 bp, rice(Oryza sativa)
  misc_feature (71): n=t or c
gcatttcatttcttgatggactcgactactcgtcgatcatatgactttgaggaagataagacgattaaaangactacaagttgatggggttctcgtgctga

SEQ ID NO: 41353 - DNA, 101 bp, rice(Oryza sativa)
  misc_feature (71): n=a or g
tgatatcttcaagagcccatcttctgtagctgttggaatgaagagcgagctagcagaatatttgattcagnggtccatgacgcttgttcgtgaggctgtcg

SEQ ID NO: 41354 - DNA, 101 bp, rice(Oryza sativa)
  misc_feature (71): n=a or g
tcccttttgataccttgttcggatcataaaaatcacgaagtttcagcatcatttgattacacaaatcagcnacatccgaattctgagtcaacacgctcctg

SEQ ID NO: 41355 - DNA, 101 bp, rice(Oryza sativa)
  misc_feature (71): n=a or g
gctcaggttgaaatattgctgtcggaagcaatgaagaacatatccagcaccccagggaaaagagcagaccntaggattatcaaaaaggaaaaaatggttga

SEQ ID NO: 41356 - DNA, 101 bp, rice(Oryza sativa)
  misc_feature (71): n=a or g
gcgcactgtagattgtaccgaggattgcaaccacagcgaccaatggagggctgcgtagcattttccatctncaattgacacgcatgaaaaatcccactatc

SEQ ID NO: 41357 - DNA, 101 bp, rice(Oryza sativa)
  misc_feature (71): n=t or g
ggtggtcacaaggtacttctcatcacctctttgatgctcatctgtattgtctaccggtatgccatcctcgnctgatgccatgtattgggcatgatatctcg

SEQ ID NO: 41358 - DNA, 101 bp, rice(Oryza sativa)
  misc_feature (71): n=t or c
atactaatgtttcgagagtgcccaaaattacatataatgctagtggttttacgacttctatggctgcgtcngggaggaagggttgggaaccttcctccccg

SEQ ID NO: 41359 - DNA, 101 bp, rice(Oryza sativa)
  misc_feature (71): n=a or g
gaaccgggactaaaaagcaactctccactagtgattcgtagccctccaaaaggtggaacacagatggctcntttgccccgacgaaccccacaaaccgatct

SEQ ID NO: 41360 - DNA, 101 bp, rice(Oryza sativa)
  misc_feature (71): n=a or g
ccattcttatataacacggatcccgaaaaagccaacaccagagactgcaaatgatttcagaccaattgctntcaaaacaagatttcggcaataataaaagg

SEQ ID NO: 41361 - DNA, 101 bp, rice(Oryza sativa)
  misc_feature (71): n=a or g
cagcagcaatttatttggtttggacttgtcacatggatgcagcctaggagagatttggcgacggggatcantgcttgattgatgattaatttgccgagatg

SEQ ID NO: 41362 - DNA, 101 bp, rice(Oryza sativa)
  misc_feature (71): n=a or g
tggggaaagaaattgtaggggattgaagagattaattccacacctctctgcaaatttccttcaattctcanggagggattaattagccgaacaagccaaag

SEQ ID NO: 41363 - DNA, 101 bp, rice(Oryza sativa)
  misc_feature (71): n=t or c
tcaacgctttgtatatatatgcgcaaaaatgaatagcaggttctctacaagttaaaaggtacactgtcctngtgttgtcggagaatgtcaattcgcgatat

SEQ ID NO: 41364 - DNA, 101 bp, rice(Oryza sativa)
  misc_feature (71): n=a or g
tcaatatgatcagggtacccaaagtgttgctaggatacactacattcagggaaaattcggtcaaagggggnaaaattgtacttaggctgagtttagttcca

SEQ ID NO: 41365 - DNA, 101 bp, rice(Oryza sativa)
  misc_feature (71): n=t or c
aacgattacaagatttaatcaaccttgatgcaaaatgatgcctttgtcaggtatacactagtccaaacgtncagttacctaggagcatgggtggcgatcta

SEQ ID NO: 41366 - DNA, 101 bp, rice(Oryza sativa)
  misc_feature (71): n=a or c
cattgagcaggaaggttcgttcctacgtacgggagatgatgtcacgattagctgtagtagcttatagatcnagtttcgtatgcacgtcacgtcaaattggg

SEQ ID NO: 41367 - DNA, 101 bp, rice(Oryza sativa)
  misc_feature (71): n=a or c
ctacaaattttgcatgactttttgttatttcacttatttcattttgatctcctctgcctctttagcccagntgtacacattcagctcattgttcttgaggt

SEQ ID NO: 41368 - DNA, 101 bp, rice(Oryza sativa)
  misc_feature (71): n=t or c
atattatccgatccgttttcacccctagtagtagacatttattcacattttctgcttgtactccctctccngatgaatatattaccttagtccgaaaatat

SEQ ID NO: 41369 - DNA, 101 bp, rice(Oryza sativa)
  misc_feature (71): n=t or c
cttcactgaaccatgtgtttaccctatcatcgtaactttgcacctcatacctaaagcattttgcaggaagngatcattaatgaccattctagagtaatact

SEQ ID NO: 41370 - DNA, 101 bp, rice(Oryza sativa)
  misc_feature (71): n=t or c
atatgtctcggagcacctgatcaatgctgagtaagctaacaatacctactgatctgttcgtgcatgcatangctgcatgcttgctgctgattatatctcga

SEQ ID NO: 41371 - DNA, 101 bp, rice(Oryza sativa)
  misc_feature (71): n=a or g
ttaaagtttgtctaggaagttttgcatgtatgcatgcatgtatgatcacatttgatatcgtgggcatcttntttttctcagaaaaaatcgagcacctggtc

SEQ ID NO: 41372 - DNA, 101 bp, rice(Oryza sativa)
  misc_feature (71): n=t or c
gaaggttgatgtagcagatggaacttgtgcattgtgagttgtgtgatacatgaggaattgcattgcgactnatgtcgcagtgacacaacaatgaccaaagc

SEQ ID NO: 41373 - DNA, 101 bp, rice(Oryza sativa)
  misc_feature (71): n=t or c
catatatataactgcattcttcagcgagatcgttgaaacacaaggaaattaagcaaaggtccaagaccgantcggtttatttattcccgagatgaactagt

SEQ ID NO: 41374 - DNA, 101 bp, rice(Oryza sativa)
  misc_feature (71): n=a or g
ctttgcaaagaacaaaaaattatcccctaacagaactcgaccagtatcctctaaccatgatcgagggaatnacgtatcacccggattataaaatgcaaccg

SEQ ID NO: 41375 - DNA, 101 bp, rice(Oryza sativa)
  misc_feature (71): n=a or g
agtaattaagaagaagatcgcatctctgcgacgaacagataaagtaggttcatttacacgcactacttgcnatgcaaggcaaaccttaatttaggtcagac

SEQ ID NO: 41376 - DNA, 101 bp, rice(Oryza sativa)
  misc_feature (71): n=a or g
ggaaactcgaacgcatgcgggagaaatatacatcacatcgaatctttaattgaatctttgatacatatctngagcattaaatatagataaaaagaaaaaac

SEQ ID NO: 41377 - DNA, 101 bp, rice(Oryza sativa)
  misc_feature (71): n=t or c
atcaataactagcacctataatatccaaagaacaacttaaaaaaagcggcgctggtgtgcttgcaagtggnggtagacgcacatagagacggagctctcgc

SEQ ID NO: 41378 - DNA, 101 bp, rice(Oryza sativa)
  misc_feature (71): n=a or g
gggcatttgctggtggtgctcgcggtggcatacgagctggcataccagtaattaggggtgaaaacggagcngattcagatggatagtcgtcataccatatc

SEQ ID NO: 41379 - DNA, 101 bp, rice(Oryza sativa)
  misc_feature (71): n=a or c
agtaggtggtgacagattgacagcccgatcaaaccccgcccccctaaaaaaaaaaagaaaaagcaaccatnctccctccatccttaaaaaaaaacttaaac

SEQ ID NO: 41380 - DNA, 101 bp, rice(Oryza sativa)
  misc_feature (71): n=t or c
agaccagattaaccaacatgtcaatatgctccgtactgcttaaggcaagttggagtgatcgtgcattgccntggaagcactaacgagtcaatataacatag

SEQ ID NO: 41381 - DNA, 101 bp, rice(Oryza sativa)
  misc_feature (71): n=t or c
atactaggttttatacaatttttgcaggtacaccaatgctctcgtacaaaatcaaggcgtagggtaggggnacagtaattgatatacacactaaatactct

SEQ ID NO: 41382 - DNA, 101 bp, rice(Oryza sativa)
  misc_feature (71): n=a or g
ccacggggatctacgacgaaatcttgacgcaagtatcaattaggggaaattatggagaggattaggggagnatttggaggggcaccttgggtgtggtgtgg

SEQ ID NO: 41383 - DNA, 101 bp, rice(Oryza sativa)
  misc_feature (71): n=t or c
gaatacatcatatttaattatcatcctctttcttccgttctcaacctctaccaaacctaagctactttccnctatttgatcggcccctaattaacatggcg

SEQ ID NO: 41384 - DNA, 101 bp, rice(Oryza sativa)
  misc_feature (71): n=t or c
actggactgccacgtggacgtcacgtcggtgaaaaccactcttaaaacagttgagagagctaaattgagcnagttttcatagttaaggggtaaagatatct

SEQ ID NO: 41385 - DNA, 101 bp, rice(Oryza sativa)
  misc_feature (71): n=a or g
ttcttaactacttaccacttttgcccatgtaacatgccaatgtgtaacgatctgggtaaaatatgatgtgngacccacttgtcagtctctcccctctcttc

SEQ ID NO: 41386 - DNA, 101 bp, rice(Oryza sativa)
  misc_feature (71): n=a or c
ctatatggtattattattagtattgttcagcctttgctataaagaaaagcttcccttccactctcccctgntcctccatctctaccgacaaacacactccc

SEQ ID NO: 41387 - DNA, 101 bp, rice(Oryza sativa)
  misc_feature (71): n=a or g
atggggtaggaagaggaaggccggtgtggtagcggtggggaagtagagaccattggcccgtcagcaaacgnctcgggcttcctcctctgcaacttcgtcgg

SEQ ID NO: 41388 - DNA, 101 bp, rice(Oryza sativa)
  misc_feature (71): n=t or c
tttataatagctctctgtcgcaatttggtcctttgctgttgctgtcagatatgcgttttgtcttgtgttgnccctttttggtataaagaaatgtgaatatt

SEQ ID NO: 41389 - DNA, 101 bp, rice(Oryza sativa)
  misc_feature (71): n=t or c
gaagtgttggttgatccggcgtgatcggtggcgccgccgcgacatcgtaggggtatcattgattcattggntccatcctggctggatgtacgacggcgcat

SEQ ID NO: 41390 - DNA, 101 bp, rice(Oryza sativa)
  misc_feature (71): n=t or g
aagtctgctgggcaatctgtaattttttttgcaatatgggatcaggcaatgccccgtcgtgttatttcctnagggatgttgaaaacttagtacatttgagc

SEQ ID NO: 41391 - DNA, 101 bp, rice(Oryza sativa)
  misc_feature (71): n=t or c
gttcagccggcagcagggcttctcgacgccgacgtcctccgtcgacgaagccatgcaggtcacttccgttncatcactggttagcaaaagctctgcacatt

SEQ ID NO: 41392 - DNA, 101 bp, rice(Oryza sativa)
  misc_feature (71): n=a or c
taatttgtaactaactttatacacataatcaactcaaacactaacacaattttcttttgaagaatctaacntgaaaattttaaatcaagaatcgggaaaga

SEQ ID NO: 41393 - DNA, 101 bp, rice(Oryza sativa)
  misc_feature (71): n=a or g
ctactgctcaagcctgctgagctcgaattccaccatgacacaagcttgcacagggtggacgaaccagaacncaccgtatgatttgccggggcaatcgattc

SEQ ID NO: 41394 - DNA, 101 bp, rice(Oryza sativa)
  misc_feature (71): n=t or c
attataaaaattgaagatatttttgccggtattttggtacatcggcggtgtttgagtcagttcttaagttnattcgtttttagtaatatatccatgtttga

SEQ ID NO: 41395 - DNA, 101 bp, rice(Oryza sativa)
  misc_feature (71): n=a or g
tgagcaagcaaacagcacaaacgcatctccgctgtttgctacttcttcatctagccgcccgctgccaccgnccgcaccctccgcccgccactagccactcc

SEQ ID NO: 41396 - DNA, 101 bp, rice(Oryza sativa)
  misc_feature (71): n=t or c
aggatattaggatttggaatttcatctttttacactagaaatccttaggtgagtgacttaagtgtgccgcncgcgaaaatcaatttttttaggcaggtctt

SEQ ID NO: 41397 - DNA, 101 bp, rice(Oryza sativa)
  misc_feature (71): n=t or c
ccaggcttcggaacaaaccaagcaccaatccaagctgccacgacgctgtcgcagccaatttttgacccatncatggcggctcagcaagtacctccaattgg

SEQ ID NO: 41398 - DNA, 101 bp, rice(Oryza sativa)
  misc_feature (71): n=a or g
gcttgacacccctagaaaaacaaacaaggttgggtccaacgtcaccctaatcaacgtcatgcagattcctngtctcaacacactcggcatctcaattgcgc

SEQ ID NO: 41399 - DNA, 101 bp, rice(Oryza sativa)
  misc_feature (71): n=a or g
acattctctacgtaagcttcaccaaaagaaagccacgttataggcctttttgacaaagtttcggatcatgnatttaaagtttgtgtattaaattataatag

SEQ ID NO: 41400 - DNA, 101 bp, rice(Oryza sativa)
  misc_feature (71): n=a or g
gttgtttattgttcctttgacattatgttgatccaagccacacggaacgccatcatcattgatttggttcncattgcaaaattcataaaatcgtgatatct

SEQ ID NO: 41401 - DNA, 101 bp, rice(Oryza sativa)
  misc_feature (71): n=a or g
tcacactaggggctaatgttctaaattaaccgtcaacctctcatcatatatgctgggctctaaacccaacntagttagcggttcttaattagtggaatcaa

SEQ ID NO: 41402 - DNA, 101 bp, rice(Oryza sativa)
  misc_feature (71): n=a or g
ctctgtgccttgggaagttccagatggagtagctgcatcttcttcatcgatattgagagcaaggataatantagagctcactatctactggagtattagcc

SEQ ID NO: 41403 - DNA, 101 bp, rice(Oryza sativa)
  misc_feature (71): n=a or g
tgaaacaatctggaacaggatctttcaagaaggttacagatgccaagaggataatggtgagacttctactnaaatccttaatttttaatctgccactagaa

SEQ ID NO: 41404 - DNA, 101 bp, rice(Oryza sativa)
  misc_feature (71): n=t or c
tatatccgattcctgtcacgcgtaacattcattgcgaagtcacaattcatgagcgaaatgtgaaagaggtncgtgtgatgtaaataccaagcgaatgaaac

SEQ ID NO: 41405 - DNA, 101 bp, rice(Oryza sativa)
  misc_feature (71): n=a or c
accaaactatatatatcacgtgtgtatattccttgtgccaataatagctagctggatggtgccacatgttncccctgggagttactagagtagcatccaag

SEQ ID NO: 41406 - DNA, 101 bp, rice(Oryza sativa)
  misc_feature (71): n=a or g
ctcataatgtttgtgccgtgttcttgcgcagatgtcgtctcgttgctccggtgtacgaggcagagcctggngatcatggcgtcgagtagaggggcactgat

SEQ ID NO: 41407 - DNA, 101 bp, rice(Oryza sativa)
  misc_feature (71): n=t or g
tggtatgagactcactgcaatgtcatgatttgtttcctgatatgtttacgtaatttttcagaggaactctnttgtgaaaatgtgctactttaattacttac

SEQ ID NO: 41408 - DNA, 101 bp, rice(Oryza sativa)
  misc_feature (71): n=a or g
tcccaactaaacattacatacgtgttgttttaccatgggcttttaatatcttcttggaatattcatctacnttgcaggagccctcgaattgactcttagct

SEQ ID NO: 41409 - DNA, 101 bp, rice(Oryza sativa)
  misc_feature (71): n=t or c
ttgaaggtaataggaatcacactgaacaaaccacaactgtgagctgtcaacaacttatattatgcaggggnttactcttgcatgtggacgtccacaatata

SEQ ID NO: 41410 - DNA, 101 bp, rice(Oryza sativa)
  misc_feature (71): n=a or g
taattgagttgctcctgcaatacaagcatccttcaaccttactcctgttttatcctgagcatgaaaaaaanagaggagcaaattgaaacatgtatcctaca

SEQ ID NO: 41411 - DNA, 101 bp, rice(Oryza sativa)
  misc_feature (71): n=a or g
atgataatcaagcatgtgtcggtgaagacggctattagttactgcttctggaaaaaggttgtaattcagtncagagttgtgtacgtgtccatttgaataaa

SEQ ID NO: 41412 - DNA, 101 bp, rice(Oryza sativa)
  misc_feature (71): n=t or c
tccacaactttccttttctttgagaatggattccctcaccaccacattattattttagctagtagtacagnactagctcttcttcttgttgttcttgttct

SEQ ID NO: 41413 - DNA, 101 bp, rice(Oryza sativa)
  misc_feature (71): n=t or c
atggcaagcatatctgctactaaattaaataaaattggtgagaggggatcccctgtctgaaaccctttttnattaggaaaaagtggcctatctcatcgtta

SEQ ID NO: 41414 - DNA, 101 bp, rice(Oryza sativa)
  misc_feature (71): n=t or c
ggagtatcttttaagggaatcaagtttcgtgagcgtgtataggacaaataaaaacactgacctgatccatngggagctgtatacctgaaaagaagggaaaa

SEQ ID NO: 41415 - DNA, 101 bp, rice(Oryza sativa)
  misc_feature (71): n=t or c
ttgcacatatgacacatcaacgcattatgttatcagacacatgagatgtgctatgacaagtttatgccgcntaaccttcaatccttcagttctttccttca

SEQ ID NO: 41416 - DNA, 101 bp, rice(Oryza sativa)
  misc_feature (71): n=t or c
acatgagccaaaaaaaaatgttgatgagaaaaagagaaatgctcacaaagaaaaagagacaaaatattctngagcatgaaaaaaagaaaaaaaaaagggag

SEQ ID NO: 41417 - DNA, 101 bp, rice(Oryza sativa)
  misc_feature (71): n=t or c
gacgcttcctcgtgcatgtgggagtcaaagatgcatgcatgcgttgtttagagggccagagagatatcttnggagactttgtttattaaaaaaattagatt

SEQ ID NO: 41418 - DNA, 101 bp, rice(Oryza sativa)
  misc_feature (71): n=t or c
cccatcaaggtttaaattctgattcccacaaatgtaaagcacatgcaagtgcaaataggtttagtaacatnagaaatttgtcaccagtttctgtctcttat

SEQ ID NO: 41419 - DNA, 101 bp, rice(Oryza sativa)
  misc_feature (71): n=t or c
agatgggttgatttgaatgggttctttcaaataggaactgggaactgtcttgctcttttggagtatgtgtngcacagtcgattaattgctgacgaggaaac

SEQ ID NO: 41420 - DNA, 101 bp, rice(Oryza sativa)
  misc_feature (71): n=t or c
ttcatcatagtctaaccatttaaaagtctacaagtgaattcatcatttttgtttcgacctacacgctttcnaaaatactaaacggtgtgcttttggtgaaa

SEQ ID NO: 41421 - DNA, 101 bp, rice(Oryza sativa)
  misc_feature (71): n=a or g
caaatatcaacgaaaaaatcacccgtgtgatgtttagcaaaatcgattttcttgaggctgggcaagcctancaagagataaaaactatgggcctgttcact

SEQ ID NO: 41422 - DNA, 101 bp, rice(Oryza sativa)
  misc_feature (71): n=a or c
aacagataatatgttatccttttttcctggtaagtggtctcatttctctgtctcttggtcagtacaacatncacgttttcgtatctcagctatcatcaact

SEQ ID NO: 41423 - DNA, 101 bp, rice(Oryza sativa)
  misc_feature (71): n=t or c
gaaatctgcgaagttaaattaaggagataatgttgaccggtgaaggcgagccatgacatatgatcagccancgtgaatacgaggttgactggactgtagac

SEQ ID NO: 41424 - DNA, 101 bp, rice(Oryza sativa)
  misc_feature (71): n=t or g
gatattgcaatatccaagcggcagaaacgcaccgcctagatcagtcaatattcggaaagcttgcaacaganagagcaaaggagaaaattaagatcacaata

SEQ ID NO: 41425 - DNA, 101 bp, rice(Oryza sativa)
  misc_feature (71): n=a or g
tccacatgacagtcaaaaccgatataaaatgggcttatccacgatgcactaatatagggacccgccagtcngcctcctagccgaagaagcagctcggaagt

SEQ ID NO: 41426 - DNA, 101 bp, rice(Oryza sativa)
  misc_feature (71): n=t or c
agtatatgattgttttttttttcaaatgccttcggatggaaagaaattttcatatcagagttgtagattcngatgtacatcattgtaatggacaattttca

SEQ ID NO: 41427 - DNA, 101 bp, rice(Oryza sativa)
  misc_feature (71): n=a or c
aagccaaataaaatcgcttaccaatgttttggtcacgttttcccaccgaaaccggttgaaaacaacacaanattgtcaagccaatgtcttgacgtgggacg

SEQ ID NO: 41428 - DNA, 101 bp, rice(Oryza sativa)
  misc_feature (71): n=a or g
tgaagttttcttgcactgatcagtttactgaacatgaagcttaagccttgtgtacggatatacttcctccntcccaaaacatagttattttaggatacgag

SEQ ID NO: 41429 - DNA, 101 bp, rice(Oryza sativa)
  misc_feature (71): n=a or g
ccaagcaaaatctactataagtttagcataattagttcatgtgatacatgtgagtttgcagttaaaatctntgaaaaatgtattttcatgctatgttttca

SEQ ID NO: 41430 - DNA, 101 bp, rice(Oryza sativa)
  misc_feature (71): n=t or c
atccatctctccctctccctctcctccccagcaaaggcaaaaatgagctcaacgacgcccatttcagcacngcgagctccccggcagcggaagtggaagtg

SEQ ID NO: 41431 - DNA, 101 bp, rice(Oryza sativa)
  misc_feature (71): n=t or c
gttaagaaggcaaggagagtacagaagattataaccgatgcattggttagtgatgcagtagtacctttggnaagaaggattggtttgatagtaagcaataa

SEQ ID NO: 41432 - DNA, 101 bp, rice(Oryza sativa)
  misc_feature (71): n=a or g
aatttgatgcgtatagagaagccatatgaattaagcaaccaaaaatattttataatgtccccgtctcaaantataagcatgttcataatagtgctaagtca

SEQ ID NO: 41433 - DNA, 101 bp, rice(Oryza sativa)
  misc_feature (71): n=a or g
cgcactcattggctcatctctcatataattttccattcccatttacacagccacagaaaactaatcactgncaggtggcccgtgaacagtgggcccatggg

SEQ ID NO: 41434 - DNA, 101 bp, rice(Oryza sativa)
  misc_feature (71): n=t or c
ctgacaaaatgctaagtttgccaatgccatttgtttttttttttctaccgtgtcagatcgagagcgtgatnggtgtcaagacaggtcgtagcagcatgagc

SEQ ID NO: 41435 - DNA, 101 bp, rice(Oryza sativa)
  misc_feature (71): n=a or g
aacataaaaatgtcatgtcatcagtgcaagtccagtagaaagaaaaatggaaaacggaaaacgaaggtacncagaaaaacttgactacactaaggctgtgt

SEQ ID NO: 41436 - DNA, 101 bp, rice(Oryza sativa)
  misc_feature (71): n=t or c
gcgaagagcgccagatgctagcaagctttacttcatttatagtctgcctcatgaggaagtatgtgcatgtngatgtacaatttgagtacgagtgatcattg

SEQ ID NO: 41437 - DNA, 101 bp, rice(Oryza sativa)
  misc_feature (71): n=t or c
acacacagatcggtactatagatgccagaacagttaaaaccgacacttataatgttttttccacctacacnggctgaaaatacaaaaaatgacacctttaa

SEQ ID NO: 41438 - DNA, 101 bp, rice(Oryza sativa)
  misc_feature (71): n=a or g
tattttaaaaaaatgctactgtaattcgtttatttagagccatgccatccaaatacaggtgaaatgggtcncatgccatgtcgtatgaaggagactcgttt

SEQ ID NO: 41439 - DNA, 101 bp, rice(Oryza sativa)
  misc_feature (71): n=a or c
gtccgttttagtcgagcaagagatcaagaagaattattagcataaagaaagggatgtgaggcgaacagtgnaaattggttctacgttgattgaaatcaaag

SEQ ID NO: 41440 - DNA, 101 bp, rice(Oryza sativa)
  misc_feature (71): n=a or g
ctacagactatgtgcaaaacaaaggagcatgtcagttatcatcaagaaaataggtaagttttgatttgganacaataaggaacaaaactaataagagcatc

SEQ ID NO: 41441 - DNA, 101 bp, rice(Oryza sativa)
  misc_feature (71): n=t or c
tgcatgctgcctattcttgctggcttttggcgactctatgagtctcaaagaaaacaggagccatatacgcntgggaggaatctgggaaaagtcgatgtcac

SEQ ID NO: 41442 - DNA, 101 bp, rice(Oryza sativa)
  misc_feature (71): n=a or g
caaagttgtatggaacaattttctgtcagtgcatagagatagtacatcagtgtagcagctcagaatttcangatggatcaatatatataactataactaga

SEQ ID NO: 41443 - DNA, 101 bp, rice(Oryza sativa)
  misc_feature (71): n=t or c
ttacgaaagctagcttcctagtactaagttttagcttgtcctttgcgtgtttagccagtttccactcttcntttctttgaactcgggacctatatattatc

SEQ ID NO: 41444 - DNA, 101 bp, rice(Oryza sativa)
  misc_feature (71): n=t or c
agcagggcagactccgtcggcggtggctagcctcgtctagttcgacgacaacggcaacggccagatctcgnggctcgagagcctcggccacacagccaccg

SEQ ID NO: 41445 - DNA, 101 bp, rice(Oryza sativa)
  misc_feature (71): n=t or c
cacctaaacatgggtaattagggtcctggggtgacttcaaacaaatatcaccatatcgaaccccctaaccntagattcattctcctccgtctcccccggac

SEQ ID NO: 41446 - DNA, 101 bp, rice(Oryza sativa)
  misc_feature (71): n=a or g
gtcaaacctgaatgggccgagcaggcccgcctagtggctgaagtaatgttgctagtattcttgggaagagntttgataatttaacactttttaaaatgggc

SEQ ID NO: 41447 - DNA, 101 bp, rice(Oryza sativa)
  misc_feature (71): n=a or c
cattctcccctaatgtgcctgatgcgccagctagaatggaacaaggctttgttattcctcttcctttccgnactcatatctctcattttttgcgcgcatgc

SEQ ID NO: 41448 - DNA, 101 bp, rice(Oryza sativa)
  misc_feature (71): n=t or g
ctcgccatggtccgccgcgatgtcacggtagtaactgcaatttgcaattggtagtgttggttttagattgnggggagaagcctgccgggtgcaaggatttt

SEQ ID NO: 41449 - DNA, 101 bp, rice(Oryza sativa)
  misc_feature (71): n=t or c
tttgcatgtatatgttggattgttggcgtcatgtactagcaagggagcggctgcatcgtatgattcttgcntgttctttttttttccttttttttaaagaa

SEQ ID NO: 41450 - DNA, 101 bp, rice(Oryza sativa)
  misc_feature (71): n=a or g
tccaggagttatcagttttgtcttcgctttagagctggcgttctacttgagtaactccaattatttcactngaaattttggcttctccaaatttttcaagt

SEQ ID NO: 41451 - DNA, 101 bp, rice(Oryza sativa)
  misc_feature (71): n=a or g
ggtggggctgttcgccacgatgggcgtgtccatgtgcagtgtcacgcgcttcttcttcctccgcgagtccnccgccgcgctccggggcggcaggccgacct

SEQ ID NO: 41452 - DNA, 101 bp, rice(Oryza sativa)
  misc_feature (71): n=t or c
gacatatcaaagagagaaaatcaatgaattcaatcgagctctagctaacaagcactgcactactgctaaancaatactccatatggatactacaagtaatc

SEQ ID NO: 41453 - DNA, 101 bp, rice(Oryza sativa)
  misc_feature (71): n=a or c
gcgaagaaatgataatgataataatgaataaaaataaaagtagtcaactgaagtgaagaggaaccggatgntactactgctagtagtcggccacgttacag

SEQ ID NO: 41454 - DNA, 101 bp, rice(Oryza sativa)
  misc_feature (71): n=t or g
cgacggcccactgttggcccagcccattcctgcctgagcgaagcagtcccctctcgattttccttctccgnggagtccacacgctctcgccgccgccgccc

SEQ ID NO: 41455 - DNA, 101 bp, rice(Oryza sativa)
  misc_feature (71): n=a or c
aagacaaaagtggtcatcgtacgtacgtttacaagagctcaaaatgttggtatagatttctcattaaggtngccggagatactgcatgcatgcagcactct

SEQ ID NO: 41456 - DNA, 101 bp, rice(Oryza sativa)
  misc_feature (71): n=a or g
taatagcatagacatgggagatgaataccttgcaagaccatcatagcaacctgttaatacgaaactgccanaagacgaatagtttagtgatactggaaacc

SEQ ID NO: 41457 - DNA, 101 bp, rice(Oryza sativa)
  misc_feature (71): n=a or g
ttaacttataaatgggtttatgggttgacccacttacatcatctctagatacggcaagtcgggccaaaacncgaaaacccacggattaccacttatttgat

SEQ ID NO: 41458 - DNA, 101 bp, rice(Oryza sativa)
  misc_feature (71): n=t or c
ccaggtggaagccttgacaagcatctggatagtaagttcctacatacaattccggacatattttctgttgngaaaatgagataattttcgtaagttctctc

SEQ ID NO: 41459 - DNA, 101 bp, rice(Oryza sativa)
  misc_feature (71): n=t or c
tcttcttctccaactagcggctactaggtaccatgcgtctgtcacgtctagaggagttttttctttctttnttttctttttttctttttttgccatggtgg

SEQ ID NO: 41460 - DNA, 101 bp, rice(Oryza sativa)
  misc_feature (71): n=t or g
actttgggggattacttgcttgcatgaacaacaactgcaactagcttccacctccatcttcatgatacagncaaaatggtcatcaaaatcgtaaatcaatc

SEQ ID NO: 41461 - DNA, 101 bp, rice(Oryza sativa)
  misc_feature (71): n=t or c
tagttaaacggaattgctaaccttctttagacagaaattacatccccaaatcttgtagattttgggacacngaataagcttcgagattcgtgttctaggcc

SEQ ID NO: 41462 - DNA, 101 bp, rice(Oryza sativa)
  misc_feature (71): n=t or c
gaaaccgtttgaaattctgaaggcatatctaattctggcccatgtcgagagggtcgaatttcacaagattngaacccatttcgacaaatttgtgaaccccg

SEQ ID NO: 41463 - DNA, 101 bp, rice(Oryza sativa)
  misc_feature (71): n=a or g
ttggcacacttttcccatatatcaaacccgagaattacaatgggcaacaccatgaggccggagggaggggnttggcgctattgtcatgcacgccgcctcgt

SEQ ID NO: 41464 - DNA, 101 bp, rice(Oryza sativa)
  misc_feature (71): n=t or g
taaaagctatagacaaaacatggattataatcaggtctagatctaactagtacaattttttaaacaaaagnataattaacttccgatctactccctccatc

SEQ ID NO: 41465 - DNA, 101 bp, rice(Oryza sativa)
  misc_feature (71): n=a or g
catcgattggatgagttcagagttccacatatcatactagatcatgacattgtgataccgtggtagcattnataccactagttgtcatgctcctacacaat

SEQ ID NO: 41466 - DNA, 101 bp, rice(Oryza sativa)
  misc_feature (71): n=t or c
gctttgattgaaaatgttttgcataacctaatatatactctccagatcgagttactcaccacggatcgatnatgcgttgtcaaagcagctacctaaggtgt

SEQ ID NO: 41467 - DNA, 101 bp, rice(Oryza sativa)
  misc_feature (71): n=t or c
aaggagccgacgatgcaggcgaggatgaagtatccggtgatcttcccctcgtactgctccgccctcccggngatcgcctcgccgccgccgccgccgaaccc

SEQ ID NO: 41468 - DNA, 101 bp, rice(Oryza sativa)
  misc_feature (71): n=t or c
taacaaattaatatagttttacaacaaaaccattagacccaataggtcaaattctgatgcaatagacttgntgaacagaactaagatttgttgtttgcata

SEQ ID NO: 41469 - DNA, 101 bp, rice(Oryza sativa)
  misc_feature (71): n=a or c
tagattacttggtagtaattgttgcgtggtacaggaatcaatgtcgagtgcgtagccaacaatgtgttgangaggttagctagctggagtagctgatgatg

SEQ ID NO: 41470 - DNA, 101 bp, rice(Oryza sativa)
  misc_feature (71): n=t or c
aacagcgagcgcatgcttgaatgaatacgtcggtactactcggcattcggcaaggaaacgattgaggaacnatgtgtctgtttgaagagatttgttctggt

SEQ ID NO: 41471 - DNA, 101 bp, rice(Oryza sativa)
  misc_feature (71): n=t or g
gatccgcctatgctttgggactacgaatccggagttccggttcaaataccaccaaccgggactaaagaagncagccggtttgttttttttattactgtttc

SEQ ID NO: 41472 - DNA, 101 bp, rice(Oryza sativa)
  misc_feature (71): n=t or g
catttgcttaggagaatgtatatagctagcactcagcattttccttgttctctctcctccacgaaagtacnccctccgcccctaaatatttgacgtcgtta

SEQ ID NO: 41473 - DNA, 101 bp, rice(Oryza sativa)
  misc_feature (71): n=a or c
tcaaatgaagactatgggatgttataggttatcacaggagggaggcatcacctatacaaatttaatccagnaagtctctgtcttacctaatgcaatttttc

SEQ ID NO: 41474 - DNA, 101 bp, rice(Oryza sativa)
  misc_feature (71): n=t or c
atttttaaatgctagaagttgtattttgggatggagagggtagttttcaactgtgtatacagaaaatatancaatatatatctttgtttcaaaactaagat

SEQ ID NO: 41475 - DNA, 101 bp, rice(Oryza sativa)
  misc_feature (71): n=t or c
gcagtatggcccctgaggttaagggcccaaactatgagattaccggtcccaagtttctcctgttccattgnaaatttcgccttattttcagctcaaagaag

SEQ ID NO: 41476 - DNA, 101 bp, rice(Oryza sativa)
  misc_feature (71): n=a or g
acagaacaggtctccccctagaaagaatgattttgagtgagcgtgcatctatgaattatttactcccttcnttccaaaatataagcatttttagagtctga

SEQ ID NO: 41477 - DNA, 101 bp, rice(Oryza sativa)
  misc_feature (71): n=a or g
tggtatttgagcttcgcaatagagatgaagcctttagctaccctactccggcatctgctcctagaactacncaaatatacaactcaatgtagcatcacttg

SEQ ID NO: 41478 - DNA, 101 bp, rice(Oryza sativa)
  misc_feature (71): n=a or g
gctgctatgcctggagctcaggctaccctctttggatgcctgactaaggctaaggggctgtttggttggtnacctgagtgatatgcctgagaaaaaagcgt

SEQ ID NO: 41479 - DNA, 101 bp, rice(Oryza sativa)
  misc_feature (71): n=t or c
acatacatgagaaggattcgcaaaaatatacccgtcctgtgggatgaagatgcgggaccatgacagtcctnagctccaaaacgcaggaccgtcgcagtccg

SEQ ID NO: 41480 - DNA, 101 bp, rice(Oryza sativa)
  misc_feature (71): n=a or g
aaatttattagaaaagggggaaaaaacacgggacattaacatgagttcggagtgaattagcgcttccgggncaattaaaaaacttgcctaatccagttata

SEQ ID NO: 41481 - DNA, 101 bp, rice(Oryza sativa)
  misc_feature (71): n=t or c
cctccttttcttttcctaatctttgtgtgtgttgtgtgagttgtgggtgggttgttataagatttcttctnctcgatgacacattcacaatgagacgttca

SEQ ID NO: 41482 - DNA, 101 bp, rice(Oryza sativa)
  misc_feature (71): n=t or c
ttagatgagaatcagttgtggaggagaataatgtggtccgattagatgagaatcagttggggaacctaagncatgattatggaggagaataatgtggtcct

SEQ ID NO: 41483 - DNA, 101 bp, rice(Oryza sativa)
  misc_feature (71): n=t or c
gctcaacaccgtgtcgtgtgtcgggacactacatcagcttcggccccacaactcccatccccaacaagtgntgccaggggtggagctagtatatattaggg

SEQ ID NO: 41484 - DNA, 101 bp, rice(Oryza sativa)
  misc_feature (71): n=a or c
aagaggtcgacgggggcggcggcacgatcccccgccacgaatggagaagaaggccatactggctctaaatnatcggaaacgagtccggctgctagcggaag

SEQ ID NO: 41485 - DNA, 101 bp, rice(Oryza sativa)
  misc_feature (71): n=a or g
ttcctcagcctatagattgacaagaaaggacttccctaaacaggcaaggtgcagtaaggaatacaataatntttttttcccacgaactgttgtattttatg

SEQ ID NO: 41486 - DNA, 101 bp, rice(Oryza sativa)
  misc_feature (71): n=t or c
aagatcttgatatgatcatatgatcctgtacttgtggttgatggtggagtactgaaattttgtgcattttnctatattgttttgtatggtgaacttacttc

SEQ ID NO: 41487 - DNA, 101 bp, rice(Oryza sativa)
  misc_feature (71): n=a or c
atatgggttatgtcccaacttccaattgccacatggtatgacaggcgagatgatacctctggcaaaggatngaggaatggcagcagagtactttaggcttc

SEQ ID NO: 41488 - DNA, 101 bp, rice(Oryza sativa)
  misc_feature (71): n=a or g
atttttggtggcggaaggcttgaggatctcaaaccctagctttggcggcgctgtgcgtgaacaggagcgtnaaatgggatttgagaagatgatgattgttt

SEQ ID NO: 41489 - DNA, 101 bp, rice(Oryza sativa)
  misc_feature (71): n=a or c
atgccttcccttcttctccagtggcatccaaatccactcctaatctacgcaagctaattagtttccccagnttctgtgccactccgctgtctcgttcaatg

SEQ ID NO: 41490 - DNA, 101 bp, rice(Oryza sativa)
  misc_feature (71): n=t or c
cctgcaatgttatatggacatatgtatgtgttttttcactttatattttactgagctactccctccgtttnataatattgtttaaattcattagtatttat

SEQ ID NO: 41491 - DNA, 101 bp, rice(Oryza sativa)
  misc_feature (71): n=a or g
acttataccagtaacttttagatagatgcgaggaaagcaaagaagactaggcaagggggaaatacagaagnaggaatccatcgactactagtcgtcgtcct

SEQ ID NO: 41492 - DNA, 101 bp, rice(Oryza sativa)
  misc_feature (71): n=a or g
ttgtgaggtcctctatgaagacctagagagtcttgtctgtcgggttgttgataatccaattggcaatgtcntttttagggtttgaaaaaaatacacaaata

SEQ ID NO: 41493 - DNA, 101 bp, rice(Oryza sativa)
  misc_feature (71): n=t or c
tacctttcctgatctgacgagaagccaagacagccacaggaactttaaggtcagaacatgcaggcaaacanggttgaacagaatgcctgaacccaacagca

SEQ ID NO: 41494 - DNA, 101 bp, rice(Oryza sativa)
  misc_feature (71): n=a or g
cctaattactacagaattcttgtcaggccataataaagcaccgtgcatgatatgaccatcattgcaataanggtaccaaactagatatcaatactatgaaa

SEQ ID NO: 41495 - DNA, 101 bp, rice(Oryza sativa)
  misc_feature (71): n=a or g
ggatggtgtcttgggcaataagcaacgtgatttttgacctagctagttagagaagttacagcaggtgcgtngaaactgcaaagtaaaagtgccatatttgc

SEQ ID NO: 41496 - DNA, 101 bp, rice(Oryza sativa)
  misc_feature (71): n=a or g
tccaaaatcgcgcctccgatgatccgatccggcctccccacgcatagatcgcaactaacctcactagctanccgcggcgcggcgcctatacaagataaaca

SEQ ID NO: 41497 - DNA, 101 bp, rice(Oryza sativa)
  misc_feature (71): n=a or g
ggcagtgaaaatcctactcctactattagtctagtacccctaccgttggctagggtcgtgtcaagttggantctacacgtaacactcggaccaaacttgta

SEQ ID NO: 41498 - DNA, 101 bp, rice(Oryza sativa)
  misc_feature (71): n=t or g
gaacacctgaacagagcacagcacctatcccacttggtgaaataacatggccaattttataagaccacacntacatcttcccccgtcacggcaggtcggca

SEQ ID NO: 41499 - DNA, 101 bp, rice(Oryza sativa)
  misc_feature (71): n=t or c
aaaattattataaaactatagattttgggattcaaatcctcatgttatgtttgagttattaacgttcaagntttggactaaattgatgttaaacctgtatt

SEQ ID NO: 41500 - DNA, 101 bp, rice(Oryza sativa)
  misc_feature (71): n=t or c
aggtgtctagaaaaatgaatattttcgcgtgtgggtggcccaaccacacgagataattgattattctgtgnggtcaaattataccacccgcacggaaaaaa

SEQ ID NO: 41501 - DNA, 101 bp, rice(Oryza sativa)
  misc_feature (71): n=t or c
gtgtaagttttgagaaagaagaggctaactcattcgaggaaaataagaaaaaaaatcccccagctggtaangtggtatatttctgttaaagaccgcatatt

SEQ ID NO: 41502 - DNA, 101 bp, rice(Oryza sativa)
  misc_feature (71): n=a or g
ggcaactacatcaacgacgaattaggtggcaacgacttaagcgttgtcatgcatgcacgatatctgacttntctgtctcattgagctccgcataattgttc

SEQ ID NO: 41503 - DNA, 101 bp, rice(Oryza sativa)
  misc_feature (71): n=t or c
tatctgaagccttttgtgaagatgatggcttgagatctctacccaacagtacaccacgtacagcaccaganaaagaatcttcttttggaacacttgcacta

SEQ ID NO: 41504 - DNA, 101 bp, rice(Oryza sativa)
  misc_feature (71): n=a or g
ttctccccttccgttttcgactaggatctggacttgagttcgacatggatctttgcgattttcagtgcagnaattcgtctttgctagatcttacaaaatcc

SEQ ID NO: 41505 - DNA, 101 bp, rice(Oryza sativa)
  misc_feature (71): n=a or g
gagctactttagtcccaataagctactcccttagggacttatactaaagcactttagtccctcctgtttgngactctacagatttaaagggacttaaagtg

SEQ ID NO: 41506 - DNA, 101 bp, rice(Oryza sativa)
  misc_feature (71): n=a or g
aagattttcaaaatgtcttctacctactattccatctatccaaaccattattatttggattaagatagcangtaaaattaaatggagggttgaagaagttt

SEQ ID NO: 41507 - DNA, 101 bp, rice(Oryza sativa)
  misc_feature (71): n=t or g
atgccgatgtccgagatggcgatgaagacgcgctcccgcctcatgtagatggctccggagggatcgaagtngctggcgaaccgcgggtaccagcgacccca

SEQ ID NO: 41508 - DNA, 101 bp, rice(Oryza sativa)
  misc_feature (71): n=a or g
gaaatgccattcacaagtgcccaactctaagaaataccgccgataagtgtaagttcctcgaaatatcatcntacaagtgattttgttccagaaacgctatt

SEQ ID NO: 41509 - DNA, 101 bp, rice(Oryza sativa)
  misc_feature (71): n=a or g
gggtggtggacccggtggacccgtcatcgcggtccttctttgggatgatcaacgtcatggacgatccgctnacggaggggcccgagcccgagtccaagccc

SEQ ID NO: 41510 - DNA, 101 bp, rice(Oryza sativa)
  misc_feature (71): n=t or c
tcgtctatagataaatttgtatggatgactctatggctcgggcgcccgattgggttggagaaaaattgggngctgataacgtcagcgcccgatttacgtgt

SEQ ID NO: 41511 - DNA, 101 bp, rice(Oryza sativa)
  misc_feature (71): n=a or c
tctcatatacgcttagtttttatccaatatcgattgaaccccgtatgaccaaaccactggtccctcagtcnaaaaaaaaaattatggcattcaataaacta

SEQ ID NO: 41512 - DNA, 101 bp, rice(Oryza sativa)
  misc_feature (71): n=t or c
gtgactagaagtggccacgtggcgaaaaaaaagagccaaaagaaagaaaacccaagatctgtcctcctagngacctagcccaataacgctcattagcacgt

SEQ ID NO: 41513 - DNA, 101 bp, rice(Oryza sativa)
  misc_feature (71): n=a or g
aaaatagaactccttatttaattatcatgttctgaaatcggtctttgtttactgtaatgcacctcagtccntcatgcgtgtgatctgctttcaaagttaac

SEQ ID NO: 41514 - DNA, 101 bp, rice(Oryza sativa)
  misc_feature (71): n=t or c
tgcttgccatacctttattaaaagagacgctagacatcactaatgtaaagagttagggtggtccattatanaacaaaggcaaagttacctagtccaaagtg

SEQ ID NO: 41515 - DNA, 101 bp, rice(Oryza sativa)
  misc_feature (71): n=t or c
tcgagctcgacggcggcgttcttgtcgaacacaagcgtgatcctcggcagcgcgaagctgcggacgccggncatgtcgtagcaggtgtcgagcgggccctt

SEQ ID NO: 41516 - DNA, 101 bp, rice(Oryza sativa)
  misc_feature (71): n=t or g
atgaaataatttagtaatgtaagcaatatactctccagtgacgaataagggatggtttgggcattaacacngtccaaaactcaactttgactttcaatcta

SEQ ID NO: 41517 - DNA, 101 bp, rice(Oryza sativa)
  misc_feature (71): n=a or g
cgaagaggagcgaaggaaaagcgaagcgatttgactcccgtttccgtcgcctacttgcctcgatcacggcnctggccgatcgctcgtcgctacagacgcta

SEQ ID NO: 41518 - DNA, 101 bp, rice(Oryza sativa)
  misc_feature (71): n=t or c
ggaacttttgtgacgtaggtacattgtcatttcaaatattttctacaccattgcaattgcattccacttgnagaaggtaatcgaactgatagtcttttata

SEQ ID NO: 41519 - DNA, 101 bp, rice(Oryza sativa)
  misc_feature (71): n=a or g
gttagaagcttgcatacttctctcttccatgtgtatacaaatatttaaatgtgtaagacttgcaactacantcttgtacataacccgatacctgcaaattt

SEQ ID NO: 41520 - DNA, 101 bp, rice(Oryza sativa)
  misc_feature (71): n=t or c
atgcaggcacacaccttcttaagtttttgaaaactagcttgttagttgttaaatagtactccctccgtttntaaatatttgacgccgttgacttttttaaa

SEQ ID NO: 41521 - DNA, 101 bp, rice(Oryza sativa)
  misc_feature (71): n=a or c
ataactgttttgagaagggtcttagctagctatttgctcttaggtacaattagccgctatagctctatttngtccgttatagatgtcactgtagctgtttg

SEQ ID NO: 41522 - DNA, 101 bp, rice(Oryza sativa)
  misc_feature (71): n=t or c
cgttcccgcctttccctctcgctagatttcatcgagattcgtgctaaggggaagatactccctccgtactngcgaagggagtagttttggacagcagagac

SEQ ID NO: 41523 - DNA, 101 bp, rice(Oryza sativa)
  misc_feature (71): n=t or c
tctttatcttcaggagattcaaacaccacccgagtgctagattataataatgaattgtagctctcttgagnaaaggccgggatgttatactctattatctt

SEQ ID NO: 41524 - DNA, 101 bp, rice(Oryza sativa)
  misc_feature (71): n=a or c
catccatgccgagagagtaaacaaacgatcagggcaagtcacagacgtaccgtgccatcgtttggcttatntatgaaataaaccaaacggcatatttacaa

SEQ ID NO: 41525 - DNA, 101 bp, rice(Oryza sativa)
  misc_feature (71): n=t or c
ccactccccaccgccaatttgaggatgactccggtgagataactataggtacgaaccttctctaggcgggncgtggctctatccatctactcttctccaac

SEQ ID NO: 41526 - DNA, 101 bp, rice(Oryza sativa)
  misc_feature (71): n=a or g
gttgctcaaacctacaattatgatgcattaataattttgtacaagatcatcggcttcatgatatacacttntgtaagacttgtacatatcaatgtagtttt

SEQ ID NO: 41527 - DNA, 101 bp, rice(Oryza sativa)
  misc_feature (71): n=a or c
aaaagtgtaaaagaatgttgaggtggtagtgccaccaccatatttttaaaggagtatagattttgatgtgnacacgaacgagagagccgagagcaaatcaa

SEQ ID NO: 41528 - DNA, 101 bp, rice(Oryza sativa)
  misc_feature (71): n=t or c
atccctccagtttatattcaataagaggatctcgttgggtgtaacccctcaaaccaacagctttgttgcanaaacttctaccgttctacgcctgcaagtgt

SEQ ID NO: 41529 - DNA, 101 bp, rice(Oryza sativa)
  misc_feature (71): n=t or c
gcttcgatttgatagccgcagcaggagactgtcctggcctgttcaccacctagtgtagactgaaggatttntcacaattcggtcctttcacaaatttcaca

SEQ ID NO: 41530 - DNA, 101 bp, rice(Oryza sativa)
  misc_feature (71): n=a or c
ctctatttcccgccactgctaaagcccctctatttcacaaaaccaactaggaagctcgaggtgctcgtcgncccttggcatgccatatggttggtgagtcc

SEQ ID NO: 41531 - DNA, 101 bp, rice(Oryza sativa)
  misc_feature (71): n=t or c
gatattgaaagtcattgtatctattatgtgaactgaagcacacaagtaatgaatttgaccctttccttatnaaaaaaaagtatgcaatatatgacatcttt

SEQ ID NO: 41532 - DNA, 101 bp, rice(Oryza sativa)
  misc_feature (71): n=a or g
tgaggtgctttttttccaccggtagaacctgattcgtttagaggatggatgttcgtgcgggattccacgcnttcccctttgccgattccgtgtggattgga

SEQ ID NO: 41533 - DNA, 101 bp, rice(Oryza sativa)
  misc_feature (71): n=a or g
gatcatgttcgtgtgtgacacgaagtctgtgtcaagatcggatttcaattattttgtgtcacggtcttatncaaatagaataatttatctggtgtaatgtg

SEQ ID NO: 41534 - DNA, 101 bp, rice(Oryza sativa)
  misc_feature (71): n=a or g
catcccattccgacgggatgacacctcatcttgtccaaatgtccaaatggggtatcaatcgatacctactngatatcatacgatatttgcgaggtatcatc

SEQ ID NO: 41535 - DNA, 101 bp, rice(Oryza sativa)
  misc_feature (71): n=a or g
gcgtgacagagtgcagaaaaccattgagcaaaacacttcttcgattgaccgaaaggctaatcacaacttcntcattccatccattttcatggagagtccat

SEQ ID NO: 41536 - DNA, 101 bp, rice(Oryza sativa)
  misc_feature (71): n=t or g
gtctttaatttatttccaaaaaaactacgtaaaacataccgagcttatatatgtgcatcaacgtcaatagncacttacttcctccgttccaaaataaacga

SEQ ID NO: 41537 - DNA, 101 bp, rice(Oryza sativa)
  misc_feature (71): n=a or g
tccctatctcccctctcttcatctctctcccctactcccctctcctctatccaggcatggcagggaagcanccggtgggaaaaggaggggtgcgcggtggc

SEQ ID NO: 41538 - DNA, 101 bp, rice(Oryza sativa)
  misc_feature (71): n=a or g
tctatctaggtaactacaaacttcatcttatcgagccgaccttctattcatcgaaggacaattttgttatncgtagctagtatattgatatgatgttgggc

SEQ ID NO: 41539 - DNA, 101 bp, rice(Oryza sativa)
  misc_feature (71): n=a or g
aggaaaatggctggatatcaagcttgctcgtttgtttaggctaactcagttcagctcgtttaggggcacgncgtatcgtgttggggggaaaaagaagaacc

SEQ ID NO: 41540 - DNA, 101 bp, rice(Oryza sativa)
  misc_feature (71): n=t or c
tttttcagagtgagaggaagcacctgtatggtggaaatcccatgccgaagattgaggcgatgtcgaggtcngaggctttgttggcaatgccctcactgagg

SEQ ID NO: 41541 - DNA, 101 bp, rice(Oryza sativa)
  misc_feature (71): n=a or g
aaaggtaccccagccatctctctcttcctccctcctgcttccgttctgaatgaaaaaaaacgatcgatctncagccatggcgaacctgggtggcggcgccg

SEQ ID NO: 41542 - DNA, 101 bp, rice(Oryza sativa)
  misc_feature (71): n=a or c
gctgttcggcatcgcttcttcggcgcttgctgcggctgcgttgtagtaagaaaccttaggaccataatatntaatatatagggttatgtacgtaccatata

SEQ ID NO: 41543 - DNA, 101 bp, rice(Oryza sativa)
  misc_feature (71): n=a or g
tagtatcaacactagattcctggttttatgagacaatagcttgcgcgattgttacaacgtagctactactntatactccctccatattttaatattgtatg

SEQ ID NO: 41544 - DNA, 101 bp, rice(Oryza sativa)
  misc_feature (71): n=t or c
tatagcatccaagaaaaactagataaaagtcaactggaaattgatgaggacccaaagctttattgtgttangtttggataattgcttctctaacttttttt

SEQ ID NO: 41545 - DNA, 101 bp, rice(Oryza sativa)
  misc_feature (71): n=a or g
gttttaggagtctctgaaaagtgaccaagaatctggcccttgggttaatgacaaatttgattcaacgatantacatgaatttaattgaatatacacatgat

SEQ ID NO: 41546 - DNA, 101 bp, rice(Oryza sativa)
  misc_feature (71): n=a or g
ttttccgaccgatggatttgctccgagattcacgccaaaaaccacgcgagtcaaacaaaaaactcaaaaanctctttcgtcttcctcctcgcgactcctcg

SEQ ID NO: 41547 - DNA, 101 bp, rice(Oryza sativa)
  misc_feature (71): n=t or c
ttgctttcattgttagacatattaaagtgttgattgatggagagagggatttcatcatcaggaaggtccanagatctcaaaaccagattagccatgcttta

SEQ ID NO: 41548 - DNA, 101 bp, rice(Oryza sativa)
  misc_feature (71): n=t or c
tactgctttactccttcctctgtatttggccctcaccataagttttttgaagtctaaattcggagcagttncatttttttaaaggaataagttcactttat

SEQ ID NO: 41549 - DNA, 101 bp, rice(Oryza sativa)
  misc_feature (71): n=a or g
tgttgccttagttttctttggcattttgattccaggtactttgtctgttgtttgtagagatgtcggtgtcnagaatgtccagcagcgcgggcagcctgaat

SEQ ID NO: 41550 - DNA, 101 bp, rice(Oryza sativa)
  misc_feature (71): n=t or g
ttggagatggcatgggccgggcccgttgaccaatcttgttgtaggcctaattccacttggaaatgtttagntggtgtttggttggagggactaaagtgagg

SEQ ID NO: 41551 - DNA, 101 bp, rice(Oryza sativa)
  misc_feature (71): n=t or c
accgtaacttagcttcttctcagaacgcagccttactgtaggacggggagaatagttttgtgcaaagatgnagctaaattaaattcattggttatatcagg

SEQ ID NO: 41552 - DNA, 101 bp, rice(Oryza sativa)
  misc_feature (71): n=t or c
ttttactttttgtacccttggtaaatgtaacatcaacaaactgcaaaagtaactttgtgaaatctgcatangtaacttctctgttttttctttttatacag

SEQ ID NO: 41553 - DNA, 101 bp, rice(Oryza sativa)
  misc_feature (71): n=t or c
agtacttaagtcgacactactacacaaagggtttttccatacggttgggaagcatctttgcatgcggttgncccaaccgcatggacaaaatcgtctgcaaa

SEQ ID NO: 41554 - DNA, 101 bp, rice(Oryza sativa)
  misc_feature (71): n=t or c
tttgaaccctaggtcggtcttaaccaagagattaactctcacatcgagtgagctgcagctaagctgcctangtatagtagtagctccctaattacattatt

SEQ ID NO: 41555 - DNA, 101 bp, rice(Oryza sativa)
  misc_feature (71): n=t or c
accaatttcatcttcaatcctataatccttgctccgtgtggaacccacccctcactctacacccgaaaaangcgcacaaaaaggaaaacaaaaacgaaaaa

SEQ ID NO: 41556 - DNA, 101 bp, rice(Oryza sativa)
  misc_feature (71): n=t or c
gataattatcatgtccaatcattattttcttgcatatagattcagtactcacggctaccactactcccttntgaaggagtataggcccttggacagtacat

SEQ ID NO: 41557 - DNA, 101 bp, rice(Oryza sativa)
  misc_feature (71): n=a or g
acacaaacaagatatcaaggtgatttggagggtgatttctaattatgtgtagtttgggttcttatgccacntggtgttgatatggccctagaaacaaaatc

SEQ ID NO: 41558 - DNA, 101 bp, rice(Oryza sativa)
  misc_feature (71): n=a or g
tcaaaattctcctccctgcctctccaattcttttagttgaaaaaccaagaggacaaaccgccagcttcatntatgttcagaagtcaagtcaagtcaagcct

SEQ ID NO: 41559 - DNA, 101 bp, rice(Oryza sativa)
  misc_feature (71): n=t or c
ggtgccgctagacttaactcatcagactaagcattgatgggtgtgtttgtcgttgcgcttgcagcatgggnatttgggccaatactataaatttgatgtta

SEQ ID NO: 41560 - DNA, 101 bp, rice(Oryza sativa)
  misc_feature (71): n=t or c
gtcttgcaataatgtggacggcagatgagaagaccctgaaaacatgggaatgcaataagaaaaatacttanatattttttctatttatttaatgtatagtg

SEQ ID NO: 41561 - DNA, 101 bp, rice(Oryza sativa)
  misc_feature (71): n=a or g
ttgaatttgagagaaaaagttaggcgagaggatagaggtattagaatcctctcccagattaccaaacgcancagtgaaatggtttactcagggcaagtact

SEQ ID NO: 41562 - DNA, 101 bp, rice(Oryza sativa)
  misc_feature (71): n=a or c
tcgattgatcacctgttacagatcttttaggagggaacttataaataagtaaacatcagtttataagaganattaactgatttaaatagcattaggaattt

SEQ ID NO: 41563 - DNA, 101 bp, rice(Oryza sativa)
  misc_feature (71): n=t or c
taatttaatcagtatcgacacaatataactcactgctgttcatatgaaaatacagttcaaattagtcctanattccaaaaacatgaaaatcattacttact

SEQ ID NO: 41564 - DNA, 101 bp, rice(Oryza sativa)
  misc_feature (71): n=t or g
gcggcggttggttggtcgcgtagaggcgcgtagctccgttctacaggctccccccgctttgttccgaggcntgtgggggtgtgtgtgggttacaacttagt

SEQ ID NO: 41565 - DNA, 101 bp, rice(Oryza sativa)
  misc_feature (71): n=a or c
gtttaataggagtgaaaacctgaccggacttcagggttgcagcgctgatccgtacgaatgattcgttgagntacctaatccctgccttgattgcttttcct

SEQ ID NO: 41566 - DNA, 101 bp, rice(Oryza sativa)
  misc_feature (71): n=a or g
tttagcttatatttaatactttatatacgtattaaaagttggatgcgacaggccgaaaaactttggggtgntatttaaacagggctagcgaaagatcggtt

SEQ ID NO: 41567 - DNA, 101 bp, rice(Oryza sativa)
  misc_feature (71): n=t or c
tattattgcctgttgactaaattatgtgcttaaggagaaatttaaactggatcctgtcttctcgtttagtngtttgtccttttggttttaatttttaaaca

SEQ ID NO: 41568 - DNA, 101 bp, rice(Oryza sativa)
  misc_feature (71): n=a or g
acggaaggagatggtggaatggtttggaagaagtgggtgggccactgtgagatcggactcggcctcatttntagggccagctttcttggggcccaaaagta

SEQ ID NO: 41569 - DNA, 101 bp, rice(Oryza sativa)
  misc_feature (71): n=a or c
gacacgatttggatatgaatttgtccctctacctaggagatatttgtagctaggcattatattagcagcantttgcatgagagagagagagagagagagag

SEQ ID NO: 41570 - DNA, 101 bp, rice(Oryza sativa)
  misc_feature (71): n=t or c
tcgaggatcagcggcatcttgatccattcattcgccagcttaattaacaccatcacgtcacggcaagctgnagcttccacttcctctgccgacgtgcaata

SEQ ID NO: 41571 - DNA, 101 bp, rice(Oryza sativa)
  misc_feature (71): n=a or g
gctgggagaacggtgaaagggaactatggtttattatggttggagaagggatcttaagaggctcatgaaantaataaattgaatttaccatgcatttagct

SEQ ID NO: 41572 - DNA, 101 bp, rice(Oryza sativa)
  misc_feature (71): n=a or g
cgtcgaggttgtcgtagcagaagatctccgagacgaggaggctcggccgcgacgcgaacatgacgtccttntcgcggagcacctcctgcgccgccgccggc

SEQ ID NO: 41573 - DNA, 101 bp, rice(Oryza sativa)
  misc_feature (71): n=a or g
tgggtttttttatggaaggagtacactacttgcctagcctagctaacattatatcacactactaggaaaancatttttgcaagcggccaaaagcaattttt

SEQ ID NO: 41574 - DNA, 101 bp, rice(Oryza sativa)
  misc_feature (71): n=a or g
gtgtgagaggcattccatttccatgtagttgaatttgcaatggtttcattttctcacctgtgttgctaacnctttttcggttaaatctattatgtaaactc

SEQ ID NO: 41575 - DNA, 101 bp, rice(Oryza sativa)
  misc_feature (71): n=t or c
tacagtgtaatatgtgaccaggaaaatagcaaatttactgcggataagcctcgagaaaaaaaacgaaatgncaatttttactctctatgtcttaaaatata

SEQ ID NO: 41576 - DNA, 101 bp, rice(Oryza sativa)
  misc_feature (71): n=t or g
acatatgttgactgaacagtcaatactaaggacttggaaatgctaacttatggaaatgctgacttatgtanactagtgcgtgtcatttccacaaacaagat

SEQ ID NO: 41577 - DNA, 101 bp, rice(Oryza sativa)
  misc_feature (71): n=a or g
ggtcccgccaccgctgttgcctccaaagaagaagccgtttccgccactgtcaccgatggcggcagcgaagnaggagcccatcgagctcgcggcggtggcgc

SEQ ID NO: 41578 - DNA, 101 bp, rice(Oryza sativa)
  misc_feature (71): n=a or g
ccaccctcaaaaccaaataaaaaaaaatcatttttccaccgatttttaatagtaggggattaaaatatcgnatgctacgattaaaggatgtgaatcagatt

SEQ ID NO: 41579 - DNA, 101 bp, rice(Oryza sativa)
  misc_feature (71): n=a or g
agactaggacttgggtattacgtttacttgtgtatcaaggaacggcttgcagtcctagtctgttaagtttntagattagatataggaaacttaaatcatat

SEQ ID NO: 41580 - DNA, 101 bp, rice(Oryza sativa)
  misc_feature (71): n=a or g
cagttattttaagttgtatttctacttaaaataattgatgagtatatctggtggcatcctcgtgcggagcnagcggcaacggggaccttgagtaggagcga

SEQ ID NO: 41581 - DNA, 101 bp, rice(Oryza sativa)
  misc_feature (71): n=t or c
ctcgttaagaagttagattagattctggttttgcggtcttcttttattctcgtgagtgatccggttttttncccctactcttttttttatcacgaacgacc

SEQ ID NO: 41582 - DNA, 101 bp, rice(Oryza sativa)
  misc_feature (71): n=t or c
tttagtttacaatttgtaacatcccatcctccagaacaccgtagtccaacccatccaactgacgcgcccanttacaaagatcaccttactcacacttacgt

SEQ ID NO: 41583 - DNA, 101 bp, rice(Oryza sativa)
  misc_feature (71): n=t or c
attcctccctaaatttatccccttcctcctccttcaagaaagccaagaacaagaaagagaaaagatgtttngtggtcaggtcgattaacctatggatggaa

SEQ ID NO: 41584 - DNA, 101 bp, rice(Oryza sativa)
  misc_feature (71): n=a or g
gggagtatctcgtttattcctacagaatccaagggagagagagaagcagctgagagagagagccaagaccngcgatttcaccgagatgaggagcaggcgag

SEQ ID NO: 41585 - DNA, 101 bp, rice(Oryza sativa)
  misc_feature (71): n=a or g
gtggctgctcgaaaccacctcagtgtacaattgtgaaataatgcataggaaaattggcactaaccatgtanacccataatagattatagtttattgcaagc

SEQ ID NO: 41586 - DNA, 101 bp, rice(Oryza sativa)
  misc_feature (71): n=a or g
tgttacacacactacttaaaaaagggttttccttgtacatatacctctttaaattgcagacggaccaatcntgtctgcgaaaatcatcctccattttcgtg

SEQ ID NO: 41587 - DNA, 101 bp, rice(Oryza sativa)
  misc_feature (71): n=t or c
caagctacttgaattactaaactagtaaggaattgctgcttcatttgcccttctgctcaaatgactatatnggcattgagtaattgatagatacttgctcc

SEQ ID NO: 41588 - DNA, 101 bp, rice(Oryza sativa)
  misc_feature (71): n=a or c
gacagcaacgtttttgtctgtgctgattgaggaccacacatgctccaagttccgatcccctgaatacacanaaaaaaaaaagaaagaaaaaaaataccaac

SEQ ID NO: 41589 - DNA, 101 bp, rice(Oryza sativa)
  misc_feature (71): n=t or c
acaagcgctcgtgcatcaaccaatggtttgaatggttgcatggatttttcacgtaaaatattaatatctgnatggatcatatttgtgtacgtcgttgttct

SEQ ID NO: 41590 - DNA, 101 bp, rice(Oryza sativa)
  misc_feature (71): n=a or g
caacaactgctactgccaacacaatttcaagtgaagacactggaacagatgattcagaagcacagtcagcnccatcacaggatattccgtgcagcacacaa

SEQ ID NO: 41591 - DNA, 101 bp, rice(Oryza sativa)
  misc_feature (71): n=t or c
tgtatatgtaggtattttatggatgaaaaccactcgtcatgtgaagaaatacacctccgaaaaatcaggangcgttttacatggattggagggcccatatg

SEQ ID NO: 41592 - DNA, 101 bp, rice(Oryza sativa)
  misc_feature (71): n=t or g
cttcagaagatgatgtgcccagtgctgttactactatcaaaatgccatgaacatggatccgtgtattcctncaacacagtgccttgcgctatggtcttttt

SEQ ID NO: 41593 - DNA, 101 bp, rice(Oryza sativa)
  misc_feature (71): n=t or c
agggttttagttcatcgttttgggagggttagaggatgggttctaggtgctgtgttttggatcgttagttnggggcgctgtcagattttctgtctctctgt

SEQ ID NO: 41594 - DNA, 101 bp, rice(Oryza sativa)
  misc_feature (71): n=a or c
ctaacaacctacataaagtaaacacaggtgatgtttcacatcatacgatatcaaagagctatttatctctntcataatgggcaaaaacacattaaattaaa

SEQ ID NO: 41595 - DNA, 101 bp, rice(Oryza sativa)
  misc_feature (71): n=t or g
cattctcatagcttggttaattatgtttttttttagcatttgagatgttggagttcaccgaatttgaaganggaagtttgttagatctctcatttgactat

SEQ ID NO: 41596 - DNA, 101 bp, rice(Oryza sativa)
  misc_feature (71): n=t or c
cggagatggaaacttaaagcgtgcgctatcaggatgatgtacgaattttgagaggcaaaaacaccttaaanttttataataggtaaagatatagattcatt

SEQ ID NO: 41597 - DNA, 101 bp, rice(Oryza sativa)
  misc_feature (71): n=t or c
actctatcctcagccatacgggagtattatcaaatgtacatgcaatatatccaaactctaacatagaatanaatacttttgtgatgtgttgttcacgctag

SEQ ID NO: 41598 - DNA, 101 bp, rice(Oryza sativa)
  misc_feature (71): n=t or c
cccccctccatctcccccgtttttacgccgaactcaacaaacttcttttttactagggctgtgtttttctngtaaagttgaaagtttgtgttgaaattggt

SEQ ID NO: 41599 - DNA, 101 bp, rice(Oryza sativa)
  misc_feature (71): n=a or g
aagagtatactaggtgtgtggagcagcaacaacacgacgtgaaacgaaggctttgcaatgtgactgaaaanttacgtgtgtatgaaagatttgatgtgatg

SEQ ID NO: 41600 - DNA, 101 bp, rice(Oryza sativa)
  misc_feature (71): n=t or c
tgacaaagagacggcgctggaatgagttataccgaaggtgccaatggggtgggcagaaaaagaccgagatngaaaagaccgaaactgataaatttggtcca

SEQ ID NO: 41601 - DNA, 101 bp, rice(Oryza sativa)
  misc_feature (71): n=a or c
tatacaaacccttggtgtttatactagtccttgaggtttacaaaatttaggccctacttgaaacacgatanttttgcaatgatttcatataaacaattcaa

SEQ ID NO: 41602 - DNA, 101 bp, rice(Oryza sativa)
  misc_feature (71): n=a or g
ctttgggggacagcgggtgtcgcagaggacgataacgtcttaactcttaagtgtcgacgaccaatcctcgncaaggagaaggcggatcctacgaaggtggt

SEQ ID NO: 41603 - DNA, 101 bp, rice(Oryza sativa)
  misc_feature (71): n=a or g
cttttctcaccacctttttccccttcacaatcacaagcgaaacaaatccaaatcgagagagggtggcggcngcaactagcgcgcaagggggcggcggcgca

SEQ ID NO: 41604 - DNA, 101 bp, rice(Oryza sativa)
  misc_feature (71): n=t or g
aacatgccacgtcatcggcgtgatagtgttgttttatcacaccaaccggctggcgtagtcaaaagtttcanaattataaataagttttgaaaatgtttatt

SEQ ID NO: 41605 - DNA, 101 bp, rice(Oryza sativa)
  misc_feature (71): n=t or g
ctgtgtattggacggaattaggatagttcagattcacggtaccggatgtgttaaggtttataatttttttngacggaggaggaagtatatgtgagtgtaaa

SEQ ID NO: 41606 - DNA, 101 bp, rice(Oryza sativa)
  misc_feature (71): n=a or c
atgtgcttagttgtttgctttagaggtaaagccatctcccaggctagtctggcgattgtcgggctcaacancatcagtggcttcaataatggtttgcttca

SEQ ID NO: 41607 - DNA, 101 bp, rice(Oryza sativa)
  misc_feature (71): n=t or c
caatgggccttggcctgccaagaggcccatcagatcacacggcccaataggaggccttcgagaaggttctncgctggcctcgcacgctctggacttcttaa

SEQ ID NO: 41608 - DNA, 101 bp, rice(Oryza sativa)
  misc_feature (71): n=a or g
aatacaaatcatctaacaatgctgctcactaacacataaacctgagaaacgtaaggagatttttcggttanctccacagggtggttagtcagggtttattt

SEQ ID NO: 41609 - DNA, 101 bp, rice(Oryza sativa)
  misc_feature (71): n=t or c
attttgaaataagggctcgatatatcttcggttcgacgaagtcactacagataccccgctgtcgatgttangtcgcctaccactaaaaaaaataattagct

SEQ ID NO: 41610 - DNA, 101 bp, rice(Oryza sativa)
  misc_feature (71): n=t or c
ttttcgctctgtttttacttttattacggacggttttttcaccctctttacggggaatcggacacgttttnttttcaaggcagcccaattaatttgcttgg

SEQ ID NO: 41611 - DNA, 101 bp, rice(Oryza sativa)
  misc_feature (71): n=t or c
tttattttttttccttcttgcctattgttttcgcttacatggtttctctgatctgatcagcatctttgtanatcattgtgtagagaaggctggacgtgagc

SEQ ID NO: 41612 - DNA, 101 bp, rice(Oryza sativa)
  misc_feature (71): n=a or g
tggttcgccccagaagccgcccagggtgccaagctttataggtttcctaattataaaggcgcgcggaaggngcgagcgctgagtgcgtgggggcggtggaa

SEQ ID NO: 41613 - DNA, 101 bp, rice(Oryza sativa)
  misc_feature (71): n=a or g
cttgttgcctcatcggcgagctttccgctccgtcatcgtcaagcacttcgcactcaagctcaccacggtgntcgccgttgcgctgcctctgcattctcggc

SEQ ID NO: 41614 - DNA, 101 bp, rice(Oryza sativa)
  misc_feature (71): n=t or c
ggttgaatgaattattgaagcgattatcggttagccggaattatcgccaccgttttctgcatataaatganaaacgtctgattttatggtttgtccctaac

SEQ ID NO: 41615 - DNA, 101 bp, rice(Oryza sativa)
  misc_feature (71): n=a or g
taactatttctgattagggctggagggaaaaaaaaaaggtcatgactcgctaactcgctcagctcgactcncaagccaaaggcaagcaacgggtaagcgaa

SEQ ID NO: 41616 - DNA, 101 bp, rice(Oryza sativa)
  misc_feature (71): n=a or g
ttggaattttccagaaaagtccatgcctttttccctttttccttcatctctttctctattctgcctttttncagaaaagcccttctccttcctcctttttc

SEQ ID NO: 41617 - DNA, 101 bp, rice(Oryza sativa)
  misc_feature (71): n=a or g
ctttggcggtgggctcatagggacgactgcgctcagcttccatttggcacggccaaagctccaaccaaacnattttagcttcaccagaaaataaagtaaag

SEQ ID NO: 41618 - DNA, 101 bp, rice(Oryza sativa)
  misc_feature (71): n=t or c
ccctcttctctcaagcatggcgagatcttggctgatctcagagaagacaggttcggcgtcgagctcgtcgnagcctagatctagggggctgaggcgtcaac

SEQ ID NO: 41619 - DNA, 101 bp, rice(Oryza sativa)
  misc_feature (71): n=t or g
caagcaatatgagtcacgcgtatgaatcattttactgcatcaatcgctgacatcatgacatcgccgaactngtgctactgtgctagtactccaacaaacgg

SEQ ID NO: 41620 - DNA, 101 bp, rice(Oryza sativa)
  misc_feature (71): n=t or c
attatgcctccaattatttgatcaacccatgcaagtgtgccatatagtttatatatatttatgtatggatncaaatcaattatagcctcgatcaatctctt

SEQ ID NO: 41621 - DNA, 101 bp, rice(Oryza sativa)
  misc_feature (71): n=a or g
acacatcatggtaccgtctgaggtggattttaacctacctgattttgtgcactaggtatggttgcgactcntatttggttggaaacttgtcaaaacttgga

SEQ ID NO: 41622 - DNA, 101 bp, rice(Oryza sativa)
  misc_feature (71): n=a or g
ttgcacttaaattaacagctgtaatactatcgaaacctccatcctcaattaaaggcttcgcaggggttccngtgagacgcttctccctgccaaaatttgca

SEQ ID NO: 41623 - DNA, 101 bp, rice(Oryza sativa)
  misc_feature (71): n=t or c
attttactggatgatcaaagtacctcttttcttcatcaacttgagcgatctagaaatcagatcattccttncttcttgaattgcaaacttaggtatgtcta

SEQ ID NO: 41624 - DNA, 101 bp, rice(Oryza sativa)
  misc_feature (71): n=a or g
actagtacgtacttaccgcagcaagctagtggtagacgttattctctccgttgtattttgtattttaagtncagctatttttttcctaattttgattatct

SEQ ID NO: 41625 - DNA, 101 bp, rice(Oryza sativa)
  misc_feature (71): n=t or c
aaccatttgtctgccaacgtacgtcgatgatatatattcgtctagcttgttctctagatttaaaagcaatncgtacatgctgtcataccgcatataatttg

SEQ ID NO: 41626 - DNA, 101 bp, rice(Oryza sativa)
  misc_feature (71): n=a or g
atttacatgccggcttcagaagattattgatggacgaggtgaactcatccatgaagatacagtcatagagnttgacatgcacgcagaagattaagacctat

SEQ ID NO: 41627 - DNA, 101 bp, rice(Oryza sativa)
  misc_feature (71): n=a or g
ctttggtaaaatcaagtccaccacgtagacactcataacatgctctccaagcagaaatatcacaagtaccnccgcgaccagggccgtcgcaaggaaaacta

SEQ ID NO: 41628 - DNA, 101 bp, rice(Oryza sativa)
  misc_feature (71): n=a or g
aaaaagacgtgtttggcaaccttccctcctatcatggaaaacagggcggtagaataacacatgattaatgnaatatattaactaaaaaactctaaaataga

SEQ ID NO: 41629 - DNA, 101 bp, rice(Oryza sativa)
  misc_feature (71): n=a or g
ccaaatctagcacttaaactcgggtgaacatgttccaaaaccaaaaaacctaacctaagtagctgagcaangctcacttgcataaatttgatccggtgaaa

SEQ ID NO: 41630 - DNA, 101 bp, rice(Oryza sativa)
  misc_feature (71): n=a or g
tctactggtgctaccagcaaatgctggaagccgggaacactgggtacgttggaaaccacgtgatgtgaagnagtaagataaactgtaggagaaaagcattt

SEQ ID NO: 41631 - DNA, 101 bp, rice(Oryza sativa)
  misc_feature (71): n=a or g
ccgtcctaaaaaaagcttaatctaggaggggatgtgaccatcattagtccagatacattgtcctaagaggngtcagattgagttttttttttgggacggag

SEQ ID NO: 41632 - DNA, 101 bp, rice(Oryza sativa)
  misc_feature (71): n=t or c
gctgacaagaagccaggggttgagatgaagatttgtgttcaggaggccaaggaggagaatgtggtaaaaantcgcatatttggggccaagaggaagttctc

SEQ ID NO: 41633 - DNA, 101 bp, rice(Oryza sativa)
  misc_feature (71): n=a or g
atttgatcaggcccaacaaacacccaattcctgtttgggccttttgtctagcccattaaacgcttaatttntagccaataatcaagcagatttaatggatg

SEQ ID NO: 41634 - DNA, 101 bp, rice(Oryza sativa)
  misc_feature (71): n=t or c
cttagaaaataaaagcaaaacatctaacatttgattctcgcttgaattgactgacccaaaatgatattttnatattaaaaaaatcttgcaatattttagtg

SEQ ID NO: 41635 - DNA, 101 bp, rice(Oryza sativa)
  misc_feature (71): n=t or c
acattccccatgttggattttttgaaggttctcacatcaccaaatgaggcattcagaaagtacagtaaagncacatctcgaggatgacaaaagacgttcga

SEQ ID NO: 41636 - DNA, 101 bp, rice(Oryza sativa)
  misc_feature (71): n=t or c
ggaacttcgtagagaagaaattccagcgggaactgatattctgattagtcaaagtgctcgcggatggtgangagtgacgccccgatgctactccctcaggt

SEQ ID NO: 41637 - DNA, 101 bp, rice(Oryza sativa)
  misc_feature (71): n=t or c
tgggaattgtgttacgatttgaagttgagtactccccacattacaaaatatcaggcatatttgctctttanacggtattaagtactatgttaaccactcct

SEQ ID NO: 41638 - DNA, 101 bp, rice(Oryza sativa)
  misc_feature (71): n=a or g
tctaagagcaagtatagtaagtcctagtcagcaggcggaaccgtttcccacgtcatcaaaatcctaggtgncggagtgagaagagaagagagagaacggag

SEQ ID NO: 41639 - DNA, 101 bp, rice(Oryza sativa)
  misc_feature (71): n=a or c
aaaccaatccaaatcagagaatcggcagggtgaaagcagcagagcgttgaccaccgctgctcaccggatgnaggaggaggtaggcgataggaggagaggcg

SEQ ID NO: 41640 - DNA, 101 bp, rice(Oryza sativa)
  misc_feature (71): n=t or c
ctcgcctatttgttgtccattaaccttttgcatggaataaattgataactagagagcagtgtacaataacnccaagattcggataacgctccttggtctca

SEQ ID NO: 41641 - DNA, 101 bp, rice(Oryza sativa)
  misc_feature (71): n=t or c
tagtaacccgaccattgctgttccatcagctcaatttctactgacgcagtagtattcctttctcggtctgnttactttgatgccattttcaaccataaaat

SEQ ID NO: 41642 - DNA, 101 bp, rice(Oryza sativa)
  misc_feature (71): n=t or c
cgcccgcaaaaatgacggtgactaaacaaggcccaatacagcaaaaccatctgtacaagtgatgcgattangggctaatcttcatcatcatttacattgta

SEQ ID NO: 41643 - DNA, 101 bp, rice(Oryza sativa)
  misc_feature (71): n=a or g
aataggctcggggtgccgacaggtgagacaaggttgcttacccccacgacaaagggaataagttccacccnagtctcgaaatcgccaggggtgaagtgggg

SEQ ID NO: 41644 - DNA, 101 bp, rice(Oryza sativa)
  misc_feature (71): n=t or g
gcactgcatggagacgctctacaacttgctgtagttagctagcactagtgctggccttcgtctctagtagnagtagtactacacctataaaacaaccacgt

SEQ ID NO: 41645 - DNA, 101 bp, rice(Oryza sativa)
  misc_feature (71): n=a or g
aacaccttggacgtatctcagaattaaaagggggattagaaggtaaaacacaaacaaatctaacaccactngatccgtcatccaagcccacctcccaacgc

SEQ ID NO: 41646 - DNA, 101 bp, rice(Oryza sativa)
  misc_feature (71): n=t or c
agcagccttgacctccagacataagtagctagctgactatatatagctgctttctgtgttaattcgccttnggcttggagtacttctacagtgctagctgc

SEQ ID NO: 41647 - DNA, 101 bp, rice(Oryza sativa)
  misc_feature (71): n=a or g
tatttgagaaactgaatgtgatgctgcggaaacaagtttaaaaatcaaaagattggtctagaacactatgnaaatactacaatgttaatggatctaagtgg

SEQ ID NO: 41648 - DNA, 101 bp, rice(Oryza sativa)
  misc_feature (71): n=a or g
aaacatgttggtgatggcatggatccaattttacaaaattccaatagcacacaaccgatatcgcgaatacnatgatatttatttaatacggtacatttgta

SEQ ID NO: 41649 - DNA, 101 bp, rice(Oryza sativa)
  misc_feature (71): n=a or g
ggagaggctagcaaacattgatgtattcgcaaaggaaaaaagttcacctaagatctcccatcttgtcacgnagttaaaaaatcgtctttgaaccgaaaatc

SEQ ID NO: 41650 - DNA, 101 bp, rice(Oryza sativa)
  misc_feature (71): n=t or c
ataaagggaacgagacttcgacatagactagctcggattagtaaggtcaacgtgttttcccctcaaacttncaacttttccatcacatcaaatatttgaca

SEQ ID NO: 41651 - DNA, 101 bp, rice(Oryza sativa)
  misc_feature (71): n=a or g
gttgcaggctttcagctcctttatcctgcccaacttagtttcgactttcgaaccacttgtcctacacctcncagtcctcttcgtcttttcaaaggtcggca

SEQ ID NO: 41652 - DNA, 101 bp, rice(Oryza sativa)
  misc_feature (71): n=t or c
tattggaactcgtactacaactaacaatgaatctatagcctacttttttctatctcctctcctctcttctncacattaagcataaatctgtagcccacttt

SEQ ID NO: 41653 - DNA, 101 bp, rice(Oryza sativa)
  misc_feature (71): n=a or g
tcaagccgtcagaaatacgacttagtcatgtcgctgcttgaatcaatgcccactaacgacaattggggaangaagccccaaaggaggctaggccactgaag

SEQ ID NO: 41654 - DNA, 101 bp, rice(Oryza sativa)
  misc_feature (71): n=t or c
aatcaaatcgcttcgataatcttagggacaacaggaacaggtcaatttatcatcaatctagcatgactaangaaacatagaggtcctctcaaaaaaaaaag

SEQ ID NO: 41655 - DNA, 101 bp, rice(Oryza sativa)
  misc_feature (71): n=a or c
tcttatgactagacatttcttttatctcacaccggggcgccgcttgcgagaagactatccgtaaacagagnctgacattgtggggacatacggcttggtgt

SEQ ID NO: 41656 - DNA, 101 bp, rice(Oryza sativa)
  misc_feature (71): n=t or c
cgaaaaagaaaaaatagaaattgattccctccctagtctcgctttccacctttgaatcttcttcttccctnggaatccgatgattctctttcccatttttg

SEQ ID NO: 41657 - DNA, 101 bp, rice(Oryza sativa)
  misc_feature (71): n=t or c
gactctagaacacgagactagctcgattaacaggactacccgacaatctatactattgggggaagatggcnggacccctcctccaaccttcgccggcgaca

SEQ ID NO: 41658 - DNA, 101 bp, rice(Oryza sativa)
  misc_feature (71): n=a or c
aaagacaagcatgcatctcaagtctcaaccaagaattgcatgctttgctattgtctgccacacaagcaagnttacataggcagaatttattttagtaaaaa

SEQ ID NO: 41659 - DNA, 101 bp, rice(Oryza sativa)
  misc_feature (71): n=t or g
gaataccacagtagcacaaagcatgcgttacacgaaaggctgtaacacatactacatctaatgtgaaacantacagtattataggaagaactgtcgtagca

SEQ ID NO: 41660 - DNA, 101 bp, rice(Oryza sativa)
  misc_feature (71): n=a or g
tcgcatcagcacaatcctattttcaaccggcgagagcaatcgatacctagagccccctgagccaaaatctncaaatggcaccttggccaatacatctcaag

SEQ ID NO: 41661 - DNA, 101 bp, rice(Oryza sativa)
  misc_feature (71): n=a or g
gcctagctactggctaattcagctattccatcgtcctcttctgagattgcagtaagctcggaggagtgaangtaagaatccatgacttgtggaggtggcat

SEQ ID NO: 41662 - DNA, 101 bp, rice(Oryza sativa)
  misc_feature (71): n=a or g
acacagaaactccggaatttagaaatggaagaaccaacactatcgatttggcaatcacaaaaagacatgangggaacaattatcatccaaaaaatttttgt

SEQ ID NO: 41663 - DNA, 101 bp, rice(Oryza sativa)
  misc_feature (71): n=t or c
tttgatcggatttcagcgagttcatggagtacacgtcgatgtgcattttaatacgagggaagggattcagngatggcctccggacccacgcatcggtgtct

SEQ ID NO: 41664 - DNA, 101 bp, rice(Oryza sativa)
  misc_feature (71): n=t or c
aatagctacactgctagtgaagtttatcggtgatatggacctggggatatcatctttacagggaggaggcnacccccgaacccacatgccccccctccagg

SEQ ID NO: 41665 - DNA, 101 bp, rice(Oryza sativa)
  misc_feature (71): n=t or c
aagattattgcggtgatctaagctaagacttgtcaaaaccggctagtgtacctgacggagcgtgaggctcntcaccgggagaccgcgcaggcccccctttg

SEQ ID NO: 41666 - DNA, 101 bp, rice(Oryza sativa)
  misc_feature (71): n=a or g
acggaaggtttacgggacaaacctacaaaggggtaattgcactctcgagcgacggcagacgatttacggcncaaatcgacaaagatgaactaaaactagag

SEQ ID NO: 41667 - DNA, 101 bp, rice(Oryza sativa)
  misc_feature (71): n=t or g
ttactgactcccaggtgtcaaagtacatcatccatctcaaaataagttaacattgtactaggacaacaaanctagacatactctatatccagatctattat

SEQ ID NO: 41668 - DNA, 101 bp, rice(Oryza sativa)
  misc_feature (71): n=a or g
tattatttgagtgtagtgtagggttggtttctaatcttatagtagatgtgtcatctagattcttaaagggncaattgtgttcttacccctactttcatatg

SEQ ID NO: 41669 - DNA, 101 bp, rice(Oryza sativa)
  misc_feature (71): n=t or g
cgttttgtttgtttgtatatcaaagcaaccaatctgagcaaggaaaataaaggcagatcttgccttgcctngcctggcattatatctttttaaaagttgaa

SEQ ID NO: 41670 - DNA, 101 bp, rice(Oryza sativa)
  misc_feature (71): n=t or g
tacatgcatcaaaaggcatccaattttacccctcctcatcatcaataatccctttctatggagagataganagatagatagatagatagatagatagatag

SEQ ID NO: 41671 - DNA, 101 bp, rice(Oryza sativa)
  misc_feature (71): n=t or c
gtcaaagtgtcaagtattatacattatgatatttttccgacgaaggtaagacgctgttgacttttttaaanatgtttgattgtttgtcttatataaaaaat

SEQ ID NO: 41672 - DNA, 101 bp, rice(Oryza sativa)
  misc_feature (71): n=t or c
tattataaaagtttaaaatgtttttgtctacttttgcacgtcgttccagtccgattccggttttttcatcnggctttccagagtctgtcgcgagcacgtac

SEQ ID NO: 41673 - DNA, 101 bp, rice(Oryza sativa)
  misc_feature (71): n=t or c
aagtgtgctacatgctcatgtaatttaactcgggtaacataaactctctctcagtcgcgctttgtgcaagngctagcataactatatatatgagtgggcga

SEQ ID NO: 41674 - DNA, 101 bp, rice(Oryza sativa)
  misc_feature (71): n=a or c
gggcaatgcacagtgtggaggccgaacagcatgaccatgcaaaacgcatgtcgaagcccacccctcatggnaaggtggtcaagatgtaggtcgacgatgcc

SEQ ID NO: 41675 - DNA, 101 bp, rice(Oryza sativa)
  misc_feature (71): n=t or c
tttcacaaaagacgttaaaaagacgttaagctcatgtttggttggagggatgggatcaatcaggttggagngaatatattcctcgggatgtttagttaagg

SEQ ID NO: 41676 - DNA, 101 bp, rice(Oryza sativa)
  misc_feature (71): n=t or c
aaataaaaaacatgtgagactcttgtaaatggcatacatcttcttcctttactcctttaaaaatttcggcngaaataatatcatatcggagggatccgata

SEQ ID NO: 41677 - DNA, 101 bp, rice(Oryza sativa)
  misc_feature (71): n=a or g
cccgtgctgggcaactccttcgctcccgactaggagttgcgtctccaggctagctacctacaccaccgccntatgatttcgtcaacatactggccggctcc

SEQ ID NO: 41678 - DNA, 101 bp, rice(Oryza sativa)
  misc_feature (71): n=t or g
tgcatttggagaataaatgagatagaaaaaccagaaaagccacaagacgttgcgcggcaccaaaacctgtnttcttgtgttcatctgtgttcgttgctttc

SEQ ID NO: 41679 - DNA, 101 bp, rice(Oryza sativa)
  misc_feature (71): n=t or c
gcgtggatcagatcgcgcttcatcagccgctgattgcaacaaatctactttgaatccctcaaataaaggtntaatctaattcgtatctctcaaccgcaaaa

SEQ ID NO: 41680 - DNA, 101 bp, rice(Oryza sativa)
  misc_feature (71): n=a or g
gcggagccggggctgcaggcgatgcatcagcattgccaccagcagcaccaacggatggggaccctgaagcngcagcagctgctgcagccttcgccttcgcc

SEQ ID NO: 41681 - DNA, 101 bp, rice(Oryza sativa)
  misc_feature (71): n=a or g
atgcgtgggtggatcggtggaccaacagacagcgaaggggaagagagaggctcgtcaccgggtgggccccncacaccgacaggtgggcccactgcagcgcc

SEQ ID NO: 41682 - DNA, 101 bp, rice(Oryza sativa)
  misc_feature (71): n=a or g
caaaagaacactatcaactcagatacgaaataattttccaagaccaacaacacctcaactttagaacaatngaataatttacccatttattattgatcttt

SEQ ID NO: 41683 - DNA, 101 bp, rice(Oryza sativa)
  misc_feature (71): n=a or g
aattttatctataaactacttctaactcctttatttatttcttcacggtttgtcagctcctgagttttgcntttgaatatttgtttctggagataggagac

SEQ ID NO: 41684 - DNA, 101 bp, rice(Oryza sativa)
  misc_feature (71): n=a or g
gtgtatcagctggagactgtatcggctagaaacaaagacgaactaggattgagccgatgaggcgagacacnagccgatacagacacagttgggctcacgac

SEQ ID NO: 41685 - DNA, 101 bp, rice(Oryza sativa)
  misc_feature (71): n=t or c
taattaggtcccttatgatttgatcgcacctagttagacagtctaatcgggctaattaggtcccttagagnaagtttaatagtacagcccactactagctt

SEQ ID NO: 41686 - DNA, 101 bp, rice(Oryza sativa)
  misc_feature (71): n=a or g
tgtcaaataacgtaactgaaaatgacatggctctaatttgataactctcgaatccttaatcaataaatacnaaatcgtatctatctcggactttcaattaa

SEQ ID NO: 41687 - DNA, 101 bp, rice(Oryza sativa)
  misc_feature (71): n=t or c
aactcaagggtaagagaaagacgtgtaaggagaaatcaagtgataacccacgtaagtctaaaaagaaaccngaggattggttgaaaaagaggtcaatattc

SEQ ID NO: 41688 - DNA, 101 bp, rice(Oryza sativa)
  misc_feature (71): n=t or c
tggacttccgtgaatttgtggatcatgtggaatcaatgtggcattgtgtgaattttgttgacatttcattncgtgcacgcaagctaatccccatatatgag

SEQ ID NO: 41689 - DNA, 101 bp, rice(Oryza sativa)
  misc_feature (71): n=a or g
attcggctctgaaagatgttgaaggtactggtgactaatacctcttatctttatgcctactcgttgatatnaatctatttacgcagatcgcaaaatcaagt

SEQ ID NO: 41690 - DNA, 101 bp, rice(Oryza sativa)
  misc_feature (71): n=t or c
gcgcaaagttttttcctccagcgaatcacccaacgacagatctttctccttcaaccatttaggaaacttcngtttctgttctttacaaatccaaatgtccg

SEQ ID NO: 41691 - DNA, 101 bp, rice(Oryza sativa)
  misc_feature (71): n=t or c
ctgcacacggtaaaatacggtggcttcaagccttggacgtgtaccagccaactactagtccaaccacgacngacggcacacggcacggcatggatccgtgc

SEQ ID NO: 41692 - DNA, 101 bp, rice(Oryza sativa)
  misc_feature (71): n=t or c
gatagaactcattaacaagctagatagtcagtcgagccgagctagcgttttggctcgttaagattaacacnctaagttaactcattaaggtaacaagctca

SEQ ID NO: 41693 - DNA, 101 bp, rice(Oryza sativa)
  misc_feature (71): n=a or g
tcatcgtatgattactttatgcattgctaatagttgacatgtacagctcagtgcaatgcaagaaacaaacncagtactcttgctgctcttctgatgcaaat

SEQ ID NO: 41694 - DNA, 101 bp, rice(Oryza sativa)
  misc_feature (71): n=t or c
tttaaaatgaagttgaaattgtttggttgggttccagcttcagaaaagatggagtagaagctataccaaanataacctaaggctcagttcttttcttcaac

SEQ ID NO: 41695 - DNA, 101 bp, rice(Oryza sativa)
  misc_feature (71): n=t or c
cttttagtatataatagatagattagttcaaacatggcgacattcgaatatagatacatcccaaaataaancaactttaattaacgtatcctccatattcg

SEQ ID NO: 41696 - DNA, 101 bp, rice(Oryza sativa)
  misc_feature (71): n=t or c
cagtgttggccaagcttcccagtatgaacgaacacactctcttgttgacccgggttgctaagggcatgtanaatggtagccacaagtaattgtggtctcga

SEQ ID NO: 41697 - DNA, 101 bp, rice(Oryza sativa)
  misc_feature (71): n=t or g
gcgaaaatgtgttcgtcagagaactagtttcagcagactaattagaataatcagggcctattgaatcgtanaaataaaaaaaatagacgaataagcaaaac

SEQ ID NO: 41698 - DNA, 101 bp, rice(Oryza sativa)
  misc_feature (71): n=a or c
ttgtcttcgcgaaacttgaagaatttaattctggtcactgtacgttgaatctacccgattataattaatcngggcaacaaacagcaacgtgatcaaaagca

SEQ ID NO: 41699 - DNA, 101 bp, rice(Oryza sativa)
  misc_feature (71): n=t or c
gccatctatatataaacaattagtacaaaaatcaaagcaaaatatagtttatttccatttatcatgcccanaaattgatatttttattttataaggttgaa

SEQ ID NO: 41700 - DNA, 101 bp, rice(Oryza sativa)
  misc_feature (71): n=t or c
tacaatgtcatcatgtggagtagtatatgtatagttcggttaacctccagtgaatagtcaacagaaccatnacatacagtaaacaggtacttgttataaat

SEQ ID NO: 41701 - DNA, 101 bp, rice(Oryza sativa)
  misc_feature (71): n=a or c
aacgaggaggctggagagggagtgctcgcggccaggggcattttagtacttttaacgctctttctctctcnattttcaccggaaataataaaataatgtct

SEQ ID NO: 41702 - DNA, 101 bp, rice(Oryza sativa)
  misc_feature (71): n=a or g
ttgtagtaatttaattagaatatcgtactcaaccaattaagtcctaactaagcctatacaaacgaagttgntagaacttactttctcactggagatcgaac

SEQ ID NO: 41703 - DNA, 101 bp, rice(Oryza sativa)
  misc_feature (71): n=a or g
gccttaggtacttttggtcatagatgttgctgtgctctggagtttgtgaaccggaagtttggtacttttgnttggaaatgttggcatacagtggaacttat

SEQ ID NO: 41704 - DNA, 101 bp, rice(Oryza sativa)
  misc_feature (71): n=t or c
agagagagagagagagaggaggaggaggttacgcattaatcttgcctcgacctaggttgtccaaaagtgantgaaatttgtgggtattttcaggtgataga

SEQ ID NO: 41705 - DNA, 101 bp, rice(Oryza sativa)
  misc_feature (71): n=t or c
gtcagccttcgccaagtttgaatcaaggtccagacttctctgacaaaaacacattcacaaaacaggtgatntgtgtcttcaaacgcacacgtgcagagacc

SEQ ID NO: 41706 - DNA, 101 bp, rice(Oryza sativa)
  misc_feature (71): n=t or c
tgggtttgtcactcacggtcccacttatggtggcttgtctctcatttgctattcccatatggatgcgtaanggttaccgtttctggattccgggaggggag

SEQ ID NO: 41707 - DNA, 101 bp, rice(Oryza sativa)
  misc_feature (71): n=a or g
acacattatatgctattttttatcttgttgcacgcacgaatctttgaagaaaactgtcgcaagttttctancaattccgtaatatattgacgtgtaatttt

SEQ ID NO: 41708 - DNA, 101 bp, rice(Oryza sativa)
  misc_feature (71): n=t or c
gtcaaatgagcatcatttgagccattataaaatatactttcatatatagtgtacgcatgtggcagatgtgntaatacttgctctagtaaatttggtcaaac

SEQ ID NO: 41709 - DNA, 101 bp, rice(Oryza sativa)
  misc_feature (71): n=t or c
ccaatgcgattccgtaatacaacaaaaaaaacctggcatctcacattatacaaggtacaaaccaggaggancacttaatgatgaccgtggtccaatgtata

SEQ ID NO: 41710 - DNA, 101 bp, rice(Oryza sativa)
  misc_feature (71): n=t or c
ttacgggtgaaatcaattttaatctttcctattaatccactcaaatgtgtcattaggagaaatgtgtgggncccatcgggagaagaaatatctcctccggc

SEQ ID NO: 41711 - DNA, 101 bp, rice(Oryza sativa)
  misc_feature (71): n=a or g
cttaggcctcacatagaggccacatgcggctcttgtacaaccctacaaccctccctcacaccccctcttanggcatcttaggcctcacacagaggccacat

SEQ ID NO: 41712 - DNA, 101 bp, rice(Oryza sativa)
  misc_feature (71): n=t or c
ctagttaactttagtaggatgaaatcatatttgtcaaatgtaaagtagagactacctcatatgagatcttnatattcttccttggtcgaaagggtattgaa

SEQ ID NO: 41713 - DNA, 101 bp, rice(Oryza sativa)
  misc_feature (71): n=t or c
acaatatgtgtactatcttattctgagaaaagcttgtccctagcttcctgtagcactttaattaggactgncaaggtcatctcaaacaatacatttctatc

SEQ ID NO: 41714 - DNA, 101 bp, rice(Oryza sativa)
  misc_feature (71): n=a or c
cggccaatcagaggctgacacgtggtgaaaccgcgagatttaaccctggtatgaagcgacagctgaaaagncttttcgtgtacgagaatgctacctagcga

SEQ ID NO: 41715 - DNA, 101 bp, rice(Oryza sativa)
  misc_feature (71): n=a or g
cggcaattgtgctaaggtggaatagtaacgtggcaatttttgtttacgtagcaacttttgcaccatgagcncacccatctagccaagttattataccgcta

SEQ ID NO: 41716 - DNA, 101 bp, rice(Oryza sativa)
  misc_feature (71): n=t or g
ggagatgacctgttaaatgtgtatcttttgttgctttgcatcgaccggtcggttcattgatttcaaggtanatcagatgctgatgctctgtgttaataatt

SEQ ID NO: 41717 - DNA, 101 bp, rice(Oryza sativa)
  misc_feature (71): n=a or g
tatcacctttagtttagtagcaatctcagagatcgagattaacagagagagatgggatgttgccttgaccngctgcgcgattcccttctcgcccgcatccg

SEQ ID NO: 41718 - DNA, 101 bp, rice(Oryza sativa)
  misc_feature (71): n=a or g
cactggcagcaaccggaatcaggagtaactgaaattgtccatgtccccactccctcttttctcctgcagcnccttgtcctacaccatttgcttgctgagcc

SEQ ID NO: 41719 - DNA, 101 bp, rice(Oryza sativa)
  misc_feature (71): n=t or c
aagttggcactaatagacttatatttgttgcccacaaagttattctcccaactcaaacaatatttctaccnggaagaaatatcatggagggggtggtaatt

SEQ ID NO: 41720 - DNA, 101 bp, rice(Oryza sativa)
  misc_feature (71): n=a or g
gttattttgagagctattttttaacataaggaaatagccctcaaataaaatagtaggcctatattgtttanattcaaaggttattttgagagttatttgat

SEQ ID NO: 41721 - DNA, 101 bp, rice(Oryza sativa)
  misc_feature (71): n=t or c
ggtttgataggttaacaaccaacttaaatcttatcggtttagcacgcgtcactactacagatccgggcttnagtgacgagtcatctgtgacgggtcaacac

SEQ ID NO: 41722 - DNA, 101 bp, rice(Oryza sativa)
  misc_feature (71): n=a or g
ctcccatcccctgctgatattggtgttgaatgctggtgagtagtccttacaattacaataattgcagtaanggtacccaccagtcgaccacagcaactgta

SEQ ID NO: 41723 - DNA, 101 bp, rice(Oryza sativa)
  misc_feature (71): n=t or c
tttccgattttttccaaattttggtagtttttgtcctactaatagaggctaaccgaacgacgatggtacgnaaatcatataaattaaaaaaaagtcgatga

SEQ ID NO: 41724 - DNA, 101 bp, rice(Oryza sativa)
  misc_feature (71): n=a or g
cccataaagaagagattgaaggagatttattccacatcccctctaatactcttcgatcccctccaaaccgnatcccctccaaaccgaataaacccttaagg

SEQ ID NO: 41725 - DNA, 101 bp, rice(Oryza sativa)
  misc_feature (71): n=t or g
caactgtagtacataattttattttgggattggcacacacatagtactgaatttattgctagtttttaatnccattgcataaatataaaggctaaggccgg

SEQ ID NO: 41726 - DNA, 101 bp, rice(Oryza sativa)
  misc_feature (71): n=t or c
gccagcagtttgatatcttcctttttggaaaaagatatatagctctctctgttgcatgcatctggtggtgnactccactctgaccttagcttatgatcatc

SEQ ID NO: 41727 - DNA, 101 bp, rice(Oryza sativa)
  misc_feature (71): n=t or c
taccggttgagataggacgagatactcccaaacgcctaggttattgtatatagtgccgcacgggataatanatcttcccgtgcggttgggtcaatcgcatg

SEQ ID NO: 41728 - DNA, 101 bp, rice(Oryza sativa)
  misc_feature (71): n=t or c
tgatactcctttttgttttgggtgtcttgcatcaaaaccctagcgtagttgagtgtggcagtagctttccngctaaaacaaaaacaactgaactagcagct

SEQ ID NO: 41729 - DNA, 101 bp, rice(Oryza sativa)
  misc_feature (71): n=a or g
gtcccaattatccatctcttccatatccctataacaattccacctttttattacctagctacatccagacncacgataaggatctgcgaaagtatatatga

SEQ ID NO: 41730 - DNA, 101 bp, rice(Oryza sativa)
  misc_feature (71): n=t or c
caagtggatgggaagagaacagttgtgggcacatcatatatgatactattgatatctcactataaattgcnccccccccccaacctatctcattcagtgtt

SEQ ID NO: 41731 - DNA, 101 bp, rice(Oryza sativa)
  misc_feature (71): n=a or g
atgacatgtaaactgaaggaagaaagcatgcttgccatgtaaataaaataagggtaaactgaatttggtcnaaacttatttaaatttcatatattgtcgtt

SEQ ID NO: 41732 - DNA, 101 bp, rice(Oryza sativa)
  misc_feature (71): n=t or c
gacccacatatcatccaccctctccttcccttcttcctccccggtccccactctctctcgcttactcctcnctctctctctctccccccggccttctccat

SEQ ID NO: 41733 - DNA, 101 bp, rice(Oryza sativa)
  misc_feature (71): n=t or c
taacatatatagcaattgacacttcgttaatggtggaggtagggccgtcgcagtaccttcttgggaggtgntgttgatcatcttcgttcacattgtccaaa

SEQ ID NO: 41734 - DNA, 101 bp, rice(Oryza sativa)
  misc_feature (71): n=t or g
tacttacgagaggcctggtactcagttcgatctatagcacatccattagaagaaaaattaatccctaaaanattacatcacgcggttccctgaaacaaaaa

SEQ ID NO: 41735 - DNA, 101 bp, rice(Oryza sativa)
  misc_feature (71): n=t or c
aaaatacaaatatacaagcaatcatatccatgtttttatgcaaatgctaaaggatctacgcatattagcantaaaataataattttatattcccaaattta

SEQ ID NO: 41736 - DNA, 101 bp, rice(Oryza sativa)
  misc_feature (71): n=a or g
aaatagcttacgtacctttttttcagctgctagttagcggaatcatgtttcgaagtactccctccgtttcnaaatgtttgacgccgttaactttttagcac

SEQ ID NO: 41737 - DNA, 101 bp, rice(Oryza sativa)
  misc_feature (71): n=t or c
ctatctgagatgtcaaaccagtataaaattccttatcttccgtctattttgttgtaatctcgcgtataccntggcatcaatgtttcttatactatacaaat

SEQ ID NO: 41738 - DNA, 101 bp, rice(Oryza sativa)
  misc_feature (71): n=a or g
gaccccttcttcaatcctctgccctgcttgccgccatgctgccggaactctagctaggctaaccggtgccnccgaggcacgagactacctacctctccatg

SEQ ID NO: 41739 - DNA, 101 bp, rice(Oryza sativa)
  misc_feature (71): n=t or c
ttcgaaagaggcacggaggaacaaaaaccaggtgaacagataatgagataatgaggcagaacttcaatctnacttggatgatgtgattaattacttctatg

SEQ ID NO: 41740 - DNA, 101 bp, rice(Oryza sativa)
  misc_feature (71): n=t or c
ttgcttcacgtatcaaaaacatgtttttttaaaaagaaatcatacatggcttcggttgtgttctagtgtcnagctcccaacttctattccctcgtttttca

SEQ ID NO: 41741 - DNA, 101 bp, rice(Oryza sativa)
  misc_feature (71): n=t or c
aagctagatggcgcgtaggattctgtgtgtgtggcttcacgtaccgccaccgtgtatacacacacatacanacatacatacatacatacatacatatatgt

SEQ ID NO: 41742 - DNA, 101 bp, rice(Oryza sativa)
  misc_feature (71): n=a or c
tatgtcactaaatttcatcaatagcattgttttgatctgtggagatcattagtaggcttgtttcagatgtnttgcttctcagggtaggcgttttttcaaca

SEQ ID NO: 41743 - DNA, 101 bp, rice(Oryza sativa)
  misc_feature (71): n=a or g
cgtagttaagctgaaacaggctactcctaactttttgtaagaaggtttcgaacttgttggcgtgttgctcntgccatcgccttccattttgctggattgag

SEQ ID NO: 41744 - DNA, 101 bp, rice(Oryza sativa)
  misc_feature (71): n=t or c
gtggccacaaccgtgtctgccaacgcctcttcctccttgacttggccgtgcctgacgatgaccacgacgangacagcgcccaagaggggaccggggagacg

SEQ ID NO: 41745 - DNA, 101 bp, rice(Oryza sativa)
  misc_feature (71): n=t or g
tgccataggttgttataattagtggttttgtacatggataaaagtctgtttataaatcagtcttgacgctntaaatataatacctatatttaatcattttt

SEQ ID NO: 41746 - DNA, 101 bp, rice(Oryza sativa)
  misc_feature (71): n=t or c
ggtctcgctcgttgggcatgcgagacttagccgccaccgagcggtctctcgcattcaccgtcggacaccgnaatatcgacggtatatttgtatcaataaaa

SEQ ID NO: 41747 - DNA, 101 bp, rice(Oryza sativa)
  misc_feature (71): n=a or c
gacattcgtgtactccatgttttaaaatattgatcaaatgctgatgaggacatcaataatattctctaaanacatgtatttgtgatgaaatgttgtttttt

SEQ ID NO: 41748 - DNA, 101 bp, rice(Oryza sativa)
  misc_feature (71): n=a or g
cccttattcatcatcaagtgtggaactttatactcataatatgattgtgagattaatttcacccatggtanatcagcaccattatagaacttgaccatatg

SEQ ID NO: 41749 - DNA, 101 bp, rice(Oryza sativa)
  misc_feature (71): n=a or g
cctcatctttaattttctccgattgctgcaaaagtgtggcagtccattaattggttttcctgctagcgctngctatagattagttgccagatctatgctct

SEQ ID NO: 41750 - DNA, 101 bp, rice(Oryza sativa)
  misc_feature (71): n=t or g
gcttggtaaaaaaatatttcacttagatacaacattgggaaaaagctaactacggtacaatagtaaaaatntacttatatgtaagagtaaattacaccggc

SEQ ID NO: 41751 - DNA, 101 bp, rice(Oryza sativa)
  misc_feature (71): n=a or c
aatgcaataaattatcgacaaaagggtccaaattaaccagcacacaaggaatacgatggacattagcgcgnacgaattcagatccaaaacggaaattacgt

SEQ ID NO: 41752 - DNA, 101 bp, rice(Oryza sativa)
  misc_feature (71): n=a or g
ccaccaaggagggactcaagcttgatgagagcgaggacgagaagaagcggaaggaggagctcaaggagaanttcgagggtctctgcaaggtcatcaaggag

SEQ ID NO: 41753 - DNA, 101 bp, rice(Oryza sativa)
  misc_feature (71): n=t or c
attttctggattaattttgtaactacatctacttattatctcgataaatccatggagctagatcgttattnggtaggcaaaattggttatatagcatcgaa

SEQ ID NO: 41754 - DNA, 101 bp, rice(Oryza sativa)
  misc_feature (71): n=a or g
atccacgacgggagccactaaatgtcacctacacaccgaggataccttcgatattcaccacctgcacaacnaccggactccaaccaacccgttcccacccg

SEQ ID NO: 41755 - DNA, 101 bp, rice(Oryza sativa)
  misc_feature (71): n=a or c
ttagaattacgcaatataacctagagactcacaacgcacgtacattcactcctaaacgcacgcaacctaancgcacgcacgtaagcgctacccctatgagt

SEQ ID NO: 41756 - DNA, 101 bp, rice(Oryza sativa)
  misc_feature (71): n=a or c
ttgtttatttgactggaggaagtggagtggggttggggttaggatggtggtgattgctgcagccaatacantccaatatggaccatggccgataaatttag

SEQ ID NO: 41757 - DNA, 101 bp, rice(Oryza sativa)
  misc_feature (71): n=a or g
tataacacattctgaggaattaaaatcatgggcttaataaataaaaaataaaggcccattcttatcgaaangctggcccaaaatggaccggcccatttatg

SEQ ID NO: 41758 - DNA, 101 bp, rice(Oryza sativa)
  misc_feature (71): n=a or c
cccccctataaaagccccctctcctctcctccaactctctcctccccaaagaaatcgcttcttcttccgcntccgcctcccatggcagctcccagctcgtg

SEQ ID NO: 41759 - DNA, 101 bp, rice(Oryza sativa)
  misc_feature (71): n=t or c
gtttgttgtattttgagatggagagggtatatcagtagcatatgatttttgaaagatccagtggtatatantttatccatcttaaaatataagagatttat

SEQ ID NO: 41760 - DNA, 101 bp, rice(Oryza sativa)
  misc_feature (71): n=t or c
ctcatgccccgccctctgagaccgcttgcaccggcagggcgtgtaatctcaccgtagcacccgacgagaangctctacgtgtttgcccaccatcctgcgag

SEQ ID NO: 41761 - DNA, 101 bp, rice(Oryza sativa)
  misc_feature (71): n=t or g
atgatgactctgaaaaagctggcagcaagggggtgacttgaaaaccagcaaggcaagctaacccgaagaanaaaacatccagtcgtcccatgccgaaaatc

SEQ ID NO: 41762 - DNA, 101 bp, rice(Oryza sativa)
  misc_feature (71): n=t or c
caggacatatataacaagcatattcagattaattatcaggtactatctaaaccgtaaccagcatgatttangcaaaagaatcagagtgagcctctaacatt

SEQ ID NO: 41763 - DNA, 101 bp, rice(Oryza sativa)
  misc_feature (71): n=t or c
aacttctctcaaaaattttcatcccactttcctgtcgcttcgctccctaatggtatctgttttttttttcntttttctatttgtgcaagtctatgcatgcc

SEQ ID NO: 41764 - DNA, 101 bp, rice(Oryza sativa)
  misc_feature (71): n=t or c
aatttttcctatacccacaccatccatcccttcgccggtttcgtccccttggccactctcccctctccccnctcccctctcccctctcctccggagccttc

SEQ ID NO: 41765 - DNA, 101 bp, rice(Oryza sativa)
  misc_feature (71): n=a or g
tcaaatttttccacaatcttgttgctggtgaccgacacaaaatggagttgtagcttgcaatggacaattcntatgtaggatggaattggagagggtgcaaa

SEQ ID NO: 41766 - DNA, 101 bp, rice(Oryza sativa)
  misc_feature (71): n=a or c
tgattattttgtagatcggccactctactatgagagaatgttttgcacaagatttcgtatgcgaaagcatntctttttacgtattgtgcaagccctagatc

SEQ ID NO: 41767 - DNA, 101 bp, rice(Oryza sativa)
  misc_feature (71): n=t or c
gacggaggtaataggatacttgcaggcttgcagctcagccgccaagcacttctgaatactccctccgtccnaaaaaaggcaaaccctgggtttccgtgtcc

SEQ ID NO: 41768 - DNA, 101 bp, rice(Oryza sativa)
  misc_feature (71): n=a or g
tacgagaccgagcagtctcgagccgtggtcgcccgcgttgtcacgtccacatcaattttacgttacgtttntgcgagatcagatgtatatttttgaaaaaa

SEQ ID NO: 41769 - DNA, 101 bp, rice(Oryza sativa)
  misc_feature (71): n=a or g
cccacatgtcaattacatccttttatccttccctgtctctcccctttctctcccctgctgcggaagcggcnctgatggagtcagcgaggagatctacagcg

SEQ ID NO: 41770 - DNA, 101 bp, rice(Oryza sativa)
  misc_feature (71): n=t or g
gtacgatatgatgtgtttatcacccattttctctccatgctccgtggaataggacgtccgaaaagtcgatncgatgcagatgtccactctgatctgatgga

SEQ ID NO: 41771 - DNA, 101 bp, rice(Oryza sativa)
  misc_feature (71): n=t or c
agtttctagtctagagaaggagcgtcaacatcttcaatctactgttgaggctcttcaagaaggtagttacngttttactctgatgtaaaacttttttgaac

SEQ ID NO: 41772 - DNA, 101 bp, rice(Oryza sativa)
  misc_feature (71): n=a or g
tccaagctttaggacgggatgaggtgtgtcacctgcacctcattctgtattaagtgtagggtagggatgtncgttcggtctaaatcgagagttcaatctag

SEQ ID NO: 41773 - DNA, 101 bp, rice(Oryza sativa)
  misc_feature (71): n=a or g
atatgatgtgttatatctgattctagtttagtattttatgggacagatgaagtacgtgctagtagtagtcncgtataattaaggccttatcttatatagtg

SEQ ID NO: 41774 - DNA, 101 bp, rice(Oryza sativa)
  misc_feature (71): n=a or g
tatcaaacgaatagatcagcctactatctgacaaacttttggcacacatggttagaagatcactggaaganctagctagtagtaaccaagtaggcccttaa

SEQ ID NO: 41775 - DNA, 101 bp, rice(Oryza sativa)
  misc_feature (71): n=t or c
cgcgggagaccatcgtgtcgcaccgtcactgttccctcctgcgaccacacggcagcaagacatcttcaagnggttccctcgagcagcaatgcgtcttttgg

SEQ ID NO: 41776 - DNA, 101 bp, rice(Oryza sativa)
  misc_feature (71): n=a or g
ttttatctaaatgataatcattactacgttatcactacagcagtgctagttttatcatctaggataattcngcacctatattgctttgaacagctgaagag

SEQ ID NO: 41777 - DNA, 101 bp, rice(Oryza sativa)
  misc_feature (71): n=a or g
agtggacacgacaagaagccgaacgactcagattggagcaggaacgacaaacacaggagcaagcaagactnctgcgtgagcagcaggagcatgaccgactg

SEQ ID NO: 41778 - DNA, 101 bp, rice(Oryza sativa)
  misc_feature (71): n=t or c
ttaatctttatccaactcttgttggagaaaagaacgagacaatattatgattttctaacattaacttttanatcgcgaaaaatacatacatagaaggtttt

SEQ ID NO: 41779 - DNA, 101 bp, rice(Oryza sativa)
  misc_feature (71): n=t or c
agaaaaaaaaggaaagaaacaggaaaaggaaaaaaaaaaggaaaagcatggctgtctgccgccctcctctntgcgcgacgcgggggagggtgcgcacgact

SEQ ID NO: 41780 - DNA, 101 bp, rice(Oryza sativa)
  misc_feature (71): n=t or c
gcccaaataggatgatgcagcaccgggatatattttggatgtcaacttattcagtcgattcccgttgactnggaaagaatttggacgtgtgtccaaaacca

SEQ ID NO: 41781 - DNA, 101 bp, rice(Oryza sativa)
  misc_feature (71): n=a or c
catcttcgggtaactgcgaggaaaaccaaaaaaagagagataaaaaaataatcaaaaaatcatcccaaaanccccccacccagaatcggcccacgcggttc

SEQ ID NO: 41782 - DNA, 101 bp, rice(Oryza sativa)
  misc_feature (71): n=t or c
aaagtctgaactttctgcattcgggaattgtcaatatgaatatactacttgtaggagacttgattttaccntcatctttccatacgcagggaaaggtttcc

SEQ ID NO: 41783 - DNA, 101 bp, rice(Oryza sativa)
  misc_feature (71): n=t or c
ttcatcctcctctctctctctctcctctcactttctcctctcaaggatcaaggccggcaagggaggagggncgacgtggcgggcacgccggcggccgatgg

SEQ ID NO: 41784 - DNA, 101 bp, rice(Oryza sativa)
  misc_feature (71): n=a or g
ggtggtaaagaaaaaaatatcacatggttaagtgggaggctttgtgtagaccaacagatattggaggtttnggtttcttggacacaagagttatgaatata

SEQ ID NO: 41785 - DNA, 101 bp, rice(Oryza sativa)
  misc_feature (71): n=a or g
cgcgcgccgccggcgcgcgcaccgattagcgatcgcgccccaccaccacctccttagtccttacccttttngagtgaagaaaagataaggtcccacatgtc

SEQ ID NO: 41786 - DNA, 101 bp, rice(Oryza sativa)
  misc_feature (71): n=t or g
tacgtacgttcctacggatcagaacagcagtcgtgtttgtatcatatatacaggaggaggaagttattatnttttttaataataaatctaagctaatagtg

SEQ ID NO: 41787 - DNA, 101 bp, rice(Oryza sativa)
  misc_feature (71): n=a or g
ctgataattagataatagaaaatagtctaatatcgaaaccatcacacgaggtcttttttaaaaggaaaaantacgaattaccccttcaaactatcgcggtc

SEQ ID NO: 41788 - DNA, 101 bp, rice(Oryza sativa)
  misc_feature (71): n=t or c
atctcttcctcaccattcctcaatggggtggctccactccctcttctcccctctcaggaggctctgggttngcgcgcattcggagcgcaggaaccgtaagt

SEQ ID NO: 41789 - DNA, 101 bp, rice(Oryza sativa)
  misc_feature (71): n=t or c
taaggtttcttatgatggaacctgctaatctaagtttaagttctaattttagcacgaatacttgtatttanagctactacctccgtttcaaaatatagcaa

SEQ ID NO: 41790 - DNA, 101 bp, rice(Oryza sativa)
  misc_feature (71): n=a or g
gtagggccggccggccgcatccgcaggcgtgcttgctttcttcattatggatagatagatagagatagtangctattactattagcggcggcggttggcgg

SEQ ID NO: 41791 - DNA, 101 bp, rice(Oryza sativa)
  misc_feature (71): n=a or g
gtaaacttcgggctcgagcccaatgccccgatctgtcataggtccatagctgcctccgcccctaattcctntatagccttctaattcaataaaattcatag

SEQ ID NO: 41792 - DNA, 101 bp, rice(Oryza sativa)
  misc_feature (71): n=t or c
aggacttggttagattggcaacattcctaatagccgattttagtcttgacttttgttcctcaaccgtcttngggagatcggccaatttctgtttttccaaa

SEQ ID NO: 41793 - DNA, 101 bp, rice(Oryza sativa)
  misc_feature (71): n=t or c
agcgcttagtcaagcggataatgtcaccgctctcatcattcttatccacttccgctctctttctttctttnttctctctttccgctctctgctctctcata

SEQ ID NO: 41794 - DNA, 101 bp, rice(Oryza sativa)
  misc_feature (71): n=a or g
accacacttttccagcacattccgatttcatacaaatggcagagtaatcaaaatatattggtttttcaatntatgttggagtacataagtaaagagaaaca

SEQ ID NO: 41795 - DNA, 101 bp, rice(Oryza sativa)
  misc_feature (71): n=t or c
gcccaaccggagccacaactttaggtcttgggtcttttggattgtgtaggtccaggacctaaatttgtggntccggttaggcctgtggtggagcaaaccca

SEQ ID NO: 41796 - DNA, 101 bp, rice(Oryza sativa)
  misc_feature (71): n=a or c
tcaaaatattttcactccataattgcattcatgtacattgtaattaccctgtatttatcttgtaacttttntatagctacagtgtaactacaatatataac

SEQ ID NO: 41797 - DNA, 101 bp, rice(Oryza sativa)
  misc_feature (71): n=a or c
aaactggcagttcattcaaagagtgaaacctaccgttgcacgtactaaatattacgatgtgtactgctcantgctcaatggtaattaagcaagactgcagt

SEQ ID NO: 41798 - DNA, 101 bp, rice(Oryza sativa)
  misc_feature (71): n=t or c
cttgggtttggttgctgctgttgtactgcccctgctctaagctaacaaaagcagttatcatttgttttttnttaaataagcttaaggtcttgacaaatttg

SEQ ID NO: 41799 - DNA, 101 bp, rice(Oryza sativa)
  misc_feature (71): n=a or g
ttagcggtttacatattactgtttgttgctcgatgacaaagagatgagactgacactgactccgtgtttanctgccatgtgtgttttaacctttgtgttaa

SEQ ID NO: 41800 - DNA, 101 bp, rice(Oryza sativa)
  misc_feature (71): n=a or g
actgcactgctgtttgcttcgttactacttctccctatccaatccaacagtcttattttcatcccgatcancatcgaacgggtaatatgtgttagatggat

SEQ ID NO: 41801 - DNA, 101 bp, rice(Oryza sativa)
  misc_feature (71): n=a or g
taatacttgagggtgaaagatttctagttttcggatctaagagagtaattcatacgcacacaatagttcangggtaattcagacttttcccttacaaatat

SEQ ID NO: 41802 - DNA, 101 bp, rice(Oryza sativa)
  misc_feature (71): n=t or c
gtagtgtcaaccggcgactctgatccaggagtgaggagagagcacccggtgaaaattactccctccgtccnaaaataaatatagttttacacggttcatgt

SEQ ID NO: 41803 - DNA, 101 bp, rice(Oryza sativa)
  misc_feature (71): n=a or g
tctctgtttgacaaattaaacattgaaaaccttctaagactgccaggaagaagttaccctataccgaaccntgctgatacttcttgtcattgaggatgaaa

SEQ ID NO: 41804 - DNA, 101 bp, rice(Oryza sativa)
  misc_feature (71): n=a or g
tttagcgtggcaaaggcatccaaaagctagtagagtactccacttcagaaagcatcacgagcacgatacgntgttcagatcatgccgtaaagctttggtat

SEQ ID NO: 41805 - DNA, 101 bp, rice(Oryza sativa)
  misc_feature (71): n=t or c
ttatattaatatatattttaagtttttcagataacacctaactaatcatatgttatgttaataagtaaccngttttacatagtggcgtagccagctaggtg

SEQ ID NO: 41806 - DNA, 101 bp, rice(Oryza sativa)
  misc_feature (71): n=a or g
cttaacttagaaaccaataaaaacctgaaacatatattctgagtatggaaactcgagaccgacgaaaattngcttggcgtcagactctgtctatctgaccg

SEQ ID NO: 41807 - DNA, 101 bp, rice(Oryza sativa)
  misc_feature (71): n=a or c
aatcattcacgttttgatgatgcaagatgagtggccgggcggtcgctgtcggggaaatttaagaaacgggngccgtcggcgaactcgatcgatcgatcgag

SEQ ID NO: 41808 - DNA, 101 bp, rice(Oryza sativa)
  misc_feature (71): n=a or g
taaccaatacaggatgttagtatttggaggttaattagaatcgttacagtagggctatgtttgtgtgtgtntatatcctggagtaagtcttttgcttttgc

SEQ ID NO: 41809 - DNA, 101 bp, rice(Oryza sativa)
  misc_feature (71): n=a or g
aaactagtccagaattttcagccgtagctgtcaaaagccacccccatcctctcaccaaaaataaaataaanaaaataaagaaaataaaaaaatccctatcc

SEQ ID NO: 41810 - DNA, 101 bp, rice(Oryza sativa)
  misc_feature (71): n=t or c
ttatcatccataaaccgtaataccagacatttttcaccctccatcttgacaaaaccatttaagtcaagtcncgtgacagtatgtataggtggtttcgctga

SEQ ID NO: 41811 - DNA, 101 bp, rice(Oryza sativa)
  misc_feature (71): n=t or c
gtgtgtaggaaactattgtggtgtgtaggcacgtttggaggaagcatggaagcatgatgtgtacagtcaanactccacaaacatggcgttagatagtttgc

SEQ ID NO: 41812 - DNA, 101 bp, rice(Oryza sativa)
  misc_feature (71): n=a or g
agagaacaatgagcttatatattctacatgtcgaagcttggaagttacaatacagattttcgccaactacngatgtagattaataaatagacttcaataat

SEQ ID NO: 41813 - DNA, 101 bp, rice(Oryza sativa)
  misc_feature (71): n=t or c
tttgatgttttcagcgctgcaatatggctcttgctgttatcaaatgggattgccaactcacttcttattgnctggccgacatggaaacactgaaatgcctc

SEQ ID NO: 41814 - DNA, 101 bp, rice(Oryza sativa)
  misc_feature (71): n=a or g
gactgctcagatatattgtatctgtacttgtcttcgtagttctatttgaaaaggggaggtataaatactanaccctctaggaagaggggagagaccaacac

SEQ ID NO: 41815 - DNA, 101 bp, rice(Oryza sativa)
  misc_feature (71): n=t or c
ttgggaaaaaaatttgggactggattttgttggtgtaattattttccatcgaatccaaccaaaagaaaagnaggggcccctgtgtggcatgtgaaggcagc

SEQ ID NO: 41816 - DNA, 101 bp, rice(Oryza sativa)
  misc_feature (71): n=a or c
tattaatccatatgcactagtggcagaaagaacagcatgaatggataattcaaagaatgaatgagtaagtnattgacagcatattaaaacaatcatatatt

SEQ ID NO: 41817 - DNA, 101 bp, rice(Oryza sativa)
  misc_feature (71): n=a or g
tttaattatgggcgggtgaaatgtatgattctgacgtgaattacatggcatgaaaaaaaaaatatcgtacnttaatattgcgataaacggtatatggattt

SEQ ID NO: 41818 - DNA, 101 bp, rice(Oryza sativa)
  misc_feature (71): n=a or g
atgggttatatgtgtgtgctctgatcaactggtaatgtcgagggagatcgatgtgtgacacctcccgcctnggaatgacatgggagagcaaggcgagacat

SEQ ID NO: 41819 - DNA, 101 bp, rice(Oryza sativa)
  misc_feature (71): n=a or g
tacaacaattgaataaagtaagttcctaattttttatattaatccttttgctatttctctccacaatatgngaaaagatatgccaaagtaataaaatatta

SEQ ID NO: 41820 - DNA, 101 bp, rice(Oryza sativa)
  misc_feature (71): n=t or g
cgcttctaaaactaaaactttagacgataactttcttgtttttcgttagtttttctaaaccgtaaaatgangtgtttttttaaaaggttttttctaaaccg

SEQ ID NO: 41821 - DNA, 101 bp, rice(Oryza sativa)
  misc_feature (71): n=t or g
tgcaacgcacgggcatttttgctagtataccatatgaaagggaaagaaaaacaataaaaaaggcaaaattnactatagtatactcaaagtttatgttcttt

SEQ ID NO: 41822 - DNA, 101 bp, rice(Oryza sativa)
  misc_feature (71): n=t or c
cacgtcggaaggagcggcttctcgttttgaactgaagttagcgagtctgttggctgcttcgttattgtgcngaagaacgtgggtgagttcgagcccatcga

SEQ ID NO: 41823 - DNA, 101 bp, rice(Oryza sativa)
  misc_feature (71): n=t or c
cgatacagtcagcaaaaacaaataaaaaaacagtggggcccacttgtcagctttttttctctcctccttcnctgcctctctctcagtgagcagagagagca

SEQ ID NO: 41824 - DNA, 101 bp, rice(Oryza sativa)
  misc_feature (71): n=t or c
gaatttggatacagtttgtcatacacgatacaaaacatacagagacgagtgggtagcgacatgtcgaagcnatcaccataatttaaatagctatattgccg

SEQ ID NO: 41825 - DNA, 101 bp, rice(Oryza sativa)
  misc_feature (71): n=t or c
agtttaagagtttagggatggaaattatacgttgatgtagcacaattatcggaggaacttcttcggtgtgntgatatgtagatatagcacaaaatgttgta

SEQ ID NO: 41826 - DNA, 101 bp, rice(Oryza sativa)
  misc_feature (71): n=a or g
cgtggcattcacgttggcataaataatatgtgacatgtttttttaccagatttgcaccctcaaacaaattnaatgattaatttgagcaatttataaaatga

SEQ ID NO: 41827 - DNA, 101 bp, rice(Oryza sativa)
  misc_feature (71): n=t or c
acgtccccgcctttctcttcctccactacaacaattgttgtggatgaagaggtgagggaaggatgtaccgngtggcctccatggtcatcggtggcgacaac

SEQ ID NO: 41828 - DNA, 101 bp, rice(Oryza sativa)
  misc_feature (71): n=t or c
cttatggttatggtgtatcttaacactgaggataccctaatgcggggacatgaggagtggtcttgctaggncatgtgggagccaacttatcacgtcaggcg

SEQ ID NO: 41829 - DNA, 101 bp, rice(Oryza sativa)
  misc_feature (71): n=a or g
tatcctgagcctcacacagactagaggaatgcactgcttatttcttattagcccgggggcttaaggcccgngccggctaatagagcaactactagggggga

SEQ ID NO: 41830 - DNA, 101 bp, rice(Oryza sativa)
  misc_feature (71): n=a or c
tggctacgattgtttttgtgattacagtaccgaactccgatgttgtggctatactataggtacaagacagnggatgagtttgagcacaaattatttcaaat

SEQ ID NO: 41831 - DNA, 101 bp, rice(Oryza sativa)
  misc_feature (71): n=a or g
cccattagaatggcacggcagccatatgtttcgcgtcatggcgcaacgacggcgagggtacagcacaaaanccgtttccttcgacacagtgcaacgacggc

SEQ ID NO: 41832 - DNA, 101 bp, rice(Oryza sativa)
  misc_feature (71): n=a or g
tgtgaaaaggtaaaaccatagagaaaataaaaggtgtaatccaatactaggaaggagctataaaataaccntggactaatgtaaattattattattttatc

SEQ ID NO: 41833 - DNA, 101 bp, rice(Oryza sativa)
  misc_feature (71): n=a or g
acagccatcaattcctttttcactaaattttttcacaactccacgggagaagctcaccgtccccacggganaagccgatgccgcgggaacggacgccgacg

SEQ ID NO: 41834 - DNA, 101 bp, rice(Oryza sativa)
  misc_feature (71): n=t or c
tgtctcacggttggattagacgtatttggttctggtgtagttcgcgaaaagaaagtatttggtattagatnggatgtcggaagggatttttggacacaaat

SEQ ID NO: 41835 - DNA, 101 bp, rice(Oryza sativa)
  misc_feature (71): n=a or g
ctcgctttcaaattttgctggggctagctagcttaatcgcttggctcttttgtctcaatttcaacgtacgnctttctcagtgacagtcgtacgtcttcatt

SEQ ID NO: 41836 - DNA, 101 bp, rice(Oryza sativa)
  misc_feature (71): n=t or c
ctctctagctttctttcctgcattaatatgaatgaaaaacagagcttgaccattgaggctgatagatatgnacgcgtcacgatccatcacataatgtgaca

SEQ ID NO: 41837 - DNA, 101 bp, rice(Oryza sativa)
  misc_feature (71): n=a or g
ctcagagtaatctaatgggaaacatatttcccaccaacatttgtgtctatatataacatatctacatatcntacaagaataatttgtcagttcaatagtat

SEQ ID NO: 41838 - DNA, 101 bp, rice(Oryza sativa)
  misc_feature (71): n=a or g
caggaaggaaggcttcgaaggaagaagtcgatagcgtcatggttgagttatcatcaattaccttctggacngacgatggcgaatcaacatgagtgaaccca

SEQ ID NO: 41839 - DNA, 101 bp, rice(Oryza sativa)
  misc_feature (71): n=a or g
ccggccatcccgatctagggttttcacacgagtgaggagtgaggagtaacgagtctgctgtgcgccacggncctaactaccgccctgctgacttagcgtcg

SEQ ID NO: 41840 - DNA, 101 bp, rice(Oryza sativa)
  misc_feature (71): n=t or c
caccgggagccggtcgtatgctagcaaggatccaaatacttgtactcgtccaagtgcaagcaaagatatcngcccgtatgctagcttggcgtttggactgg

SEQ ID NO: 41841 - DNA, 101 bp, rice(Oryza sativa)
  misc_feature (71): n=t or c
caggcatattttagctatttttacaattaggtcctcgatgtcaatgttattgacgttgctcccctttatancagtgacttagcttccacaatgggggcgag

SEQ ID NO: 41842 - DNA, 101 bp, rice(Oryza sativa)
  misc_feature (71): n=t or c
gcagggcacgattgaggcaccgggtaatgtgtgtactgacatagtgttgtttacacaacaaagtcaatcancataaccatctcagccttctactaagtgta

SEQ ID NO: 41843 - DNA, 101 bp, rice(Oryza sativa)
  misc_feature (71): n=t or c
ttatgtagatatgcaatttctggtgtgattgtagtattgtctgcggatatgtatacaagtgaacatgacgntgtgtttagttcacgctaaaattagaagtt

SEQ ID NO: 41844 - DNA, 101 bp, rice(Oryza sativa)
  misc_feature (71): n=t or c
aaaatatctagtaggagtacgtagtactgaacagctaggctggcgtaaaactttcttatcattttctttgnctgaaaaaacataaataaattaatatgctt

SEQ ID NO: 41845 - DNA, 101 bp, rice(Oryza sativa)
  misc_feature (71): n=a or g
tatacatggtaatcctggcggcggctatcctacccacgacgaggctacccaggtttttgcttgactccctnattgattcaggttcttgttgccaaaccatt

SEQ ID NO: 41846 - DNA, 101 bp, rice(Oryza sativa)
  misc_feature (71): n=a or g
agacccagtcgccatcttctcccactcgaaatccccaaatgctaaccttaggttggtcatcggcggcggcngcggcggtggtggtggcggaagaagaggcg

SEQ ID NO: 41847 - DNA, 101 bp, rice(Oryza sativa)
  misc_feature (71): n=a or g
agtcgtacctctacacacttgtgaacggagcaacataaattattattgtccattggactattgtatccttnttgtcagtgtgaaaaaaatctgcgtccctt

SEQ ID NO: 41848 - DNA, 101 bp, rice(Oryza sativa)
  misc_feature (71): n=t or g
atggtcaaatgagcaattattccatatatttataggtgtcggttgttttaaaatttctgcacctatagtantggtgccgattttttcctattgaaccaaca

SEQ ID NO: 41849 - DNA, 101 bp, rice(Oryza sativa)
  misc_feature (71): n=a or g
aaccgatatattggagaggcgacaactccaaggcgattgaggatcagagcggtggcgttacacgatcaggngaaagagagagagagagagagagagagtgc

SEQ ID NO: 41850 - DNA, 101 bp, rice(Oryza sativa)
  misc_feature (71): n=a or c
ctgaaatacaaagatgagccactaacaatacataatctgaaccaaaatttagatacactacaaaatgctgncttttaaagtttaagaatttgctaataatt

SEQ ID NO: 41851 - DNA, 101 bp, rice(Oryza sativa)
  misc_feature (71): n=t or c
tctccctccccggccaccacgccgctctccttttgcgctgccaccatcacacagctccagttgcccctcgntggcggtcgagaccccctcggacactggta

SEQ ID NO: 41852 - DNA, 101 bp, rice(Oryza sativa)
  misc_feature (71): n=t or c
atgacgatgcctgcaggttgcaagttgtcgtcccaccaattgattaagatggggggacgagaatcagcagntgcctttatgcgagagatttcttctctgtc

SEQ ID NO: 41853 - DNA, 101 bp, rice(Oryza sativa)
  misc_feature (71): n=t or c
cccgcgtctcaagttggaacctcatctccatgttgagcgacgcaggacttcgtcaaaacgatgccgcgagnagaggagaagactggaggcgcgcgcgctgt

SEQ ID NO: 41854 - DNA, 101 bp, rice(Oryza sativa)
  misc_feature (71): n=a or g
agttcattgcaggaatacacaccgacatcgaaattaaccatactactagactccctccatactcgtaaagnaagtcgtttaggacagcgacacggtctcca

SEQ ID NO: 41855 - DNA, 101 bp, rice(Oryza sativa)
  misc_feature (71): n=t or c
cactacaaaaaccctccccgcatccccctctccatttttgccactcaccaccctcttttccccttggaaangagctcccatcgccgctctctctctccgcc

SEQ ID NO: 41856 - DNA, 101 bp, rice(Oryza sativa)
  misc_feature (71): n=a or c
ccgaagacggtttgcctaacccggttaggatagggtttacgtttcccgacgcaagtgaggatccaaaagtnttcactcattaaatatcgaatgacatgcgt

SEQ ID NO: 41857 - DNA, 101 bp, rice(Oryza sativa)
  misc_feature (71): n=a or g
aattatgtactaatcacatttctcattttatgtgcggctaattagccgtttcaaacctttgaaaaacacanccttaacctataatggaatgtgacccatac

SEQ ID NO: 41858 - DNA, 101 bp, rice(Oryza sativa)
  misc_feature (71): n=t or c
ggccaccgtgcctccgccggtgtaccttgcccgtgacatcgctacaaggtgttccccaacccacgccacgncacgtcagcggtggcgcaggcggagcgtgt

SEQ ID NO: 41859 - DNA, 101 bp, rice(Oryza sativa)
  misc_feature (71): n=a or g
ttaggtttttgtcatattctgtgtttcttgtatctcgtactctttctatctataataccttatattattcncgaagagagtaccaaccatctatctcatct

SEQ ID NO: 41860 - DNA, 101 bp, rice(Oryza sativa)
  misc_feature (71): n=t or g
aaatgcatcgttattcctctatgtaactgccatagggctagatggatgccatcacaaagttgcttaagtgntgatttataccaaccctgagcaaagttgtt

SEQ ID NO: 41861 - DNA, 101 bp, rice(Oryza sativa)
  misc_feature (71): n=a or g
tacatcagatttgtgctagaggagagaagatgagagataagaaaaacgggatacatatttatagtcagatntagcacgaactttaataaactatgtgagag

SEQ ID NO: 41862 - DNA, 101 bp, rice(Oryza sativa)
  misc_feature (71): n=t or g
cagactgtatagcggtcgcgaaacgctatagcggctgctaagttccaatacgctatatgtagtccgctacnatcgctatttattaccttgtctacaactac

SEQ ID NO: 41863 - DNA, 101 bp, rice(Oryza sativa)
  misc_feature (71): n=t or g
cttatgtccaattaataaagaattcagggtacgttatatttgcactatggcaaacaataagtttaatcatntttaaattgttgtgtttttctccttcttat

SEQ ID NO: 41864 - DNA, 101 bp, rice(Oryza sativa)
  misc_feature (71): n=t or g
aggtatacccctgctgcatatatggctccatgcatggctgctatgcttggacttggatgaatgatattaantagtctcgatcaaataaagaatatgattta

SEQ ID NO: 41865 - DNA, 101 bp, rice(Oryza sativa)
  misc_feature (71): n=t or c
cttcccaatgccgctcggccaccaccgccaccagccgcagccatagccgaacctaggggtgaaaacggatnggataatatccgatccgatccgctccgaat

SEQ ID NO: 41866 - DNA, 101 bp, rice(Oryza sativa)
  misc_feature (71): n=t or c
ttttttttttcttatttctcgatcgtctaaattggcaccattacttttttttatcatgaccgaccgacganaatgtatacattgttatgaaatcggtcata

SEQ ID NO: 41867 - DNA, 101 bp, rice(Oryza sativa)
  misc_feature (71): n=a or g
cttaagaacaagtaccattgaactagctttgttgatcaattaccactcatagtttgttttatattctgacnaactctcgtacctctttatgaatacaatat

SEQ ID NO: 41868 - DNA, 101 bp, rice(Oryza sativa)
  misc_feature (71): n=t or c
acaacgcacgacatgcatcatttgcaaacttcgggctgcagcgtgtaaagacggattgctttgtcgctggnggctgcaatgcaaatttggtttagcattta

SEQ ID NO: 41869 - DNA, 101 bp, rice(Oryza sativa)
  misc_feature (71): n=t or c
ctgctcagcgcgcacctgtgcgataccccgccgctgccttcaggccttcattgcaccctgcatggaagtgngctctggcggcgacggcgagacagcttcac

SEQ ID NO: 41870 - DNA, 101 bp, rice(Oryza sativa)
  misc_feature (71): n=a or c
acaaataaaacataaatatttgtgttattacggtttaaaagccaacgataaaaaaacagacttaaaaaaanccctaaaattaaatctaattatgttcacaa

SEQ ID NO: 41871 - DNA, 101 bp, rice(Oryza sativa)
  misc_feature (71): n=t or c
gcacatgcatcgtcgcgtgacgcgtggcgcgcacacgatcgagaggcagagcgcacggggttattacttantagtatcggattttaggtaatacttcatct

SEQ ID NO: 41872 - DNA, 101 bp, rice(Oryza sativa)
  misc_feature (71): n=t or c
gttgaggaggaagaaggggaggtggtcttgtgcagggtaaagaagcggcggagcaggtggacattggcagnatccatgtccaagagcgcggcggcgtggag

SEQ ID NO: 41873 - DNA, 101 bp, rice(Oryza sativa)
  misc_feature (71): n=a or g
gacagcgccatccgatctccccctctccgccccccacccacccaaaaaatactcgcaaaacctcagcgccnaagctagtgggcgaaacggagaaaaaaaat

SEQ ID NO: 41874 - DNA, 101 bp, rice(Oryza sativa)
  misc_feature (71): n=t or c
aattgattagagttactttcaatcttttccgtgtttggataaggattggtttagttcccaattttattttnttaaaaatgtcacatcaaatctttagacac

SEQ ID NO: 41875 - DNA, 101 bp, rice(Oryza sativa)
  misc_feature (71): n=t or c
agaatatattgtacaccttggaaaagaattagtcaatgatgcggttctagtcatgtttttggaatacacangatgtattagagaatcttgtagcgtctttt

SEQ ID NO: 41876 - DNA, 101 bp, rice(Oryza sativa)
  misc_feature (71): n=a or g
gactcaactgcaagtaaaaggatcctaggcgcggcacttgatgacagaattcagacacaaaacatgttganttcagaatatctgaagaacatgcgtgacaa

SEQ ID NO: 41877 - DNA, 101 bp, rice(Oryza sativa)
  misc_feature (71): n=t or c
taaaaaaacagaattgatcgtcacataacacgaggagcaagcgaaattcctattttctcatgtgcatagtntagtaattgtagtgacctgagtagtatcca

SEQ ID NO: 41878 - DNA, 101 bp, rice(Oryza sativa)
  misc_feature (71): n=t or c
acactctttaaagataaatttgcccttggtaacttgctctctggtaaggaaaggagcgacgccagcacgcngagcagcatgagctcctggacgcccttggc

SEQ ID NO: 41879 - DNA, 101 bp, rice(Oryza sativa)
  misc_feature (71): n=a or g
caacctctgcaacaaacatccctgtaccacttcccagtaggccaccaccatttaaaccacaccaatacaanaaaagttcgagtcaaagttggaacagtact

SEQ ID NO: 41880 - DNA, 101 bp, rice(Oryza sativa)
  misc_feature (71): n=a or g
ggataattgaagaaggaagaataataatttgtaatccacgcaagtgaaaaaatatatatagctcaccgcanaatcgggatcgagatgtgtaaaaaaaaaag

SEQ ID NO: 41881 - DNA, 101 bp, rice(Oryza sativa)
  misc_feature (71): n=a or c
tgctatagacaccatcctaatcattgggttgggaatgccctagtgatctgttgtcgtatacacgctgcttntgagttatgactgaatattttttagcgtga

SEQ ID NO: 41882 - DNA, 101 bp, rice(Oryza sativa)
  misc_feature (71): n=a or c
catggaattttaagctcttagccatctgcttgttcaatgcctgttttgccatgaccaggctcatgaaagtntcattagtgaggagtattcgttaacatagt

SEQ ID NO: 41883 - DNA, 101 bp, rice(Oryza sativa)
  misc_feature (71): n=t or c
tataaatagagccaacctatagggcctattttttttcaaagtcctcattctccctcattcctctcccgcgntgtaatatcccggcctagggcttaatagaa

SEQ ID NO: 41884 - DNA, 101 bp, rice(Oryza sativa)
  misc_feature (71): n=a or g
gtttgcacggaatatcatatatgccttacgtcccattgtattttttaatgtataatctctcgtattccagnaaaatacaatacgaacgaagaagagaaaat

SEQ ID NO: 41885 - DNA, 101 bp, rice(Oryza sativa)
  misc_feature (71): n=a or g
cgtccgatgtgaggatacggtaagggtttttagatatctggctggatgtggatgtggattttgtcatgcgnatgcggatgtggtatcaacgatatccgatg

SEQ ID NO: 41886 - DNA, 101 bp, rice(Oryza sativa)
  misc_feature (71): n=a or c
gaatatctcctaaaaacttgaatgctaattaagtcgacggcggtcaactcagatctctatctctctctctntatatataaaatctcatgcctatagtgtgt

SEQ ID NO: 41887 - DNA, 101 bp, rice(Oryza sativa)
  misc_feature (71): n=a or g
gtactgttcagccctcaagcaaagcaagtaaaagaaacacttaaaacaagcacaagcttctctgctcctcntcttggttcccttcttagcaaaataatcaa

SEQ ID NO: 41888 - DNA, 101 bp, rice(Oryza sativa)
  misc_feature (71): n=t or c
ttgtactttcctaataaattaggaaatatgttaatagtttaccaccttagtttgctctctctctctctctnttttccgtctcgagtgatgcaaaaatggga

SEQ ID NO: 41889 - DNA, 101 bp, rice(Oryza sativa)
  misc_feature (71): n=a or g
tactagtgactgtaatgataatgatattatgttagagaatccttacccgatgtttacacatatcttggctngccctttattgactttaatgatgctctcat

SEQ ID NO: 41890 - DNA, 101 bp, rice(Oryza sativa)
  misc_feature (71): n=a or g
gatgttacagagcttgggagtgggccttttaaagcaaaataatcaaataatccctccatcccattataagnctctgtttagttttcaaatttttttttcca

SEQ ID NO: 41891 - DNA, 101 bp, rice(Oryza sativa)
  misc_feature (71): n=a or g
cgcggtgctaatttgaggtggcaccggcaagaatgtggctctcctccggcagtgaggtggagcggcgacancgagaatgtgtctaggtccaagggcatttc

SEQ ID NO: 41892 - DNA, 101 bp, rice(Oryza sativa)
  misc_feature (71): n=t or g
agtttactttaggtctcttaacttgacacgagttggattttcgtccatcaaacaaaataccagatacaatngatcccacaagtgttaaaaccgatgcaata

SEQ ID NO: 41893 - DNA, 101 bp, rice(Oryza sativa)
  misc_feature (71): n=a or g
taatagatatcatttaaattatcaccaatagactaataggtactacgttcccgaacctgatctcatatccnccaaaaaagacctgtattcgacccgatatc

SEQ ID NO: 41894 - DNA, 101 bp, rice(Oryza sativa)
  misc_feature (71): n=t or c
cagtgcctcactcgctcaactcgcagtctcacccaatggtatagccaactaactttaaatcatctatactnaatttaataactaatttatacaataattat

SEQ ID NO: 41895 - DNA, 101 bp, rice(Oryza sativa)
  misc_feature (71): n=a or g
ggggaagggccggcagcggcggggggtgggtggtggcttcttttttttgttcgctgagaacattttcacangcgggtgaatatagggcttgcgaagatgaa

SEQ ID NO: 41896 - DNA, 101 bp, rice(Oryza sativa)
  misc_feature (71): n=a or c
ttacaacaaagtttaagggctgcatcatctgattgctttagttattttttctgaaattcgagaatgcaatntaactcatagaagtataaggaacttaccct

SEQ ID NO: 41897 - DNA, 101 bp, rice(Oryza sativa)
  misc_feature (71): n=t or c
gaacacaagtgtgttggtatttacatggtatctgttaacaataagttttcagtctataacaagatgtttanggtgacttcgttaatcttaagttatgcctc

SEQ ID NO: 41898 - DNA, 101 bp, rice(Oryza sativa)
  misc_feature (71): n=t or g
cctggtgcagggtgacctgcgccttgaggaacttgacgtagtggatggcctgctccagcatggacaccgtntccatcttgctgccgcccggcacgaggctg

SEQ ID NO: 41899 - DNA, 101 bp, rice(Oryza sativa)
  misc_feature (71): n=t or c
gtttgagccgcactcccctgtttttttttccttctttcaatctgatattccctgctggacccttttttttngctgctgctttgatctttttctctttgctg

SEQ ID NO: 41900 - DNA, 101 bp, rice(Oryza sativa)
  misc_feature (71): n=a or g
ggttcaaccctcaaaaaccggaaaaggctgtatatatcctccaagttgttctgccatcagagtaaaactcntaaaaaacattgaatgcataagcacctaag

SEQ ID NO: 41901 - DNA, 101 bp, rice(Oryza sativa)
  misc_feature (71): n=t or c
tgtaatttgaaaagaatgcagtaccgtagttacaagacttcctccgttttcatattgtaagactttatggnattgcccacatctatataaatgtggacaat

SEQ ID NO: 41902 - DNA, 101 bp, rice(Oryza sativa)
  misc_feature (71): n=a or g
atgaacagtgtcctatcaaatttgggcctttggatttgcatcctacagttatggtataactgcctaagttncagtcatagtaaggactgcacaggaaccaa

SEQ ID NO: 41903 - DNA, 101 bp, rice(Oryza sativa)
  misc_feature (71): n=t or c
aaccatagatccccgctggtagctggcctgcctacagaattcagcttccctaaccacatttctcttgctgngctggacctgtaacagcccccagctgccag

SEQ ID NO: 41904 - DNA, 101 bp, rice(Oryza sativa)
  misc_feature (71): n=a or g
ccgtgataattttctaaataggttataaggtgaaatttcaaaacaagcgtgataattgggtgtggtttatnctattttgacatttctaattattttttggg

SEQ ID NO: 41905 - DNA, 101 bp, rice(Oryza sativa)
  misc_feature (71): n=t or c
agaaggctgggaatgccattaatgacggtaggattcttttgaggataagcggcggcgacctggcgtgcggnggcggtatgaatccgcccgacgagcgcagg

SEQ ID NO: 41906 - DNA, 101 bp, rice(Oryza sativa)
  misc_feature (71): n=t or c
ttcaaaagatgctaatatactagacaaatgggtactatcggttctttttattgtattactagctaaatgcntgtgctttgctatccatagaaggaaaaaaa

SEQ ID NO: 41907 - DNA, 101 bp, rice(Oryza sativa)
  misc_feature (71): n=t or c
ataatgtattttacctcattgaaatcttcaatgtgcaagattctgtctactgatatcaaatacaaaagatnttgatctatctcctcgccaaatttcttttg

SEQ ID NO: 41908 - DNA, 101 bp, rice(Oryza sativa)
  misc_feature (71): n=a or g
aattggtgggagagttcccaactcttgttactgaacacagcctaaagggtgtttaattggtttttattacntatactgatttaatatgaaatagtaaatgt

SEQ ID NO: 41909 - DNA, 101 bp, rice(Oryza sativa)
  misc_feature (71): n=a or c
atcagtggccaaagctcagatgtttcatgatgcttttatatgctttaattgggttagtaatttaatatagnacattcaattgttataaaacaaatcagaga

SEQ ID NO: 41910 - DNA, 101 bp, rice(Oryza sativa)
  misc_feature (71): n=t or c
gccaagtcactggggttagtggcatagcttacggcgctgagctattgacgttgaaaatgatcttctggacnttttggtttgcatgttctcgtgtagtgtgg

SEQ ID NO: 41911 - DNA, 101 bp, rice(Oryza sativa)
  misc_feature (71): n=t or c
tcaccgttgattgaaaaaaaaaaagaattctattcaagacatgacaagcaatcaattttgccttaccccantgttctttggaaagtcccatagcgtctaac

SEQ ID NO: 41912 - DNA, 101 bp, rice(Oryza sativa)
  misc_feature (71): n=t or g
ttcttgccatgtgtccttccagatgacggttggagcgcagaaaacggtcacagctgtctaaggttggtaantaccaattggtggagtttgagggccagttg

SEQ ID NO: 41913 - DNA, 101 bp, rice(Oryza sativa)
  misc_feature (71): n=t or c
gctttgatcactttaattctagtttaattcttgctcatccctgttgcccagccgccacgattgggcaagangacgaccctatcagccaatcgacagattcc

SEQ ID NO: 41914 - DNA, 101 bp, rice(Oryza sativa)
  misc_feature (71): n=a or g
atctttggtcggttaccaaaaacaacaatactcccggttgcttaaaaaaccgggggtttaaaagtgcaatnatctttagtcccagttagtgttaccaaccg

SEQ ID NO: 41915 - DNA, 101 bp, rice(Oryza sativa)
  misc_feature (71): n=t or c
gcctgattaaaaaaatagagaatctattctatttattccactgagttggttcgagttcatgatttgccatnaacattatcactttctataatatactggtg

SEQ ID NO: 41916 - DNA, 101 bp, rice(Oryza sativa)
  misc_feature (71): n=t or c
ttccggtattttttccctgcacgttttcgtaccacccggccatgcgtgaccgggacggatcaggctccacnatctatataaggctgtgtttagtttacacc

SEQ ID NO: 41917 - DNA, 101 bp, rice(Oryza sativa)
  misc_feature (71): n=t or g
tctaaaactagtgatggctagtggagacttacttgctacttgtctcataagatggacgtgcaccagtttgnaagatcaaatcctcaaagataatgaagagg

SEQ ID NO: 41918 - DNA, 101 bp, rice(Oryza sativa)
  misc_feature (71): n=a or g
accaatttttttacagtgcctttggaacattcgtaaggtttggcgtcacatatatattatttggtagcatnggtagaattcttaatttgtttggattgcag

SEQ ID NO: 41919 - DNA, 101 bp, rice(Oryza sativa)
  misc_feature (71): n=a or c
gattaactgggccccgtttcattctcatgcatgaactgattaaattcgacgagactacaaatcagacatcnaattttttcataaaaattggggctgtttca

SEQ ID NO: 41920 - DNA, 101 bp, rice(Oryza sativa)
  misc_feature (71): n=a or g
ctggtttttaacgttgaggggcacgtctggttttgcggtttagggataaattttagactcggcaattgagngatctaaagtgaacttattcctaataatat

SEQ ID NO: 41921 - DNA, 101 bp, rice(Oryza sativa)
  misc_feature (71): n=a or g
cagctctgaacaggctccccctcaaattctggggttacttttagtgactatgagcttgaaagttcctttcntcccattttcaccatacgtctccagttact

SEQ ID NO: 41922 - DNA, 101 bp, rice(Oryza sativa)
  misc_feature (71): n=a or g
cgggtcccactcaaggaccggttgctgcatagctttcgggagaaggcatggatcgagactcggtcaaagtngagtggggtccccctcccattggggggagt

SEQ ID NO: 41923 - DNA, 101 bp, rice(Oryza sativa)
  misc_feature (71): n=a or g
aaaagggatgtagcgcagcttggtagcgcgtttgttttgggtacaaaatgtcacgggttcaccttctttcntcaataatttatctgttgttgataacggtg

SEQ ID NO: 41924 - DNA, 101 bp, rice(Oryza sativa)
  misc_feature (71): n=a or g
ccaactggaaacggattagtattgctaattatcatgcagacatgaaaaattcttccgcgtgcagtattgcnaagccatatacatacatgtttatgataagt

SEQ ID NO: 41925 - DNA, 101 bp, rice(Oryza sativa)
  misc_feature (71): n=a or g
gccccaagcaaagctagaaagatgggccctttaatacagctctgatgatataataatgtttctaacaaatntaatgcatgaaaaaaacattcttatcaaac

SEQ ID NO: 41926 - DNA, 101 bp, rice(Oryza sativa)
  misc_feature (71): n=a or g
gctgggttcccgtttgcttaccatgcagtttcatgtgccttgctagaggtgggcgatggtgttactttccngttattccgcaaggaatatcacctttcttg

SEQ ID NO: 41927 - DNA, 101 bp, rice(Oryza sativa)
  misc_feature (71): n=t or c
tgtgaggagatccttgagttatttcgtcctattcaggtcttgaagttgtcttggccgatggaactgttctngatatgcttactactttaaggaaagacaac

SEQ ID NO: 41928 - DNA, 101 bp, rice(Oryza sativa)
  misc_feature (71): n=a or g
tctgttactgcatgtggagggttaaagttcaaaatgccaatctcgaaaagcaatatctcacaagaggtatnttattttttaaaccatttccaccatgatgc

SEQ ID NO: 41929 - DNA, 101 bp, rice(Oryza sativa)
  misc_feature (71): n=t or c
gactagcatcttgcagtatatctagcttccctaacattttgcggcatctccatgagattactttccttganctttcatataaccaaatccacggagcaata

SEQ ID NO: 41930 - DNA, 101 bp, rice(Oryza sativa)
  misc_feature (71): n=t or c
accaccttgcttctcatacttatctagaagcatattgaaggtcaccttagccttcttaggagctttagaanttgaagcttcactcctattctccttccaaa

SEQ ID NO: 41931 - DNA, 101 bp, rice(Oryza sativa)
  misc_feature (71): n=t or c
tttctgcagctattgctgccatgacatttgccgtggcctctcagctatctggaatagggtacattgttacngcttcacttactggtgccatcatggcggcc

SEQ ID NO: 41932 - DNA, 101 bp, rice(Oryza sativa)
  misc_feature (71): n=t or c
actagtgaaaatttagccggtgagaatatggttttttttagcctctggcttctaatttatttctttgattngacaattacaacttcttaaaatctggatta

SEQ ID NO: 41933 - DNA, 101 bp, rice(Oryza sativa)
  misc_feature (71): n=a or c
gatataatagtaaagcaaatagccaacatggtcttgaattgttgatttgattagaaaaactaaagctgctnaagtgtatcttaaattaaacgtgtagatcg

SEQ ID NO: 41934 - DNA, 101 bp, rice(Oryza sativa)
  misc_feature (71): n=t or c
cacccacccccacgcgcaagttaaattttaactctgcaacccacaacccaacctgtcccccacgcgcactngatctggtgcataccacacagttaaatttt

SEQ ID NO: 41935 - DNA, 101 bp, rice(Oryza sativa)
  misc_feature (71): n=t or c
tggaaggttttgctgctaccgatcaatgcgcgtaatcacataattatgaaaatagctatgaattaaaacangttaatcccataggcaatgggtggaaaacg

SEQ ID NO: 41936 - DNA, 101 bp, rice(Oryza sativa)
  misc_feature (71): n=t or g
gacctcgcgttcgcgtatgtacgtcgcctactatttttttcaccgcccaccggggcgatctgcgggttggncctgtactccctctgcacctaggaagtcgt

SEQ ID NO: 41937 - DNA, 101 bp, rice(Oryza sativa)
  misc_feature (71): n=a or g
gagagaaatggggtaaaatgcagcaatactacattaaaagctcctttgaatcaaagaaattaattataaangaatttcataggattaaaatcccacttcat

SEQ ID NO: 41938 - DNA, 101 bp, rice(Oryza sativa)
  misc_feature (71): n=t or c
aggaggcgaaggccgagaacaagcggctccaaaccgaattggagaaggaaaaagagattagggccgaggtngatcacctcaaggccaaattggagaagggg

SEQ ID NO: 41939 - DNA, 101 bp, rice(Oryza sativa)
  misc_feature (71): n=a or c
ctgcatcataacagtactaggatctgcttgttttttatcgttagtccaatcagttgataagcactgatgtnctgttagaggactgcctgaagcctctagct

SEQ ID NO: 41940 - DNA, 101 bp, rice(Oryza sativa)
  misc_feature (71): n=a or c
actaaaactagtttataagggaaattttatatatgtattgttagcgccagggtttacgattttgacaggcncttctgtttcgggcactggcggaattcgga

SEQ ID NO: 41941 - DNA, 101 bp, rice(Oryza sativa)
  misc_feature (71): n=t or c
tcaatctcaaggatttaccagcctaatcttcgaagatcctcataggagcaggcactactagagaagtgatntttgctgggtcaggcaaaaatcacaatagt

SEQ ID NO: 41942 - DNA, 101 bp, rice(Oryza sativa)
  misc_feature (71): n=a or g
atatttttagacttcgatacggtcttcaacatgctactttgaccatttttcctgaaaagttataaaaaatntctgcgtttagtttgttgctaaatttggta

SEQ ID NO: 41943 - DNA, 101 bp, rice(Oryza sativa)
  misc_feature (71): n=t or g
aagcaaaagataggtggaatgcaacagtggtgtagacagagtattagttaaagacaatgatggtagaaaanaatgataaggggcaaagttgatcttatatt

SEQ ID NO: 41944 - DNA, 101 bp, rice(Oryza sativa)
  misc_feature (71): n=a or g
agatacctcaatgtgggtgtttgattaagttttttacgcaaagcaatacggtaataacgtgtgattaattnagttttaattattacaaacttaaaaattag

SEQ ID NO: 41945 - DNA, 101 bp, rice(Oryza sativa)
  misc_feature (71): n=t or c
cttcctggcagctttttctcacaagcagagaaagttgcccggaacttcctgagttcttcctaggaacttcngggtagttgtgaattgctatttcaagcacc

SEQ ID NO: 41946 - DNA, 101 bp, rice(Oryza sativa)
  misc_feature (71): n=a or g
caatgccagctaaaaccacacgtcgtcttttttttttccaaaattcattcaaaagtttgctaacttgtcgngagtcgggatcagtttttactaaaccgttt

SEQ ID NO: 41947 - DNA, 101 bp, rice(Oryza sativa)
  misc_feature (71): n=a or g
ctgatacctaggtactagctagtacccaaggtatcaggtaccagccagaacacttataggtgccaggtgtnaggagggaggaatcatggctcatacccaca

SEQ ID NO: 41948 - DNA, 101 bp, rice(Oryza sativa)
  misc_feature (71): n=a or g
tatgggccagcgagaaggttccctcggcagtgaggttgagataggtgaccgagagcttgtattctcccaanaaggcagaaaagttgaaggagccgcggtca

SEQ ID NO: 41949 - DNA, 101 bp, rice(Oryza sativa)
  misc_feature (71): n=a or c
taatctcaagtcgctggtgtgcatttcatgcatgatgagattccatacttcacaccatccgcccatatcangttggttggctacaagaagaatgtccggac

SEQ ID NO: 41950 - DNA, 101 bp, rice(Oryza sativa)
  misc_feature (71): n=a or g
ccttcatgacatccgcaatcaaatcggcccatggttgttgctgaggcgttccttgagactgctgtgacatnggctcaaattggttgtattgaggaacaaac

SEQ ID NO: 41951 - DNA, 101 bp, rice(Oryza sativa)
  misc_feature (71): n=t or c
tcacaagtggtgttacttccctctgagagatcaagtgaaacaactccttctggttcccaatggagacaagntgaaggcagcccatcccgatctcttcgcca

SEQ ID NO: 41952 - DNA, 101 bp, rice(Oryza sativa)
  misc_feature (71): n=t or g
acaggaaggaataagggcagggttgggttgggccatgtaaaataagggttacgatgggctggacactgtanctcaaaatggggttcagcccatgggcagta

SEQ ID NO: 41953 - DNA, 101 bp, rice(Oryza sativa)
  misc_feature (71): n=a or c
taagatgcatcaatgatgattacaacgggctcccgtttcggcccaacgaaaagcaaagtaaagtgggcctngattgcgccagaagcccatcccggccaact

SEQ ID NO: 41954 - DNA, 101 bp, rice(Oryza sativa)
  misc_feature (71): n=t or g
tgttggttcctgttgtagattgagttagaatctaaaaattctctcctaagtatcttgttatgatctcaagngagcctatttttcaaaaacaaaaaagcatg

SEQ ID NO: 41955 - DNA, 101 bp, rice(Oryza sativa)
  misc_feature (71): n=a or g
atggaggaatccggaatctttaattaattgaagagatcaatgctgcacgggaaaccttcactggtcggcancatctcgaattttcactacttcggtttcaa

SEQ ID NO: 41956 - DNA, 101 bp, rice(Oryza sativa)
  misc_feature (71): n=a or g
cacataatgacccgtagccttctcgaccaaggccacgtggcccagtacgacacggcctattaaccatgccnccatcggggcacgcgtcgtgctcaggcggg

SEQ ID NO: 41957 - DNA, 101 bp, rice(Oryza sativa)
  misc_feature (71): n=t or g
cggcaaaagatggagaagcgcgacagcgagaagatgaagaagcgtagtggctgactgggggcgacggcaangcctcctcatgcaacggttccaagccgttg

SEQ ID NO: 41958 - DNA, 101 bp, rice(Oryza sativa)
  misc_feature (71): n=t or c
tttcgttgtcttggccgacgttgactcccccgttggttgcctttcaaaaggtgaccccggcgggtgaagtnctgatggcggcggctcaggcatctgcaggc

SEQ ID NO: 41959 - DNA, 101 bp, rice(Oryza sativa)
  misc_feature (71): n=a or g
tcgggtatatatagctaggcgattgtgtgataccgtacgtgctatgatttggagtaatttatgatcaaatntttgtttgttgcgcttgcaggatcgcgtac

SEQ ID NO: 41960 - DNA, 101 bp, rice(Oryza sativa)
  misc_feature (71): n=a or g
gtacgtactaatacgcacaaatccctacatcaaattagtgcctttataaagtattatactatcactaaaantaatttgaaacgtttggtatgaaaggtaaa

SEQ ID NO: 41961 - DNA, 101 bp, rice(Oryza sativa)
  misc_feature (71): n=a or g
tcccaatgcaggaagagaagagggtggggacaaagcagtctcccactgtagggagagaaggaggggaatanaggagagccctgacacgtgggctctacctg

SEQ ID NO: 41962 - DNA, 101 bp, rice(Oryza sativa)
  misc_feature (71): n=a or g
tattgagccccgcaatcgcagcaccacgtctcctcctgttatcagccatgccgaaacccgggttgacctcnccgagaatgctaatccctacatgcgaatcg

SEQ ID NO: 41963 - DNA, 101 bp, rice(Oryza sativa)
  misc_feature (71): n=a or c
gtatatggaatttatgtgtatttcgtattctttaaaaatcatgtgccaccacgtgtgctgcttggagcagnagatcaatgataaaataaagctaaatatat

SEQ ID NO: 41964 - DNA, 101 bp, rice(Oryza sativa)
  misc_feature (71): n=a or g
ctgccaagaagaaggaaaaggatttggaagagaataagtgggcaaagaatatcaagagtgcaaaaggagcnaaggtatacttctcattttggaattgtggt

SEQ ID NO: 41965 - DNA, 101 bp, rice(Oryza sativa)
  misc_feature (71): n=t or c
aaaaatatttgaattcaaattcaaattggaatcggacatataaactacttttgacttataaacttttggtntctaaactttagatgtgtaaacttgaggtg

SEQ ID NO: 41966 - DNA, 101 bp, rice(Oryza sativa)
  misc_feature (71): n=a or g
ctaccacattgctaatattatagtccaggactgcatcagtcaataatctactactagtgaccagatgccantgatcagtaaacattctgcggtcataagct

SEQ ID NO: 41967 - DNA, 101 bp, rice(Oryza sativa)
  misc_feature (71): n=a or g
agggtatcaactagttacgaggtaacttctgcccatgaattgaactcatgttttaatataaatcattatgnggctgtttggttctttaccctaccaaatct

SEQ ID NO: 41968 - DNA, 101 bp, rice(Oryza sativa)
  misc_feature (71): n=t or c
ccatgcatgaatcataccttaagcaattttctctatttagctaccaaaagagtgctgctcctaaaatatcntttttctcatgttgagcaacaaaataacaa

SEQ ID NO: 41969 - DNA, 101 bp, rice(Oryza sativa)
  misc_feature (71): n=t or c
ttaactcacactctagtgatattgatgtttgatacatgttgtctgtactagtcacttcatcaacaacttgnggtaattttcttttcaagaattgtttccat

SEQ ID NO: 41970 - DNA, 101 bp, rice(Oryza sativa)
  misc_feature (71): n=t or c
tgaaattctcaccatttcttctctcttaaaaattgatgctaagttccatcttagtatccttttgggtgttngttcaaaaacattagtacttccagcacaat

SEQ ID NO: 41971 - DNA, 101 bp, rice(Oryza sativa)
  misc_feature (71): n=t or c
ttgatctaatgcaaagataattagacaggaactatgtaagttcatcaaaagatgcacagcagcatagcggntttcttgtttttttttacaatggattgcta

SEQ ID NO: 41972 - DNA, 101 bp, rice(Oryza sativa)
  misc_feature (71): n=a or g
gccatagaatttgatattctttttacctattttgcaccaactccctccttttaaaaatatatggctattcntcatattaaaataactaaaaacgagtgttg

SEQ ID NO: 41973 - DNA, 101 bp, rice(Oryza sativa)
  misc_feature (71): n=t or c
ggctaggctaggccgatcataccagtgctaggtgtgtggtaagaccagtcggcccgatagtctgaccgacnagctctatgacggttgtttctttgaatatg

SEQ ID NO: 41974 - DNA, 101 bp, rice(Oryza sativa)
  misc_feature (71): n=a or g
agaaacgaagaccaaagctctgttactgtcgtcgtcgacggtgaggccggcccggccatgcaggacgaacnggtaggttattacccgcggcggccggagaa

SEQ ID NO: 41975 - DNA, 101 bp, rice(Oryza sativa)
  misc_feature (71): n=a or g
actaatgaacacaactgatttttcagaaatgcatgatgtattgacttggcacatgctacatacaccctgcnaaagacaatgcggaaaagagttgggatgag

SEQ ID NO: 41976 - DNA, 101 bp, rice(Oryza sativa)
  misc_feature (71): n=t or c
attagggtagaactcaacaagtcgacataccttgtgtgcatcacaagtaaaacaatgagtcaatgcttagnaggattcaagaatgtcatactatatacaaa

SEQ ID NO: 41977 - DNA, 101 bp, rice(Oryza sativa)
  misc_feature (71): n=a or c
agggcacgcaaggaggaagaagagaaccgagggagaaaacaaatataggagattagagattgatttaactntttcttaattcctccttaacgattacatct

SEQ ID NO: 41978 - DNA, 101 bp, rice(Oryza sativa)
  misc_feature (71): n=a or g
tggtaaggtgtcttcctccaacccgtcttcagactgtgcgtcgtcagccttgttgtcgtcttccccttcangtccttccttctcttgggacttccagctgg

SEQ ID NO: 41979 - DNA, 101 bp, rice(Oryza sativa)
  misc_feature (71): n=t or c
acagagtggctatcataggtgtcgacccatcagatttagcgaaccatgacgccaaaacagctgagtttacnttctttggagaaattggctaccagttgatt

SEQ ID NO: 41980 - DNA, 101 bp, rice(Oryza sativa)
  misc_feature (71): n=a or g
agactgggaggccagagaaggaagaagatgcccaggctcgacacagaggaaaaatgatcttagtttctctntgtgtttcagcagacctgtattttaatttt

SEQ ID NO: 41981 - DNA, 101 bp, rice(Oryza sativa)
  misc_feature (71): n=t or c
atgcattcatcatcaacagtaaaagactactactcctcctaaaagttaatttgtttgttaggtttggtgtngtggcgttggaccaacaacaacaacaacaa

SEQ ID NO: 41982 - DNA, 101 bp, rice(Oryza sativa)
  misc_feature (71): n=a or g
tctccacaagtcagatattgttctcgatcccaatttccgtctcttaagagaaactgccactcgagaagacnagcaggatggtgacgctagatgggcgatca

SEQ ID NO: 41983 - DNA, 101 bp, rice(Oryza sativa)
  misc_feature (71): n=t or g
accagattcaccgtgattagcctcatattaaaaatatggcccaatgaaactggtttagttcaggtggtttngttggagctgttgcaacgtggtgtagcgtt

SEQ ID NO: 41984 - DNA, 101 bp, rice(Oryza sativa)
  misc_feature (71): n=t or c
ccaaaaacagatagattgcaacacaatagcctattttgcaagtttttattcctcatctaatgggattaggnacttgaactacttcattcttgaaattttaa

SEQ ID NO: 41985 - DNA, 101 bp, rice(Oryza sativa)
  misc_feature (71): n=a or g
ttccgttctttttccgcccgttctttttccgcccaacagtatgttattcgtttccttttaaataaaatacntctaatctaatctaatggtctaaattattg

SEQ ID NO: 41986 - DNA, 101 bp, rice(Oryza sativa)
  misc_feature (71): n=t or c
atcttcttctgccttatgtggaatatgtcaaggtattggatattcccccatctttttgattaatctattangagcctgttctaggcagccaagatttccct

SEQ ID NO: 41987 - DNA, 101 bp, rice(Oryza sativa)
  misc_feature (71): n=a or g
ttcccaaaactatagagtaaatatggcccgtttataagcaatgtaagccgaaatatcggcctttaccatgngccacaatttgagattacgcttttcgaaaa

SEQ ID NO: 41988 - DNA, 101 bp, rice(Oryza sativa)
  misc_feature (71): n=t or c
caaatgaaaattaatttcgagccatatcgaaacattggaaaaccgcgaaaaactgaccggctttcgttggntttgtgaacctgcgccgggcgtggcgtcgg

SEQ ID NO: 41989 - DNA, 101 bp, rice(Oryza sativa)
  misc_feature (71): n=a or g
gctagtactggtcagggttcataatttccacgaaaactgatggagttttacgaaatttggatacagcttgnaattaagtttcgattaaaattttaaaagtt

SEQ ID NO: 41990 - DNA, 101 bp, rice(Oryza sativa)
  misc_feature (71): n=a or g
ctattaaacttgctcttatacatgcgcatagacctaagacctagctacacaaacacaattaatacttcttngtactaaatctcactatcaacgggtacagc

SEQ ID NO: 41991 - DNA, 101 bp, rice(Oryza sativa)
  misc_feature (71): n=t or c
ttaacacagccgccagcgaaaatgaattattgcaagcggtcggtgtaaggcaaccgccagcaaaatggatntttgctggcggctggcttaagatgatcggc

SEQ ID NO: 41992 - DNA, 101 bp, rice(Oryza sativa)
  misc_feature (71): n=t or c
gagttttacatgcaatgaagccactggctgaaaatgaacaagaataaattcagatagatcactcagataanttctggctttcagaaagtcatccccaagtt

SEQ ID NO: 41993 - DNA, 101 bp, rice(Oryza sativa)
  misc_feature (71): n=a or g
agagagcgcatcatcagcaacaccacaacccgaaatccaccaccccggagcgcgcacgagagggatagggntcgcgctggctcacctgcctggcccttgtg

SEQ ID NO: 41994 - DNA, 101 bp, rice(Oryza sativa)
  misc_feature (71): n=a or g
ggttggggtggtgctacggctttcggcgtcattacagctcacagcagcggggtgatgcagcacggcgacgncggcggaatcagagcacggcaaggttccag

SEQ ID NO: 41995 - DNA, 101 bp, rice(Oryza sativa)
  misc_feature (71): n=a or g
aggcgggcggctaattgcaaaaataccacactcggggtcttggccgcaggatgttgatccaaaggctccgnatgggtgtgtgcatgagtgcatctaccttg

SEQ ID NO: 41996 - DNA, 101 bp, rice(Oryza sativa)
  misc_feature (71): n=a or g
gaagtcgacggcgatggcagcgagatctggtgaaggcaagttggggaaggcggcggcagtgaggtcgacgncgacgacaaggtgggaaagatgatgacgac

SEQ ID NO: 41997 - DNA, 101 bp, rice(Oryza sativa)
  misc_feature (71): n=t or c
aaatctaccagtaacaaagaaaatgaaaatgctacacacgcgacctgagcgtccaactttccaacgactgngaagtacacggcgtcggtaacatgcagaac

SEQ ID NO: 41998 - DNA, 101 bp, rice(Oryza sativa)
  misc_feature (71): n=t or c
ataataaatggccaagagtgattcaaagctctaactccatgaattggaaaatataatccgaaatcgtcaangccgccactgttgcccactagatctgccaa

SEQ ID NO: 41999 - DNA, 101 bp, rice(Oryza sativa)
  misc_feature (71): n=t or c
aactgagggtccttgtgcgtaggtttagaaatggtgctaatcatgttacgggtgaccagaggagattcagntagatgccaacaagataacgctgaaacaaa

SEQ ID NO: 42000 - DNA, 101 bp, rice(Oryza sativa)
  misc_feature (71): n=t or c
caaatttttttccggtatcttggtacccaccgtgctaacgggcctttacgcgaggagcgtcgctagctgcnaggagcgccctcacagccgcacgcaaggag

SEQ ID NO: 42001 - DNA, 101 bp, rice(Oryza sativa)
  misc_feature (71): n=t or c
tctaccaacaaaaagaggtattctttcattatctgctgtagggtcaaataaaccattagatttctgcaagnaggggcggatccaacgtgggtgcaggggac

SEQ ID NO: 42002 - DNA, 101 bp, rice(Oryza sativa)
  misc_feature (71): n=a or g
aaaattttgtcaagtcttgattctgaaattgctgtgataaattcttcttttataggaagtacagtactganttgtgggttgtacaatacttaaattctgaa

SEQ ID NO: 42003 - DNA, 101 bp, rice(Oryza sativa)
  misc_feature (71): n=a or g
cagatggtcaattgttctgaagcaaagctgaaaaataatagttatttggccatcccctgagttgcaaccgntctgctgtctacacccggttttgcagtgcg

SEQ ID NO: 42004 - DNA, 101 bp, rice(Oryza sativa)
  misc_feature (71): n=t or c
gggcggccaccatttcattctagttgtcaccaagacgccaagtcgttagcctaggagaaatcgatctcccngggtgtttttcttcgtcgtcatgcttcgac

SEQ ID NO: 42005 - DNA, 101 bp, rice(Oryza sativa)
  misc_feature (71): n=t or g
aaagagataaaatatgactgaaagtttacaaaatttcaggtacctgaaatctagcaatacacatttaacantaagctctaaaatttaaattagtactaatt

SEQ ID NO: 42006 - DNA, 101 bp, rice(Oryza sativa)
  misc_feature (71): n=a or g
agcgcacacgctaagccttttggttgtttgtcccctttttttaacccgatctgttcaccgcgcgtctcccngacgcttttagtttttttcgtcaatctttt

SEQ ID NO: 42007 - DNA, 101 bp, rice(Oryza sativa)
  misc_feature (71): n=a or g
cgaaaaaagtgggggaaaaaagcaaaaaaaaaaactgtaaaaaaagaaaaaaataaggtggaggaggcgcncgcgtgccggcgcgagcccgaaacacgcac

SEQ ID NO: 42008 - DNA, 101 bp, rice(Oryza sativa)
  misc_feature (71): n=a or g
taattgccataggcatcccatgcagtcggtgtatattgttcataaatatctccaccacctgttccacactntatgggtgtgacaaagccagaaaatgagca

SEQ ID NO: 42009 - DNA, 101 bp, rice(Oryza sativa)
  misc_feature (71): n=a or g
aagaagcagttagctggtagccagcttctaaaaatctttcacttatggctttctttctagttcattttcanctataccttttaaaggaacttctgattctg

SEQ ID NO: 42010 - DNA, 101 bp, rice(Oryza sativa)
  misc_feature (71): n=a or c
ggcctggatatccgactagagataggaggtagaccgagtgagggattatgtaagagattagagcttgtgantgttaattgccttgttttttagggtaaaat

SEQ ID NO: 42011 - DNA, 101 bp, rice(Oryza sativa)
  misc_feature (71): n=t or c
ccgtcaagaggaagaaacggacggatcaagaaaatactgatgcacctgtagaggaaagtaacctgcctttnaagaagcactcaatattttcaggtatctgg

SEQ ID NO: 42012 - DNA, 101 bp, rice(Oryza sativa)
  misc_feature (71): n=a or g
ttcagagggggaaaacagcctttatacatatgtaaataactttctaccgcagtaaccaaagtgcttgcacncctaaactagaaaaaaatttacacatagaa

SEQ ID NO: 42013 - DNA, 101 bp, rice(Oryza sativa)
  misc_feature (71): n=t or c
ggatgtcgacgccaggggcgattatgtccggcttgagtatctcagccacaaagcggttaggtccacggctngagaaggccgcgaccctcggagcatatggt

SEQ ID NO: 42014 - DNA, 101 bp, rice(Oryza sativa)
  misc_feature (71): n=a or c
tgcaagaattcaacaagtgtctcaatttctctcatgtattcaatctgccctctatgggtgatatttacatnctacctccgtcccaaaatacttgtcgttat

SEQ ID NO: 42015 - DNA, 101 bp, rice(Oryza sativa)
  misc_feature (71): n=a or g
tgcccatgtatgtcatgtcagccttgtactggttgggccagattgaatatttttggggggaggaggggtgngagtggaaaattgcaaagcgtgtggcgcgt

SEQ ID NO: 42016 - DNA, 101 bp, rice(Oryza sativa)
  misc_feature (71): n=t or c
tttatatgtggttgtaagaaataccaacagtatctctccactctctccaccaacccaggtgcaacatcagnggacaaagcatatggagattgatcttcatt

SEQ ID NO: 42017 - DNA, 101 bp, rice(Oryza sativa)
  misc_feature (71): n=a or g
aaaagttgtcaatgcacaggttcattgaaggtttgaagcattgtaaagtaaaacccatcacctttttcttngaagtggatttttatccctcgaggggacat

SEQ ID NO: 42018 - DNA, 101 bp, rice(Oryza sativa)
  misc_feature (71): n=t or c
tagtaaaaaacaaaagagaaaaaaattgttgtcacgggagcaattaaccttttccgattcttccaactttngtggatttaattctatatgtatcaagttaa

SEQ ID NO: 42019 - DNA, 101 bp, rice(Oryza sativa)
  misc_feature (71): n=a or g
agatattttgttctcctcgttgtgcaagaaatcaatgggggacctgagatgcgacactttttacaataagngagaaaaactaagccgggtaatgcaattgc

SEQ ID NO: 42020 - DNA, 101 bp, rice(Oryza sativa)
  misc_feature (71): n=a or c
tctctaaaaaatctacagtgttggcacgcgcggaacaccgatgaacaactaaaaagttggctaaaaaaggncgggaccacctatacatttgtcgacaaatt

SEQ ID NO: 42021 - DNA, 101 bp, rice(Oryza sativa)
  misc_feature (71): n=t or c
ccctgtctatgctagactcggcagcatcccagcccgcaaggccacttctgctttctccatatcctcccctngatgtagggctgtcaaaaaagctcgaggct

SEQ ID NO: 42022 - DNA, 101 bp, rice(Oryza sativa)
  misc_feature (71): n=t or c
ttattgtgtgtgctatgtgccataacacttatctgtgcacaaacttcaattgtagtgccacactaccggancgcgtgaattgtaattggtgtcctatggta

SEQ ID NO: 42023 - DNA, 101 bp, rice(Oryza sativa)
  misc_feature (71): n=t or g
ttcccatatgtccctgaatatatcaccaccatatgttgttttgactggttttgagttctcaatctactgcnaggtggtagtgccatatgttgttttaactg

SEQ ID NO: 42024 - DNA, 101 bp, rice(Oryza sativa)
  misc_feature (71): n=t or g
cgtcgcgccacacctcggtgagttccccacgtcgtgctcttgtcttcatataagatgcagtgccgcgacgncgacggccgcgggcagcatggcctcgacgt

SEQ ID NO: 42025 - DNA, 101 bp, rice(Oryza sativa)
  misc_feature (71): n=a or g
cgatataatcggcaagcaatcaacaaggtgatagcttttcttttccttgttagggtgtgttttagttgggnaaaagaaaatttttaggtgtcacatcaaac

SEQ ID NO: 42026 - DNA, 101 bp, rice(Oryza sativa)
  misc_feature (71): n=t or c
acaaataaagtagcaaaacaatcattccaaaaagtggcatcactgcattaggaaaggaactgaatgtttgnaaagttgaaaagacaataattcagttaaaa

SEQ ID NO: 42027 - DNA, 101 bp, rice(Oryza sativa)
  misc_feature (71): n=t or c
cttcatgttcctgagctgctcctggcttccccgattctattcacttgcgcgcacgggtgatcagtacgttncccttcctgttcctgagctgcttctggctt

SEQ ID NO: 42028 - DNA, 101 bp, rice(Oryza sativa)
  misc_feature (71): n=t or c
agctagtttgtacaaatatatgcaactattagtgtttgaactttgaaatctgatatttgccatttaatacncgtgtgttacagataatgttgtatgagaaa

SEQ ID NO: 42029 - DNA, 101 bp, rice(Oryza sativa)
  misc_feature (71): n=a or g
agcaatgcgtgttgttcacaatcgtcatgatattcagcattgcacattggagtatatatagggtgtagtcntgtaggccactaacatacatttgtcttaat

SEQ ID NO: 42030 - DNA, 101 bp, rice(Oryza sativa)
  misc_feature (71): n=a or c
tcatcatagcctccaaccctccatgcacttctcctcacagccaccgccatcatatgtgctctcctctcctntcctctccacgactctacgcatccatgggc

SEQ ID NO: 42031 - DNA, 101 bp, rice(Oryza sativa)
  misc_feature (71): n=a or g
tctggcccaggccgtgttgccgtgttggttcataggttctactcctacttctgtctaactaatccccttcntcagcgacaggctccgtctccacccaccac

SEQ ID NO: 42032 - DNA, 101 bp, rice(Oryza sativa)
  misc_feature (71): n=t or c
agcgtggggggatgagaaagccgtttcttgatttgaatttatccagtgggggagcccaatgtcggtgcganacggctaccgcgcgcgatcggctcagatcg

SEQ ID NO: 42033 - DNA, 101 bp, rice(Oryza sativa)
  misc_feature (71): n=t or g
gttagaattatcttttgtactgttacttattttttacctcttgacacctattcgtagtggtacctaggagntacatctacattgcaataacccccaaggat

SEQ ID NO: 42034 - DNA, 101 bp, rice(Oryza sativa)
  misc_feature (71): n=a or g
ccgattgaaggagggacatgaaatggacttcggagaagggatagaaccagccgaaaggaagagagaatggnccgagaactaaaagtgaacttttctagttt

SEQ ID NO: 42035 - DNA, 101 bp, rice(Oryza sativa)
  misc_feature (71): n=t or c
tgtagattttttttataagaatcaatttaattcaggtaaatataagggaaaaaattagcacttggaaatgntacatgccgggatcctatcgggacgagatc

SEQ ID NO: 42036 - DNA, 101 bp, rice(Oryza sativa)
  misc_feature (71): n=t or c
cgtttgttgactaacatcccttttccctagatagtgagtcctcatcacctcacttgtatcatctattatangtttcatgcttacctattttctaattttgg

SEQ ID NO: 42037 - DNA, 101 bp, rice(Oryza sativa)
  misc_feature (71): n=a or g
actggctgacaagttgggtccatccatagtttttcttattctcttttgaccgagttcatcaaccgagttcnaaacagatttgtctttcatctttaattaag

SEQ ID NO: 42038 - DNA, 101 bp, rice(Oryza sativa)
  misc_feature (71): n=a or g
catctgtaaacagagtagcaacaagctgcttccgaaaggcatattaaaaaaaaaaaaactcgaatattagnaaataacctaatatcaaataattagaaggg

SEQ ID NO: 42039 - DNA, 101 bp, rice(Oryza sativa)
  misc_feature (71): n=a or c
ctcttttgaatcaagaggtaaatccaaccataccctagcttaattgactcggctaccattgcttgtgccanacagctatgagaaaaaaaatagtattccct

SEQ ID NO: 42040 - DNA, 101 bp, rice(Oryza sativa)
  misc_feature (71): n=t or c
actctaattgcattcctaggtttaataactgtggtttagagatatatcatcccgaggaaaaaaatatactncctccatcctataaaaaactagtattagat

SEQ ID NO: 42041 - DNA, 101 bp, rice(Oryza sativa)
  misc_feature (71): n=t or c
ttgctacaactaagcactgttgcttgcacatgaatactagtagcagctgctagctcatgtgtgtgcgctcngcaatatatattatctatatttttacatga

SEQ ID NO: 42042 - DNA, 101 bp, rice(Oryza sativa)
  misc_feature (71): n=a or g
gcgtgaggttaagcatgcccagtgacgtgccacgttcaggggcatttttctcgacttagctgaatgccgcnagccatcctaaccacgggctttttttgttt

SEQ ID NO: 42043 - DNA, 101 bp, rice(Oryza sativa)
  misc_feature (71): n=t or c
aagagatgtacctgatagtgtagtagcaagaggtgtatagttttaaccccgagatcccgtgttcaatcccnaatacactcataatttcttcttaaaaatgt

SEQ ID NO: 42044 - DNA, 101 bp, rice(Oryza sativa)
  misc_feature (71): n=t or c
catacttgaggtgccggaggaggagcggcagcatcaatggaaggctggcgatcttcaccgttgccatttgntgtgtcatcgtcgtcctccaccaccacatg

SEQ ID NO: 42045 - DNA, 101 bp, rice(Oryza sativa)
  misc_feature (71): n=t or c
ctgtgaacttttttaagtctatagtacggctttaaaacaattgcatgtgatgtgtatgtctaatcaacggnagagaacaaagccacaatcggtttcgtact

SEQ ID NO: 42046 - DNA, 101 bp, rice(Oryza sativa)
  misc_feature (71): n=t or c
tggaggagttagggctataaattggggtgctatggactcaattcaagacattaaaccccatttcacatgangaatccatcgaagtgttcaagagaattgtg

SEQ ID NO: 42047 - DNA, 101 bp, rice(Oryza sativa)
  misc_feature (71): n=a or g
tttgcatgtactgcttggaggtggcagaccactggctatcagatgcttcctgcagaggtaatgtctgggtntcaaggctccaccaccgttaggaccagcca

SEQ ID NO: 42048 - DNA, 101 bp, rice(Oryza sativa)
  misc_feature (71): n=a or g
cgcggggcccaccgacagacacgagggattgattatccctagctacagtactgtatttaattatcgaatgnaatggatcatctgtctatggctctcagaca

SEQ ID NO: 42049 - DNA, 101 bp, rice(Oryza sativa)
  misc_feature (71): n=t or c
gttctttgagtatgtgtagacataaggaagagtatcttcagacttacttccttctaacgtatgtcactganatatgttctctctagatagtggacccatat

SEQ ID NO: 42050 - DNA, 101 bp, rice(Oryza sativa)
  misc_feature (71): n=a or c
ggtctctcctaccacacacgcaaagcctgtgatatgatccatttgaccacaacatttactccctccgtccnaaaaaaaaagtcaaaccctggatttccgtg

SEQ ID NO: 42051 - DNA, 101 bp, rice(Oryza sativa)
  misc_feature (71): n=t or g
ttatatcagtgatagaagaacttaacatgggggtacaacctactataaaaacatattaaacatgatgcacnaacttgtctaatatgtacgaaccatagcca

SEQ ID NO: 42052 - DNA, 101 bp, rice(Oryza sativa)
  misc_feature (71): n=t or c
gccaggtcagctagaatcgcatcacatagctagtgagcaggattctatattggtgaaagctaaacaaattngagagggccgatagatctaatatttcagaa

SEQ ID NO: 42053 - DNA, 101 bp, rice(Oryza sativa)
  misc_feature (71): n=a or c
ctggcgtgggcttccgctacaatccagtcgccatatatcgagctcctccagcagttgcttgtctcctccanccgttccttcacccgccagattacatcgct

SEQ ID NO: 42054 - DNA, 101 bp, rice(Oryza sativa)
  misc_feature (71): n=t or c
atgacagcatgaaaatgctgtggcgtttcctgcagaacacccctgcgctggagaagctcactcttcagaantgcaaggtaaacagcatgcaaacttttatt

SEQ ID NO: 42055 - DNA, 101 bp, rice(Oryza sativa)
  misc_feature (71): n=a or g
gatctctgtgcgcgattgcccgttggatatgacgatcagatggttgatattacgcatgtctgtcagatgcntctgctatgtcaggaatcaagaccaccact

SEQ ID NO: 42056 - DNA, 101 bp, rice(Oryza sativa)
  misc_feature (71): n=a or g
gatcgagtttaagctaatgcgggtttctaagtttgtattaaggggtgtatacatggtaaaaatagttaagntatagctaaaaaattttcttgaccgggttt

SEQ ID NO: 42057 - DNA, 101 bp, rice(Oryza sativa)
  misc_feature (71): n=a or c
aagaacacagcctatatatgtcccaagatataattcatttcattattaaagaaatatcatagctctctctntatatatagctttgtgaattttgtttacac

SEQ ID NO: 42058 - DNA, 101 bp, rice(Oryza sativa)
  misc_feature (71): n=t or c
tcgatagttcaaggggtaattcgtactttttcctatacttaattacatgagcaattttacagtgctagtgnttgaggagtaccatttttttaggcaaaatt

SEQ ID NO: 42059 - DNA, 101 bp, rice(Oryza sativa)
  misc_feature (71): n=t or c
ctgtttcgataatctgagaaataatactacctccttttcaaaaagtataatgccgttgacttttccacaangtttgaccattcgtcttattaaaagatata

SEQ ID NO: 42060 - DNA, 101 bp, rice(Oryza sativa)
  misc_feature (71): n=t or c
attagcactttgatatttttctcattggataatgcttttgcttgagtaactctgtacctctcgctgaaatnctgcgtccgctactgaatccgagccaagcc

SEQ ID NO: 42061 - DNA, 101 bp, rice(Oryza sativa)
  misc_feature (71): n=t or c
taggtaaaacgattacactatacactattgagaatgagttctttagttgaggtttccaactcatttttctngttttacacatgcatatttcccaaactact

SEQ ID NO: 42062 - DNA, 101 bp, rice(Oryza sativa)
  misc_feature (71): n=a or c
aaaggggaatgttttcttctgcttgctgcatggtccaagcttaattaggcactgtttggttctgacgcacntggaacgtttgaacatctgtataaagtgtt

SEQ ID NO: 42063 - DNA, 101 bp, rice(Oryza sativa)
  misc_feature (71): n=a or g
cgactgtccaggctactacagtactacgcgtgtgcgcaatactcaccggtgacgacctcgacacgccgccntcgcgctccttcttccgcctgctcatcatc

SEQ ID NO: 42064 - DNA, 101 bp, rice(Oryza sativa)
  misc_feature (71): n=a or g
gttattgattttcatggcacacagttggttgaatgtatggcttattcttcttctcaagtactcctccttgncataatcctttttccacagtttatatatat

SEQ ID NO: 42065 - DNA, 101 bp, rice(Oryza sativa)
  misc_feature (71): n=t or c
acaatgaataattacttcaaatatactcacttcattccacattataaaacgttttgagcttattctaagtnaaacttcctcaaatttgaccgaatatatag

SEQ ID NO: 42066 - DNA, 101 bp, rice(Oryza sativa)
  misc_feature (71): n=a or g
tgatttttccacacgtggagaaaaaaacaagccacaaccaaagtaaaaagagcctgtatactctatatatntaaaaaaaaaacaggtgtgcctatatatat

SEQ ID NO: 42067 - DNA, 101 bp, rice(Oryza sativa)
  misc_feature (71): n=a or c
taccacagttgtcgacttttgttgccgtggggttaatctagacaaaaataacctcaaaactcacaattganctcaaatattttaacttgaacacaccttca

SEQ ID NO: 42068 - DNA, 101 bp, rice(Oryza sativa)
  misc_feature (71): n=t or c
cacgaagcagaaggatggtcgtcgtatcgctcctgggcattgtccgccatcgacggtcacatttcccttcntcacgtgaacatggggacgggcacatggtg

SEQ ID NO: 42069 - DNA, 101 bp, rice(Oryza sativa)
  misc_feature (71): n=a or g
gaacccataaaaatcttgatttatgagattggactcgatggtttcgggattgaccgggcattggcatgagncgaaaaaaaaaatcgggaaaaagaaaaaac

SEQ ID NO: 42070 - DNA, 101 bp, rice(Oryza sativa)
  misc_feature (71): n=t or g
ttctactttagattcgtccctgcaaatgcacacaaggagatcaagcctactccatccggtctataaaaatntaatcctaaaaatgtatctacagggtaata

SEQ ID NO: 42071 - DNA, 101 bp, rice(Oryza sativa)
  misc_feature (71): n=a or g
cccattcaaatgtctcggatttataggaaggggagatctcaaacgtaaaattggtactcgcgcagaacacnatgcaagtttactttgtctcaagggaggcc

SEQ ID NO: 42072 - DNA, 101 bp, rice(Oryza sativa)
  misc_feature (71): n=a or c
agtggcattaacaccgccacgtacaccatccacctgttccgtcacccattactaggtcgccgcattatcancgccacacacgttgttcacctcttccgtca

SEQ ID NO: 42073 - DNA, 101 bp, rice(Oryza sativa)
  misc_feature (71): n=a or g
ataccatttccagatcaccatccatatcccgcatcccttcatttcatatgattaatatgcaatctcctcancaacagaaacaaacatttatcgccaatacc

SEQ ID NO: 42074 - DNA, 101 bp, rice(Oryza sativa)
  misc_feature (71): n=a or g
aaccgcagtaaccgtgtggttaccgactataagtcgaaccctactctctatccggtacatgtacgtgtgtntatatatatatatagagagagagagatcat

SEQ ID NO: 42075 - DNA, 101 bp, rice(Oryza sativa)
  misc_feature (71): n=t or c
ctgaattcgtttgctaactgaattggaaatgaatgtgtgtttattatataattttagtccaattatactgncagtagaaaaaaatatacaatcaataatta

SEQ ID NO: 42076 - DNA, 101 bp, rice(Oryza sativa)
  misc_feature (71): n=t or g
attgttgcatatggtttaccaattaaacatctcttttaatagcattattttagtgcgacatggttaggctncaaaccaaacaaaaccatattaatcctcat

SEQ ID NO: 42077 - DNA, 101 bp, rice(Oryza sativa)
  misc_feature (71): n=a or g
gtacagccgaaaaaaaagagatactccaatcatgcacaaacatgaaaaaaaaaaccgtgatagctaatctngaagaccccctcaccgtaatggaagggtac

SEQ ID NO: 42078 - DNA, 101 bp, rice(Oryza sativa)
  misc_feature (71): n=a or c
gtaaagcaacggcgctcgatctgctcttggccggcctctcacaagttgtgaattgaaacctgcgtgatttnatttcgtttctgtaacgtcaagaagaacta

SEQ ID NO: 42079 - DNA, 101 bp, rice(Oryza sativa)
  misc_feature (71): n=a or g
tggcctaccatgcgcaatgtcaaagaacaccgagcacaagtttcaactccttaatctagaaagtctgggcnccggggaaatgcaaatttcatgcttggctc

SEQ ID NO: 42080 - DNA, 101 bp, rice(Oryza sativa)
  misc_feature (71): n=t or g
attatctgcactttaccattcatcctagtataactgttggactgtttctacttcataaacctcatatttanttatcaacctgctgccagggtttctttttg

SEQ ID NO: 42081 - DNA, 101 bp, rice(Oryza sativa)
  misc_feature (71): n=a or g
aagcatctgtatccaagctgaagagagcaaagtggcttgtgatgaagaaaaaaatggatgctgtaaagggncaataccagaagctattcaactaccaactt

SEQ ID NO: 42082 - DNA, 101 bp, rice(Oryza sativa)
  misc_feature (71): n=t or c
actgtaggagacaaacacctccatgtcagtcttgggagactactcgatccacacattcaccttcatcccgntgatgggctcaaccacagggtgagcggcca

SEQ ID NO: 42083 - DNA, 101 bp, rice(Oryza sativa)
  misc_feature (71): n=a or g
tatatataatctatataaactttatttatttcgttttatttgcacaatacatctgtgtttcactagtaganaaaccatctttggtcggtcgacccaaatcc

SEQ ID NO: 42084 - DNA, 101 bp, rice(Oryza sativa)
  misc_feature (71): n=a or c
tctcaagctgctacgtggctccctcaaaacgcttcgccacgtggcgcaacaagagagttgagaaccccctngggcccgcacgtgcagtgcatgggttattt

SEQ ID NO: 42085 - DNA, 101 bp, rice(Oryza sativa)
  misc_feature (71): n=a or g
caagcccatgtggcagtgtacagtgtgaaaagtggcaaaaaagtagaaaagtttctctatccaatggcatnttattaactaaaaatttaagaggggtattt

SEQ ID NO: 42086 - DNA, 101 bp, rice(Oryza sativa)
  misc_feature (71): n=t or c
atcaactgggactacatatcattttcagtcccggttgaaaaagtgtccgccctcctacccgttttattccngtttggaaacaccaaccgggacttaaaatt

SEQ ID NO: 42087 - DNA, 101 bp, rice(Oryza sativa)
  misc_feature (71): n=a or c
gacaaagttaattactcgatctgaaaaaaaacatatatatgcacattgctctcgttgcgttcatcattttntatataccaaagcatatgcatgccagttta

SEQ ID NO: 42088 - DNA, 101 bp, rice(Oryza sativa)
  misc_feature (71): n=a or g
acgtaataatgagtaatacatacgtagatgaaataactaggcaattatgtaggcaaatagccaatcaagcntctttgtttgcttgcgacaaaaaaatccct

SEQ ID NO: 42089 - DNA, 101 bp, rice(Oryza sativa)
  misc_feature (71): n=a or c
ttcctgtcgcgctcttgcgctgccgccacaagggccacttgcagcatacagtatgcgctatctacgatganatctaacctgtactgcattattattggcat

SEQ ID NO: 42090 - DNA, 101 bp, rice(Oryza sativa)
  misc_feature (71): n=a or g
attcgtagacaagaattggaacatcaaactgaagacagcaaccaagaagcttgacgatgttttcatggttnactcgagaaagtatgagcagctcatctgta

SEQ ID NO: 42091 - DNA, 101 bp, rice(Oryza sativa)
  misc_feature (71): n=a or g
gggtgtccgtagccttgattatttctttacttggtacagtcggctcataaacatgttcgacgaatacgtcngaaggagctgcttctcgctttgaaccgaaa

SEQ ID NO: 42092 - DNA, 101 bp, rice(Oryza sativa)
  misc_feature (71): n=t or c
taaatcgaccccgaacgagtttcgcaatctgccgttttctgaccgttatccccaacgctttaaatactaancgccgccctgaaaaatcttcaccccgttac

SEQ ID NO: 42093 - DNA, 101 bp, rice(Oryza sativa)
  misc_feature (71): n=a or g
ttgatgtagcaatctattgtatgtgtttgttgcactctattttattcgtgtgtttcatccttgttttatcngatgttgcacatgatgtacgatgttttagc

SEQ ID NO: 42094 - DNA, 101 bp, rice(Oryza sativa)
  misc_feature (71): n=t or c
cggcgctgcggaagctatggatgaacgaaaatcatggcgtcgcactggattttaaagggttggcccgcggnacgaaaccgcactacttccttcgtttcaca

SEQ ID NO: 42095 - DNA, 101 bp, rice(Oryza sativa)
  misc_feature (71): n=t or c
aaaatgtcaccgttttattgtttcctattacatactcatttttacaacaacaaaatttaggcatatagtanaatactacatccgtcacaaaatataagaga

SEQ ID NO: 42096 - DNA, 101 bp, rice(Oryza sativa)
  misc_feature (71): n=t or c
aggagctcgggaaaaatggggaaatggaagaggggaggccagggatgctttttatagcctcgggagtcganggggaggccggttagcggcagatttgaagg

SEQ ID NO: 42097 - DNA, 101 bp, rice(Oryza sativa)
  misc_feature (71): n=t or c
tagacagtgggtgcctacggggcctgtatacctgagggaccgtcgtgtacggtgaaagggcggtgaacgantgagagagaccaatgtgtgaagggggagat

SEQ ID NO: 42098 - DNA, 101 bp, rice(Oryza sativa)
  misc_feature (71): n=t or g
ctcctgattacgaatctgcatatatccaatgttaagttttgtagatagaaatttaactttatggaatgaangaagtatgttttgctacgtcactactagaa

SEQ ID NO: 42099 - DNA, 101 bp, rice(Oryza sativa)
  misc_feature (71): n=t or c
gcagtgaatctccaggataggacatgtggttgtttcaaatgggatgccactggtgttccttgtaaacatgntgtgtcagccatttacaagtcaaagcaaca

SEQ ID NO: 42100 - DNA, 101 bp, rice(Oryza sativa)
  misc_feature (71): n=t or c
atggtatattaggtttatttttaagtataaatacggttccatctattaaaagagcacatacctaagacaanggtaatatgtagtggtgatagataagtaaa

SEQ ID NO: 42101 - DNA, 101 bp, rice(Oryza sativa)
  misc_feature (71): n=t or c
ccctatagtagggacttatgttttttgagaatgattaaaatttagtcccattttaatccctccaaccaaanattatattagagctggctaatagcatgcta

SEQ ID NO: 42102 - DNA, 101 bp, rice(Oryza sativa)
  misc_feature (71): n=a or g
acgccattgtccacgtctcgttatcggtctgattgtgtgatctgttgtcaagcatagtccagtcagctacnaaatcggcgaggacctgggacttgatggtt

SEQ ID NO: 42103 - DNA, 101 bp, rice(Oryza sativa)
  misc_feature (71): n=t or g
acatctatatttttttttggctgttcaaattatagaaaaataaatcgagttgacaatactgccaaattttnacgggatagccatatattatctatctttat

SEQ ID NO: 42104 - DNA, 101 bp, rice(Oryza sativa)
  misc_feature (71): n=a or c
gttttccttttatttttccatctttttcgctattttttcgtgtttttccttatttttttaattgttagganacgtgttttcaaaaatattagagttgaaag

SEQ ID NO: 42105 - DNA, 101 bp, rice(Oryza sativa)
  misc_feature (71): n=a or g
gactgcagcccagacaagaatgagtagatgctcactccttcgacacagttgcagatcaaaagagccttttntttgatagctcatacttatcatgtctgtcg

SEQ ID NO: 42106 - DNA, 101 bp, rice(Oryza sativa)
  misc_feature (71): n=a or c
catagcataaaccaaaatccatactgtgatagtggtgcaaaatattatttattctaaaggcgtaatggagntgcaaattattgagtagtgcacatttttcc

SEQ ID NO: 42107 - DNA, 101 bp, rice(Oryza sativa)
  misc_feature (71): n=a or g
tagggatgcaagcgggccgaccagcaagttcactcataggtcaaataaatgataattcatgggttttcgcntcgtggtctggtttgctgtatctagatatg

SEQ ID NO: 42108 - DNA, 101 bp, rice(Oryza sativa)
  misc_feature (71): n=a or c
caaatcacaataaaataccaaaaaaattcatccgttgttcttaaaaaaaatccaccgcctccacctcgccnccgccgctacagagccgtgccgcagcctcc

SEQ ID NO: 42109 - DNA, 101 bp, rice(Oryza sativa)
  misc_feature (71): n=t or c
ttagattgaagcccatgctagatttgtcatcaatatataacattcttccctataattcacatgttggcttnatattggtagcaaaccaaatataaccaact

SEQ ID NO: 42110 - DNA, 101 bp, rice(Oryza sativa)
  misc_feature (71): n=a or g
agaactaccacttgctttatttactttttgtgtgagagactgtacatacataatttatctccttgtttctngtaatagtgctactatacggtatgttatgt

SEQ ID NO: 42111 - DNA, 101 bp, rice(Oryza sativa)
  misc_feature (71): n=a or g
gtttctttttagaatatgaatcaaaataaggaacctatatacgaaaatgtaatcgaatatcatcgaatacnttaacagagtgaatcgaatacggtaacgaa

SEQ ID NO: 42112 - DNA, 101 bp, rice(Oryza sativa)
  misc_feature (71): n=a or g
ttatccggctactcgcagctagttatcttgtctgattttcagctagttatcttgttcaagatcctacgtcntgaagatcgggacaacatctgtatcaagaa

SEQ ID NO: 42113 - DNA, 101 bp, rice(Oryza sativa)
  misc_feature (71): n=a or g
ttaaacaaaatattgctaagatggtgtttgaatctcctgaagatatcagattaagtgtttcacgcaaaacnaggtggtaataacgtgcgattaattgagtt

SEQ ID NO: 42114 - DNA, 101 bp, rice(Oryza sativa)
  misc_feature (71): n=a or g
ccgtgccacgtaaatctatcggtgaccgtctcgacctccatggaccgcactggtcggtcgggaatggcacngccccaagctagcctcaggcctcagccgtg

SEQ ID NO: 42115 - DNA, 101 bp, rice(Oryza sativa)
  misc_feature (71): n=a or g
tcaaatggctctcttgacctcaggatgtctgcttgactgaggtaggtggccagttgtctggagcccagacntagatatatatgcctattgagataagttgg

SEQ ID NO: 42116 - DNA, 101 bp, rice(Oryza sativa)
  misc_feature (71): n=c or g
gttgcgtcaccgtatttgggcctttgggccgtgtatcgtgttgggttctccattagggttgcatcgagagnggtttgcacgaccctaaactctatgtatca

SEQ ID NO: 42117 - DNA, 101 bp, rice(Oryza sativa)
  misc_feature (71): n=t or c
aacacatatatagggtacatatatgtgatctcttttcagctaatattaatttggagtaatctaaacagtanaggggcttttaactatttgccactgttaga

SEQ ID NO: 42118 - DNA, 101 bp, rice(Oryza sativa)
  misc_feature (71): n=t or c
tgtaagttatggatatgtgtaagttatggacaaaatattatccataacttacacacaaagggacaaaaacnagcaagattgctacttcatgcatatgcatc

SEQ ID NO: 42119 - DNA, 101 bp, rice(Oryza sativa)
  misc_feature (71): n=t or c
aaatttgaacactacattttggaacagaggggatacaccattttatcttaaaaacaatattaaaatcatantccatccatttcatattataagtcgctttg

SEQ ID NO: 42120 - DNA, 101 bp, rice(Oryza sativa)
  misc_feature (71): n=t or c
gcggggagcttggcggcgacactggatccgactgcaagttcgccgctcctccccacctcagatcgaaggangtggagctccgccgccggcgcagggctgcc

SEQ ID NO: 42121 - DNA, 101 bp, rice(Oryza sativa)
  misc_feature (71): n=t or c
aaaacataatagcctgaagttgaccttctatcatttggacaactagtccaatctgcatcacaataaccttncaccatcaggtgtttatttttcttgaacca

SEQ ID NO: 42122 - DNA, 101 bp, rice(Oryza sativa)
  misc_feature (71): n=a or g
agagaaaagtagtggtaatataataaatacagagcaatttgtttattttagtttgggtatgagttgtatgntagccttttagggcccatttgaatcgcggg

SEQ ID NO: 42123 - DNA, 101 bp, rice(Oryza sativa)
  misc_feature (71): n=a or g
gttactatgtaaaaagttgtcggtagctagcagaacgaacttggctagtgtttagttccacgccaaaattnaaagtttacgtcaaaattagaagtttgaag

SEQ ID NO: 42124 - DNA, 101 bp, rice(Oryza sativa)
  misc_feature (71): n=t or c
cggagacaatggagttggtggtggcgaagggcagcgatggtaccgtgtctctgatggcgagggctggcaanggacagcgatggtggctagccctcccccgt

SEQ ID NO: 42125 - DNA, 101 bp, rice(Oryza sativa)
  misc_feature (71): n=c or g
ctacgccgagcaggcacttactctcgaatccttgtgttgcgtggtgcagatccttgtaggggaaccgatgnggcccaaactcaacctcccaatcttcgcgt

SEQ ID NO: 42126 - DNA, 101 bp, rice(Oryza sativa)
  misc_feature (71): n=t or c
atgtagtaagtgggaagggaggaaagaacttcattcacaatggtcaatttgtccccatgagataacaaagnagtggttgctgagagtcttctcgctactct

SEQ ID NO: 42127 - DNA, 101 bp, rice(Oryza sativa)
  misc_feature (71): n=t or c
ttctttatactgcacattgaatttttagagatttccaataggattttgaaacgggaatgaggtgttctccnacctggaagcagcaaggatgcaattcccga

SEQ ID NO: 42128 - DNA, 101 bp, rice(Oryza sativa)
  misc_feature (71): n=t or g
agatattaatgatgtaatatagatctataattgactgttgtgtgggtgggctattaggttggttattatanatgatattttaatttttaagctagtagtag

SEQ ID NO: 42129 - DNA, 101 bp, rice(Oryza sativa)
  misc_feature (71): n=t or c
tcaatgtgaaagacgtggccgctagcgacgagcttcgacatgaggcatggacgttggaggacgcgtccacngacgaagacctctagcgtggggcgtggacg

SEQ ID NO: 42130 - DNA, 101 bp, rice(Oryza sativa)
  misc_feature (71): n=t or c
tcttcaccattcaattttcccacctaccttcaattctcaactaatcacacttatcctccatttaattttantttactttcttaataattgtgtcaaactct

SEQ ID NO: 42131 - DNA, 101 bp, rice(Oryza sativa)
  misc_feature (71): n=a or g
tctgcttgcttgtgctatgtttagttgttacccgtcctttatcaaccctaggtgataatttatctagctcntgatacttatgttgatctagctagaattat

SEQ ID NO: 42132 - DNA, 101 bp, rice(Oryza sativa)
  misc_feature (71): n=t or c
tcaactcacattagctataaatacaagatattctaagataggttgtgtgtatagatctaaagtttggatcnaaacttcagtcattttccaacacattaacc

SEQ ID NO: 42133 - DNA, 101 bp, rice(Oryza sativa)
  misc_feature (71): n=a or t
tgcgaatctcgcgcacgcagaaaccgctcccaaaccctagacgcaatggtggtcaccatcgatctccgggnggtcaccatcgatctccgggaggaggacga

SEQ ID NO: 42134 - DNA, 101 bp, rice(Oryza sativa)
  misc_feature (71): n=t or c
tatatatatatatatatatatataaaccatacagcaaccgggccatgcaactaaaaaaaagggcaactcangtggctgagccatctttagtcccggttggt

SEQ ID NO: 42135 - DNA, 101 bp, rice(Oryza sativa)
  misc_feature (71): n=a or t
ttagtttttttcctcttcgtctttgttgggccggggtaggaaagtacaagcacaattgagatttttttttnaaaaaaaatagcttatttgtttgtgtgttg

SEQ ID NO: 42136 - DNA, 101 bp, rice(Oryza sativa)
  misc_feature (71): n=a or g
tctttttagggattctttttacataaaatcaatttaaccttagtaagaatcggaatatatatagctaaggncatgtacaaagttaaagtcagatatgagct

SEQ ID NO: 42137 - DNA, 101 bp, rice(Oryza sativa)
  misc_feature (71): n=a or t
ctcggtgggatcaagattgccgatcggaccaaggaaataatggtgctcatgtgacagactcgggatcgtgnccagattggacaagtgctacagatgtaaac

SEQ ID NO: 42138 - DNA, 101 bp, rice(Oryza sativa)
  misc_feature (71): n=a or t
ggtcctgcttttttcctagtttggcaacttttgtttgatggatccagcattgttagagggcaatattggantttaggcagaagatgcacaaggaaacgaaa

SEQ ID NO: 42139 - DNA, 101 bp, rice(Oryza sativa)
  misc_feature (71): n=a or t
tcgctgttcgctctccccctccgcctcacctcattgcgccgccacacagaaaccgcatcagatcgaaaaanatcgccactcgccagtcgccgcctccgcgc

SEQ ID NO: 42140 - DNA, 101 bp, rice(Oryza sativa)
  misc_feature (71): n=a or t
tgtttagttttctgtgtatgctcactacactgattgtggttttcttcacaaagttactgcaattttttttnaaaaatattgagctgccacatagtctctta

SEQ ID NO: 42141 - DNA, 101 bp, rice(Oryza sativa)
  misc_feature (71): n=a or t
aaaaccaggcgtctatagccgtcataaagaggaacaaaaaaaaggccattgcggcgtttggtcgaacaccntgtgggcgagcgcgcgcgcttgaggacgca

SEQ ID NO: 42142 - DNA, 101 bp, rice(Oryza sativa)
  misc_feature (71): n=a or t
atttaagccccacgtgttagtgggtcccgtaattttttgtgagacaaaatgggaccccacatatttttttnaaaaaaatctaatgtcacgtaagcgctatg

SEQ ID NO: 42143 - DNA, 101 bp, rice(Oryza sativa)
  misc_feature (71): n=a or t
aacaaacctctcttgagtcagaatacactgaactagtactgaatgtcagctatattatcttgtactgctcntttttttttcatttctaataattctgatac

SEQ ID NO: 42144 - DNA, 101 bp, rice(Oryza sativa)
  misc_feature (71): n=a or t
tgtggccgtagcagtagactactactgctgcttctgaaaagcacagtggtatagctgctgctgctgctgcngctgttgttgcagctgcagctgcaatgctt

SEQ ID NO: 42145 - DNA, 101 bp, rice(Oryza sativa)
  misc_feature (71): n=a or t
cttgcatataaacgggtgtacccgttaacttccaagccaatcaaattgatctggattacatccaacggtcngaaagtttggagcccatgcaccatggtgcc

SEQ ID NO: 42146 - DNA, 101 bp, rice(Oryza sativa)
  misc_feature (71): n=a or t
ggtttccattttgttccacacaatttatgcatgcctcctttggaagtaggaattttataggtttttttgtnaaaaaaataaactagatcatgtaaaaatac

SEQ ID NO: 42147 - DNA, 101 bp, rice(Oryza sativa)
  misc_feature (71): n=a or t
tataagctgtctcatgcttgttactatatcccctgagtttcaaagacaatatcagacattggatgctcatncgataatcacgagactatgtaacatgtttg

SEQ ID NO: 42148 - DNA, 101 bp, rice(Oryza sativa)
  misc_feature (71): n=a or t
cgtatcgtcgccttgctcagtacgtggctacgtgcacctatcctcatcagctttctcgatcgttgcatatntttcaaaatttaagttagattcatattctt

SEQ ID NO: 42149 - DNA, 101 bp, rice(Oryza sativa)
  misc_feature (71): n=a or t
ttttttttggtaatttactttgcaatcctattgatgcctttgatgcgcattaagaacttgttttctgagantttttttttgggtgctcatggtctttatag

SEQ ID NO: 42150 - DNA, 101 bp, rice(Oryza sativa)
  misc_feature (71): n=c or g
taggcccaatacttttcggccttgcccatgtgcgtacaatctctcaaacactgcaaaatattattggattngatgacccaatactttcggctattctctat

SEQ ID NO: 42151 - DNA, 101 bp, rice(Oryza sativa)
  misc_feature (71): n=c or g
ggagtagctgcctagctgaccgtgccagagcagagtctgttctccgctcctctgttccgacgatcttttgnccaacccgccactccactccgtcaggcgtc

SEQ ID NO: 42152 - DNA, 101 bp, rice(Oryza sativa)
  misc_feature (71): n=c or g
cccccatcacatctcgaccatccaatgtgtatgtgtagagaaaaagttgccttcccacgccacgccacgcnacgcgacgcgcgaggcattggcgcgcgccc

SEQ ID NO: 42153 - DNA, 101 bp, rice(Oryza sativa)
  misc_feature (71): n=c or g
ccctcaaacaaatccatggaaaataaaaagagacactgtttcactcgggccacctcccttcctttttctcnctcaggcccacacggcctccctttcttctc

SEQ ID NO: 42154 - DNA, 101 bp, rice(Oryza sativa)
  misc_feature (71): n=a or t
ataccatttcagctggcagaccaatcgtcaagtctgtcttgcattcagacgatggcatgattttttttttnaaaaaaagggtcttgtgagaattttttttc

SEQ ID NO: 42155 - DNA, 101 bp, rice(Oryza sativa)
  misc_feature (71): n=a or t
ttctatgcctacctttgatacataaatgctatcgttctcacaaacgagcagtgctatacaaactttttttnaaaaaaaatcttatagaacttttacaaact

SEQ ID NO: 42156 - DNA, 101 bp, rice(Oryza sativa)
  misc_feature (71): n=a or t
ttggtttttgaagaattacctcctaaaatattaccatcatttgaattaccccatgaaattttaataccagntgcaactgttcaaaccggcaaataacacac

SEQ ID NO: 42157 - DNA, 101 bp, rice(Oryza sativa)
  misc_feature (71): n=a or t
acaaaattagcacaccggtcaagtataaggcaaacctgtagtgtaaattgcccaagaaatgcatttttttnaaaaaaagaagtgtatatttggacagtttc

SEQ ID NO: 42158 - DNA, 101 bp, rice(Oryza sativa)
  misc_feature (71): n=a or t
actctcttgcgaatcttggtgttgcctacattcaaaggtttgaacggtaaatatcatttcgacttccgttntcttccttctgattgttaacacttgtgaat

SEQ ID NO: 42159 - DNA, 101 bp, rice(Oryza sativa)
  misc_feature (71): n=a or t
acgagccaacgccccctcccgttgacctcgtgtgcatggtgttgacattaggccccaccataatttttttnctaggatgtggcgccagctaaaccagctgc

SEQ ID NO: 42160 - DNA, 101 bp, rice(Oryza sativa)
  misc_feature (71): n=c or g
tccacaccggcggccatagaggagaagtggaggggttttgtagtagcgatgtaacttcgtatgaaggagtnatgattttttttatgaaatagtattgctcc

SEQ ID NO: 42161 - DNA, 101 bp, rice(Oryza sativa)
  misc_feature (71): n=a or t
atagagcatgccaaaccaactcagagaaaagaaccccaacttcatggaatgaatgcactgttgtttttttnaaaaaaatgctagtgaagaaggttcaagct

SEQ ID NO: 42162 - DNA, 101 bp, rice(Oryza sativa)
  misc_feature (71): n=c or g
cgtatttaattttctctgcagacccattccggcgtcgggcgcgtgttctctcggctgtgcactgctactgntagtggtagtggacgaagactcgtcgtcgt

SEQ ID NO: 42163 - DNA, 101 bp, rice(Oryza sativa)
  misc_feature (71): n=c or g
tactaaaaggtgtttttattctatttaattaggagggatcatatggaggttagtttatcaacattctaaantatcaatattgatgctcatgattttgttaa

SEQ ID NO: 42164 - DNA, 101 bp, rice(Oryza sativa)
  misc_feature (71): n=c or g
cggcagccaagtattgttgcaactgcatcagcttgctcagtgtttatatgtggatttagaggtttaaacgnccccttcttcacacttccggaggatgatcg

SEQ ID NO: 42165 - DNA, 101 bp, rice(Oryza sativa)
  misc_feature (71): n=c or g
gcacctactaattaacaccaatgcatgcagtaatagagctagatatccatgcttgcgcatgaactcacatnatacaagcaagcatgcatatatctctggcc

SEQ ID NO: 42166 - DNA, 101 bp, rice(Oryza sativa)
  misc_feature (71): n=a or t
gacaggaaaataacacggaaaaatcgcaaaaaaaaaagatcgcgaggagggaatcggacaacgtacgaaanttttttggcaaaaacatcttaaacttttat

SEQ ID NO: 42167 - DNA, 101 bp, rice(Oryza sativa)
  misc_feature (71): n=c or g
aatttttccttccgcgctcatcataaatagcagcagctaataaactggcctgtaacccgcgcatttcgcanccatgcatggaccgatggaggagagagtcc

SEQ ID NO: 42168 - DNA, 101 bp, rice(Oryza sativa)
  misc_feature (71): n=a or t
attcatgtgttatatcaagaataatgtgtactactcattccaatgcactaaaaagtctaaaactgcatatntttcaaagtcattttggtcaaaaaaatata

SEQ ID NO: 42169 - DNA, 101 bp, rice(Oryza sativa)
  misc_feature (71): n=a or t
gaactttttccaatttgagggggattggaaaggcatgaccattggatgtgtgaatcctctacttttttttnaaaaaaaatctgtttttcctttactttccc

SEQ ID NO: 42170 - DNA, 101 bp, rice(Oryza sativa)
  misc_feature (71): n=a or t
ttcttcatgatgaacagagccaaaggtgagattttttttacatgaaaatgctgtctttttctaaagaactnggtgttggtttgcacttactgcccatgtgc

SEQ ID NO: 42171 - DNA, 101 bp, rice(Oryza sativa)
  misc_feature (71): n=a or t
aacgttcttttggaggacgtattttaaaaaacaccctcccatataccgtgtaggtgtagatttgtaaaaantttaataaataaaaaaaatccgttgtggcc

SEQ ID NO: 42172 - DNA, 101 bp, rice(Oryza sativa)
  misc_feature (71): n=a or t
aatacaaatgtttttcccacatgaatagttgaatacaaatatggtattagactttccgacggatacacatnttagaagtttaggtggatttcgtgttccga

SEQ ID NO: 42173 - DNA, 101 bp, rice(Oryza sativa)
  misc_feature (71): n=a or t
cgtgggacggtgggggctcgagactcctactggcaataaaaccatgagagctcccataaaaccctcactantttttttttatcatagggtctgttcacttt

SEQ ID NO: 42174 - DNA, 101 bp, rice(Oryza sativa)
  misc_feature (71): n=c or g
tcttaatctctaaaattattgagggatcgattagatatatatgcggccaaatctttgaatctttcttgatntctaaaattattgagggatcgtttagacat

SEQ ID NO: 42175 - DNA, 101 bp, rice(Oryza sativa)
  misc_feature (71): n=a or t
aaaagcttcagcgcctgtagtgggacaagaacagattactaactaaaactaactaactaaagccttttacngttcagatatcttagtgagatcaccattgt

SEQ ID NO: 42176 - DNA, 101 bp, rice(Oryza sativa)
  misc_feature (71): n=c or g
atttagtaaaaccgaaatactagcaaacaccgataaccatagttacatactcttatcacgagttagctcantgatctcatggaccatctcctctagttttt

SEQ ID NO: 42177 - DNA, 101 bp, rice(Oryza sativa)
  misc_feature (71): n=a or t
ttttttctctctttatggatttggtgattatcgtgtgtatgtttttcaatctcctaaacgatatttttttnaaaaaaatctttttaatatgtaattcattt

SEQ ID NO: 42178 - DNA, 101 bp, rice(Oryza sativa)
  misc_feature (71): n=c or g
ctaaacagggagcctggaatcggagctgttgcacagagaaaaagacaactgaggagcaacataaattatantcgctcacaattcgcagttcaagcaaccaa

SEQ ID NO: 42179 - DNA, 101 bp, rice(Oryza sativa)
  misc_feature (71): n=c or g
gctgtccggtgtgtggctgcaacctgatatcaaggtgagtagtaggtgggtgacaccggatctccaccagncaagaagcgcttggatcagaagcaaatcag

SEQ ID NO: 42180 - DNA, 101 bp, rice(Oryza sativa)
  misc_feature (71): n=a or t
gcgcacgatcggcactgacccgtattgggtcgacgccgatccaccacaaaacaagaacgtgtttttttttnaaaaaaaataaacacaaaaaatacatcaaa

SEQ ID NO: 42181 - DNA, 101 bp, rice(Oryza sativa)
  misc_feature (71): n=a or t
atttttcactcgagggtatcatctcattcgtgcatcccatataatcgtgcatgccatataaatagttattnaaaaaaataaaaaaaataaaaagataggtt

SEQ ID NO: 42182 - DNA, 101 bp, rice(Oryza sativa)
  misc_feature (71): n=c or g
ctccagttgctacagcaagttttgtaacatcagctggatgttccttcttttcatcctctttcagcaccgtnttactaccaaccagcaaaccatcagcctta

SEQ ID NO: 42183 - DNA, 101 bp, rice(Oryza sativa)
  misc_feature (71): n=a or t
ccattcgatggcctcctacgagaaaatcttggagctgggttgacacagctctagatccatttatttttttnaaaaaaacaattgtgtattgctagcttctg

SEQ ID NO: 42184 - DNA, 101 bp, rice(Oryza sativa)
  misc_feature (71): n=c or g
ataattataattaacagtacatttcctctaaaaaattaacagtacattaatctctcgccgtatccatcgcnggagcgcagaacgacgacgaggcatgtcgc

SEQ ID NO: 42185 - DNA, 101 bp, rice(Oryza sativa)
  misc_feature (71): n=a or t
cgagacaaactttctctctttcacatgttgtcgaaagcagccctactttaacaaatattgttagtcaaagnagcatcgttaagacaatgtcgaagtacaac

SEQ ID NO: 42186 - DNA, 101 bp, rice(Oryza sativa)
  misc_feature (71): n=c or g
tagttcaggtccagcaccttccactgtatcttaccagtgcaacggtggaaagccagggtgaacaacaacgntgaccgaaaacccatcaccttcctctgcat

SEQ ID NO: 42187 - DNA, 101 bp, rice(Oryza sativa)
  misc_feature (71): n=c or g
ccctcccctctcgcgccgccgctcgccggccgtcgaggtagtgctggtacacgtacgagagaaacccccanacggccatgagcatggctaccaccttggtg

SEQ ID NO: 42188 - DNA, 101 bp, rice(Oryza sativa)
  misc_feature (71): n=a or t
atttatatttgagttcccgttcgaggtcagtggccagttctagttgaaaaaatagtaaaaaaaggcaaaanggtgaaaagaaaaggaaataaaaagccgca

SEQ ID NO: 42189 - DNA, 101 bp, rice(Oryza sativa)
  misc_feature (71): n=a or t
gaagtatgagattgaataggcagggatgccagcctgacaagagaaagaatgccatgatgctttgttggtcntttttgaggagagagaaagatgagagatta

SEQ ID NO: 42190 - DNA, 101 bp, rice(Oryza sativa)
  misc_feature (71): n=a or t
agatctctctatcttcacgatgttcacttttgatttgaactgggcatttgaccatatatcttatttaattnatattattgttgtgacttgttttattatta

SEQ ID NO: 42191 - DNA, 101 bp, rice(Oryza sativa)
  misc_feature (71): n=c or g
tcgaattagacaggttgcgtagggttggcagtgttcctagttttgactttaatgtgaacctagtcattganaagtgggagcaagagattgaagcgaagttt

SEQ ID NO: 42192 - DNA, 101 bp, rice(Oryza sativa)
  misc_feature (71): n=a or t
ctcttcctattagcacattttcgtctccttttctctctcttctttcaatggatgcatgccgatgatgacangacagttcttctggtaaggaatttttacat

SEQ ID NO: 42193 - DNA, 101 bp, rice(Oryza sativa)
  misc_feature (71): n=a or t
aagtcaagatggccgagttggcgccagtttcagctaccggttcgaatcccattattgacaatacttttttntttttgcaaaatcttgattatttttttttg

SEQ ID NO: 42194 - DNA, 101 bp, rice(Oryza sativa)
  misc_feature (71): n=a or t
taattaataaacggcaacaacactttgcctgttcccatctgaaatcaacattgtatgcagagaagagtacnagacaatcctcgctgaaatcaacattgcat

SEQ ID NO: 42195 - DNA, 101 bp, rice(Oryza sativa)
  misc_feature (71): n=c or g
cccaccttttgcagacccattccctactcacatcgccaagtacgggacatttgatgatgcaaggcagtttntcaaggccttgacggtgaataacaagtacc

SEQ ID NO: 42196 - DNA, 101 bp, rice(Oryza sativa)
  misc_feature (71): n=c or g
tttctccccgcaaacaattccatgttgcaagatcctggacgaagaaacgacaagaccatgtaacaaaaccnttattttgtcgcgagacgaacaagaaacaa

SEQ ID NO: 42197 - DNA, 101 bp, rice(Oryza sativa)
  misc_feature (71): n=a or t
ttcaagggcttaaaatgtgattttgcctaaagtattctttgacctcataagttgaacaagaaaaggaacanagtaaacaaaatccggtgacatgttaaaaa

SEQ ID NO: 42198 - DNA, 101 bp, rice(Oryza sativa)
  misc_feature (71): n=a or t
ttgagggcctgggccttcttgcgaagcaggccagtcttcagatgcttaggttttgcatacagccctacagngtttcaactttggcgctgtttcaaatgcag

SEQ ID NO: 42199 - DNA, 101 bp, rice(Oryza sativa)
  misc_feature (71): n=a or t
aggccaaactaattccttcctggcatctattgctaagtgaaatcccctgctaatcatttgtgcaagaagtngcatcccagggtgcatcttgtaaatagcgt

SEQ ID NO: 42200 - DNA, 101 bp, rice(Oryza sativa)
  misc_feature (71): n=c or g
tggatagctacctcagctctccaggcgttgattcacagccaacagagatccttgactacgatgacttcagntacaactacgactttagcaacctcgacgat

SEQ ID NO: 42201 - DNA, 101 bp, rice(Oryza sativa)
  misc_feature (71): n=a or t
atctgtcggccggaagaggccggcgatgaaggatttcgccgccggcgtcaaggctggcagaaaattccacnagggcttcaaatccggcgccgccgcatggg

SEQ ID NO: 42202 - DNA, 101 bp, rice(Oryza sativa)
  misc_feature (71): n=a or t
gtcatgagtgcctcaaggatgtcacagactcacaaattcataaatgccggacatatagcattatttttttnaaaaaatcgttattcctttgaagcaaatta

SEQ ID NO: 42203 - DNA, 101 bp, rice(Oryza sativa)
  misc_feature (71): n=a or t
gacatcaccagaattcagcaaggcctaataagtacgtagttgatgtcataaaagcttgattataagagaanaaaattctctttaataaactttatgtctcg

SEQ ID NO: 42204 - DNA, 101 bp, rice(Oryza sativa)
  misc_feature (71): n=c or g
ggagcgcgaggccaagtctgccaagaagcgtaccacatgcatcgtagaggaatatgagcgcgtcatcttgnttattggctccctcacatgcctcctcttct

SEQ ID NO: 42205 - DNA, 101 bp, rice(Oryza sativa)
  misc_feature (71): n=a or t
gatcactgttatatattaaatccgttagatatgaagtacgtacctacatgttattagtcattcaaaatcanaaggcagatttgtttcagaaaaagggtacg

SEQ ID NO: 42206 - DNA, 101 bp, rice(Oryza sativa)
  misc_feature (71): n=a or t
attgactattttagtagcttccattcaagaatagcttctattatgctactcagcggtcctagctgtactcntaactatattattttgataagtttgatctt

SEQ ID NO: 42207 - DNA, 101 bp, rice(Oryza sativa)
  misc_feature (71): n=c or g
gctagaaaagggatagtcgaagataagatgcttgttaattatacatattcttgtcccccaaatcaagcaangcgaggaaaaggaactgactttatacaacc

SEQ ID NO: 42208 - DNA, 101 bp, rice(Oryza sativa)
  misc_feature (71): n=a or t
attttgtaatatataagtcacgaaaaataaatgattttctagaaaagtctctgtgacaacagctagagctntgccttcattcttttccatatgaaaaaaat

SEQ ID NO: 42209 - DNA, 101 bp, rice(Oryza sativa)
  misc_feature (71): n=c or g
ctaaggtccatacaccgataccctttgtgatctctgggatagccaagaaagacgcatgctgtggaacgaantgatagcttatctggagcagtggcggagag

SEQ ID NO: 42210 - DNA, 101 bp, rice(Oryza sativa)
  misc_feature (71): n=t or c
cctcgcaaaaaagaaaagtacaccaccagaaagaaattaaccatgcctgcttgccatagagggcgaacaangctatggctcgccatagcgttcgcttcttt

SEQ ID NO: 42211 - DNA, 101 bp, rice(Oryza sativa)
  misc_feature (71): n=a or c
gtcgccggagacttgcccggctgcccgagttactgattccattgttagcttgtacctgattccctactgcntgagtagcaacttggtgccatacgtggcta

SEQ ID NO: 42212 - DNA, 101 bp, rice(Oryza sativa)
  misc_feature (71): n=t or c
tctctcaaataattttggtctgcttgatgttggcaaaccttttgatgaccgcataaaaaaactttatctgnagcagtacaagaaaccgttgtccccagctg

SEQ ID NO: 42213 - DNA, 101 bp, rice(Oryza sativa)
  misc_feature (71): n=t or c
gaattcctcataaaagcacctaaattctccccataaagccactctcccaactactcgaacaaaacaaacanaagaatccaaccaccaaccaacactcccag

SEQ ID NO: 42214 - DNA, 101 bp, rice(Oryza sativa)
  misc_feature (71): n=t or g
tgactatattgctgaatgttactctgtggaagcatttagaagtacctatgaccactaccttcagcccttanaaggtatgagtgcttggcctcaggatgata

SEQ ID NO: 42215 - DNA, 101 bp, rice(Oryza sativa)
  misc_feature (71): n=a or g
tcagaaatggagccaaccggaagtcggctataccaatgaaaagcagcccctgttagagaaccagagaactntcttaagagaagagatgggttacgtgcagt

SEQ ID NO: 42216 - DNA, 101 bp, rice(Oryza sativa)
  misc_feature (71): n=a or g
aaaaccgcatttggttttactgttcatgcagggcttatttgtattgttcaggactcaggagattagtcagngttcagagtcattggatctaattcatgtga

SEQ ID NO: 42217 - DNA, 101 bp, rice(Oryza sativa)
  misc_feature (71): n=a or g
ataacaagcactcttggcaacagagaataactaaacctgcagtagttttcgaactaaacaaggatagtcanttactatttctatatggtgaatgcaaaatt

SEQ ID NO: 42218 - DNA, 101 bp, rice(Oryza sativa)
  misc_feature (71): n=t or c
ttgttgcactataaatagcctctagtgctttcatgcttcacaaagaacataactagcggaatgctattctngaggaacttatggcccaaaaggaaggactc

SEQ ID NO: 42219 - DNA, 101 bp, rice(Oryza sativa)
  misc_feature (71): n=t or g
gtctttaaaatagatgtagatgaaagtctgggcattgctaaggaaaaattatacgatagtaactaaacgtnaggtacaaagtaaatttgctttgtagttaa

SEQ ID NO: 42220 - DNA, 101 bp, rice(Oryza sativa)
  misc_feature (71): n=t or c
tttgcttggtagggacgatttgctgccccgctacaggctacagctacagctacaactgttgatgttgttgntgctgctgctgctattatgttactgccacc

SEQ ID NO: 42221 - DNA, 101 bp, rice(Oryza sativa)
  misc_feature (71): n=a or g
gcaggaggtaccatggatattagcggcgatacgttataccttagtgtcaattactttggcaccaatccttngtaggattaaatgtaagaagttacaagtct

SEQ ID NO: 42222 - DNA, 101 bp, rice(Oryza sativa)
  misc_feature (71): n=t or c
cccatggcaaatcttggcaaaatttgcacaaatcaactcacctgatgccccaaatcggccaaatccacccnggaaattctgccgccgcgcgatcgagctac

SEQ ID NO: 42223 - DNA, 101 bp, rice(Oryza sativa)
  misc_feature (71): n=t or c
gacacaagcagccgtggtgaagttggatgcgggagtgagtggatggagacctcaagtggaatcagcaattnaggggttgcgcgaggaagtcagcgaacttc

SEQ ID NO: 42224 - DNA, 101 bp, rice(Oryza sativa)
  misc_feature (71): n=t or c
ccgccgccgccttcactccgccctctttctccatctcgacgactcccccaacaacacctaccccccaaacntctctctctctctctctcagacgaagacta

SEQ ID NO: 42225 - DNA, 101 bp, rice(Oryza sativa)
  misc_feature (71): n=a or g
gatgcttacaattcatcaaggcaagaatggagaaacattaattttcctcttattgtgcatcattaaggccntaaaatactcattgatttcatcatatttac

SEQ ID NO: 42226 - DNA, 101 bp, rice(Oryza sativa)
  misc_feature (71): n=a or c
acccgagccgagccagtaaaaccccacccaaatcccaacacctgcaactgcaagtgcaaccccccttcctngcagattcgcatcgaatcccgatctgagct

SEQ ID NO: 42227 - DNA, 101 bp, rice(Oryza sativa)
  misc_feature (71): n=a or g
cctgcacagttcaaacttgaacttggctggttcctttgggatgatttttgtgaccgtgttatagaaatctngaataagccagttaaggaccgcaaccctgt

SEQ ID NO: 42228 - DNA, 101 bp, rice(Oryza sativa)
  misc_feature (71): n=a or g
cgccgccttctccgacaggtacttctgcaagtacaacactccgtgttactctctagctgcagcctcttcangtgctgtgcgaggagaggaggaaggggatt

SEQ ID NO: 42229 - DNA, 101 bp, rice(Oryza sativa)
  misc_feature (71): n=t or g
cagtctagcagaaacaccagtctgaatctgtatctgttcttgagagtgggttcagttggcttgcatcgccnagagagcaagaagccgtgtatgattttata

SEQ ID NO: 42230 - DNA, 101 bp, rice(Oryza sativa)
  misc_feature (71): n=t or c
agtcacttataaatattaaggtctgtgtagcagacgcattgctcggaattatttcgcttttagaccactgnaaagcttacggttacgggcacatcgtataa

SEQ ID NO: 42231 - DNA, 101 bp, rice(Oryza sativa)
  misc_feature (71): n=a or g
aacaacattttatcctcactcttgcggcgttgtgttttggttttcgtcgacgataatctgatctatagccntatgttggaggaacatgttaatcatttgag

SEQ ID NO: 42232 - DNA, 101 bp, rice(Oryza sativa)
  misc_feature (71): n=t or c
agcagcagcgatgcctcgtaccctcccgctcgctaggatcaaggaggtcgattcaacgttgacacccaagnaagtgattgcatggtgacgtgctagagaag

SEQ ID NO: 42233 - DNA, 101 bp, rice(Oryza sativa)
  misc_feature (71): n=t or c
tgaaatatcatgcaattcagagaaaaagaacttgcctgtccactaagtactgttcctccactctctttaanagcatctgccgctttcttaaatttttcaaa

SEQ ID NO: 42234 - DNA, 101 bp, rice(Oryza sativa)
  misc_feature (71): n=a or c
caaccggaatcctgcaaaagaagccatcaccaagaatactggtaagaaagccaagaagcaggtcaaggggnagaaggaagattgcaatggaggcagcgagg

SEQ ID NO: 42235 - DNA, 101 bp, rice(Oryza sativa)
  misc_feature (71): n=a or g
agagaggagtgtgattagttgggggagtgatgcgatggcccgaattagcaaggggaaatcaggtttaatcngccgattggattagattagattagattaga

SEQ ID NO: 42236 - DNA, 101 bp, rice(Oryza sativa)
  misc_feature (71): n=a or g
cttaaatcatccaaatacctaatccctatgtcttcaagacgcatgctcccttctggtgcaacgaagccctntgccacccacatgccaacaatctcatctcg

SEQ ID NO: 42237 - DNA, 101 bp, rice(Oryza sativa)
  misc_feature (71): n=t or c
ataatttatgtaagattaggcctaggaaagaaagaaagaaagaaaggatggatgaagaagaagaggtctcnggccggccgggcgccggctcatccctgcct

SEQ ID NO: 42238 - DNA, 101 bp, rice(Oryza sativa)
  misc_feature (71): n=a or g
tgaagtagtagcaaaatgcttataggatatatgctcaacaagacgaataccattaccagctagagattgcngagaagaagtgatgagagatcgcagcgcga

SEQ ID NO: 42239 - DNA, 101 bp, rice(Oryza sativa)
  misc_feature (71): n=t or g
caagatgagaattgcaaaccctggcacgatcgatacatcgataacctgagccatctacttattcttgatcnaatgattcaaatcgacagaggtcgacggcc

SEQ ID NO: 42240 - DNA, 101 bp, rice(Oryza sativa)
  misc_feature (71): n=t or g
accattctcagcagcccgagaagctgtcaaaagaagacttgagcaccagtcagggacagaaggagccaaantcaagctctggtcttccaaaagagctcgcg

SEQ ID NO: 42241 - DNA, 101 bp, rice(Oryza sativa)
  misc_feature (71): n=a or c
attaattaggaataagatgtttatgtgatgtcaacatacctgtgggccaaaagaatccagctaatataggnaacataaatgatagagatgatatttccaga

SEQ ID NO: 42242 - DNA, 101 bp, rice(Oryza sativa)
  misc_feature (71): n=a or c
aatcagttcaagaaatacatagaggagatggccgaggaaagtcttcgatgtgttgcttttgcttatagaantcttgatctgaattatgttccaaatgagga

SEQ ID NO: 42243 - DNA, 101 bp, rice(Oryza sativa)
  misc_feature (71): n=t or g
tagggattttggcctggtggaggcggaggtatattggttggcataggacccattgaacctggcatcctaancacctgcggctgacctggtattggcggtgg

SEQ ID NO: 42244 - DNA, 101 bp, rice(Oryza sativa)
  misc_feature (71): n=a or g
cacaagtatcgaaatggttagcggtgatgtaggagtagtagtgtactacctgctgctagtattagtggtgntgcaggggtgcaaaggcagcagcgcggtgc

SEQ ID NO: 42245 - DNA, 101 bp, rice(Oryza sativa)
  misc_feature (71): n=a or g
atggcaattgctttggcatctcgccaattggtagagatttcatggggatttcatggagaaaggagaaagcnagacaaggaagctagaggcagaggtaagcg

SEQ ID NO: 42246 - DNA, 101 bp, rice(Oryza sativa)
  misc_feature (71): n=a or g
tgccgctgagcgcgaggttgaagcaagagccgcttcccgcaaaacatcttgattatgctgacgaattctcnctcgttgggctttttccagagcttttttgt

SEQ ID NO: 42247 - DNA, 101 bp, rice(Oryza sativa)
  misc_feature (71): n=t or c
ctttatctttttcagtaaaagaaccattttctttgattcgactccctcctctgggtgcaaaatatcatccngtatgcaggccctgcggagcttgcgaggag

SEQ ID NO: 42248 - DNA, 101 bp, rice(Oryza sativa)
  misc_feature (71): n=t or c
tggtgaagaagccgaaggcacaaacgattggctttgctaggagcattcacagtgcacaataacctcaccanggccgagtggcttgtcctgctcctgctcag

SEQ ID NO: 42249 - DNA, 101 bp, rice(Oryza sativa)
  misc_feature (71): n=t or g
tctccagatcgagacgggaaatacctcagatcaatccctcgatctgccctgcccgaccgagggaactcgcntcggcggcggcggcgaggaagacgacgacg

SEQ ID NO: 42250 - DNA, 101 bp, rice(Oryza sativa)
  misc_feature (71): n=a or g
atgtcaccataccaacttgtctacaggaagacttgtcaccttccggtagagttagaacacatggcacactnggctatccagacttggaacatggatctaaa

SEQ ID NO: 42251 - DNA, 101 bp, rice(Oryza sativa)
  misc_feature (71): n=t or c
ggagctcactcaaatctatttagaggaggaaatttactggcaaaggagaagtggagaaaaatggatgatanagggggatgctaatacctccttctttcatg

SEQ ID NO: 42252 - DNA, 101 bp, rice(Oryza sativa)
  misc_feature (71): n=t or c
agaacacacatgtgatatgttgaatgatgcttactaaccagaagtgtcaaacttaatggctccaccagtangggatcctgaggcgccccaagtcccatttt

SEQ ID NO: 42253 - DNA, 101 bp, rice(Oryza sativa)
  misc_feature (71): n=a or g
gagagatgcagtgaggcaccggaatctgaaatcttggcatttgtggatggtctgtcaaaggcaattcagtngacttcactcccaatagtggttgagacaga

SEQ ID NO: 42254 - DNA, 101 bp, rice(Oryza sativa)
  misc_feature (71): n=a or g
aaaaggccagccacgcataagaccagcacgccgacgacgaaccagaacgccacacaagcgacggacagctnggtcgacccgtcgagctgcaggttccaatg

SEQ ID NO: 42255 - DNA, 101 bp, rice(Oryza sativa)
  misc_feature (71): n=t or c
gcagatagctgctggtattattaatcttggtgatatgggatacaagacactgtcaaagtactgccaagaanttctgccagatggttctggctcccccttgt

SEQ ID NO: 42256 - DNA, 101 bp, rice(Oryza sativa)
  misc_feature (71): n=a or g
gtctttaaatcagagaagtaacggatttgtaattgttttgcgcagggatcatcatcaacatcgtcgtctcnctaaatcaactgcttcttggcggctgaggg

SEQ ID NO: 42257 - DNA, 101 bp, rice(Oryza sativa)
  misc_feature (71): n=t or c
tagctccgtcgtgtaatctcgagaggtttgcaaagccaattaagcgtaagatcgatcaatggcgccgcgangcctggctgctcttgcacccctggccgtgc

SEQ ID NO: 42258 - DNA, 101 bp, rice(Oryza sativa)
  misc_feature (71): n=a or g
catgccagtcctttcaataactcaaagttactgaatcgcagatttgcagattttgttctagttgccacttncagctccacggttagataaatcttccaagt

SEQ ID NO: 42259 - DNA, 101 bp, rice(Oryza sativa)
  misc_feature (71): n=t or c
tcatgattttccttaaatggacaggctactgcagaggagaaattcaagcactgcagtgcagcataccaaanattatgtgatagtttggcctctgcataaac

SEQ ID NO: 42260 - DNA, 101 bp, rice(Oryza sativa)
  misc_feature (71): n=t or c
atggcatagtcctcggcaaggaagttttagggagtgtaggtttgatagactacaagcatttgagccacttngaaaagtaaggtcagaagctggggtgactg

SEQ ID NO: 42261 - DNA, 101 bp, rice(Oryza sativa)
  misc_feature (71): n=t or g
aggtacatcttcgtctatcatctagtataattatctgctactaattaagtttcgctcactacaggtggcantccctcgatgtacaagccggccatgacaag

SEQ ID NO: 42262 - DNA, 101 bp, rice(Oryza sativa)
  misc_feature (71): n=a or c
gaacattctgaatagtccccagaacgatctcagcattcagatgatcagccaatctggatatgaactgactntcaataggcagttgctgattcatcagagac

SEQ ID NO: 42263 - DNA, 101 bp, rice(Oryza sativa)
  misc_feature (71): n=t or c
cccatttgtcaccatctttcactgggacacccccccaggctctggaaagcaaatacggaggcttcctgagngaaaacatagtgtaaattatttaccactac

SEQ ID NO: 42264 - DNA, 101 bp, rice(Oryza sativa)
  misc_feature (71): n=t or g
cttgagtgatcctgtttctttgatggtgtatgacttgtattttcaaatgtaataccgccattgcttgaacntgaacatcccatttcaggcgaactgcgccg

SEQ ID NO: 42265 - DNA, 101 bp, rice(Oryza sativa)
  misc_feature (71): n=t or c
ttcattttctgaatcatagatgtataattgagcgaatttcggaggtgaaccacgagatcgcacaagagtancaattcggtggtgcacaactccattgatct

SEQ ID NO: 42266 - DNA, 101 bp, rice(Oryza sativa)
  misc_feature (71): n=a or g
gcagggggaggtcaaacagtaccttgtctgcaatgttttcagtaagctatcacagtatgcacgtgctgacnacaggtcaacttttccagtatctattatta

SEQ ID NO: 42267 - DNA, 101 bp, rice(Oryza sativa)
  misc_feature (71): n=a or g
ccgacaaacaagtgtgtgttggttacaactcagatggattgcgtcttttttaggtttttggactcaacaantagagcgtatggaagccggaacagcaatgc

SEQ ID NO: 42268 - DNA, 101 bp, rice(Oryza sativa)
  misc_feature (71): n=a or g
gcggtgatcacggtggcgccggagtcgaccacgaacgactgctccattccgcgccggttgacgatgagtcnggcggcgacgagggcgtccgccccggcggc

SEQ ID NO: 42269 - DNA, 101 bp, rice(Oryza sativa)
  misc_feature (71): n=a or c
gacctataggacaattaagcatttgagaagctccaatagtatcagattcctctaaccctatagtgaaaacntcactcttgtggtaattaatttttagacca

SEQ ID NO: 42270 - DNA, 101 bp, rice(Oryza sativa)
  misc_feature (71): n=t or c
attctttatccctgcaatcgactctgatcctccaactgtaaccagtccctggcaacagacgatcttcaagntctctattgaccagaggccactccagattt

SEQ ID NO: 42271 - DNA, 101 bp, rice(Oryza sativa)
  misc_feature (71): n=t or c
tctagtcccacaaaaataaacagcaattcaacccattaagcaaatcatggagaagcatcaacatgtttccnagctctagtctgggaagtcaaggcctcagc

SEQ ID NO: 42272 - DNA, 101 bp, rice(Oryza sativa)
  misc_feature (71): n=a or g
ttctaaatgccagcgtgctcaaggtgatgacatttcgagtcggtgtgagattgagcaaaaagtggctgtcnaatcagcgcaggctacttcgcttgagggaa

SEQ ID NO: 42273 - DNA, 101 bp, rice(Oryza sativa)
  misc_feature (71): n=t or g
aggtccgagtccatatcctccatgtcgtcgtcgaggtcaaggctgtcagtcaagaactggttgattccacnggtgcctgctgctggaattgttgcttctgc

SEQ ID NO: 42274 - DNA, 101 bp, rice(Oryza sativa)
  misc_feature (71): n=a or g
tacgctttggccgtgaagcgcatgggagggagaggggagaccttgtcgacgttgaactcggacaggtcctngtcgtggtagcgggtgtagtaggtttcgcc

SEQ ID NO: 42275 - DNA, 101 bp, rice(Oryza sativa)
  misc_feature (71): n=t or c
gaatggtacaggagaatctcagcttctaagcaatccttgtggaaaaagatgggaatagctaagtgtctgtnactatccctagccgatatgccaaaaaatga

SEQ ID NO: 42276 - DNA, 101 bp, rice(Oryza sativa)
  misc_feature (71): n=a or g
caatgtgtacgtgtgcaccagcctgctcaacatgtactgtaagctgggcattgtttctgatgctcgcagantgttcgacggaatgcctcagcgcaactcat

SEQ ID NO: 42277 - DNA, 101 bp, rice(Oryza sativa)
  misc_feature (71): n=t or c
atggctagaaagtcatgcaatcctgcatttgctgctgcacagttaaaatttgaagagttgacttccaattngacggtcagtaggtccaacagtctggatgg

SEQ ID NO: 42278 - DNA, 101 bp, rice(Oryza sativa)
  misc_feature (71): n=t or c
gatgttgtgatcttctttgacaagagatgtgaagaggactcaagcattgagatggcgacctctctagcttnggccaacagcttgatcaccctggagccctc

SEQ ID NO: 42279 - DNA, 101 bp, rice(Oryza sativa)
  misc_feature (71): n=a or c
aatttctctctctctctctcaggcagctataggtttgatcaccatgaaggagaaactgaaggcgaggtttnagatcatcgccgtcttgctcgccttcgcca

SEQ ID NO: 42280 - DNA, 101 bp, rice(Oryza sativa)
  misc_feature (71): n=t or c
taggaataatcatggcctatcagatatgctctgcactttctatgggaaccacggtattcctttccgattgngggatcattgttcaaactttgcaacaggat

SEQ ID NO: 42281 - DNA, 101 bp, rice(Oryza sativa)
  misc_feature (71): n=t or c
gaagatgtagatgaagcggctgaacacattagtgaaacaagggaacaaactactccagctgatccacctgntcctcaaagaacaccatcacctccagtacg

SEQ ID NO: 42282 - DNA, 101 bp, rice(Oryza sativa)
  misc_feature (71): n=a or g
tgccgtttcaggatcatagaattgttcaagtcaaaacaggatggtcaagaaagagaaagaggtagaatccngaatcaattacaagaggataaggtctgata

SEQ ID NO: 42283 - DNA, 101 bp, rice(Oryza sativa)
  misc_feature (71): n=a or c
cctatcggtgtcacctttgtagccatcaaactacagcaccccctccctatcgccatattctccttacaacnttgtttcatcttgatatcgctgttggatcc

SEQ ID NO: 42284 - DNA, 101 bp, rice(Oryza sativa)
  misc_feature (71): n=a or g
cgcggcgacggctgggaccgatgcactatatcctgtcattctccgatgcgccgatcttcttctccccaccnactggcctcgagctcgtcggatctgcacgg

SEQ ID NO: 42285 - DNA, 101 bp, rice(Oryza sativa)
  misc_feature (71): n=t or c
tatattgcatgtacgaaggccactgaccccgagttctacaacctcagccttttgagcatcacttagattcngatgggatcataagaatgccacttggtcat

SEQ ID NO: 42286 - DNA, 101 bp, rice(Oryza sativa)
  misc_feature (71): n=t or g
tctgatgtggcgccaaggaagccgatgaaacaggttgatgctagagatgatgtgaggaatgtggaattgcnaggagagggtatggaatcggataatgggga

SEQ ID NO: 42287 - DNA, 101 bp, rice(Oryza sativa)
  misc_feature (71): n=a or g
ccatgttgcagcaacccaaccatctgaaatgtagctttggatctcaacgtacttgatgtaaccgtggacancggcaatgtcccgaaattctcgggcatcgc

SEQ ID NO: 42288 - DNA, 101 bp, rice(Oryza sativa)
  misc_feature (71): n=a or g
aacttgtttgttaatcctcgttcacagaactacacctgtgcagaatgactgaagaggattctggtagagcncacgacacgctaacaatgacaaaatcgaag

SEQ ID NO: 42289 - DNA, 101 bp, rice(Oryza sativa)
  misc_feature (71): n=a or g
ctggcgtctgggtttgttactggatcgaaaggactttctctcaatatcgcgtccaagttccgcaactgatnagcgggcattctcgctgctgcggacgcact

SEQ ID NO: 42290 - DNA, 101 bp, rice(Oryza sativa)
  misc_feature (71): n=t or c
gttgtcatagctagtagcccgcaagtcgtggtcgttgtagtagcccacattgcaaagccgcggcaagatcnacgatttgtcttggatccgcctaggctcca

SEQ ID NO: 42291 - DNA, 101 bp, rice(Oryza sativa)
  misc_feature (71): n=t or c
tgctgcagagaggcgcacgacgactataaaaggagagtgcaggtatcttcctatagtagctagctaattgnattatactagcttgcttgttcaattcaatc

SEQ ID NO: 42292 - DNA, 101 bp, rice(Oryza sativa)
  misc_feature (71): n=t or g
cgataaccatagttacatactcttatcacgagttagctcactgatctcatggaccatctcctctagttttntatacgatgacccaccaatctccatggcct

SEQ ID NO: 42293 - DNA, 101 bp, rice(Oryza sativa)
  misc_feature (71): n=t or c
tttcactattttttttctgtcagtgacaatgtgaaaatttattggacagacgactagcttgtggtactagntaggaaattccctatcctcgatatgaacaa

SEQ ID NO: 42294 - DNA, 101 bp, rice(Oryza sativa)
  misc_feature (71): n=a or g
taaagaactcatcaccactctctcagattcaccatcaagtgcgctggttgcctcatcaagaagaagaatgnctggacgcttaagaagagttcttgcaatag

SEQ ID NO: 42295 - DNA, 101 bp, rice(Oryza sativa)
  misc_feature (71): n=t or c
gacgtggccacctcttgtaatacaagttgcaacgccagaacaaaacaaaatttgcccatttggacctgttnagttgtaaaaaattttatccctacatgtta

SEQ ID NO: 42296 - DNA, 101 bp, rice(Oryza sativa)
  misc_feature (71): n=t or g
ggcctggattgctgaggtgcgagagctggcccactgtgttgaggatgtacttgataaatattcatatcatnctcttaaattggatgaagaaaatgctgtga

SEQ ID NO: 42297 - DNA, 101 bp, rice(Oryza sativa)
  misc_feature (71): n=a or g
caacaccatgcccaactgcagtactcaagcacagcatttgaggtcatcacagctgcaatgtggaagtgtcncacagtagctctcgggtatgtgccggacca

SEQ ID NO: 42298 - DNA, 101 bp, rice(Oryza sativa)
  misc_feature (71): n=a or g
atggatcatgcatgggagaatgtcaagcgaaggcttggcgagtgccttgtcgaacacagatggattgatcnaggccataggaagtaagttgctaagaatca

SEQ ID NO: 42299 - DNA, 101 bp, rice(Oryza sativa)
  misc_feature (71): n=t or g
ggatatgtgtcccattcagaatatgcaaaacatacctcaatgccttcaaagccgctaaccgtgcagcaaanttaacctcatgatggagtatccaattcaca

SEQ ID NO: 42300 - DNA, 101 bp, rice(Oryza sativa)
  misc_feature (71): n=a or c
cgacggatgacgaggtcaagattcttgaggtcctcgtggcccatttcaagagccacggcactcagcttaangttgaggggatcatcgctgctgtcggcgat

SEQ ID NO: 42301 - DNA, 101 bp, rice(Oryza sativa)
  misc_feature (71): n=t or c
aattcatatagatgctaatgaatatagacgaaaatgaaaaaggccaaaacgccttaaacacatacctgaangtacggggtgaggagagagagctgcagcgc

SEQ ID NO: 42302 - DNA, 101 bp, rice(Oryza sativa)
  misc_feature (71): n=a or g
aacaataaagctgctaacgatagtaattacggataattggaccctcaggccccgccaacttcttccacacnggcggacacagcatggaaggcacggacacg

SEQ ID NO: 42303 - DNA, 101 bp, rice(Oryza sativa)
  misc_feature (71): n=a or g
tattatttccctgcagttacataatcctgagccagaatcaattgatatcgaaccacctaaagaaaacacancaggtaggcgactgtgtttttggagcatgt

SEQ ID NO: 42304 - DNA, 101 bp, rice(Oryza sativa)
  misc_feature (71): n=t or c
caataaactgcaatgtctagtagtacaagattaccatgaggagtgcatgactacgagaagactcagtattnaacttcgtgtttgcagcaacacgatgagcc

SEQ ID NO: 42305 - DNA, 101 bp, rice(Oryza sativa)
  misc_feature (71): n=t or c
tgaattcactgctctgttcatcttcttcagaagaattgaaatgccatgttgccatggatgatgcattgccnactggccattacatgatgctgcagggttgc

SEQ ID NO: 42306 - DNA, 101 bp, rice(Oryza sativa)
  misc_feature (71): n=a or g
tgtcagctgatgaagctcttggaggcaaaggcccaaaagtaaaagtactacactacaccaccggttaaacnaaaagcattggctcatggttgcgatgaatc

SEQ ID NO: 42307 - DNA, 101 bp, rice(Oryza sativa)
  misc_feature (71): n=a or g
tatcagcgatgtagcgaaatcgtgttccgtccgccccacggatttcacctatccgatgaagcatcttagcnagactgactccaagcaactgtttctcggca

SEQ ID NO: 42308 - DNA, 101 bp, rice(Oryza sativa)
  misc_feature (71): n=t or c
tacccccgaggcctgacagaacctctaccgaagcccaagacctccggtaaaattaacacaaaaagatcccnacctttgagcggcatgcgggttccgtcgaa

SEQ ID NO: 42309 - DNA, 101 bp, rice(Oryza sativa)
  misc_feature (71): n=a or g
acaaaccaaactaaagcttcaaatccacaccaaacacaaacacaaaacctcacaaatttcgccaagtcgcngcacacgtcacggacacgtacacagaagga

SEQ ID NO: 42310 - DNA, 101 bp, rice(Oryza sativa)
  misc_feature (71): n=t or g
cattaaagaacaataaatatatactcatttgggatgggccacagcaaggttaatttctaaataggaaaagnttttactcatattaaaaagcttccaaatgt

SEQ ID NO: 42311 - DNA, 101 bp, rice(Oryza sativa)
  misc_feature (71): n=a or c
gtcctccaaatcacgctgtagaaattattagccatacgcatgtccttcaaagaagtggtaacagcaagtgncacatttgcctgtatgataaaaagctgcct

SEQ ID NO: 42312 - DNA, 101 bp, rice(Oryza sativa)
  misc_feature (71): n=t or c
tggtaggaaaaggaatgatgctggaagtcagattaagcgcaatgttcgccttccttttcttttgttatgtntatgcttgtatatgcatataaatttgaact

SEQ ID NO: 42313 - DNA, 101 bp, rice(Oryza sativa)
  misc_feature (71): n=t or g
ttgtgctgctgtagttcaacgaccgcgaattacaaacacagcttataaccttcctccgtcccatcaaaccngacgttctaagatttctcaattaaattagt

SEQ ID NO: 42314 - DNA, 101 bp, rice(Oryza sativa)
  misc_feature (71): n=a or g
gttttttttttacggcgatgaattgcatctgacagttgagttgagttgagcgcttcagttgggttggggtntgaacttggtgatgaagttgtagataaggt

SEQ ID NO: 42315 - DNA, 101 bp, rice(Oryza sativa)
  misc_feature (71): n=a or g
atccttgccatcctcatcgatcgatccatttcgcgagctagctaacgagaggtgtttgatggcagaggagnacggcgacccgtacagggtgccgacgaggg

SEQ ID NO: 42316 - DNA, 101 bp, rice(Oryza sativa)
  misc_feature (71): n=t or c
atacttgccgaaagtgctgatcgaaaacaacaattggcttcttgggttgctgacaagaaaaaagtcagtgnacatgctatggatctgaagcagctagacaa

SEQ ID NO: 42317 - DNA, 101 bp, rice(Oryza sativa)
  misc_feature (71): n=t or c
agccgaataaggcccaatatcacccgcttgtgcctcaagccctaacctagcccaacgtcattcccggcgcngaatccccccgaaacacacgatccttcccg

SEQ ID NO: 42318 - DNA, 101 bp, rice(Oryza sativa)
  misc_feature (71): n=a or c
tctggactagtgggcatgacagtgagcttatcgcctttaaatttggaaactgcatggtacgtacctcagtntgaaaatataacaatttctgagatccccaa

SEQ ID NO: 42319 - DNA, 101 bp, rice(Oryza sativa)
  misc_feature (71): n=t or c
cgatcttcctcctcttgccaacccttctggtctcccaccaaccttcgccccatcattgaccaaatttgtanaaatttaattatttcggattaaaaaattct

SEQ ID NO: 42320 - DNA, 101 bp, rice(Oryza sativa)
  misc_feature (71): n=t or g
tctagtggtggcggtaaatgcaaggccatttttagcctccgatccatttttgaagatccagttggttgtcnccatcactgacatggaaagtcggttgccac

SEQ ID NO: 42321 - DNA, 101 bp, rice(Oryza sativa)
  misc_feature (71): n=a or c
tccattggaccttgttcaatacatatccatgatctaaccgaaaaaagtccaccagggcccaaaatggagtncgagtttaagaccacactcaattgggtagt

SEQ ID NO: 42322 - DNA, 101 bp, rice(Oryza sativa)
  misc_feature (71): n=a or g
caggggagcgcagagatccccgtgaagaatgttactttccatgatatgtcagtcggtttggtggacaggangaaccacgttttccagtgctccttcgtcca

SEQ ID NO: 42323 - DNA, 101 bp, rice(Oryza sativa)
  misc_feature (71): n=a or c
caactgatccttctcgcagttgagatataagaaagaagaaagaatcgctgcatcattgcagacctggaatnttgcacgagttgccaaacaatttccgcccg

SEQ ID NO: 42324 - DNA, 101 bp, rice(Oryza sativa)
  misc_feature (71): n=t or g
gcaacatctggcgaatgtctcagatcttctagacatgtcatacatcgatggcttgatgatcattcctcctncaggttgcccatacgatggtgatttcatat

SEQ ID NO: 42325 - DNA, 101 bp, rice(Oryza sativa)
  misc_feature (71): n=a or g
ggtggagatggcttataagctggttgagatccaactctcactgatctatgactacatgtacactaagtatngggcgcttcagttccgccttggccttgtct

SEQ ID NO: 42326 - DNA, 101 bp, rice(Oryza sativa)
  misc_feature (71): n=t or c
tatatgtgatgttattttttgggcctgtttcgaagggttttagattttgagaatggaatagtgggaattangagaagatggtaatatacggcctgttcact

SEQ ID NO: 42327 - DNA, 101 bp, rice(Oryza sativa)
  misc_feature (71): n=a or c
cagcagaccatcttgcccatttccttgagcatccagtgctttccaagagtcctttattgtttgaaagcagnttaaactttccctctaaaacacagtgaata

SEQ ID NO: 42328 - DNA, 101 bp, rice(Oryza sativa)
  misc_feature (71): n=t or c
cccacctctgcttcttcttcttcttcttccccgtggtgtggtgtggtggtgaattgttgttctgttccctncatttttcgttgattcgtgagcgcggcgac

SEQ ID NO: 42329 - DNA, 101 bp, rice(Oryza sativa)
  misc_feature (71): n=a or g
gaaactccacttgcaattgacaaagcgcctcccatgcaatatccagtaacaccaacctacatggaggaatntaagttatcataatgcaattcattacattc

SEQ ID NO: 42330 - DNA, 101 bp, rice(Oryza sativa)
  misc_feature (71): n=t or c
ttttaattatactacagtatttaatactgcctcactccactccacatatttacgcatgcagctggttagtngtgtccacgaccatctgggtagccctccaa

SEQ ID NO: 42331 - DNA, 101 bp, rice(Oryza sativa)
  misc_feature (71): n=t or c
agagcttgaccatcatcagctagttctcccaagtgccaaccctatcctctgatcacaattcacaaaaaccnccatggttggcaggatgctttcttccccag

SEQ ID NO: 42332 - DNA, 101 bp, rice(Oryza sativa)
  misc_feature (71): n=t or c
cctgcaattagaccaacatttgtcactctgttttacagatcagatcagcggacacctgcatatgagaggcngtgtgccgcgtgctagcgacaaacgcgaga

SEQ ID NO: 42333 - DNA, 101 bp, rice(Oryza sativa)
  misc_feature (71): n=t or c
caagatgacgtgtattgccttattagagcccatacaagctcagttgttatacttgcccttaggacagtccnaaccctccacctaagatggtgtctatggca

SEQ ID NO: 42334 - DNA, 101 bp, rice(Oryza sativa)
  misc_feature (71): n=t or c
caaaaatgtttgtcttcttcatggcctctttgtaacccgtccttttccctattgtaggtgaaagcgtcatngttgatagacccatcggccccatcggcaca

SEQ ID NO: 42335 - DNA, 101 bp, rice(Oryza sativa)
  misc_feature (71): n=a or c
tggagaaagaagaaaaacagagctttcatgtgtggtctagctacaaacgaaggatgtctatcggcattganaattcagatatcttttgactgttagtcttc

SEQ ID NO: 42336 - DNA, 101 bp, rice(Oryza sativa)
  misc_feature (71): n=a or g
aggcttcctgcaggaccccgtgtacgcgtcgtccccgttgggcggcgatgctgccgtgaagcacgaaacgntggtggatcatcccagtcaggccggcggcg

SEQ ID NO: 42337 - DNA, 101 bp, rice(Oryza sativa)
  misc_feature (71): n=t or c
tgttcactgatatttgtcctaatgaagagttcctgcctagaaattcagctcccaaatatgcttctgataangactctgattctgcagagtaaatccaaact

SEQ ID NO: 42338 - DNA, 101 bp, rice(Oryza sativa)
  misc_feature (71): n=a or g
aagtttgaatgtgaaggtgaggtcaccacgtaatgagtatttactcgcatttcgctctttggggacccatnagataaaaacttaaagcaaaatacgataag

SEQ ID NO: 42339 - DNA, 101 bp, rice(Oryza sativa)
  misc_feature (71): n=a or g
cctacagcaccaacagtgcagctgatattcagctcacgtgtcaacaagtccaaagctgaaaactaccgagnacaaatcctgcaggcatttgagtctgttct

SEQ ID NO: 42340 - DNA, 101 bp, rice(Oryza sativa)
  misc_feature (71): n=t or g
aatttgttcgtgtatttagccccaagcggacccaccaatagggcaatgttgggaaatggctagacctaccngcgccggcgaatatccccttccccggactt

SEQ ID NO: 42341 - DNA, 101 bp, rice(Oryza sativa)
  misc_feature (71): n=a or g
tctgagccatccgtagaagggatcgatggttcagatggagcagaatgtaggcattattagttggaagctancatatgatgaggcgtgggcgtccaaacgaa

SEQ ID NO: 42342 - DNA, 101 bp, rice(Oryza sativa)
  misc_feature (71): n=a or c
ctgtccctttgccaagctgcaaaatctaagtgcccaaggagtcctgacagaaaaacaagttcttgaagttnaggttatggtccttctagatgttagcatgg

SEQ ID NO: 42343 - DNA, 101 bp, rice(Oryza sativa)
  misc_feature (71): n=t or g
attgcacgtgtggtacggcctcgtctgatctccacagggacaggaggaggcagcgaggaggaagagggganagtgctgagcgagccggacccgaccagcgg

SEQ ID NO: 42344 - DNA, 101 bp, rice(Oryza sativa)
  misc_feature (71): n=a or g
aatgtaattcatctgtgtactttgaaaacattaccaaccagatagtggtcagtggtcagcaacttaactcnagcatataagccgcaaagaaatttaaatct

SEQ ID NO: 42345 - DNA, 101 bp, rice(Oryza sativa)
  misc_feature (71): n=t or c
ctatttgcaaggcactaagcactacatgctaacttatagaaagttagataaccttgaagttactagttacncagactctgattttggagggtgcatagaca

SEQ ID NO: 42346 - DNA, 101 bp, rice(Oryza sativa)
  misc_feature (71): n=a or g
cgggaactcggtgacggatagcttgagatgaggagcggatgagactagacggatgcctactagtggcgtcncggagccgaagaacggcaggccgtagtcgt

SEQ ID NO: 42347 - DNA, 101 bp, rice(Oryza sativa)
  misc_feature (71): n=t or c
tctttttgaagcccactgatttgtgctgctggggtttggagaggcagatggctgattatagaagaagagtngggtcatttgtttcttgtagaaagagttag

SEQ ID NO: 42348 - DNA, 101 bp, rice(Oryza sativa)
  misc_feature (71): n=t or c
ccaataaaacttctcttgcaaaatcacgtcgatacgaaattacttgctaagcattggccttactgctgcanagctcgatagctggagcggcttgaagggaa

SEQ ID NO: 42349 - DNA, 101 bp, rice(Oryza sativa)
  misc_feature (71): n=t or c
tctcccatacagcacctctgtgaaaactcctcatttatacttccaacatgttttgagagccgatataagcngtgtttcgattcaaaattttttcttcaaac

SEQ ID NO: 42350 - DNA, 101 bp, rice(Oryza sativa)
  misc_feature (71): n=t or c
tcagctgggttcataagccagattttgtaaacaccaacagcaacccgtgctataacttacttgggaaagcnatgtgctgagatatgcctattttagacact

SEQ ID NO: 42351 - DNA, 101 bp, rice(Oryza sativa)
  misc_feature (71): n=t or c
ccgtttctgccgcagagtccaccactgagaccgctcgtgagtcgtgacagcggccttgcccatcaggggcnagcgacaggaggagcacaccggcctaccgg

SEQ ID NO: 42352 - DNA, 101 bp, rice(Oryza sativa)
  misc_feature (71): n=t or c
ttggttccgaggcctccggagccaactgccctctacgggcttgccaacttcgcagggctccatcaagagcncgccttgcgggactccgcaaggcatcggtg

SEQ ID NO: 42353 - DNA, 101 bp, rice(Oryza sativa)
  misc_feature (71): n=t or c
ggccctggtttactcctttctgtgtatggtttctctcatcttgtgttctgattcaggatagacagcttacnttatttcattttccggttataaatattcag

SEQ ID NO: 42354 - DNA, 101 bp, rice(Oryza sativa)
  misc_feature (71): n=a or g
atgctcatccagtacttcttttctttcctccaaagatctcagcttatttgcaacttccagatgctcctttncattttctaacatctctgcagttgccttgg

SEQ ID NO: 42355 - DNA, 101 bp, rice(Oryza sativa)
  misc_feature (71): n=a or g
aagagaaagccatcattatctaaaaaagaagagagccgtatttccagagcgtgcttgagaagaagaaagangtctggctcggataggagttttagggtttg

SEQ ID NO: 42356 - DNA, 101 bp, rice(Oryza sativa)
  misc_feature (71): n=a or g
ccatccaaaccgtccttgagaggcaaattgctatggttttaacagttgtcttgtcggttttgcgtttaggnatgtaaatcaaacttgtagaatagaaattc

SEQ ID NO: 42357 - DNA, 101 bp, rice(Oryza sativa)
  misc_feature (71): n=a or c
actcgcaaggagaggaatagcgttgtcagcactctgcagtgcaggccttaaactaaatatttaaatccatntgtcgtttgggcaatgtagcacggaaaaca

SEQ ID NO: 42358 - DNA, 101 bp, rice(Oryza sativa)
  misc_feature (71): n=a or g
tcttggattaaaaccgagccgattgacttctcgccagccaacaaatatagtttgaaaggtactcccttctntggaggaatcaacaccggaggagagctaag

SEQ ID NO: 42359 - DNA, 101 bp, rice(Oryza sativa)
  misc_feature (71): n=t or c
tgcaacacaaaaatcacatggttcttcacacggtcaaatcgccaacattcgccgtgattttcttgtacagngttaacgcacacgtttcagtgtgcccaaga

SEQ ID NO: 42360 - DNA, 101 bp, rice(Oryza sativa)
  misc_feature (71): n=t or g
ttttgtttttttgtgtttcctatctgtaactggttctgtagaggaggatgctgaactgaattggtgattanatagtgtagtaaatagtgcctccttgttac

SEQ ID NO: 42361 - DNA, 101 bp, rice(Oryza sativa)
  misc_feature (71): n=a or c
agaccttgacgtaggagctatcagactgtcatggttgattcttggaagttggaagatggaaacttcttcantttaaactgttttacaggtatctgaacatt

SEQ ID NO: 42362 - DNA, 101 bp, rice(Oryza sativa)
  misc_feature (71): n=a or c
cattatcaacaagccttttgtattctttacaagtgacacgggcacttcctggaagtatgtccaaacttggngctgactgcatagaacgcaacagcaagtga

SEQ ID NO: 42363 - DNA, 101 bp, rice(Oryza sativa)
  misc_feature (71): n=a or g
gctctatgcatggttcatcaatcaaccgatcctgggtactctatggttcattagtcgagactcaagaatgnttagccgatgtcctagctagtgctagctga

SEQ ID NO: 42364 - DNA, 101 bp, rice(Oryza sativa)
  misc_feature (71): n=t or c
aagggcatgaccaaggcgacagatgaggggatcgaacttcaatagctctagcgagaaaaagtttcataccntgtaagagagtcataaaaggagatcgagag

SEQ ID NO: 42365 - DNA, 101 bp, rice(Oryza sativa)
  misc_feature (71): n=a or g
atcaacgaaaattgcttctgatcatcttcctcgaggtatttgaggtattgctggatatgaggcaagcgggntatggcacaaggcggcggcgggtgcgccct

SEQ ID NO: 42366 - DNA, 101 bp, rice(Oryza sativa)
  misc_feature (71): n=t or c
aataattaatctggattaccgtgcatactaatcatccttcccataaatcgctgtctttctgactgctgaanaatggcatttctgcaacctaatgaacttat

SEQ ID NO: 42367 - DNA, 101 bp, rice(Oryza sativa)
  misc_feature (71): n=t or g
aagtacctattgaatattgaagatcctgaagagcggtttggtgctcttgcaacagccttttctccagaagncgagcatgaagccaaggatgaagatgctct

SEQ ID NO: 42368 - DNA, 101 bp, rice(Oryza sativa)
  misc_feature (71): n=a or g
ggctttgctagggattggaattgtttcttgtggtgtgaagagtgactgtgatccggtatgtccatcttttncctctctccacatcttctaaaacttctaat

SEQ ID NO: 42369 - DNA, 101 bp, rice(Oryza sativa)
  misc_feature (71): n=a or g
attccactgttcaggttgcagttgtggtagcccatgaattagctcaccagtggtttggaaatcttgtgacnatggagtggtggacacacctatggcttaac

SEQ ID NO: 42370 - DNA, 101 bp, rice(Oryza sativa)
  misc_feature (71): n=a or g
gactattgctggttttctgacctctaagatgctattggaaaaccccgagctggcttctattctgacctgcnatgaggacctcgagctgcttgaaggctgtg

SEQ ID NO: 42371 - DNA, 101 bp, rice(Oryza sativa)
  misc_feature (71): n=a or g
gaccatatacttgttgggaaaagacacaagtaactaggaggtgatgtatcccccagcctggtcaaaaagcngacaagcgatgagatgtggcggccctcgct

SEQ ID NO: 42372 - DNA, 101 bp, rice(Oryza sativa)
  misc_feature (71): n=t or c
ggcagtcacaaccatccacgctcatcagaaagggtgtttggagatggttcagctactctggatgcaatccntgtaggtgagatattacaagcagcaggggt

SEQ ID NO: 42373 - DNA, 101 bp, rice(Oryza sativa)
  misc_feature (71): n=t or c
gattcagatgatgatagtgagtccgatgctgatatggaagtggaaagtgataaggaaagtgaagaggctgnagaggtagatgttgctcaatgtaaagctac

SEQ ID NO: 42374 - DNA, 101 bp, rice(Oryza sativa)
  misc_feature (71): n=a or g
cagcccaccagctttcaaaagatttcatcctaatagtatcgtttggttatttacctgcagaagtattagcngaagtacaacaatcaacagactatagttgg

SEQ ID NO: 42375 - DNA, 101 bp, rice(Oryza sativa)
  misc_feature (71): n=a or c
cctctctgaaagagaagcggaggagatctattcaacggagaaaagaaaagtacaaaactgtagtctctgcncgcacgcgaaaagttcgtttcgagtacgcg

SEQ ID NO: 42376 - DNA, 101 bp, rice(Oryza sativa)
  misc_feature (71): n=a or c
acatgatcacaaagcttgttatagagttgtcatgctcacgtaacccaacgcctaaatcaaagggatcatgntaggaaaaaaaacataattagaacactgat

SEQ ID NO: 42377 - DNA, 101 bp, rice(Oryza sativa)
  misc_feature (71): n=t or g
atcacaggaaaaaatgcagtactccagtatatatgtctatcaaagtcgtcgttgtcgtcgacgaagaatcngccgtcaaacaatttgcgtatatatatagg

SEQ ID NO: 42378 - DNA, 101 bp, rice(Oryza sativa)
  misc_feature (71): n=t or c
tcgacgttacgttgtgctatatatatattggactggtcactgcaagtatgtgtatatatatatgtgcgcgngcgcacacagcggcttgcaaacacacgaca

SEQ ID NO: 42379 - DNA, 101 bp, rice(Oryza sativa)
  misc_feature (71): n=t or c
tccatagtaatatctccgtcccaagataagtgaagttgtggggaaccatgtccagtgtttgaccgtttgtnttatttaaaaaatttataaaaaaattaaaa

SEQ ID NO: 42380 - DNA, 101 bp, rice(Oryza sativa)
  misc_feature (71): n=a or g
actaataacagaccagagcttgctatgcttgcagacctatgtaatatgcataacacagttgcactacctgntgatgattgttcagtcgatcagtcagcagt

SEQ ID NO: 42381 - DNA, 101 bp, rice(Oryza sativa)
  misc_feature (71): n=a or g
acggcgtgaagatcagcgaaattgagccacaagaaaccttcctcggccatgaaagcatcaggtgatgttcnaacagctaatgacattaggcctttcttgtt

SEQ ID NO: 42382 - DNA, 101 bp, rice(Oryza sativa)
  misc_feature (71): n=a or g
agcaaaccaaacaccaacctaagaaagtttggcacatctagtactcgaatatgtggcatgacgatttgtgncagtgaaccaaacaaccccggaacccacaa

SEQ ID NO: 42383 - DNA, 101 bp, rice(Oryza sativa)
  misc_feature (71): n=t or c
ttctgtcaagcatgaagccatgcacagacctgacaactgaacctctacacaagcctccttccattgatgtncagtgtgcaaatccatttgtcgaaaccatc

SEQ ID NO: 42384 - DNA, 101 bp, rice(Oryza sativa)
  misc_feature (71): n=a or g
cttggatggaatagcttctctggaacactgccaatgtggattggggacttggtgcagctacaatttctgcngttaagctataacatgttctccggtaatat

SEQ ID NO: 42385 - DNA, 101 bp, rice(Oryza sativa)
  misc_feature (71): n=a or g
atttgatgtttcctttcttcattctgaagatcttaggggttgagaggacagcttcacagcaggaaataaanaaggcttatcacaagttggccttacgtctt

SEQ ID NO: 42386 - DNA, 101 bp, rice(Oryza sativa)
  misc_feature (71): n=a or c
cataaatttaagaaatgaagatggtaactgcatgcattgttgtcctatctttgccaccattcgatcttcancaaataatagtagctccatgacctgggagg

SEQ ID NO: 42387 - DNA, 101 bp, rice(Oryza sativa)
  misc_feature (71): n=t or g
tgccggcgaacggcgtttcttgcgctgttcgctgtctgctcggaggaaggagcggcagatgtggttttttngaggagcagtcgtggtgatgagtgctagga

SEQ ID NO: 42388 - DNA, 101 bp, rice(Oryza sativa)
  misc_feature (71): n=a or g
gactcgaggtatgtggatccgtcggtagcaacaggagaagcggatccaccggtgacctctcccttccatcncttctccccatacttagcgcatggatccgc

SEQ ID NO: 42389 - DNA, 101 bp, rice(Oryza sativa)
  misc_feature (71): n=a or g
tagcgtatgcctgaaaactgttttctgaacttcacttgagtctcttcatatctctactgtcacccttgtcnaatgtaagcagggcgggtattctgatgata

SEQ ID NO: 42390 - DNA, 101 bp, rice(Oryza sativa)
  misc_feature (71): n=t or c
cagaacatgttaagtacctaataaagttgccctgagaagagtcaccgacaacaagcttgtggatttcgtanattgaaacaacattggaaatggtttctgcc

SEQ ID NO: 42391 - DNA, 101 bp, rice(Oryza sativa)
  misc_feature (71): n=t or g
cttgtgaacctgcttgtgaatggatggacggattgctggaatctgtgaatggatggattgctggaaccagngccggatctcagcgccagcaaaaatggcgc

SEQ ID NO: 42392 - DNA, 101 bp, rice(Oryza sativa)
  misc_feature (71): n=t or c
atcgtgttcaatgggtatacttgttgaatagtagttcacagcacgcagaatcttgcttgtgcgctaaaaanaaacaagatttgaagggagagacatccctc

SEQ ID NO: 42393 - DNA, 101 bp, rice(Oryza sativa)
  misc_feature (71): n=t or c
aaacagctcccttgtgaagaaggttctctattagccaatgaagatgtgaaaatgtcagaagtctactcggnggttctttctgttgatgtaagtttttctct

SEQ ID NO: 42394 - DNA, 101 bp, rice(Oryza sativa)
  misc_feature (71): n=t or g
ttcctaccgagccatatctaccggatttccgctgcagttttacaggaataagtttcccatcacttgttatntgctgcacctcgccgctgcactgcaagaag

SEQ ID NO: 42395 - DNA, 101 bp, rice(Oryza sativa)
  misc_feature (71): n=t or g
cttactgaatgtgtactctttcttttgatttggcagatgcaaggggtactcattcttttgattttgtccanatggacagctccagtccataacattctatc

SEQ ID NO: 42396 - DNA, 101 bp, rice(Oryza sativa)
  misc_feature (71): n=a or g
gtgcattcgtagatgagtatagtattacgtctgtagtaatgtgtgtgcgtctgtcgtgtactccctccacngctaaagaaacaaatatagaaacggatata

SEQ ID NO: 42397 - DNA, 101 bp, rice(Oryza sativa)
  misc_feature (71): n=a or g
gcagggatggaagacttcacgccgcactccaaggctagctggtgcaggctggtgaaactcttctggagctngttgcggatggagaagatgtggtcttgaag

SEQ ID NO: 42398 - DNA, 101 bp, rice(Oryza sativa)
  misc_feature (71): n=t or c
gtgtgtcgtcctttggtataccgtttgacggtgacggatcaagttcgtgggtttactatcttttggttcgnatttttacggtcttttcatatggttttagc

SEQ ID NO: 42399 - DNA, 101 bp, rice(Oryza sativa)
  misc_feature (71): n=a or c
agaaacaagccccaaggcaatcagtcagcacgcatgaagatgttttgttgtcatctctgcaaaatttgttnaaaaagaagaatcttcgatcactagagatc

SEQ ID NO: 42400 - DNA, 101 bp, rice(Oryza sativa)
  misc_feature (71): n=t or g
cctaccctgtttaactcacgagaccatgaaccaacacgtgtcgtctgttgccacgttaacatcgccgcaanatccatttttcccatcacctatagccccta

SEQ ID NO: 42401 - DNA, 101 bp, rice(Oryza sativa)
  misc_feature (71): n=a or c
atggcatgttgaagaggttgaaggaatctgttgaagggttgcataaggcaattgctggtgtaaaagatttnatgggttttgtgaataaggttggtgttgtt

SEQ ID NO: 42402 - DNA, 101 bp, rice(Oryza sativa)
  misc_feature (71): n=t or c
actgccacctgcttgtacctttttggaacaacacgtaggaattttttgatcatatgctcatcatcaagcangccacccatgtcacggatgtccgtgaccac

SEQ ID NO: 42403 - DNA, 101 bp, rice(Oryza sativa)
  misc_feature (71): n=a or g
tccttggggacgtcctctgagtctttgaggtcatgcaacaggcgcttggattgtgaaacaagcccggcacnctcgtaggccacgaccatcgtctggtaaag

SEQ ID NO: 42404 - DNA, 101 bp, rice(Oryza sativa)
  misc_feature (71): n=t or c
aacagaaaaattctaatttatctcaatgaacgggtatatgttcataattaatgcatagatcggatttgcanatatgggctgaaataagtttttttaaaaat

SEQ ID NO: 42405 - DNA, 101 bp, rice(Oryza sativa)
  misc_feature (71): n=t or c
tttccatccagaatccattgtttcatgatctctaatgcaattctgcaccggctagtagccagcacctcggnataactaccaccacttcctagtggtctcaa

SEQ ID NO: 42406 - DNA, 101 bp, rice(Oryza sativa)
  misc_feature (71): n=t or g
gtcgctggcaagacaggagaaatacatggcaatcgtcttgttaacagcctccgtgtcaccgtcggactgtnggtgaaacaccgagctgatctgcagctgaa

SEQ ID NO: 42407 - DNA, 101 bp, rice(Oryza sativa)
  misc_feature (71): n=t or c
caacctttttcaaactgaatattccgtgacttttaatccaaatgttctctctgaggttgataacacttgtngtttggacaagagcacggtctccaaaaaca

SEQ ID NO: 42408 - DNA, 101 bp, rice(Oryza sativa)
  misc_feature (71): n=a or g
gaagtataaaaaaatactaagcttcatttccacctgtatccaaaacaaaaagaaatgttatactcccttcntccctaaatatttgacgttgttgatttttt

SEQ ID NO: 42409 - DNA, 101 bp, rice(Oryza sativa)
  misc_feature (71): n=t or c
attatggaggagatttagttaaccttttgcgcaggagaaagacttataataaactatgtaaaacccagtanattatcgtgggagttccgtatgataatagt

SEQ ID NO: 42410 - DNA, 101 bp, rice(Oryza sativa)
  misc_feature (71): n=t or g
cagtaagtatttaagtgtacttaacagttaactccaccatctcctatcttggttttccataagaagaaaanaattacaggcaacaagagtagctacctagc

SEQ ID NO: 42411 - DNA, 101 bp, rice(Oryza sativa)
  misc_feature (71): n=a or g
caaattttgaagaaatgatctccgaaccaattcatttacatacaagtgcccaatttcttccatccttttcncaccgtcctcctgaatgaaacccaaagcac

SEQ ID NO: 42412 - DNA, 101 bp, rice(Oryza sativa)
  misc_feature (71): n=t or c
ctacactttttttttcatttttcatgtgggtgtacgtgcaaggtgtttttcatggctataacttgagtttntcttgtcggaatatcacatcaacttttttt

SEQ ID NO: 42413 - DNA, 101 bp, rice(Oryza sativa)
  misc_feature (71): n=t or g
ctccctggcatggaggacaggaggggaagcacaggaagaaggaagaaggtgaggtaactatttacatatgnatcctataagttttatttatttttaactag

SEQ ID NO: 42414 - DNA, 101 bp, rice(Oryza sativa)
  misc_feature (71): n=a or g
aagctgagttgacgtttagactaagtaggtggacagcaatggaggcgtagtgagcatagttgaaaaaaccngaccggtggatgacccggtgaacacctcgg

SEQ ID NO: 42415 - DNA, 101 bp, rice(Oryza sativa)
  misc_feature (71): n=t or c
atggattattaccttaaactaatcccactaggcgatgatcaataatgcaccatactgaacaagtgaacaangatataaatcaatgccatgcgccaactaaa

SEQ ID NO: 42416 - DNA, 101 bp, rice(Oryza sativa)
  misc_feature (71): n=a or g
atgctgtattatctgaggaaacgatcatatcatacgttggtttccgttgcatgtagggtagtacgtcctcnttaattacgtttttgcatacatacatcata

SEQ ID NO: 42417 - DNA, 101 bp, rice(Oryza sativa)
  misc_feature (71): n=t or c
tgcctcagttcattccaaagctccccaaaccagagaaacacagcgtagcgttgcagaaacggataaggttnaacgtcttctgaatcgtggacgaatccttg

SEQ ID NO: 42418 - DNA, 101 bp, rice(Oryza sativa)
  misc_feature (71): n=t or c
ccttttatttacatgaaacttacaaagtacaaactactccttacatatgctagttactatgccaagagctnatgcattgcaacggaagacaaattggattg

SEQ ID NO: 42419 - DNA, 101 bp, rice(Oryza sativa)
  misc_feature (71): n=a or g
cttgttgctaccacaccaaaatagtggcactttgcagcagtgagcaaaaataatagcccaacgaaaagatncaacttatgggcttttatacagttgcgtgc

SEQ ID NO: 42420 - DNA, 101 bp, rice(Oryza sativa)
  misc_feature (71): n=t or c
aggtcgaatcggaggcggaggcggtgaaacaaggtcggcacagattcgtcgtcgcaggagcaaacagtcantgacatgtggagcccacctacaacggcccg

SEQ ID NO: 42421 - DNA, 101 bp, rice(Oryza sativa)
  misc_feature (71): n=t or c
ctgctataccgatctagctgacatgacagcgttatttggtacggtcacgctagtttggatggtgtgatagntttgtgtgacgtgtcagtgttgttttgtta

SEQ ID NO: 42422 - DNA, 101 bp, rice(Oryza sativa)
  misc_feature (71): n=a or g
atttctagctggtagaaatccagttcttaatatggtgccacaagctactcttgaagaaaagtttcttagtntctatgagaaagaaaaacagaagctgaagg

SEQ ID NO: 42423 - DNA, 101 bp, rice(Oryza sativa)
  misc_feature (71): n=t or c
aggtttataggaaataggtgtttccatgttttaacattagtaattattccactccctttgttcaccaaaanatgatgttttagccaatgttgcagagaaca

SEQ ID NO: 42424 - DNA, 101 bp, rice(Oryza sativa)
  misc_feature (71): n=a or g
ttacaatgtctctctctctccaattctgcacgtaacacaagagcttgtgctgtacttaacaatggtgagantacgttaattatctgcagctgcaagaagaa

SEQ ID NO: 42425 - DNA, 101 bp, rice(Oryza sativa)
  misc_feature (71): n=t or c
tgctttctttaaagaggaacggctttttctactttaacttaaaatgaacatagacgaaacggcgttgtagnaagcttctgcagattatggtaggctagctg

SEQ ID NO: 42426 - DNA, 101 bp, rice(Oryza sativa)
  misc_feature (71): n=t or c
tcatgccgataagagccatgaggacaagggaaaagagacaaggcaagcacaaagatgatatggctatcttncttagaggtggaaggacaccattccttctt

SEQ ID NO: 42427 - DNA, 101 bp, rice(Oryza sativa)
  misc_feature (71): n=t or c
tttgccctagagacatgccatttctgggtgtgttcggatctcccagctcccaactccttcttttgttttcnacgcgcacacagttaaacgttgtgtttttt

SEQ ID NO: 42428 - DNA, 101 bp, rice(Oryza sativa)
  misc_feature (71): n=a or g
aatgcaccaccggtccagccgatggcagcagtttcagctctagcaacaggtgcaccgtcgtcggcacaaangcaggtggttaatcctcatgtcttgaccag

SEQ ID NO: 42429 - DNA, 101 bp, rice(Oryza sativa)
  misc_feature (71): n=t or c
cttctcttcttcccctttctagttttttcttctcctctcttcctggaccataagctttactagtccattgntcgtcatggcccaagcccaactagtccaaa

SEQ ID NO: 42430 - DNA, 101 bp, rice(Oryza sativa)
  misc_feature (71): n=a or g
aatcctgatccctcttatatgtagccatcttatcttgtgccacttcatcatagtcctgtgtgtcctgtatntttcagagaggcatgccatatttaatgcat

SEQ ID NO: 42431 - DNA, 101 bp, rice(Oryza sativa)
  misc_feature (71): n=t or c
ttttcgctgacgatagcttattgttctttaaagccgaggttgatcaagcgagaagtgtgaaggaggcgctnagtctatacgagaaaagcacagggcagctt

SEQ ID NO: 42432 - DNA, 101 bp, rice(Oryza sativa)
  misc_feature (71): n=a or c
aacacgtatcagtgcgagatccaaggagctctcggtgatcaaatcggatggaatgtcgcggcatacgtcgncgacgctgccgtcaagacaaaaacaggcga

SEQ ID NO: 42433 - DNA, 101 bp, rice(Oryza sativa)
  misc_feature (71): n=a or c
atttggttgggttgggtacgggctcaattcgtgaatcagttgacaacttgacaaacgcttgacaatatgcngtgcatttatgcttcagcaaattggggaag

SEQ ID NO: 42434 - DNA, 101 bp, rice(Oryza sativa)
  misc_feature (71): n=a or g
gtctttgaggaaactccccgtacacagccagagtgctccggtttgcccaaggcataggttagcttgtcacngtctctatctggcacgaacgtcctagcctg

SEQ ID NO: 42435 - DNA, 101 bp, rice(Oryza sativa)
  misc_feature (71): n=a or c
ggttgttgagaaaaaaagcgtaataggggctttataataagcccatgaggttaaattttttatagacagtnatgatagtacgatctaaataatcaatggct

SEQ ID NO: 42436 - DNA, 101 bp, rice(Oryza sativa)
  misc_feature (71): n=t or c
tctgttgatactagaactctagaagtattgaggccccttaaaggcttcaagcttgctgtcacttggttganctgatgcagtcttattatataactaattac

SEQ ID NO: 42437 - DNA, 101 bp, rice(Oryza sativa)
  misc_feature (71): n=t or c
agctgccgatttaggggtacgccagttcagaaaattagaggcaagtagttcactgttcacactgtattgtnactccgattcttcctccatatattgcaaaa

SEQ ID NO: 42438 - DNA, 101 bp, rice(Oryza sativa)
  misc_feature (71): n=t or c
tgcttgttatattacagtaaccagaacaaccatggcataactgagctttcgatgcctcttagacctaacanacatgctgcatggtcaggggtggatctaca

SEQ ID NO: 42439 - DNA, 101 bp, rice(Oryza sativa)
  misc_feature (71): n=a or g
gccaggtgaccgatcgcgttccctgctgctcatcaattttctttcatcttatcgatattaacatcaatatnaatataagaaatactagaataacttatatt

SEQ ID NO: 42440 - DNA, 101 bp, rice(Oryza sativa)
  misc_feature (71): n=a or g
agccaacaagcaggtacaaacaagggatcaatggcatgatgtgtttaattctattggtcgcggacttaccnaagagcccaaggttgaggacatgacaaaga

SEQ ID NO: 42441 - DNA, 101 bp, rice(Oryza sativa)
  misc_feature (71): n=a or c
tcacatatgaaccaccgaagaacatagatagcatcgcccaacctcgctgcattcgcattaccaaagtgtgncaacgccatggtggtgaccttcacatctcg

SEQ ID NO: 42442 - DNA, 101 bp, rice(Oryza sativa)
  misc_feature (71): n=a or g
ttaggatcttaacacggtgtaagtggggttgcttggagaagaattttctataccgggtgtcattctcaccnaaagttacaaggaagctctaacgattttgc

SEQ ID NO: 42443 - DNA, 101 bp, rice(Oryza sativa)
  misc_feature (71): n=a or g
ggtacgtttggtatacgagatttggatcatatcactacaaatattgcaacacatcccattcaccttcatgntcccatcagcatgaatttttttttctcaaa

SEQ ID NO: 42444 - DNA, 101 bp, rice(Oryza sativa)
  misc_feature (71): n=a or g
cggcacaatgagggttagaattagattccaatttcgatacttgtaaactactccctcactcctatcttaantacggttacagttgacatgtatggcgtttg

SEQ ID NO: 42445 - DNA, 101 bp, rice(Oryza sativa)
  misc_feature (71): n=t or c
tgcgccaccgcggattcttgtaccagctgacactaccggggcggtggctgtgctccttggattgttggatnggttggtttgggaaaggttaggcgccctcc

SEQ ID NO: 42446 - DNA, 101 bp, rice(Oryza sativa)
  misc_feature (71): n=a or c
ctccaaatcacaaactaccaatgttttcatcacacgcaatcttaaattaactcctcgattttacatgcgcnacatgagccgttggatttcttggacggtgg

SEQ ID NO: 42447 - DNA, 101 bp, rice(Oryza sativa)
  misc_feature (71): n=t or g
ccttgggactaacgaatttaactgtggatattgtggagaatatccggtcgataccctgatactcatactcnaggtttgcatgattgagactttagcaaaat

SEQ ID NO: 42448 - DNA, 101 bp, rice(Oryza sativa)
  misc_feature (71): n=t or c
atcccaaggccatacaggaacttccaatgattgtaactttccaataggactcttatgttcagcctttactngctgacattccccacatgatgccacgtact

SEQ ID NO: 42449 - DNA, 101 bp, rice(Oryza sativa)
  misc_feature (71): n=t or g
aaatgggagtgacccagtatgagttcaagaatttcatcagcaggaaacttcccttcagataatacaacaantatgcatcggattgcttttattacaacagg

SEQ ID NO: 42450 - DNA, 101 bp, rice(Oryza sativa)
  misc_feature (71): n=t or c
cgacttccacctctttactcttttcttttgttttatcggcctcaccgcctcatcagctcgatccatgtgtngacaacacatttagccttgttcggttaatc

SEQ ID NO: 42451 - DNA, 101 bp, rice(Oryza sativa)
  misc_feature (71): n=a or g
gtttgcgtgcgccaacagctccccctcttttatatggcacttcgtgagaggggcccacagccattgaacgncgggcgccccctatcagggcgcgtgaggcg

SEQ ID NO: 42452 - DNA, 101 bp, rice(Oryza sativa)
  misc_feature (71): n=t or c
ttatagcaaactgttgcctaccatactagtgctgtttctcaccatacatatcctacattcatcaatgccangttttgcacatcattgagagtacattgatt

SEQ ID NO: 42453 - DNA, 101 bp, rice(Oryza sativa)
  misc_feature (71): n=t or c
agcaagatggtcaatgcctgaagattacttacatcgaatttatcaaatgactcaacgaatcgattaaggcnggagcgcggcgacacagatcgagccctcaa

SEQ ID NO: 42454 - DNA, 101 bp, rice(Oryza sativa)
  misc_feature (71): n=t or c
ctcgctttgcttgtttagctggagtagattggacgggatgtgtgtctgttagtagtctaatgctgttgatntaatctatggtggtgtcgttgaaccttgtg

SEQ ID NO: 42455 - DNA, 101 bp, rice(Oryza sativa)
  misc_feature (71): n=a or g
accatctgtcgattgagggcgtgagtacgtaatatttgcatggcacccatatagcctaaatggtggctcanttgcatcaattgatttcttagaagagccct

SEQ ID NO: 42456 - DNA, 101 bp, rice(Oryza sativa)
  misc_feature (71): n=t or c
tattagcgctcacactaagaagcgaacaagatagcagaggtcctgagtcaaataacttacgtttacgatangagttgcttgaccgagtgcctttttcagtt

SEQ ID NO: 42457 - DNA, 101 bp, rice(Oryza sativa)
  misc_feature (71): n=a or c
tgatttccagtggatcttccatacggacattttcatcggtggcatcggtggccatgttcaagccttctctnataatttctaccggagtttcaatttcagag

SEQ ID NO: 42458 - DNA, 101 bp, rice(Oryza sativa)
  misc_feature (71): n=a or g
cagtctgcaggttaatatcctagacgaccctcacgttaggaggggttttcggcgcacttgatgaagggccnctgcccaccaatacgagggccgccggtgca

SEQ ID NO: 42459 - DNA, 101 bp, rice(Oryza sativa)
  misc_feature (71): n=a or c
acacaaaaggcaagtgtgttctgggaagaccatgaattattattatcaaagtgacgaaatagggactccanaacacgacggaatgttgttgcctccctgga

SEQ ID NO: 42460 - DNA, 101 bp, rice(Oryza sativa)
  misc_feature (71): n=t or g
ggcaacagacatataggggccaagatatcgactatataagcattaattctgactctgagggtgctggcacncgatcatacagctatcgtgtaagttaaatt

SEQ ID NO: 42461 - DNA, 101 bp, rice(Oryza sativa)
  misc_feature (71): n=a or g
tagcgtgttttttcccaacggtttagacgacgactccggggtgattcaatggaagggctgatctatgggcntcagctcgctttgaggtattacaatcgcgt

SEQ ID NO: 42462 - DNA, 101 bp, rice(Oryza sativa)
  misc_feature (71): n=t or g
agggcagtgtaagatggaagtagagagaggggaaaacaaacacggcatgcatggtacagtaattttttttnataatacttatcgttttagataatgatgag

SEQ ID NO: 42463 - DNA, 101 bp, rice(Oryza sativa)
  misc_feature (71): n=t or c
gccttggtgcctatgagagagctgagctatactataagtctagccattatccacactgacttatggtaagnacaataatttctcacaagagttttcgtgaa

SEQ ID NO: 42464 - DNA, 101 bp, rice(Oryza sativa)
  misc_feature (71): n=t or c
aagggttacaccggagcacagtacctccccgccatccccaccgagcgcatcgccaaggttttcggcgagtnatcgccggaggcccagccgtcgaagagcga

SEQ ID NO: 42465 - DNA, 101 bp, rice(Oryza sativa)
  misc_feature (71): n=t or c
aggcaagcccattctgtggcaagccgaacgaggatgcaagtgctcacttacagcagttcctggatatttgnagcacttacgggtcagtccagacgccgtta

SEQ ID NO: 42466 - DNA, 101 bp, rice(Oryza sativa)
  misc_feature (71): n=t or c
tgtgtggccctcgggcttgttaatatccccgacaaaggggaggaccctcagtgatgggttatggtatccangctgttcttcctgttgttcttggggctggt

SEQ ID NO: 42467 - DNA, 101 bp, rice(Oryza sativa)
  misc_feature (71): n=a or g
caactaggattacgcctcaatgtacttgatctagaaggctgcaaaggattggagaagtatcacctgaacancgtttgcaagatatttcaactcaagtattt

SEQ ID NO: 42468 - DNA, 101 bp, rice(Oryza sativa)
  misc_feature (71): n=t or g
ttattgcttaccttggacctataagtgaagttgaaacatacttctcaagcctggggattaaggttcctgancgtgagaatcctccagactactatattgac

SEQ ID NO: 42469 - DNA, 101 bp, rice(Oryza sativa)
  misc_feature (71): n=a or g
cgtttatgtaaaacgttgtaggcccactacgatattctctattgctaatagaaagcagtttgaatcgttgntcctattcgatagaagagttcagatctatt

SEQ ID NO: 42470 - DNA, 101 bp, rice(Oryza sativa)
  misc_feature (71): n=a or g
gattctgctcctggagccgtggatgccagtcaagcgcattgtcttcaacaacgacaggtcgatggattccngcaggttcaggtcgcagtagcttaggcaca

SEQ ID NO: 42471 - DNA, 101 bp, rice(Oryza sativa)
  misc_feature (71): n=t or c
aagcagatgacgagaggagctgaagttagttcgggcaaactcccagttcggctgaacttctgggccacctntgtcatgccccgatttttgttagggattcc

SEQ ID NO: 42472 - DNA, 101 bp, rice(Oryza sativa)
  misc_feature (71): n=t or c
tgctgaagtgatgcggaatgctgcttactgatgatctttcaaaagggctgggtggcacgtcattgatagtnggcttatgccgtgccagtgggctctcgcca

SEQ ID NO: 42473 - DNA, 101 bp, rice(Oryza sativa)
  misc_feature (71): n=t or c
tcaggatatggttttcgataagtgcgtgctctactcttaggttccacatcaaatgtttctctaaaaacacngaccaattgctctctaagtgtttccggcac

SEQ ID NO: 42474 - DNA, 101 bp, rice(Oryza sativa)
  misc_feature (71): n=t or g
attatacattggaaaaattacaaattttgcatagcatgaaaacacgctacttaatcacaccatgaaaacantacatgtactacatgttctattcatcatca

SEQ ID NO: 42475 - DNA, 101 bp, rice(Oryza sativa)
  misc_feature (71): n=t or c
cagtgttttccatttcggtaagcaggaaaatttcggtggcaccgaaatatcgaacgattttttttgaaaanttaacacatttatattgaatttgaataaat

SEQ ID NO: 42476 - DNA, 101 bp, rice(Oryza sativa)
  misc_feature (71): n=t or c
tctatcgatgagccatcagacatttatcacttggtttcgttttacctatcctaggccatgacaaaagtttngataaaaaagtcatatcaaatgtttagaca

SEQ ID NO: 42477 - DNA, 101 bp, rice(Oryza sativa)
  misc_feature (71): n=a or g
acatcttcaggccttaagcctgatcaatatacatggagtgctttactgtcagcgttatataggtctggtcnttgttgggatgtcctagatctttttcaagg

SEQ ID NO: 42478 - DNA, 101 bp, rice(Oryza sativa)
  misc_feature (71): n=a or g
agtagtgagtacgcgtcaaggtgacagacacgctgggaatgggtttttcatttctgtcacatcatttttgnccctggcaatcgggtcatatatagttgctt

SEQ ID NO: 42479 - DNA, 101 bp, rice(Oryza sativa)
  misc_feature (71): n=t or c
tgaacttgggatgaggcagcatccgagcttgagctaaagcccaagatgatggcagtacggtgtagttgctngacgcaggtggaggcggagctcgccaaagg

SEQ ID NO: 42480 - DNA, 101 bp, rice(Oryza sativa)
  misc_feature (71): n=a or c
ctatgcattgtgaggaataagagtacaagaacgtacatgtaaacccgtgaagcataattgtattgtgagantgattagcgaatcctaagaaaataactagt

SEQ ID NO: 42481 - DNA, 101 bp, rice(Oryza sativa)
  misc_feature (71): n=a or g
ctctgttcgattcatgaaccagacagaaactcaaccagtccaaagtccacccaggcacacgatgaggactnctggataaaccatatttgccgggtcaacca

SEQ ID NO: 42482 - DNA, 101 bp, rice(Oryza sativa)
  misc_feature (71): n=t or c
cgaatagtctcttcgaagaattgtcaatatcttgtttctcatctcacatggatttaagatcggtcatcgcntttccttgttcttcttagttcatcaatcaa

SEQ ID NO: 42483 - DNA, 101 bp, rice(Oryza sativa)
  misc_feature (71): n=a or c
tatatttactcctactagtaacatgcccgtgctaatgctacgctactattaaataggtcgttcctgtttangctaatcaccgacagcctacgcacgtacta

SEQ ID NO: 42484 - DNA, 101 bp, rice(Oryza sativa)
  misc_feature (71): n=a or g
acgggcaacccacgtaccagtgcttctctgcccatcttgcgcagcgcggtgaagttgacgtgcccgaaacncgcgtgccagcgccaagcgtcctctcccgc

SEQ ID NO: 42485 - DNA, 101 bp, rice(Oryza sativa)
  misc_feature (71): n=t or c
tgaccaatatagcacccaatagggatgtcaacttcagaaaatccaccgtagatctgagccacagcacctgntcgataaccttcatctgaaatttttttaca

SEQ ID NO: 42486 - DNA, 101 bp, rice(Oryza sativa)
  misc_feature (71): n=t or c
ttacttgtattggattaaatacgtatgtacagaggccacttgaatacagtggtatacgtacaccattccanttgtgtaactctgctgcattgacaacacat

SEQ ID NO: 42487 - DNA, 101 bp, rice(Oryza sativa)
  misc_feature (71): n=a or c
tcgagattcgctgcaagaaagaaagaaagaaccacgggcatgagcgcaacgacggcgacgacgacgatgcnaaccgaaagaagagggagaagcacggccgg

SEQ ID NO: 42488 - DNA, 101 bp, rice(Oryza sativa)
  misc_feature (71): n=t or g
tagtaagagacgggaaaaatatagagtttagaaaactttcccaaatattcagccgagagttgccaattctncgaggaacgcgtcgacgtgctcgtccctga

SEQ ID NO: 42489 - DNA, 101 bp, rice(Oryza sativa)
  misc_feature (71): n=a or g
gataatggagtaccaatagctacttttcctccagtatgaagggtttgatctctctcgcatgtcccattgantgcgttgcctttgggacgactgcgagggca

SEQ ID NO: 42490 - DNA, 101 bp, rice(Oryza sativa)
  misc_feature (71): n=t or c
gtgcgcatcctgacccatcaaccatgggtcacctaggtcacagtcacattagatctgttccaccacaggtncaaccggagttataactttagattctaggc

SEQ ID NO: 42491 - DNA, 101 bp, rice(Oryza sativa)
  misc_feature (71): n=t or c
cggactgcataccatgaggggagtaacagtagagaggagctgcataccggatttggtggtggaaatttgcnagagtgaagacagagaagcgctggatctgg

SEQ ID NO: 42492 - DNA, 101 bp, rice(Oryza sativa)
  misc_feature (71): n=t or g
aataaaagggaggaagaagaagaaaggagaagttggggcaaggtgctataatctagtattttgcagttganggatgcgattcaacgaagggcaaaagatga

SEQ ID NO: 42493 - DNA, 101 bp, rice(Oryza sativa)
  misc_feature (71): n=t or c
gtgccaagtacagcggcatcaccttcagaagtacttgccatgcctttcacccttgccaacttctttaattntgtgctaaactcagaaagtatgtcgttgtc

SEQ ID NO: 42494 - DNA, 101 bp, rice(Oryza sativa)
  misc_feature (71): n=a or g
ttcacaaatttttgagatttcgagcctacttgggttgacaaaccgctcaataaacagccaaattgaaaaanattaaatcaaactagattccacttttttta

SEQ ID NO: 42495 - DNA, 101 bp, rice(Oryza sativa)
  misc_feature (71): n=t or c
atctgctgtcaggttcaccaaactgttttgaatggtgttatcgttcttttatgctaaggcagtggctcttnggtggcttggccgatatccactgttggatg

SEQ ID NO: 42496 - DNA, 101 bp, rice(Oryza sativa)
  misc_feature (71): n=t or c
gaaccggttgcgtgggatacgaaggggaagcgtgcgtgtaggtgtggaaaaaatgtccttgggtggaattngaacccaggacgcatgggagagagttaact

SEQ ID NO: 42497 - DNA, 101 bp, rice(Oryza sativa)
  misc_feature (71): n=t or c
atatattcttttgtttgttcaagatgggattgcatatcatagtcctcgatatcaggagcttgttcttcgtnaatatcttcatcatcactatcatctttcct

SEQ ID NO: 42498 - DNA, 101 bp, rice(Oryza sativa)
  misc_feature (71): n=a or g
cagaatttccgcattactaatgtttcgatatatgcacacaatatgataaagaaaaatgttcttcattcacngtagttctgatatatagtgctaccttttgc

SEQ ID NO: 42499 - DNA, 101 bp, rice(Oryza sativa)
  misc_feature (71): n=t or c
catcgccaattaaggctaaagctagccttattaattgggtcaacaaacctcgacaaaattccaatatcatntagtaaaacattgtttcaatttaaggttta

SEQ ID NO: 42500 - DNA, 101 bp, rice(Oryza sativa)
  misc_feature (71): n=t or g
atcttcaaacactagctgtcatccattcagtcaagttgcagcatcacacactccaaatttttcactacctncattaattccaattaagaaaagagagagac

SEQ ID NO: 42501 - DNA, 101 bp, rice(Oryza sativa)
  misc_feature (71): n=t or c
tcatcctctctgtgtacatagagtatgcgggggtactttcttaaaaaaaaaaaagaggacacaagctttgnctcgtgtatattgatagagaagagataaca

SEQ ID NO: 42502 - DNA, 101 bp, rice(Oryza sativa)
  misc_feature (71): n=a or g
cagcccatctgctttgcaaactggcggttcaatagagcccgggttgccggttttcctcaaaaaccgtccgnttcatccggttcacaccgggttgattgcat

SEQ ID NO: 42503 - DNA, 101 bp, rice(Oryza sativa)
  misc_feature (71): n=a or g
ctgctttctgaaaagcatttttgttatccgaatcgcacagagctcctgagttaaccaaatagaaggactanagaatatgtcaggctgttctgttggatcac

SEQ ID NO: 42504 - DNA, 101 bp, rice(Oryza sativa)
  misc_feature (71): n=a or g
agatgggacgtctgatttgaagtttcttccattttcgtcacttcccaaatcccccgaaaaaaaaatctccngctgccaaagtcctccgtcactggatcgca

SEQ ID NO: 42505 - DNA, 101 bp, rice(Oryza sativa)
  misc_feature (71): n=a or g
aagttggcatcattaagaaaaccaaatcaattacttttgcaggttcccataaaagaaattacttttgcagntataatcagaaacaactgttgggctcaaac

SEQ ID NO: 42506 - DNA, 101 bp, rice(Oryza sativa)
  misc_feature (71): n=t or c
gttgtaaatacgagcacacacgttaaatctaatatttaaattcgagtgaactgattctataaaaaaaaaanctaattagttgaggtaggctcacttcacta

SEQ ID NO: 42507 - DNA, 101 bp, rice(Oryza sativa)
  misc_feature (71): n=t or c
tttgcagtcagttcgatggtgtaattgtttcttcaccagtgatttttattttggctgtgaacacaaagcgnttagttcagttgtgaccaaggctgaaccag

SEQ ID NO: 42508 - DNA, 101 bp, rice(Oryza sativa)
  misc_feature (71): n=t or c
ggagagagtgggtgctcgagagagaggggagagatcaagagagttcgactgtgagagcggagagaacgacnagttgaccttatctcctcgtcctcgacgcg

SEQ ID NO: 42509 - DNA, 101 bp, rice(Oryza sativa)
  misc_feature (71): n=t or c
ttttctccccaagccactttgccttctataggtcattatgccaccctacgaagccactactcccatccacngtggcaactgagcctagctggagctcgaaa

SEQ ID NO: 42510 - DNA, 101 bp, rice(Oryza sativa)
  misc_feature (71): n=t or c
ctcgccacgttgttgtgttacacaggacatacaaggatcccttcaatgccattactactgtataggaccanatacctacacctgcttcagaacacataaat

SEQ ID NO: 42511 - DNA, 101 bp, rice(Oryza sativa)
  misc_feature (71): n=t or g
tgcgcaccaaagaggtggacaacgacatctcagcggttgaggcaaaagcgatgcttcggtcctcactgctnaatgctgggcaacgccttcaccaacaagga

SEQ ID NO: 42512 - DNA, 101 bp, rice(Oryza sativa)
  misc_feature (71): n=t or c
ttaaatagccccaactctcaagcatgatttctaggaagaaaatttttgaaaccattagccatgattagacntcctcaactgataagagtttgaaaactgtg

SEQ ID NO: 42513 - DNA, 101 bp, rice(Oryza sativa)
  misc_feature (71): n=t or c
cggaactgcccactggccaacgccgggagaccactcactgcctagccaacatcgtcccgcagccaaccacngtcagcggcccgcaacgacgccagcactgc

SEQ ID NO: 42514 - DNA, 101 bp, rice(Oryza sativa)
  misc_feature (71): n=t or c
ctctgaaactttgtcaaatactaccttatatgtccctgaattttgcgacattagagagcttaataagcacntcgctaacggctgcagaacgccgaggtctg

SEQ ID NO: 42515 - DNA, 101 bp, rice(Oryza sativa)
  misc_feature (71): n=t or g
gcttgtagaaccccatgaccatgaagccacaaagcaggtggagcgcaccgaattgacgcgtgattgggttncagatgaaccaccatattccaccgatggag

SEQ ID NO: 42516 - DNA, 101 bp, rice(Oryza sativa)
  misc_feature (71): n=a or g
cataatatccgaggttatgtatcaccggttataataccttcttcctttgtcgcacaaaaaacacacctaangcaaaatgtgacatattttagtactactta

SEQ ID NO: 42517 - DNA, 101 bp, rice(Oryza sativa)
  misc_feature (71): n=a or c
caaaaccatgccacatttcatgacaaagccaatcattggttaccaatccaagaatgagctacctcccagtncaagtgatggagcttcatatagcgatggat

SEQ ID NO: 42518 - DNA, 101 bp, rice(Oryza sativa)
  misc_feature (71): n=t or c
tgtgcatttctttttctggacagatcagtgtcacctgagttcagttttagctaaccctaacacgtgtagcntactagccatgcagtactttagataaccct

SEQ ID NO: 42519 - DNA, 101 bp, rice(Oryza sativa)
  misc_feature (71): n=t or g
ctcccacatgagtagatgcagctggaaggagcacaatgggtatcggctcaaggaaagcttttggctgatcnagagagtgtcaaagcagcggattgcccctg

SEQ ID NO: 42520 - DNA, 101 bp, rice(Oryza sativa)
  misc_feature (71): n=t or c
tatcatgtgctattcagtagagggaatgaaccaagatgattttgagcgtgtgctgaagaagctaacaaagntgagggtggtgcacttggatttgagacatt

SEQ ID NO: 42521 - DNA, 101 bp, rice(Oryza sativa)
  misc_feature (71): n=a or g
ccacaaaacaatgttgtacacttgctgactatcctcacctatgctagtaggcaaaagtagaatttcagaanctgaactaagatatacacattccaagtatc

SEQ ID NO: 42522 - DNA, 101 bp, rice(Oryza sativa)
  misc_feature (71): n=a or c
ttccattgttattctttgatcccacgtagttttttgcttgcgtctctgcagacagcttcgatgctactccntccattccaaattgatctaatatagttttt

SEQ ID NO: 42523 - DNA, 101 bp, rice(Oryza sativa)
  misc_feature (71): n=a or g
atgctaactttatgatttcacacatgatagttggataattcagtatgaggcttgagctctagttgctaatntttgttgattacaagcatagaaggtttagt

SEQ ID NO: 42524 - DNA, 101 bp, rice(Oryza sativa)
  misc_feature (71): n=t or c
agtgaaagctatcctgatgtcactctccataagaaatttaatgagagcactacaggagaaatgatatttgntaggtcggctgatttccacaatagtgctgg

SEQ ID NO: 42525 - DNA, 101 bp, rice(Oryza sativa)
  misc_feature (71): n=t or c
gcttaccagcgcattcataaaaagttttcaaccattttacccttgtcttcttcctccttcccctccttccntcccctccccctctctctctctctctctct

SEQ ID NO: 42526 - DNA, 101 bp, rice(Oryza sativa)
  misc_feature (71): n=a or g
acaccaagaaacacttctcactgtactgagctttatacccttcctgtgcagccccaattcttcgggagttntggatctgggttttgggaggatggcagggg

SEQ ID NO: 42527 - DNA, 101 bp, rice(Oryza sativa)
  misc_feature (71): n=a or g
gaagacggcgattgccccgctgagtttgcaccgctggccaaatccatgcagggcagaggtgttcgaggccngcgcaaggacggaggatatggatgccacgt

SEQ ID NO: 42528 - DNA, 101 bp, rice(Oryza sativa)
  misc_feature (71): n=t or c
tggccaattaccataatattttccccactttggttttttgtttcaatgttaatcagtggagtctcttttgnagggagagggagcgtggacattcccgcgag

SEQ ID NO: 42529 - DNA, 101 bp, rice(Oryza sativa)
  misc_feature (71): n=t or c
atccacaccgacgctcatcgtcttgatcgcgtcccatacttccttggcattgtccttctttgatagggggnacaacatttccttgggaacggcttggagaa

SEQ ID NO: 42530 - DNA, 101 bp, rice(Oryza sativa)
  misc_feature (71): n=t or c
ccagccttggtacaaagaaatgaaaacttattggctattcaatgccagcgatccatatatatcatgtgtgngcaatattactgttgcagatacgtggaggt

SEQ ID NO: 42531 - DNA, 101 bp, rice(Oryza sativa)
  misc_feature (71): n=a or g
ctctccctcatgccgcctccagcttgcgctcctccactgcaatctcctcctcctcctgccggaatcatccncccacaccgacctcttcgaccccatcctct

SEQ ID NO: 42532 - DNA, 101 bp, rice(Oryza sativa)
  misc_feature (71): n=a or c
cttcagagttcagtccccaacattttttatgggacagataccagcaggcagcagttgcagttcctcaccanaacgccatccccatcctccctgccatcctc

SEQ ID NO: 42533 - DNA, 101 bp, rice(Oryza sativa)
  misc_feature (71): n=a or g
tcgtggtcacctccgacgggtcggtgttggagaagctcaacccatacctggagtccgggaaggtgaagccnctggtggaccccaaggggccattcgccttc

SEQ ID NO: 42534 - DNA, 101 bp, rice(Oryza sativa)
  misc_feature (71): n=a or g
gaagagggtgaatgcactgaaggattatctggtaccagtaggcaattggtgacacttttgtcgacatacancattttcctttcaaaatccttttctttttc

SEQ ID NO: 42535 - DNA, 101 bp, rice(Oryza sativa)
  misc_feature (71): n=t or c
tgttttgtttctaaagccatagatactggttcatcaaaagattctgcattctcactcagctgagcccttgnggcatccaaagaagagagtagaaggtaact

SEQ ID NO: 42536 - DNA, 101 bp, rice(Oryza sativa)
  misc_feature (71): n=a or c
ggtttttttgactagtagccatgaaagtgaaattgtccgaaaaggataaaagagttaacgacgtcggtcgngctcaaagctctgcgctcaagaatccgagc

SEQ ID NO: 42537 - DNA, 101 bp, rice(Oryza sativa)
  misc_feature (71): n=t or c
caccatcataatcaacactcttttgtgctaatctccctaacacattcccattctccttgtagtaaggtctntgaccatagacaggggcggagctacaatgt

SEQ ID NO: 42538 - DNA, 101 bp, rice(Oryza sativa)
  misc_feature (71): n=t or c
cttcctcttctccgttgaccgtccacgctatacatcttaaatcagcctaggaagtcgctagagcgcatcancaatcaccgatcgatcatctctctcaagtc

SEQ ID NO: 42539 - DNA, 101 bp, rice(Oryza sativa)
  misc_feature (71): n=a or g
gcacaaattcagtcaaacactagcctcatgagtcatgacacactcatgctatgttgctattcgatagattnaatttcagattatagttcagaataccaggc

SEQ ID NO: 42540 - DNA, 101 bp, rice(Oryza sativa)
  misc_feature (71): n=t or c
agcagtactgctccttagctctgtctacatcttatatcacaatggcaggaggccgaatatgtatcctctcnttggacagtaatgaagagcatagcagtgtt

SEQ ID NO: 42541 - DNA, 101 bp, rice(Oryza sativa)
  misc_feature (71): n=t or c
tgttgcataggaatgcattaagaagccttcagatcatcaagtccaacactggcctgcaagaatagtatganggaagacatcacattagaatcagacaatta

SEQ ID NO: 42542 - DNA, 101 bp, rice(Oryza sativa)
  misc_feature (71): n=a or g
gagtttgcatccacgtttggaatttgggccttcttgcaagcttgggcctgaaatcgctgtaaaaattccanccctaaattttcgagttgggctgaaaacga

SEQ ID NO: 42543 - DNA, 101 bp, rice(Oryza sativa)
  misc_feature (71): n=t or c
gcatctcatgttaaaattcattcaaaaaccctgtgaacgccaagccaaaagaaactcatatgatttcccanctcgatccaaatgaccacgtaagaaatttt

SEQ ID NO: 42544 - DNA, 101 bp, rice(Oryza sativa)
  misc_feature (71): n=t or g
ataaattcaggcatggcatcttagcactttggaagtgtagtttggagaaatgacatatcgcagagacacanatggttaactgttatcttaatagaagccaa

SEQ ID NO: 42545 - DNA, 101 bp, rice(Oryza sativa)
  misc_feature (71): n=t or c
ctttctttattcaaggactaaatagcggttcatatggctttcgcaacacgccaacaaagaaccttggtttngttgcgccctgtattccgaggcgaccattt

SEQ ID NO: 42546 - DNA, 101 bp, rice(Oryza sativa)
  misc_feature (71): n=t or c
aaggaatggagcaggcggtaagggcaaggagaaggactagggaggtggaggcaggtgcagggccaaggagngggagcggcggcaacggtgggtagggggag

SEQ ID NO: 42547 - DNA, 101 bp, rice(Oryza sativa)
  misc_feature (71): n=t or g
gggattggatgaagattttgaacccatcatttcctctttggtgtcaaaatctgaacatgtgagcctagggnaggcttactcccagttgctcagctttgagc

SEQ ID NO: 42548 - DNA, 101 bp, rice(Oryza sativa)
  misc_feature (71): n=a or c
catttgagagctatcccaatggtgatgtctaaaagtagagctcctcgaagagaaggatactaaagaaaacngataggttgtttagcaactttcacgtagaa

SEQ ID NO: 42549 - DNA, 101 bp, rice(Oryza sativa)
  misc_feature (71): n=t or c
tccatcggcgtgatgatagccttggtgatgtgagggaggtcgtcgagtaatgtgatgcgaaccgaggtttngggcttgatgcccatgcagtcagccatgtc

SEQ ID NO: 42550 - DNA, 101 bp, rice(Oryza sativa)
  misc_feature (71): n=a or g
tttacaagcacagatacacatcaagtaagtgaatgtcgacatgcaaagtaatgcatgcatcaggataagancaaggttaagatcctttttgctggccatta

SEQ ID NO: 42551 - DNA, 101 bp, rice(Oryza sativa)
  misc_feature (71): n=t or g
gtggttagcacattagtaaagtggatgggaaaaaaaactcttgggctcatatagaatgcatttaccagcancaaggatcatttcatctttcacccttatcg

SEQ ID NO: 42552 - DNA, 101 bp, rice(Oryza sativa)
  misc_feature (71): n=a or g
accaatttctttagctcattcacggatacaggcaactgtttcacgcgggttctcctcacatctatggtctncaactcatggagttctccaatgtcttcttg

SEQ ID NO: 42553 - DNA, 101 bp, rice(Oryza sativa)
  misc_feature (71): n=a or c
ttgaaacatctttctttaaataactctcgacgattactatatggaagaatatttggtaactgtgaagacanggaaaaatatcctgatgaggagttggctga

SEQ ID NO: 42554 - DNA, 101 bp, rice(Oryza sativa)
  misc_feature (71): n=t or g
gatccctcattaacaggtcgagtttcattcgtgtccttcgcaaattcgggtatagaactttccccaactanaaaaattataaaaattagtgtaaatccccc

SEQ ID NO: 42555 - DNA, 101 bp, rice(Oryza sativa)
  misc_feature (71): n=t or c
gagtggattggttggttaaagctccgcatcttgcggcggaaatctcgctctcttctctgcggtgggtggcnggagaagtcgccgccggtgaggcatgggga

SEQ ID NO: 42556 - DNA, 101 bp, rice(Oryza sativa)
  misc_feature (71): n=t or c
tgatctagctaggtgatactgggatgtgttttgccaactgatcatgtatgagttcaaagagtaaggtgganttgttaatcacaaatgaaaatttagggtgc

SEQ ID NO: 42557 - DNA, 101 bp, rice(Oryza sativa)
  misc_feature (71): n=t or c
tcaactattaataccggatgaattaccctccctcccctgatcaactcaacgcggagtggttttggtcgtangtggcaattcagttagcattttcttaaaaa

SEQ ID NO: 42558 - DNA, 101 bp, rice(Oryza sativa)
  misc_feature (71): n=a or c
cttatcttccaaaacccaccgtacgctacttttagccattacatcaagcatagaaaatggtcatataggtnaaatgcagaggaccagggaagtgcactcac

SEQ ID NO: 42559 - DNA, 101 bp, rice(Oryza sativa)
  misc_feature (71): n=t or c
tcgcagtagtccttttcttttcgcaattggttgttgcagtgattttttttttactctcttccagcatacgnatgtctagccgattgcgttgtgtatcaaaa

SEQ ID NO: 42560 - DNA, 101 bp, rice(Oryza sativa)
  misc_feature (71): n=t or c
acggatcaatttagccactagagcatgtccactgtataattcctgaaggaatcttaaggtgagacccactnacgtcatactagcaactactccattcattc

SEQ ID NO: 42561 - DNA, 101 bp, rice(Oryza sativa)
  misc_feature (71): n=t or c
atgtgaccaccgtgaccgagtggccatggaagtaatgagataacttccttacagtgatcaagatagcgtanaacaacttctgaacctgaggatatctcgtc

SEQ ID NO: 42562 - DNA, 101 bp, rice(Oryza sativa)
  misc_feature (71): n=a or c
ctagctctctaactcaatgaatccatgcatgcagggtattcgaactccaagccgaatcagcagggaacaanaaactacggcaactcctacaaagaaaacaa

SEQ ID NO: 42563 - DNA, 101 bp, rice(Oryza sativa)
  misc_feature (71): n=a or c
atgatcttgcctgttttggaccaaggagcacactccgccgctaccaatatgatattgataagatctacagnagctgaagcagatggatcatcactagtgcc

SEQ ID NO: 42564 - DNA, 101 bp, rice(Oryza sativa)
  misc_feature (71): n=a or g
cctctactttggataaacaggccaacgatgtcaaagttattggtgaaaggacatctatatccttacttccngttgcacaattatctctctacttttttcat

SEQ ID NO: 42565 - DNA, 101 bp, rice(Oryza sativa)
  misc_feature (71): n=t or c
cagtcagtacagtgattttttttaaaaaaaaaattccaacgcaatgcagtgcttttcctaatcaccaccanttagttagttgtactcgttttagcttgatc

SEQ ID NO: 42566 - DNA, 101 bp, rice(Oryza sativa)
  misc_feature (71): n=a or c
gtttgctcaaagaaacttaaaccaacctaacttttattttctagtatggatgcatggcttccgatacttgnagtgggctgcacctagtcctggtgtgtctg

SEQ ID NO: 42567 - DNA, 101 bp, rice(Oryza sativa)
  misc_feature (71): n=a or g
aattacggttaattactctttcgatgatagacgacgtacctgttgatagcgagtcatatatgatgatttcnttaatatcaatatatgtcatgttgatagct

SEQ ID NO: 42568 - DNA, 101 bp, rice(Oryza sativa)
  misc_feature (71): n=a or g
cagcgatgaggatgatgccatcatcgacttactagctgcaacactcaaataaacgagagagctccaaggcnaataccggttcaaatcggtattagttggat

SEQ ID NO: 42569 - DNA, 101 bp, rice(Oryza sativa)
  misc_feature (71): n=t or g
cattagttctaaggtggcagtcagtctgcaaggcatggttcctatcaagaaattagttcaggtgaaagtgnctaatgtcacagtgcttccttgttctgctg

SEQ ID NO: 42570 - DNA, 101 bp, rice(Oryza sativa)
  misc_feature (71): n=t or c
atacctatagcgatatatacctatatatgggtactgtgtctgcagatatcccttgtatcaaatctgatagntatcatcacataaggtattctgttggagct

SEQ ID NO: 42571 - DNA, 101 bp, rice(Oryza sativa)
  misc_feature (71): n=t or c
caatttgttgtcacatcaaaagcataccacctatcattggtggtaaaaaaaattgatcagagcaaaagtgnccaataatggaggttatgcggtggttttcc

SEQ ID NO: 42572 - DNA, 101 bp, rice(Oryza sativa)
  misc_feature (71): n=t or c
gccgatagatggatggatgggccatttcaggccttattcagtgggatttgttagtattaatcttgactagnaggcgtcatatactcttgcacgtgttgtgt

SEQ ID NO: 42573 - DNA, 101 bp, rice(Oryza sativa)
  misc_feature (71): n=a or g
gaacttttttatggtccaaatattttcagcgcggtgaacattgacttgtcatcaaactatttagttggtcnaattccagaggaaatagcttctcttgcact

SEQ ID NO: 42574 - DNA, 101 bp, rice(Oryza sativa)
  misc_feature (71): n=t or g
gcaatctatcaaatccagccagtcgaagaagttggaggtactgcagctgccacaactgcggaatattttcncaccttgtataactagtactgagatcaagc

SEQ ID NO: 42575 - DNA, 101 bp, rice(Oryza sativa)
  misc_feature (71): n=a or c
tgaagacagtgcagaatcagaaggatgtgtaataaaacaatcatatgcctggcagtatgtatgaccttggnagaaaaatgtaaaacactgttccatcaaat

SEQ ID NO: 42576 - DNA, 101 bp, rice(Oryza sativa)
  misc_feature (71): n=t or c
gtgtgcctactacttggagagcaaaaaccagcaatacctccattcccgattccaggacctcgtctctctcnccccaaggacccaaggagtgctccaaagaa

SEQ ID NO: 42577 - DNA, 101 bp, rice(Oryza sativa)
  misc_feature (71): n=a or c
ctcgttttgttgggtttcgttgagaaatcaagagcgtttagtggcaacatcgttttgatctcggatttttngttactgatctcgcggtagggtttgaaatt

SEQ ID NO: 42578 - DNA, 101 bp, rice(Oryza sativa)
  misc_feature (71): n=t or c
gaatgtgatgttgatgtattcttgatgaatgatgaacgatgttcttgaagtgctcgggtccggcttgattngagccgagccggtttttctttttgggctcg

SEQ ID NO: 42579 - DNA, 101 bp, rice(Oryza sativa)
  misc_feature (71): n=a or g
cacctctacgaggcctacattggggtagtgcatttccttgacctctttcgcttcttctatgaactccgatngatggaagccaatcgggtttcgggatgttg

SEQ ID NO: 42580 - DNA, 101 bp, rice(Oryza sativa)
  misc_feature (71): n=t or c
ggataaggttgactgccagggaaaaaagatggagagagtggttaggtgggaccaactaggcacgcgtcatngaactcaaagggcgcatccttggctagtag

SEQ ID NO: 42581 - DNA, 101 bp, rice(Oryza sativa)
  misc_feature (71): n=a or g
agagagagtgttctacttctactacaagacggcggccggctggttgttctggacctcatgtactccctccntcccataatataagggattttgagttttta

SEQ ID NO: 42582 - DNA, 101 bp, rice(Oryza sativa)
  misc_feature (71): n=t or g
gagccttgccagtccttgttaaaactccaagaaacaatggagctccttgatcggcgctgattactaaagcntcttctaaagaatttagttatcagtacaat

SEQ ID NO: 42583 - DNA, 101 bp, rice(Oryza sativa)
  misc_feature (71): n=a or g
atcccagacctaaaatgctccccaattgcgtggtttgaaggtgctctcttaatatcatgcacccaacgatnattctgcaacctcatgaatgttttttagat

SEQ ID NO: 42584 - DNA, 101 bp, rice(Oryza sativa)
  misc_feature (71): n=t or c
catgtcagtggcccctcccattgagcacaacaatgttgcccatggcttacgaatatcagggtttacattancggttgacaattaaatttcgagccccatcg

SEQ ID NO: 42585 - DNA, 101 bp, rice(Oryza sativa)
  misc_feature (71): n=a or c
taaattctcttattaaaactttaaacctgctgtgactgtcatgcttgagctcaccattttggcatttggcntggagaacttttcagaactctttcatggtt

SEQ ID NO: 42586 - DNA, 101 bp, rice(Oryza sativa)
  misc_feature (71): n=a or g
ctaatgatctcattaaaaagcataatatcatttacatctccaccaggaaggtttctatttttaactgatcngatgaagttaaagtctcccatgaaaatcca

SEQ ID NO: 42587 - DNA, 101 bp, rice(Oryza sativa)
  misc_feature (71): n=t or g
ggaatcaagaagacattgggtggtggcataactcataaaccaagtctacctcaatatccatgcgcatgccntgttagagcagatacaatagcagactatta

SEQ ID NO: 42588 - DNA, 101 bp, rice(Oryza sativa)
  misc_feature (71): n=t or c
tgaacctccaaaacctcaaaaaattcacaattccatcctggcttgctctgatgcttgtgagttgtgatgantgatgaggtcgggctaccagcagcagcagg

SEQ ID NO: 42589 - DNA, 101 bp, rice(Oryza sativa)
  misc_feature (71): n=t or c
tcattacccaccttctcctccttgttggcatattatacggctgatggctgttacaaggaaaataaacaggncatgttgcaactggagcaatcaaagtactt

SEQ ID NO: 42590 - DNA, 101 bp, rice(Oryza sativa)
  misc_feature (71): n=a or g
gggcagcgacttgtttttaccgtcatttgcagcgagcactatacaccagtacactcctcctaccctgaggntaccacaatgattatctataggctttttac

SEQ ID NO: 42591 - DNA, 101 bp, rice(Oryza sativa)
  misc_feature (71): n=a or c
gattgtattgagttgaactatacctcaaaacttgattctcatgtgctgagaaatagtctgatgaaaaaatnacacatatttccagtcgacaaacttggaat

SEQ ID NO: 42592 - DNA, 101 bp, rice(Oryza sativa)
  misc_feature (71): n=t or g
aaaccatcttcctcagcataatagtctgctctgattacttcgattgttttcctacttcgcctccctcactngaaacggcctctccctcccactaaaccttg

SEQ ID NO: 42593 - DNA, 101 bp, rice(Oryza sativa)
  misc_feature (71): n=t or g
atcccatccttgaggaggcttatctgatgagaaaccaccctgctttgcttgcactgaaactgcactcacantttttcatggcatgctatgaaacattgatg

SEQ ID NO: 42594 - DNA, 101 bp, rice(Oryza sativa)
  misc_feature (71): n=t or g
ctagaccgtttcacacaaccaaacgcatcatcaaggaaaagaatgcacgaaatttgaaagctagtcagcancatcagtaaataagattgggtcaataggtt

SEQ ID NO: 42595 - DNA, 101 bp, rice(Oryza sativa)
  misc_feature (71): n=a or g
ggcgtcgatgtgctatccctttctattggtaagagcggtgatgagttctttagcagcttccacgctgtgangaatggcattactgtcattttcgcggcagg

SEQ ID NO: 42596 - DNA, 101 bp, rice(Oryza sativa)
  misc_feature (71): n=t or c
taggctgagggagggagagcacgagcaggggatgtgcggatggtggggaaagagaagggaaaaagatagtngggcccacatatggctagttgctgaggatg

SEQ ID NO: 42597 - DNA, 101 bp, rice(Oryza sativa)
  misc_feature (71): n=t or c
aagcatgagtttcgagacggtgatgaatgctgcctaatggcatgaggaattgagaccagagcacttgttgnttagagagataccactctatgactttccta

SEQ ID NO: 42598 - DNA, 101 bp, rice(Oryza sativa)
  misc_feature (71): n=t or c
cggtaaaaacatcttcaatttttataatagtagaggttctgatggttttccaacgctcctttattattagntttaaggtcactaagggaagtttacttaca

SEQ ID NO: 42599 - DNA, 101 bp, rice(Oryza sativa)
  misc_feature (71): n=a or g
tatttggttttatttttatttacagaaggaaaataattaaaggtaggtttgggtagccattgatgttgcangagtgtgtgtgtgtgtgtgtatatgggggg

SEQ ID NO: 42600 - DNA, 101 bp, rice(Oryza sativa)
  misc_feature (71): n=t or c
tgggctgccacgtcaacacacttagaccaagtcaacttgctatgtcaccaaaaccgctttcgaaaccactnaaggagtcaatttggaccggtttttaaaat

SEQ ID NO: 42601 - DNA, 101 bp, rice(Oryza sativa)
  misc_feature (71): n=t or c
agtgcatagctatgctataataaaatcaaggaaaaatctcagtactcctgacctgacaataggcacatgangacaaaaaatagagtaaattatatctattt

SEQ ID NO: 42602 - DNA, 101 bp, rice(Oryza sativa)
  misc_feature (71): n=a or g
ttgaacctgccgcagcaagcggcaagtgacggcgtgctctgattcaaatgaccctgatgaagcaccggatntcaaaagctgttaattgtagttgccgtttc

SEQ ID NO: 42603 - DNA, 101 bp, rice(Oryza sativa)
  misc_feature (71): n=t or c
aagagtggcaaatagttaaaagcccccctagcaattgaatgcgcatctatagatgcaaatgttatgtattngattctttcttcagtgtcaaatttatgcct

SEQ ID NO: 42604 - DNA, 101 bp, rice(Oryza sativa)
  misc_feature (71): n=a or g
caccgaggacgccgtctggggctcgcccaccttccacaagatgggcagggagaaggtgctgctcatcaacncgctcctgcccttcggctacgagctgctca

SEQ ID NO: 42605 - DNA, 101 bp, rice(Oryza sativa)
  misc_feature (71): n=a or c
tgtttgctacacttcaactagaattccgtaaccaagtccttacataccacatgcatcacagataccaatcnttaacacaagcttcactgtgtacaaatgca

SEQ ID NO: 42606 - DNA, 101 bp, rice(Oryza sativa)
  misc_feature (71): n=t or c
cctgctcgacgaaatgcctctctgctgcgctgcgtttcgttgcttgttaagagtcatcaaagttgtgtttngaagccttgccatcagcataaagaatttgc

SEQ ID NO: 42607 - DNA, 101 bp, rice(Oryza sativa)
  misc_feature (71): n=t or g
gctaacgttgtttctaggaatatgattaccaatttgatgagctgctacatcagtgctttaacgtggaacantattacaagatttttcatcacttcaacttc

SEQ ID NO: 42608 - DNA, 101 bp, rice(Oryza sativa)
  misc_feature (71): n=a or g
atctagtttgttagttgataaacctgtaggagactggtctgcaatttacgactctattggttttaggactngagatcaaaatgaggcagttcagaacacaa

SEQ ID NO: 42609 - DNA, 101 bp, rice(Oryza sativa)
  misc_feature (71): n=a or c
tgttgaggctatccgtcctttggggttttactttgacctccttgtgcttcggtccgttcttgatctacccnatggagcaatgctccatccttggtctcctt

SEQ ID NO: 42610 - DNA, 101 bp, rice(Oryza sativa)
  misc_feature (71): n=t or c
gaactgaaaaaaaatgcagatgaaataagtcctatagcatcgatacaatcacagtggttatagagaagaantatagaagtggtatttgaagtggcaaatag

SEQ ID NO: 42611 - DNA, 101 bp, rice(Oryza sativa)
  misc_feature (71): n=t or c
tgatgtacgtgtgtgcattcatagagacgagtatgcgtgcattgtaatcaagcgtctgcgtgtgttcgtangatgtttttttttcagaaaaaaaaaaaccc

SEQ ID NO: 42612 - DNA, 101 bp, rice(Oryza sativa)
  misc_feature (71): n=a or g
tatacaatcgtagcgatcaattaacacagggagaaaaattgatatatatgcattgttcccatttaaattcnaattttaatttagcagatatgatcgagttt

SEQ ID NO: 42613 - DNA, 101 bp, rice(Oryza sativa)
  misc_feature (71): n=t or c
gccgttctccatgtactcatagacaagcagatgctctttctccttttccttccggaacggtggcaggaggngccgctgcttctcctcgaccaacacatcac

SEQ ID NO: 42614 - DNA, 101 bp, rice(Oryza sativa)
  misc_feature (71): n=t or c
catctcaaatcatccccaatataaacacttgcagatcacgatcatcatccaaagatcgatcatgcgtttgnccttccaagttctaccctctacgctctatg

SEQ ID NO: 42615 - DNA, 101 bp, rice(Oryza sativa)
  misc_feature (71): n=t or g
catcgctctcaccagattgcatcatgccgtgcctactccttttccttcgcttcatcacgagaggcagatanagagagagaggatggccggtgaaatggaca

SEQ ID NO: 42616 - DNA, 101 bp, rice(Oryza sativa)
  misc_feature (71): n=t or c
attgagtctagttccgatccccaccgttgactgaaattgtccttcaagaatcctgactctcttaccttctnacatggtatcccgatcgcactagacctctg

SEQ ID NO: 42617 - DNA, 101 bp, rice(Oryza sativa)
  misc_feature (71): n=a or g
gcggggtagtctcaagatcttcggcatcgagatcccgctttatgccaattggtctttctctgattccctanagtaagtatcaaagctgctctatttcgaaa

SEQ ID NO: 42618 - DNA, 101 bp, rice(Oryza sativa)
  misc_feature (71): n=a or c
ctgacaattttccaactgtaaacgaggtgatgaaattatcaattatgaaaatttcttggaccggtaagaanaaaatgcaaaataataaaaaaaagaaagta

SEQ ID NO: 42619 - DNA, 101 bp, rice(Oryza sativa)
  misc_feature (71): n=t or c
gactgatgaggattttagcaattgatggaggtgcaatctctttcatagaccacacactaaaacaggcattncaaacttccatcttgatcacatacccaaca

SEQ ID NO: 42620 - DNA, 101 bp, rice(Oryza sativa)
  misc_feature (71): n=a or c
ttccccttggcttgagctccaccttggtcagccaggttggaagcagtcaagcacatggaagccagaggtcnacagtgccagcccaatggctgtgggtaagc

SEQ ID NO: 42621 - DNA, 101 bp, rice(Oryza sativa)
  misc_feature (71): n=a or g
gctagtggtgcaatctcataaaacctttgggaataaatttagctctatttgtatctggggactagtccctntcacatcggatatttgaatactaattagaa

SEQ ID NO: 42622 - DNA, 101 bp, rice(Oryza sativa)
  misc_feature (71): n=a or g
gcatggtacctctgctattgtagtactcctatgttagtaggatttgacatatgctcctagttccttctccnttttgttcccctgatatttttcccaaaaac

SEQ ID NO: 42623 - DNA, 101 bp, rice(Oryza sativa)
  misc_feature (71): n=t or c
ggctgaaactaaaagatcaagacatatttttcggcacatgatgaaactgatgaagatgaaagattttttgngcacgtaaacgagaaagctattagcacttg

SEQ ID NO: 42624 - DNA, 101 bp, rice(Oryza sativa)
  misc_feature (71): n=a or c
atatataatcagcttcattgaaaaaggttgcgtatgtccatcactgcattaatcgctttttcgtggctaanacaaaatcacctaatgatttgcggtgtaat

SEQ ID NO: 42625 - DNA, 101 bp, rice(Oryza sativa)
  misc_feature (71): n=a or g
ccatcggcaacgtcgcctctcggtcaatctccaccgtttcaggtttgcagtcaacaagcgcataataggancgtttcaggtttgcagtttcagagtgccaa

SEQ ID NO: 42626 - DNA, 101 bp, rice(Oryza sativa)
  misc_feature (71): n=t or c
ctttcccttatcctctttggctctcgttagcatgaagggttggtctgagtagctgatagtattactccctncgtccctaaataaaagggattttggttgga

SEQ ID NO: 42627 - DNA, 101 bp, rice(Oryza sativa)
  misc_feature (71): n=t or c
ttgggtcatcttctattgctgtagttttactttggatcacccctagggcctagtccaatcttttttttacnttgcactagctaactttatatttgttatat

SEQ ID NO: 42628 - DNA, 101 bp, rice(Oryza sativa)
  misc_feature (71): n=a or c
tgccttacgtgatctcgtggcattccattccatggcttggtttatatggtgagatttcttctatcgctaanaatgtcatttgagtagctagtagcagagcc

SEQ ID NO: 42629 - DNA, 101 bp, rice(Oryza sativa)
  misc_feature (71): n=t or c
cggtgcatgctacgcggcattggaggacccttcgtcgccgaggtacatgaactgcaagtacggcaagctcnggatgctggaggacgccggtgccgggtacg

SEQ ID NO: 42630 - DNA, 101 bp, rice(Oryza sativa)
  misc_feature (71): n=a or c
tttggggatttcacccgcttgggttttgccgccaaatccggaagaggagggagaggagaaagcggagctgncatgcgccgccgccgcctgccatggttggg

SEQ ID NO: 42631 - DNA, 101 bp, rice(Oryza sativa)
  misc_feature (71): n=t or c
acatacctgagaattgattccatgatataggtatcggtggcataagtaaagaatatgaataatgtggtggngaaagaacctgacgattggatgcaaaccat

SEQ ID NO: 42632 - DNA, 101 bp, rice(Oryza sativa)
  misc_feature (71): n=t or c
ttgttgttatgcttctattattctacttaatggattctcaggaggccccgaattgcaacttaagttatgtnataaattatagatagcaacaatgtttgtct

SEQ ID NO: 42633 - DNA, 101 bp, rice(Oryza sativa)
  misc_feature (71): n=a or g
cctgaaacggaaattcaggttgtgacaaattccccacaatgtgtgtatgtatagagtgaggaaaggaatanatttaccgcaggtccctcaacttaacagcg

SEQ ID NO: 42634 - DNA, 101 bp, rice(Oryza sativa)
  misc_feature (71): n=t or c
tttatagccacaaatagaacagaattgaaaggaacagtatacctttgagcttgtcgaaaacccatttcgcnttctcctcaacagtgctcgagagacgctga

SEQ ID NO: 42635 - DNA, 101 bp, rice(Oryza sativa)
  misc_feature (71): n=t or c
gatggttgcgatcggcgatctcaatgatgaagacgattgtgactgcacgtgacagcaacctcgacgatgangaaggttgtgaccgagcttgggcgaggcgg

SEQ ID NO: 42636 - DNA, 101 bp, rice(Oryza sativa)
  misc_feature (71): n=a or g
cctctaccatcagatctggagctacggggctcgctcgcctcttccaccatcgtcaaatccagcagccaatngacgtctactgtcatcatcgggtcccgatc

SEQ ID NO: 42637 - DNA, 101 bp, rice(Oryza sativa)
  misc_feature (71): n=t or c
gaaaaagtttttccaaaaaggtaaagcatgactgtttttttaggccgcaggatcgataacatcagttccgnggaacttctagatatcggaatggagaggcg

SEQ ID NO: 42638 - DNA, 101 bp, rice(Oryza sativa)
  misc_feature (71): n=t or c
gggttgtccttagcaaattcgtagcacaacctctgtagaagccgggaattccctccttctgatacacttgnttgatacagtcgattacaccggtgtagtgc

SEQ ID NO: 42639 - DNA, 101 bp, rice(Oryza sativa)
  misc_feature (71): n=t or g
cgtcggagacggatctttcttgtagctttcttccttgcagcacagcttccacctgaactgtgtcaccaagnagtgcatggtcaccaatgtctcagtccttg

SEQ ID NO: 42640 - DNA, 101 bp, rice(Oryza sativa)
  misc_feature (71): n=t or c
cttttcccaaatataatattgaatgagtagataaaacctagcggaatggatgtggacaaacctctctgtcnagattcattatactaggtaggataacatca

SEQ ID NO: 42641 - DNA, 101 bp, rice(Oryza sativa)
  misc_feature (71): n=t or c
ggaaaggagcctcatccgtgaagaggacggttcgttcctccttccatttgacctaaaccccaaacgccctntgattgcggtgcggagggacatcagatggc

SEQ ID NO: 42642 - DNA, 101 bp, rice(Oryza sativa)
  misc_feature (71): n=a or g
gccttgccacagccatagcagaacgattgcctacagttactgcataacatatggttgcagcctgatactcnggagatggcagtaccacaatgtggacatcg

SEQ ID NO: 42643 - DNA, 101 bp, rice(Oryza sativa)
  misc_feature (71): n=t or c
ataacgtcatgttacgtgctcacactctcacactctatccatgttagggtatcctaaatctaggctggtanatatatatatattaagatcgatgaagtcag

SEQ ID NO: 42644 - DNA, 101 bp, rice(Oryza sativa)
  misc_feature (71): n=a or c
cttcttctccattgtttcgtcgacgcagtcgcagcgggagatcttcaacaccggcaagaacggcaacaacnatggtggatggaacaagggcggcgggcagc

SEQ ID NO: 42645 - DNA, 101 bp, rice(Oryza sativa)
  misc_feature (71): n=t or c
tgataaaaataatatgtgtaacttttgtagacgggggagtaatgaattgtagatgttattattagacatgnatgttgagttttaggtgcttagtggattga

SEQ ID NO: 42646 - DNA, 101 bp, rice(Oryza sativa)
  misc_feature (71): n=a or g
gaggcttgcgtccgaatttgccgactaagagttcatgacgaacacccttagtgaaagtggcaatgatgacntcgtcggtaatgtcagagatcttattgcgt

SEQ ID NO: 42647 - DNA, 101 bp, rice(Oryza sativa)
  misc_feature (71): n=t or c
gcctcttgatgctgccaggaagacgaagacgacgaccaccaaatgtaacagtggacatggttggtcactanggagtacttattactcttgtaaggctgtgt

SEQ ID NO: 42648 - DNA, 101 bp, rice(Oryza sativa)
  misc_feature (71): n=t or g
tgagtttgatttgatttccatcgtggatcacgttttgtgaatacgtaggttgaagtaattcttttataggngtgataatacggagaaggtaaacttgatta

SEQ ID NO: 42649 - DNA, 101 bp, rice(Oryza sativa)
  misc_feature (71): n=t or c
tccccgctagatctgggcggagcggcgctgatctggcggtttttcgccaccgcctccctaggtgactcccnaagtcacccaagcacgtgagagatgagggg

SEQ ID NO: 42650 - DNA, 101 bp, rice(Oryza sativa)
  misc_feature (71): n=t or c
ttccacatcactccgtaggtctaataacagcataattgacaacagtgacaattcatcatgccatacatcgngatcactcctgacttttattatccactccg

SEQ ID NO: 42651 - DNA, 101 bp, rice(Oryza sativa)
  misc_feature (71): n=t or g
ttcacctaccttgctataggtgatggctctaacttgacttgcaaagaaagagttcgtcaaggtacagtacnatgcatagattgtttcttcagagttcagag

SEQ ID NO: 42652 - DNA, 101 bp, rice(Oryza sativa)
  misc_feature (71): n=t or c
tcgccggcgccaaatcccttctcccctctcctcgccggtgcccgtagtttagagcaacaataacgagtggnggcacgacctttacactctcctcggtggcg

SEQ ID NO: 42653 - DNA, 101 bp, rice(Oryza sativa)
  misc_feature (71): n=a or g
cagatgaataggctggagcagcaatacgcacgaacataaggtatttgctataatcgtaggctttagtccanccatgataattttgttgttgtcctgaaagt

SEQ ID NO: 42654 - DNA, 101 bp, rice(Oryza sativa)
  misc_feature (71): n=a or g
ccagctttatattagtacctcctgagaagaccgatccaaatctacatagtctccaatccactgtccaaggntaaaagattattagcacaaaaacaaatcca

SEQ ID NO: 42655 - DNA, 101 bp, rice(Oryza sativa)
  misc_feature (71): n=t or c
gcacatgagggacacacgacacaatcatacagtacaaccaagctctgctagagaactaaggttcaagtagntatgaggacttcagtagcaggccgtcagag

SEQ ID NO: 42656 - DNA, 101 bp, rice(Oryza sativa)
  misc_feature (71): n=a or g
acggttacataccccggggccacttttcatgagggagtgccaggagcaatgtcaagtgatgggctatgacntgccaaagggtacaaaatttctactaaatc

SEQ ID NO: 42657 - DNA, 101 bp, rice(Oryza sativa)
  misc_feature (71): n=a or g
tcccgtgagtgcaactcgatcggttttttacttttacaatgagcacatccacaacatatatactacccccntttttttaatgtacaacttcattgattttt

SEQ ID NO: 42658 - DNA, 101 bp, rice(Oryza sativa)
  misc_feature (71): n=a or g
agggtagatctaaaggatgagacatagataagcgataccttgaatcgaagtcaagttgacgatggtctatngtagatctgaacatcgctgccttatgatga

SEQ ID NO: 42659 - DNA, 101 bp, rice(Oryza sativa)
  misc_feature (71): n=a or c
aataggcaggatggttactcaaagactcaacggtgagcttgaaagaggtgtagatgctatgctcggactgncgaacaagaaacccttgtgcatactcttga

SEQ ID NO: 42660 - DNA, 101 bp, rice(Oryza sativa)
  misc_feature (71): n=t or c
tttttagctaatcccaattaagaaagagtgatatacgtactgaatcaaatactctctctgtcccattgtcnaggtttatagctaaagatacactctttaag

SEQ ID NO: 42661 - DNA, 101 bp, rice(Oryza sativa)
  misc_feature (71): n=t or c
ctgccaaaatccccacgtgttttcagaaaaatctgtgatcaggctttgcaattggtgaatatcgtcatggntgaagatgcaagtgggccggtgacacgtaa

SEQ ID NO: 42662 - DNA, 101 bp, rice(Oryza sativa)
  misc_feature (71): n=t or c
agggaagcagagttttatgcagattaagtatgcatgatccaccaggcgcaaactgtctgcaccttctgatngaagtgccagcggtagctctcgaggaaaac

SEQ ID NO: 42663 - DNA, 101 bp, rice(Oryza sativa)
  misc_feature (71): n=a or g
agaaaaagaacaaccattagaatcacaaagtgttggactagctaacaatcgcgctgaaattgaaaagcctnacggtgcccaccaagttcctggaaaagctg

SEQ ID NO: 42664 - DNA, 101 bp, rice(Oryza sativa)
  misc_feature (71): n=a or g
acaagctgctgcaggttttgaaagaataggatacatctctccactagctgctgcaggttgcgaaagaacancatacgtttctccacaagctgctgcaggtt

SEQ ID NO: 42665 - DNA, 101 bp, rice(Oryza sativa)
  misc_feature (71): n=a or g
cctatttgccacgtactaactagttcatagaattacattaacacgtggcaaatgaaaaaagaaccgtacanctgacatgtagaatacataataagaaaatt

SEQ ID NO: 42666 - DNA, 101 bp, rice(Oryza sativa)
  misc_feature (71): n=a or g
ggcgtagagcacgggagtataggggatgtgccaccgtcgatccgtcgtgccggaaggtggatggaaaaagnaaggaggcgcggccgtcgcgccggctcgaa

SEQ ID NO: 42667 - DNA, 101 bp, rice(Oryza sativa)
  misc_feature (71): n=t or g
ttacggctgccggctgcccggccgactgactctactgaagccggccatgagagatctgagatcatcgacgnagtgtgtcggtgtgctgtaatgttatatat

SEQ ID NO: 42668 - DNA, 101 bp, rice(Oryza sativa)
  misc_feature (71): n=t or g
agcagcacagatatgataatcagtgatggcttcctgcttaccagttaccagtgtttcatttgtcatggaantggcagctagaacacaggactgctagaatc

SEQ ID NO: 42669 - DNA, 101 bp, rice(Oryza sativa)
  misc_feature (71): n=a or g
ttttacagttttatgttgtactgtcttgattgtgtgtaggagactactttatctattactttaactagctngatggcccgtgcaattgcgcgactagcatc

SEQ ID NO: 42670 - DNA, 101 bp, rice(Oryza sativa)
  misc_feature (71): n=a or g
aagaaactgcaaaagatcacaacacagtagccttctctcaaagaacacaagggtgaacagaaactggaacncagaagcaagaagcaacatagcatcacagc

SEQ ID NO: 42671 - DNA, 101 bp, rice(Oryza sativa)
  misc_feature (71): n=a or g
gaggacttggtaaaggaggccaaagatgcatgtgaagctgaacaaagcacatgaacgcaataagccagtcngtagcatgagagaagaacacagtcgcatga

SEQ ID NO: 42672 - DNA, 101 bp, rice(Oryza sativa)
  misc_feature (71): n=a or g
aagactggggaacatgaattcaccattagccgatactttggtgatccactcatttaggttatccatctttnccaatgtaaattccctcaatttcctgaatg

SEQ ID NO: 42673 - DNA, 101 bp, rice(Oryza sativa)
  misc_feature (71): n=a or g
cagtttgtaagacgtaataagaaagctcaaacgggcagacgtgaagacatcatttggatgtactccctccnttttttaatagatgacgctgttgacttttt

SEQ ID NO: 42674 - DNA, 101 bp, rice(Oryza sativa)
  misc_feature (71): n=a or g
gctgattcccaacatagtcaaatttgaagcttcttctttggcgtcagcttcctccttagagacctgatggnctgagagtagctgttagtaggctgggtact

SEQ ID NO: 42675 - DNA, 101 bp, rice(Oryza sativa)
  misc_feature (71): n=a or c
gctgatcaaaacgaacacacaacagtttgttatacgccatttattttctttttccttgatgacatcagttngccggaggctgtttctgatcacggcggatg

SEQ ID NO: 42676 - DNA, 101 bp, rice(Oryza sativa)
  misc_feature (71): n=a or g
caacaacaacaacaacaagatttaagtaaaaaaaacaacaagaagaagaaaccccaccgaggtggccggtnggtggggatggaggaggcggtaccaggcgt

SEQ ID NO: 42677 - DNA, 101 bp, rice(Oryza sativa)
  misc_feature (71): n=t or c
atcggtacactattattgatgatgatgattgacggggctctgtgctgctcatgaggcgaggaaacaatccnggcccatgcgaaattgtgcgttcggttaag

SEQ ID NO: 42678 - DNA, 101 bp, rice(Oryza sativa)
  misc_feature (71): n=t or c
gttgggaggcccgcgagcttcctccaccctctcagcgatcgccgctacacccatcgccccctaactgcttngctcgccgccgccgcacccgccgcccgccg

SEQ ID NO: 42679 - DNA, 101 bp, rice(Oryza sativa)
  misc_feature (71): n=a or g
tcacgggagaatatcaagcttccagcagacaagggatgagacgatcccagaagcctgggaacatctgcaanaatacgtggccgcatgtcctcaccatggaa

SEQ ID NO: 42680 - DNA, 101 bp, rice(Oryza sativa)
  misc_feature (71): n=t or g
caatgcagaaaaaaaatgtgatgtttcaaatgaagtgcaatgtgcaatgtgctgtgaataagcaatgttanatttcaattctgaattttggatgaagtttt

SEQ ID NO: 42681 - DNA, 101 bp, rice(Oryza sativa)
  misc_feature (71): n=a or g
tacttttccaaagtatggtgaggggtctggcaggttgtagatggtcaaaaacaattagtaaaccttcctgngttggaactggtctattttccacatatatg

SEQ ID NO: 42682 - DNA, 101 bp, rice(Oryza sativa)
  misc_feature (71): n=t or g
tatcaattcaacgtaaagataaaataggcactaaggtagtgcaaaataagaaaaatacaactactagaggntttttaccggcgaagtaacctcaaccagaa

SEQ ID NO: 42683 - DNA, 101 bp, rice(Oryza sativa)
  misc_feature (71): n=a or c
gtaaggaataatgagtgggccgatagagatgatgagagaacagtttgggatcgatcaaacctatatgtatnaatgcccatatcctaagtagtttgataggg

SEQ ID NO: 42684 - DNA, 101 bp, rice(Oryza sativa)
  misc_feature (71): n=t or c
ccctccaaggagagcttcgtgttccggagctcctactgcgagccaacaaagaacacggcggcgcaggcggnggccgccggcaacggcatcgaccaccggcg

SEQ ID NO: 42685 - DNA, 101 bp, rice(Oryza sativa)
  misc_feature (71): n=a or c
ccaccacatctacagatatatacgtgaggaaaggtgtgtaggttgattaggggataaattccgctgggtgnattccatggcccttcaagatggcgtagtag

SEQ ID NO: 42686 - DNA, 101 bp, rice(Oryza sativa)
  misc_feature (71): n=a or g
atggtaagcttaaaggaaattcataacactgttaacatagctgccatctccaatccatacgatttccagcnatccctggtcttttaagaagttgctaccaa

SEQ ID NO: 42687 - DNA, 101 bp, rice(Oryza sativa)
  misc_feature (71): n=a or g
tcctgatgagattgttgaggtttcagctctatctgttagcataccggcttggttacaagatgttcctgctngttatgtcaatgatcctcacacgcagcgtg

SEQ ID NO: 42688 - DNA, 101 bp, rice(Oryza sativa)
  misc_feature (71): n=a or c
ggctaaacgggcaggattaccggtttcaaccgatgtatttggtgtaaagagaacttttacggtacaatctnttagtatatactagtagtatatagaagaca

SEQ ID NO: 42689 - DNA, 101 bp, rice(Oryza sativa)
  misc_feature (71): n=t or c
tttaattcacatccctcaaccgaaaaactggatatagagtagtgccccagcttataaaaccagtgcaagtnaactcccttgatagtattgatggtggtttc

SEQ ID NO: 42690 - DNA, 101 bp, rice(Oryza sativa)
  misc_feature (71): n=t or c
caaacagtttaggtccttctctttaatcgggttaaccatgtaacacagacctaagcccgtgctggagctgnttttgcttataaattgatgcatatttcatt

SEQ ID NO: 42691 - DNA, 101 bp, rice(Oryza sativa)
  misc_feature (71): n=t or c
cattatctaagaagtgattagtaactatgcgtccttattatatattgaggtgtggttgcccgaacggtcgngccaaattctatacttcctccgttttataa

SEQ ID NO: 42692 - DNA, 101 bp, rice(Oryza sativa)
  misc_feature (71): n=a or g
atagtgtggtaaaaattgaaaacgaaccgagaaaagtgggatgcgaggaaaggtgaggtggtaaaaaacgngaaaaccggaaggagagggcgttgtgcggt

SEQ ID NO: 42693 - DNA, 101 bp, rice(Oryza sativa)
  misc_feature (71): n=t or g
tcgtgatgaggggaactcaccggtgcacgacacgacgacggatggcgatagcggtgaggttaaagcagcgncgcgactcgggttgatggcagcggcggcgc

SEQ ID NO: 42694 - DNA, 101 bp, rice(Oryza sativa)
  misc_feature (71): n=t or c
cggcttaccaagtggctgcaaaggatgaccttggccccgttgccaatgaggtgtttgatggtggggatggnggctatgactcgggtgtcgtcggtgatgtt

SEQ ID NO: 42695 - DNA, 101 bp, rice(Oryza sativa)
  misc_feature (71): n=t or g
ttttggcatttaggaggatgtaacagtcccttaacgatggagcattaagccgattaattagttgcatactntattagtgtagtacgaaatgaagaccctgt

SEQ ID NO: 42696 - DNA, 101 bp, rice(Oryza sativa)
  misc_feature (71): n=a or c
gttcaactaaaaatacattttaaaatcacatagattttagcacatcatctggtaggtaattcaatgttgcntgcctgtgtttgtgtgctagaaacatatta

SEQ ID NO: 42697 - DNA, 101 bp, rice(Oryza sativa)
  misc_feature (71): n=t or c
caaccatatttggagtagctctcagctgctctcgtgaccttgaactcaagatccacatccattgtagcatngtcgagcttggtgacgctgctgccgctgct

SEQ ID NO: 42698 - DNA, 101 bp, rice(Oryza sativa)
  misc_feature (71): n=a or g
gacagtgccaatttctgtcgcccaataaacgagctctcaccgaaactactctgtacatcccataaaaaaanggaagaagaacgaattacccctcgaactat

SEQ ID NO: 42699 - DNA, 101 bp, rice(Oryza sativa)
  misc_feature (71): n=t or c
ctgctatctaggagacaattgtgtaacggtttgagagtaaccagagttcccctcgatggaaattgttgggntatgagttgcaaaagccggcagagtgctgg

SEQ ID NO: 42700 - DNA, 101 bp, rice(Oryza sativa)
  misc_feature (71): n=t or g
cccctcaacattttccgtaatttcatcctcactactttgagcatactcctatccgcttgattcctcatgcncacttggctccggcgtgggctcacgacgac

SEQ ID NO: 42701 - DNA, 101 bp, rice(Oryza sativa)
  misc_feature (71): n=a or g
tgtgggaatgatcggattaccatgggatagcagcgaagtgcagggctatgttaaaaaaatgagaaaagacnaagtttatataaatagcaaagaggatgcac

SEQ ID NO: 42702 - DNA, 101 bp, rice(Oryza sativa)
  misc_feature (71): n=t or g
atggtgaggtctggatagttctatcagcaggagcttgaaggacactggaatctgttagttcatcaacaganaaatgaatttcatttccttctcccccaaat

SEQ ID NO: 42703 - DNA, 101 bp, rice(Oryza sativa)
  misc_feature (71): n=t or c
aatctgcataaaactctgctttccccatttaccaagttcatcgttgagtttcagaatccagtcaagcatgntgcataatatttgctttttcaggaataaga

SEQ ID NO: 42704 - DNA, 101 bp, rice(Oryza sativa)
  misc_feature (71): n=t or c
tgcttacgtgcgataagcacaatccttgagtccattagtagccttcctcatttgtttccccaaatagagcngactttgttgcctattttacgaagaatgtt

SEQ ID NO: 42705 - DNA, 101 bp, rice(Oryza sativa)
  misc_feature (71): n=a or c
tttttagttttacttgtcaaaactgaaaatgtggtctcgagattgtgcaggaagaggttatcaaacaaganaatatatggatttgttggttgattggtttg

SEQ ID NO: 42706 - DNA, 101 bp, rice(Oryza sativa)
  misc_feature (71): n=t or g
tttttaactaaatttattctcatatatgggatttgcggtgtttgaaaattctggcatgtgatgtgaagtangactacccaaccaaaaattccttggccacg

SEQ ID NO: 42707 - DNA, 101 bp, rice(Oryza sativa)
  misc_feature (71): n=t or c
gtacaagctgtcaattaaccttatgccccacgtatagacaacagggacacatgtgtgcattttcttttgcngaaaacataggtcgcgaagatcaagtcaac

SEQ ID NO: 42708 - DNA, 101 bp, rice(Oryza sativa)
  misc_feature (71): n=t or g
aatttcatgaggggatgcatccaagtttctacgcatgcatctggctcacctgcattgactttaggaattanaaaagtagggtgaaaactgatctagagttc

SEQ ID NO: 42709 - DNA, 101 bp, rice(Oryza sativa)
  misc_feature (71): n=a or c
acctcaacaccattcaacgctaggtcaatgcgaggggcatttgcagtgaagagctcttcacaggtttcagnagccaatgatctaaaaacatatcaattgaa

SEQ ID NO: 42710 - DNA, 101 bp, rice(Oryza sativa)
  misc_feature (71): n=t or c
atatgttgtgaagggaatgtgggtatagaattagataggctataaccgggtaactaaggtaggtaggcaangataaattttatattactaaaaaaattgaa

SEQ ID NO: 42711 - DNA, 101 bp, rice(Oryza sativa)
  misc_feature (71): n=t or c
atgcccgtcacgaacgaatcaacattagcattcaacaaaaatgcagcgatatgatcatcgacatgtgatgngatcgcgaatcgattctctgaaaaaaagac

SEQ ID NO: 42712 - DNA, 101 bp, rice(Oryza sativa)
  misc_feature (71): n=t or c
ctcacctaacccttgtacggctgtggtgcctcttagagcttcatgcaggggggaaaggtaggcttcctttntgctagatccatcattcttggggaaggaac

SEQ ID NO: 42713 - DNA, 101 bp, rice(Oryza sativa)
  misc_feature (71): n=t or c
ggtcgtattgaagccaagctgttcgtttcaaataacatattgaactacttcctcgttttatattataagantttctagcgtaacccatatatatatatata

SEQ ID NO: 42714 - DNA, 101 bp, rice(Oryza sativa)
  misc_feature (71): n=a or g
gtgctagtgtacgttggatcgatatagttcaagtctgctgacacggtccttctctcatttttgattttcancacaagctcggctgacccaaagtcggagac

SEQ ID NO: 42715 - DNA, 101 bp, rice(Oryza sativa)
  misc_feature (71): n=a or g
attctcccactacatccacttcaagtggtcgagttatgactacccgtgatcctcgaccagcggtgtagcgnttctcccactacctctactccagcaaagtt

SEQ ID NO: 42716 - DNA, 101 bp, rice(Oryza sativa)
  misc_feature (71): n=a or c
cccacttaaatagtaccaagcacaaaataaaatccatagaacaaaaatacaggagggcaagggctcaggcngacagaagcagcagaagcccagacatatat

SEQ ID NO: 42717 - DNA, 101 bp, rice(Oryza sativa)
  misc_feature (71): n=a or g
acgagtgtgtcacagtatgcccgttaaatatcgttctgaggaattaatcatcaaactttggctacagaccngctgtccactgggtttgctgtcgcagatgt

SEQ ID NO: 42718 - DNA, 101 bp, rice(Oryza sativa)
  misc_feature (71): n=t or g
caccaatggattctggagagagagaaggagagagaggggacatgaaaaacatatggctagtaaaatgatgnaagcatggagatgtggggtgctcattttga

SEQ ID NO: 42719 - DNA, 101 bp, rice(Oryza sativa)
  misc_feature (71): n=t or g
ttccaaacctggatctcgcaactttgggcaaccacaaaacaactcgttcccaaagcatagcaaatgcaatnctactccctccgttccatttgaagtgcatc

SEQ ID NO: 42720 - DNA, 101 bp, rice(Oryza sativa)
  misc_feature (71): n=a or g
gcacaccgcctctcaacaatccaaggcgctgatattattgcagtcctgaaggacggtgcaattgttgaganggggaggcacgaggcactcatggggattgc

SEQ ID NO: 42721 - DNA, 101 bp, rice(Oryza sativa)
  misc_feature (71): n=t or g
gaagatgaacttgcttctctggcagttattgttgccacttctggcttaaatgctgtacttcaaagtgacangggcaaatatcaggaaactgagtctgtgaa

SEQ ID NO: 42722 - DNA, 101 bp, rice(Oryza sativa)
  misc_feature (71): n=a or c
gggattttcccgtgcaatttttacacggactagttaaattggatttgcatttggaatacaactcttaggtnctatttccatagataaattctctaaattct

SEQ ID NO: 42723 - DNA, 101 bp, rice(Oryza sativa)
  misc_feature (71): n=t or g
aataatatttccttcatgaacttcagccccaagtggatttgggggtttgttctgaggatctgttgacttcnaagcttgcttgtctcctgacatgtttatcg

SEQ ID NO: 42724 - DNA, 101 bp, rice(Oryza sativa)
  misc_feature (71): n=t or g
gtgcacatcagaggtcaggacacactgcactgtcatctgatgtttgcttgcatgcgcacaagttctggccnggtttcagtgaggaaggcgaaaggatatcc

SEQ ID NO: 42725 - DNA, 101 bp, rice(Oryza sativa)
  misc_feature (71): n=a or g
agaagtaattaacaaaatgattacttgattagccatctgactgagcacagtgcttcctagttgtgacagtnattgagatgaagattgggaagcagcaattg

SEQ ID NO: 42726 - DNA, 101 bp, rice(Oryza sativa)
  misc_feature (71): n=a or g
ttagcttcggcgacctctttttatctctggtgtggtgggcctcaaacttgataggaacctatggattaggntcctatgttatggttagtgtagggagaggg

SEQ ID NO: 42727 - DNA, 101 bp, rice(Oryza sativa)
  misc_feature (71): n=a or g
tcacctcgtgaaacattctcctgaatgggtcatgggcgtggtctttggtagcatttctttgggtttcttcncagcttgcacaggaactgtttctggtttac

SEQ ID NO: 42728 - DNA, 101 bp, rice(Oryza sativa)
  misc_feature (71): n=a or g
agaccggccgggtgcttgcggtcagactggctggccccatggtctgaccgacagggttttgttcggtttcngtttcaggttatcttgtctttttcggattg

SEQ ID NO: 42729 - DNA, 101 bp, rice(Oryza sativa)
  misc_feature (71): n=t or c
agttcggaaattactagtgaatttccgggcgtaacaaccgtccacccaatgaaggatcaagccagaggcgncaacttcgacaaaggcgaaggcacacggcg

SEQ ID NO: 42730 - DNA, 101 bp, rice(Oryza sativa)
  misc_feature (71): n=a or g
taccctaaccccacacaagaaacccctcctccatattacaatcaagagaggaaaaaaaaacagagagaganagatcaagagcatataatctatatatacac

SEQ ID NO: 42731 - DNA, 101 bp, rice(Oryza sativa)
  misc_feature (71): n=t or c
aacaatatttcaattaaaaaatcactcacacatatacatttgttataaaattttgagtggtgatccgatgntctctactgatactattatattaccagtag

SEQ ID NO: 42732 - DNA, 101 bp, rice(Oryza sativa)
  misc_feature (71): n=a or g
gtcagagttacagactacccacgactggttccaaaaaccaaaacggtgtgattttgttgctgcttgtgttntccgaattgcacacgggttggatcaaggta

SEQ ID NO: 42733 - DNA, 101 bp, rice(Oryza sativa)
  misc_feature (71): n=a or c
tctcctccatgcccagatcatccttgaattccatgggatctggaaagtcaaggggagcagggataggatgnctgccactatgcccaaaagaggagccttta

SEQ ID NO: 42734 - DNA, 101 bp, rice(Oryza sativa)
  misc_feature (71): n=a or g
cggagggagtagtaaaaaaagaatgaggtgatcgagctaggcacaagtttgaaaaattttagagtaaattncgtttagggtcatcttttatcaccaaagtt

SEQ ID NO: 42735 - DNA, 101 bp, rice(Oryza sativa)
  misc_feature (71): n=a or c
tggtagcatgatgcttgtagtgcttctctgtgcttgttacgatattcaaaaatagtgttccttcttgtccncgtgatattcaacatacatatggtattcta

SEQ ID NO: 42736 - DNA, 101 bp, rice(Oryza sativa)
  misc_feature (71): n=a or c
aagcagaataagggtgcccaagcgcgatgaaatgcacgtaccaccgacaaaatcactgacttgccatgaancttgggaaatccttccacgaaatccgtaga

SEQ ID NO: 42737 - DNA, 101 bp, rice(Oryza sativa)
  misc_feature (71): n=t or g
ttttgggatgcgaaaaaccgtcctataacagccagtaggattatcatttggcacaaatggcgggttcatgntgaaaggataagtgacatttgtgtagattg

SEQ ID NO: 42738 - DNA, 101 bp, rice(Oryza sativa)
  misc_feature (71): n=a or g
agtttgactcgtaacctgaaatgtatggagtaccatgtaaacactttttaccgtatgtggccgtaacctgnaaggaaacattagcagaatttgcaaccgac

SEQ ID NO: 42739 - DNA, 101 bp, rice(Oryza sativa)
  misc_feature (71): n=t or g
gaatgggtgcatgcatgcgtgtctactgggttcttgggtactcactgaagcttgaccgcagcttggattgntctgaacatcggtgacagtggagaagacga

SEQ ID NO: 42740 - DNA, 101 bp, rice(Oryza sativa)
  misc_feature (71): n=t or c
actcaaaactaattaacctgctagcaactccaattactgtgcagtgagaaaaactatgcatatctgttgangacctgtacactcttggaactaattcgtgt

SEQ ID NO: 42741 - DNA, 101 bp, rice(Oryza sativa)
  misc_feature (71): n=a or c
tattttataaaagtttttaataaaacgaacgatcgaaaacttatctgctaaccgcgcgggcacttctagtntagtaagcgaaagcccacgcgcgatgaccc

SEQ ID NO: 42742 - DNA, 101 bp, rice(Oryza sativa)
  misc_feature (71): n=t or c
aataaacataatctagacactactcataaggagaagcactagaaaatacaagtggcaggaaaaatgtatgnatcatacagctaacatggcacaaccttcat

SEQ ID NO: 42743 - DNA, 101 bp, rice(Oryza sativa)
  misc_feature (71): n=a or c
gtgcgtctacaaacgtcactcacttaacgcgtaattgagatcgtggacgaaaagatttagcgtgtagtagnttttcttttggagcgaagggcacgagatgt

SEQ ID NO: 42744 - DNA, 101 bp, rice(Oryza sativa)
  misc_feature (71): n=a or g
agctgataatcgtaaacatgaggcctcatgctgttctgattgatctctgctttgtgcaggaacggggttgntgtgagaggctacttcgtttggtcatttgt

SEQ ID NO: 42745 - DNA, 101 bp, rice(Oryza sativa)
  misc_feature (71): n=t or g
agaaatatcttcattttaagacggaggtagtatatgttattatagatctatggagaaactaggggtgctanaagcctacgttaaaacctgcacacctttat

SEQ ID NO: 42746 - DNA, 101 bp, rice(Oryza sativa)
  misc_feature (71): n=t or g
aggtgaattaggaggtggggatttgcaacaaatcttcttatgagggaacatctcaaacccagagtgatatntgagggtggtttttgcaattttcccttaaa

SEQ ID NO: 42747 - DNA, 101 bp, rice(Oryza sativa)
  misc_feature (71): n=t or c
gcaaagcaatactgtgctagaattcaaattcactggctaacttatcaccctctggtagtccggtgagtatnaaaattgatactcaaattgacagtgacatg

SEQ ID NO: 42748 - DNA, 101 bp, rice(Oryza sativa)
  misc_feature (71): n=a or g
caaggaatgtcagatccaatcatccaatattccgaaggaatccatagattatagcaagagaaaaacaaatngaaattatgtccatattcttgacttgctga

SEQ ID NO: 42749 - DNA, 101 bp, rice(Oryza sativa)
  misc_feature (71): n=t or g
tgtgacaacaacgaatgagcaagaggaacctgagattcaggatcctacagaactagttgtcacacaagagnaagagcaacatcagccccaaatagaagatg

SEQ ID NO: 42750 - DNA, 101 bp, rice(Oryza sativa)
  misc_feature (71): n=t or c
ttctcaatatattatatgtgttgtctgtttgagtccgcatgcaacagagagttgccgcaatatatacaccntaagtccccaaccatttcatatataagatg

SEQ ID NO: 42751 - DNA, 101 bp, rice(Oryza sativa)
  misc_feature (71): n=a or g
ataccaaatgtctcggacaagtcaatctcgtcattcctgtctcgatcgaggaactcccagtcaaaatggtntaggaggctggcaagcatgagctctatatt

SEQ ID NO: 42752 - DNA, 101 bp, rice(Oryza sativa)
  misc_feature (71): n=t or c
aatcttgatataggagcacattaaaatggttacacataatacttgagattatgtgtcacatgccaaaatcnctatggttttgtacaacttgaaccataata

SEQ ID NO: 42753 - DNA, 101 bp, rice(Oryza sativa)
  misc_feature (71): n=t or c
ttgttcaacagcacaggatatgaatcatccaaatcgccttttataagaccagtcctccatagataatcacnctaagtagtgcgagaaagaaaaaaatatga

SEQ ID NO: 42754 - DNA, 101 bp, rice(Oryza sativa)
  misc_feature (71): n=a or g
cttgagtcttccactctttctagagtgtgagggacgctttcggatgcttttgtactcctcaatgatgggcncacattgtttgtaaactaaagatgcagaaa

SEQ ID NO: 42755 - DNA, 101 bp, rice(Oryza sativa)
  misc_feature (71): n=a or g
tattttaactacgacaacaagctgctcacattatttggaatgatgtcctcccgaactaaatcaacgcaacnatcctaataaaaccacaatttaaatacaga

SEQ ID NO: 42756 - DNA, 101 bp, rice(Oryza sativa)
  misc_feature (71): n=t or c
ctccaatactttttaatccattctaaatcgaacaagacctaaatgtttcggcttcgttggttgggagctcnggatttatggtctatgcttttcgactccaa

SEQ ID NO: 42757 - DNA, 101 bp, rice(Oryza sativa)
  misc_feature (71): n=a or g
catctgaaaaaaaaaaagctgcgtgggctgggccgaatagacggccgaagaaaccaaaaatggtgaagctntgaagcaccagtgccccaacaaatggcggc

SEQ ID NO: 42758 - DNA, 101 bp, rice(Oryza sativa)
  misc_feature (71): n=a or g
atagacttccgaacacaccctaaggaacattggattgaaagcggctagacgtgtgcgggtgcgagcgcctnatacttgggctcagatcacgggaatttaac

SEQ ID NO: 42759 - DNA, 101 bp, rice(Oryza sativa)
  misc_feature (71): n=t or g
gttgcataagttgcttggtttcacatcgtttcttagagctgatatccagatagcgcgaactagtcctcttntatgccatggttagaaaaaaaatcaacgtt

SEQ ID NO: 42760 - DNA, 101 bp, rice(Oryza sativa)
  misc_feature (71): n=a or g
agagcagcggctacgcgattccatcgccatcgtccacgacttcgtgaacgcatcatctggtagcggcaggngcagatccgccgctggtgccaacctacctc

SEQ ID NO: 42761 - DNA, 101 bp, rice(Oryza sativa)
  misc_feature (71): n=t or c
caacgcacagatcacttatctatatacatctagaaaaaaaatattcccattgtctatcaagcgtgacacgngaataaaacctctgcacattcaaccacgtt

SEQ ID NO: 42762 - DNA, 101 bp, rice(Oryza sativa)
  misc_feature (71): n=a or c
cagaactgaaacatgcacgcaaagttgcacagacaatcacgcaaaccagagaacaacaccaccaccaccancaacaataataataaaagtatgtggtttag

SEQ ID NO: 42763 - DNA, 101 bp, rice(Oryza sativa)
  misc_feature (71): n=t or c
taccaaatattgattgaggttttgagagtaagagcttctgggttttctaattttggcatggtagcaatggnaaaaatgtgtttgatttgttgccttactaa

SEQ ID NO: 42764 - DNA, 101 bp, rice(Oryza sativa)
  misc_feature (71): n=t or c
tccagctgccacgtccaggtgatcgcgggacatgggagtccattgtagaagttctgcatgattagccagtngtcaatcccatgatgaggacaggcggccac

SEQ ID NO: 42765 - DNA, 101 bp, rice(Oryza sativa)
  misc_feature (71): n=a or g
gaagggttgcataatacctaatttgtagtagggggagtagcataatacgttatcagcataagttctatcanagaccgaggaagaacaacggtaagaactcc

SEQ ID NO: 42766 - DNA, 101 bp, rice(Oryza sativa)
  misc_feature (71): n=a or g
gaatcaaaaagtacacatgcatgaacagaattaactagaaacgtaccaagtatgacttctggtgcagcctntgcctcctcagccgagacgtgattcacacg

SEQ ID NO: 42767 - DNA, 101 bp, rice(Oryza sativa)
  misc_feature (71): n=t or c
ctaaatttaggagttgtagctctaccaaacaggctcgcatacggatacgacccattgcttcctttacttcngcaactcgatggtctcatgcaggaatccct

SEQ ID NO: 42768 - DNA, 101 bp, rice(Oryza sativa)
  misc_feature (71): n=a or g
gaagaggagcagtgccctccaaatctgacattaacactacccgtagcccgttggaggtgaggggagcgcanccatgtagatggatctggagaagagaggtc

SEQ ID NO: 42769 - DNA, 101 bp, rice(Oryza sativa)
  misc_feature (71): n=a or g
catgctaaatataacgcccatatgggttttatctctactattataaaaggaaattgctacacatccgactngtatgtacgacttagcatccgaccagtact

SEQ ID NO: 42770 - DNA, 101 bp, rice(Oryza sativa)
  misc_feature (71): n=t or c
aactcacactatcacaacacgtgtgtacacctacccatatgagcatacacatgtacaccctacctctactntaaaaaattatgccggtgtattatgagatt

SEQ ID NO: 42771 - DNA, 101 bp, rice(Oryza sativa)
  misc_feature (71): n=a or g
cagaaaagccagaaacacgatatcagccgcagtgccaagttcaagttgataactgatctgaaatagggatngcaatttccccctgcggggacccgccccta

SEQ ID NO: 42772 - DNA, 101 bp, rice(Oryza sativa)
  misc_feature (71): n=a or g
ggcgacccaggcacgagtgcttagtgctgaagatcagcgtgggaaggaaaggcgctgataagggttcaacntgagggtaattggcgctgacatccttgcca

SEQ ID NO: 42773 - DNA, 101 bp, rice(Oryza sativa)
  misc_feature (71): n=a or g
atcaatcaagctaatcactggtcccatgcatgtaattaagcatccatgtatgtgtacctaaatggaaaggnacatgattaaaaatggcttctctttcgcaa

SEQ ID NO: 42774 - DNA, 101 bp, rice(Oryza sativa)
  misc_feature (71): n=t or c
tagtcgaaacgatcaggctgctgagattctgcttgcccaatttcatttgcgcacaagcataaaacatgggntatgccaaggtgtttaagtgtatatgttga

SEQ ID NO: 42775 - DNA, 101 bp, rice(Oryza sativa)
  misc_feature (71): n=t or c
atggttttaaatttgttttttcagtcttcagttccaggtgacatcaaaagaaagtcttcgtagtcaagtcnacgaagcatatttttctcaaaacaacatgt

SEQ ID NO: 42776 - DNA, 101 bp, rice(Oryza sativa)
  misc_feature (71): n=a or g
cgcaagggttctaaaatggtggagcaactacaagttcgctggtctggtcctgattctcaggttgttacctnggaaaatggtcaagagttgcgtcgtcgatt

SEQ ID NO: 42777 - DNA, 101 bp, rice(Oryza sativa)
  misc_feature (71): n=t or c
taatgtatgatcagttgatcactgcatgtatgatgtatccaacgatctcattaaactactcccttcatccnaaaatgtttgacgccgttgactttttaaaa

SEQ ID NO: 42778 - DNA, 101 bp, rice(Oryza sativa)
  misc_feature (71): n=a or g
aaaaggcatccccatccccaccaaaattcttgtgaaagcatgctggcccagcaccccatcaacaatattancattacactaattaagctgctaattaatta

SEQ ID NO: 42779 - DNA, 101 bp, rice(Oryza sativa)
  misc_feature (71): n=a or g
tgctcacgaatcctttggttctttgctctactagtgctgtgtttgttacggttggatgggaacatgcatantgcttatgaaaaacggagtagtctattagc

SEQ ID NO: 42780 - DNA, 101 bp, rice(Oryza sativa)
  misc_feature (71): n=a or g
ttgaagagacatgagaagcaggagcagaggtattatgaagataacgatggtttcgacccacattgggactntgactttttaaggttttactggaacgaggg

SEQ ID NO: 42781 - DNA, 101 bp, rice(Oryza sativa)
  misc_feature (71): n=a or g
ttgtccacttaatacagttaattcgacaagatgctaaatatattatatgttctgaatccagggctggggtnttgctgttttggtcggcgtgccacacaagg

SEQ ID NO: 42782 - DNA, 101 bp, rice(Oryza sativa)
  misc_feature (71): n=t or c
ccactgcaccaggctggcaacgttactccggtttcgatccagctatctccgttaccatcacatgtcgtcgnggcggccggctggtggcggcgggatggccg

SEQ ID NO: 42783 - DNA, 101 bp, rice(Oryza sativa)
  misc_feature (71): n=t or g
gagctgtactgcttgtatgtcactctttctaaccgcacggtttctttactgtggctgcagtgaatgatctnttgatatttccgcatctgaatgcattgccg

SEQ ID NO: 42784 - DNA, 101 bp, rice(Oryza sativa)
  misc_feature (71): n=t or c
ggttcaggggaaatatttatgcttatcagtttcattcaaggcttcatgacaagacattccactgcaaggcncttagggacatggaagagggaattccagca

SEQ ID NO: 42785 - DNA, 101 bp, rice(Oryza sativa)
  misc_feature (71): n=a or g
gtcatcgacacctcttcgcacggggcaatcacactccgtgacaaattagttaacatatttaaggtaaacgntcaacacctaaagattttccttgagctaaa

SEQ ID NO: 42786 - DNA, 101 bp, rice(Oryza sativa)
  misc_feature (71): n=t or c
ggatgcgagtcctgctactggtctcactttcactgccagtttttggcctacatgtttttgttgattgagtnacataatgatgttaatggtgatgttaatga

SEQ ID NO: 42787 - DNA, 101 bp, rice(Oryza sativa)
  misc_feature (71): n=a or c
atttcatctgaaggtattgagagagatattggaacgttgcagctagaggtatgcatctgtagccacacccnttaagttgtctaactaatgagaaaaaatgc

SEQ ID NO: 42788 - DNA, 101 bp, rice(Oryza sativa)
  misc_feature (71): n=t or c
tacctggcatttttttatgtggccgtcatagaaacttccaatttttgcactgctcaaatttgtgtgggacntcctggcttctatgtggaatttgtgcattt

SEQ ID NO: 42789 - DNA, 101 bp, rice(Oryza sativa)
  misc_feature (71): n=a or g
tgtttgttcgccttgcttttttgcaccatcatcttactagcaaccttggcggaccaacgctcccctgactngactcgcttcactgcttcatcatgtctgtt

SEQ ID NO: 42790 - DNA, 101 bp, rice(Oryza sativa)
  misc_feature (71): n=t or c
agcgctcggcttttgtattccgatgaaatctcgtgcttctctccggttgctatgtacgcgtcgtcggagangtaggaaatgttcgtgcgatcgtccacgta

SEQ ID NO: 42791 - DNA, 101 bp, rice(Oryza sativa)
  misc_feature (71): n=t or c
agattccatttgaactggtttaacaatgatcccagaactaaatgcaccatcctatttgccaatggcattcnagggcatatccggcgacctgcaccaaatgg

SEQ ID NO: 42792 - DNA, 101 bp, rice(Oryza sativa)
  misc_feature (71): n=a or g
ttgatgaaagtgttaacgaccaaatttggtaatcgtcatcggagatggagattagactgaagcggaatccnaaacagagatcgtcctggaaacagagcggg

SEQ ID NO: 42793 - DNA, 101 bp, rice(Oryza sativa)
  misc_feature (71): n=t or c
tatgccatatatggtgtggactccatggtgcttgtggtcattgtcatggtcttgtgggtgcaagttctcantcttcttgaagtcagagatctgcagttcat

SEQ ID NO: 42794 - DNA, 101 bp, rice(Oryza sativa)
  misc_feature (71): n=t or c
agataactagattttagttgtgaagtataaaagagtctgggagaaaaactcacagcatcttctgcagaaangactcgctccttgtttgttccagcagccac

SEQ ID NO: 42795 - DNA, 101 bp, rice(Oryza sativa)
  misc_feature (71): n=a or g
ctagagggaacgacgcacaacgttgggaaagagcggactagcagaaggtgaagcagaagcaccaactgggnacccgaggagggaggaggtcggagaagggc

SEQ ID NO: 42796 - DNA, 101 bp, rice(Oryza sativa)
  misc_feature (71): n=t or c
tgtgatgaccgtctcgactatggcactgttgtagtcggtgaagtcacaggtgcaggtattgcagaatatcnccccaacgttatcttcctcatcgtcatctt

SEQ ID NO: 42797 - DNA, 101 bp, rice(Oryza sativa)
  misc_feature (71): n=t or g
ctacactgatgggttcgacgtttcatgcgaggagaaccgcacctacatgcataactcaagcagcaacatgnagatctacagcctcaatctgattggagggc

SEQ ID NO: 42798 - DNA, 101 bp, rice(Oryza sativa)
  misc_feature (71): n=a or g
gcatgcaacttcttgttgtcaaaagagcttccttgtggtggttggggagaaagccatttgtcttgcaaagntaaggtacacgatcatttctttctactagg

SEQ ID NO: 42799 - DNA, 101 bp, rice(Oryza sativa)
  misc_feature (71): n=t or c
cgtaactgaacacatcactcttccgtgacgcttttcctagagtcccatactctgctcaagaaaaattaganaccaaaaattagttgcaccctatctactca

SEQ ID NO: 42800 - DNA, 101 bp, rice(Oryza sativa)
  misc_feature (71): n=a or g
atgggggctgagctcatcttttccggcacaggtaatgtgttgttcatgtcccgtttaatgccagtagatcnagcaaaggcattaagagaggagcaaggtag

SEQ ID NO: 42801 - DNA, 101 bp, rice(Oryza sativa)
  misc_feature (71): n=t or c
atggaataacaaactcattatttctctctcatggaactctcctctttctctctctctaaccaatctattgnttgccgtgccaccgggaatgagaggagggc

SEQ ID NO: 42802 - DNA, 101 bp, rice(Oryza sativa)
  misc_feature (71): n=a or c
ttagttttgattagattagacttagatgtgacctcatcggcataagcaaattagctacgtccacaacaccncaccgtattcgtattcgatacaaacggtta

SEQ ID NO: 42803 - DNA, 101 bp, rice(Oryza sativa)
  misc_feature (71): n=t or c
gtatatttgtccataagaaaatgcttgatagaagagggaggatgtgtgcagctgatgtatgcagggtccantaatttgctctgataaattaaagcaatggc

SEQ ID NO: 42804 - DNA, 101 bp, rice(Oryza sativa)
  misc_feature (71): n=a or g
accacaagcggatccatcattagatcatgttgccagcctgcttccatagctaacctcgtcaaagtggtctntttgcaagacctcaacaaaacagcatgcac

SEQ ID NO: 42805 - DNA, 101 bp, rice(Oryza sativa)
  misc_feature (71): n=a or g
cttcacggctcggcccggcccggcccatcttgtggagatgtttcttttctttgggataagttcactcgctntccctcaatattacgtcgagtttgtttcac

SEQ ID NO: 42806 - DNA, 101 bp, rice(Oryza sativa)
  misc_feature (71): n=a or g
cagaagcactcaggccatgagtttgtgtagaaagattctggatggacacgcttgtgggggccaccaaaatntgtgttgaacataacctgcctgactcgctc

SEQ ID NO: 42807 - DNA, 101 bp, rice(Oryza sativa)
  misc_feature (71): n=t or c
ctctctctacatgtatgtacgtacgttgatcatgtagcagtatatacttgggagcggattttaatccctcnagtggatgtgtccctgtatacctttttctt

SEQ ID NO: 42808 - DNA, 101 bp, rice(Oryza sativa)
  misc_feature (71): n=t or c
acgggctaccgcctcgatcaaccaccgccggaaacgcgatagcacagtggagatagcgttgggggatcaancaggcgtagatgcggaggcggaggcgccgg

SEQ ID NO: 42809 - DNA, 101 bp, rice(Oryza sativa)
  misc_feature (71): n=t or g
tgacggtatacggtgggcacaagcacgagaggtgtcttgcggtgacagacaagcctcccttcttcctccangcacacattgtccggcgtcgtcccctccgg

SEQ ID NO: 42810 - DNA, 101 bp, rice(Oryza sativa)
  misc_feature (71): n=a or g
tatatctcgaatgatgcacaaaagaggaacaaaaaaatgagaggaggagaaggtaacagcaatggacctgnactgagatacgcttctctccgtagacggac

SEQ ID NO: 42811 - DNA, 101 bp, rice(Oryza sativa)
  misc_feature (71): n=a or g
caaagctagggaaagggcccccataattagtggcctgtgggaaatatccaccatgagagaacactcttccntaagagtcacttggtgtcccaaaaccatag

SEQ ID NO: 42812 - DNA, 101 bp, rice(Oryza sativa)
  misc_feature (71): n=a or g
caggaagtagtacatggtcccatgcagcaatataatctgcatcaccacattttccatgttcccagggcacnttaatgttgtaccctttaccatctccttcc

SEQ ID NO: 42813 - DNA, 101 bp, rice(Oryza sativa)
  misc_feature (71): n=t or c
tagttggctgtactattcacttgctctaatatatgtggatctcatcatcctaacagatcgcagcttgattnttgttgactttggggatattacgtgattgg

SEQ ID NO: 42814 - DNA, 101 bp, rice(Oryza sativa)
  misc_feature (71): n=a or g
acatgcacccaaatttggtcacaaatcgtagcgatgctccacaacttcatgggcacttcctttggatgtangatactccatgttcttcgtatctatagtga

SEQ ID NO: 42815 - DNA, 101 bp, rice(Oryza sativa)
  misc_feature (71): n=t or c
agtataactgctccgacaccatgcagccttgtggttctgatagggagagcgggaaaaacaaaggaggttgngtccggattagcgataccgggtagacagtt

SEQ ID NO: 42816 - DNA, 101 bp, rice(Oryza sativa)
  misc_feature (71): n=t or c
attaatctgaccatatacggatgggggtgattatttaactatccgacgtagttaaccgcggtttgtgtgangattaagagcaggtataatagtcttacctt

SEQ ID NO: 42817 - DNA, 101 bp, rice(Oryza sativa)
  misc_feature (71): n=t or c
attatttgatcggtagatcttctccattgttaataatattgctcaagcatgaagtattttcgagaatatangaagcatgtaggatttggttatagatgtgt

SEQ ID NO: 42818 - DNA, 101 bp, rice(Oryza sativa)
  misc_feature (71): n=t or c
gtcaaggagatggtgttgaggtgtactcctgggtattttggtcattttaaccaaggccttgttttagtttnaaactttttcttcaaactttcaaattttcc

SEQ ID NO: 42819 - DNA, 101 bp, rice(Oryza sativa)
  misc_feature (71): n=a or g
ttggctcctctgttgttgcgtaaaggaaaaataagtgggcagcactcacggcttattatataccacctccnttttaggttataagactttcacggtttatt

SEQ ID NO: 42820 - DNA, 101 bp, rice(Oryza sativa)
  misc_feature (71): n=t or g
acaaaaactatgatggcgacggcggcgttcctctctgaccctaatccgcctctaacccatggggaatcaangggatttggaggggatttcatgtggaggtt

SEQ ID NO: 42821 - DNA, 101 bp, rice(Oryza sativa)
  misc_feature (71): n=t or g
gaaggtccgaacttgatacgcgaaaagccaatcaaatcactaaatcactatgtgatccacagcgtcaagancattgaaaccaaatgtatgtttccacgaga

SEQ ID NO: 42822 - DNA, 101 bp, rice(Oryza sativa)
  misc_feature (71): n=a or c
ctaaggcaattaattaacagaatactaataaaaattgtttgtaaacttggccttcaatttcccacccactngcgagctaaccgcattgaaaatcccccccg

SEQ ID NO: 42823 - DNA, 101 bp, rice(Oryza sativa)
  misc_feature (71): n=a or g
agtacatttgataaaacaacctagagtaagtgatataccagatgtggctatcaccttcaattttatccatntcattcaaacaaaaaataagaggcaacata

SEQ ID NO: 42824 - DNA, 101 bp, rice(Oryza sativa)
  misc_feature (71): n=t or c
ggtcaataattgactctttcttgatgatcatgagcatgaaagatgattagggccatgtatgaaagattagnccatggttaattttaaaatctaatgtttag

SEQ ID NO: 42825 - DNA, 101 bp, rice(Oryza sativa)
  misc_feature (71): n=t or c
tgctggcttctgggaaatgggtgcctctttgggttcaacagcatgcttacaatcgaagattactacacctntctctttccggtatgaattgtatgaagtaa

SEQ ID NO: 42826 - DNA, 101 bp, rice(Oryza sativa)
  misc_feature (71): n=t or c
agagagagcgagccgtggaggagaaaggaggataagataaggaagagagatgaggaggagaggataaagangggatcagcttggctcggctcaatttcagg

SEQ ID NO: 42827 - DNA, 101 bp, rice(Oryza sativa)
  misc_feature (71): n=a or g
atttgcacaaatgaaaatagcatgaaaagttacttttgcaaggaaattacggggtttttttaagatacgtntcacatcaggtattatatagggtgtcgcat

SEQ ID NO: 42828 - DNA, 101 bp, rice(Oryza sativa)
  misc_feature (71): n=t or c
tttatggtgctggtactttgggtctaatgggctttcctcatctcaaatcccgttacggcccaaattaaatngcaaatttcttccaactcactcacagtgtt

SEQ ID NO: 42829 - DNA, 101 bp, rice(Oryza sativa)
  misc_feature (71): n=a or g
atcagaaggcgacagcacacagagccatacctatcgagcaaacatgcagtcaaggagaatgtggttcgccnactcaaagctcctaagtgcaaaagggacag

SEQ ID NO: 42830 - DNA, 101 bp, rice(Oryza sativa)
  misc_feature (71): n=a or g
ggacgacgcgcagagactcaccggcactgcataggcaagttcttggaaaacctatatatgttcacttcaantcgaatgggctctgaactctcttgtgctgt

SEQ ID NO: 42831 - DNA, 101 bp, rice(Oryza sativa)
  misc_feature (71): n=t or c
cttctatgcagtctgctgcctgggcaggccaaggttactctagacttccattcagttcaaactaccaacanaatgctcctccctgactgctcaaattctct

SEQ ID NO: 42832 - DNA, 101 bp, rice(Oryza sativa)
  misc_feature (71): n=t or c
agcaagtgcaatcagtacaggttatttaacatatacacgaacatgatagccatgatgaatgcgcttacaangtgccggcaacttttgtgttaacatgagtc

SEQ ID NO: 42833 - DNA, 101 bp, rice(Oryza sativa)
  misc_feature (71): n=a or c
gtcagaaaacccctgttgaatgatggcaaactagcaattttctcctcgatgaaagccatcggtagtggccngtgctagctacacggaggaattaaactcgg

SEQ ID NO: 42834 - DNA, 101 bp, rice(Oryza sativa)
  misc_feature (71): n=a or g
cacggagaaatcgttgctgtactagtgcttccacaatcaatcaatatgagactattcaacagcaactaggnccgatatatgtagcgctaagctatagctag

SEQ ID NO: 42835 - DNA, 101 bp, rice(Oryza sativa)
  misc_feature (71): n=t or c
gaaaggtgtgcaagtgacccggttttttctcgctctgttgctgtatgacagtattctaaaatgtaaaggcntttttttttagaattacacagtacaatgca

SEQ ID NO: 42836 - DNA, 101 bp, rice(Oryza sativa)
  misc_feature (71): n=a or g
ctcggtctccaggacctcgtcgtcctctcaggtacgtacacaatttcttgcattgcttgcatcgatcactnaagaagtatacgtacggagactaattattt

SEQ ID NO: 42837 - DNA, 101 bp, rice(Oryza sativa)
  misc_feature (71): n=t or c
ggtcctcaccgactcgaagacaagatacactcaaatccagaagatgttgtacgccatattcatcaccgccngcaagctcagtcactaccttcaagctcatc

SEQ ID NO: 42838 - DNA, 101 bp, rice(Oryza sativa)
  misc_feature (71): n=a or g
cttcttctccaggtagaatatctcatcctccacaattgctagctctgcaaggaggcccctgatctgcaacnatggaaagaatgaattattgacttaccaaa

SEQ ID NO: 42839 - DNA, 101 bp, rice(Oryza sativa)
  misc_feature (71): n=a or g
gattctcaacttccgaaagtagccaacatcttcagtatgaatctttatgctaaccaattcggtctcatgcnaacgcagcacaaggcagcggagctctggca

SEQ ID NO: 42840 - DNA, 101 bp, rice(Oryza sativa)
  misc_feature (71): n=t or c
ggtgtattgatctgttgatctgatcttgtgctggaaccagtccaactagattcaagtcttagactagacangggtgctcgtatttacggcaaattattatt

SEQ ID NO: 42841 - DNA, 101 bp, rice(Oryza sativa)
  misc_feature (71): n=a or g
aggaggagcccacactagtcaatgtccttctcgatggcctatcttttttctagttacccccttccgccctntgagctaaattagcataagacagagaaaga

SEQ ID NO: 42842 - DNA, 101 bp, rice(Oryza sativa)
  misc_feature (71): n=t or c
attcgcgatgctccccgttcttcctctccagttgcatctgattctgatgatggtggaaatgagaatgagcntgggactgagagcaatcctttgaggctttt

SEQ ID NO: 42843 - DNA, 101 bp, rice(Oryza sativa)
  misc_feature (71): n=t or c
tatcggacctgatacctattggtatcagacctaatacctattagtatcactatacctatcaattccgacgntgatacctatcagtaccggacgtgatacct

SEQ ID NO: 42844 - DNA, 101 bp, rice(Oryza sativa)
  misc_feature (71): n=t or g
taaaagttttagtcccatctatacagggcctaatagcttttcctaagtcagaggatctagttcctgcagcnaatggatcaaatcaattggtacggtagatt

SEQ ID NO: 42845 - DNA, 101 bp, rice(Oryza sativa)
  misc_feature (71): n=t or g
gaactaactaaggctgacttcttttcttctctttcctaactcacctctctcgtcttgcttatgcatggttnttaaaatactaaacggtatattttaaaaaa

SEQ ID NO: 42846 - DNA, 101 bp, rice(Oryza sativa)
  misc_feature (71): n=a or g
tagggggctcccggtggggagagatattgctacctcgatccccagcacagccgaaacctgccaaactcccnccccccgcagctggggttacaaagctcgca

SEQ ID NO: 42847 - DNA, 101 bp, rice(Oryza sativa)
  misc_feature (71): n=t or c
tgtatgcccagtttgtcgagcgaagtggaaagagataccctttaaccgctcgttatcttctattgtacctngtggtagaagtgggttgaatgtgaatcaag

SEQ ID NO: 42848 - DNA, 101 bp, rice(Oryza sativa)
  misc_feature (71): n=a or g
agcaagatatataaggccggtcgatataggaagtacattatgaaattaactagcagtacaggattgttagntggagtgtcggaattaagaatcaattaggc

SEQ ID NO: 42849 - DNA, 101 bp, rice(Oryza sativa)
  misc_feature (71): n=a or g
ccaatacatcttagcagcatcctagtacagagatgtgcagataacggaagaaaggcaaaattagagttcanttctaagcttccctttggagccaagtacaa

SEQ ID NO: 42850 - DNA, 101 bp, rice(Oryza sativa)
  misc_feature (71): n=a or g
aggcgagactccgccgagcatcggaaacctcaagaagttgacgcatctctacttgtcgagctgctacctgncaggggagatacctgaatccatcttcgggc

SEQ ID NO: 42851 - DNA, 101 bp, rice(Oryza sativa)
  misc_feature (71): n=a or g
gcaggaacacttttggccgatagatgtagaaatgatcctgaagattcgcacctcagcttcacttgaatccnattttttggcttggcatcctgatagattgg

SEQ ID NO: 42852 - DNA, 101 bp, rice(Oryza sativa)
  misc_feature (71): n=t or c
atataataggatgagagtcatttcacatatagatcctttccactctcttggttgatgggatagaataaacnatggtggccgggtgcggggcggtggcgtcg

SEQ ID NO: 42853 - DNA, 101 bp, rice(Oryza sativa)
  misc_feature (71): n=t or c
ccaatccagaagggcaaagtgcacaaaaatattgttctcgctgccaaaatggcaagccgcctcgttgtcancattgttctgtttgtaagtcagctttcctg

SEQ ID NO: 42854 - DNA, 101 bp, rice(Oryza sativa)
  misc_feature (71): n=t or c
aagcaaaatatagctagctgcctagctaggtcacctacaaacttcacccatatataggcctgtttagtttnaaagtttttttctacttccaacttaccatt

SEQ ID NO: 42855 - DNA, 101 bp, rice(Oryza sativa)
  misc_feature (71): n=t or c
attgcaaagagagggacatgtatcactgaagctctttgatgagatgattgtgaacagtatagagccggacnatgtaactttcgttgcagttctatcagcat

SEQ ID NO: 42856 - DNA, 101 bp, rice(Oryza sativa)
  misc_feature (71): n=t or c
taacagcagaacgaaccatgtaaaatagagcagaaacccacaacaattcttgctcaaattaatactccctnattccctatgacgccgttggcttttttaaa

SEQ ID NO: 42857 - DNA, 101 bp, rice(Oryza sativa)
  misc_feature (71): n=a or g
ggcgtccatccatccgtccatgtcaaaggtgctttcctcgtgggcttgtggtcgtattctagtagtccttncaaggtatggttgtcaacagcaataatcga

SEQ ID NO: 42858 - DNA, 101 bp, rice(Oryza sativa)
  misc_feature (71): n=t or c
cgagagcacaggtcaatgtcaggaagggatgaactgattgattaatcaaaatggaaacaagagagcaacanattacatgctaattgtccagtaagtagtta

SEQ ID NO: 42859 - DNA, 101 bp, rice(Oryza sativa)
  misc_feature (71): n=t or c
gcatgcacacaaatgacaaatcgatctaactttattgcatgtgatgagcttggggcatcaacataagtggncatttgttattcctatttttaccatgtata

SEQ ID NO: 42860 - DNA, 101 bp, rice(Oryza sativa)
  misc_feature (71): n=a or g
agagcagctcgtgtacttttagtccaagctttagatcacaccggtgtacgttgagatgataggtacaggcntgtgcccagagcgaaaacgtcggtacggga

SEQ ID NO: 42861 - DNA, 101 bp, rice(Oryza sativa)
  misc_feature (71): n=a or c
gagttggaggccctggcatggaattcatcactgaactttgttgagaacctgttcctcctatctgactgaanacagccacctatgtcacaatccatatctga

SEQ ID NO: 42862 - DNA, 101 bp, rice(Oryza sativa)
  misc_feature (71): n=t or c
gtaatacgttatcagcacgacgttctaccggagaccgagaaagaagaagggcaagaaactcttgaatcctnttacatcttgtagattgaattgcaaaaacg

SEQ ID NO: 42863 - DNA, 101 bp, rice(Oryza sativa)
  misc_feature (71): n=a or g
atttcaggtaaaataccagatggtattaacaacttcctcaaactaattaagttgggtctctctaacaatcntttcagtggtccgatacctgacagcatagg

SEQ ID NO: 42864 - DNA, 101 bp, rice(Oryza sativa)
  misc_feature (71): n=t or g
ttttcttttggttcatgtagggtctcaaatattggtaagccttgtcttgaaaatggaagcaccagcttctncttccttctctatggtggctgaggaggtaa

SEQ ID NO: 42865 - DNA, 101 bp, rice(Oryza sativa)
  misc_feature (71): n=t or c
ttggtttagcttttgttagattgaggtaattagcgactctaagatcaccgcaaatgttaggtgctataatngtgcttgtcaatttgtcaaaaaaaaaagtt

SEQ ID NO: 42866 - DNA, 101 bp, rice(Oryza sativa)
  misc_feature (71): n=t or c
ttaattgaatatgtattgacgcaattggaatttcggccattccagttgctttggttattactagactcccngttaaaattatggttataactgctttgttg

SEQ ID NO: 42867 - DNA, 101 bp, rice(Oryza sativa)
  misc_feature (71): n=t or c
ctccatcgtacgtgcaacaaacaattaaaggcctgcctgggcgcgcgtgcgacataagtatatactccctncatcctaaaatgtttgacaccgttgacttt

SEQ ID NO: 42868 - DNA, 101 bp, rice(Oryza sativa)
  misc_feature (71): n=a or g
gatattcatttgttggtcaccatgtgtttacttctgcaacttgtgcaatttgcaaagcgaaaggaaccctntcattcaaaagaatactgcagctgaatgct

SEQ ID NO: 42869 - DNA, 101 bp, rice(Oryza sativa)
  misc_feature (71): n=t or c
aatttcaaggggaggatagtactatagtatctcatggtggttaattagtcaactaattactctctagtatngtagcgtagatcgcgtgttaccatgttttg

SEQ ID NO: 42870 - DNA, 101 bp, rice(Oryza sativa)
  misc_feature (71): n=t or g
tctagtccttgatgcgctagattggaggcttcgatcgataacacccttcactttcatgtacttgtttgctnacaaggtcgatccaaatggcaagcacatca

SEQ ID NO: 42871 - DNA, 101 bp, rice(Oryza sativa)
  misc_feature (71): n=t or g
gagaaggtcccggagatgatcaaggagctcaggaggtacaccatccctgacctggtcacctacaacatatngctgacatactgctcgaagaagaacagcgt

SEQ ID NO: 42872 - DNA, 101 bp, rice(Oryza sativa)
  misc_feature (71): n=a or g
aaacatacagtagccgagggtgctaatgcagcggttggtgatgatccaaatggcagcaaaagaatcatccntgtgtggaatggcagtggcatggctgacaa

SEQ ID NO: 42873 - DNA, 101 bp, rice(Oryza sativa)
  misc_feature (71): n=t or c
agagggaagtgatagcagtgaagaaggaagaagggggatacacatcaattggaccgaagatgacaacatgngactgatgagttcttggttgaacaattctg

SEQ ID NO: 42874 - DNA, 101 bp, rice(Oryza sativa)
  misc_feature (71): n=a or g
atttcaatgtacagaccaaaccacacattttaaagtgagagggatttctttttcaataatacctatcagancagtgcagtttgtcctggatttttgtgtaa

SEQ ID NO: 42875 - DNA, 101 bp, rice(Oryza sativa)
  misc_feature (71): n=a or g
tcatgtcgaaaaatgtgtaacaatattcatcgacggctccctcgacagccccatcgatagaaataaagtcntcattgtccaagtcccactcaaaatttact

SEQ ID NO: 42876 - DNA, 101 bp, rice(Oryza sativa)
  misc_feature (71): n=t or c
gggatcgaaaatcttcaaaacttgaaggagctatggatcaacggcgtcaacataccgtttccttcaagatnccgtgaatggaaggatataaccacagttcc

SEQ ID NO: 42877 - DNA, 101 bp, rice(Oryza sativa)
  misc_feature (71): n=a or g
ccacaatggaaagcgcggccccagctgacatgatcggaaagctgcgtttcttagtttgaatggcggagaanaatttgtatgtatatctattttcaagaagt

SEQ ID NO: 42878 - DNA, 101 bp, rice(Oryza sativa)
  misc_feature (71): n=t or c
tcataaactaggaactacatgtgtattctacacaaattcacattgtattccctgatggtttgatagacctntatgtcgtacctgcgttcgcctcatcgaca

SEQ ID NO: 42879 - DNA, 101 bp, rice(Oryza sativa)
  misc_feature (71): n=t or c
tacctgcgaattaaaaacaagggagaatatagacgggtgtgctgagtaaagtagcaagataactcccaacnactaagagcatatatacccaataccaataa

SEQ ID NO: 42880 - DNA, 101 bp, rice(Oryza sativa)
  misc_feature (71): n=a or c
caatctgattgggccacgtcatcaataaatcaaggaccgttcgatacatcctccggacattatcatccgtnagatctctctatttgcaaaatctcttctgg

SEQ ID NO: 42881 - DNA, 101 bp, rice(Oryza sativa)
  misc_feature (71): n=t or c
gatttctctctaacaacttgataccctcgattcaaattaattgaactgctctgctcaactcctcttcatgnttgttgcctgctgcagatgcatatgtgata

SEQ ID NO: 42882 - DNA, 101 bp, rice(Oryza sativa)
  misc_feature (71): n=a or c
caaaggattccaaattttgtagcaaagacaaaatggtacaaatatgataacaccaaggaccaagttaccgnaaatgcaatttgatgaaatgcttcagggaa

SEQ ID NO: 42883 - DNA, 101 bp, rice(Oryza sativa)
  misc_feature (71): n=a or g
ttcaagttccattcctcctccagtgcagaatatatcttcatcggcatcatcctggttggtcgacatgccantaaattcaaatccatcggcaatacctgata

SEQ ID NO: 42884 - DNA, 101 bp, rice(Oryza sativa)
  misc_feature (71): n=a or g
cgctgtaattatttttattacaggtattaattgtggaggcttcccctatggtcttggtcaaaataataganttgaggagaatgttgtggatggggtcaagt

SEQ ID NO: 42885 - DNA, 101 bp, rice(Oryza sativa)
  misc_feature (71): n=t or c
gatcttcggcgacatggtcaacatggacaaatcaagagaagagctaggaagagagaagaactctatttttnttcaatgttaagagagatgaactctgtatt

SEQ ID NO: 42886 - DNA, 101 bp, rice(Oryza sativa)
  misc_feature (71): n=a or g
ttgtagagatgtgcaatctgccaatctgtcggaaatgttggaggtcacacatgtttttggactcaaatcantacgtcagctagaattcacatacgggatta

SEQ ID NO: 42887 - DNA, 101 bp, rice(Oryza sativa)
  misc_feature (71): n=a or g
ttgtctgaaatacctttcgtatatgaggcatgattctgtattaagaattggtatatagtgggctccgtcgngtctaactctaagagtattgggtacccctt

SEQ ID NO: 42888 - DNA, 101 bp, rice(Oryza sativa)
  misc_feature (71): n=t or c
ttagttttttcttcgcatccaaacatgccttctgctggttcagtttcttcatcgtccgttcaaggggaagnggataatgaatcaagtcctgtccacacaac

SEQ ID NO: 42889 - DNA, 101 bp, rice(Oryza sativa)
  misc_feature (71): n=t or c
tattaccaggtgaaaataacagcagggaactggctgcgtttcttcatggaagagtagatgttagggaacantccatgacctgagtagcagtagccatacaa

SEQ ID NO: 42890 - DNA, 101 bp, rice(Oryza sativa)
  misc_feature (71): n=t or g
taggggcattagattttacactcttaatttatctctcttcttcaaacataaattcgcgtcctacctttttnatgtcatctaccaaattactccattcgttt

SEQ ID NO: 42891 - DNA, 101 bp, rice(Oryza sativa)
  misc_feature (71): n=a or c
tgctcggttttgcttgcccgcgacaagttcttcgcgtggctatctgaagatcaccaacagcgacaccgtgnatgcatttctctgagtattcaatattagat

SEQ ID NO: 42892 - DNA, 101 bp, rice(Oryza sativa)
  misc_feature (71): n=a or g
tttaaacgtaagtatactgccccagtcatatttcgtcatccattgaatttgttgaggtgaacatagtattncgcagagaatccatcttcggaacgaggcaa

SEQ ID NO: 42893 - DNA, 101 bp, rice(Oryza sativa)
  misc_feature (71): n=a or g
ggagaatgccgtaaactgcaggagaaattccatgggtcagctcatggaagaacaccttctacaattatgangcaggaaagtttgactggtaaagtttcctc

SEQ ID NO: 42894 - DNA, 101 bp, rice(Oryza sativa)
  misc_feature (71): n=a or g
cccgcacaagagccgggagctggcccgggtgatattggttcggctcaaggagatggtctcacacaccgccngcgccaacgccgccgcgtccaacatggagc

SEQ ID NO: 42895 - DNA, 101 bp, rice(Oryza sativa)
  misc_feature (71): n=a or g
tgtattttacaacagcatggtgcaaccatcgtatgtctacaggaaactaagttgtcttctatcagtgatcncattattctcaatactctgggccagagatt

SEQ ID NO: 42896 - DNA, 101 bp, rice(Oryza sativa)
  misc_feature (71): n=t or c
agttacagagaatagtagcaagatttactaactgagattgacactgatgtacggattttgtaatctgaaantctgaaagattgttactgcaaatatgcaat

SEQ ID NO: 42897 - DNA, 101 bp, rice(Oryza sativa)
  misc_feature (71): n=t or c
atatatatgttaccggctcgatcggcgatcagaattcagaaatcgatcacaacataattaatattctgtangtaccatagatggaatagacgtcgtataaa

SEQ ID NO: 42898 - DNA, 101 bp, rice(Oryza sativa)
  misc_feature (71): n=t or c
aactatcagcagcatttaacttctggagaaaattgtgaccatctatgagtgaagctaatccctgggaggtnacatgatcacatcttgaaacatcaacgctc

SEQ ID NO: 42899 - DNA, 101 bp, rice(Oryza sativa)
  misc_feature (71): n=t or c
cagtgtgctgtgcacatgcatgatatatgcatgaatcatgatgggttgatcgcagtgatgcagcagccgcngcgcggctttcctcctctgccgtcgtcgag

SEQ ID NO: 42900 - DNA, 101 bp, rice(Oryza sativa)
  misc_feature (71): n=a or c
aaggtcaaaaaataaaaaaaggagcgttgaatgggaatcgaagggtgcaagggatgtttggttgcttactnactttgccaaaccctatattaggcaaggtg

SEQ ID NO: 42901 - DNA, 101 bp, rice(Oryza sativa)
  misc_feature (71): n=a or g
gcttgacactggggataccaagtatgatgtgctggtgagtgccacggaggagatggcggttgtctgggccnttgggaagctgcggccgccggatactctga

SEQ ID NO: 42902 - DNA, 101 bp, rice(Oryza sativa)
  misc_feature (71): n=a or c
aaccccggcggcagcttcttcgccgccgtcgtctccatcgatacacctcggcaaaatcaagaactcaaccnaagcagagcaccagatcgccgccgctcgcc

SEQ ID NO: 42903 - DNA, 101 bp, rice(Oryza sativa)
  misc_feature (71): n=t or c
agttgctagtgtcgcactcaaacgggagaggaggaaacgacggtcgtcgacgtccacgctcgactacgagnggaggtggcagccggcgtcatcacactgcg

SEQ ID NO: 42904 - DNA, 101 bp, rice(Oryza sativa)
  misc_feature (71): n=a or c
atggataagagcctagaagatagttttgttatagctaagaatgcagattcaagttcatagaggtggttcantgcagtgctgctggcaatacattcgaatgg

SEQ ID NO: 42905 - DNA, 101 bp, rice(Oryza sativa)
  misc_feature (71): n=t or c
tactcaatgttttttgaacatctgcaaccggataaacccctaaccttcctctggaagagcaaatgcatgangaaactaaaggtgttcctatggctactact

SEQ ID NO: 42906 - DNA, 101 bp, rice(Oryza sativa)
  misc_feature (71): n=a or g
aataagaatcttcttgtgaaaaataagcaacagacagtaccagcacatttgctcatcaggattgaccttcnccctgattatatctgtcctaagtcctacac

SEQ ID NO: 42907 - DNA, 101 bp, rice(Oryza sativa)
  misc_feature (71): n=t or c
ggtgagcagcaagatctgaggctaggccgtcgatggctgtgttggaacaaggctggatatcctccttcttnttcttcttttcatagaatgatgttagtgat

SEQ ID NO: 42908 - DNA, 101 bp, rice(Oryza sativa)
  misc_feature (71): n=a or g
tttcatttcgttgtgatggcaataaaacctaagagaagtgaggcatgcgtggcattattttttgcgaggtnccaattttttatttaaacctcctttgataa

SEQ ID NO: 42909 - DNA, 101 bp, rice(Oryza sativa)
  misc_feature (71): n=a or g
ccgtgacacaacggtgcgtaacaaagttaaatccggttgagtcgatgagttcccgtctcgtatataacacngcaccgcaaaccagtacaagagcgagcagc

SEQ ID NO: 42910 - DNA, 101 bp, rice(Oryza sativa)
  misc_feature (71): n=a or c
atgttcctgtgtacttgggtaaagtttcgattcgtctctgagtacacgactgtgtatagagtcgctttganttttccagcgtggcatgtatctggtgtccg

SEQ ID NO: 42911 - DNA, 101 bp, rice(Oryza sativa)
  misc_feature (71): n=a or g
ggaacaactattgcgaatagagtctaaatcctcttcaatggaacccatcggtgtgtagtggtacggattgnagtaaggttgtcgccaatataacttcaacg

SEQ ID NO: 42912 - DNA, 101 bp, rice(Oryza sativa)
  misc_feature (71): n=t or c
gataaatataatgttgtaccgtatacatgaagcaaattaatagagcttctcactccaagatactctctctnctaaattataaggcctatattttttacaca

SEQ ID NO: 42913 - DNA, 101 bp, rice(Oryza sativa)
  misc_feature (71): n=t or c
atactgtgaggggcaaccatccttggatcgaattactcttttaaagaacaatctttttgagtcctcactantgaggggcttcattctgtgaatgtattgat

SEQ ID NO: 42914 - DNA, 101 bp, rice(Oryza sativa)
  misc_feature (71): n=a or c
attcataagaatgataaaattatcttttctttaagctctgtacaacttgccaatatgttttaccccaatanaacgaaaaataattttaggataaaactttt

SEQ ID NO: 42915 - DNA, 101 bp, rice(Oryza sativa)
  misc_feature (71): n=a or c
agcaaattaagttttagtcccgttgcagtttcatggtacttattcagcgtgtaatatccctgaagacaagntaagagaatggagttccagttagattagga

SEQ ID NO: 42916 - DNA, 101 bp, rice(Oryza sativa)
  misc_feature (71): n=a or g
ttacaaaagaatttttgactgtgaagagcaatgtcctcctgaatttgaacaagcttctaaagagatactgnaaagatgtgatggtatacccctagcaatca

SEQ ID NO: 42917 - DNA, 101 bp, rice(Oryza sativa)
  misc_feature (71): n=t or c
cactggagacaccttgagattggtcagcataatgcgcagttgagcaccatcaacatttatctcaacacacnctgttggcagtaattgccaatataatcaat

SEQ ID NO: 42918 - DNA, 101 bp, rice(Oryza sativa)
  misc_feature (71): n=t or g
cttcaagaaggtcgcaccatctaggatgtcaccgttgctattttggacatttaggactatgttttccgccngaagagtccacccataagaacgtaagaaag

SEQ ID NO: 42919 - DNA, 101 bp, rice(Oryza sativa)
  misc_feature (71): n=a or g
ttgagcacatctttcaatcttccatcagacacgtctataagtataagcttaattaagtgctactccctctntctcattttaagtgcagctataagttttcg

SEQ ID NO: 42920 - DNA, 101 bp, rice(Oryza sativa)
  misc_feature (71): n=a or g
ttccacgccaacgaatgacacagccatctcggccacttcgcgatgtcatggcgcacgacgttctcctgcancatctcacgtacccgccgtctcgcacggct

SEQ ID NO: 42921 - DNA, 101 bp, rice(Oryza sativa)
  misc_feature (71): n=t or c
gacgttaacatcactctgatcaatggttcacgaattttggatggtttgttgcggctaatgtgtcaggaganatttaggaaagaggagaaatgcttagctga

SEQ ID NO: 42922 - DNA, 101 bp, rice(Oryza sativa)
  misc_feature (71): n=t or c
cagtgttttcacctctgaatcctcactcgtgagttgtggatcgtgatttctgatgtctgtatactccctcngttttaaaatgtttaaacatgtttgaccgt

SEQ ID NO: 42923 - DNA, 101 bp, rice(Oryza sativa)
  misc_feature (71): n=a or g
cgcggagatcgagtgcgtcaccgatggcaaatcagagaagatcgccaaccctgctttccaggagtggtttncctctgaccaacaggtcttggggttcctgc

SEQ ID NO: 42924 - DNA, 101 bp, rice(Oryza sativa)
  misc_feature (71): n=a or c
ctagcttgcttttctttttttgtcaattattttctgggcgttacaatcagcaagccttggatgcagaaagntggaacaaaatagtaaaattgattaacttt

SEQ ID NO: 42925 - DNA, 101 bp, rice(Oryza sativa)
  misc_feature (71): n=a or g
gcagtgaagaaggatagcgcaacttcaaatgagaggccacaccaatggacagttaagaggcattaattcanactcaaaatgaatactccatccattccatt

SEQ ID NO: 42926 - DNA, 101 bp, rice(Oryza sativa)
  misc_feature (71): n=t or c
gctgcttcgtgatctcaatggcctttttggttagctcccatcatctcggtacatataggtagtttcttgtnccgttctcaacgtcagattttcataggttt

SEQ ID NO: 42927 - DNA, 101 bp, rice(Oryza sativa)
  misc_feature (71): n=t or c
gaaaaccgagggggttattcgcaaaatggtgcgcactaaccttgagtccttgacaccccaagccatatccnggtatccccgctgcgctcccctcctccctc

SEQ ID NO: 42928 - DNA, 101 bp, rice(Oryza sativa)
  misc_feature (71): n=t or g
taatagatgtggttgactaagtagaaaaaagaaatactagtatgctgatgcaagctagtgtgatccagggnttcgttttgtttcttgacacacgcttgagt

SEQ ID NO: 42929 - DNA, 101 bp, rice(Oryza sativa)
  misc_feature (71): n=t or c
ctcaaacctgtcggtcgtcccgactcaggtataggacgatatcacgatggactttgtcaagggattaccgnctgtccgcggcaaatcagtcatcctcacca

SEQ ID NO: 42930 - DNA, 101 bp, rice(Oryza sativa)
  misc_feature (71): n=a or g
gatcagatatcccctgaagctgttaggagaaatctagcatatgaggatttacaaacttatgattagttgcncataataaatccttccattggcttccaagt

SEQ ID NO: 42931 - DNA, 101 bp, rice(Oryza sativa)
  misc_feature (71): n=t or c
aagacacagaaaatggccttgcatgcttcctcccggacaacggtgattccagatgatcttgagcaaaactnggaaaaaagcgagccatgtgaacaaatgaa

SEQ ID NO: 42932 - DNA, 101 bp, rice(Oryza sativa)
  misc_feature (71): n=a or g
atggttattctcatcttttagtggattaagtttgatatttttcacctgctcctctcttttgtcattaagcntttcaaatcctgtattatcattttcttgca

SEQ ID NO: 42933 - DNA, 101 bp, rice(Oryza sativa)
  misc_feature (71): n=a or g
ggtaatacaatgctatgtggcggccctccagatttgcaattcccttcatgcccatctaaagattcagaccnggcttcagtgcatcgactacatgtcttaat

SEQ ID NO: 42934 - DNA, 101 bp, rice(Oryza sativa)
  misc_feature (71): n=a or g
gagcggtgagctcgcaggcggctctcatacgagcaatgctctcgcagtcatgcagctgtcgattggggtcnacatcagggaggcgattcgtgccggcgtaa

SEQ ID NO: 42935 - DNA, 101 bp, rice(Oryza sativa)
  misc_feature (71): n=a or g
tgttactacgctccaaactctcactggcgagtgtgcacaaaagttaaccgaaaccttcaataaaaagcaanttaattttgaagcaattacaacacatcaca

SEQ ID NO: 42936 - DNA, 101 bp, rice(Oryza sativa)
  misc_feature (71): n=t or c
aaagaatggatgaataacggttttgatgggttcgaatactgaacagcgacatcagtacattacgggcatgntcatctctaccgaaatagtaggggcggagc

SEQ ID NO: 42937 - DNA, 101 bp, rice(Oryza sativa)
  misc_feature (71): n=a or g
gccaaatgggaacagttccatccagcaaatttcagacacgagagaccaaccttccatctgcggcaggttgngccacctgaagctgaccacgtactctggga

SEQ ID NO: 42938 - DNA, 101 bp, rice(Oryza sativa)
  misc_feature (71): n=t or c
ggtcggggtaattgtgcttttggtcttttggtcattataccttgctgaagaaaataacaaattccaggagncactgtatcctttttcaatcaagaaattag

SEQ ID NO: 42939 - DNA, 101 bp, rice(Oryza sativa)
  misc_feature (71): n=t or g
tttcaaaaaaaatatgctaaatgcgcacaaagcaatattttttactaatcaagatgtaacggtggttagcngcctgctgcaaagaataaacatattccttt

SEQ ID NO: 42940 - DNA, 101 bp, rice(Oryza sativa)
  misc_feature (71): n=t or c
tgataatctggataataggcgtaactgtccattcagtagggatggttggatcatgattcttggtatccccnttgattttagaaatgaatccgacattgaaa

SEQ ID NO: 42941 - DNA, 101 bp, rice(Oryza sativa)
  misc_feature (71): n=t or c
agtccgtccatttgtgcacaagattcttgtggtcatcgaaccacttctgattgatgaggactactacgctngtgttgagggccgggagatcatctcaaatc

SEQ ID NO: 42942 - DNA, 101 bp, rice(Oryza sativa)
  misc_feature (71): n=t or g
cacttacgcgtatgtcacgcgtgcagtggaggccaccgtctccgttgagcttctgcatgatcagggaggangagctcatttctgtggggagatcactgctt

SEQ ID NO: 42943 - DNA, 101 bp, rice(Oryza sativa)
  misc_feature (71): n=t or c
aagctaaaaatggaggcgtaatccgtctcaaccgagaaggagaagctcgagagcaacacaaaaatctgtanccacagatatttctgcatcatggcttctcc

SEQ ID NO: 42944 - DNA, 101 bp, rice(Oryza sativa)
  misc_feature (71): n=a or g
cacttcatttttaacacagccaacagtacaagattgctcttacctggtcaacccgcagtacagtacatgcngcatccgcagagtattttagagcgaataac

SEQ ID NO: 42945 - DNA, 101 bp, rice(Oryza sativa)
  misc_feature (71): n=t or c
ataagtacatcgaacagtttttaacaaaaaaaaaactatcagcatgtatttagatataccctcgggacttnaggtcgggggcccaatccacgaataaaaaa

SEQ ID NO: 42946 - DNA, 101 bp, rice(Oryza sativa)
  misc_feature (71): n=a or g
tttctaacaagaatagttacagtaagaactgagaaggccctataaagctattcatgctagcaatagcatcngaggcagaaaagctgcacgagaaaatttta

SEQ ID NO: 42947 - DNA, 101 bp, rice(Oryza sativa)
  misc_feature (71): n=a or c
gcgtcttctttggtgttctttgcttcgattgctcgatcagaatgtgttctttgtgattcgcaggctctgtnggtggtctgattcggcgggttttggttggg

SEQ ID NO: 42948 - DNA, 101 bp, rice(Oryza sativa)
  misc_feature (71): n=t or c
tacaagactttcgactttgaataaattcatacatcaatccaaatatatgccttatatacgtgttaaagttnatatagatattagtgtatctaaccgaggga

SEQ ID NO: 42949 - DNA, 101 bp, rice(Oryza sativa)
  misc_feature (71): n=t or c
aaatgtcagaccctgaagatatgtcagcccaatcttccagatgtgctcgtaggggtagggtatacgtgcgngtccatatgggtaagatacattgttatttt

SEQ ID NO: 42950 - DNA, 101 bp, rice(Oryza sativa)
  misc_feature (71): n=t or c
atgagtgcctctatctgcatgctttggaaagagtacttggccagattcgactccgtcacttgacaagtctngcttcatattcttcatcaagcaaagtactc

SEQ ID NO: 42951 - DNA, 101 bp, rice(Oryza sativa)
  misc_feature (71): n=t or c
gagatcatttttttgctatacatataattaacacagaacttgtacctggacatggccctcgacagcgcganggagccagatggacaacacttggcttttgc

SEQ ID NO: 42952 - DNA, 101 bp, rice(Oryza sativa)
  misc_feature (71): n=a or g
tctgggagcatctcggtgcgactgcttcctctgcatccatctgttcttctgcaacgcgatggctttctctngcaatggcccaccaggagctggagggaacg

SEQ ID NO: 42953 - DNA, 101 bp, rice(Oryza sativa)
  misc_feature (71): n=a or g
tacaagtacacaagcaatattaacaatccatatttgtttgatattcacctaggcccgttgcaacgcacggncatatttgctagtaacatatatttttacaa

SEQ ID NO: 42954 - DNA, 101 bp, rice(Oryza sativa)
  misc_feature (71): n=a or g
ccaaatgaaaggatgacaatgagtgatgtggtcgtcagactgaagaagatcaaggtggcatacaccgaatngatatctgcgacatagaatctggctcagta

SEQ ID NO: 42955 - DNA, 101 bp, rice(Oryza sativa)
  misc_feature (71): n=a or g
ttgccgcaggaccagcaaatcctccaagttggaccattgctagccaccatcgtcactgatcgagcaaaagncaacagcaacttgcggtgttcgccaatgaa

SEQ ID NO: 42956 - DNA, 101 bp, rice(Oryza sativa)
  misc_feature (71): n=a or c
tctatcttcatcttgctgtaatccagaatcaacttctggtgtattttttgttgtctttgatgaagcggacncaggcttggcatctccaagaatttgtccaa

SEQ ID NO: 42957 - DNA, 101 bp, rice(Oryza sativa)
  misc_feature (71): n=a or g
catcaaatcaccctctatgtactaatctctctctccttccctctctgcctatcttcttctaggctcgatantagcagggcgccaggatgacgatgggaagc

SEQ ID NO: 42958 - DNA, 101 bp, rice(Oryza sativa)
  misc_feature (71): n=t or g
gaaattttcatgctcattcatggagttgtcatccgccagagttgatgttcaaacttgtccatggcttgcangttctccttctcaagagatgcatcgtgcaa

SEQ ID NO: 42959 - DNA, 101 bp, rice(Oryza sativa)
  misc_feature (71): n=t or c
caacggtggcactgaacatctcttgttctgctcgtggaagcaacagaggacgcactcttggcgggcttttntgcagcctctgcagcacaagaggggggtgt

SEQ ID NO: 42960 - DNA, 101 bp, rice(Oryza sativa)
  misc_feature (71): n=t or c
taactcatgagttttcacatcgtggcctagcttaccatatctagaaatgcaaatggatcaatacataaacncatttatagatcgaattagtaagtaactgt

SEQ ID NO: 42961 - DNA, 101 bp, rice(Oryza sativa)
  misc_feature (71): n=t or g
agctccgtgccctcttctcctttccatggcggcaagcaacgaagtgcattgaggagagaggagaattccanggaagagagatgcacactgcatttataatg

SEQ ID NO: 42962 - DNA, 101 bp, rice(Oryza sativa)
  misc_feature (71): n=t or g
aatggcaagaaaatgaaaatactgatgtgcttgtagttcaactgttaaggttaaggaagaaatggcttcantgaagaaatcattacatgatgcttcctatg

SEQ ID NO: 42963 - DNA, 101 bp, rice(Oryza sativa)
  misc_feature (71): n=a or g
aatggataagtatgaagcaattgaagaaaagtctgacagaccaaattgagttcggaggatgtgtttacctntgattatttccggtcggggacgagcaggcc

SEQ ID NO: 42964 - DNA, 101 bp, rice(Oryza sativa)
  misc_feature (71): n=t or c
ttcgatttaaatggagcattgagcaaacctagctagtagaagaaaataaaccttgtctatatatgcggccngtttaatttatgaatgttaccttttgttct

SEQ ID NO: 42965 - DNA, 101 bp, rice(Oryza sativa)
  misc_feature (71): n=t or c
ttttatacctgtcagagagtaacacaaaatgctgattgtcaacgtcttccagtgcatttgccaacaacctnctctctgcatcaaccatggaaatcttaccc

SEQ ID NO: 42966 - DNA, 101 bp, rice(Oryza sativa)
  misc_feature (71): n=a or g
ggtcaatgagtggcatggtgagaggaaggccaacccaatcttggatagcaacttgtgcccaacttgttcangcgaatacgcactccaccaagatatggtga

SEQ ID NO: 42967 - DNA, 101 bp, rice(Oryza sativa)
  misc_feature (71): n=t or g
atataatcctttctgtcctttgaaatcttgcagtggaagcaacaaggatagttcgatcgagttgtatcacngaacgggaagaaaaaaaagagaagaaataa

SEQ ID NO: 42968 - DNA, 101 bp, rice(Oryza sativa)
  misc_feature (71): n=t or c
gttagttagttaattggatgtgtttgtgtgtgtgtatggcctttggttttgcatgaaggtccatagagaantaaggcaaacagctatagtcagttattgtt

SEQ ID NO: 42969 - DNA, 101 bp, rice(Oryza sativa)
  misc_feature (71): n=t or c
atctctgaaggccatatttcctagccatttgtcctcacaaaatcttatctgttgaccatcattcacaatcnaagaacccatacctagaaaggtgtttttta

SEQ ID NO: 42970 - DNA, 101 bp, rice(Oryza sativa)
  misc_feature (71): n=t or c
agtactggcagtgtgtgtcagctgcaacccatcattgtgtggctaactatggctattatatatgagatttnttccggtccaacgaaaagtatctcgatata

SEQ ID NO: 42971 - DNA, 101 bp, rice(Oryza sativa)
  misc_feature (71): n=t or c
ttgataatggcgatcttagagagtgaatggaagcgagggggagacataccttcgcccttggaagttgaagnggccatcacgacggtgtggcggcggcttgg

SEQ ID NO: 42972 - DNA, 101 bp, rice(Oryza sativa)
  misc_feature (71): n=t or c
gtagagctcctggccaccgtcgacgaaccccgtgtccatcaagtcgccgaaccactgtatgcacccgctcncgccgccgcggatgtcggcgccggcgtacg

SEQ ID NO: 42973 - DNA, 101 bp, rice(Oryza sativa)
  misc_feature (71): n=a or g
atggatgagggttgccctgaagccagccagccagcaaacttgtttgcatgcccatgcatttacatattcanatgtgaattagtagtgggagctttgcagct

SEQ ID NO: 42974 - DNA, 101 bp, rice(Oryza sativa)
  misc_feature (71): n=a or g
tggtactcggtaccaatacgtatcaggtcatgtatcatgtaccaacaataatcaggcttattaccgatacnggaatgctaggggacgggataccgtccccc

SEQ ID NO: 42975 - DNA, 101 bp, rice(Oryza sativa)
  misc_feature (71): n=t or c
cattcattcattcattttcacaaaattgctgcctaaatgtacaacaaacatgcagcttttcatctccatcnccccacattttcaatctctggcctagatag

SEQ ID NO: 42976 - DNA, 101 bp, rice(Oryza sativa)
  misc_feature (71): n=a or g
attggccatgatcggtagaagttcagcttttgttttggcctgtccatagtctcctcgtgcttgccttattntctcctgtattaattcaacctcagagaact

SEQ ID NO: 42977 - DNA, 101 bp, rice(Oryza sativa)
  misc_feature (71): n=t or c
ataggcccagtgaatctgttctttccaagatttaaatattccaagtatttaagatttccaatccatgggcngatcgaacctgtgagcttgtttacatctaa

SEQ ID NO: 42978 - DNA, 101 bp, rice(Oryza sativa)
  misc_feature (71): n=t or c
taggtccctttatcttgtcattgagtttgaattacatcgtaaaccacaatattagatataacgtgtccctntttttttcaaaaaaaaccaatacaaataca

SEQ ID NO: 42979 - DNA, 101 bp, rice(Oryza sativa)
  misc_feature (71): n=t or c
gcttattcttcgattaaactacgctatataggctgatctcgcactgtatttttccattgcttatccatcancaatttgtggcatcttcgacaccttctatg

SEQ ID NO: 42980 - DNA, 101 bp, rice(Oryza sativa)
  misc_feature (71): n=t or g
caaatgtcagtgtccctctatcttcttctcattccctcactactcttgctctctgcctctcatctcttagnttcagcccgcaaggtgaggatcggaggaga

SEQ ID NO: 42981 - DNA, 101 bp, rice(Oryza sativa)
  misc_feature (71): n=t or c
caaatttacttgaaccacagttccaacaaacattcttaaggaccagaccaccagaattcctcctgatgcancactagagggtgcaaaagcaaacgaatcaa

SEQ ID NO: 42982 - DNA, 101 bp, rice(Oryza sativa)
  misc_feature (71): n=t or c
aattgctcaagcaaagaagctactacagcttgctcggttcagttcagacacacacagtgctcgccttgagntgccacccattatggccgccggattcgtgg

SEQ ID NO: 42983 - DNA, 101 bp, rice(Oryza sativa)
  misc_feature (71): n=t or c
tccagtgttccaataccggtatcttggaggctcaaatagcgaagatgatgtctcgactcattggacagttnaggcagcttctgcataccacatccagttaa

SEQ ID NO: 42984 - DNA, 101 bp, rice(Oryza sativa)
  misc_feature (71): n=t or g
tgatacccaaaacagaaattttgtatcttactccaaaaccaaacgggccaatgactttctcttgagaattnatctttcgcaaagaaaccctcgtctctcac

SEQ ID NO: 42985 - DNA, 101 bp, rice(Oryza sativa)
  misc_feature (71): n=a or c
gccaagccaccagtgatattctataggttgtttcagcagtggtgaattccagcttatgatgagaggcaagnatacattttcagccacagatgtgcacactt

SEQ ID NO: 42986 - DNA, 101 bp, rice(Oryza sativa)
  misc_feature (71): n=t or c
actacccatggccatggctccactaccatgtacaacacacttgctagtgacctccaccttcgatgccaccntgtaccactcctgtcggcaaacaagagctt

SEQ ID NO: 42987 - DNA, 101 bp, rice(Oryza sativa)
  misc_feature (71): n=t or c
agaattgaaaagtgtatacctcggggatcatatccttttcctcccgacatcatgatttggtagcgatccangagagttcgctcggccaaacactcgagcac

SEQ ID NO: 42988 - DNA, 101 bp, rice(Oryza sativa)
  misc_feature (71): n=t or c
ataatataggtaagtactttttcagatctgagatactctgagataaggagatcgatggcggtcgtgaactngtgatagtgatgatgatgaataaaagatct

SEQ ID NO: 42989 - DNA, 101 bp, rice(Oryza sativa)
  misc_feature (71): n=a or g
tcttggtacattcttgtggggttgattgagttgttgcaagaaggcttgaaattttgcttctaaggtcgaanttgcttccatcatagcttgtggcgtgtgag

SEQ ID NO: 42990 - DNA, 101 bp, rice(Oryza sativa)
  misc_feature (71): n=a or g
aatgataccctcatattactcttatttgttagtcgcagtgataccctcatatgagaatcacgtcaccgaantctctacttgcgtgaagcattcctcctctc

SEQ ID NO: 42991 - DNA, 101 bp, rice(Oryza sativa)
  misc_feature (71): n=t or g
ttggcgcccttatctccaacatgctgaatttttcattcggactaaccatcgaagtctatcttttctggatnatcagcgtctgaccactccctggcaacaca

SEQ ID NO: 42992 - DNA, 101 bp, rice(Oryza sativa)
  misc_feature (71): n=a or c
aagatatggctttaatataccagtacgttcacctcatgggcagctcaaatatttcagaaatcggaacttgnagtctacagaagacagtgcacactcgatcc

SEQ ID NO: 42993 - DNA, 101 bp, rice(Oryza sativa)
  misc_feature (71): n=t or c
tctcccctcctgacactaagtatggaattcttgcatgcttcagagatggcgatgagatgcacgtccatagntccatgtgatggattttgtcaggcaggtaa

SEQ ID NO: 42994 - DNA, 101 bp, rice(Oryza sativa)
  misc_feature (71): n=t or c
cggcgctcagcctgtgatagccagctcatctcgtgctgcggcggctgctagcggataagattgatttattntccaagttcgacatggataagattgtttga

SEQ ID NO: 42995 - DNA, 101 bp, rice(Oryza sativa)
  misc_feature (71): n=t or c
tacaactttatgccttattcattaagtaataattcatcaaggcagctgtcttcaatcggctcccgtcttcncctgcagctcaaaagtggtgccttttttac

SEQ ID NO: 42996 - DNA, 101 bp, rice(Oryza sativa)
  misc_feature (71): n=t or c
gtccaagtttggaagcggcggtggcagtgttcccaaaagttcttgatctagttcttgttcacaaccttgcnggccttctcgtaaatcgctgcctgcagatt

SEQ ID NO: 42997 - DNA, 101 bp, rice(Oryza sativa)
  misc_feature (71): n=t or g
aagaatgtcaagtagtagtagaaaccagtgtttcagtagaaccagccctcagattgggcttacaagtaaanccaagataaccagggttttttcagtcccaa

SEQ ID NO: 42998 - DNA, 101 bp, rice(Oryza sativa)
  misc_feature (71): n=t or c
gtaggatctcaaaatcagtttctactctctctcccccttctgaaccaagaaattcagctatgatcctagcntcccttgaacagaactaatttcaggaacaa

SEQ ID NO: 42999 - DNA, 101 bp, rice(Oryza sativa)
  misc_feature (71): n=t or c
agcctttgacaatttttttgtcttgtcattttaaaaacaatgaaaggagtgttgggtaatacttccaccgncctaaaaaatcaatttaaaattgtatttaa

SEQ ID NO: 43000 - DNA, 101 bp, rice(Oryza sativa)
  misc_feature (71): n=t or g
gcatcatcacacatcatcttcgacttgctagacaaaaatcaagtggaaacgaactactccttccgaatcanagctatagcttctggcctttcctgatctgg

SEQ ID NO: 43001 - DNA, 101 bp, rice(Oryza sativa)
  misc_feature (71): n=t or c
ggagtgcggacaacgatatctctccacaactctagaccaaggtcaaagacaggtgtctttttgttagttgnaataaatgtcctatccatatacatgagtat

SEQ ID NO: 43002 - DNA, 101 bp, rice(Oryza sativa)
  misc_feature (71): n=t or g
tgcactttcacccatgaccccctgggaaacagtattggtgttgtctgaaagctgcttctcaatgttttctngtccagaaactgggttcacctcaatgcctg

SEQ ID NO: 43003 - DNA, 101 bp, rice(Oryza sativa)
  misc_feature (71): n=a or c
agcttcatcagatagcacacaccataaccttttcctaactagctttatcatgcacccttagcagaaaaaantttgctgttttttaagccttgtggttttct

SEQ ID NO: 43004 - DNA, 101 bp, rice(Oryza sativa)
  misc_feature (71): n=a or g
ttttagcagttttgtcaactgctgacaataacattttagcagttttgacccggagaagtgtgtgtggggcnttcgcgtgggtaagttattgggcttccttg

SEQ ID NO: 43005 - DNA, 101 bp, rice(Oryza sativa)
  misc_feature (71): n=a or g
aatattgtctaaactcttaagtaaatatggcagggtcagttgcccaatggacttgtggttgccatcaaaanactcgatgaatgtgcagtaaactttgattt

SEQ ID NO: 43006 - DNA, 101 bp, rice(Oryza sativa)
  misc_feature (71): n=t or c
gttctgcatttaggtgatgacaaaaacaatggccagttgtgctgaatgcttgatccaggggtggttagatnatgcatcgaacagcaagagcatagaaatag

SEQ ID NO: 43007 - DNA, 101 bp, rice(Oryza sativa)
  misc_feature (71): n=a or g
tcttttgcccagttgtgtcgattgcttctactcgaacgccactattttggcatgactccttttgtctttcncttttgtgtaaaacgtatatccattcagat

SEQ ID NO: 43008 - DNA, 101 bp, rice(Oryza sativa)
  misc_feature (71): n=t or c
cctcctggcaatgccccctccctccctccctttcccctctttggcttatcaatttgttttagtcctttggncaaatctagctaaccccaacattgaggtac

SEQ ID NO: 43009 - DNA, 101 bp, rice(Oryza sativa)
  misc_feature (71): n=t or c
gaagatgataggtactaccactcatacttccaatccaaggatcatcttcagtggatcattgtgcagctagngtacgtctactccgcagaacgccttgagcg

SEQ ID NO: 43010 - DNA, 101 bp, rice(Oryza sativa)
  misc_feature (71): n=t or c
tgccgaacaactgaactatcagctccattctctaacagagccgccagtctttttcttgccttttctgactncctgcctatattcttaaccttcctgttact

SEQ ID NO: 43011 - DNA, 101 bp, rice(Oryza sativa)
  misc_feature (71): n=a or g
tcgaaaaagaaataggaggttgtgcgcatagaggtttgagttggcgtttgctcgtatggatttgttgtgcnccggatttgaatggacaagttgttgcgtcg

SEQ ID NO: 43012 - DNA, 101 bp, rice(Oryza sativa)
  misc_feature (71): n=a or g
tttgctacctataatctataacatgtggtcactatgcgtctataatatacaatggcggatgcaacgtgggngcagaggggttttaagccccctactactag

SEQ ID NO: 43013 - DNA, 101 bp, rice(Oryza sativa)
  misc_feature (71): n=t or g
agcaccagttaaataaacaaatcaggtggtggagcgtgcaatttgccgaaatttgttagctaccaaagcanagcatgcagttcttgactaattaaagtttc

SEQ ID NO: 43014 - DNA, 101 bp, rice(Oryza sativa)
  misc_feature (71): n=t or g
gatgtctgtgaagattaagccatatttcgtctgatgttttgccgatggacatctgaagtttttgtcaggangggttctatgaacaaactagttcagaaact

SEQ ID NO: 43015 - DNA, 101 bp, rice(Oryza sativa)
  misc_feature (71): n=a or g
gaaaaaaaatgtagataaggaaatgactctggaaggctctactgtgcaagaggcgggaaactctgacaacnaagaggttgaaaatcttgacagccaactaa

SEQ ID NO: 43016 - DNA, 101 bp, rice(Oryza sativa)
  misc_feature (71): n=a or g
tatttccccgcggcagaagaaggtcaatgaagctcttgcgctgataaataagactcttgatgaactaattnacatctgcaaggtgaacttcttttcttatg

SEQ ID NO: 43017 - DNA, 101 bp, rice(Oryza sativa)
  misc_feature (71): n=a or g
agtttggcaacaatttgtctcagatttggttgtttttgttgcagattggattgtctagggtttggattttnggggttatggctccatctgagtgcccgccg

SEQ ID NO: 43018 - DNA, 101 bp, rice(Oryza sativa)
  misc_feature (71): n=a or g
acaggtacgtccagtggaaactactgaagtttcactcttggctagagtctgaattgaagcatttttgcttntttcttgaacatgggatggcgtggaggtag

SEQ ID NO: 43019 - DNA, 101 bp, rice(Oryza sativa)
  misc_feature (71): n=a or c
tcattatgtttgataagcttctcgaatatatcgttggaagaagtttatgatggacatagcttactagagtnataccaagttacatacgtagataccttgaa

SEQ ID NO: 43020 - DNA, 101 bp, rice(Oryza sativa)
  misc_feature (71): n=t or g
catgtgagcatttctacgtttaaccgaatgaagttgtgaaattgcccaaacgggaattaatagggaaatcnaatgaaatgtttgcaacctcccaagatttt

SEQ ID NO: 43021 - DNA, 101 bp, rice(Oryza sativa)
  misc_feature (71): n=a or g
gtgtgtagctataaaataaaaagggaaggtaatagctgggtttgcatcaatcaatgatcagaggaggagancccaggctgtgtaggagttggcagcagctc

SEQ ID NO: 43022 - DNA, 101 bp, rice(Oryza sativa)
  misc_feature (71): n=a or g
aggatttcaacgatgggggtatgaagttacagactacggattatgtacatagtgctaaggaaactagttcnacgttaaaaataaactcaaaccactaatga

SEQ ID NO: 43023 - DNA, 101 bp, rice(Oryza sativa)
  misc_feature (71): n=t or c
attaacatccgagctagaaatgttattcgtttgtagtttcggctgcgtgaggcatatactctctccgtttngaaatgtttgacgctcttgactttttagca

SEQ ID NO: 43024 - DNA, 101 bp, rice(Oryza sativa)
  misc_feature (71): n=a or g
cgggaagaagagaaagagagagatagggggaagagggaagaagagagagtgaggatgaagaagagagaagngaggagtgaggctgacatgtggggccacgt

SEQ ID NO: 43025 - DNA, 101 bp, rice(Oryza sativa)
  misc_feature (71): n=a or g
gtcggcgcgacggctgatggtttgtcaccccaccattggatcttggtgtttggtgcagggcataggcgatngccccaccgccatccctcccctttgccgct

SEQ ID NO: 43026 - DNA, 101 bp, rice(Oryza sativa)
  misc_feature (71): n=a or g
tagcaaccttatgaggcggtttgaaccagaaaggtaatgaaaatgacacatttgaaacacatctaaccacntatatggcaatcaatgaaaagatgttgtat

SEQ ID NO: 43027 - DNA, 101 bp, rice(Oryza sativa)
  misc_feature (71): n=a or g
acagctctgctgcgaaatgctaagtttacaagtctcgatccacgcatgcaacaaaaacacaacaacaacancagcagcagcaacaacgtacacgatggcga

SEQ ID NO: 43028 - DNA, 101 bp, rice(Oryza sativa)
  misc_feature (71): n=a or g
cgtgggacatcgctgtatgtggaggcccatatccagggagcctcgaatgtaccggaggatccgcttgagcncggcgaggtgaggctcgcgaggatcatgca

SEQ ID NO: 43029 - DNA, 101 bp, rice(Oryza sativa)
  misc_feature (71): n=a or g
gtcaaaaatagaaccagaaaactgatattggtcttaccggaaagaaataacttcaaaagtggattaacacnatttattatgacctggactagactagattt

SEQ ID NO: 43030 - DNA, 101 bp, rice(Oryza sativa)
  misc_feature (71): n=a or g
agagaacagcacagctcagaccaacctgaagatgtcacaagtgaggtcgctttctatattcagtagttctngtgttagtttattaccatctctttcaagct

SEQ ID NO: 43031 - DNA, 101 bp, rice(Oryza sativa)
  misc_feature (71): n=t or c
taaaccctgatgagtggagtcatgctccaccaccacactgttgatgcttttctcaaagagggcagctacanaacgggataccgttgcaacgggatatttta

SEQ ID NO: 43032 - DNA, 101 bp, rice(Oryza sativa)
  misc_feature (71): n=a or c
cctcctcctcctcttcagcaaatcagacgcctcaaaatcatcccaagaatcatcaattttctctctctctngagagagactagaggagtgggtgttcttgg

SEQ ID NO: 43033 - DNA, 101 bp, rice(Oryza sativa)
  misc_feature (71): n=a or g
gactaacgcttaggatcataaacgagccgctaataatgaaacaacgaggtaagcacctgcttttgaaggcntagtaactgaatgtagtgtagcaaccaggt

SEQ ID NO: 43034 - DNA, 101 bp, rice(Oryza sativa)
  misc_feature (71): n=t or c
ttgtccttgctgtggccgacatgccgcaggacccgcacacgcaagcctcgtccgtagacatagtcgtgccngagctctaccagcccgctcgccaccgcgag

SEQ ID NO: 43035 - DNA, 101 bp, rice(Oryza sativa)
  misc_feature (71): n=a or g
cacgtgtcagttctatttttttttccaattacggctgctggtaaggaagacgttcaattgagatctgcatntgcacgttggcgatagaggagaatgagtga

SEQ ID NO: 43036 - DNA, 101 bp, rice(Oryza sativa)
  misc_feature (71): n=t or c
ttttgtccatttaaccttacgaggattcctcttcatcttgaaatttttatgacattttgaccggcaaaagngaaagatctgcgaacagaaataaatgtaac

SEQ ID NO: 43037 - DNA, 101 bp, rice(Oryza sativa)
  misc_feature (71): n=a or c
cgcgcattcctccttttcatatattttttttcgccttttgcaggtacccaattggtcagtgtggcaacaangtcggcttgctgctgctgctcgacaaggct

SEQ ID NO: 43038 - DNA, 101 bp, rice(Oryza sativa)
  misc_feature (71): n=t or c
taaaagatgtagtacacaataaaacttggaagaagtccgtaaggaggaaaaattttgtaggcttttctttntctcttttgaggttgacatttttggaggtt

SEQ ID NO: 43039 - DNA, 101 bp, rice(Oryza sativa)
  misc_feature (71): n=t or c
gttgcgatactgtcaatagcagcggagcagcctcattaagttacctacgctaactaatttaacacaaaagnttaaagtgttgagaaaaggtttagactaga

SEQ ID NO: 43040 - DNA, 101 bp, rice(Oryza sativa)
  misc_feature (71): n=t or g
ctatgacattatcagatttttcaaggagatccagaatgctggcttatacgctattcttcgcatcgggccanacatttgcggcgaatggaactatgggtaca

SEQ ID NO: 43041 - DNA, 101 bp, rice(Oryza sativa)
  misc_feature (71): n=a or g
aaaagataggcatggtggatttagcacctcaaccttccgtagggcgtttctctagctggtggtcccaagtngtcagaggtgtccctaaggaagctaagaaa

SEQ ID NO: 43042 - DNA, 101 bp, rice(Oryza sativa)
  misc_feature (71): n=t or g
tctactgtgcgtaccccgggcccatatcaccaacaaggtagatcaagttgtttggtactcccatgaagaanaaaattattgcaaaggaataaaatgtttgt

SEQ ID NO: 43043 - DNA, 101 bp, rice(Oryza sativa)
  misc_feature (71): n=t or c
gtgagccaaatctctagtcatgttttgctgactttagccgtctttcactacaaccgtgcaaaggataatcntggaaacagttcaaatgtacacattttcaa

SEQ ID NO: 43044 - DNA, 101 bp, rice(Oryza sativa)
  misc_feature (71): n=a or c
tacgagtttccagagttcagttctgcctctgaagatcctactcttgtgtattcagatgacatgaagaaganttcccatctcaaggacttggaagcactagg

SEQ ID NO: 43045 - DNA, 101 bp, rice(Oryza sativa)
  misc_feature (71): n=a or g
cgatagtgaagaaactgctggggaacttgaaatttggaaagagcagtaggaagttcagcttgcataggacnagaaaatccccgagcccccttcaattgaga

SEQ ID NO: 43046 - DNA, 101 bp, rice(Oryza sativa)
  misc_feature (71): n=a or c
tgtgatggccatgtgctttaagagtagccgtcaagtaccataattgtcagctgacactcgcatgaaatatnttaggaggatacaatataaaatgtgcaacg

SEQ ID NO: 43047 - DNA, 101 bp, rice(Oryza sativa)
  misc_feature (71): n=a or g
ctgaagtgtgggcccttgtgaggacacgaagaacatgcactgacgtgtggaatctcacgtggggatttacntgaagttgataaaataacaggagtagttgg

SEQ ID NO: 43048 - DNA, 101 bp, rice(Oryza sativa)
  misc_feature (71): n=t or c
aacagaaaagcctgaaatgcagatttggaatacaatgaacaacatcaacacagaacactgtaactgagganaaacagctgcgtagaactgaaagggtagta

SEQ ID NO: 43049 - DNA, 101 bp, rice(Oryza sativa)
  misc_feature (71): n=a or g
atttaggctgttcaactattccttgagatgttggcacatagtctagcaatcaatccttcaagggctgctcnatgtccggttacttcgagggcgtcgagtgc

SEQ ID NO: 43050 - DNA, 101 bp, rice(Oryza sativa)
  misc_feature (71): n=t or c
cagtgtgcgcccctggatatatagttcgttcgtcttactacaataatttccggccctaacgcgtggaggancaccctgcgcgtcgtcctgtgtcatgcgcc

SEQ ID NO: 43051 - DNA, 101 bp, rice(Oryza sativa)
  misc_feature (71): n=a or g
agaactatcccttcacggaccatgaagtgacacttttcccaactaagtatcaggtccttctcttggcatcnttgtaagactttgtctagattctgtagaca

SEQ ID NO: 43052 - DNA, 101 bp, rice(Oryza sativa)
  misc_feature (71): n=t or c
ccgcattagttttctctactctttacaagggcttgcattaccgaccaccgattttgagcctcgtcggtatnattccgactaaattttggtcaaatttgttg

SEQ ID NO: 43053 - DNA, 101 bp, rice(Oryza sativa)
  misc_feature (71): n=a or g
gtgttccatatagctcatgagctcacatgtcagtgagcatgtcatgtggcagtttcacgttagaggatccnctttcgacatgatgtagtcccacggtgcga

SEQ ID NO: 43054 - DNA, 101 bp, rice(Oryza sativa)
  misc_feature (71): n=a or g
tgatatacattctgtggagtgtggatctgaacatttcatttcttcaaatttgttcaacactgatacctgtnttttatgaatgctgttacttatttctttaa

SEQ ID NO: 43055 - DNA, 101 bp, rice(Oryza sativa)
  misc_feature (71): n=a or g
aacacctcaaaacaagggttgaatgcccaacaaaaattgtatgagggccatgtgcacaaataattgctgtnaaatgtttactaataaaccatcaatatgat

SEQ ID NO: 43056 - DNA, 101 bp, rice(Oryza sativa)
  misc_feature (71): n=t or c
cgcccctcttctagttcccatctcccagtcctatcgcgtagcccacactccaccctatcgcgccttctctnccatcgccacggcccacactctgccgagcg

SEQ ID NO: 43057 - DNA, 101 bp, rice(Oryza sativa)
  misc_feature (71): n=t or c
ttggagaagtggaggaggcagccatgcgccattggtttcactcgagggagatggaaggaattgttaaatangtgattctaattttaggcccacaatatatt

SEQ ID NO: 43058 - DNA, 101 bp, rice(Oryza sativa)
  misc_feature (71): n=t or g
tagaagctaccgacaggggacaggtgaacgggggaaataatagaggtgaagctacagtggaattgaagtgngtgtggatggatgggacggatgagtgacat

SEQ ID NO: 43059 - DNA, 101 bp, rice(Oryza sativa)
  misc_feature (71): n=a or g
cagatgtagtgtgcatgtgtggcattgcatcataaatgagaatcaaaaggcttagcttaggtcctgtttanttcctatgtaaaatttttttaccatgtaat

SEQ ID NO: 43060 - DNA, 101 bp, rice(Oryza sativa)
  misc_feature (71): n=t or c
tgttgccacgatggggcttcggagggggccaaatgcgaaatgtttgctaccatggacaaccacgttggcanccgagacatgtgaaaggcgattcggaccaa

SEQ ID NO: 43061 - DNA, 101 bp, rice(Oryza sativa)
  misc_feature (71): n=a or g
tcccattgtgctcttacggctatcaacatcgcccgcaagatcactgtcattgtagccaatgaggcacacancatccttcttccttcggtattgacagccat

SEQ ID NO: 43062 - DNA, 101 bp, rice(Oryza sativa)
  misc_feature (71): n=a or g
gccattccggcccatggtgcatgacagaacataatatcacgcaaagtctataaaaagaacatcatgccgangataaacgtccaaattattttttttatttg

SEQ ID NO: 43063 - DNA, 101 bp, rice(Oryza sativa)
  misc_feature (71): n=a or g
gtaggcggcgtactgtttcgagaggcgtatcaaggagatcaggatagcaccagagcacttgatgccgatgntctccatggagtttgtggtattccttcaac

SEQ ID NO: 43064 - DNA, 101 bp, rice(Oryza sativa)
  misc_feature (71): n=a or g
gtgaattaagcattaaaagtacattatacgctggccttgagaggcacgagtatgtcgattcggaacccatntttaaaggcaacaaaaaaataaagagttgg

SEQ ID NO: 43065 - DNA, 101 bp, rice(Oryza sativa)
  misc_feature (71): n=t or c
ctttccatttcaacacttaacagttcgtttattcgtcatcttcagctgggaaactcaatctatgattcacngggcaaacgaagacgctgcacgtccaaggc

SEQ ID NO: 43066 - DNA, 101 bp, rice(Oryza sativa)
  misc_feature (71): n=a or g
aggcagatcaattcaccaggaaaggtcaaagcttgctgaagaatatatggggacgtaccagtgcgctgtcnccttcctatattaattgcgaggtacaattt

SEQ ID NO: 43067 - DNA, 101 bp, rice(Oryza sativa)
  misc_feature (71): n=t or g
caagttctctgcccagtccaatttatcagctgatgttctgaagtggtggccaaatccttcaatgccgccanctggacagacagccacagcgttcttgtcct

SEQ ID NO: 43068 - DNA, 101 bp, rice(Oryza sativa)
  misc_feature (71): n=t or c
ttttatgctttcttactctgcagatgtctgatgttctctatttgctctagttaggtcgccatcttgatganacttgggtggcatatgttggaaatggagct

SEQ ID NO: 43069 - DNA, 101 bp, rice(Oryza sativa)
  misc_feature (71): n=a or g
catttaatccacctccgcaggtatgcatcagaattcttcagctgtgatcaaaatattactttatcttcctntcaaattatctgaccgcggagagtatctta

SEQ ID NO: 43070 - DNA, 101 bp, rice(Oryza sativa)
  misc_feature (71): n=t or g
agcatccataatgtatagttcatgtaagggtactagagatgggacacatcaattatatggtaattagatgngactatttatcatatatcttagttaatcta

SEQ ID NO: 43071 - DNA, 101 bp, rice(Oryza sativa)
  misc_feature (71): n=a or c
aactcatcgaaaagtaaaagaaaagggtggcgacatattcctgtagtattttccatgcttccgggatcgtntcatccttcgtttgctgaaagctggaaatt

SEQ ID NO: 43072 - DNA, 101 bp, rice(Oryza sativa)
  misc_feature (71): n=a or g
aagacgatggctcttcccccttccttgctgacagctcgtcctgttgtcccctcctcttcttctctcaggancggctggatctgccgccgcacgcatggggg

SEQ ID NO: 43073 - DNA, 101 bp, rice(Oryza sativa)
  misc_feature (71): n=a or g
gccggatcataatcaccacaaggcatgaaagtattgctaagcattgttcaggggatcaacaaggaaaaatntatcaactcaatcgtctaggagacagcgat

SEQ ID NO: 43074 - DNA, 101 bp, rice(Oryza sativa)
  misc_feature (71): n=a or c
ggacggagggagtacataattgtttagaccaaaagaattcctcacttccggtccaagctctgacttcaggngtgccaacctggttgtgcagaaattgaatc

SEQ ID NO: 43075 - DNA, 101 bp, rice(Oryza sativa)
  misc_feature (71): n=a or c
tacaaacctatgttgcatataacatctaattaatgaagacatagcacttcccctgctgtgcagacggctgnaaaatcggaatcatccaacagataatgaca

SEQ ID NO: 43076 - DNA, 101 bp, rice(Oryza sativa)
  misc_feature (71): n=a or g
gccgcgagagttaacttcgctagtgtggttggggatgaggaagaaccgaagaatgaggataaagttggggnaaggtttcggctatgggtcccaccgtccag

SEQ ID NO: 43077 - DNA, 101 bp, rice(Oryza sativa)
  misc_feature (71): n=a or g
ttttttttgtgggcttttttttattttgttttttttaattacggattcggtggatctggtcgtcgtttgtnagagggaggggggaggatgcggaattgccg

SEQ ID NO: 43078 - DNA, 101 bp, rice(Oryza sativa)
  misc_feature (71): n=a or g
cagtggcgattagcctccttgatggatgaggatggtgattcttcttctccttctctagtgatagcaatagncggtgatgaatctaacaagctaaaattttt

SEQ ID NO: 43079 - DNA, 101 bp, rice(Oryza sativa)
  misc_feature (71): n=t or g
aagacctcacttggcaggcttccaccaaatgaattgtgggagaaatcaagcttctctaattgtctccactnccctaagtttgaaggtatgctcccgttgaa

SEQ ID NO: 43080 - DNA, 101 bp, rice(Oryza sativa)
  misc_feature (71): n=t or c
ttagtttctttgtttccgccgctaagcaccttaccatcatcgtaatttccacacaggacctaacagaggcngtgtatcaatatcccgtgtaataacagaga

SEQ ID NO: 43081 - DNA, 101 bp, rice(Oryza sativa)
  misc_feature (71): n=t or g
agtggttagtctcagtttacctgaaatggattcaggggggacaaatcttggttttgtcttcgatgtactgncctcaaagggatgatgagatgttgatgttc

SEQ ID NO: 43082 - DNA, 101 bp, rice(Oryza sativa)
  misc_feature (71): n=t or c
gagaacgtgcccgttaggccacaaattaacttaggagacacaaacttcgatctgaagtcgagcctcatcangatggcgcaggctagcccgttctgcggcaa

SEQ ID NO: 43083 - DNA, 101 bp, rice(Oryza sativa)
  misc_feature (71): n=t or c
acattctgatggcttgaggagtcatcttgctcatccattgtgcgaagaaggctaaggagagacgaatcatncgagctctgatctttggcggtcaaaccagc

SEQ ID NO: 43084 - DNA, 101 bp, rice(Oryza sativa)
  misc_feature (71): n=t or c
gttttctcattcctgcgattcaaaggggccctgactatgtcaatggccataaaccacacgtttatgattangttagatacgcaacctaaccaatataagga

SEQ ID NO: 43085 - DNA, 101 bp, rice(Oryza sativa)
  misc_feature (71): n=a or g
ggtcttggttgtattctcatttagaacaccaaaccaatccctctcaaggaacaagctaatccaatggctcntacacgtgctgcgccgatcgttcccgtgaa

SEQ ID NO: 43086 - DNA, 101 bp, rice(Oryza sativa)
  misc_feature (71): n=a or c
gcatgagaaaccaacaatctatgttccgatgttttcatatatagctagaaggggaaaaaccaattgggaanatttaatacgatcgattgaggcatatatag

SEQ ID NO: 43087 - DNA, 101 bp, rice(Oryza sativa)
  misc_feature (71): n=t or g
gtagtgtttttgtttttctccttttcttgtcccatttctggttcagtcagatctcagccgctttgaagcanatggctcgtcgttctacccgtcagaccctt

SEQ ID NO: 43088 - DNA, 101 bp, rice(Oryza sativa)
  misc_feature (71): n=t or c
accaagcagtcaagcacttagtagtcaggggaagctcaagcacttagagtctatttgagagcttaagattngaataaacagctaactagcagtcagcttct

SEQ ID NO: 43089 - DNA, 101 bp, rice(Oryza sativa)
  misc_feature (71): n=t or c
caaatcaataaaacttaaagttgtgttcattttcacctcttctcaacttctacttcctcgggttttcacgngcacacttcccaaaccgttaaacagcatgt

SEQ ID NO: 43090 - DNA, 101 bp, rice(Oryza sativa)
  misc_feature (71): n=t or c
acatctcctagggaacaaggcatccggatcccatcccattctaggacagtgcatgatattggtacagctanaaacctagcgccaagactctgaagatatat

SEQ ID NO: 43091 - DNA, 101 bp, rice(Oryza sativa)
  misc_feature (71): n=a or g
cactttgcacctgtcaacactgacaaactcaacatgcttgcctcctaaagatgtgactgagctgagtttangtattccaactagttcaaggacatcagata

SEQ ID NO: 43092 - DNA, 101 bp, rice(Oryza sativa)
  misc_feature (71): n=a or c
cgattgaatatggtttggagctgttgaaaaagggtctcatctagcgagtgggaaatggcaggtcaatcaanatctggcgagacccatggttgcccagggat

SEQ ID NO: 43093 - DNA, 101 bp, rice(Oryza sativa)
  misc_feature (71): n=t or c
ctccagttatacaataaatcaaacaaactatgactctatgagtcccgtcggttagcctaataaaccaaaanaaaagtcaatttgaatcctcaaacttaatt

SEQ ID NO: 43094 - DNA, 101 bp, rice(Oryza sativa)
  misc_feature (71): n=t or g
acaagcagataacgtatttacgtttcctactatgcttatgtttccatctaatcttgggcagctactggganatctatttgagttgtttgagtccgtatgat

SEQ ID NO: 43095 - DNA, 101 bp, rice(Oryza sativa)
  misc_feature (71): n=t or c
gctccagatcagggacgtaatcctttcgtctcaaatattgggggcgtctcaagctgccgcctcttcgcaanaagctacaacttcgacaacaatcaccatct

SEQ ID NO: 43096 - DNA, 101 bp, rice(Oryza sativa)
  misc_feature (71): n=t or g
ttgccttaagtttatttttgttttgctttggctcctgcagggatttgttcttgaggatgctacaggtttancattgagtggggaccttgatgtgcaatcag

SEQ ID NO: 43097 - DNA, 101 bp, rice(Oryza sativa)
  misc_feature (71): n=a or g
catgtgtgaaaagtgaaaaaaaaatgcaagcagcagcaattggagaggaatctccaatcaaggtgaattanaaggaaggtatatttgcaacaaatcgtctt

SEQ ID NO: 43098 - DNA, 101 bp, rice(Oryza sativa)
  misc_feature (71): n=t or g
atggcttggagctcacacgtaagcaaggtaataaatagcaaataggtggttggtagcaaattagtgtctgnataattaatagtggttgctattacggacgc

SEQ ID NO: 43099 - DNA, 101 bp, rice(Oryza sativa)
  misc_feature (71): n=t or c
gggtttcgctctctcaacccacctgccccctatttaaatagctcctccaagccaccgtcaatccatcgtcncgcctcccccgcactgctccgcctccattg

SEQ ID NO: 43100 - DNA, 101 bp, rice(Oryza sativa)
  misc_feature (71): n=t or g
atatttgatgctcgagggttgataaactcagttctaaccgaatgaatactcccatcaggtggttgatgagnaacagcctggcaagttgatgtatttgcttg

SEQ ID NO: 43101 - DNA, 101 bp, rice(Oryza sativa)
  misc_feature (71): n=a or c
atatagtatatctatagagattaattacgatgcagcttgggatcgtatatatccacttgggcatgaatccntcgagtattcaattgggagcttttcccaaa

SEQ ID NO: 43102 - DNA, 101 bp, rice(Oryza sativa)
  misc_feature (71): n=a or g
gtctacaatatctaagaattcgtaagtgcaaaaatataaatgcgattgttttttacctccaacatggggtnagcatatgattttaagggtttctcgtcctc

SEQ ID NO: 43103 - DNA, 101 bp, rice(Oryza sativa)
  misc_feature (71): n=a or c
cagcagaatcacaaaggctagagccatgaggagaatgacacataggtggatgagcagcttcgaggccaatncgagccacgcgagcctctctccgagcaccg

SEQ ID NO: 43104 - DNA, 101 bp, rice(Oryza sativa)
  misc_feature (71): n=a or g
actccctagttttggaaatggtgcaggtttgccttggagagcaaccaatgaccatgttaagaacatggccnaagagagttttacattgaaccaacagatag

SEQ ID NO: 43105 - DNA, 101 bp, rice(Oryza sativa)
  misc_feature (71): n=t or c
ggccgtggcaacgtgaaacactgtggacaaccacgccaaatctagagatggaagtaacaaatactctctcngtccctaaatatttgacaccgttgattttt

SEQ ID NO: 43106 - DNA, 101 bp, rice(Oryza sativa)
  misc_feature (71): n=t or c
gacgaagtagtcttctcccccccaaaaaatgaaaacgaagcaaaaatttagcaaaccaaccggacaaaatngactcatttttgtgtcccaaaacgattaca

SEQ ID NO: 43107 - DNA, 101 bp, rice(Oryza sativa)
  misc_feature (71): n=t or c
gtggtgtgcacggtcaaacttgccgatcaaacacagtaaaaatgcaggtcgatggatatgtcatctactangaaaagaataattattcataaatacgagcg

SEQ ID NO: 43108 - DNA, 101 bp, rice(Oryza sativa)
  misc_feature (71): n=a or g
acaatgtctgttgcgaaagttaaaaagaatgatggggacagagctaggagtttacaacagcatgtcaagcncaagtatttgatgttgttaggagttttggc

SEQ ID NO: 43109 - DNA, 101 bp, rice(Oryza sativa)
  misc_feature (71): n=t or c
ccaaatttggtcgttaacaaaggggtatggaccgaaaaggagggggagacctaggaaaacagataaaagangagagttgtattttggaatatcagagattg

SEQ ID NO: 43110 - DNA, 101 bp, rice(Oryza sativa)
  misc_feature (71): n=a or g
ctttgaggtgttttgtgtccctttggttcccgaaaacatcttctatagaagcagcgataatttggaccccnacagcaacagcagcgttgatcaggagtcat

SEQ ID NO: 43111 - DNA, 101 bp, rice(Oryza sativa)
  misc_feature (71): n=t or g
gctcatcaagaacccagcagaaatggcgaaagtgcaagcagaggtgagacatgtcgtagcagctgcacacngaggagaaggagacgaagacgccgtcgtca

SEQ ID NO: 43112 - DNA, 101 bp, rice(Oryza sativa)
  misc_feature (71): n=t or g
cttatggttgtcttgtgccaagcagatgatgcatctgtcataagtgtcatctgtggatgctgctgtagctnaacattgtaacttgtcgggggatgtgtttt

SEQ ID NO: 43113 - DNA, 101 bp, rice(Oryza sativa)
  misc_feature (71): n=a or g
agtcacaaatatgtataggtttattgttcattgacctaattggcatacatgatagcctaataaatgaggcntacacgctatgttgctgtctaaacagtatt

SEQ ID NO: 43114 - DNA, 101 bp, rice(Oryza sativa)
  misc_feature (71): n=a or c
ctcctccgcaggcagccagctgagcatcatccctccctcccccacaccatgcagcgcagcgtcatggcctnttgggcaccggatctgcccgatgacggagg

SEQ ID NO: 43115 - DNA, 101 bp, rice(Oryza sativa)
  misc_feature (71): n=a or g
agaagggagaaagagagaagggcggaagaagaagggagagcacgggtggaggtggaagaagaagggaggcngaagaaaaaaggataagaccaatgggcgtg

SEQ ID NO: 43116 - DNA, 101 bp, rice(Oryza sativa)
  misc_feature (71): n=a or g
gatcaaagaaaatcatatagttctactagaataggaaagtctagtatttctcatacatggtagagtgtacntatgttgtgagcacttacatttgtaccatg

SEQ ID NO: 43117 - DNA, 101 bp, rice(Oryza sativa)
  misc_feature (71): n=a or g
cgttgtgaacaagcttttcaaaaacgttggccgcaaaaggatagagatagacttggaagccatcagagatntgccttcgggggagcgtgcaaccctccggc

SEQ ID NO: 43118 - DNA, 101 bp, rice(Oryza sativa)
  misc_feature (71): n=a or g
attgttttgcttgtaattttttccagaggtaaatgatgaacagagacagaaggatgactaaagcaccaagnacagctccaacaactgctgctgcattttcg

SEQ ID NO: 43119 - DNA, 101 bp, rice(Oryza sativa)
  misc_feature (71): n=t or c
tatttgaataagaacagagcgtagaaatgaataggtcgctacagctactgtgtgatcacacagatgctgcncttgcaactgactgcaatccccaggcagta

SEQ ID NO: 43120 - DNA, 101 bp, rice(Oryza sativa)
  misc_feature (71): n=t or c
tgacttcatctggacatcaccaggttggaaaccctcatgaaaagaggttctccactgctcttgcatacttnttcatcgggcgctgaattaagcactgcaaa

SEQ ID NO: 43121 - DNA, 101 bp, rice(Oryza sativa)
  misc_feature (71): n=a or c
tcatgctcatctaccttttgaacgatttgcatgtaatggcataacagctggagaactccaatgttgctagngagaacccaccaactgatggaatcaatcct

SEQ ID NO: 43122 - DNA, 101 bp, rice(Oryza sativa)
  misc_feature (71): n=t or c
aataaaccaaatcaaatgagctcaaaatcaaccttgaagttggcgtggatgctgccgaccttggcagtggngaggaggttggcggggaagaaggtgatgaa

SEQ ID NO: 43123 - DNA, 101 bp, rice(Oryza sativa)
  misc_feature (71): n=a or g
ataatgaaatttctaaagaaaccaggaagctctgctgaaaaatccggtggacataaggttacaccgaatgnaagcataccgcaaatgcaaaatcatatttc

SEQ ID NO: 43124 - DNA, 101 bp, rice(Oryza sativa)
  misc_feature (71): n=t or c
acatgttttggctatcatgactttacatggaagatttgacacaactagcagaaatatactacctccgtttnaggttataagactttctagcattgcctaca

SEQ ID NO: 43125 - DNA, 101 bp, rice(Oryza sativa)
  misc_feature (71): n=a or g
tggatcctatcaaattcataaggattgtagccttagggcatttacaatgggcctacgtgtcgttcagcccngtcagtgccaacggaaaaattgacaccacg

SEQ ID NO: 43126 - DNA, 101 bp, rice(Oryza sativa)
  misc_feature (71): n=a or g
ccggggctcctcattggtgtactgagggagggggggggggtttccaatgacaacacttttagttacaattnatattattcactgcttgtcaaggttgcctc

SEQ ID NO: 43127 - DNA, 101 bp, rice(Oryza sativa)
  misc_feature (71): n=t or g
aagatactaaaacgatgcaaggaggcaattccttccagagaagcaggagggaaggtcattgtcatagatgntgtggttggatcctccacccaagcaatgtg

SEQ ID NO: 43128 - DNA, 101 bp, rice(Oryza sativa)
  misc_feature (71): n=t or c
acagattgttgtagtgtgtcatggtggttgtgtagattatctatggtccgacagaacattgtagacgagtnatcatccactttgtttgatcaagtacaaga

SEQ ID NO: 43129 - DNA, 101 bp, rice(Oryza sativa)
  misc_feature (71): n=a or g
ctttagacaatggacatgctttatccatctcaatagccggaggcatacatgctttcaccaccacaatatcnttgaaagcccttgattcttgatacgttttt

SEQ ID NO: 43130 - DNA, 101 bp, rice(Oryza sativa)
  misc_feature (71): n=t or c
ctcacaatcaaacctatattctgattctaaatctttcttcctactcttgcaattcttgtccgtgaccctgntgatgtccatcaccctcttctgcttatagt

SEQ ID NO: 43131 - DNA, 101 bp, rice(Oryza sativa)
  misc_feature (71): n=t or c
atgactttggtatcgaccccctcacataagtaacttaagcttccgtggagggctaatgagatggcgtcaanatcattggcaccgtcatattggatcacgac

SEQ ID NO: 43132 - DNA, 101 bp, rice(Oryza sativa)
  misc_feature (71): n=t or g
agaatatgattttggaggggctgacacccgacagaattatgtacacttctctcattgcatgctattgtaancgttcaaacatgaaaaaagctatggaaatt

SEQ ID NO: 43133 - DNA, 101 bp, rice(Oryza sativa)
  misc_feature (71): n=t or c
acctctggaatttttttttctcgcaaacggtctagtgaacctggatatgattggtgaggaatgtctgtagnacagctgatgtagtagcagacaccgacgta

SEQ ID NO: 43134 - DNA, 101 bp, rice(Oryza sativa)
  misc_feature (71): n=a or c
gccgccgccgccgactacgccatggccgccaccgcgacgaagaccatcgacttcgccgcggagagaggtangcgacgcgcccccctcccctcccctccaga

SEQ ID NO: 43135 - DNA, 101 bp, rice(Oryza sativa)
  misc_feature (71): n=a or g
aataaggagatggcggcaaagacggtcgcaatggaagcaacagcacgtgttggtgagaatggccagatccngctaccctatggtcacatccagtctcctct

SEQ ID NO: 43136 - DNA, 101 bp, rice(Oryza sativa)
  misc_feature (71): n=a or g
tgatcagagccaaagcatgactgcagcacaagcatcatccagcaacaccaatgagtcatcatctttagatnttgctggtagcctgagaccttaggtgagtt

SEQ ID NO: 43137 - DNA, 101 bp, rice(Oryza sativa)
  misc_feature (71): n=t or c
cccatcttccatcatgaaagccatttcatcaaaaccaattccttgttggtcaccatcatcttgcacactantagacatcccaaatgtattatcgaactgtg

SEQ ID NO: 43138 - DNA, 101 bp, rice(Oryza sativa)
  misc_feature (71): n=t or c
atttccaatgaggcctttgacacttgatcatgattctgtaggcggtacttttgcggaagcgcttgtttcgngtagtcaataaccaagaagaaaaaaatgtg

SEQ ID NO: 43139 - DNA, 101 bp, rice(Oryza sativa)
  misc_feature (71): n=a or g
cactgctgggatatgggagagtctccctaatgccaaatatgctagggaaggggtcaaaattaaacacctgntaacactagcacatggtttttttttccctc

SEQ ID NO: 43140 - DNA, 101 bp, rice(Oryza sativa)
  misc_feature (71): n=a or g
aagccggcgaggcagttaacgtgtgcggggcataccggcacttagaggtgaaaacggtatgatttccacanaactagtataataataatatttttaccgat

SEQ ID NO: 43141 - DNA, 101 bp, rice(Oryza sativa)
  misc_feature (71): n=t or c
aactttaaccatcaataattcctagaacgcttagttcaaaaagaaggaaaataatatgcacagatttgccnagaaaagtacgatttttttaacttttgtaa

SEQ ID NO: 43142 - DNA, 101 bp, rice(Oryza sativa)
  misc_feature (71): n=t or c
tttattttccgagtagttccaccatttcttgtacttggactgctgcatgatgcattattcggcctgctggnctattgtattcgttgtagtcattacatcct

SEQ ID NO: 43143 - DNA, 101 bp, rice(Oryza sativa)
  misc_feature (71): n=t or c
ccacaatcccccccacccggcagccaacaacaggaaccaaccaagaacgatataatttacagagagaaaangagctaggatggacgccatggggatagggg

SEQ ID NO: 43144 - DNA, 101 bp, rice(Oryza sativa)
  misc_feature (71): n=a or c
ctttgcgccttcagggaatagaaacatgaggaggtctggttctcatttacattgatagcagccgccttgtngactgccgacttgccgcaacgcggagccgg

SEQ ID NO: 43145 - DNA, 101 bp, rice(Oryza sativa)
  misc_feature (71): n=a or c
ggttctgcagcacgcaattatactattgctgagctacacagggcctactctagccattggtcagagacacnaggcgtgagggttccaacaggaatcagcaa

SEQ ID NO: 43146 - DNA, 101 bp, rice(Oryza sativa)
  misc_feature (71): n=t or c
gatggagtgggattgggattaaacttttaaactaactctctgtttgggaaacaggtacttattacaagtcnctgtcacatcggatatttggacgctaattt

SEQ ID NO: 43147 - DNA, 101 bp, rice(Oryza sativa)
  misc_feature (71): n=t or c
tttccttttagggataatcccacttcacgtcttcacctattccccaaccaagcacaatgaaaaatgatttngactcaacccgacctattaaaggggtgttt

SEQ ID NO: 43148 - DNA, 101 bp, rice(Oryza sativa)
  misc_feature (71): n=a or g
gcgtcgcgttgttgtttatggacacagcacaatggagaacgaacaaaagaaaggcaaaagaagatcgaatnataggaaagggcggtgggaaaaggaggagg

SEQ ID NO: 43149 - DNA, 101 bp, rice(Oryza sativa)
  misc_feature (71): n=a or g
tacttagcaaaaaaaaaaaaaactccttggatttgcatgaaatatcgcacaaatccttgaaccaactgatncccctgtcatgttttatccaggaaacccct

SEQ ID NO: 43150 - DNA, 101 bp, rice(Oryza sativa)
  misc_feature (71): n=t or c
tgctgaggtacctttaaatagaggggaaaagttgccctgcatactgctggcaacgtaacgcttgaaatgtntgtagtgcgacacaccattttcttttaaaa

SEQ ID NO: 43151 - DNA, 101 bp, rice(Oryza sativa)
  misc_feature (71): n=t or c
gacttacattgtgaaatggaggaagtagttgctaacatggaagggagaaaatggagagaaaatagagttgnatcttcacaaaacaacaacatgagcgtgca

SEQ ID NO: 43152 - DNA, 101 bp, rice(Oryza sativa)
  misc_feature (71): n=a or g
tacgaaaatgatctttgcatgcggccaacctgtttccgcaggcaggaggagcacacgtctagagccagatntctgcaaaaattggtattttttgagtgggg

SEQ ID NO: 43153 - DNA, 101 bp, rice(Oryza sativa)
  misc_feature (71): n=t or g
aaatctcctattttaatgtttttattgcttaggagagagaaaactttcaaaataatggtaagtacccctgntttgcaaattgctttcgagttctccttcta

SEQ ID NO: 43154 - DNA, 101 bp, rice(Oryza sativa)
  misc_feature (71): n=a or g
tactcggtactccttacccattagtgctatgtaaagctgcgctcataaaactgagtagttttttttccccntaggtgacttgataacactgagcattaacg

SEQ ID NO: 43155 - DNA, 101 bp, rice(Oryza sativa)
  misc_feature (71): n=a or g
ggcatcaagcatgttgtgctaccacaagtgtagcaagggtcatacattcggttgagttgaagccaccccgncaaaggctactattgacaatagtgcataac

SEQ ID NO: 43156 - DNA, 101 bp, rice(Oryza sativa)
  misc_feature (71): n=a or g
acttcgtatgtcataaaatcagttttctttaccagctttaattaccacattatttcgtagctagcaatttnttcaccatacttttataactatcgtaactt

SEQ ID NO: 43157 - DNA, 101 bp, rice(Oryza sativa)
  misc_feature (71): n=a or g
gaaatagcatagacgagcggcatgttgtcctttggtctttgcccgtccagccaggcggactcccaaaagtngatcgtgtttccatcccctattgttatttt

SEQ ID NO: 43158 - DNA, 101 bp, rice(Oryza sativa)
  misc_feature (71): n=t or c
ggcccaaccatggctgtcattgccctcaaatgcccagcaattgaggtggtggttgttgacatctccaagcntcgcgttgatgcctggaacagcgaccagct

SEQ ID NO: 43159 - DNA, 101 bp, rice(Oryza sativa)
  misc_feature (71): n=t or g
aaatggtgcagaccggatgccccagatagttcccaggatgcttctctcattctttctcttattagtagcancagcactcgcactgctactagtactagccg

SEQ ID NO: 43160 - DNA, 101 bp, rice(Oryza sativa)
  misc_feature (71): n=a or c
aatagctgagcttgtacatgcacagaaattacagtctctggttgttgaaggctgctctaatatatctgaanatgctgtgcagggctcagctagatcagtcc

SEQ ID NO: 43161 - DNA, 101 bp, rice(Oryza sativa)
  misc_feature (71): n=t or c
gtcgtctctgtaaccagtaattccttcatccacagataagaggaacaaatcaagacaatatttgtgacgangatttaactctgatagcacatatgcgagca

SEQ ID NO: 43162 - DNA, 101 bp, rice(Oryza sativa)
  misc_feature (71): n=a or c
tatgacttgtgtaaagaaacagctgtggacaaaaccaacactagtagatggatcagctatctccgttctcntccggctccaccacactagtacgtggctga

SEQ ID NO: 43163 - DNA, 101 bp, rice(Oryza sativa)
  misc_feature (71): n=a or c
gcggaggcctctgatgcttcaggagcaggaacttcaattgctactgatgacacaggagcgctttcctcaangactgcggtgacagattctgttgaagcaac

SEQ ID NO: 43164 - DNA, 101 bp, rice(Oryza sativa)
  misc_feature (71): n=a or g
atgaacttttctctttattttttctcgattacacggaagatgctgcccgcgaatgcttcccctaacacatnattaagaggtgaaaaccagcaacaaaagct

SEQ ID NO: 43165 - DNA, 101 bp, rice(Oryza sativa)
  misc_feature (71): n=a or g
gaaaggagggaagttatcgagaatccttcccgtcggcgtccgaagcccgaggaaaacagttttcctataantctgtcgtcaaattttttacttaaaatttg

SEQ ID NO: 43166 - DNA, 101 bp, rice(Oryza sativa)
  misc_feature (71): n=t or g
aatgaacgaactcacacatctgacatcattgtccaagctcaattacgttgcaaacagtctttgtgattgtntgagcatgcctttgggctcatggccatctc

SEQ ID NO: 43167 - DNA, 101 bp, rice(Oryza sativa)
  misc_feature (71): n=a or g
cacacatacacacatggccacaccaaccattttctccatggtccatagtgccatttttcttgattccttgnatgattggtcactgctagtcaatgcctgga

SEQ ID NO: 43168 - DNA, 101 bp, rice(Oryza sativa)
  misc_feature (71): n=t or c
ggaactagaaatctgaaaaaaaattggatgcaatactcattgctcaatatataaatagggaacaaagtctnctaatgccaactgatatagttctacaatgt

SEQ ID NO: 43169 - DNA, 101 bp, rice(Oryza sativa)
  misc_feature (71): n=a or g
actactaggctgaaagccaatttctttgaaagagaaggtgctttatcaggtttcccacctgtaatcccttnccatcctcttccagttggtgtttctgaagg

SEQ ID NO: 43170 - DNA, 101 bp, rice(Oryza sativa)
  misc_feature (71): n=a or c
taatatgacataatagtaaagcgaatagccaacatggtcttgaattgttgatttgattaaaaaaaaactanagctgctcaagtgtatcttaaattaaacgt

SEQ ID NO: 43171 - DNA, 101 bp, rice(Oryza sativa)
  misc_feature (71): n=t or c
tcaaaatcaaatgtctcctcttttccggaatccttgacccattgacatgtgaccactcttttattcctcgnccactcggctgttgctacctcaggatcctc

SEQ ID NO: 43172 - DNA, 101 bp, rice(Oryza sativa)
  misc_feature (71): n=t or c
ttgatcttgtgctcataaaaaaaaggcccaaacaagacttgtcttagttccagatgttagaacattcaacnaacgctttgaaaaaaccaaaccgacatggt

SEQ ID NO: 43173 - DNA, 101 bp, rice(Oryza sativa)
  misc_feature (71): n=t or g
tattgaagcaagcgatctacagatttttttgcctcgtcttctgggcaagacatttattgaatgctattttnctggtttgtttaataactaacttcattatt

SEQ ID NO: 43174 - DNA, 101 bp, rice(Oryza sativa)
  misc_feature (71): n=t or c
taaaaaacgaggacagaatcataaacctggaaattggaaaagtagaagatgcccctatgagaatttaagcnacccaaacaagtttcatctatgagaattta

SEQ ID NO: 43175 - DNA, 101 bp, rice(Oryza sativa)
  misc_feature (71): n=t or g
gtcgctctctgtctttggtgattttaacaagataccccctcttgtggaccttgaagttttacgagtactanacctcttgaattgctctagtttgaaggatg

SEQ ID NO: 43176 - DNA, 101 bp, rice(Oryza sativa)
  misc_feature (71): n=t or c
ctcgccatgatcacgcacgccgtctttgccatcttcatcgacgatcgacaaggaggacgcgccgggatctnatggtgggggttggtggccggcgccactac

SEQ ID NO: 43177 - DNA, 101 bp, rice(Oryza sativa)
  misc_feature (71): n=a or g
aaaatatattaaaagaccttattataaggttgcacccaaaaagtttgaaaaacatttatatactccttccntccaaaaataaaccaatctagattaattgc

SEQ ID NO: 43178 - DNA, 101 bp, rice(Oryza sativa)
  misc_feature (71): n=t or c
acatggttttttctatatttttttagtgtcacgttatccaaaccactctcaatactgccttggtgtctaangtgacccggttttataatactagagcggtt

SEQ ID NO: 43179 - DNA, 101 bp, rice(Oryza sativa)
  misc_feature (71): n=t or g
gatgctactcattgtgtcagcacaacgatctcgatgtcataattctttttggaggtcacctgaggctaggngccagccccttgctcaggccactgatctga

SEQ ID NO: 43180 - DNA, 101 bp, rice(Oryza sativa)
  misc_feature (71): n=t or g
actccaggcttaccaaatttcactgttaacacactctaataacatcagtcttaagggtcccaatttctttngaagaaatgcgccgggaaaccatcggaccc

SEQ ID NO: 43181 - DNA, 101 bp, rice(Oryza sativa)
  misc_feature (71): n=t or c
ctgaatgtctcacattgcagcaattgttctatcttgacatcacctagtaacaagtggcgtattgggcaccnctcttttatgacctcgaataatttaacaga

SEQ ID NO: 43182 - DNA, 101 bp, rice(Oryza sativa)
  misc_feature (71): n=a or g
gaatttctcaacagcttcgatgtcttcaaatttcatcccaactgcaggcgttatctcctcatcacaatcangagtaaatgaggaacactgaaaaaccaggt

SEQ ID NO: 43183 - DNA, 101 bp, rice(Oryza sativa)
  misc_feature (71): n=t or c
cattcatgcttaggctgttgatgcaaaagacgacactgcattgccaaattttgctgatcatgaggagaggntttcaaagttatcatgcctaactaagagtt

SEQ ID NO: 43184 - DNA, 101 bp, rice(Oryza sativa)
  misc_feature (71): n=a or g
ctctccgtctgtcaccaaattacatagttagcgattactctaattagcgtggacctccaaggaaacaaaancgctaaatagaaggcaccaaataaaaatta

SEQ ID NO: 43185 - DNA, 101 bp, rice(Oryza sativa)
  misc_feature (71): n=t or c
aagtacaccgaaggcccctcaacttgtcatcaaaatcgtcccctaatcttttctaaaatgacactggaccnacatttcatagacacaaatgggcccatttg

SEQ ID NO: 43186 - DNA, 101 bp, rice(Oryza sativa)
  misc_feature (71): n=a or g
atcttttctgcgcgcaaccacgcgtagtatatcaacaagtcaaagattgtgttttagtttctgaaattggnaaaaagtttaagaaaagttggtagtttgaa

SEQ ID NO: 43187 - DNA, 101 bp, rice(Oryza sativa)
  misc_feature (71): n=a or g
tgtgttcgtggaaatgcccataagaatgccatgagcctgcacttgcacatgcaatcggaaaatcgccggtnttagtttcaacgatttagctaggagaatga

SEQ ID NO: 43188 - DNA, 101 bp, rice(Oryza sativa)
  misc_feature (71): n=t or g
taacgcaatctgtaccctcttgcagacagattgggatctaaggttagcttgccttcttctctatgcatttnatgtagaagacaacttttggcagctatatg

SEQ ID NO: 43189 - DNA, 101 bp, rice(Oryza sativa)
  misc_feature (71): n=a or g
acagatgacccttatcggcctttgctagccatgccatgccatcccaggcgggtcttttttgtcctcactcntgtgcaccagggaagaacttctcggtcggt

SEQ ID NO: 43190 - DNA, 101 bp, rice(Oryza sativa)
  misc_feature (71): n=a or c
cgaacagatctagcaagctgccatggagcttgtgccttcgacatttagctgatcagatcgcctcatcaaancaccctctacctaatgtaacctgaagaagc

SEQ ID NO: 43191 - DNA, 101 bp, rice(Oryza sativa)
  misc_feature (71): n=t or c
ggctgatgttcaaccagtaattcagtacaatgaatgcaagcatacacacccatggagaattctttcgttcntgagagattcaagtatagtctgctccgcaa

SEQ ID NO: 43192 - DNA, 101 bp, rice(Oryza sativa)
  misc_feature (71): n=t or c
cgacaaaaaaaaaatggtacacttagattcaatggaccctgaccaatcataggttgctaaagagatccaangctgcaatgacttcagaatgatcatgcatg

SEQ ID NO: 43193 - DNA, 101 bp, rice(Oryza sativa)
  misc_feature (71): n=t or c
agccgttctcgaggtacttgtaaacaagtgccttggtggtggtgccttgatgtggtaatatagctgctccncggtgcggcggtccagtgtgcggtgcaggg

SEQ ID NO: 43194 - DNA, 101 bp, rice(Oryza sativa)
  misc_feature (71): n=t or c
gtgtgccagttttagaaccggtacctgcctttcggtattggtaccactaaattggtacaggctgagaaacnggtacctaggccgattcccaaccagtacca

SEQ ID NO: 43195 - DNA, 101 bp, rice(Oryza sativa)
  misc_feature (71): n=a or c
gccggtgcctttcacgtttttcggccagctgggattccacaacgaagtgatacaaggaagggatgtaatantatgtgcaatctgaacctgccgacgaggat

SEQ ID NO: 43196 - DNA, 101 bp, rice(Oryza sativa)
  misc_feature (71): n=a or g
atccaaatagcccctaattcatgacacaagaaaggtgctttctatgtcagacatggtgcttaagctgagcnaacattaactgtattcattgtgtttttctt

SEQ ID NO: 43197 - DNA, 101 bp, rice(Oryza sativa)
  misc_feature (71): n=a or g
ttgcgagctttacaattactttcaaactcagcttttacagcagcagcgttaatctcatcaagatttacatnaggatttccaatctttttccaaatatcata

SEQ ID NO: 43198 - DNA, 101 bp, rice(Oryza sativa)
  misc_feature (71): n=a or g
ggttgattttcatggtggtggtatttgtcccaccaaggcgagctggtgcgtggcaaatttagctgtggggnattcccggctgcaggcggcgttggattggg

SEQ ID NO: 43199 - DNA, 101 bp, rice(Oryza sativa)
  misc_feature (71): n=a or c
caaaacaattagtagcaggttccaagaagacacaagatattatattgagatcttcacctagagaagagtgnaatcaactcattgggatgagacgagaaggt

SEQ ID NO: 43200 - DNA, 101 bp, rice(Oryza sativa)
  misc_feature (71): n=t or c
ggacgatgacgatgatggggaacagcaagagggggctactgctgtggcagaagagcagataaaggatcaancgagggcaatggcggtgactgacggtgagg

SEQ ID NO: 43201 - DNA, 101 bp, rice(Oryza sativa)
  misc_feature (71): n=t or c
aatgattaaaatggtagataaaatacatacttcagcacccacttccattgcagcttcggtgatttcaactnttacaggctgctggttcccagaaagtgtta

SEQ ID NO: 43202 - DNA, 101 bp, rice(Oryza sativa)
  misc_feature (71): n=a or g
agtcccaagacggtttgagcggcggtttcagctaacatggcattgatgtggtacttagtcagaaaataccntagaccccatgtgtcaatgagtgtccggtt

SEQ ID NO: 43203 - DNA, 101 bp, rice(Oryza sativa)
  misc_feature (71): n=a or g
tctcatctaacagcatcttctcaatgcacaaagtagcctatcaggtttggtaacatagtatacatattttngaggcccagtgcggtcgcactgcccgcact

SEQ ID NO: 43204 - DNA, 101 bp, rice(Oryza sativa)
  misc_feature (71): n=t or c
agttaatgatgtatagcacaatgttcttgaagggagtagaaaaggaggggtgggaagccaaagggaactcntgagaagaaaagagaaacccaattcataag

SEQ ID NO: 43205 - DNA, 101 bp, rice(Oryza sativa)
  misc_feature (71): n=t or c
tcacttggttccttacagaaaaacaacgaattctggtgtccggtgttcttgttgttctgtcagttggtganagacagaagccataatcccagtcataataa

SEQ ID NO: 43206 - DNA, 101 bp, rice(Oryza sativa)
  misc_feature (71): n=t or c
aatgagtgagagactgacaagtgggtccactgtcatagacttataatgaagaagagtacagatagagaggntgttggaatgaataacgagtttggcttgct

SEQ ID NO: 43207 - DNA, 101 bp, rice(Oryza sativa)
  misc_feature (71): n=t or c
ctgaatctctgattcatctgatgttcattcattcattcgtctgctgctgcactgcactctgatgcagtaantgctgcttattctgatcctgcaatgcttct

SEQ ID NO: 43208 - DNA, 101 bp, rice(Oryza sativa)
  misc_feature (71): n=t or c
gcgttgcaacttcaacgatgggaagaagaagaagatcatcaagctagtttttctagatcatttccacggcnctatccacagtttcgtcaccactctctctc

SEQ ID NO: 43209 - DNA, 101 bp, rice(Oryza sativa)
  misc_feature (71): n=a or g
acgggtgaaaagtttttacgtgtgatctaaacatgggctgacgacatctgagtagttgagtctgtcgatcnacaagcatatgctagaggtgtgtttagttg

SEQ ID NO: 43210 - DNA, 101 bp, rice(Oryza sativa)
  misc_feature (71): n=t or c
tcagagctacaggcagtgacagttaactcctccagagcagtcaaatgttgcaaaccttttgggatcgagancaactttgggcagcaacttatttgaagaga

SEQ ID NO: 43211 - DNA, 101 bp, rice(Oryza sativa)
  misc_feature (71): n=t or c
cggcgagaagatctaggtggtgtggccggcgagcttctatcattaatgcttcatcatcacctcatctcccngcctcgcaccccatggcagtggccgagaag

SEQ ID NO: 43212 - DNA, 101 bp, rice(Oryza sativa)
  misc_feature (71): n=t or c
agtgaacaagaatggatcagtacagctcggctcggctcagttttttatgggtgtcatttttttaaagaaancgacacctatatattataaatgtcgtcttt

SEQ ID NO: 43213 - DNA, 101 bp, rice(Oryza sativa)
  misc_feature (71): n=a or c
cggatgcgagcttcacgcgcactgccgctacgtgactaattgagcaacgtatatcttcatgtgacgttcangtgcatccctgacacctccgtctgacacta

SEQ ID NO: 43214 - DNA, 101 bp, rice(Oryza sativa)
  misc_feature (71): n=a or c
ctgagatgcttctccacggacatagagatcatgtttttgcagggagcaatgccaatgctcacgaatatttnatttgagccatctggtgatgattcagccaa

SEQ ID NO: 43215 - DNA, 101 bp, rice(Oryza sativa)
  misc_feature (71): n=a or g
ttttattattattgagtagatagggtgcaactaatttttggtgtctaatttttcttgagcagagtaagggnctctaggaaaagcatcacggaagagtgatg

SEQ ID NO: 43216 - DNA, 101 bp, rice(Oryza sativa)
  misc_feature (71): n=a or c
ggtggacgccggcgtcgtcgacccggccgatggcttctactacagaagcgtctacccctccatgactcgtncagggatctccgccacgtcagcaaaaccta

SEQ ID NO: 43217 - DNA, 101 bp, rice(Oryza sativa)
  misc_feature (71): n=t or c
acctgataatgctttggtttgatccctggaagttgtctgtatacgaatgatactgtctgtcaaagtgtctntttgggtggtttagtttcttaagttttaga

SEQ ID NO: 43218 - DNA, 101 bp, rice(Oryza sativa)
  misc_feature (71): n=a or g
atggaaatgctgtgtgttgctgcatgaggtgcttccatttactgtgaggataccaagtggatgtgattaantaagtttaagaaatacccctgttttatgtt

SEQ ID NO: 43219 - DNA, 101 bp, rice(Oryza sativa)
  misc_feature (71): n=t or c
ccgaccaagatctctcacctcgttgagcttctgctcctcgatctgggcgcggagctcctcctcctgcttcncgatctcggccgccgtcatggttgggaggg

SEQ ID NO: 43220 - DNA, 101 bp, rice(Oryza sativa)
  misc_feature (71): n=a or c
atcactatataaaacaaacacaatttcaatggctaggatttatccttagctctttaccacccaataggtangaaggaacaacttaaaagggttctttttgt

SEQ ID NO: 43221 - DNA, 101 bp, rice(Oryza sativa)
  misc_feature (71): n=t or c
gaagctgcatcagaaaactcatcttagaggtttgcatctctcctggaatgatgtgtatggcatggatgttncacatttggagattctagaaggcctgaggc

SEQ ID NO: 43222 - DNA, 101 bp, rice(Oryza sativa)
  misc_feature (71): n=a or g
cccctctcttgctcatcgatcgattgaaatcgtctcgatcagccaaaacgtgtagttagttactccctccntttcgaaatgtttgacgccgttgacttttt

SEQ ID NO: 43223 - DNA, 101 bp, rice(Oryza sativa)
  misc_feature (71): n=t or c
tgccgagcaagagttcgatgatcctgcaccagtaggagaatgccccaaagtgagcctcgagaaagcccacngcgagatctcgcacagcgccgctagccacg

SEQ ID NO: 43224 - DNA, 101 bp, rice(Oryza sativa)
  misc_feature (71): n=t or g
ataggggattacaaatatagagatatgcatgtgttaatttcaccacacagtactactcgatcacctctgtngtccggtgcctctcatgattcatccatgtc

SEQ ID NO: 43225 - DNA, 101 bp, rice(Oryza sativa)
  misc_feature (71): n=a or g
tctttccgtatataaggggattgtgcactgacttatttagcggcgtctatcaccgacatgtgggtcctatntagtgggccctacggttagtactccgcccc

SEQ ID NO: 43226 - DNA, 101 bp, rice(Oryza sativa)
  misc_feature (71): n=a or g
cgaggagcgacgccacatacgagttttgctatagtcctatagtgtccggatggtcattttgcgaaaaaaanctctaacaacctaaaaatttaattagtagt

SEQ ID NO: 43227 - DNA, 101 bp, rice(Oryza sativa)
  misc_feature (71): n=t or c
ttgcaaagcttcagagacgaaatacggcttcagagacgaaatacagcttgcaaggggtgaagataagatanattgaaatggaaaagcttgcttacgctcta

SEQ ID NO: 43228 - DNA, 101 bp, rice(Oryza sativa)
  misc_feature (71): n=a or g
atgtatatgtaatcgttgcattgtgctgtctggcaaaagtgaagtgatgcaatccaagtcagacatgcacnaagacctcttttatcttaattaatttgctc

SEQ ID NO: 43229 - DNA, 101 bp, rice(Oryza sativa)
  misc_feature (71): n=a or g
aaagaaaaaagaaaaagtgagaactcgaataacacttcttccctttcatattattatacaactattataanagagagagagagagagagagagagagagag

SEQ ID NO: 43230 - DNA, 101 bp, rice(Oryza sativa)
  misc_feature (71): n=t or c
acctccaccgcaccccatattatcccgaccctgcatctatttttatttcacaatcacatcctttgtaaccnattatcttgatatctcatacatattataca

SEQ ID NO: 43231 - DNA, 101 bp, rice(Oryza sativa)
  misc_feature (71): n=t or c
cccttcttgatgaaaccagtcagaaccttctttgcctttgaccattgcttttctgactctgaatttctcangaacggacacacttcaccaatagtgatctt

SEQ ID NO: 43232 - DNA, 101 bp, rice(Oryza sativa)
  misc_feature (71): n=a or c
atagaaaggagagaagggtgttagagcaacagctgagttttatgattatggaagaaaagctgaaatggtancaaagaagcaaagttaaagaaatattagag

SEQ ID NO: 43233 - DNA, 101 bp, rice(Oryza sativa)
  misc_feature (71): n=a or g
gggagaattgcaaacctgtttggaagactctagcccctccgaagtgtcgttatttcatttggctggtcgcnatgaagagatgttggacgacagaccgtctg

SEQ ID NO: 43234 - DNA, 101 bp, rice(Oryza sativa)
  misc_feature (71): n=t or c
tttaattaatgttgataacaatttacaactggttcttcattgttgtggcccagaatgccctgctactgtcnaagtacacatgatccactctacctgaaaga

SEQ ID NO: 43235 - DNA, 101 bp, rice(Oryza sativa)
  misc_feature (71): n=a or g
tcaacttgggattagaaatttaggattgattatccgttgcaagccgttctccgcgtgctcggaatgggacnccctgagccttttggatttggagccaattt

SEQ ID NO: 43236 - DNA, 101 bp, rice(Oryza sativa)
  misc_feature (71): n=t or g
ttcagtaactataatgatagttgtcaaagtttggccatgaagtttcctgcctttcttttggcatattcgtnaactatgccagctgtgctctgtctgtggcg

SEQ ID NO: 43237 - DNA, 101 bp, rice(Oryza sativa)
  misc_feature (71): n=a or g
tgtaaaataatcactcgcattcttgcatttacccatttgcctactcagggacagttgttgaaggatccacngtacacagaactgagtatgtagaagtagaa

SEQ ID NO: 43238 - DNA, 101 bp, rice(Oryza sativa)
  misc_feature (71): n=t or c
atcaagtttcaaaatctacaccctttacttcaataaatgtcatttacttttcatcaatcaattgttaaaancactagtgcaaattatgtagttactacaac

SEQ ID NO: 43239 - DNA, 101 bp, rice(Oryza sativa)
  misc_feature (71): n=a or g
catttcacgctcatggatgcgaacaattcagccatctttctctctgatgtgtcaactagagtgcaagctgngagaaaagcagctaaggcaaggggaaggga

SEQ ID NO: 43240 - DNA, 101 bp, rice(Oryza sativa)
  misc_feature (71): n=t or c
tagtgaatcttgtaggctgagaaggctgcttttgacgaggcagagaaaaagaaggaagaggaggtaaattncttcaccttacaatgttctaatatgaggat

SEQ ID NO: 43241 - DNA, 101 bp, rice(Oryza sativa)
  misc_feature (71): n=a or c
ataaatttaccccataaatatgtttgttgaatggtaaataaataaatagatccactactggagaaaccatntttggtcggtcgcccaaaaaccacaatagt

SEQ ID NO: 43242 - DNA, 101 bp, rice(Oryza sativa)
  misc_feature (71): n=a or c
ggtactacttctactaccagtacacacttgtaccatcgtgcttgcagccatggccatggccgccggagtcnacggaggaggtagtggtagctcgtagtact

SEQ ID NO: 43243 - DNA, 101 bp, rice(Oryza sativa)
  misc_feature (71): n=t or c
tacggagctttgccactataggtactcacatatgtagatgtagaggagtagtcaaatggaatttcggttcngtttttggaaacctccttttggtcccccct

SEQ ID NO: 43244 - DNA, 101 bp, rice(Oryza sativa)
  misc_feature (71): n=a or g
aatacatgagctgggagtcagaaacggtagtagcttgcatgtgtggggtgtgcaattctgaaggccattanttttaacctagcttgttgtgtcagtttggt

SEQ ID NO: 43245 - DNA, 101 bp, rice(Oryza sativa)
  misc_feature (71): n=t or c
tgtggatatccaagccaagtgtacctttagtctctatgtttagcattgttcctaatgtaacgctgaatcangagtcagatgctttacgttttatgtccatg

SEQ ID NO: 43246 - DNA, 101 bp, rice(Oryza sativa)
  misc_feature (71): n=t or c
cttataaattggttccacccttgctaaataacaagttggtactaaacacaagtacacagctctcatggatnacacaagctaaattctaattgagtcaggat

SEQ ID NO: 43247 - DNA, 101 bp, rice(Oryza sativa)
  misc_feature (71): n=a or g
caaagcaggatactccagagtcgtcatggcgaacttcaagttgacacttctcatgccacagccgctagtcntgctgggcagcctagtaccggtagtgcgcg

SEQ ID NO: 43248 - DNA, 101 bp, rice(Oryza sativa)
  misc_feature (71): n=a or g
atctaaaccaaaactcattttcttatattgcagaatatcccatgtgaatttgtccgtgagtgtcttccccntaccaacaaaaggatcacactctgggatcc

SEQ ID NO: 43249 - DNA, 101 bp, rice(Oryza sativa)
  misc_feature (71): n=t or c
tgtgagttacctgtgactattccacgcccatcataggtattttcactgtaacaggccatatctcaacagcngtcacaagaaacttacctatgatgggttgt

SEQ ID NO: 43250 - DNA, 101 bp, rice(Oryza sativa)
  misc_feature (71): n=a or c
acctttaaaatgcgcttagaaggcgattactgggccgaatatatctttgatgtaacaatagattcaattcnatagtcgaaaaattagaccatgatcagtgg

SEQ ID NO: 43251 - DNA, 101 bp, rice(Oryza sativa)
  misc_feature (71): n=t or c
gttcgatttggactcaccttatggccatactagactagatgagcctgacctaactaatatggctcactatnaatccacttcgaacaaatggaccgaattag

SEQ ID NO: 43252 - DNA, 101 bp, rice(Oryza sativa)
  misc_feature (71): n=a or g
tttctttggagtatgccaagagtggcaagcttttccacaaaatggctagggcaaagctcaatgaggagtcngcgagaaagtattttcaacagttgatctct

SEQ ID NO: 43253 - DNA, 101 bp, rice(Oryza sativa)
  misc_feature (71): n=a or c
tatatgtttttaggacaattttatggattctgtggctctagaacaactcagtttccctcaactaacatganggtagatgtggctaattctcaagtcaaccc

SEQ ID NO: 43254 - DNA, 101 bp, rice(Oryza sativa)
  misc_feature (71): n=a or g
cgccaacggagagccccctcaggtgcgccgacaaatcaaagcagtcagcaaataatatcgatcccctttcnctcacaaacctaaagaatgagacaggggca

SEQ ID NO: 43255 - DNA, 101 bp, rice(Oryza sativa)
  misc_feature (71): n=a or g
gaagttcggcacggggcatcaatcgacacccacagcccaacctcatgtacaagctgtggcttcaccgttcncgcccccatacccatagttgaattggccct

SEQ ID NO: 43256 - DNA, 101 bp, rice(Oryza sativa)
  misc_feature (71): n=t or c
cagatctgaccaaaagagttataaccttgtccagctcattgcatctgcactggatgtctacaatattctgngcaataaaaatgtaccaccgctctccttct

SEQ ID NO: 43257 - DNA, 101 bp, rice(Oryza sativa)
  misc_feature (71): n=t or c
tcttatgaaatgatgtttaggtatccaatccattagattttgtactatcttattcttttgtttcaaatganttgataataaaatttctaagtaataaaatc

SEQ ID NO: 43258 - DNA, 101 bp, rice(Oryza sativa)
  misc_feature (71): n=t or c
tgtgccaggaaggtataactgtggaagtgcgtgtcattgtccccgggcggtgggcagccatcttgcaccangtgcgacgccgagccagaggaggcgttcgt

SEQ ID NO: 43259 - DNA, 101 bp, rice(Oryza sativa)
  misc_feature (71): n=t or c
ttggaatcattatactgtggttagcaggtgaaatttgttaaagaactcagatgaaatactccttccgtccnaaaatatgagaacttttagcctacaaaatt

SEQ ID NO: 43260 - DNA, 101 bp, rice(Oryza sativa)
  misc_feature (71): n=a or g
cctacatcatttccatcagactactctttcctaaagaaaacagcattcaaacaaatgcatttgcagtaagnattttgttcatcaagatttatctcataaac

SEQ ID NO: 43261 - DNA, 101 bp, rice(Oryza sativa)
  misc_feature (71): n=t or c
agtaacatcattggcccttttgttttagaaaaatcataatgcaattggtaagatctgagacgtactgctcnctcctgatcaatcctgctactactatatat

SEQ ID NO: 43262 - DNA, 101 bp, rice(Oryza sativa)
  misc_feature (71): n=t or g
tgtagagcagaggctgtgattttgctgttcctgcagagttgctggtgaaaatgactgaggctttttttttnattgtgtgagcctgcagaattcaggctggt

SEQ ID NO: 43263 - DNA, 101 bp, rice(Oryza sativa)
  misc_feature (71): n=a or g
agcctccaactgcacatcggggttcccattcaccacggtaaaaagaccctaaaccttggatgaggatttcnttttcagatatgtgcatatatgtttttgtt

SEQ ID NO: 43264 - DNA, 101 bp, rice(Oryza sativa)
  misc_feature (71): n=t or c
tgttacaggtggcacagcgccgcgacccagcatggcgttgcagtgcagtggtgcagggatagacaaagggngaagacgcaatgcggccaggcgacggcgtg

SEQ ID NO: 43265 - DNA, 101 bp, rice(Oryza sativa)
  misc_feature (71): n=a or g
ctgagatccacgccatgatgtgccatgacgcccctgtgctaagccagagttaaaagagcctgttcactttnatactattttcaaccttacaaaattttgta

SEQ ID NO: 43266 - DNA, 101 bp, rice(Oryza sativa)
  misc_feature (71): n=t or c
gctgtctgagcataatccttctgagtcatactcagatctgtccccaagagcatgtcgagcattcctacatnaaaaggtagaattttagatcgctggacgac

SEQ ID NO: 43267 - DNA, 101 bp, rice(Oryza sativa)
  misc_feature (71): n=a or g
acctgaacctcacctctaatggcctcactggcacgataccagaggctctgtcttcatgctctaaccttcanatcattgatatctcaaataactcgattgat

SEQ ID NO: 43268 - DNA, 101 bp, rice(Oryza sativa)
  misc_feature (71): n=t or g
tctctttggaatttgtgggggaaagagtgagggagggagggagctcagtgggagagatggaggggaatttnccgccgagaggagcccttgtccatggccat

SEQ ID NO: 43269 - DNA, 101 bp, rice(Oryza sativa)
  misc_feature (71): n=t or g
gatgctttagatgccagtttatcttgtttttttttcagcactgatcaggaccgcagccgaatactctaagngtccctttgaatcacaggattgaaaaaaat

SEQ ID NO: 43270 - DNA, 101 bp, rice(Oryza sativa)
  misc_feature (71): n=a or c
aattgcgttgagacctgctaatcgtatcactgcagctctccctcctgttaaagatgaaccagaaccgattncaaggcaggtggtgaacaacgaactgattc

SEQ ID NO: 43271 - DNA, 101 bp, rice(Oryza sativa)
  misc_feature (71): n=t or c
catcagtggaccatcacagttgcaatccaaccaagctagcctagccaggccaaacttgaggaccatgaatngatcgatcgattgtcccaagcccatgcata

SEQ ID NO: 43272 - DNA, 101 bp, rice(Oryza sativa)
  misc_feature (71): n=t or c
tttaccataaagtacgagtcagtctgctgcaagaagtcgatcatggggctcatcaccgactgcgcgatgtnatcccggaaagcgcctgcggacggcgggaa

SEQ ID NO: 43273 - DNA, 101 bp, rice(Oryza sativa)
  misc_feature (71): n=a or g
acctccttttgtaaaggcaactgaccacttctacgctggaaatcaaaatagcgcctgtgcttttcttcaanaggagcctgagaacatataatgtatataaa

SEQ ID NO: 43274 - DNA, 101 bp, rice(Oryza sativa)
  misc_feature (71): n=a or c
atgagcgtagtctgaacatgcacactactacaactgaatccaagcttatgaacaatgccatgtatctgaantccgagttgccagtcccccgttttgccaga

SEQ ID NO: 43275 - DNA, 101 bp, rice(Oryza sativa)
  misc_feature (71): n=a or g
cccaccaaggctcatcatcccgatgttggctttggattcacctaattggcttggttgataagtctggctcntagagcttttcagatcttccttatcttcag

SEQ ID NO: 43276 - DNA, 101 bp, rice(Oryza sativa)
  misc_feature (71): n=a or g
aatcgaataaagtgtagccttggtacaacgtcggaatatgagtattttagggtactgatatactccctccnttattacatataagtattttaaggtgttta

SEQ ID NO: 43277 - DNA, 101 bp, rice(Oryza sativa)
  misc_feature (71): n=t or c
gatcctcccatagtgaggaagaggtcgatctcccctgcaactaaaggtgctttgtttggcaagacttttanatgagtactggtttcaaggaacatggtcct

SEQ ID NO: 43278 - DNA, 101 bp, rice(Oryza sativa)
  misc_feature (71): n=t or c
tttttctcttctcttctcttctttagcgagcgcggcaattggcagcaaaaggggtagacgccgggtggggnggcgggcgaagcaggcaggcgatataagct

SEQ ID NO: 43279 - DNA, 101 bp, rice(Oryza sativa)
  misc_feature (71): n=t or g
ttgaaggaaggaggtgacttggcaagttgcatcaacacctaccagtcagaaagaaaccaaaagaagggganacagtgtagtgatggtccttctgtaagaag

SEQ ID NO: 43280 - DNA, 101 bp, rice(Oryza sativa)
  misc_feature (71): n=t or c
ttttctattacattaataagttaagggagtagctatattttatggcgtcaatttttcaccaaaaaatcggnagcatgtatttacattaaaagtccctaaac

SEQ ID NO: 43281 - DNA, 101 bp, rice(Oryza sativa)
  misc_feature (71): n=a or g
ttctcgctgatcttctcagcagatccatatccttcgtgatcgacagatactgccagcagcagcagggtgtngaggagaatctacagcagttacaacgcatg

SEQ ID NO: 43282 - DNA, 101 bp, rice(Oryza sativa)
  misc_feature (71): n=a or g
gagctgagtgcttaatgtctgaggctaacgaagataaaacatctggggattttaaagaaatgggtggtagncttgctggggaagttgttgcattcctgaaa

SEQ ID NO: 43283 - DNA, 101 bp, rice(Oryza sativa)
  misc_feature (71): n=a or g
actggttgttgaaacacttgaccgactgaagttttcacttttttggggtgttccacaaatgttttcgctcncttgttcatctttgatcatgctaaatatct

SEQ ID NO: 43284 - DNA, 101 bp, rice(Oryza sativa)
  misc_feature (71): n=a or g
gacggcggccccacctaccagcggcggcagcagcattaacctcctacgaggctactacgactatatatgangcagtctcacccacccgacccaaccgaacc

SEQ ID NO: 43285 - DNA, 101 bp, rice(Oryza sativa)
  misc_feature (71): n=a or g
tctgcaaatgctggtagtgaccagtagatttcatatggcgcccgaggtccattgtttgccaaaagcaatanttgttgagcgatatgaatgatattttcctc

SEQ ID NO: 43286 - DNA, 101 bp, rice(Oryza sativa)
  misc_feature (71): n=a or g
agacgcgcacagtgttttgggtctgatgctacagtaacaagcaggattataccagtattgcactgtagatncagtacaaacagtactgtagcgatacactg

SEQ ID NO: 43287 - DNA, 101 bp, rice(Oryza sativa)
  misc_feature (71): n=a or g
caagttttcaaaaaaggtccacgtaaaaaatctaggtaggccgggcgttcgccaacgatccatttggcagncagcggcccatgcggaatcaagtcttggac

SEQ ID NO: 43288 - DNA, 101 bp, rice(Oryza sativa)
  misc_feature (71): n=a or g
cgaatacacaagaacgagggagcatcatgtgttccttgatgagggggttcggtttttgtggttacaggagnaagaggatatccaagccatcatgttggtgt

SEQ ID NO: 43289 - DNA, 101 bp, rice(Oryza sativa)
  misc_feature (71): n=a or g
tcaggaatcagcatatatactctcaatcagtatactgccttgtcctatacatatatagattcgttcctacngaaatttcggttcctaacagttgacggtac

SEQ ID NO: 43290 - DNA, 101 bp, rice(Oryza sativa)
  misc_feature (71): n=t or c
aaagaagaattggaagcagaaatgaacacaagcatgatacactggcatggctgcacctgcaaaaaattacngaagaaacaaaacttacctgctatcacaga

SEQ ID NO: 43291 - DNA, 101 bp, rice(Oryza sativa)
  misc_feature (71): n=t or g
tctgggattagttttcatgtctcgtgacatgcacaatgtataacttctgtgatttgtgtggactgcaaaantgggaaaaactgagaattaataaaaacaga

SEQ ID NO: 43292 - DNA, 101 bp, rice(Oryza sativa)
  misc_feature (71): n=a or g
cagcaattttgaaacttgcaggtgaaatctattccattgattcgctcttaccggccctacttcgtacactngaagaacagaaatctcccaagtcaaaattg

SEQ ID NO: 43293 - DNA, 101 bp, rice(Oryza sativa)
  misc_feature (71): n=t or g
tctaggcggctggttgtcgtccatctgcgttgttgttgtcaagagggatcgatctcggtctcctcggtcgncaaagttctttgtcgcatcaagcaacttca

SEQ ID NO: 43294 - DNA, 101 bp, rice(Oryza sativa)
  misc_feature (71): n=t or c
tgttaaaagaacaacataaaaagggttggaactcaagttgatctgttgcagctcacaatgtgactgatganggctctagtttatctaataaactttggatc

SEQ ID NO: 43295 - DNA, 101 bp, rice(Oryza sativa)
  misc_feature (71): n=t or c
aaaaaaacacagagataaacgtactgcggttatgtgcctaacaatattcgaggtcctactgacattctatnttcaactaacaagttattcaaaggcctatg

SEQ ID NO: 43296 - DNA, 101 bp, rice(Oryza sativa)
  misc_feature (71): n=a or g
caatatcccctgcaggagtaacaacacaatcaagctacaagaaaccagttctaaattttctattaggacanctaacaaccaaaataaaataaaataaaact

SEQ ID NO: 43297 - DNA, 101 bp, rice(Oryza sativa)
  misc_feature (71): n=t or c
ctctttcctgtgatcatctcaaggagcattatcccgtagctgtagacatcaccacttgtcgatgttttggntccatatccgtattctggacgaaacaatag

SEQ ID NO: 43298 - DNA, 101 bp, rice(Oryza sativa)
  misc_feature (71): n=t or c
tgtcggtttggaaatatatcattactatttatgtatttgtaccgatgccattgatgctggtttgtaatctnagtgatgccactaagatacgtatttttgca

SEQ ID NO: 43299 - DNA, 101 bp, rice(Oryza sativa)
  misc_feature (71): n=a or g
tagcttccaaccccatagctccaatggtgctgttgccatctcatagtccgtcctcgaatagctgtctactntaggtctgaccatcgtccatggataaagaa

SEQ ID NO: 43300 - DNA, 101 bp, rice(Oryza sativa)
  misc_feature (71): n=a or c
gctaggaggagagagaagctccactaggatatgcatgtgcatgcatgcagcagcaaagtacgacgcgagtntagggagaggtctcagctttgcacccaagc

SEQ ID NO: 43301 - DNA, 101 bp, rice(Oryza sativa)
  misc_feature (71): n=a or g
agttgatttcactattactcaatcagcaatggcatatactaatcaagtgcgcacaacactcataggccacntagatcaagatctcacgcccaccgaccaat

SEQ ID NO: 43302 - DNA, 101 bp, rice(Oryza sativa)
  misc_feature (71): n=t or c
cctttaccagtacatgttttaaatgccagatgctgcgaaggttcaagctggtaactggtatatgtaacttncatccttaacaaggtactgtatttttttat

SEQ ID NO: 43303 - DNA, 101 bp, rice(Oryza sativa)
  misc_feature (71): n=t or c
attagaatattttaattaactttagaaatatcaaagccttcgagttatataggatgaatttaggatgatanaaagtaaagccaatttcattttgggaaatg

SEQ ID NO: 43304 - DNA, 101 bp, rice(Oryza sativa)
  misc_feature (71): n=t or g
caaaaccatgaaaaagaacttgaattggatcttctttcccgtactcctgaccatattctgcaattgctatnaaaccaccagcttccttatcatgcatgtac

SEQ ID NO: 43305 - DNA, 101 bp, rice(Oryza sativa)
  misc_feature (71): n=t or g
gacgcgatgcgcgacgtcgtacgacgacgtaatgcgtgcagcgtgcgtacgtacgtaccgaagatgacggngacctccttgtgcggggcggggaaggggta

SEQ ID NO: 43306 - DNA, 101 bp, rice(Oryza sativa)
  misc_feature (71): n=t or c
gaaggaatacgctctgaagacatgaatcagataggtgttcagtccaactctgcactaagttctgaacagcncacccagcctcttccagtggcaccattagt

SEQ ID NO: 43307 - DNA, 101 bp, rice(Oryza sativa)
  misc_feature (71): n=t or c
tgactggggcattggatcctctgcatctgtgtgaaatgtccctaagtttccgtgtctaaagtttaactgtncgtcttatatgaatttttttataattagta

SEQ ID NO: 43308 - DNA, 101 bp, rice(Oryza sativa)
  misc_feature (71): n=t or c
tttcatttttgaccaaaaaaatcccctctttggtgtcttggaggcagctgatctccttctgctgtttcgtnttactgagagagacaacgatggaggcagct

SEQ ID NO: 43309 - DNA, 101 bp, rice(Oryza sativa)
  misc_feature (71): n=t or g
ggtatttaagggagaaaatttctcgtcttatgtgccgaggttagatagaatattagaagttggtttttttnaataaaattcaaatttcagaagttgagtta

SEQ ID NO: 43310 - DNA, 101 bp, rice(Oryza sativa)
  misc_feature (71): n=t or c
tgtcagcttatctagggtgattgggatgatgttatcagggtcaacctcagatggttggccggttgtttgcntaatgtccaccatggtgaaaaattgtcaca

SEQ ID NO: 43311 - DNA, 101 bp, rice(Oryza sativa)
  misc_feature (71): n=t or c
ttggccaaaagctgaaatatcaaatatgtgccaggaaatagtagttaagcttctgactgttacctgggatnagttgatcacaaaatgggctagggagaact

SEQ ID NO: 43312 - DNA, 101 bp, rice(Oryza sativa)
  misc_feature (71): n=t or c
tttcataatgatttcaatttcagggatttgtccaataacagcttatctggcccaatacctgattttctagngcaaatgccagcactcaagttcctgtaagt

SEQ ID NO: 43313 - DNA, 101 bp, rice(Oryza sativa)
  misc_feature (71): n=t or g
aaaactggagcagaagcccacagaatgtcactcaaaactgcccagaatacaggagatgaagtcaccaaaancaggttttatcatagtctcatctgatgaga

SEQ ID NO: 43314 - DNA, 101 bp, rice(Oryza sativa)
  misc_feature (71): n=a or c
tatcatgttgtaaagttagatattgtctctatatttccacgtcattatcactaagaattatactgtagacnactcatgtacagcaataaacataattagca

SEQ ID NO: 43315 - DNA, 101 bp, rice(Oryza sativa)
  misc_feature (71): n=t or c
gtaagctgctacttctttatttctaattgtgcaagcttgcttgtaaactcacttcgccacttaaaccagtngctgagtgcaagggatgacatgattggcat

SEQ ID NO: 43316 - DNA, 101 bp, rice(Oryza sativa)
  misc_feature (71): n=a or g
cactaaggaggatgttgctaggcttcaaatcacaatgaatcactgtcgggcaactgttgttgtgaagatgntctattgcatcggcaacatcaacagcgatg

SEQ ID NO: 43317 - DNA, 101 bp, rice(Oryza sativa)
  misc_feature (71): n=a or g
aaagcgatcgagagatctatcacaagctgctagccatactgacaagtcacaagagaacagggctcgcacantggcgggcgtactagctaatggagtgttca

SEQ ID NO: 43318 - DNA, 101 bp, rice(Oryza sativa)
  misc_feature (71): n=t or c
tgtcattccaacagagtactaaacgcgactagtgctcagtcctcatcatcagaataccgatacctaacgtncagagaggcgttcagcaacggcatgtcgat

SEQ ID NO: 43319 - DNA, 101 bp, rice(Oryza sativa)
  misc_feature (71): n=t or c
gtcgagtaagcttcaagacaatggctggaagccgagatggttccagaaggatggcgaagacgggacatatngcttcaaaggcggttactgggaagcaaggg

SEQ ID NO: 43320 - DNA, 101 bp, rice(Oryza sativa)
  misc_feature (71): n=t or g
gatcgatttgtagactcagataattatatgtcattttgggccctgccaatcagccgttgcctcatcaacanatcactagactgatgaagagtgccgcgtca

SEQ ID NO: 43321 - DNA, 101 bp, rice(Oryza sativa)
  misc_feature (71): n=t or c
tgaggccttgcccgcccataggaagccacggcggatcttatcgattccttttattacccacttcggtgcantgatcgccattatcaaatacaataagaaaa

SEQ ID NO: 43322 - DNA, 101 bp, rice(Oryza sativa)
  misc_feature (71): n=a or c
cagtaccagtatcagtatgcggttgacatctcaaatcaagatgtccagacgagtttggtttatcagatatntcagcagctaatttgttgacttcattgtta

SEQ ID NO: 43323 - DNA, 101 bp, rice(Oryza sativa)
  misc_feature (71): n=a or g
ctttcaggttaatttgttcaacgacacatgcagtatacgcacgtcatttcgatggaatatgtggggttgantttgttttgaaatttccgcatagatgttga

SEQ ID NO: 43324 - DNA, 101 bp, rice(Oryza sativa)
  misc_feature (71): n=t or g
ttgcagatagcggaagccaattggataacgctacaaaactgcttccctggcatcagcaaatagaagagagnggacataagttagttttctatatgtgatgc

SEQ ID NO: 43325 - DNA, 101 bp, rice(Oryza sativa)
  misc_feature (71): n=a or g
gcttcgccacctgcagatccttcttctccagctccttggagctagctatgtcctctacaaacatatcatcntcggcgacgtgactacgagaggacacgagc

SEQ ID NO: 43326 - DNA, 101 bp, rice(Oryza sativa)
  misc_feature (71): n=a or g
atgctgggttatgcagcagggccaagattggaagtgtattggttgttgcttggaaagagattggctgatgncttgagaattgtggacaatgaagtggagat

SEQ ID NO: 43327 - DNA, 101 bp, rice(Oryza sativa)
  misc_feature (71): n=a or c
ggcgcctctgcttcttgctctgctttcttgcttgcagtgcatcaatctgagcttgattactcgatcattcngtatgctgctgcggctggttgattactcga

SEQ ID NO: 43328 - DNA, 101 bp, rice(Oryza sativa)
  misc_feature (71): n=a or g
agataactcactgaagttttcctgtctcaaacacatacaattgtttgcgcacatattatctcatggttccnacaaaattctgtacttagcttatgtcatga

SEQ ID NO: 43329 - DNA, 101 bp, rice(Oryza sativa)
  misc_feature (71): n=t or c
ctctctctctgctactgctctgctctgctcctaggggttttgggttaggatcggagaaagattattattantattattatcatcatcaagggtattagtag

SEQ ID NO: 43330 - DNA, 101 bp, rice(Oryza sativa)
  misc_feature (71): n=a or g
gatctggaggcggaggggccaatggcattaggacctcaagaggcggcctccaccccgagcttatttcagcntcgacatcgccttcgatcccgagctccgcc

SEQ ID NO: 43331 - DNA, 101 bp, rice(Oryza sativa)
  misc_feature (71): n=a or g
agagaagaaaggaaggatatggaggcttaacaattggggactgcgtagacttgcttacaaaataaagaaancaagacatgccaactacatcttaatgaact

SEQ ID NO: 43332 - DNA, 101 bp, rice(Oryza sativa)
  misc_feature (71): n=t or c
gatgaagatccccttcttcttcatcttctcgacaccatcgtcgtcttcttgggacctcggcttcttccgcngccggctatccatggccggcgcttcaccgg

SEQ ID NO: 43333 - DNA, 101 bp, rice(Oryza sativa)
  misc_feature (71): n=t or c
atgcatgctctatatgctaatccaaacaggagcaatgaagaactgtgtaagttgcatgaagccttgcaggntccccaaaactcattggccactagtaacgc

SEQ ID NO: 43334 - DNA, 101 bp, rice(Oryza sativa)
  misc_feature (71): n=t or c
gaggaccatctaccaaataaataacagtaaaagaaaaaaaaacccgtaccagcttgagcatctcctggagnacggaggcgacctgctcgccgccgcggaga

SEQ ID NO: 43335 - DNA, 101 bp, rice(Oryza sativa)
  misc_feature (71): n=t or c
catcttgcttgtgattacgagccacgaaacaagttcgagtcagaattaagatgcaatgcaatggaagaagnggagcagggaggagagttcagaaaacgact

SEQ ID NO: 43336 - DNA, 101 bp, rice(Oryza sativa)
  misc_feature (71): n=a or c
tgtgctggcaatgccaaaaccattaggcactggcatttggcagtaagccagtaatactatcagctcatacnattccaaaatgcctcatcaagtgcttcctt

SEQ ID NO: 43337 - DNA, 101 bp, rice(Oryza sativa)
  misc_feature (71): n=t or c
ttctgtttcctgctaatttcttcattccttccatttgctctcttgtcaaaagaagcaaggtgttgaggtgnaggtgcccttgaactagatttggtatgttg

SEQ ID NO: 43338 - DNA, 101 bp, rice(Oryza sativa)
  misc_feature (71): n=t or c
catagtttccttcccatatttggcttgcgggtgcctcagtttccaaggtcaacctgggtcagtttttgaanagctcatttcagttaatctgtttcaattca

SEQ ID NO: 43339 - DNA, 101 bp, rice(Oryza sativa)
  misc_feature (71): n=a or c
gtctcgcctgccatcctggtgtctagctctactggcatcgcgtttctggataagaggccatgtttaattcnaaaaaaaaaacttcacgctgacacatcgaa

SEQ ID NO: 43340 - DNA, 101 bp, rice(Oryza sativa)
  misc_feature (71): n=a or c
ctttctgtcaaattgtactactataattttgaccaaatagatggattttcacttgaaacatcaatttcacntcattaaatcacatgtacaactatttgtcc

SEQ ID NO: 43341 - DNA, 101 bp, rice(Oryza sativa)
  misc_feature (71): n=t or c
cagtggtatgaaggtttagttcttgcgtcgtatcatattcatcacgtgagctgcttcaagggagtctttangcttattagctttgtggatatcaagtagca

SEQ ID NO: 43342 - DNA, 101 bp, rice(Oryza sativa)
  misc_feature (71): n=t or c
tcagcatattatacactctacatgtcttccttcagttgctgctggaagcgtctcccaattcacccttgctntcgctgttgtcccagccgacgtccttgccc

SEQ ID NO: 43343 - DNA, 101 bp, rice(Oryza sativa)
  misc_feature (71): n=t or c
aaacatctccttcaaacatgcatgcacataaatatttccatgaaagttagttaggaccgtgtttagttacntttaaacttccaaaatttctgtcacatcaa

SEQ ID NO: 43344 - DNA, 101 bp, rice(Oryza sativa)
  misc_feature (71): n=t or g
ttctctcacgtatatactttccgtagaaatgcaacctgttacattgaaatttagctgtgtgagctttatantatgctaaacacaataaagcttaaaatatg

SEQ ID NO: 43345 - DNA, 101 bp, rice(Oryza sativa)
  misc_feature (71): n=t or c
atatgattccaagatatacaacttaatctccagctagtttaacaagttagattagtgcaagatcaaatggnggtcctcttgaaacaagtgatatgataaat

SEQ ID NO: 43346 - DNA, 101 bp, rice(Oryza sativa)
  misc_feature (71): n=t or c
agggttgctattcatgaaaatatagcagaagtcgaagcggcaaaacaacgcggaaactctaatgcgcgatngatcgctaccgcgatcgggtagcgatcacc

SEQ ID NO: 43347 - DNA, 101 bp, rice(Oryza sativa)
  misc_feature (71): n=t or g
agtatgggacgtgaaggtaagatgagtggcccaacagtaagtctgaagaataagatgggctcacttatgtngcacatcataaaagcccaaattccctaaat

SEQ ID NO: 43348 - DNA, 101 bp, rice(Oryza sativa)
  misc_feature (71): n=a or g
cgacagttgcggctggcccgtgaccccgtgtcactcctctccacatgcagataacatggtcaaactttttngatttttaacggcaaagttattccctccgt

SEQ ID NO: 43349 - DNA, 101 bp, rice(Oryza sativa)
  misc_feature (71): n=t or c
taatatgtcatccaatgttttaacaacctatggctgctaggtgcttatatccaccatgttagaaccacagnaacagattatgtagttaaagtgcagttggc

SEQ ID NO: 43350 - DNA, 101 bp, rice(Oryza sativa)
  misc_feature (71): n=a or g
ggaagaggatgcagttgcggtaagaaagaggagagcaagtttgagttcgggtgatgccgccacgagtgatnttgctgcgggagcgagtgatcctgtggagt

SEQ ID NO: 43351 - DNA, 101 bp, rice(Oryza sativa)
  misc_feature (71): n=t or c
atgttgacgcttaaattgtccgattgcgaaaaggaaacatcgaaaagcaaaattccaaaaatctcgagagncaaaccctagaacctcgcagccactgccgc

SEQ ID NO: 43352 - DNA, 101 bp, rice(Oryza sativa)
  misc_feature (71): n=t or c
tgttgggtcaaatctatcaatgacagggctttagttttggcaagataaatataattgtcatccgtgacggnaaaatacccgatacagatgacttctcatat

SEQ ID NO: 43353 - DNA, 101 bp, rice(Oryza sativa)
  misc_feature (71): n=t or c
tcactgttgagaatcactgttggttgtcagtgatagtggtaaatctcagctcagtaatgcacctgaggtangacgaggctggcaagggtgaggccggcaat

SEQ ID NO: 43354 - DNA, 101 bp, rice(Oryza sativa)
  misc_feature (71): n=a or g
gccatcatggtatttagcttgagcgagtagctgcaatattatgtaggcttttgttgtggagcttatagcantactgttgcgtttgatggtttctccccttc

SEQ ID NO: 43355 - DNA, 101 bp, rice(Oryza sativa)
  misc_feature (71): n=t or c
ttctcgaaccctggaggtgccatctcattttgcaaacatggttcagattgcaccactggagaagggggtcncaatagtggttgttgcagtagtccctcagt

SEQ ID NO: 43356 - DNA, 101 bp, rice(Oryza sativa)
  misc_feature (71): n=a or c
caagtgacgactttgttcagccatgctgaaaaggtggagaaggaattgaaagagaaccctgcaccatcagngtctgatattgaggcagctagagttgttgt

SEQ ID NO: 43357 - DNA, 101 bp, rice(Oryza sativa)
  misc_feature (71): n=a or g
tcacatcctctatcttttcctcccctcctccccttgctggcttcccttctccctttaccctcacgtcagcnggcggcagccaaagacattggcggcgcggc

SEQ ID NO: 43358 - DNA, 101 bp, rice(Oryza sativa)
  misc_feature (71): n=t or c
agatgcaaatgagtagatgagaagattacaagaactccctagctcactttaccccctaaccacggttaaanaaggtgtggcggcgtgggagtcagacgtga

SEQ ID NO: 43359 - DNA, 101 bp, rice(Oryza sativa)
  misc_feature (71): n=t or g
acggcgttctcggagagcttcttgaccttgagcaagggagcaaccttggcgatcttgtgcgggggctcctngacggcggagtcagcggcggcggcggcggc

SEQ ID NO: 43360 - DNA, 101 bp, rice(Oryza sativa)
  misc_feature (71): n=a or g
taggtcatcccaaaacagaactgtggtaccagaaataatgtcacactttgctattcctctaaagtaatctnagagactgacaatatccctccaccaaaaag

SEQ ID NO: 43361 - DNA, 101 bp, rice(Oryza sativa)
  misc_feature (71): n=a or g
ctcaccctgagtaaacactgtgggttctggatgagtagttccaaacccctgaacaccactatttcccatcngacacgacagactccttgtggtcatgggag

SEQ ID NO: 43362 - DNA, 101 bp, rice(Oryza sativa)
  misc_feature (71): n=a or g
tagtgattccatgttgattaatgctactaatcctggagatacaagttctgttccagctatgcagggttctngtgaaaatttggagcaaatcaatgaagatt

SEQ ID NO: 43363 - DNA, 101 bp, rice(Oryza sativa)
  misc_feature (71): n=a or g
aacattttaattttttcttaattatgtgttctcaacttttcatacgctttcagtttcacctaacataaatngtaagattatttttttgaatctttcaaggt

SEQ ID NO: 43364 - DNA, 101 bp, rice(Oryza sativa)
  misc_feature (71): n=a or g
taagcattctttatatgtaggttttttagaagatccttcaacttttgtattcatataatatggggtttctngagctttcttatttttggctcttttgcatt

SEQ ID NO: 43365 - DNA, 101 bp, rice(Oryza sativa)
  misc_feature (71): n=a or c
tccagaaaaaataaaagaaagataatacacttcaccgtttccagtgactattgagtatccacgtccttcgncgtacgcagttgtcacttcgacaaccatac

SEQ ID NO: 43366 - DNA, 101 bp, rice(Oryza sativa)
  misc_feature (71): n=a or c
ttcaaattttatttggtttatatccatataggaaaaatttcagaaaaatggcatatgtatcctcgtggtgnaatttacatctaactttacttttgaaggtt

SEQ ID NO: 43367 - DNA, 101 bp, rice(Oryza sativa)
  misc_feature (71): n=a or g
gaaacaaaatactgatagggctgatcatagatcaccttgagttctttcaccccgaatgtgacatccactgnatcaccggaatgtacatactccacgaactc

SEQ ID NO: 43368 - DNA, 101 bp, rice(Oryza sativa)
  misc_feature (71): n=t or c
accgagctggttgatcggcttacagataggagaggcaaactcgggaggcttacagatatgtttttataggncccgttctttggttgaatgaagtaaaaatt

SEQ ID NO: 43369 - DNA, 101 bp, rice(Oryza sativa)
  misc_feature (71): n=t or g
tgaattcacaagcttccaacaaacaaaatgcaaaagggggcataagtttatctaaggtgagccggactccncctcagagtctgcaactatcatttcacgat

SEQ ID NO: 43370 - DNA, 101 bp, rice(Oryza sativa)
  misc_feature (71): n=t or c
caacaaactaggagtaaaacgtctctccctccaaataaaacttaggttaaccgaaaataaaatgctcactntgttttttttaatatatgacgacgttgatt

SEQ ID NO: 43371 - DNA, 101 bp, rice(Oryza sativa)
  misc_feature (71): n=t or c
gattggggttgcacagcaggcccgctgcacccctcctccaaatttttttccttagttaatggcctatatgnatgcatgccttatattatggaacatcttaa

SEQ ID NO: 43372 - DNA, 101 bp, rice(Oryza sativa)
  misc_feature (71): n=t or c
ctaaaacagtggaggtcatgtggtgctctcatatgagctaaacaggttgaagcagctatcgccaaatcaancgcagacgcggctatctctctgtaagacac

SEQ ID NO: 43373 - DNA, 101 bp, rice(Oryza sativa)
  misc_feature (71): n=a or c
gactctagctttctcctaatctgagaagtggcatacaatgtgagcctataaatcattccaaagctttctcntaggactctagcatttgttgaaagttttat

SEQ ID NO: 43374 - DNA, 101 bp, rice(Oryza sativa)
  misc_feature (71): n=a or g
acagatgtacttagaagtacctaggtagaatctggatagactcatatgtgccgggtattctctaaactcgncactgatgtgggcacatctgtgctgggtat

SEQ ID NO: 43375 - DNA, 101 bp, rice(Oryza sativa)
  misc_feature (71): n=t or g
acgaatgagcgcatccaactcggaacctgtaccataggtgagtcagagatgtcaagttcttcgagtttaantggtgaagggcaccacggatctggtaagag

SEQ ID NO: 43376 - DNA, 101 bp, rice(Oryza sativa)
  misc_feature (71): n=t or c
cacacttgatgaagcatgaagaaatggaatgaaacggaaaaaacactactccaaaattattaagcaagaanaagtgtaggtcaccctctcagtgagtggct

SEQ ID NO: 43377 - DNA, 101 bp, rice(Oryza sativa)
  misc_feature (71): n=t or g
tagggaataaccgaacgaggtctaattgagaatccaagaatagtcttacttttggggatggccggagccgncgcgccggtgagatgcagcataggcttgct

SEQ ID NO: 43378 - DNA, 101 bp, rice(Oryza sativa)
  misc_feature (71): n=a or g
atcaagaatactcgagttcgtgcatcacacaatttttcacaagaaaagttggagtcaaggcgtgctggggntagggccaagtatgcaactcaaacacctac

SEQ ID NO: 43379 - DNA, 101 bp, rice(Oryza sativa)
  misc_feature (71): n=a or c
agggtacggcaggaagtacttcaaggctgcaaactagtgtttacgcgtgtattcccgttacatcagcgccnacaagatcagatgatctggaagatggccga

SEQ ID NO: 43380 - DNA, 101 bp, rice(Oryza sativa)
  misc_feature (71): n=a or c
actttggaaatgcatggcttgtcctgatacatgtactcctttgtagcagcagaataaactagactactgcnaaggccaaagcccccactatttatattatc

SEQ ID NO: 43381 - DNA, 101 bp, rice(Oryza sativa)
  misc_feature (71): n=a or g
ttcgtggatggatctaaagtgggcaatattgttttttgggccaaattcgttagtgggatttttataggccnaattcgttgattgttattaagtgggccaac

SEQ ID NO: 43382 - DNA, 101 bp, rice(Oryza sativa)
  misc_feature (71): n=t or c
ggcgacctggttgccttacacccaaccaccaagtcaatagcctggtcaaccaacgtttcagccaagaactncaccagcaacagcaacaacactgcagccgt

SEQ ID NO: 43383 - DNA, 101 bp, rice(Oryza sativa)
  misc_feature (71): n=t or c
acgagatccctcgatagtattgtcattagttttggctgatatggcgtctacttggatcctttgactagacntttgtcgtacgtgttattgacatggcgctt

SEQ ID NO: 43384 - DNA, 101 bp, rice(Oryza sativa)
  misc_feature (71): n=a or c
ccaccagtggatgagcagcctcctcttgatcgccgcgtcgtccgggaagacgacgaagcagaggaggcagngcttgagccgcgtgtcgaggctgtccatcg

SEQ ID NO: 43385 - DNA, 101 bp, rice(Oryza sativa)
  misc_feature (71): n=t or g
gtagactagaattattatctgctaacagcgaagaaagtgaccggattcagattaaattaaggtgccccatncattttcagatcgagttatgttttttttac

SEQ ID NO: 43386 - DNA, 101 bp, rice(Oryza sativa)
  misc_feature (71): n=t or g
cagatgatgaagatgatcatagtgaccaccgctcaagaagaaggcacagaagcagatccctatgggatcgnttgggtggccgccgatccagcagaagcagg

SEQ ID NO: 43387 - DNA, 101 bp, rice(Oryza sativa)
  misc_feature (71): n=a or g
gaattatgacactgatcattgattagagaacctatatcctgttcaaccatattagctcaacacttctcacngtacaataatcaaaatcagataaaacataa

SEQ ID NO: 43388 - DNA, 101 bp, rice(Oryza sativa)
  misc_feature (71): n=t or c
ggtagtttagttgtagtgtcggaaggtttaattaacgggtaattaaggcataagaggtattcatatcctancttaatataaagctgatattcactaactct

SEQ ID NO: 43389 - DNA, 101 bp, rice(Oryza sativa)
  misc_feature (71): n=a or c
tgcagtgttctgtgcctaacgcagtgacataaccgttcgtacgagtggctgtagcaacattggtctattcntatgcacagtaaaaaaaattgtaccgtagg

SEQ ID NO: 43390 - DNA, 101 bp, rice(Oryza sativa)
  misc_feature (71): n=a or g
cagccgactcttaaattttttgtttggcaatgatcaattaatgccacaccaaaataattggcagtgggccngggccgaggccgggccaggccctagttctt

SEQ ID NO: 43391 - DNA, 101 bp, rice(Oryza sativa)
  misc_feature (71): n=t or c
ttataaaaatgctaaacatggattagtaatgttattaatacctagaaggaattagcggcgggaggtgaggngtgccgcgcgctaggatcgtgcgcttgttt

SEQ ID NO: 43392 - DNA, 101 bp, rice(Oryza sativa)
  misc_feature (71): n=a or c
tatcaaacacattcttctcaaggtgcattacgtcgatggcatgctgaacctccaggtctttctagtaatcnagatacctgaaaaaaattgagtgcttcttg

SEQ ID NO: 43393 - DNA, 101 bp, rice(Oryza sativa)
  misc_feature (71): n=t or c
ggagaagcgcctccgttggttaggcactccacggtcagggtgaagatcgcatccagctcttcaacgtcganccaccgttgtgggccgtcatcatcatggtt

SEQ ID NO: 43394 - DNA, 101 bp, rice(Oryza sativa)
  misc_feature (71): n=t or c
cccatttgaaataacgcctcttttatttcctcatccgagtaggccttgcacagttcttcatttatggattngtccaccttacatggaatggcctctaggac

SEQ ID NO: 43395 - DNA, 101 bp, rice(Oryza sativa)
  misc_feature (71): n=a or g
aaaattggagtagtggagtaggtgccatttcttcatttttatctcattttattcagatacgattaagttcncacgtatgcgacacatatccagtaacaaaa

SEQ ID NO: 43396 - DNA, 101 bp, rice(Oryza sativa)
  misc_feature (71): n=t or c
gaattgcataatgtgtcaaatcgggccttaaaaaatggcaagaagcaatggaggtgcagtgcttatttccncttgtttgaagattgaaagagtggctggat

SEQ ID NO: 43397 - DNA, 101 bp, rice(Oryza sativa)
  misc_feature (71): n=a or g
cagtaccgctacttcagttatcacttgtgagctttctggacataatttgtatgtcgtggtattgtgacatncacatatattgtgacatacacataattcat

SEQ ID NO: 43398 - DNA, 101 bp, rice(Oryza sativa)
  misc_feature (71): n=a or g
ttcctgtggcagaattgtgcatctgaaatgccatgttccaggtacctgcagaatataaccaacaagaggancatttgttagaataccagcagaaagaaaaa

SEQ ID NO: 43399 - DNA, 101 bp, rice(Oryza sativa)
  misc_feature (71): n=a or g
atttggtttataattgaaaccggagtattgcggtagtaggaatcctatgcccatttccaccaaatctcttngacaggtggcaccaccaatattaaggctgg

SEQ ID NO: 43400 - DNA, 101 bp, rice(Oryza sativa)
  misc_feature (71): n=a or g
gggttgcgatcgtatgtgtactgttgggtgcctgtgatttgggctgattctaccgatgaatatttataganatcccgatcgtgttgggacgcgtcacgcat

SEQ ID NO: 43401 - DNA, 101 bp, rice(Oryza sativa)
  misc_feature (71): n=a or g
gcagccccgcgcggtgacggcaacggcacggcggtggagggaggcgattgatttgtgattttaagtgttgnatttggttgatttatctgtgaatttgctga

SEQ ID NO: 43402 - DNA, 101 bp, rice(Oryza sativa)
  misc_feature (71): n=t or c
ggttatattttctcctaattgacatcctttgcttccagcactaggaacataacagagtgacagaactcatntgttacacctaaagaaggtggtccatttct

SEQ ID NO: 43403 - DNA, 101 bp, rice(Oryza sativa)
  misc_feature (71): n=t or c
atgaaacaaaagattaatatttaccgaatctaagagtgtaacttcactgcgcatagtgtcatgttcttctnctttgaaagcatcaatgactaaaaatagat

SEQ ID NO: 43404 - DNA, 101 bp, rice(Oryza sativa)
  misc_feature (71): n=a or g
aggggcatctttcaccaaaaatttcactcacagcttaaaatttcctcctccgcccaaaaaccctctcgacnctccgaaccccagcaatggcggacccgccg

SEQ ID NO: 43405 - DNA, 101 bp, rice(Oryza sativa)
  misc_feature (71): n=a or g
cctggaattgaagaaatcaaacaaaagagtacatgcatgttagtcgatagagatctcacctccattggcgntaaacggcgcctcagcataacccacaggcg

SEQ ID NO: 43406 - DNA, 101 bp, rice(Oryza sativa)
  misc_feature (71): n=t or c
aatatctacgaatcaggatactgacaaccttgatgcagttacttttttcacaataaccacgtggttatcgnagtaaccgtcaaaccatggggtggcggtaa

SEQ ID NO: 43407 - DNA, 101 bp, rice(Oryza sativa)
  misc_feature (71): n=a or g
atctataaacaggttttactccgcagaatgtcttgcaaggttatcaaagaaactgcaagaggaagagaccnctatatgtttattttggcagaaagatactt

SEQ ID NO: 43408 - DNA, 101 bp, rice(Oryza sativa)
  misc_feature (71): n=a or c
gttgcaaatgtatctactcctttgagcattaattcatctggacaggttccaaaccctacttccaagcctantgtggaaggatcaagtttcactgcccaatc

SEQ ID NO: 43409 - DNA, 101 bp, rice(Oryza sativa)
  misc_feature (71): n=t or c
cactctagtttcatctgtccgttctgttacactccggatgtcgaccacgagattcttcgatgcaaccactngtccatgagcatcattgttgacaacggtca

SEQ ID NO: 43410 - DNA, 101 bp, rice(Oryza sativa)
  misc_feature (71): n=t or c
cagcaccttgcaatcggtattagagatgtgtcacaactgtgactaactattatgtggcgtcaaaagattangctatttcatatatcttttacactaaagtt

SEQ ID NO: 43411 - DNA, 101 bp, rice(Oryza sativa)
  misc_feature (71): n=t or c
gcacatgtgtcagggctccagcagaaaaacatataccaaaaaaaattaccaagacgccgcatacgaccgantcactaacaatgtcgtactccctccgtccc

SEQ ID NO: 43412 - DNA, 101 bp, rice(Oryza sativa)
  misc_feature (71): n=a or g
tcacttggagagctaacactgctcagatatcttttgttgagaaatcttccaaagctacagcagattggccngcattctcatatgtctagtagtagttccat

SEQ ID NO: 43413 - DNA, 101 bp, rice(Oryza sativa)
  misc_feature (71): n=a or c
tccatgggaagagggatgggtgagataggctgacaatggacccaccaaaagtatagggtattatgcaattnttttctattattatggagtctaaagtataa

SEQ ID NO: 43414 - DNA, 101 bp, rice(Oryza sativa)
  misc_feature (71): n=a or g
aaattcactgcgtcacaccaagccacttcgagaaattctcaaactctgtgtagtcactgtcagaaatcatngttttgtaccatgcctttccagcagccttg

SEQ ID NO: 43415 - DNA, 101 bp, rice(Oryza sativa)
  misc_feature (71): n=a or c
tacaccacagatagggcagatgcctactggttgtatccttcttttccgtttatacctataaagtttatacnagtaaggtcccaaaagcagtttggacgacg

SEQ ID NO: 43416 - DNA, 101 bp, rice(Oryza sativa)
  misc_feature (71): n=a or g
cgatggcgggacaacgacagagaggtggattctttttttttattgccaagatctgggatgaattttgagtntcaaaatttgtgttgtggatgaatagattg

SEQ ID NO: 43417 - DNA, 101 bp, rice(Oryza sativa)
  misc_feature (71): n=t or c
gtcttccagtaattattgaatcctttatggggccagaaagcccatattctcctgtcctatcatccagtttnaatttcaccaggaactttcaaggtaagtgc

SEQ ID NO: 43418 - DNA, 101 bp, rice(Oryza sativa)
  misc_feature (71): n=t or c
gtttaaaggcacactacccaatttgcagaactatcaagccgcttcaacagtttaacaactgcagcactaanatatcacttacataacagcaaaactgccct

SEQ ID NO: 43419 - DNA, 101 bp, rice(Oryza sativa)
  misc_feature (71): n=a or g
cttcagcaattccaaaccaaactcaattgctctctagcccggcgaagcattcccgccaaaacttgtgtcantgagatttccatttaggaaatatttcgctt

SEQ ID NO: 43420 - DNA, 101 bp, rice(Oryza sativa)
  misc_feature (71): n=a or g
gccatctgccacactctgtcgagcgtgacgaggtcgctcttcttgttcgtaagggcatcgcccttgatgcngtaacccttaggattctccttgacgtgctc

SEQ ID NO: 43421 - DNA, 101 bp, rice(Oryza sativa)
  misc_feature (71): n=t or g
tgcttctgatcttaaagacaatcttcgttaacccaggtaaggtacatcgtacacaatgctttccactttgnaagtccactctaattggtactccctccgtc

SEQ ID NO: 43422 - DNA, 101 bp, rice(Oryza sativa)
  misc_feature (71): n=t or g
caggatacagcagaaaaaaaaaagccacataccttgcctgttcgacacgattcctacgactctactctccntaaaaaaaaaaagagtcaaaccctgagttt

SEQ ID NO: 43423 - DNA, 101 bp, rice(Oryza sativa)
  misc_feature (71): n=t or c
tgcgccagcgaagatcattttcactggtgactgttataaggcaaccgccaacgataactatctttgttggnggctccattatgttatccgccagtgaaaat

SEQ ID NO: 43424 - DNA, 101 bp, rice(Oryza sativa)
  misc_feature (71): n=a or g
gtccggcagcagcagaacccagccattcccaaagcccactctcgccagagtgaagtctgaaagggccaccnccgccgccgcagcctcgccacggcctccag

SEQ ID NO: 43425 - DNA, 101 bp, rice(Oryza sativa)
  misc_feature (71): n=a or g
gcaacgcgactggagaaaaatgcaatctgatttcttctgctcaagccttcaaagtttctgtccatgacacngctcatcggctgaaacgctctgaaatcgac

SEQ ID NO: 43426 - DNA, 101 bp, rice(Oryza sativa)
  misc_feature (71): n=t or c
caccacattgttgtgtacacgcacctcaacattgactagtaattactagggtttggacatccttacagtcnttcactttagactatggatccatttgagta

SEQ ID NO: 43427 - DNA, 101 bp, rice(Oryza sativa)
  misc_feature (71): n=a or g
cgccaccgggagggtcgcgctggggttcaccatcgacacactgaaggggcgctgctcattgtctatgctgnccggatgccgcggttcgggtactccgccca

SEQ ID NO: 43428 - DNA, 101 bp, rice(Oryza sativa)
  misc_feature (71): n=a or g
cccttgaagctcaatataacggcggaaaaatggatatggtagacaactttggccatacaatgcatgtatcntcccttccttcctttcttatcaggcaatct

SEQ ID NO: 43429 - DNA, 101 bp, rice(Oryza sativa)
  misc_feature (71): n=t or c
aagtgcttatggatttgcacaaattagtgggttgttcttcgtgcaaaccatctcctttcaaccggtaaatnactctcccttttgtgcttactctcaaatag

SEQ ID NO: 43430 - DNA, 101 bp, rice(Oryza sativa)
  misc_feature (71): n=a or c
cagattacttgagatattcagtacctggagtggccaatcagatgatgatgagtctacctcttgtagttccncgccgaggcggttgaagctgacatcgagga

SEQ ID NO: 43431 - DNA, 101 bp, rice(Oryza sativa)
  misc_feature (71): n=t or g
tttcctaacagaaacaaaaacacgtgtgcacacagatacagcatagtactactatgctcacttttcactgncgcacgaaaaccatcccaacggacgcacgg

SEQ ID NO: 43432 - DNA, 101 bp, rice(Oryza sativa)
  misc_feature (71): n=a or g
tggcggcggcggcgatggagcggctgatgaggactcggtgcagctgcacaagcgatggatacccctacctnctgacgcgccgagggggaagctacatgagg

SEQ ID NO: 43433 - DNA, 101 bp, rice(Oryza sativa)
  misc_feature (71): n=t or c
cgaacagtgagtcatcactgaccggccgtgcttcatattcagcggtcatcgcacacagaacagcaactgcngccgcttcctcctttctcccgccagcactg

SEQ ID NO: 43434 - DNA, 101 bp, rice(Oryza sativa)
  misc_feature (71): n=t or c
ccgcccttgtactccctgaacttgtagttctcctggaacttgatcagcctgcacggcatctgctcgccggncgacgtgcggttcatcccctcggcgccgct

SEQ ID NO: 43435 - DNA, 101 bp, rice(Oryza sativa)
  misc_feature (71): n=a or g
cactgcatggccactgctgcttgctgtcgaatggctatttgttgcatggcttggactgctgcttgctgtcncatggctactggctgcatggcttgagctct

SEQ ID NO: 43436 - DNA, 101 bp, rice(Oryza sativa)
  misc_feature (71): n=t or c
catgggagagaagatcgtcgatcgttcatggccacgcccaagtcgaaaaatagcagaaatatggcgcaagnagcccgtttgaccagcaccgaaccaggccc

SEQ ID NO: 43437 - DNA, 101 bp, rice(Oryza sativa)
  misc_feature (71): n=a or g
aagatcgtcctgtgcatcaatgccatcgtcatactcatcatccggatcaacctccctgatcccagtacccncagctcccatcgcagccgcctcatactgct

SEQ ID NO: 43438 - DNA, 101 bp, rice(Oryza sativa)
  misc_feature (71): n=a or g
ttttattccatgtgtgagctggggccttttcggtagtacagtatgtgtatttcccctttatactgatgagntgggacttttaatattcgcacggtacaact

SEQ ID NO: 43439 - DNA, 101 bp, rice(Oryza sativa)
  misc_feature (71): n=a or g
gtgccatttcatgatccatgcttcagagcgcctgacatttcttgcttgtaattcctttaggtgctgctctntgtacagctccactatcacaagctgttaca

SEQ ID NO: 43440 - DNA, 101 bp, rice(Oryza sativa)
  misc_feature (71): n=t or g
tttccatactagtgggcgcacaccatcggaacttgtaaagacctcaggctcaggaacaccaagcagtaaantcagcgctgcagctattgcaagtgctaatt

SEQ ID NO: 43441 - DNA, 101 bp, rice(Oryza sativa)
  misc_feature (71): n=t or c
agccgcagtatggaatgatgcatatcttgagaaacaactaaaaagtctgaaacccacaccataatactccntccgtcccaaaatatttgacgtagttgact

SEQ ID NO: 43442 - DNA, 101 bp, rice(Oryza sativa)
  misc_feature (71): n=a or g
caatgacgagctgcaccagtgcacaacgtactcctgctatatacgtactgcgtgcatgcgtgtcggggagngttcacaattccgacgaaaaccggtcgatc

SEQ ID NO: 43443 - DNA, 101 bp, rice(Oryza sativa)
  misc_feature (71): n=t or c
gaaggacgaagcactgatgcaaaaggctttgcttttggcctactgttttccgcaactgagctactagcagnactgggggctatataatctgagagagctgg

SEQ ID NO: 43444 - DNA, 101 bp, rice(Oryza sativa)
  misc_feature (71): n=t or c
aaatatttgatcgagatctcagaaatttcggtgccctcaatggaaatatacaaaacgaagttacagactcnacttccaaccatgtttgtgtgttgaccaat

SEQ ID NO: 43445 - DNA, 101 bp, rice(Oryza sativa)
  misc_feature (71): n=a or g
cctttttttctcgttgtttttgagtctggttgtcttcgttaggtagcctagtgtgctttttttctcaaacncgcaaaaggattgcacgtcaatatattaga

SEQ ID NO: 43446 - DNA, 101 bp, rice(Oryza sativa)
  misc_feature (71): n=t or c
gtcagacatttaggaatggagggagtagtacagtgcaaaagttgacgctcacaacacttcgtatacttacncttataaacacacgtgcgtacaccttattc

SEQ ID NO: 43447 - DNA, 101 bp, rice(Oryza sativa)
  misc_feature (71): n=t or g
ggtcttcatggagcaagcaatgtgcgagagatgctcaggcacaacccgcaagagcttgtcaactaccttgnactcagggattggggcctgagcgtcgccaa

SEQ ID NO: 43448 - DNA, 101 bp, rice(Oryza sativa)
  misc_feature (71): n=a or c
ctagtcacaccttggaggatctttctcgttagtgtttcaacatcgaaaatgtgagaaacacaaacccagangaacaaatcaaaataatcttttaccttgtt

SEQ ID NO: 43449 - DNA, 101 bp, rice(Oryza sativa)
  misc_feature (71): n=t or c
agtattgctacattcctataattttcatgctttcatgcaaatcaaaggggccttggcctttaaactttttngtagtccaatttcaacccgaatttagatac

SEQ ID NO: 43450 - DNA, 101 bp, rice(Oryza sativa)
  misc_feature (71): n=t or c
tactaagcaggaaggtatttcaatctcaagagcagaagagaagcgagcagtcattaagcaacgggaaaccngtgatgctgagcgactccaacgaaccaacc

SEQ ID NO: 43451 - DNA, 101 bp, rice(Oryza sativa)
  misc_feature (71): n=t or g
ggaagaggtgtagctgcgacaatgtcgggcgcatatgatcatgatatatgatcctagattgtggccttccnaccttccccgtatcgcgctctgcgctctcg

SEQ ID NO: 43452 - DNA, 101 bp, rice(Oryza sativa)
  misc_feature (71): n=t or c
tcggtcatgataatgctagctctttatcgacagcacctctagaacagcaatatgtatttgatcgatagatngagattctatgtacgaattggtccccctcc

SEQ ID NO: 43453 - DNA, 101 bp, rice(Oryza sativa)
  misc_feature (71): n=t or c
aattggacggaactcatggtttaaagtttacatgcgtacttaactcctcccttcccacccttcggaatatngttaatcattgtggaaactcgaacatgatt

SEQ ID NO: 43454 - DNA, 101 bp, rice(Oryza sativa)
  misc_feature (71): n=t or c
aactccctcactattttcttcacagcaacctcacgctccagctgcttcaggaaaccactatagactacccnaaatgcgccttccccgagcttgcgatcgtc

SEQ ID NO: 43455 - DNA, 101 bp, rice(Oryza sativa)
  misc_feature (71): n=a or g
cgccgatcgcgtgtaacagccctaaaagttgacaacatttcaaaatcaatttgattaattttgtttacctnaaatattaccatcgatgtcacgcccagaat

SEQ ID NO: 43456 - DNA, 101 bp, rice(Oryza sativa)
  misc_feature (71): n=a or g
cttcggcaccgtgttagcgagagatcagtatgactataggtgtgtgtatttgttcaggcgtagcagggacnatccccagatcatcacctcaccggtttgta

SEQ ID NO: 43457 - DNA, 101 bp, rice(Oryza sativa)
  misc_feature (71): n=a or g
atgaagacaatgggtacaacgatgtcccactcttttttccacaaaggaaaagggagtgaacttatgtagcncaatatgcagagtacatggaacaaatatct

SEQ ID NO: 43458 - DNA, 101 bp, rice(Oryza sativa)
  misc_feature (71): n=a or g
cgaccacgtggatgagatgagctcgagctccatgaaacttgcaccagggagaggagcttgttgtcaggcancgccagacgggtgccgacaccaggcactgg

SEQ ID NO: 43459 - DNA, 101 bp, rice(Oryza sativa)
  misc_feature (71): n=a or g
ccccacagtaaatccgcccctgattgctcaaatttatacattagttccatgaaggggtggttctaggaatngtggagaggggggcacatcttcttcctcct

SEQ ID NO: 43460 - DNA, 101 bp, rice(Oryza sativa)
  misc_feature (71): n=a or c
tactctatgcgctctcatcaactactcagatgtacgaaggatgagagcacattagatgacggtaacaacangacgtgcacaacaatagtgatgagcagcgt

SEQ ID NO: 43461 - DNA, 101 bp, rice(Oryza sativa)
  misc_feature (71): n=a or g
tagctgtagacatcgctcttctcgtccacccttagagtgtaagcatactctgtaaaaacaaaaccgcacanttagccacgcgcaaaagttaaatatccgta

SEQ ID NO: 43462 - DNA, 101 bp, rice(Oryza sativa)
  misc_feature (71): n=t or c
gaggacacccaatatttacttgtatcaatttgtcatcaggagcttcaagagttagagagcttcctgcatangagttctgcaaacaagggtttgtgttgggg

SEQ ID NO: 43463 - DNA, 101 bp, rice(Oryza sativa)
  misc_feature (71): n=a or c
aataaaatttaaaaataaaaaaatcctcccccgccatctcgcgaagaaactagttatccaagcgcaaaatntaaatggagaggcctctcgatttagtcata

SEQ ID NO: 43464 - DNA, 101 bp, rice(Oryza sativa)
  misc_feature (71): n=t or c
tggcggtcaaattggttttgatgttagaaaacgatttgagaatactagcaaacttgatggcaaggctatancagctgaatttgtttgcaacaaggaaggct

SEQ ID NO: 43465 - DNA, 101 bp, rice(Oryza sativa)
  misc_feature (71): n=a or c
acttgattatcaatttttcttctttccatagttgtcttattctaggaggacgagtgcgggtaactaaattntagagcaaacacaatgtagaaccgatcaaa

SEQ ID NO: 43466 - DNA, 101 bp, rice(Oryza sativa)
  misc_feature (71): n=t or g
accactcctgctaaagctgccctcattatgaactcgctggacaatgagtagcaattgcacattgctgattnccatctcctgcggttacattcgtacacgac

SEQ ID NO: 43467 - DNA, 101 bp, rice(Oryza sativa)
  misc_feature (71): n=t or g
gatcattaaaccgttgattaggcatgcagcttatagcactaatgggttatggctgtgcttccaatcatctnttcgttggtttgatcgagttatgttgaaca

SEQ ID NO: 43468 - DNA, 101 bp, rice(Oryza sativa)
  misc_feature (71): n=a or c
ctcctccaaaaatatttttaaggtgcgaggagtagggacggataaaaaaaaaaccattatagggaatcatnttcttcttcctctcgagtcatttctcctct

SEQ ID NO: 43469 - DNA, 101 bp, rice(Oryza sativa)
  misc_feature (71): n=a or g
tcgtctagatcgaagcccgtcgtagacctgcaacactcacctcacagttccactgtcgtcgtcgctttggncgaactacctgaatcactgctgcctcaagc

SEQ ID NO: 43470 - DNA, 101 bp, rice(Oryza sativa)
  misc_feature (71): n=t or c
ggtagcgagctattgcagagaggtcagaaacaataagagaacagactaaagcgttattataaatccatggnggcccctataaagtactcatacccacaaac

SEQ ID NO: 43471 - DNA, 101 bp, rice(Oryza sativa)
  misc_feature (71): n=t or c
caatagcacgcgatggaacgtactggagcttagcattttacctccgacatcacaatagtgctgtgaaaacnggctatgtaaaacaccgaccctattggtta

SEQ ID NO: 43472 - DNA, 101 bp, rice(Oryza sativa)
  misc_feature (71): n=t or c
aagcacaaattgtattttatcctagttattaagcactctgacgtgtagtatctaggtcccgttcttttctncaataagagtttgatgaagattaaaatttt

SEQ ID NO: 43473 - DNA, 101 bp, rice(Oryza sativa)
  misc_feature (71): n=t or c
tgatcaaatagtcgtatctgatcgtaggatatcaagtcgtatgtataaagagaaacgcctaggggtcttcnggctagtgccatgagatggtgggctagacg

SEQ ID NO: 43474 - DNA, 101 bp, rice(Oryza sativa)
  misc_feature (71): n=t or c
actacaggttcccatctgctcatctactggaggacttgtcgacacggttaaggagggcgtgaccggattcnacatgggtttgttcaatgtcgaggtaagga

SEQ ID NO: 43475 - DNA, 101 bp, rice(Oryza sativa)
  misc_feature (71): n=t or g
tatttttgccgaaggggatatcgctctgcgagaacccgaagggggatatcctatagaatttttgcctgatntatgaactccaacctgtatttatgaaatat

SEQ ID NO: 43476 - DNA, 101 bp, rice(Oryza sativa)
  misc_feature (71): n=t or g
gatcgaaccgatcgagagaaattgaagataaggctcgacagccaattaatctggccatatattggtacgcnaggcctcatatcagcgactcaccgtgtgac

SEQ ID NO: 43477 - DNA, 101 bp, rice(Oryza sativa)
  misc_feature (71): n=a or g
gcaagagccaaaggaacaagagcccaaaggagaccaaactagacaatgttgcacaccacctcaacagtggntaaccaacaagaagcagaaagacatcagat

SEQ ID NO: 43478 - DNA, 101 bp, rice(Oryza sativa)
  misc_feature (71): n=t or c
cgctgtaaattgcttagttgttacagtgagatagaggtgtggcttgtgaagcgaggtaaacatgtatcaanggcactgattgttatgacagaggttttgtg

SEQ ID NO: 43479 - DNA, 101 bp, rice(Oryza sativa)
  misc_feature (71): n=t or c
gttcaaggctgggtacaacaacatcagcgggaccctgccagatgaactcttcgatgctatctcattggagnacctctcttttcctaacaatggattgcagg

SEQ ID NO: 43480 - DNA, 101 bp, rice(Oryza sativa)
  misc_feature (71): n=t or c
atctctgcactacaccctccatgctcaacactgtcaccaagctcctctatcctccttgctgatggagggtnccgatagcggtctctgccgccacatcatgt

SEQ ID NO: 43481 - DNA, 101 bp, rice(Oryza sativa)
  misc_feature (71): n=t or c
cttacttctttcagtagggaggaatcagaccatcgctgatgctcgcaatcagaacctgaatcagcaaccanaagcacatcggtcgtatatgaagtattgca

SEQ ID NO: 43482 - DNA, 101 bp, rice(Oryza sativa)
  misc_feature (71): n=a or g
ttgtacgagagggatatgagtgatggtctgagagtatgagccaagtagatttttttttctcccatcggatngcctattaagccaaagaaaaagccaaattt

SEQ ID NO: 43483 - DNA, 101 bp, rice(Oryza sativa)
  misc_feature (71): n=t or c
tgaagccaggttgtccttggacttggtgattcctccgcgctggcaatctcctcctgcagcttggcgttgtncgcacgctcttccgttagatgggcttccag

SEQ ID NO: 43484 - DNA, 101 bp, rice(Oryza sativa)
  misc_feature (71): n=a or g
cctccaaaccgaacaaagccttagttgccgactttcctaactggtgccacggaggcggcaccgatgactcnagtgattggtgtcggtttcaaaaccgacac

SEQ ID NO: 43485 - DNA, 101 bp, rice(Oryza sativa)
  misc_feature (71): n=a or g
gggtcattttggagcgatgccaaaatgtggcatatcaattatttggtaacttaattaaatagtagttgtcnacgtttgatatcgcaattccggtatttgca

SEQ ID NO: 43486 - DNA, 101 bp, rice(Oryza sativa)
  misc_feature (71): n=t or c
accgagtacgacatgagggcgacattctccaactacgtaaatcaataacctagaaagcttaccgatggagngggcgtcttccggcggttgccgagcacgga

SEQ ID NO: 43487 - DNA, 101 bp, rice(Oryza sativa)
  misc_feature (71): n=a or g
ctaaagtatattctcctccaatccctcaattgcttgtcactagtacagaaacagtgtttggtgccggtggnaaactagtcataggtacgtgccggttttgt

SEQ ID NO: 43488 - DNA, 101 bp, rice(Oryza sativa)
  misc_feature (71): n=a or g
caatataatacttcgataagtttcttggagcactttcaacttgctctgagttagggtgtgtttagttcatnttaaaattagaagtttgattgaaaatggaa

SEQ ID NO: 43489 - DNA, 101 bp, rice(Oryza sativa)
  misc_feature (71): n=t or c
aatataggtatacgcaccgtaaccaggctttcacgttatcgcgcggtaatcacggttatcgtgcttaccgnggggaaggggatcggttaccggcggttagg

SEQ ID NO: 43490 - DNA, 101 bp, rice(Oryza sativa)
  misc_feature (71): n=t or c
tggcctattaactggattagccttttcttttttcacccaaatggcctaactgcatcaagctaggtcccgtngaaaatctttgggctcgtccgctcttggcc

SEQ ID NO: 43491 - DNA, 101 bp, rice(Oryza sativa)
  misc_feature (71): n=a or g
acctctccagatcgagtcctgtgcaatccgacttcctgctactcaggctctggccacgttccatggtcccngcttcaacaccaacacgtgcacaccgccat

SEQ ID NO: 43492 - DNA, 101 bp, rice(Oryza sativa)
  misc_feature (71): n=t or c
ttatttccattttaagacggatggggtatcagagtataaaatgatattcatcctgaagctgtgtttagttnagcgtaaagtttggattttggttgaaattg

SEQ ID NO: 43493 - DNA, 101 bp, rice(Oryza sativa)
  misc_feature (71): n=t or c
ttcccaataaaatgtgcagtctttgtcgttttgttaaaaaaaacagctgaacaggttggttgctgcctttnatcaacgtttcgggggcacgcctaatgccc

SEQ ID NO: 43494 - DNA, 101 bp, rice(Oryza sativa)
  misc_feature (71): n=a or g
aactcaattatgaaagtgttggagcggttaacccaagacgagaacggtgtctccatccattttatttttcngtttatagtgccaaaataattttactactc

SEQ ID NO: 43495 - DNA, 101 bp, rice(Oryza sativa)
  misc_feature (71): n=a or c
tcccagtatgctgcaactgacacctgggtcctactcctacgctctagtgttgtgggaaggaataagttcancggaggtccctcaacttaacagcgagattt

SEQ ID NO: 43496 - DNA, 101 bp, rice(Oryza sativa)
  misc_feature (71): n=t or c
atttgcatttggtttttccatgattcaggaagagaaggccattgagcggggaatcctgccattgcttcgcngtgcgacgctggtccagacttttgggcaga

SEQ ID NO: 43497 - DNA, 101 bp, rice(Oryza sativa)
  misc_feature (71): n=a or g
cctgacgtgatgaaacaatattatcacatcacacgcaattgatgtgacggttttatcttgtcactcgggtnttgctagggcacgatgaaacaacgttgcta

SEQ ID NO: 43498 - DNA, 101 bp, rice(Oryza sativa)
  misc_feature (71): n=a or g
tttgcacacgtttatgaagttacatttcttggggaaaaaacagcacgttatggcgccaaagcataccaccnccactgaaaccacatgccgctgccaaaaca

SEQ ID NO: 43499 - DNA, 101 bp, rice(Oryza sativa)
  misc_feature (71): n=a or g
catctttgcaaaatatttataggttaaaggctttattaatgaaatggccgtaaggatagaagatgaagacnagaggatctcaagccttgcaaaactcttct

SEQ ID NO: 43500 - DNA, 101 bp, rice(Oryza sativa)
  misc_feature (71): n=a or g
agaaagcaaagttttttattacacaacgaaacggtcataaggctactgctaggggataggaaaaaaagaanaaaaaacagagtaaaggaaggaaaaacctc

SEQ ID NO: 43501 - DNA, 101 bp, rice(Oryza sativa)
  misc_feature (71): n=t or c
gtttgagatacattttgaatttgaggggaatgggagcacattatggtgaagttgaggtttgggaggaaagnggatggcatgagggggaggatggaggagat

SEQ ID NO: 43502 - DNA, 101 bp, rice(Oryza sativa)
  misc_feature (71): n=a or g
atgttttattcgttgtagtactctcttcattaaaaaaatgtggggcatattagttttgggaggtcacaacnaataaggagaacatgaaactaagaaaaaag

SEQ ID NO: 43503 - DNA, 101 bp, rice(Oryza sativa)
  misc_feature (71): n=t or c
acaccatttgaagtaacttatggctaccaaccaacccattttggtattagcctggaagattgttctgttcnagatttggaggagtggttaagggacagaaa

SEQ ID NO: 43504 - DNA, 101 bp, rice(Oryza sativa)
  misc_feature (71): n=t or c
taattagtaaggtggaacaacatggagtcttgtttttatctaagctctatatgatttaaaaaataaccaancgatgcgtcatatgattaaaacttctaata

SEQ ID NO: 43505 - DNA, 101 bp, rice(Oryza sativa)
  misc_feature (71): n=t or c
aagggcgatgccgggggaatgtataaccagctgttgtactgcagcaggtcgtcgacgagcgcccaggggcncgtgcgcgtgccggcgctgacctcgtcgcg

SEQ ID NO: 43506 - DNA, 101 bp, rice(Oryza sativa)
  misc_feature (71): n=t or c
ttctatctctttttttcttctctctactgatctcaccatggtgtgatgggcacatgaattgtccccattcnaaaactcaatttcttcgagtttcttgatct

SEQ ID NO: 43507 - DNA, 101 bp, rice(Oryza sativa)
  misc_feature (71): n=a or c
taccattaaattgacagaaacaagtccactaggcttgccaacatttagatttaggtaccaccggcaacatnaacacatttcataaaccaaacctaatgata

SEQ ID NO: 43508 - DNA, 101 bp, rice(Oryza sativa)
  misc_feature (71): n=a or g
tcgttgtcggcctggaggccttcggcaccaagcctaaaaagccaaagttctattgggccatttgccatttngggccattaaagagctcattaagaagcccc

SEQ ID NO: 43509 - DNA, 101 bp, rice(Oryza sativa)
  misc_feature (71): n=t or c
ataatccactgttctagtgacattcttgggtacgtgcctgtgtactcatgaccactccagaaaaattctanagcagccaacgactagacaacatgctccac

SEQ ID NO: 43510 - DNA, 101 bp, rice(Oryza sativa)
  misc_feature (71): n=t or c
acgtaataactgggctgcaaataaatcttcactcaaccttcaaggtaccatacagctagcggaatgctttnttaaactttatttattttgtttttatcatg

SEQ ID NO: 43511 - DNA, 101 bp, rice(Oryza sativa)
  misc_feature (71): n=a or g
gcagttcattgttgcaaaataaaattactcagcaatgaactaacgaatacgcaacgcaatctaatgaatcntttaaaagtttacaaaggagatgctaaaat

SEQ ID NO: 43512 - DNA, 101 bp, rice(Oryza sativa)
  misc_feature (71): n=a or c
catattactgccatcttgtagctggaacaaatctgaaatgtctctgttaagagtactgccgcaaaatcgtntcctcttcctagctttgtactgagaatttt

SEQ ID NO: 43513 - DNA, 101 bp, rice(Oryza sativa)
  misc_feature (71): n=a or g
aagacgccacaggaggggatccaacggtgactggctctcagatccatcatagccgggaggggacccaaatncgcgtggttgccgtgggttcgatgcttagc

SEQ ID NO: 43514 - DNA, 101 bp, rice(Oryza sativa)
  misc_feature (71): n=t or g
atattgtgtctacatttaactaaagaatcatcaaattctgatcgactaacaggacatatatgaggacgatnacttgtcattctctactgaaaaggttagca

SEQ ID NO: 43515 - DNA, 101 bp, rice(Oryza sativa)
  misc_feature (71): n=a or g
ggtggcaagtgggctatgccagcctggtgttggatgcacgaccataggcgtgggttgctcgatggcaagcnggtcgacaacgggcttggctggcctggcat

SEQ ID NO: 43516 - DNA, 101 bp, rice(Oryza sativa)
  misc_feature (71): n=t or c
agggagtgaagttctgagaaatttcagacagtccgatgtatcggacaatccgacgatatatcggatagtcngatatttttgccaacactcagaccaaagac

SEQ ID NO: 43517 - DNA, 101 bp, rice(Oryza sativa)
  misc_feature (71): n=t or g
tccaccgcaacggcggctctgcctccctgcccgacctgctcgccaccctcccaatcgcagagaacaagagnccattcctgcatcggctcatgagattccta

SEQ ID NO: 43518 - DNA, 101 bp, rice(Oryza sativa)
  misc_feature (71): n=t or g
tctacgttaattttatcaatacttgtctagtgtattgaaaatgcttgaggtgtgcatttgccattacgttnttgaaaaataaatacaccgactcattgttc

SEQ ID NO: 43519 - DNA, 101 bp, rice(Oryza sativa)
  misc_feature (71): n=t or c
cttctcctcgtaatataatgtgctttgtcactgatcatagcatatatatggagtatgtcgtcgttctattngatttatatcgattaatagctttcgatcga

SEQ ID NO: 43520 - DNA, 101 bp, rice(Oryza sativa)
  misc_feature (71): n=a or g
gtttgactaatttcagaatacttgctatcaaaaccgaccaatcatcgaaagtaaccaaaattcgcattacnattctatcacctgttggtatgtttcatctc

SEQ ID NO: 43521 - DNA, 101 bp, rice(Oryza sativa)
  misc_feature (71): n=t or c
cggcttggcctgctgctgctgggattccggtagatttgcttgtttcatcgccatattcagcccatatctcnttgttggtgttggtgatggctattagtaac

SEQ ID NO: 43522 - DNA, 101 bp, rice(Oryza sativa)
  misc_feature (71): n=t or c
ttatcccgcggttcagtcaaatggttattgttgtgttttttttattttgcaatgccttattttgtacttanatttctgttagaataatgtgttttttctaa

SEQ ID NO: 43523 - DNA, 101 bp, rice(Oryza sativa)
  misc_feature (71): n=t or c
atgttcgcttctccgttagctgtcatggtacgtatgcctctcgatcaagctgagctcttgatcaatatcanctccggcatgtttaatagaactgagggatc

SEQ ID NO: 43524 - DNA, 101 bp, rice(Oryza sativa)
  misc_feature (71): n=a or g
cgatgacctgagagttgagctatgttcaaaaggggcacctccggggattgagaataacggcaaggcatagngagatctgcttaccgttgtaaggtggtagg

SEQ ID NO: 43525 - DNA, 101 bp, rice(Oryza sativa)
  misc_feature (71): n=t or c
tctccaacattatctttgtggttttcgtcagccgctatgtcagcgaaattcgaccggtataaatgttatanggaggtactgtttttttatttgaggaagac

SEQ ID NO: 43526 - DNA, 101 bp, rice(Oryza sativa)
  misc_feature (71): n=a or g
gtggttaacatggataattgaccatgtttaacctggcggagccaacaacaaaccccacatgtaaacggccngcgctttcctcttcctctcttcccatctcc

SEQ ID NO: 43527 - DNA, 101 bp, rice(Oryza sativa)
  misc_feature (71): n=a or g
atgtttcttagttgtgtgttgagaggtgattcttgaatataaggtgctgctcctatttataggcagaagcnttatgtgatgatgtggataatgtgcaaatg

SEQ ID NO: 43528 - DNA, 101 bp, rice(Oryza sativa)
  misc_feature (71): n=t or c
acctcgtgatcagggcaagtgtagaaaatgcgccccagattagtaggggtcctcgatgtgcgcaccacganggtgttctccttgcataaagggcactgaat

SEQ ID NO: 43529 - DNA, 101 bp, rice(Oryza sativa)
  misc_feature (71): n=a or g
ttgctacttaggcacctttaaggattccaccccttgtcaataatgtggctaattgacaaaatcatgcttcncagctgtttgatgcagccctagcacatcta

SEQ ID NO: 43530 - DNA, 101 bp, rice(Oryza sativa)
  misc_feature (71): n=a or g
caggtgtcccaacggcaccgaggaaaaagggatagaaatagtcacagaaatttcggatctactcagtattnactataaatcatctatgaccaatacataca

SEQ ID NO: 43531 - DNA, 101 bp, rice(Oryza sativa)
  misc_feature (71): n=a or g
agatcagtgaggtctccttttgcaacacaaacagtatgccggctgatatataagctactgctgtcctaatntagtagaaaaaaacggaccgagcacgcggt

SEQ ID NO: 43532 - DNA, 101 bp, rice(Oryza sativa)
  misc_feature (71): n=t or c
tcttacattttcaaagttcaatgccatcaaaagaggaaatggacaatatcataaaaaatatgcccacaganagaggccctgggccgcatggttttaatggg

SEQ ID NO: 43533 - DNA, 101 bp, rice(Oryza sativa)
  misc_feature (71): n=a or g
aacccagacacggaataagttcacttttggttcctcaagtagccgtcgaatctggaattcatcgaaccacnataccaaatatcaaatatgatacgtccctc

SEQ ID NO: 43534 - DNA, 101 bp, rice(Oryza sativa)
  misc_feature (71): n=t or c
tcccgacaattgaaagttttggttttgttaggcaccaataaaaataaagaaaatagatggcgtgggttgangagtggagaggcgacaaaacagagggtggt

SEQ ID NO: 43535 - DNA, 101 bp, rice(Oryza sativa)
  misc_feature (71): n=a or g
gaggaagagatcggcgtgcgggtactgcggcgctagcacattccacgcaatagacggtccggtgagctcgnaccgctgtgccgctccgacgaggcagaccg

SEQ ID NO: 43536 - DNA, 101 bp, rice(Oryza sativa)
  misc_feature (71): n=t or c
ccggagtagatctcgtcggagatgaggtggatgtcgttgcgcgacacgaagtcgaggatgtcgtcgagcancttgcgcctgaccgtggtgccgagcgggtt

SEQ ID NO: 43537 - DNA, 101 bp, rice(Oryza sativa)
  misc_feature (71): n=t or g
gataatatacgacattatacatcgagtcatactcgtgctcgatggatggttgtatgggtttgtctcataanttgttgctaaacaccataaggcaaaataag

SEQ ID NO: 43538 - DNA, 101 bp, rice(Oryza sativa)
  misc_feature (71): n=a or g
ggcgtcggcgaggagcaggtagtacacggcctcccattcggggaggtaagggaagaagctggtcaggaagntcaccgatccgtcgagagatcgccggcgtc

SEQ ID NO: 43539 - DNA, 101 bp, rice(Oryza sativa)
  misc_feature (71): n=a or g
gaagatgatctccaccgatgtgttgtacttgaaccgcttcagcttggtcgccttgaacgtcggctccaacncctcctcgagcgggccgggagggatgagat

SEQ ID NO: 43540 - DNA, 101 bp, rice(Oryza sativa)
  misc_feature (71): n=t or g
cttgacatagacagcaagagcattaaggacgtggaatcttttacaactggaatgatcagtaaagagctcancgcaggtccagatccacccatagttccatc

SEQ ID NO: 43541 - DNA, 101 bp, rice(Oryza sativa)
  misc_feature (71): n=t or c
ggtgtaggaagcgcatgagggctacgaagtgcttcacagagtggatagagcatgagccaagggagaaatgntcattgatgtacgatgcggatggttcacgg

SEQ ID NO: 43542 - DNA, 101 bp, rice(Oryza sativa)
  misc_feature (71): n=t or c
aacaaacaatgagacaacacaagttactcaacggcccaagcccaactgaaaggaaaaccctagagactacnctcggtctcccactctccccgatttccctg

SEQ ID NO: 43543 - DNA, 101 bp, rice(Oryza sativa)
  misc_feature (71): n=t or c
ccccacacgcagcgaccctccggttcatctccacctcccaaaagatcgatgccctaacaacttggaagccnatctcgcctcgccgccccccttcatattca

SEQ ID NO: 43544 - DNA, 101 bp, rice(Oryza sativa)
  misc_feature (71): n=t or c
tgctggatatctggttttgaggatgttaaacctaaatgcctctataccgtgtgaagctcaatatagtcggnaagactttctttctctgtgccttgaaacat

SEQ ID NO: 43545 - DNA, 101 bp, rice(Oryza sativa)
  misc_feature (71): n=a or g
gtagtaccatcttttttaactagtcgtgctgattgtaatacacccccttttgaaacgcactgtaggaaacngtaagaggagctctccaattactccatcac

SEQ ID NO: 43546 - DNA, 101 bp, rice(Oryza sativa)
  misc_feature (71): n=a or g
ccgagcaactaacctgggggcgacatgcaagccctaccgccaccaccctcctccccattcccaaccgtacncagccggagctagccgccggaaattgagcg

SEQ ID NO: 43547 - DNA, 101 bp, rice(Oryza sativa)
  misc_feature (71): n=t or c
agccatgtaacactgaaactcatagcttccattcctagcaaaatggcttcatgttcaatagtatcaaaagncttctcaatgtccaattttaacaaaactat

SEQ ID NO: 43548 - DNA, 101 bp, rice(Oryza sativa)
  misc_feature (71): n=t or c
cggggacacaacgacgttctagtcaggtagaaccgtagaagccctgcttcgttacagagggcagcctcatnggccgccgcctttgcaacctcaatccagga

SEQ ID NO: 43549 - DNA, 101 bp, rice(Oryza sativa)
  misc_feature (71): n=t or c
atcatactgccctaaggtatcatcatcgtcatcatcattgtacaggtcatcttcttcaacttccagatccngttgcctgcgaatctgatcaactagggact

SEQ ID NO: 43550 - DNA, 101 bp, rice(Oryza sativa)
  misc_feature (71): n=t or c
ttgtcttcgtaaccgtctcgacgtattaccgatggtggtatatacgaagtacttttcatatatatagacanacacttttcaacgtgtaagatttttgtgtg

SEQ ID NO: 43551 - DNA, 101 bp, rice(Oryza sativa)
  misc_feature (71): n=a or g
atgaaacatggggtggatatgagaagtttcatatatgcaagagaagcttataggtaataacctccaccttnttgatcaccctgaaagacccatagtaatag

SEQ ID NO: 43552 - DNA, 101 bp, rice(Oryza sativa)
  misc_feature (71): n=t or c
gtgaagcaatttcccaataggctcaagatgaggacttcccgtaaaattacataaatctaagactaacacgngcacaactttaaagctccatagcgggggca

SEQ ID NO: 43553 - DNA, 101 bp, rice(Oryza sativa)
  misc_feature (71): n=a or g
atcatcccggaatatccgaaacgcaagctaactcgatcttacctagaagttggaatatccaatcaatctgnaatgtttgatattgtgatgaactaagtgtt

SEQ ID NO: 43554 - DNA, 101 bp, rice(Oryza sativa)
  misc_feature (71): n=a or g
ccatctatgagacaaaaaaaatcacactcataaacaaggggatttgattcttacctaaacctggaggttgnggaggcggcggaggaggtggggaagagggt

SEQ ID NO: 43555 - DNA, 101 bp, rice(Oryza sativa)
  misc_feature (71): n=a or c
ggtcatgacatgctgaaagttgcgccaatacttccagggccacaaggtcgtggtcttctacttgtaccatntctgagaagttgttctcaataaagaagtca

SEQ ID NO: 43556 - DNA, 101 bp, rice(Oryza sativa)
  misc_feature (71): n=a or g
tgctagggtcagagccgaggttgatgggattgttgatattttctaccagcaatatttttaggtgggttacncacgagatagaaaagcgatgaatgcggaag

SEQ ID NO: 43557 - DNA, 101 bp, rice(Oryza sativa)
  misc_feature (71): n=t or c
gggctattactttcacaaaataatcaggttgcttgtcctatctaattctggtagctgaattaagtccctanacattgcaaattgcagtactttctttaaca

SEQ ID NO: 43558 - DNA, 101 bp, rice(Oryza sativa)
  misc_feature (71): n=t or c
aaaggggtgatggcggtggtggtcaacagcagtaaaagggtggtggcggtggccaaggggccagatcacanggtggaagaaggggagcagcggtggaggcc

SEQ ID NO: 43559 - DNA, 101 bp, rice(Oryza sativa)
  misc_feature (71): n=t or c
aacctacaccaacctcatattcctctagccgatatattgtcggtcggctagagaagacactaaatctagtngttatgctaccaactctagcaacgactagc

SEQ ID NO: 43560 - DNA, 101 bp, rice(Oryza sativa)
  misc_feature (71): n=t or c
gccaactttttttagtttcaaaggacaaactttatttagtgacaatctcagagaatcggaggcaactctcngctgccaccaaccatcccacacacaagcac

SEQ ID NO: 43561 - DNA, 101 bp, rice(Oryza sativa)
  misc_feature (71): n=a or g
cgcgaactcatttttttctcctgtggcaaacagcctgaaatctgcgggaggaacgacgacaccgacgacgncggtgccgggcgtgaccacggacgccccac

SEQ ID NO: 43562 - DNA, 101 bp, rice(Oryza sativa)
  misc_feature (71): n=t or c
tattcagctttcccgtatgcatttggacaggtaatttgtcttttagactctcggttggcctagttctaatntcatgtatataatgtatgacttcaaagact

SEQ ID NO: 43563 - DNA, 101 bp, rice(Oryza sativa)
  misc_feature (71): n=a or g
ctatggagtaatatagatgtttacctaaagagaaatatatctagtctatggcaaaagggtacgtagcctantggttacaagagtctcagtagcaccatagg

SEQ ID NO: 43564 - DNA, 101 bp, rice(Oryza sativa)
  misc_feature (71): n=a or g
ggtgtggtttgagcctgacaagttcatcccggagaggttcctgcagaaagaggtggatttccgtggtcgcnacttcgagctgattccatttggctccggcc

SEQ ID NO: 43565 - DNA, 101 bp, rice(Oryza sativa)
  misc_feature (71): n=a or c
tgctgctgctgaagagaagagaggtgataccaagcttggtcttcttcttcttcctattcaccatggctagntaatgtattgatatggatgggatcagacaa

SEQ ID NO: 43566 - DNA, 101 bp, rice(Oryza sativa)
  misc_feature (71): n=t or c
ttttttgtaataatatgctcactgttagcttgtacactgtaccagtactacaacaaacctatgattgtaanaagtctatttaaagcaccacaagacaaaaa

SEQ ID NO: 43567 - DNA, 101 bp, rice(Oryza sativa)
  misc_feature (71): n=t or c
gtgacccaaaggggtaacacagctacaacttcgtatcgatgtagtggcaaaaagtctaccgatggtgaggntacaccgagaagtgtacctcttagcactgt

SEQ ID NO: 43568 - DNA, 101 bp, rice(Oryza sativa)
  misc_feature (71): n=a or g
gcaggcaagtccgtgtgtgtgtataaactagttcagcacggaacgaactcacagcacagcacaatgtgtcnttctgcctgctttttttagaatgatatttt

SEQ ID NO: 43569 - DNA, 101 bp, rice(Oryza sativa)
  misc_feature (71): n=t or c
gtttagtttggattggatttgtttatattttacagcacacgatctactatacttttgatacgtactacctncgttccaggttataagactttctaatatta

SEQ ID NO: 43570 - DNA, 101 bp, rice(Oryza sativa)
  misc_feature (71): n=t or c
gagaaaggacgcctacacattctccacacatcttcaggagacagttgagagtctctttgttaggccagttnctatctagacgatactaatcaatttttagc

SEQ ID NO: 43571 - DNA, 101 bp, rice(Oryza sativa)
  misc_feature (71): n=t or c
ttgcccatgtcagcatcagcctccttggtcatggtgagggaaatcggtgtcatcatggccgtcgatgaaantaagggtgcagatgaggccggggtggctgg

SEQ ID NO: 43572 - DNA, 101 bp, rice(Oryza sativa)
  misc_feature (71): n=t or c
accagactagcggttcgaccggaaaaactggaaccaggaccccatggtccggtccccttaaaagatcaagnatgcaattgggcggtttttatataaatcgg

SEQ ID NO: 43573 - DNA, 101 bp, rice(Oryza sativa)
  misc_feature (71): n=t or c
ggtatggatagagtatcaaaaatattgctgtctagaaagggacgtccaagcttttttgatagacacaaggnttatggagacgcgtgaatatttcacctact

SEQ ID NO: 43574 - DNA, 101 bp, rice(Oryza sativa)
  misc_feature (71): n=a or g
caattagcaggccaagtaacagggaaatggcgtgacatttttcttcttttgattgttgtgccgtttggctnaacctgtactggtatgatcatttctagtaa

SEQ ID NO: 43575 - DNA, 101 bp, rice(Oryza sativa)
  misc_feature (71): n=t or g
gtacttgtgggtatacggatcacgtacacatgcgtacgtgtctcatccccggacgacagtgccagcagcanctcacccctgtcgctccgccgccagccacg

SEQ ID NO: 43576 - DNA, 101 bp, rice(Oryza sativa)
  misc_feature (71): n=a or g
aaaaaatgttacgtgtaagatttgtcaatgtcatgataaactttcactcctagatactcgaagatgccacnaattttagtattaaatttgtttccaataca

SEQ ID NO: 43577 - DNA, 101 bp, rice(Oryza sativa)
  misc_feature (71): n=t or c
ccccgagattacaacaagtgaacatcagtcatctcttttgttcttctcctttttttccccttttgttacantaaagaaatgtggtatgatctgttcttgta

SEQ ID NO: 43578 - DNA, 101 bp, rice(Oryza sativa)
  misc_feature (71): n=a or g
gacatggaccatatgcatctgtttgagtgcaactgggatccctatgatgactcacaaggtgacattgtgcncgacagtgccttgagtggaatcaatgtcgc

SEQ ID NO: 43579 - DNA, 101 bp, rice(Oryza sativa)
  misc_feature (71): n=t or c
ttgcaaagctgcaaatggttcctagcaaatttacacacttccacccatacaagtgacccaaaacacaatanccaacactgcaccacccacaatgaggcctt

SEQ ID NO: 43580 - DNA, 101 bp, rice(Oryza sativa)
  misc_feature (71): n=t or c
gagttggcatatatgtgaatgtgaggcatgacagcagtaaaacccatgctgtttaaatgcagtctccagtngttgctcgctgacacatggctgcaaggccc

SEQ ID NO: 43581 - DNA, 101 bp, rice(Oryza sativa)
  misc_feature (71): n=a or g
aattaattaattaattatttgaaatcagatgtagtagtacaaactatggatcggcaacatgcatgtgcctnctctttattcgaagtcaactgccgtggagg

SEQ ID NO: 43582 - DNA, 101 bp, rice(Oryza sativa)
  misc_feature (71): n=a or g
cgaggaaattgatccaggtcttgactacattggcttccacattacatgacgcgatagattttgagaggtcntcctcctaagttgatatggaaagaaaaaca

SEQ ID NO: 43583 - DNA, 101 bp, rice(Oryza sativa)
  misc_feature (71): n=a or g
acctgattgatctagtctgcaaaacttcctccaaaaacagatctgttatcttttctctctcctcttcctcncgcaagagaaacaagcacggccgaatacag

SEQ ID NO: 43584 - DNA, 101 bp, rice(Oryza sativa)
  misc_feature (71): n=t or g
gtcaggtacagtggcaaattaagcaaaaccgttgaagggaaaacgtgttcacgaaaatacagccaagatanaagtcgtcataatgaaaaaaaaaactagaa

SEQ ID NO: 43585 - DNA, 101 bp, rice(Oryza sativa)
  misc_feature (71): n=t or c
atcgcttgaggtcgagctcccatgattcttcttcccctgcaactgcgagatggatagcagaatttcctttnccccaaatgccttgaaaatttgttgttttc

SEQ ID NO: 43586 - DNA, 101 bp, rice(Oryza sativa)
  misc_feature (71): n=t or c
cgaggtactagaggttgggaaaagcgaaaaacgaacacaccttgatttctttgtaatatacctccggtgcngttgtgcaatattgaagcatctcacgcagt

SEQ ID NO: 43587 - DNA, 101 bp, rice(Oryza sativa)
  misc_feature (71): n=t or c
tacaaagatggatgcaccagtgtgtttttgtcctaccttcttgtcagattgtgcagccttgaggaaccttntcatgaaacagtatggagttggaactgaca

SEQ ID NO: 43588 - DNA, 101 bp, rice(Oryza sativa)
  misc_feature (71): n=t or c
gatctgagccgttggattagacgacccgacgtttcatatttcacgtgtctgttaagtgcgtctgctatgtnagaagtcacgaccaccactacggatttttc

SEQ ID NO: 43589 - DNA, 101 bp, rice(Oryza sativa)
  misc_feature (71): n=a or g
catcggcttgtaaggatttcatatatatatcgactcccttatcgactccccggcctctggcgaatgctgantagatgttgctgtgtcttcggctcctcata

SEQ ID NO: 43590 - DNA, 101 bp, rice(Oryza sativa)
  misc_feature (71): n=t or c
gaaagcagcttcaggcttcaccttggctgtgacgatcgatgaatcaagggcaccatgtgatcagtgtgtantacctataacctactccatccgtctaaaaa

SEQ ID NO: 43591 - DNA, 101 bp, rice(Oryza sativa)
  misc_feature (71): n=t or c
cgcatttgtactccgaaactacggatatcccgttctgctcggtgtcagttgccggcgttcacattgctgancgtcagggtggagtcaccaacaccatcaaa

SEQ ID NO: 43592 - DNA, 101 bp, rice(Oryza sativa)
  misc_feature (71): n=t or c
tgggagggggcaagacacggcgggaacttggcttttgggtggtgcaacaaccattagagcagtgcgacctngacactgaagaccagtgatcggtgctgcct

SEQ ID NO: 43593 - DNA, 101 bp, rice(Oryza sativa)
  misc_feature (71): n=a or g
gcgggagaagtggggcagttaaagccaccccccgccaagccgggtttttatatagaaatcatagagaagancggaagaagagagaatcagacaagccacac

SEQ ID NO: 43594 - DNA, 101 bp, rice(Oryza sativa)
  misc_feature (71): n=t or c
cgcaaccttgcaagctctttcaacctcctccatgttgatatcaccttgtaattggtgatcgaccaaactcnccacatctccctttagaagattacgcgcag

SEQ ID NO: 43595 - DNA, 101 bp, rice(Oryza sativa)
  misc_feature (71): n=a or c
cccatgcaacattgaaactaaccacttgtagtagcgattcgtttggcagcacatgttgcacttcacatcanagaatggccatatactatgaacgtcgatga

SEQ ID NO: 43596 - DNA, 101 bp, rice(Oryza sativa)
  misc_feature (71): n=a or g
ccccgacagtgttgatgtcgagtgattccggccatccttctccacgaataatttgcacacggcgacagggntattggcagtgtccggccggacagcgacag

SEQ ID NO: 43597 - DNA, 101 bp, rice(Oryza sativa)
  misc_feature (71): n=t or g
ggagctgatgcccaactatctgcagtatgacacgatcatatgggccgtgatatcactgctgcttgttctgncatggggggttggcctgctcatgcttctct

SEQ ID NO: 43598 - DNA, 101 bp, rice(Oryza sativa)
  misc_feature (71): n=a or g
aagcaatccacatggaaaaagatggacatatttcaatgtttgctgctgtctctagccgatatgcccaagantgagtccatgctatcagctgcaacttactt

SEQ ID NO: 43599 - DNA, 101 bp, rice(Oryza sativa)
  misc_feature (71): n=t or c
acataattatcattggggtttattttttacttttataagacccgtcaacttaatggcctactcatcgtccntcctcttaatggtcattgagattctatttg

SEQ ID NO: 43600 - DNA, 101 bp, rice(Oryza sativa)
  misc_feature (71): n=t or g
ggccaaatgcgaatggctttggtgaaacgttctagagcagagagagatcttttgagcgctcgtttttgttncgtagctcaacttgttttgaacactgtggc

SEQ ID NO: 43601 - DNA, 101 bp, rice(Oryza sativa)
  misc_feature (71): n=a or g
gttgctacaatatggtattagagccatcgattcgtggggtttcttttctagtgtggggaagatctgcagcnatgtcccatgcaattcgctgtcagatatag

SEQ ID NO: 43602 - DNA, 101 bp, rice(Oryza sativa)
  misc_feature (71): n=a or g
aaaatttcaaccgagataatgccttactgggggtccaaaattttgaaccaaattaaaattgcattcacggnccaccccgccgccaccaccattgaccactc

SEQ ID NO: 43603 - DNA, 101 bp, rice(Oryza sativa)
  misc_feature (71): n=a or g
aaaagaacgaaagaaaaggtttccgttgttagatttgctatcgagaaattaagattctgctcctctgcatngttggttcctagggtggaggaactttctca

SEQ ID NO: 43604 - DNA, 101 bp, rice(Oryza sativa)
  misc_feature (71): n=a or g
tacaattggttcttgacgtcaatgatattggtgtcgtccccccttcatataagtgacttagcatgtacagnaagtctagggggatgatgttaatatcattg

SEQ ID NO: 43605 - DNA, 101 bp, rice(Oryza sativa)
  misc_feature (71): n=t or c
ccaatctcttcttcagacttttgtttatcttgcagtggtgcttctgactgccacaagatgcctatgttggngggtctgcgtgggggagaatggatccatct

SEQ ID NO: 43606 - DNA, 101 bp, rice(Oryza sativa)
  misc_feature (71): n=t or c
attgatgagatctataacttaactgtgcatgttgatgtttgtcaactcttgaagagatacagttggattantctgctatgacttaaacaaaacatgcaacc

SEQ ID NO: 43607 - DNA, 101 bp, rice(Oryza sativa)
  misc_feature (71): n=a or g
aggcaaactaatccctgtattactccattatccattcgattcccacgaggccaccaccatgcgagcggagnggagaatacggcggccatcaggaggagcgc

SEQ ID NO: 43608 - DNA, 101 bp, rice(Oryza sativa)
  misc_feature (71): n=a or g
tttggacgggataataaattagatgactatcaaacgatatctcagaggcattacccgtacgttcgaacggnatatcagcatacctaccagatagtatcatc

SEQ ID NO: 43609 - DNA, 101 bp, rice(Oryza sativa)
  misc_feature (71): n=a or g
ccggcgtcactgctcgtgttttgtggtgttgagttcgttcagcacacaaaaattcacaagacaaaaaacgnggagtttcagcaacaattaatcctatatat

SEQ ID NO: 43610 - DNA, 101 bp, rice(Oryza sativa)
  misc_feature (71): n=a or g
ttttgctagagatctagccactttctttgatcgacatatatatccatcgagataaaaggagatagtgacangtaattaacttagttttttccaataacgaa

SEQ ID NO: 43611 - DNA, 101 bp, rice(Oryza sativa)
  misc_feature (71): n=a or c
aaagcgagaaaatgtaaaaatacaggcacaaaggggagagaagctagagcactaaaaaaatatgtacttcntccatttcacaatgtaagtcattatagaat

SEQ ID NO: 43612 - DNA, 101 bp, rice(Oryza sativa)
  misc_feature (71): n=t or c
agaagggtctctcacgcaacatgaattcggcttccgatactcgcagaatatatgcatatggtacgagaaangctccaaaaaatattggagataagtcactt

SEQ ID NO: 43613 - DNA, 101 bp, rice(Oryza sativa)
  misc_feature (71): n=a or c
cagatcaaatacacaacagaagtagtagcgtgcgtagcagtaattaacatgtgatcgccacattaaaaaancgaagcgataataatcagtggtggccggag

SEQ ID NO: 43614 - DNA, 101 bp, rice(Oryza sativa)
  misc_feature (71): n=a or g
gaagaatagtcagggtatggactgtggacaatcaagagccttgtagaaatagcagaaaatgattgacaacnccactgaatgattggcgaccttttgacact

SEQ ID NO: 43615 - DNA, 101 bp, rice(Oryza sativa)
  misc_feature (71): n=a or g
cttaattaattaggtggagcatgcatgtctacgctcctgacaaattttctttattagtttactttaggtgncatgcaaagtttcctccataaaaattttgc

SEQ ID NO: 43616 - DNA, 101 bp, rice(Oryza sativa)
  misc_feature (71): n=a or g
ctctaaaggttcacgtcaaaaatccccttacggtctaaaggttcgttaaccgcgttttaatttgcacaacntaccattccacatcaaaattttattaattt

SEQ ID NO: 43617 - DNA, 101 bp, rice(Oryza sativa)
  misc_feature (71): n=a or g
tcaagcgactccccggcctccatcaccatgctggcgaattctcctttcagagtctgcaggcgcgcgtcgcncaccttgtctgccccgacgaacctcgtctt

SEQ ID NO: 43618 - DNA, 101 bp, rice(Oryza sativa)
  misc_feature (71): n=a or g
aataagagagcgccagtatgcatgcttatggatggacccagagagcagcttaatagagagaagtagaagtnagggcgctaagctgaaggaaaaggctgaat

SEQ ID NO: 43619 - DNA, 101 bp, rice(Oryza sativa)
  misc_feature (71): n=a or g
ctaaaggaattggaggatcttaagaggaaggtggtggaaatccaaaccaacaaggatttagtggaggtagngaatgataaacttcggttggatgttttatc

SEQ ID NO: 43620 - DNA, 101 bp, rice(Oryza sativa)
  misc_feature (71): n=a or g
ggacatggagaagctgccgttgcggtcgaagtcgaggaggaacacgccgacgcagtggtggtacttcatcncctccatgcgagggatcaccttgtgccgcc

SEQ ID NO: 43621 - DNA, 101 bp, rice(Oryza sativa)
  misc_feature (71): n=a or g
ccacccgttcctttgcgccaaacccccgctggaagtggtcgtcaccgtgaagccgatctaatctatctccngccgcgctgttcgtcgtcgtctatcgtcgc

SEQ ID NO: 43622 - DNA, 101 bp, rice(Oryza sativa)
  misc_feature (71): n=t or c
tcagggagctgcttgcctggtggagcctctcaccactgcttggcgtcatcatgtcggccccaaactccgcngccagatccagtagttggttgtgttagccg

SEQ ID NO: 43623 - DNA, 101 bp, rice(Oryza sativa)
  misc_feature (71): n=a or g
aggtggcaggcggcgggcaagacggagattttggggattttggggatgatttggggcatgattttgtgatntaaatttgtggatgatttttagatgttttt

SEQ ID NO: 43624 - DNA, 101 bp, rice(Oryza sativa)
  misc_feature (71): n=a or g
tggagtccgggaggctgccttaggtggtcttctcgagctggcgcgggacaatacatccggtgctggaaacntgctacctgaccaagacaagctgaaagatg

SEQ ID NO: 43625 - DNA, 101 bp, rice(Oryza sativa)
  misc_feature (71): n=a or g
tcctgctacccatatatgtgctgccaatcatgctcccgggtattctgatggctctagatgttcaagcactngggatggcaacggagcggggcagggccgga

SEQ ID NO: 43626 - DNA, 101 bp, rice(Oryza sativa)
  misc_feature (71): n=t or c
ttcccaatcaaatattatataatccatattttaatttgaacacgagacatccatatgaaaacatatgattngatttcgctagaaatctgtcgtgtgatttt

SEQ ID NO: 43627 - DNA, 101 bp, rice(Oryza sativa)
  misc_feature (71): n=a or g
aataagttcactttgactccattactctgaaccgcaaaactagatatcttatctctaaactgttaaaaccngtgcaatttgattccctcgacgattttaac

SEQ ID NO: 43628 - DNA, 101 bp, rice(Oryza sativa)
  misc_feature (71): n=t or c
ctcatctctacttccaagatctcaagaactgaattaagacagtttcatcaggctttcagttagatcgattntgcagtaattacaggttataagatggccac

SEQ ID NO: 43629 - DNA, 101 bp, rice(Oryza sativa)
  misc_feature (71): n=a or c
tattagtgttaggtgtaatttaaaccatatatgcacacaagtacaactcagtgctgccaagacaatgtagnaaagtagttaattagcttcccaaatgtcat

SEQ ID NO: 43630 - DNA, 101 bp, rice(Oryza sativa)
  misc_feature (71): n=t or c
atggtacatatgatcttaacagaacaatcgatcactttaaaaaaaagaacaatcaattttagtactctctntatctcatattatataaaacttttgtatta

SEQ ID NO: 43631 - DNA, 101 bp, rice(Oryza sativa)
  misc_feature (71): n=a or g
aaaactcttacattcttttttttggcgaatacgcatcattaagacgtaatgaggtgtttgagtacatcgcnaacgaacagaattacaaagaaagacaatag

SEQ ID NO: 43632 - DNA, 101 bp, rice(Oryza sativa)
  misc_feature (71): n=t or c
catgaggccaaagctctggatggagctgagagttgggacataaagcaaaggagagcttgtcgatcatcttnggttccaccggtgaggaccagtggaaggaa

SEQ ID NO: 43633 - DNA, 101 bp, rice(Oryza sativa)
  misc_feature (71): n=a or g
ttttcttttggggaaagtaaacaggcccttacatccttataatagcttaaatgctcaatccacttccagantagctagcagtgtaaagcagaatttttaat

SEQ ID NO: 43634 - DNA, 101 bp, rice(Oryza sativa)
  misc_feature (71): n=a or c
attttaccaaactaattaatgttaaaaaaatcataaggtgcctaaaacgtgtgataagagtaacctgactnagagtaaggtggcaactgccagcatctccc

SEQ ID NO: 43635 - DNA, 101 bp, rice(Oryza sativa)
  misc_feature (71): n=a or g
ttgcattgtgatggtttgttgatacagatgatatactaagaccctttttatttgcatgagactgaaggagncttgtgtctttgaaaattggaacaagtagt

SEQ ID NO: 43636 - DNA, 101 bp, rice(Oryza sativa)
  misc_feature (71): n=t or c
ttcaacatacaaatacaaacaaaaataataagtttaactccgaattgaatgcataattcatatagccaaanttattgttttttttctaattatatttgtcg

SEQ ID NO: 43637 - DNA, 101 bp, rice(Oryza sativa)
  misc_feature (71): n=a or c
ccttaaaaaatattgttaccaaactccagtttccccatgtactcgtatgttaccttcttggacctagaggnatgacagaaatgaccttaactttcataaaa

SEQ ID NO: 43638 - DNA, 101 bp, rice(Oryza sativa)
  misc_feature (71): n=a or c
cactttacccaggttggtctctttgtgaccaaaactgtcagtctgtcacttgctggactaagcaatggtanttgctcttaactctctttggagacttacta

SEQ ID NO: 43639 - DNA, 101 bp, rice(Oryza sativa)
  misc_feature (71): n=t or c
ggctttgcatgcagaagctagccggacagttgctgcctactgatccactcccactgtcctaaaataagtgnaaccgtgagttttcatgtctaactttgatc

SEQ ID NO: 43640 - DNA, 101 bp, rice(Oryza sativa)
  misc_feature (71): n=t or c
gctcataagtttcttcttcgtttctgctcccagtgctaaggcagcacagtcgttcgtcgccatgccagggntcaccatcggcgacaccgtccccaacctgg

SEQ ID NO: 43641 - DNA, 101 bp, rice(Oryza sativa)
  misc_feature (71): n=t or c
gaagatgaacacaatatccagcaacgctatgcgccaattcatggacaaatgctttaaccgcaagcacacancacgcaccccgatggtgaggatggagagcc

SEQ ID NO: 43642 - DNA, 101 bp, rice(Oryza sativa)
  misc_feature (71): n=t or c
ggcggcggcgccgtcgtggccatcccgaagtcgcaaatcgcgcgaagcccgggccgacgaggatgttgccnggcttgatgtcgcggtgcgccatgccggcg

SEQ ID NO: 43643 - DNA, 101 bp, rice(Oryza sativa)
  misc_feature (71): n=t or c
atctttgttttcatctccttcattcttcttcccggagtaacttggtttttatgttctcggaatggaagagnagacctcgagagtagacttgccggccaaga

SEQ ID NO: 43644 - DNA, 101 bp, rice(Oryza sativa)
  misc_feature (71): n=a or c
ttatatttttagtaatatcattaagaaatatcaacaaccttggaaacctgctggcttcatatttagttatncgctggctttaaatatggaaattttagttt

SEQ ID NO: 43645 - DNA, 101 bp, rice(Oryza sativa)
  misc_feature (71): n=t or c
taaaattagaagtttaaagagattgaaacgatgtgagaaaaattaaaacatagtatagaaaaatttgatgngagaggttaaaagtttgaaaacagatcctt

SEQ ID NO: 43646 - DNA, 101 bp, rice(Oryza sativa)
  misc_feature (71): n=a or g
cctttttctatccatttaataatataatagatgttttttttgtcgatggtatattgtagaatgtggcttcnctgatgcatatatatttgtagattatgttg

SEQ ID NO: 43647 - DNA, 101 bp, rice(Oryza sativa)
  misc_feature (71): n=a or g
ttgacccgtctgaaaaaattgtttttcacattggctctgtagtatgtacgcttcaggctaaagcgttttantatacatccatctatctatctcgatcgatc

SEQ ID NO: 43648 - DNA, 101 bp, rice(Oryza sativa)
  misc_feature (71): n=t or g
agacatgacatcacgtccaactactagagtaactcacatctagcagaatatttactatgcaatttggacanaagtggacttgtaaagttagggtcatgggt

SEQ ID NO: 43649 - DNA, 101 bp, rice(Oryza sativa)
  misc_feature (71): n=t or g
ttactagactcttatagtaacgttgtgatagaactgtagtaacgtgtaacgtacagttgcaacaagtaatnctattgtattactacttgtggagagtcaaa

SEQ ID NO: 43650 - DNA, 101 bp, rice(Oryza sativa)
  misc_feature (71): n=a or g
tcgaagtgcatcttgtgatgcttgtaaaaattgttggctgggtgagtttacaatcgttgttgtaacgtgcnatggtgatagtttattagtttagtttatgc

SEQ ID NO: 43651 - DNA, 101 bp, rice(Oryza sativa)
  misc_feature (71): n=a or g
gatccctcataccataagcttcatgaggagagctgcggtggagctccgctgtctaagctcgagctccactngcctccgcatttgcctcagcctaattctag

SEQ ID NO: 43652 - DNA, 101 bp, rice(Oryza sativa)
  misc_feature (71): n=t or c
tcctccattgtgcaaccgtgcaaccaatatcgctgcaccttagcgtgaaaacgataataaaaatgaacaantacaaatttatcattattttgaatcgttat

SEQ ID NO: 43653 - DNA, 101 bp, rice(Oryza sativa)
  misc_feature (71): n=a or g
gtcgaggccgccgctcccgggtggctcctggctgctggaccgctcgaatctacgcttcttgcctgtgggcngcgccgccgccgccatcgccggcggcaaac

SEQ ID NO: 43654 - DNA, 101 bp, rice(Oryza sativa)
  misc_feature (71): n=a or c
ttgtagctagctagagcccagagtactatactagctgctagctagctatagcgctatagtggtcacataantgatctggactctactgtactactcttttc

SEQ ID NO: 43655 - DNA, 101 bp, rice(Oryza sativa)
  misc_feature (71): n=a or g
gtgaattccttctcctcaactgaataatccagaaatatgtaaggagcgagatgagggagcaagaggactgncctgagatgctattcctagacgtcgttgct

SEQ ID NO: 43656 - DNA, 101 bp, rice(Oryza sativa)
  misc_feature (71): n=t or c
tgagacagaggcagtaccacactaccactacataagaacatacagaaacatcgttgttagtttgttactanagtacatggcatggttcgcaatggaaacaa

SEQ ID NO: 43657 - DNA, 101 bp, rice(Oryza sativa)
  misc_feature (71): n=a or g
atggaggtcgatggggatcgatggagcaagtcacaacgggagtcaatgagtacagaaggagcatagtgtgngtgtgtcttacatcatgggatccgttcgac

SEQ ID NO: 43658 - DNA, 101 bp, rice(Oryza sativa)
  misc_feature (71): n=t or g
tagttaaggggaaaacaaggttgaatgccagaattagaggtccaaccagctggattacgctgaaagagacnctacaatccttaccattagaccctgttttt

SEQ ID NO: 43659 - DNA, 101 bp, rice(Oryza sativa)
  misc_feature (71): n=a or c
atttattttagcattctttttcttgaacaacaaataagatgcccgtgtatatgtgggggtttcttttccgntttatattctgaaaatatcctccattttat

SEQ ID NO: 43660 - DNA, 101 bp, rice(Oryza sativa)
  misc_feature (71): n=a or g
acgaaaggagggtcatgtctaaattcgtagtcctagtatgggacctagattgttacattatgggacaaagngagtagcaaataatagtccttttggcctct

SEQ ID NO: 43661 - DNA, 101 bp, rice(Oryza sativa)
  misc_feature (71): n=t or c
taattctcactctctccaacagttcttgccttctatcagtccaaagctgtccaagaccgaacgctgccatntgcttcacttttgtccaaagcccttggcca

SEQ ID NO: 43662 - DNA, 101 bp, rice(Oryza sativa)
  misc_feature (71): n=a or g
gtcactcggaagtatttatgatgttggctgtttgttgttcattccatgagtgcactttcagggaacgtgcngtttttttttcttctgaacatttcaaactg

SEQ ID NO: 43663 - DNA, 101 bp, rice(Oryza sativa)
  misc_feature (71): n=t or c
tcgactccagcaggctgcgcacgtacccctccctccgcttggatctgcatcacagaaaaagaaaccgaggngaatttgaggttcttgcccatgcgacgcag

SEQ ID NO: 43664 - DNA, 101 bp, rice(Oryza sativa)
  misc_feature (71): n=t or c
ctttctttgtgatctctacatactcccatcgcatatattcatataccttgtctgctggtttttcgataatnatagatgcaagagctggaagtacaacttct

SEQ ID NO: 43665 - DNA, 101 bp, rice(Oryza sativa)
  misc_feature (71): n=t or c
tgttacagatttatagccaactatagcacgaacttcaggatatagcacgaacttcaggatgatgtgtgtanaaaaggtggctcaagtattaatggtttagt

SEQ ID NO: 43666 - DNA, 101 bp, rice(Oryza sativa)
  misc_feature (71): n=t or c
tagtgggaaagtgagtactcccccatgaacattcggcgtgatgcacgcagggaattatataggtttagtcnacacagatgcgtgataccctactcttgtgt

SEQ ID NO: 43667 - DNA, 101 bp, rice(Oryza sativa)
  misc_feature (71): n=a or c
acatgtggagattgatttacattttgttcatgatcgcgttgctgctggttctgttcgagtgcttcatgttncaacgacatcacagtacgcggacatcttca

SEQ ID NO: 43668 - DNA, 101 bp, rice(Oryza sativa)
  misc_feature (71): n=t or c
aacccagtaaactatgacacgcctaacatttgggtgtggcaatttgtggccttcatgtaaacattcccttnaggatatttcttaagaatgttgaataagat

SEQ ID NO: 43669 - DNA, 101 bp, rice(Oryza sativa)
  misc_feature (71): n=t or g
tctttcgtttgtaacacagtggaaaaaactagctccggcaaagctaaggggggaggtggagactgtacaanggttgtttcttgccagcattcgcgagacag

SEQ ID NO: 43670 - DNA, 101 bp, rice(Oryza sativa)
  misc_feature (71): n=t or g
tcgcaattaacctgccacgttagctgaaatcacttctcaacaccaccgaaagagttcatttgcgtcagttngtaaaggtgggtgaagtgctatactcggtt

SEQ ID NO: 43671 - DNA, 101 bp, rice(Oryza sativa)
  misc_feature (71): n=t or c
aacaactgaaataaacaaaattatgaaacatctattagtacactgatgaggacattactggctcagacatntattagctgcctttcgcatagaaaggtgca

SEQ ID NO: 43672 - DNA, 101 bp, rice(Oryza sativa)
  misc_feature (71): n=t or g
agagaaggacgagaaaaagggaaaaaaaaaacgaaggaggggagcgaaattaaggagaaaggaatgagcgntggggctaccacccattgcagatctgggtg

SEQ ID NO: 43673 - DNA, 101 bp, rice(Oryza sativa)
  misc_feature (71): n=t or c
aacgtagtggattctatgttcctctacggtgctcaagccttttatgttcctctgatgtagaatctggttgnggaaccagatcctctaacgtagtggattct

SEQ ID NO: 43674 - DNA, 101 bp, rice(Oryza sativa)
  misc_feature (71): n=a or g
gtgtgaattactagtagtataaatatctatacatgatgtttttacaatctgtaccgaactgagaaagaggnaaaaaaagagagagatttttttttagtgtc

SEQ ID NO: 43675 - DNA, 101 bp, rice(Oryza sativa)
  misc_feature (71): n=a or g
cttcgcatggcgtccttaattatttgggatgaagctgcaatgacaaagcgtcacgcggttgagactcttgntagatcccttcaagacattatgggttgttc

SEQ ID NO: 43676 - DNA, 101 bp, rice(Oryza sativa)
  misc_feature (71): n=t or g
ggtagcttcaactcaagcactataaaatggacaggtttgatttgatgctaaaattgcattaggtaaggctntgtttagttcacgccaaaattagaagtttg

SEQ ID NO: 43677 - DNA, 101 bp, rice(Oryza sativa)
  misc_feature (71): n=a or g
aacagagagaggggaaagtatccgcatcgttatagcctggttaagtggtacttactttcttactttctccntcttatctctactacttaaaaaatccgtag

SEQ ID NO: 43678 - DNA, 101 bp, rice(Oryza sativa)
  misc_feature (71): n=t or c
ctttcactcgcatcctccggtgaaaaagaaccctcgagggatccggttctaacttctactacctcttctgntggccacacaaaaaaacggggacaaaaacc

SEQ ID NO: 43679 - DNA, 101 bp, rice(Oryza sativa)
  misc_feature (71): n=a or g
cttgcagttgcagccatgatagattgatcgacactgtcactcatttcgcgacgagtcgccttagctgtccngcgatcgatcatgcgccgctgcaccgcaca

SEQ ID NO: 43680 - DNA, 101 bp, rice(Oryza sativa)
  misc_feature (71): n=a or g
atcacttctgacccattcaagctcaagccggcaggttagatctatattttccagccagatttcccaatttntttacatgtatgcactgacaccacaagtta

SEQ ID NO: 43681 - DNA, 101 bp, rice(Oryza sativa)
  misc_feature (71): n=t or g
gagaaagaattgaaggagaaaagccgtggaattatgccgcacaaatctctcatgttttgtccgactacggntgtaaaaaaaagaagtccattttactttct

SEQ ID NO: 43682 - DNA, 101 bp, rice(Oryza sativa)
  misc_feature (71): n=t or c
tagtaagctacttatatgcatgaatggtaacccatgtcatatggaagaaaattgcccgagatcagtagtantacctccttcccaaaataattatatttcta

SEQ ID NO: 43683 - DNA, 101 bp, rice(Oryza sativa)
  misc_feature (71): n=t or c
ttgaatgattcatccaggcaaactttcttgtttttaattaatccaacttcaggagtatgatacatctgagntgaaaaattgaaaaaaatatcaaatcatta

SEQ ID NO: 43684 - DNA, 101 bp, rice(Oryza sativa)
  misc_feature (71): n=a or g
ctctggctggatcctttgctagatgccatcagatgtgtcagcttggtgccgcatatcacttggagaaagancatctacaacagcatggctatttttgcctt

SEQ ID NO: 43685 - DNA, 101 bp, rice(Oryza sativa)
  misc_feature (71): n=a or c
aagttagcgtatataatactccctccatcccacataaaaccaatttagcattggatgggccgttcctatantaacgaatactagaatgatttttttgggac

SEQ ID NO: 43686 - DNA, 101 bp, rice(Oryza sativa)
  misc_feature (71): n=t or g
cgaaggacatattaagcaatgaccgacctaagcttcatcatctccacgactagtcgatctcggtgacactnccaccgctgaagcccagctcctctccgtcg

SEQ ID NO: 43687 - DNA, 101 bp, rice(Oryza sativa)
  misc_feature (71): n=t or c
cgattaactggtaattggtcatatttatcattagagtaaaatgcattagcggtctttgaacttgtagggtngtgtcatatagatccctaaactctcaaaat

SEQ ID NO: 43688 - DNA, 101 bp, rice(Oryza sativa)
  misc_feature (71): n=a or g
tgacacggagacctggtcaactactcttttgttaaaagaatgcatttttaggctgtgatggatccgtgtgntcatatgagcctgtctgcctgtgcatacgc

SEQ ID NO: 43689 - DNA, 101 bp, rice(Oryza sativa)
  misc_feature (71): n=a or g
tgaattggagggtgtacaaggcttattgcaaggtaaactcgaagtcttaaactatggatgtaaacggtcgnaaaatgtcttaccatttccataaccatatt

SEQ ID NO: 43690 - DNA, 101 bp, rice(Oryza sativa)
  misc_feature (71): n=t or g
ctcagaagcttctaactcctatcctatgttcctagaacaggcagaacggcatctttctgaaaccaaatgangcagcgaattcagcaatggtgtaccagagc

SEQ ID NO: 43691 - DNA, 101 bp, rice(Oryza sativa)
  misc_feature (71): n=a or c
cagtttaggagaagtgttaaccttagggcaaccgcgagatcggacggcgtaggagtgaccacgtatatggnggttattctgtccgtaattaacacgggccg

SEQ ID NO: 43692 - DNA, 101 bp, rice(Oryza sativa)
  misc_feature (71): n=t or c
ttatcatgtgctctaaattaagtccgaactaattaaggtaagctagaggtgattgtcacttgtttagcttnttagaatctgaactaaaaaccgaactgttt

SEQ ID NO: 43693 - DNA, 101 bp, rice(Oryza sativa)
  misc_feature (71): n=a or c
taatcactcctagtaataagataagcaagtgatatctcgagtgctttactcagcctatcaacattaaaatnttctttttcgtcccaaaaaaacatgaaaaa

SEQ ID NO: 43694 - DNA, 101 bp, rice(Oryza sativa)
  misc_feature (71): n=a or c
tattccacatgtagagtcctgacatggaatgacgggttctacaacggcgagataaagacaaggaagatagngaacaacctagtgacggagctcacagctga

SEQ ID NO: 43695 - DNA, 101 bp, rice(Oryza sativa)
  misc_feature (71): n=t or g
tcgcctgtgctcgcaaatgttgatgaacatgttttgcatacagttcttgtggggtggtcagctgcctgtgnttttttggttgcttccgtgtaatttcgtgg

SEQ ID NO: 43696 - DNA, 101 bp, rice(Oryza sativa)
  misc_feature (71): n=t or g
aaccttgactttcataatacacttggtcttccataaccaaacaaaaggcctatgagggctcataagacatnaagttaagcttatatctctgaattccaaat

SEQ ID NO: 43697 - DNA, 101 bp, rice(Oryza sativa)
  misc_feature (71): n=t or c
tggaagcataaacttcacgtgtaacgtaaaactagaaactactgttgaataaagagtactacctccgcccnaaaataagtgcagccgtggatatccgtgcc

SEQ ID NO: 43698 - DNA, 101 bp, rice(Oryza sativa)
  misc_feature (71): n=a or g
gctatgatgcaagaggtgggtgaccaaaggttatgctagggcacctacatttctcaatttgcgaacctctnatgcctccacctccgtggcgaagacttcct

SEQ ID NO: 43699 - DNA, 101 bp, rice(Oryza sativa)
  misc_feature (71): n=t or c
atgacgtcgacgcagcgaagcgagagcatgaacaagttggtgaagcacaagtttgttgaccaccaaaccangctgcaccgttttgctcggagaatgttgga

SEQ ID NO: 43700 - DNA, 101 bp, rice(Oryza sativa)
  misc_feature (71): n=t or c
atgagttaaatcaaattaggctttcagcttgtgagcttaacaagatagctcgcgaactgctcaattagctngttagtgcttatattaactaatatttagtc

SEQ ID NO: 43701 - DNA, 101 bp, rice(Oryza sativa)
  misc_feature (71): n=t or c
tccaggccaattagttaatcctcggttgctggtgagagaacaataacaacatagtggacagaatatgaatnggctaacacaagatcaggttgcatctatgt

SEQ ID NO: 43702 - DNA, 101 bp, rice(Oryza sativa)
  misc_feature (71): n=a or g
ttaatagcaccaaatcgtaccaatgaataaaagccactgcactgaacccattaaaaatcacgagagccatntatatccttgtgtcttttaattctgtccta

SEQ ID NO: 43703 - DNA, 101 bp, rice(Oryza sativa)
  misc_feature (71): n=t or c
aggtaacgatggcggggcggcgggaatggagtaggagaggattaagggtgtgttcgccagtccatatttcnaaccgaaacagtacgcatagaaaacggagt

SEQ ID NO: 43704 - DNA, 101 bp, rice(Oryza sativa)
  misc_feature (71): n=t or c
gagaggagggagaagatagggcctatgacatgtgcctgattaggatgccatgtcaatcaaaacaattatcnatattgttttaggatattacttaattcgat

SEQ ID NO: 43705 - DNA, 101 bp, rice(Oryza sativa)
  misc_feature (71): n=a or g
attttcacgattgtgtgagtttcacggttgattacatactctgattacgtaggccgatatacgtaacaacntacctgggaggtcgatttcatgatttattt

SEQ ID NO: 43706 - DNA, 101 bp, rice(Oryza sativa)
  misc_feature (71): n=t or g
cagttagatatcactagagtgtactactactagcagcgcattgattagaagtggtggcacacacctgctgnttgttctggccaggtggtccatgatcgcgg

SEQ ID NO: 43707 - DNA, 101 bp, rice(Oryza sativa)
  misc_feature (71): n=a or g
tgccacacctgttccttgggaggtacaatttcccacatgcactgatctggaagaaccatgtgccacccaantgcaggtacttcttatggctagttgctcac

SEQ ID NO: 43708 - DNA, 101 bp, rice(Oryza sativa)
  misc_feature (71): n=a or g
ttaataaaaaaaattataaataaaaaaaattccatataggactactactcagcacaatgaggcccaggcangctgacgaattctcgcgggcctcacacgac

SEQ ID NO: 43709 - DNA, 101 bp, rice(Oryza sativa)
  misc_feature (71): n=t or g
gtggttgggggctgtcgggattcgatgaattggggattgtttcgttacgcgattagcgtcgattcttttgnttccggtaccgaattgtgttaatgctgggt

SEQ ID NO: 43710 - DNA, 101 bp, rice(Oryza sativa)
  misc_feature (71): n=t or c
acccttcgtgtgctcatttaagtgttgaaaaacccgctgctttgccgccatcaccacttcccattgctcgnatgctgatcttttccatgatgcttctcttg

SEQ ID NO: 43711 - DNA, 101 bp, rice(Oryza sativa)
  misc_feature (71): n=t or g
acaagaagatgtggtggtagtcgtcggacagcggtgatctacacaagaaggggatttgcgcgggccgacanggggagggaggtggccttggcagccaagga

SEQ ID NO: 43712 - DNA, 101 bp, rice(Oryza sativa)
  misc_feature (71): n=t or c
gacctcggccctggcctctttccctttttccagctcggattgaaggcgcttgacttcagcttttgcctctntgagggtgttggcgagggcctccacctcca

SEQ ID NO: 43713 - DNA, 101 bp, rice(Oryza sativa)
  misc_feature (71): n=t or c
tgcggaagggtgtgcgtatatggtgaggattcttttttatctactcgttttttttcgtcgggccgaacctnagcaccaccgccacattgatcaatctccta

SEQ ID NO: 43714 - DNA, 101 bp, rice(Oryza sativa)
  misc_feature (71): n=t or c
tcgagatttgcgtcagaacacaagagcgacgaccccaccgtatcccacacctcgctcacctcactgccctngctttcgtcccccgcatccgcacctcgtcc

SEQ ID NO: 43715 - DNA, 101 bp, rice(Oryza sativa)
  misc_feature (71): n=a or g
gtcgtcgcgctgatgacgctttcatccacaagtgagttctgggacatgaacaacctgtatgagaaccaagntttggtcaacctaatgtccgggagatagtg

SEQ ID NO: 43716 - DNA, 101 bp, rice(Oryza sativa)
  misc_feature (71): n=t or c
tattggacaaatgaacaaaaccaacttgggtgggctgtcaaatgataagttcctgttcaatgctttcttcngtatcgatttatccaatactaatcaatact

SEQ ID NO: 43717 - DNA, 101 bp, rice(Oryza sativa)
  misc_feature (71): n=a or g
agagaggctggagatgaagcaacggaaagtatgcgaaacaatgtgccaagcttgaagaagaagctgaaacngaatatgagctagctgcttagtcaccaaag

SEQ ID NO: 43718 - DNA, 101 bp, rice(Oryza sativa)
  misc_feature (71): n=t or c
gttcatctcaaattatctctaaggattctgataattgacctcctattatatcacatatatctttcacacgnctctatgatttgttttattttaatagggat

SEQ ID NO: 43719 - DNA, 101 bp, rice(Oryza sativa)
  misc_feature (71): n=a or g
cacaaagaattacactactactctttctatgaaatgatcatgatcagagagctcgatcgatcatcagtttnttaattaattatgacccccggtgcatggtt

SEQ ID NO: 43720 - DNA, 101 bp, rice(Oryza sativa)
  misc_feature (71): n=a or g
gaataaggaaacatgcacacttttaactcccccccccccaacaagaaaagagagctttactacctcaaatncctatatgcatgcatgcaaacccaattttc

SEQ ID NO: 43721 - DNA, 101 bp, rice(Oryza sativa)
  misc_feature (71): n=t or c
aactttaccttccatcaacctccgattgaagattgcatatgcacacaacagtacgcatttaattagttcgnagcacttaaaaaaaagagaacttttacggt

SEQ ID NO: 43722 - DNA, 101 bp, rice(Oryza sativa)
  misc_feature (71): n=t or c
atcgttgttgttatctaatgctttcaagcctagtcacaccaacacagtactgtcgctaaaaggaaaaaccnggcctgtttggtagtgttttcggaacgctt

SEQ ID NO: 43723 - DNA, 101 bp, rice(Oryza sativa)
  misc_feature (71): n=a or g
ttagcccacgtgtcaggtcagatcatgaccatcatttaaacatgctcaggcagggagccaagaaacaaccntttggacgcctcacacacagacggccacac

SEQ ID NO: 43724 - DNA, 101 bp, rice(Oryza sativa)
  misc_feature (71): n=t or c
gcaatatggcgtaagcaatagcacgtagcgatcactcgtttcaaggatctaggtccccttatatagatgtngggagaccgactaaggatggtacagtttcc

SEQ ID NO: 43725 - DNA, 101 bp, rice(Oryza sativa)
  misc_feature (71): n=a or c
tctacggttttcctatcacacgtttcaaaggagtcactttaattttttcctacaagttgtttggcaccaanaaaaatgttataatcttttagaatggttcc

SEQ ID NO: 43726 - DNA, 101 bp, rice(Oryza sativa)
  misc_feature (71): n=a or g
ataccgtccactagtggtaagaagtatctcatcagaacaaccttcacttacggaaactacgatggactcangtcgtcagagaacggttccttatttctgtt

SEQ ID NO: 43727 - DNA, 101 bp, rice(Oryza sativa)
  misc_feature (71): n=a or g
aatactaagtgctcagatgcgcaaggggtagaatggaagacaagagcaatacccttacatcattatgatcnactagtgtcaaaatcaagctttccgccatc

SEQ ID NO: 43728 - DNA, 101 bp, rice(Oryza sativa)
  misc_feature (71): n=t or c
gggtgtaaatgattttttttgggaccattgtttctcttgatgctaggtaccattatcatccagggtctagnggccctaagcctaaccccatttttggatag

SEQ ID NO: 43729 - DNA, 101 bp, rice(Oryza sativa)
  misc_feature (71): n=a or c
aactctacctaagcaatcaagatgacaagatcgttccaactctcttttcttggcgaacaaacttatgcttnttatgcatgctcgatttgatgacacctaac

SEQ ID NO: 43730 - DNA, 101 bp, rice(Oryza sativa)
  misc_feature (71): n=t or c
tcaggtgttcatgagcttgccggatttcttcctgcctggacaataactcttcctgctgacgctggccaaantgtgcaagtttttgcacagtctccctgaaa

SEQ ID NO: 43731 - DNA, 101 bp, rice(Oryza sativa)
  misc_feature (71): n=t or c
gcacaaatgcttgtttgtactggacaacaaaattttgataatctactgtaacacggtgcgctttgtacagnggtaccattatgtacaagttgctcagtatg

SEQ ID NO: 43732 - DNA, 101 bp, rice(Oryza sativa)
  misc_feature (71): n=t or c
tctcagtacaaaatcaacaatcagattagtacaacatccgcatttcaacgcgatcaacccaacaacatttnagtagaaaattatctcagtccaatatagca

SEQ ID NO: 43733 - DNA, 101 bp, rice(Oryza sativa)
  misc_feature (71): n=a or g
tgcctagatccatcatggtgtttagtactttaattagtgggttgagattttatctgatttagtcggtacgnatttttaccttcctttttaatagatgtcac

SEQ ID NO: 43734 - DNA, 101 bp, rice(Oryza sativa)
  misc_feature (71): n=t or c
caggacccggcccaaccgatgggtgacgttttagcccgataagagatccatgggtgtaatatttggaacanatttgtctcctaatagagtaaaaacccatc

SEQ ID NO: 43735 - DNA, 101 bp, rice(Oryza sativa)
  misc_feature (71): n=a or g
tgcctccgtgaaccaaacgagaccccatatgaccagatgagatgaccagaagaattggggaaggaaaaggnagaattggggaagacagccaggcctgaggt

SEQ ID NO: 43736 - DNA, 101 bp, rice(Oryza sativa)
  misc_feature (71): n=a or g
accgttgtcagcctaaccagaccgagctagactttatcccgccacccatccattgttgtcctgtaactatngctccaaagctggccaccaccagtcaccca

SEQ ID NO: 43737 - DNA, 101 bp, rice(Oryza sativa)
  misc_feature (71): n=a or g
ccgcattatccttttattttgcgagtttcacaaatctgttgtatatcatgcatggttctttttgcatagcnacctaccactgatacattaaaaagaacagg

SEQ ID NO: 43738 - DNA, 101 bp, rice(Oryza sativa)
  misc_feature (71): n=t or c
tattcaatgaaaattctactgtgttatttgcctatgggaatcatgccctctttattgtgttgggatattgnaagttaatcatatgaccttgcttgcagcta

SEQ ID NO: 43739 - DNA, 101 bp, rice(Oryza sativa)
  misc_feature (71): n=t or c
cctctgcctcaggatgctcgtttagattgccatggggcagtggatggaacgctcaatcctggccatggaanggggtaggaagggcctttttggttggtgtc

SEQ ID NO: 43740 - DNA, 101 bp, rice(Oryza sativa)
  misc_feature (71): n=t or g
tggccatcttcatgtgttccttctcgtactgcttcaggtaccttgacatcttcttgtggccggagaattanaccttttttggctggctttgaagccaaatc

SEQ ID NO: 43741 - DNA, 101 bp, rice(Oryza sativa)
  misc_feature (71): n=a or g
cacaaacgtcaataaattacggtgatttattgatcatttgttccatctgatgcatgacaaccttcaatacnacaactgaaacttaaaaaataaacagttag

SEQ ID NO: 43742 - DNA, 101 bp, rice(Oryza sativa)
  misc_feature (71): n=a or g
taagaggtgttgagtggcattagcaatgcttgccttttttagtgcttgcactagggattgtcaaaggggangaatatgctacttgatcaacattcatcttt

SEQ ID NO: 43743 - DNA, 101 bp, rice(Oryza sativa)
  misc_feature (71): n=a or c
agagtgtttcaagtgtggtgaaaaatatgctcccggacaaaagtgcccaaagtctgtacaattacatgtgntggaagagcttttggaggtattacagcttc

SEQ ID NO: 43744 - DNA, 101 bp, rice(Oryza sativa)
  misc_feature (71): n=a or g
gagttttggaccttgcaatttgctatgtgagtttcattcttggtcgtcgccatctctagcgagttccgacnaactccgacgaggcccagagtggcgatgtt

SEQ ID NO: 43745 - DNA, 101 bp, rice(Oryza sativa)
  misc_feature (71): n=a or c
cgaacaaaacatcaaagcacacatcatcatgtgggtttcagatccagggatgctttgctcaacattggtcnccctatcccgccctgctactcacgccctac

SEQ ID NO: 43746 - DNA, 101 bp, rice(Oryza sativa)
  misc_feature (71): n=a or g
aatggtgcggatcgcttcctaggcctcacacgccgtctccttttgcgcgagcgacgtcagcatgtcttgcnggacggcacgtagaatggcggcgagggctg

SEQ ID NO: 43747 - DNA, 101 bp, rice(Oryza sativa)
  misc_feature (71): n=a or g
atcgatatcgatctgaggactaaaattagagagttggaaactgggcttaagcagctccctaactttacttnagatctaacttctagagttaaattagggag

SEQ ID NO: 43748 - DNA, 101 bp, rice(Oryza sativa)
  misc_feature (71): n=t or c
aggatgacactgacagagcagctatatcggcaactatatatggtagtgtgtacattgagccatatctgaantagccaccaaggacctccatagctgattgt

SEQ ID NO: 43749 - DNA, 101 bp, rice(Oryza sativa)
  misc_feature (71): n=a or g
aaatcgaggtggttgcgactccgttaacactaggaatctgtaggtaagtccgtatttactggaaaaaagcncgaacaattatatgatggagtatataagag

SEQ ID NO: 43750 - DNA, 101 bp, rice(Oryza sativa)
  misc_feature (71): n=a or g
gagtgttggttggatgatcaaagctttgccataggatgcttccaccttgatccttcaccacaaggttcccngagtccatgagctcggcacggacagcttct

SEQ ID NO: 43751 - DNA, 101 bp, rice(Oryza sativa)
  misc_feature (71): n=t or c
ccggacagctccacgcagctcacggcgggggtcaacgtcctggagacgtatgggctgcctcgatcatcatnggctccgcctccgcctccaggtagcagcaa

SEQ ID NO: 43752 - DNA, 101 bp, rice(Oryza sativa)
  misc_feature (71): n=a or c
tgcttatttctttctgtatgaagcagcagagagacactgaagtaacaaacgatcctaatcttgggaaaatntgccgtcagtgaactgaattaccgattagt

SEQ ID NO: 43753 - DNA, 101 bp, rice(Oryza sativa)
  misc_feature (71): n=a or g
tgagttatagtgataattctgtaagaaagataaagcatactaactgcatcgatgctcgaacgagaaactcngcacggttgacattgcggttttcatcgaac

SEQ ID NO: 43754 - DNA, 101 bp, rice(Oryza sativa)
  misc_feature (71): n=t or g
tatgattgcacagtagccagcacgattagtttctcaagtgcaaaggaagcagcgatctggcccttgtttangtctaaactttttcttcgaactttcaactt

SEQ ID NO: 43755 - DNA, 101 bp, rice(Oryza sativa)
  misc_feature (71): n=a or c
tcccgcttccccccagtccaatcccccaagaactgatccgcatctctcgctagattcctccaccaatcatncatggccaccaccaagccattcctcctccc

SEQ ID NO: 43756 - DNA, 101 bp, rice(Oryza sativa)
  misc_feature (71): n=t or c
gattatatataagtggtaatttttaactagaggactatatgactgtgtcggagatatgggaactggggtcntcattcctccggattactgaggcgtagtga

SEQ ID NO: 43757 - DNA, 101 bp, rice(Oryza sativa)
  misc_feature (71): n=t or c
attccggtatgttaacgcctccactaaagcttatgttgcctgtgactatgttcttcagagaaattgtgcangaggaatctggccatgtcctcaagatccca

SEQ ID NO: 43758 - DNA, 101 bp, rice(Oryza sativa)
  misc_feature (71): n=a or g
ctctgatatatagttcaccagactggtcgaggtggaacaataatgtcaggacaatatataagattctaatncatgatctaatatatactatatatattagt

SEQ ID NO: 43759 - DNA, 101 bp, rice(Oryza sativa)
  misc_feature (71): n=t or c
gcgcgcaagctcgtcggtgaacgatgacacgacggcgctaacgaagagcaccaaaatgatgcgagcgacgnggcgaactcaccggtgaccaaaacagcggc

SEQ ID NO: 43760 - DNA, 101 bp, rice(Oryza sativa)
  misc_feature (71): n=a or c
gaaactgttaatcctaggggtgctccctgaaaaacagtcatggatgaactctctcccctccccccaccccnaaaaaaaaaaaaaacaagagtcatgaatca

SEQ ID NO: 43761 - DNA, 101 bp, rice(Oryza sativa)
  misc_feature (71): n=a or c
atccatcggcagagttttttcccatatgttcttttacgtgccaacgcatcattttaacttgagctttgtanctaaagaaatgcctcagccgtgatattata

SEQ ID NO: 43762 - DNA, 101 bp, rice(Oryza sativa)
  misc_feature (71): n=t or c
tgttgtacgaaagattcaaccaagcaagagaagttagagaagctaactcaggagggatttcccctgagagnttgttccaagagagatccaatgactccagc

SEQ ID NO: 43763 - DNA, 101 bp, rice(Oryza sativa)
  misc_feature (71): n=t or g
cattgaaaatatcgtagcttgccaaggagacctagacagggtttttgatcggaggatcatgttgataatgnagagggaggcgcatcagcaacaatcccacg

SEQ ID NO: 43764 - DNA, 101 bp, rice(Oryza sativa)
  misc_feature (71): n=a or g
ctaatcgcgccacgacctgtcacatgtaagctgtcatcgatccgtaaacataggtaatttttgtcctatanctaaatggagttggtcttcagacgacttaa

SEQ ID NO: 43765 - DNA, 101 bp, rice(Oryza sativa)
  misc_feature (71): n=t or g
ctataggtccacctctcgtctcgtccacgtttattggtgctcgccgtaggtagttttttttaatacgtttnacgtattggtctcttttttaaaatgctaca

SEQ ID NO: 43766 - DNA, 101 bp, rice(Oryza sativa)
  misc_feature (71): n=t or g
gatcaggacgatcttgtggtgtctggccaggctcaagctctcgagtaatctcatcccactttgggttgctngtcattgtaaggaatacatctggcttccca

SEQ ID NO: 43767 - DNA, 101 bp, rice(Oryza sativa)
  misc_feature (71): n=a or g
ggcagtgacgtgcgtaccaccgcgctgcagtgcaggcaactaaacgtaacccctagcaaagcacgtagtcnatcgtactcgtaccgataggcgatagctgc

SEQ ID NO: 43768 - DNA, 101 bp, rice(Oryza sativa)
  misc_feature (71): n=t or c
acttggttcttttttacgctttactttgggttgcttttccctcctattagctgatttcctcttctttttcncttcatgcaaatgatggtaattgatgcata

SEQ ID NO: 43769 - DNA, 101 bp, rice(Oryza sativa)
  misc_feature (71): n=a or g
ttttcatgcttaaaagataaagttctcattttcataccataagctgttgggtagataaccccaatcattcngagattaaatagactttttccccaaaagta

SEQ ID NO: 43770 - DNA, 101 bp, rice(Oryza sativa)
  misc_feature (71): n=a or g
ccgctaattaacgagccagcacaacatcggtgctttgatcaattaacccacagaaggtgctgtttgctctnacacttaggcgccgccggagcgggacggga

SEQ ID NO: 43771 - DNA, 101 bp, rice(Oryza sativa)
  misc_feature (71): n=t or c
catcccccatcagccttcaatacacattcgtgcacagcatgcttacgcatgattccacgcctgctcctatnaacacacattatttcataccgatgaacttt

SEQ ID NO: 43772 - DNA, 101 bp, rice(Oryza sativa)
  misc_feature (71): n=t or c
gcaacttagaactggctgattagatcggttccagaactacaaagcggcagccgcatccacagccaatctgngaccggtcagccacgacaatcgccggatcg

SEQ ID NO: 43773 - DNA, 101 bp, rice(Oryza sativa)
  misc_feature (71): n=a or g
taaatatgctaaaaaaatcatgttaatgtgaagtggaacaatttggactaacgtagtacgtcttgcgttcnatcttatccgctcgtatcgtacacaatcat

SEQ ID NO: 43774 - DNA, 101 bp, rice(Oryza sativa)
  misc_feature (71): n=a or g
catcctaattctctatggaaatgggacaatgtggtgtgtggactgtgatatgcagatagcagctccatgcnggaatcttttgtattttcattttttcactg

SEQ ID NO: 43775 - DNA, 101 bp, rice(Oryza sativa)
  misc_feature (71): n=a or g
agacaaagcccagaaccgcgtaatatgcaatcagaatcggcagagagatcaatgttccgaatataaccctncattcaaaattagattttcgttagtgatta

SEQ ID NO: 43776 - DNA, 101 bp, rice(Oryza sativa)
  misc_feature (71): n=a or c
atccaagtactactataaaccaatcaagattgcaagaatccattgctcattgggagtctcaaaaaggaganaaacatacaaacataaagacaacaaaaaga

SEQ ID NO: 43777 - DNA, 101 bp, rice(Oryza sativa)
  misc_feature (71): n=t or c
ggtatggaatctcggaataggcgtactgtaccttcccatcaaggaagcaaactagctgttggagtgcacantaacgctggtacatgcccacatcaagaagt

SEQ ID NO: 43778 - DNA, 101 bp, rice(Oryza sativa)
  misc_feature (71): n=a or g
aatccaatctataatttaccaaatttggtcgttaacaacagctctacagaacccctctctccttcttttcntggtgtattagtttgatttgagcaacgtga

SEQ ID NO: 43779 - DNA, 101 bp, rice(Oryza sativa)
  misc_feature (71): n=t or g
gtgagcggaaacaaacaagatcacacacgcgaacacaccaaattattaaaaaccacaacacactgcaggcnagcatatctatcgatcacacattcacacag

SEQ ID NO: 43780 - DNA, 101 bp, rice(Oryza sativa)
  misc_feature (71): n=a or g
ctcgagcgcctgacacaccggcgactcatccctagccacgttgacaagttgcgcgtgcacgactccgcccncgccttcgccaacgtccgcggcacacgtcg

SEQ ID NO: 43781 - DNA, 101 bp, rice(Oryza sativa)
  misc_feature (71): n=a or g
aaggagatatgtcaaaacttcaatgacaacaataagcaatgtggtccacaaaaaggggaaatacacatatntacgtatagccaaaccaatattaattattc

SEQ ID NO: 43782 - DNA, 101 bp, rice(Oryza sativa)
  misc_feature (71): n=a or c
tcatacgtgatgcattaggtatacacttagacaatcagatcccctaactacaaagcaagcaggtccttagncaaacctgagggaaaggaagcaaaatgaaa

SEQ ID NO: 43783 - DNA, 101 bp, rice(Oryza sativa)
  misc_feature (71): n=a or c
tcctcttgatgaaactctaggtagctagcactagctacgatgcttaattaatcccatcctctctcactagnttggcgaacatttgagataaaggagggtga

SEQ ID NO: 43784 - DNA, 101 bp, rice(Oryza sativa)
  misc_feature (71): n=a or c
aggcagcaccccagtatgagctgcaacctatcgctccggtctagccttccgccatatgggggctaaacatnatcggccctttcccggtagcgcgaaatggg

SEQ ID NO: 43785 - DNA, 101 bp, rice(Oryza sativa)
  misc_feature (71): n=a or c
taattgaacataaatatttctaatgcatataatctgatcatatacaaattcacaatttcaaagaccacaantcaaatttaaatttaaaacttttaaatatg

SEQ ID NO: 43786 - DNA, 101 bp, rice(Oryza sativa)
  misc_feature (71): n=a or c
ataattggttgtagcttttgttgaattgaaggcagactttcgtccattatcttaagaaaattgaagcgttngagtcaaaagtcacgcctaatttaaagtct

SEQ ID NO: 43787 - DNA, 101 bp, rice(Oryza sativa)
  misc_feature (71): n=t or c
tttataagacaaacctataaagggtatcgcactctcgcagcgaagaagaataatttatgatgcaaatcganaaagatagacataactagaataaagtagat

SEQ ID NO: 43788 - DNA, 101 bp, rice(Oryza sativa)
  misc_feature (71): n=t or c
agcatttaaaatagcattcttcttgtttgtcacaatcagcattaagctcataagtggattttttttggtangagtatttgttttggtgctacaattgatta

SEQ ID NO: 43789 - DNA, 101 bp, rice(Oryza sativa)
  misc_feature (71): n=t or c
agtatttgaattttaagacggtccataagctaaaatgcagatgagagccgattgccggcttctttactagnactgctctacaaatattgacaactcgaaac

SEQ ID NO: 43790 - DNA, 101 bp, rice(Oryza sativa)
  misc_feature (71): n=t or c
tattggtacaatgtacatgggagaaaagcaagcaagctgcttagtttaattaggagtacacagtactatgntcttttgtgacctgtgagctgtcttgtaat

SEQ ID NO: 43791 - DNA, 101 bp, rice(Oryza sativa)
  misc_feature (71): n=t or c
cacttccaccatgagagaatggaccacaacaggagcaccaatatgagacctcctccaattgagaaccctanggcaatggctttcttgtgatctgcatcgat

SEQ ID NO: 43792 - DNA, 101 bp, rice(Oryza sativa)
  misc_feature (71): n=a or g
ctaggcctaccttgaggagggagctcgcggcgtgcaggtgcctttttgccttctcattcgggtgcagcaanttgatcaccggagccggtgacacctgcggc

SEQ ID NO: 43793 - DNA, 101 bp, rice(Oryza sativa)
  misc_feature (71): n=t or g
ctcagaacaacaaactctgagtgcgctagcaatcctattcctatgccgctacggcctacgctatgcatgtnaatcggtcaaaaatattggattctctcgaa

SEQ ID NO: 43794 - DNA, 101 bp, rice(Oryza sativa)
  misc_feature (71): n=t or c
cagataccgccactaccattctaatcatttattgctcctcggcttactctctcatggcaaccactgcctcnctgctccttggtcacatgtccaatcggcat

SEQ ID NO: 43795 - DNA, 101 bp, rice(Oryza sativa)
  misc_feature (71): n=a or g
tttaacatgtttcaaaatgttaggtcactcctccccatggactccctccatctagagatgaaaacggattnaatacagtcagaaacttgctatatcatatt

SEQ ID NO: 43796 - DNA, 101 bp, rice(Oryza sativa)
  misc_feature (71): n=t or g
catgcaggcatgtatactacatactacaataatccaactgcataatgccgtgttttgtgcgtcgatcgtcncatcgacaatgtcgcgaccgtagcacaaac

SEQ ID NO: 43797 - DNA, 101 bp, rice(Oryza sativa)
  misc_feature (71): n=a or c
ccataccggcgaccaacaaccaaaaggagagagagaacaccacaaaagctactaaaaaaagcaccgagaantctagtggtgcagcaagcgagcaaaccccc

SEQ ID NO: 43798 - DNA, 101 bp, rice(Oryza sativa)
  misc_feature (71): n=t or c
aaaagacgacttgggcaaagtcttccagtctacatcttcattgataatgctaagcccatccatggcatcantattaggcaagagaagcacagctatataca

SEQ ID NO: 43799 - DNA, 101 bp, rice(Oryza sativa)
  misc_feature (71): n=a or g
ccaagaaacatcacatccaagttccaacatcacaaattcaagagaagatcaagacatctcgaaaagagggngagaagatgaaggaagaaacacttacttgt

SEQ ID NO: 43800 - DNA, 101 bp, rice(Oryza sativa)
  misc_feature (71): n=t or c
aggccgtggcgccgctgaagcaagaggccgacgatgagattggtctattctgctgcttgatgacgaaagangacgacgacaatggagctgtcccacggcct

SEQ ID NO: 43801 - DNA, 101 bp, rice(Oryza sativa)
  misc_feature (71): n=a or c
aaaatatcattatgatagagttaagaggaaatatgaagagacatggagcattggacttatcgaaggacatntgtcgaaacaatatttcagcaatataaaga

SEQ ID NO: 43802 - DNA, 101 bp, rice(Oryza sativa)
  misc_feature (71): n=t or c
acagcctctgagccaccatgttctactacagaaacaaccaaggtcaaatatgtcagaggaggtgtgtgtangttaagagattgtctcggtatctacttgtg

SEQ ID NO: 43803 - DNA, 101 bp, rice(Oryza sativa)
  misc_feature (71): n=t or c
gccaaatccattaaatcccttcacaattcttcatcatggctagcaagtctatgattccatacgaagcctcnacctccaacaccaacgatctagagggagaa

SEQ ID NO: 43804 - DNA, 101 bp, rice(Oryza sativa)
  misc_feature (71): n=t or c
gaacaaatactgggagtgggagagatagacgcatataggatcgcttggtttgcctcgacgggaagtaattngctaaactcggtttcagctaacaagcaaga

SEQ ID NO: 43805 - DNA, 101 bp, rice(Oryza sativa)
  misc_feature (71): n=t or c
tttgcagagacctctgcctgactgcaatgtgcataggaccatagtatgtgtgcgtgtacgactaagctggngagtgcgccactagcgatgacgaacagttc

SEQ ID NO: 43806 - DNA, 101 bp, rice(Oryza sativa)
  misc_feature (71): n=t or c
atcaaaactctgatggatcccctcaggaagatgataaaaacccatggcataaaaggggatggaggagaggnatgcattaatctggactgctctaccagcat

SEQ ID NO: 43807 - DNA, 101 bp, rice(Oryza sativa)
  misc_feature (71): n=a or g
tatcctgttcgcaactgatctccagaggtctccgacaaaggtggtgagccaacgtcgtcacctctatttgnggaaacttaagattttgagaagtagctggt

SEQ ID NO: 43808 - DNA, 101 bp, rice(Oryza sativa)
  misc_feature (71): n=t or c
cccctcacaatccgagcttgattaccaagtgacgctcgtgtgatcgtgttgtttaacggcttactccctcnagttttattttaattgacgttttagataat

SEQ ID NO: 43809 - DNA, 101 bp, rice(Oryza sativa)
  misc_feature (71): n=a or g
tccatggccaatgaggttgatgcatcagtcgtacttgagggcaagtgagttaggtctcgggatgattactntgcatgtcccggaagatgctttcaaggacg

SEQ ID NO: 43810 - DNA, 101 bp, rice(Oryza sativa)
  misc_feature (71): n=a or g
tcttccaaaatagttcaccataaggacatttcatcgtcgccataaagaataggttgtaagcagcgtagacnatgaactagccattacttgtcagcttccaa

SEQ ID NO: 43811 - DNA, 101 bp, rice(Oryza sativa)
  misc_feature (71): n=t or c
aaaaacatgcacgcgaaaaacaagaaatatgagttgggaatggaaagggaagagtacgggtggggatgctntggagttcactccaactccatccgaaggat

SEQ ID NO: 43812 - DNA, 101 bp, rice(Oryza sativa)
  misc_feature (71): n=a or g
ttaccgagctctcaacggcgaggtttcaataccattgctactctcgcaacatggactatctggaaggagcnaaataacagggtgttcaaccagaagcacag

SEQ ID NO: 43813 - DNA, 101 bp, rice(Oryza sativa)
  misc_feature (71): n=a or g
gttgtgtagaggttaaagcttctttggtacaacatgcaaaacccaactgcttgatgaagagtcgcagctanatgcgatgaagaaggctactgctcttgaag

SEQ ID NO: 43814 - DNA, 101 bp, rice(Oryza sativa)
  misc_feature (71): n=a or g
agtggcagcgatgacatggatctactgaccctattgtcaaatacggggacgatgaccgctggtttccgcancgaaggcggtctctttggggctaaggcagc

SEQ ID NO: 43815 - DNA, 101 bp, rice(Oryza sativa)
  misc_feature (71): n=t or c
ttctttctcaacagatcctcaccaatggcaagtacaagagtattgagcacagagcagtaataaaccctganaaggaaaggatcacacttgctgcattccag

SEQ ID NO: 43816 - DNA, 101 bp, rice(Oryza sativa)
  misc_feature (71): n=t or c
tcccgatgcgtcactgcactgaaagtctgaaaccttctaatccctctgctataaaatcgctctgctttacngctgttttctggcattgcctgtgcgccgcg

SEQ ID NO: 43817 - DNA, 101 bp, rice(Oryza sativa)
  misc_feature (71): n=t or c
accgcaccactaccaccgccctcctccatcagtgtgaccatgtagctcctacggaggccttgtcgcctcgncgtccttctggcatcaccattagccactag

SEQ ID NO: 43818 - DNA, 101 bp, rice(Oryza sativa)
  misc_feature (71): n=a or g
gcgaaacacaatcagagcacaaattggctaacaaattaacgagagcgaaatgctgtcgcacacttattagngaatgaagccacacactgatggttcgacag

SEQ ID NO: 43819 - DNA, 101 bp, rice(Oryza sativa)
  misc_feature (71): n=a or g
caaaacaagaagcttaatcgactgacggttcacatttcttttcttattgtattggatcaattgccttatantatataactaatgtaataaataatgtgtat

SEQ ID NO: 43820 - DNA, 101 bp, rice(Oryza sativa)
  misc_feature (71): n=a or g
gtttgtgacacctgtgagtaccatattgaatagcaaggtttcaggcctaatacccatagataccacatctnttacctaggtactaggtctgatacctgtgg

SEQ ID NO: 43821 - DNA, 101 bp, rice(Oryza sativa)
  misc_feature (71): n=t or g
caccgaaggatatcaccggagacatggtaaccaaccgactttctagtttctagtgtgtcctgcatttgtancttatgttggctgctttctttgtgtcctaa

SEQ ID NO: 43822 - DNA, 101 bp, rice(Oryza sativa)
  misc_feature (71): n=a or g
tgcactattgtggtgtggttaaattatcctcctttttgctttgtagcctaggaaggaattcatgtggaganatgattgcaactacgcccgtatacaagtag

SEQ ID NO: 43823 - DNA, 101 bp, rice(Oryza sativa)
  misc_feature (71): n=t or c
gtggtcgatgccaaagatgtgctaaacacgttgagatggcaaattaattacaagggcttgctccacagtcnacgctgcagttgcataaactgcatcaagct

SEQ ID NO: 43824 - DNA, 101 bp, rice(Oryza sativa)
  misc_feature (71): n=a or g
atctccgctggcggtgtcgggatgaacggccaggattggtcttggcaaagcgtacgggacacagtttgtgngcctgtgggcttgagttgcttgggccgaat

SEQ ID NO: 43825 - DNA, 101 bp, rice(Oryza sativa)
  misc_feature (71): n=t or c
tcacgacgccatgatcgaggaagtcgcccaaaagagaaccgagaccatgacgatcgcgatcggcgagggcnagacaacactggtcacggccgtcgccgtaa

SEQ ID NO: 43826 - DNA, 101 bp, rice(Oryza sativa)
  misc_feature (71): n=t or c
gctcgctattatgtagtcagcttgaagttcaaagctggccctgctaacaacagagctcaattcaatgaaantagcctagtcttttcttttctttcccttta

SEQ ID NO: 43827 - DNA, 101 bp, rice(Oryza sativa)
  misc_feature (71): n=a or g
cacatttggtatagctacacgcaaaatctttcagaaatatgaacagatctatcatgcatgctagatcaccnttaataaaaaaggagaggggaaagaaaaaa

SEQ ID NO: 43828 - DNA, 101 bp, rice(Oryza sativa)
  misc_feature (71): n=t or c
ttgtggatgcgactgtgacactgagaggtcagaaatggtccagttatgaatacatccatcctgatactctntccgttccataatataagagattttgagtt

SEQ ID NO: 43829 - DNA, 101 bp, rice(Oryza sativa)
  misc_feature (71): n=a or g
aactcatttcctcccgtgcgaaaaacgagttatcgcacaattaagtacgtaatccctcaatccaaaaaaangtaacctacgaaaggatgtacccgtctagt

SEQ ID NO: 43830 - DNA, 101 bp, rice(Oryza sativa)
  misc_feature (71): n=a or c
tagttactactctcgtgtttataattcactaaagtaaacactatatattcaatgtagcgaacaatgatccngaatgctaataggaactaaacaagagataa

SEQ ID NO: 43831 - DNA, 101 bp, rice(Oryza sativa)
  misc_feature (71): n=a or g
atgaaaacaagaaactaaacattcagaacgaggtattgcctgacttctaagctacaacaccaaacttaacngagaagacattatttaggacaagtaagttg

SEQ ID NO: 43832 - DNA, 101 bp, rice(Oryza sativa)
  misc_feature (71): n=a or g
aaaccctagcccgttgccggttgccaccacagccattgtcgtggccgtcaccaccaccgtcatcgtcatcntggttctcaacggagttcgctcctgagggt

SEQ ID NO: 43833 - DNA, 101 bp, rice(Oryza sativa)
  misc_feature (71): n=a or g
tcctcacatcttaagccatggaggcaaggtggagcagtggccaagatcaaacgaattgataagatgcaaanttggctggttggaaaagtcttgctgtcttg

SEQ ID NO: 43834 - DNA, 101 bp, rice(Oryza sativa)
  misc_feature (71): n=a or g
ggcgatggcgggggagacgacgctcctttggaacctgaggttcgtggaggtcacagatgaggcgccatacntcgacgggattcacccgtgctacagtaggt

SEQ ID NO: 43835 - DNA, 101 bp, rice(Oryza sativa)
  misc_feature (71): n=t or c
ataatattacaaatttaaataaatctctttatggtgctatattttatagctgtatcatggagcctgagaangcatgacacgacaaggcaaccgaatccgta

SEQ ID NO: 43836 - DNA, 101 bp, rice(Oryza sativa)
  misc_feature (71): n=t or c
tcaagtaatcattatacattgagcacgtatgagttattcttcattcgatctgaacccaaaacataatgttntatattcatcgctttaactttgttatattt

SEQ ID NO: 43837 - DNA, 101 bp, rice(Oryza sativa)
  misc_feature (71): n=t or g
ttctgcagatattgcagaatcatgatcggttcatcatcacacataagactcctcataagccaccgagtaanaaagttctttgggtttagcttctgagatac

SEQ ID NO: 43838 - DNA, 101 bp, rice(Oryza sativa)
  misc_feature (71): n=t or c
gatgtgagatgcgggctgtatgattaaatgatgttgttgcgtgccgtgatgctaattgtacgtgttgaaantctattaggactaaaagaggaacgcaatct

SEQ ID NO: 43839 - DNA, 101 bp, rice(Oryza sativa)
  misc_feature (71): n=a or g
taaggttgtttcacgacgtaaataaagtaccgaaaatggagccttactctccaataattggcttttatacngaaacgttaaatggaaataaaagaaaatat

SEQ ID NO: 43840 - DNA, 101 bp, rice(Oryza sativa)
  misc_feature (71): n=t or c
ttcccagtgcgtgtacatggcatgttaccttcacctgccatattggactcgcttacgtgtcgacgaggctngcgcctctgcttagccgctcgccccttatc

SEQ ID NO: 43841 - DNA, 101 bp, rice(Oryza sativa)
  misc_feature (71): n=t or g
tggagcaaattcaagttgacgtggcatattcgcctagacggagtctgttcaagcttgtgtcaaatatgtgnatgtagtcggttacagtttagaaattagag

SEQ ID NO: 43842 - DNA, 101 bp, rice(Oryza sativa)
  misc_feature (71): n=t or c
ccagctcacgctgcctcgcctcatccaacctgtaaaaccccaaaaccctctgagggcaagtattatggtanatgggcatctaatcacaaaacctaagataa

SEQ ID NO: 43843 - DNA, 101 bp, rice(Oryza sativa)
  misc_feature (71): n=t or c
gctgctctgctcccagtcgcctacagactgacatgtgggcctatgttcatatgcgagtacagacccagctnagcgaatgcttaaatcatgtaatgttttaa

SEQ ID NO: 43844 - DNA, 101 bp, rice(Oryza sativa)
  misc_feature (71): n=a or g
tctgagaactgcatgaaatgatttggacagatagtgtgggtgatttcacgtaaaggccttcaatgactatngctttgggcattaatgtagatcactctatc

SEQ ID NO: 43845 - DNA, 101 bp, rice(Oryza sativa)
  misc_feature (71): n=a or g
gcgtacgtcacgtaacactgtcaactggaccctgtgcagtgccttggaaggctagctagctaatcgaaggnttctcacatttcctcactgaaccccgaagt

SEQ ID NO: 43846 - DNA, 101 bp, rice(Oryza sativa)
  misc_feature (71): n=a or g
cgcgcttgcgcatttgctctgggattccacgcttggtggttgaggcgcctcctccatggtagtaagaagcngcgtggatggcgagatggcgggtggcggcg

SEQ ID NO: 43847 - DNA, 101 bp, rice(Oryza sativa)
  misc_feature (71): n=a or g
tagcatgggctggcccaatactgttcaatgtcgatctaacgtccatctggagacctgcagacaatccaatngctcaggaaaaaaagatgacgtggcgcaat

SEQ ID NO: 43848 - DNA, 101 bp, rice(Oryza sativa)
  misc_feature (71): n=a or g
acgagtttactactgcggagacgtgcatgtgggtccttgaaaccgattgcacagaagtgattaaactcatnccccttgggcaaaataaatcgagatggtgt

SEQ ID NO: 43849 - DNA, 101 bp, rice(Oryza sativa)
  misc_feature (71): n=a or g
aagattgatcctggtgccgtatccacaagacaactagctatccattgatcgggtgccgggtgatcattcangacaaagttgaactcgacggttgcgaagaa

SEQ ID NO: 43850 - DNA, 101 bp, rice(Oryza sativa)
  misc_feature (71): n=t or c
agatccagtggagaaagagagaaaaggggtatttgtgattggaaaagtatactaaaggtcaaatagctctngcatccaaacagctcaagggctatttcatt

SEQ ID NO: 43851 - DNA, 101 bp, rice(Oryza sativa)
  misc_feature (71): n=a or g
atcatctcatgctgatgatgaaatgaccttgcatgatttcctacagtcactcctcgcttttcttgcattcnctattcatggttgctgatatgcatctatct

SEQ ID NO: 43852 - DNA, 101 bp, rice(Oryza sativa)
  misc_feature (71): n=t or c
tattttttagataatggattatattaaacacggcctctacaagtcacaagcacgagtatataagactctcntgttatatgggtaaagcataaataagtttt

SEQ ID NO: 43853 - DNA, 101 bp, rice(Oryza sativa)
  misc_feature (71): n=t or c
tggattggttaaaaatcagtttcctttttatcccataaatcaaatcctaattatcggctgccatccactcnacctcctggctgactcccactcgccccttt

SEQ ID NO: 43854 - DNA, 101 bp, rice(Oryza sativa)
  misc_feature (71): n=a or g
ctcatataaatccacatcctatttaccaaacagagcatgattacttgcaacaagtaagggtgactttgtgnaaattttaactcatggtgacgtggacgaat

SEQ ID NO: 43855 - DNA, 101 bp, rice(Oryza sativa)
  misc_feature (71): n=a or g
gagatcctgtggaagacagtggcgacgtcaacgccgatgagattccttcacatcactaccaaggtgaaccnggtgctctggtgcgctttctgtcgcgctca

SEQ ID NO: 43856 - DNA, 101 bp, rice(Oryza sativa)
  misc_feature (71): n=t or c
ttaaacggagacaaaatagtcgagcaacaatcccaggtactgatgaacactatcatagagtttcatattangcattagccagaggaagtaatgaattttca

SEQ ID NO: 43857 - DNA, 101 bp, rice(Oryza sativa)
  misc_feature (71): n=a or g
ataagcaacggagagtggcgtctgttagtggactggtacattagctacttactctcgtaccaaaatataanaatcatatggtatctgttatgggacaggta

SEQ ID NO: 43858 - DNA, 101 bp, rice(Oryza sativa)
  misc_feature (71): n=t or g
gagtgggaccactccttcagatatgattgcaattcagtggtgtgtacacccgtacttagcaacaacggtanatataggctgtgtttagatctaaaagtttg

SEQ ID NO: 43859 - DNA, 101 bp, rice(Oryza sativa)
  misc_feature (71): n=t or c
cgtgttttctccgggccgctttttacgagccagcaactgtgtgccgtgccgtctggatttttttttccctncttattattatttttatattacttatattt

SEQ ID NO: 43860 - DNA, 101 bp, rice(Oryza sativa)
  misc_feature (71): n=a or c
cagcagtaatgccgagtgacttccatcaagtttgatctgatcatattgtctgcaaactgaagtactattcncaactaaacaatcataaaagcaaattgagg

SEQ ID NO: 43861 - DNA, 101 bp, rice(Oryza sativa)
  misc_feature (71): n=a or g
ctttagatctctcgtcttgacgttgaaatactccctgtctcataatataagcaattttaactcaccatttntcttattaaaaaaaattggaattattattt

SEQ ID NO: 43862 - DNA, 101 bp, rice(Oryza sativa)
  misc_feature (71): n=a or g
cttcctccttcttacccccacgtagcagtgattcaagatactctctccgatcttcagcactgaaattggtncccatagacatggtataatggaaaggaaaa

SEQ ID NO: 43863 - DNA, 101 bp, rice(Oryza sativa)
  misc_feature (71): n=a or g
gttatttttgaatagcgggagtgtggcgtcactaaaatcatctattgtacatgtaaaattagataaaaccnaataaaataattagataaaaagcactttag

SEQ ID NO: 43864 - DNA, 101 bp, rice(Oryza sativa)
  misc_feature (71): n=t or c
gatcatcatcccgaacattgcaaggtgatctcggttcattcggttggatcatattgcaagaatctctctcnttttgcattgcgttcttcttcgctgagaca

SEQ ID NO: 43865 - DNA, 101 bp, rice(Oryza sativa)
  misc_feature (71): n=a or g
ttatttcctgaaaagaaaaagtctaagagtaatttatttactcaaggaagatggatgatgaaaaggcacanagtaatttatttattaagagaagactgaac

SEQ ID NO: 43866 - DNA, 101 bp, rice(Oryza sativa)
  misc_feature (71): n=a or g
tgcggacggcggcgtcgcggagcactcggacacggccaagctccacttgagcacgacgtcgcatgagcacngcgtggagacgaagtgatcgcgcgcggccg

SEQ ID NO: 43867 - DNA, 101 bp, rice(Oryza sativa)
  misc_feature (71): n=t or c
gggaggcatgcgcttcaatgcgatgctatcggactgcatccgtctatggctgtctggataaaaagatttgncacgtcacatcggatgtacggatacatatt

SEQ ID NO: 43868 - DNA, 101 bp, rice(Oryza sativa)
  misc_feature (71): n=a or c
tgtatcagcagtgtacatatgtactgagccagggggtgcatttcataatttctgtgtctgtataagttagnactcgccattgtacacacacttgtactctt

SEQ ID NO: 43869 - DNA, 101 bp, rice(Oryza sativa)
  misc_feature (71): n=t or c
catatgccattagattcatgggaaagatccaaagaaggcacaaaatcttctgttctattacctgaacccantcaaaatagctgacgaccacgccgcctgaa

SEQ ID NO: 43870 - DNA, 101 bp, rice(Oryza sativa)
  misc_feature (71): n=t or c
aacaataattccccgatcaacaacaacaacaatccgtcacagatgatcacaaatcacacatcaacacaatnactgttggaggtatgtcacgagagccttcg

SEQ ID NO: 43871 - DNA, 101 bp, rice(Oryza sativa)
  misc_feature (71): n=t or c
atgacatgcatgatggatcccaaattaagcatgccatgtagctgctcatctgtgatagaggtacaatgtanagcgtgagactagatgctttgaagcttcat

SEQ ID NO: 43872 - DNA, 101 bp, rice(Oryza sativa)
  misc_feature (71): n=a or g
cctcatgtacgctactagccaaccgagcaaagggttctttttttctatcagtaacatagacatagacatangttacaatactattatataatgtaataaca

SEQ ID NO: 43873 - DNA, 101 bp, rice(Oryza sativa)
  misc_feature (71): n=t or c
ctggagtggacatgatatacacaacagaagtgccttttccttgtgctggtattgtgtgcatattaaacacngaagatcctgaaatcccttgcaatgatgat

SEQ ID NO: 43874 - DNA, 101 bp, rice(Oryza sativa)
  misc_feature (71): n=t or c
agcaagtcattacgctgggcgaaaattgtgtcctctgactcctcttcactttgcctcgtgtgtgttccaancaacaagaatcgttcctggatttttcacat

SEQ ID NO: 43875 - DNA, 101 bp, rice(Oryza sativa)
  misc_feature (71): n=t or c
gaaccacaagttctcttttgtttatagcaacggagaagaaagaaacagtggataaagccttgcagcttganatactccatactatagctgtagctaagcaa

SEQ ID NO: 43876 - DNA, 101 bp, rice(Oryza sativa)
  misc_feature (71): n=t or c
agggagcagtgtgaccatctacccgcgaacggtaattgtagagtatagggatcgttgaatccagggtatangtgagattaaggtaaaagaaacaagaaaca

SEQ ID NO: 43877 - DNA, 101 bp, rice(Oryza sativa)
  misc_feature (71): n=a or c
tttcttttgctttacattttcaacaaactttgccttctacattatctcatcatctagacaacagggaaacnaaaatcaaactttattttttttttggtttt

SEQ ID NO: 43878 - DNA, 101 bp, rice(Oryza sativa)
  misc_feature (71): n=t or c
ctttatgcaccacacaatttgctttagtattaattaggatccttgcagccagtcctacttcaagtatacangggatcaagttggaaagttctcaagtgaat

SEQ ID NO: 43879 - DNA, 101 bp, rice(Oryza sativa)
  misc_feature (71): n=a or g
cgccgccggcctccaccccgctctcttcgaactcacctccctcaggtatgaaaagaatttgacaatatatntgtatgttttttttagaatttgtatttata

SEQ ID NO: 43880 - DNA, 101 bp, rice(Oryza sativa)
  misc_feature (71): n=t or c
ggaagagttgaagtagaggaaagtttcctacccttttcctatgaattagagggatccataagaacaaaatnataaaggtactgaatctaaaaaaaattcat

SEQ ID NO: 43881 - DNA, 101 bp, rice(Oryza sativa)
  misc_feature (71): n=a or g
gctgtgtaattgtgtctaagaaggaagagaaaatcattgtgctagttgcctcgaggatacttcttcgtccnctcggtgttgactctaactccttgtgtggt

SEQ ID NO: 43882 - DNA, 101 bp, rice(Oryza sativa)
  misc_feature (71): n=a or g
acagattaatgcgctagtattttctgttttcatgtccggatgatggcgagcctcgtgagtgcaattcgccnggatggtacggtgtggttgctcaccatccg

SEQ ID NO: 43883 - DNA, 101 bp, rice(Oryza sativa)
  misc_feature (71): n=t or c
caccattgatgcgcttgcacacacgagagatactaattaacaaggaacatatcatatacacataaactttncgtacacacttcgtacacaccaattagcaa

SEQ ID NO: 43884 - DNA, 101 bp, rice(Oryza sativa)
  misc_feature (71): n=a or g
tagtgaggcccgtcttgatggtagcgagtggtgccggaggcagcgagaagaaggatgcgtggaggtggccnatgatgccatgggtgggctgaggctgactg

SEQ ID NO: 43885 - DNA, 101 bp, rice(Oryza sativa)
  misc_feature (71): n=t or g
aactttatattgccatttgttggagaaacagggggaaatttaagtgttcagattcatgtgcaccaacacantgtagcacacaaagcccacatggctcctac

SEQ ID NO: 43886 - DNA, 101 bp, rice(Oryza sativa)
  misc_feature (71): n=t or c
cggtcaaaatgggtcacaatccctactcagatcctttttttcatgcttctctccgactcccatctcttctnttcgtacgacgcgcagactcgcggacaact

SEQ ID NO: 43887 - DNA, 101 bp, rice(Oryza sativa)
  misc_feature (71): n=t or c
tctgtcaaaattgtagtggttatacaaagtgaaccatctaactgctttgttccgctagttgtagcgagcgngccggcggcgcgcgtttccggccaagaagg

SEQ ID NO: 43888 - DNA, 101 bp, rice(Oryza sativa)
  misc_feature (71): n=a or g
ctgccatttatattatgaattctcatgtcattgaattaatccttatggcaactttttcccctgattaagtnaacatctatatatggctaataaacctgccg

SEQ ID NO: 43889 - DNA, 101 bp, rice(Oryza sativa)
  misc_feature (71): n=t or c
gtgcgtccggacatggccactctttttgtcgaaaacaggcatatggaacatgggacatttagcagcccaanccctgtcatttccatgtattacatacaagt

SEQ ID NO: 43890 - DNA, 101 bp, rice(Oryza sativa)
  misc_feature (71): n=t or g
acaaaatatagaagatacatacagtacgagtgaggaaaagttaacatgaatcttacccaggaataaaagangatgtaataactgcactgattacatcatct

SEQ ID NO: 43891 - DNA, 101 bp, rice(Oryza sativa)
  misc_feature (71): n=a or g
tgcgggagaagctgggaccgatggatccacgaccattataaatagcggtcaaccaaacccttaaccctaantctatttcagcccaatcccccgatcctctt

SEQ ID NO: 43892 - DNA, 101 bp, rice(Oryza sativa)
  misc_feature (71): n=a or c
atgcacgcatatggagacccgtatgcatgtgccatcgacatatactgaagtacatgtgacatgctgacatntccctatgcgcctgcaattgcaaattagac

SEQ ID NO: 43893 - DNA, 101 bp, rice(Oryza sativa)
  misc_feature (71): n=a or g
actgccgccgtcggccgggagctctggcagcgcttcattgtttactattcaatttgctctgcagtctacanctacatgtagcgtgtatacaaatggaagga

SEQ ID NO: 43894 - DNA, 101 bp, rice(Oryza sativa)
  misc_feature (71): n=a or g
caccaccaagtacaagcatatcatgtattttattaactcaaccatatgtctcataacagcacacaactccntatatatatgtatattgtaatctaatctac

SEQ ID NO: 43895 - DNA, 101 bp, rice(Oryza sativa)
  misc_feature (71): n=t or c
tgtacgatgctaaccgataagccatgcgctgatggaggcatagaacaggtagatgaatattatccggaaanagtgtaaaagctgagtgctatcagtattca

SEQ ID NO: 43896 - DNA, 101 bp, rice(Oryza sativa)
  misc_feature (71): n=a or g
atacaagataacctaataatgttgacaatatcatggtcacattgagtgtattctctatcacataagctggncaaatttagataagaaaagagtaatgcaca

SEQ ID NO: 43897 - DNA, 101 bp, rice(Oryza sativa)
  misc_feature (71): n=a or g
ttgcctgctgtatatatcttcacctgtagtgataattcgtcctttgttatcattaagctcagcagaggaantaatcaggatgcatgctatactggtcaatg

SEQ ID NO: 43898 - DNA, 101 bp, rice(Oryza sativa)
  misc_feature (71): n=t or c
tagcaaatagctatcttaacttagactacattactagcaatatatgctagtatgccaaaaccattggcaangggagtttttttcttaaaaaaaaatgaacg

SEQ ID NO: 43899 - DNA, 101 bp, rice(Oryza sativa)
  misc_feature (71): n=a or c
gatgatataatttcatccagacaagcaattactgccatcatcaggacattcagaggtgaaggatagcagcnttttttgttctgattttcaaacattttttt

SEQ ID NO: 43900 - DNA, 101 bp, rice(Oryza sativa)
  misc_feature (71): n=a or g
aaatatctcacggtaccatgctatactcgtaaagtggatgccactcgacaaaatcacatcacccatgttcncactgtgatttttttttcttcacctcttgc

SEQ ID NO: 43901 - DNA, 101 bp, rice(Oryza sativa)
  misc_feature (71): n=a or g
accgtctttaatagtactatctagacgccgttgtgtgatagccatatagggattcggtatatgatgtctgnacacaactcatgtgcaatgtgtgacatata

SEQ ID NO: 43902 - DNA, 101 bp, rice(Oryza sativa)
  misc_feature (71): n=t or c
ttcgctttagcatcttgccccttttcttaattggcatcgtttttcgcgcgctcgcgatcgatctggtccgnccaatacctgcctcctccctaccccgatcc

SEQ ID NO: 43903 - DNA, 101 bp, rice(Oryza sativa)
  misc_feature (71): n=a or g
cattctccttcggctcttcacctctctttttatctcttcgtgcatggtgtgcaaacacccggaagtactcntgtgcaagtacccggaagtcccggttctct

SEQ ID NO: 43904 - DNA, 101 bp, rice(Oryza sativa)
  misc_feature (71): n=t or c
ggtatggaggttggagtcggcggcggggttgcggatgtagccatactcggtgatggcgacgcgattacgancgaagatgacggcggcggcggcggctcgga

SEQ ID NO: 43905 - DNA, 101 bp, rice(Oryza sativa)
  misc_feature (71): n=a or g
aaaactaaacgtgtttgtctttaaaatgcaacttgtaatataattccttgtactaacaattactacctccntcccataataattgcatttctagaaaattg

SEQ ID NO: 43906 - DNA, 101 bp, rice(Oryza sativa)
  misc_feature (71): n=a or g
tgtatgtatttgcgtgtgtatatatatcatggtcggggtatatttaaagagggatggaatgcaaccggtanaattagcgaattttccttgagttgtgtttg

SEQ ID NO: 43907 - DNA, 101 bp, rice(Oryza sativa)
  misc_feature (71): n=a or g
accactgaaattttggaaatttcggcggcaaccgaaattgcaaaccctggataaaagaatgctatcgtaanggaggttcacatccactattataactagtt

SEQ ID NO: 43908 - DNA, 101 bp, rice(Oryza sativa)
  misc_feature (71): n=a or g
atgaatccaatagtagagatatttgtcatcgctttggctattttcggagctaatgtgatgcagttagcacnactaccttcaaaagttaaatctgataaaat

SEQ ID NO: 43909 - DNA, 101 bp, rice(Oryza sativa)
  misc_feature (71): n=a or g
agacaaaaccttttatctactgagttggtcactcgggtccatcctgatatttgtcttttgtgtcctctaanagaaaatatattttcattcaaagatattta

SEQ ID NO: 43910 - DNA, 101 bp, rice(Oryza sativa)
  misc_feature (71): n=a or g
acgcaggtattcatatttatagctatatgtgccggcccattcctttggagatgcacattaggggtagagcntgcgtgcgttattcgttaatctcgagatat

SEQ ID NO: 43911 - DNA, 101 bp, rice(Oryza sativa)
  misc_feature (71): n=a or g
agatctatattcccagacggaccacttatattatgtggatcgcctgggaatatagatcttcacaggcgctncgattattttaggcgggagacttatgtcgt

SEQ ID NO: 43912 - DNA, 101 bp, rice(Oryza sativa)
  misc_feature (71): n=a or g
taagggcttgttcggtttggaggttattgaatgaggattgagacggaataactctacaccgcaatagtgtnaaataaatcccctccaatccctccctcatg

SEQ ID NO: 43913 - DNA, 101 bp, rice(Oryza sativa)
  misc_feature (71): n=t or g
tgaatatttgggtttttgaaacatggattggactcgagtttatggagtttgcttttttggagggatgaacngcataacatgagattatttgacacagctta

SEQ ID NO: 43914 - DNA, 101 bp, rice(Oryza sativa)
  misc_feature (71): n=t or c
tgttggccgcctgccgcctgcttaccagtcacatcttaggtggtgtttggttgaggtcaggaaatgcaaangtaaatgggatcagctacagcggtaaggga

SEQ ID NO: 43915 - DNA, 101 bp, rice(Oryza sativa)
  misc_feature (71): n=t or c
ctcagctatttcccgttcattctcttttgatggttcctttgctgtggagcttggataccaagtgcgtcgtngtcaacacgttcgcagccttggaggccgcc

SEQ ID NO: 43916 - DNA, 101 bp, rice(Oryza sativa)
  misc_feature (71): n=a or g
caaaatccaaactttgtactgaactaaacacagccctagttaaaataagaccagaatgttcctacaagcanttacacaaaattgttatttgaccaactgtc

SEQ ID NO: 43917 - DNA, 101 bp, rice(Oryza sativa)
  misc_feature (71): n=t or c
ggagggagatggatggatgtgattttaggtcagggattcatgcacacatgcgttgcaacaagcagagatgngagagttgacgggttacagtaatggagaga

SEQ ID NO: 43918 - DNA, 101 bp, rice(Oryza sativa)
  misc_feature (71): n=a or g
ttaatattgttttgggatttcctgatttacgataagactttagaaagttttgacatttttttgacgcaaanaaaagttttgacatcattgttttagccttt

SEQ ID NO: 43919 - DNA, 101 bp, rice(Oryza sativa)
  misc_feature (71): n=t or c
gttagatcaggttcataaaatctaagctacttctacattaactaccctaaagtacacacataacatctctntctaattataacactcatataaagatcacg

SEQ ID NO: 43920 - DNA, 101 bp, rice(Oryza sativa)
  misc_feature (71): n=a or g
ataaaatgtatagctcattaaccaacgatatatatatagcttgactggtggacaggagacaagagaaaatntcaagttctagggcttaccaacatagttga

SEQ ID NO: 43921 - DNA, 101 bp, rice(Oryza sativa)
  misc_feature (71): n=t or c
tattttgaaaatcggattttcgcatgtaaattgcaaagatccgattttcagattttgggtgaatgcggatngtttgtccagatgcaaaaattgatattttg

SEQ ID NO: 43922 - DNA, 101 bp, rice(Oryza sativa)
  misc_feature (71): n=a or g
aagaacctttttacctgcatcaactagctcgtcataccgtgcaaccctaaaagcagcaacaaattcgcccntgtattttccataaattagacagccacaag

SEQ ID NO: 43923 - DNA, 101 bp, rice(Oryza sativa)
  misc_feature (71): n=t or c
acctgctaacctcctctcctgtcttccctgtttggtttggcttacttcctgttgttgggtgggttgcttcnaggggatctggagttctggacatttcaacg

SEQ ID NO: 43924 - DNA, 101 bp, rice(Oryza sativa)
  misc_feature (71): n=a or c
gtggagcaacttgtgtcggggcccaagaaagaggtgataaagatcacttctatgcagaagcagacccgtgnctggtagtgcatcaagttcaagatgtttgt

SEQ ID NO: 43925 - DNA, 101 bp, rice(Oryza sativa)
  misc_feature (71): n=a or g
atttttatttgacaaagcaataattgtcataggctgctcatcttgcatggagtattgtgggctgatctaanggcttgtttagttccaaacttttttttgaa

SEQ ID NO: 43926 - DNA, 101 bp, rice(Oryza sativa)
  misc_feature (71): n=t or c
tgactaattcaacataagatactcttagatgcgaatcattgataagtgccaagtccgattttgcttgtgtnttattcctttgccagaatgcaaatagagct

SEQ ID NO: 43927 - DNA, 101 bp, rice(Oryza sativa)
  misc_feature (71): n=t or g
aaaaacgtcgtatattttaaaaatgaggaagaaaaaaaaactgtagaacaaacaagcaacatgagtgagtngatgggggtgaatttttttaattaattaca

SEQ ID NO: 43928 - DNA, 101 bp, rice(Oryza sativa)
  misc_feature (71): n=a or g
tgagcgtaactcaattggttaggttttttactggaacctatcacccgagtcaagttctagacttgataccnatacttgtatttatggctaattattatttc

SEQ ID NO: 43929 - DNA, 101 bp, rice(Oryza sativa)
  misc_feature (71): n=a or g
aattttgcggcgcactgattattgaagttgtacagccatagagaacaggaacctgaatggatagcactgtnggtgttgttgtcagcaagctggttcctcgc

SEQ ID NO: 43930 - DNA, 101 bp, rice(Oryza sativa)
  misc_feature (71): n=a or g
gaacttgttggtcctgggcgaaccacttgttgtactccggattggagatgatggtcttgatcttcttgtcnccgtcttctttctcacactccgccgctgga

SEQ ID NO: 43931 - DNA, 101 bp, rice(Oryza sativa)
  misc_feature (71): n=t or c
gtacgactacaattttgagtaagtcgaacctttttttacaaaacggaatttgttgtctcggtagtagaganagaaattagaaccgaaacataaaattaaaa

SEQ ID NO: 43932 - DNA, 101 bp, rice(Oryza sativa)
  misc_feature (71): n=t or c
ggcgacgagcaggtggccgtggagcgggcgtgtgttggactggcagtaatggccgagcacggagaaccccnccggcacgccggccggcctgtagaacgtga

SEQ ID NO: 43933 - DNA, 101 bp, rice(Oryza sativa)
  misc_feature (71): n=t or c
gaaagttttgtaacctgaaacagaggtgaaaagttcattaaatctaggcacacaaaagatggaaatgcgcnagaggtgaaaagttcattaaatattatggt

SEQ ID NO: 43934 - DNA, 101 bp, rice(Oryza sativa)
  misc_feature (71): n=t or c
gaaagtaccaaaatataaccaaatataaattttagagttttttcaatcgtatatttgtcttttacttcccntgtcttaaaatacgtgataagacatatatt

SEQ ID NO: 43935 - DNA, 101 bp, rice(Oryza sativa)
  misc_feature (71): n=t or c
agctagaaacatccctttcggcatgctcccaagatactatatatgcttgcttgcagaaattaattactacncgcagtaatttttcttgttaattaaactgc

SEQ ID NO: 43936 - DNA, 101 bp, rice(Oryza sativa)
  misc_feature (71): n=a or g
tagccatgacttggacaacaacaaatttatgtgcatactgaataatgctacagaaactaatactccctccnttctaaaatataaaaaattttagtaggatg

SEQ ID NO: 43937 - DNA, 101 bp, rice(Oryza sativa)
  misc_feature (71): n=t or c
gccttgcgctggcccagatttcacctcgttcttcttggcccaaaccgcagcccatgacaggcaaccatccnggattttttaaaaaaatattagaaaaaatg

SEQ ID NO: 43938 - DNA, 101 bp, rice(Oryza sativa)
  misc_feature (71): n=t or c
tgaataggaaaatagttcaaattactcccgtgaattattgtgacggtacgaattacctctatatcagattncggagtggttttggtcccacatggcgcata

SEQ ID NO: 43939 - DNA, 101 bp, rice(Oryza sativa)
  misc_feature (71): n=t or c
tctcttcgctgtcatgtgtcgtagtagaatcgctgtgtgaagcacaggaaattaagctgtttgctgccaanggaatgaagctgcgtattacagtacttaca

SEQ ID NO: 43940 - DNA, 101 bp, rice(Oryza sativa)
  misc_feature (71): n=a or g
aggtagaccagaggataattttgtcagaacatgagatgaaagtaaagggagaagaaaagaaagcatggaanctttgtagtgcagcacttgcaattgcaaag

SEQ ID NO: 43941 - DNA, 101 bp, rice(Oryza sativa)
  misc_feature (71): n=a or g
tctttaagttgcactcgttttgagtgatttcgtgtaataattagttgtaactcatttgagcaaaggctagnatggatttctattccattattatcttaaaa

SEQ ID NO: 43942 - DNA, 101 bp, rice(Oryza sativa)
  misc_feature (71): n=a or g
atcatggacaagtacatcactcctcaacgccaatcacctgctcaggagaccaagaattaagacgagtccanatcgatcgatcgaaaagcttctgaatttct

SEQ ID NO: 43943 - DNA, 101 bp, rice(Oryza sativa)
  misc_feature (71): n=a or g
acccccgaaactgttcaggatcgagattaggctgtccacgtcttggcatgatggcttgatgaagattgccncgtcgtcagcatacagggagcatctgaagc

SEQ ID NO: 43944 - DNA, 101 bp, rice(Oryza sativa)
  misc_feature (71): n=t or g
tcagggacacactactaacttaaggataacttgtgcagttctgcgcccaccaacacacgtaactacacttntctaggaatccttcacatgtatgtttcagt

SEQ ID NO: 43945 - DNA, 101 bp, rice(Oryza sativa)
  misc_feature (71): n=a or c
aaacatgtaccttcagattgtgcatcagcaagttggacagttgtcctatttccatgcaatcagaacaaatntcctatgtgtactaatttgctacgtaccat

SEQ ID NO: 43946 - DNA, 101 bp, rice(Oryza sativa)
  misc_feature (71): n=t or g
aaagcggctacatcttatcaacaaatttcaggtatggcacatcacttacaaatgctaactcggtcatcctntacaatatatatacaccgcagatcactgcc

SEQ ID NO: 43947 - DNA, 101 bp, rice(Oryza sativa)
  misc_feature (71): n=a or g
catagactggaaattttgcgtggaaaaggacttgatcactataaaaactatagttgataccccgcgctttncagcagaatatatggatgaatgcatgttat

SEQ ID NO: 43948 - DNA, 101 bp, rice(Oryza sativa)
  misc_feature (71): n=t or c
gtatgtatgtatgtatgtatgtatgtatgttgaggtttgctccagtccatagtatgtatgtatgtatgtangtacgaacaatcaagcatggtaataaataa

SEQ ID NO: 43949 - DNA, 101 bp, rice(Oryza sativa)
  misc_feature (71): n=a or c
gggcgcaaacgcttagcttcctaactattttgcttggaggagtgagtgttacgcgaggagaggacataatntgtgggagccattttgttattatagaacta

SEQ ID NO: 43950 - DNA, 101 bp, rice(Oryza sativa)
  misc_feature (71): n=a or g
cctaaagttaaaataggtagtaggagtggagctagagtcggactctcccaaatagagaggaggacaccatnatgtaatcataatagcaactataatgtagc

SEQ ID NO: 43951 - DNA, 101 bp, rice(Oryza sativa)
  misc_feature (71): n=t or c
tgagagacgtgcatctccgcaacatctttaacggatgcgacctgaactggactctttttttacttgacgcngcgccctccttgaacagcatgtatatttcg

SEQ ID NO: 43952 - DNA, 101 bp, rice(Oryza sativa)
  misc_feature (71): n=a or g
ccccggtggtacttccttgggaaacacataagagtactcctaaaaaatgttagaaacagcaggggggaaangaatactgcatatcgtgaagtgaaaacaaa

SEQ ID NO: 43953 - DNA, 101 bp, rice(Oryza sativa)
  misc_feature (71): n=t or c
gaatgcccgagaaaattgctgaaattttaccgcgttcccgtgctcccagttgtcatgggtgctgagtattnttttattttgatttgtgtttggtgcgtgcg

SEQ ID NO: 43954 - DNA, 101 bp, rice(Oryza sativa)
  misc_feature (71): n=t or c
gaactgtgtggcagcattgcaaaatgccacatggtaccatggagtaatatgcatcactagagctatatcangtggcgcatcagtgtccgggagaaaaggca

SEQ ID NO: 43955 - DNA, 101 bp, rice(Oryza sativa)
  misc_feature (71): n=t or c
taggaatccttctccctcgacaagcaaatagagtagtggattagcgtatgattaattactacctctatccnaaaatgtaactatttctaacacagtaactt

SEQ ID NO: 43956 - DNA, 101 bp, rice(Oryza sativa)
  misc_feature (71): n=t or c
gcttaatgctcaaaaaaggtaccgtgccaatgtatagaactcttgttgtgctcaacacgaagatccatttngaattcttggggccctcagaagtgtcgaca

SEQ ID NO: 43957 - DNA, 101 bp, rice(Oryza sativa)
  misc_feature (71): n=a or g
gatagcaccattgtgagcatagatgccgtgccatattgcgacactcgagccaatcgaggtcacccaaatantgctatacatctttttttttttggtaaaac

SEQ ID NO: 43958 - DNA, 101 bp, rice(Oryza sativa)
  misc_feature (71): n=a or g
aaggtgggggcatgacatcattggcccgttccctatggcgcgaaatggctaccggttcgccattgttgctnttgagtacttctctcggtggttagaagctg

SEQ ID NO: 43959 - DNA, 101 bp, rice(Oryza sativa)
  misc_feature (71): n=t or c
tttaaaacttaaatctgggtgaacatattccaccacaagaacacatgctgaaaacttaatgaatagaaatnaagtctcattttatttatagttcaaaagta

SEQ ID NO: 43960 - DNA, 101 bp, rice(Oryza sativa)
  misc_feature (71): n=t or g
accagagacgtctgactttgcatcgagcacaccggagaagagaagagaacatgcatgcatgattacaatantacattattcagtgctactagtagtagcag

SEQ ID NO: 43961 - DNA, 101 bp, rice(Oryza sativa)
  misc_feature (71): n=t or c
cgagtatcgccaaattccccatgaccccaatgaggagaatagtcgtgttcgcatgacgttgactagtgatngtgaagaccttccatcaatgatgtttgaag

SEQ ID NO: 43962 - DNA, 101 bp, rice(Oryza sativa)
  misc_feature (71): n=t or c
ttgatacttagaaaaccactgctaggtgaaatatatgctagtacacgaaatatagtgactaagaacatttncaacagagtggtcatcccactctccaagtt

SEQ ID NO: 43963 - DNA, 101 bp, rice(Oryza sativa)
  misc_feature (71): n=t or g
gacaataggccagaggctgatgctgcatcgtgttagtgcaaatgtattagaaatttaccaccaaagagaanatattgagttcttttagatagagaagggag

SEQ ID NO: 43964 - DNA, 101 bp, rice(Oryza sativa)
  misc_feature (71): n=t or c
cctacgtcattttgtctcgttacaacgcacgagcaccttgctagtaatcatcagctaataactcctctacntgtatcgattttcttaattttttgaatttt

SEQ ID NO: 43965 - DNA, 101 bp, rice(Oryza sativa)
  misc_feature (71): n=t or c
ctggaaatgacccttattcaaacatttctacccaatcagccatcgaactgaataccacatttatggtgccnttgcgtgttctccaaacagcttttgtgccg

SEQ ID NO: 43966 - DNA, 101 bp, rice(Oryza sativa)
  misc_feature (71): n=t or g
gagggcggtgcaacgagtcttgatgagccatggccttagcaagctgttctttgtgttcaagtcgtcgtcgncggaggacctcaatcccacttatcttgtgc

SEQ ID NO: 43967 - DNA, 101 bp, rice(Oryza sativa)
  misc_feature (71): n=a or g
caccccttttacaccatctcgctgccataccatcgtctcggcgtgtaacagctccatggttaactaaaatnaaaaaatgcaaaaaccatcccaaatatctc

SEQ ID NO: 43968 - DNA, 101 bp, rice(Oryza sativa)
  misc_feature (71): n=a or c
tctcgtgtcatacaatcttccttccataatcaacaaattatcaaactaaaaaccgaaggcccagccatagnaagtgctatctgttaaacaattaatcacat

SEQ ID NO: 43969 - DNA, 101 bp, rice(Oryza sativa)
  misc_feature (71): n=t or c
tggacgtaggccaaaagacgccatgccacttgcttacgcaatctctaagagaaaaggaaaatccttacgcnagggaaaggagaacgactcatgggttggag

SEQ ID NO: 43970 - DNA, 101 bp, rice(Oryza sativa)
  misc_feature (71): n=a or g
tgaaacgcatcctggatgaacagattttctttcacatttcagacaattgtttgtgctggctgtctctctcncagagatggtcctgactgaaaaataggctc

SEQ ID NO: 43971 - DNA, 101 bp, rice(Oryza sativa)
  misc_feature (71): n=t or g
acaagtgccaatgagtgccaaaaaaatattgtgagtttctgttgttctcttcctgtgaagttcctcctttnggggttttcagttttcactgcagtcagaaa

SEQ ID NO: 43972 - DNA, 101 bp, rice(Oryza sativa)
  misc_feature (71): n=a or g
ctcaaaagcgggtataatatgtgtaacaacccgtccttaatgggcgagtccactaacctgttcttaatggncgagtccagttaccttaaaagggttaatcc

SEQ ID NO: 43973 - DNA, 101 bp, rice(Oryza sativa)
  misc_feature (71): n=t or c
cgtcaacctgaagaaaagtcactactacaaaacactctttgggtttcgattggaaattttatgttggtgtnggatttctcaaccgatatcctactagcgac

SEQ ID NO: 43974 - DNA, 101 bp, rice(Oryza sativa)
  misc_feature (71): n=t or c
gtcgttgatccttgctggtcgtgtttcgctgctactggtccgtgcgacttcaacaaggagccctgtgttgncgtcggcagcatgctgggattcgctgccgt

SEQ ID NO: 43975 - DNA, 101 bp, rice(Oryza sativa)
  misc_feature (71): n=t or g
agaccatcgcactaagcctaaacatcgcaacgggaaagtagtgttcgcaatggtgaaggatctgaaagtantatttggaaaggggattggcagccaaccta

SEQ ID NO: 43976 - DNA, 101 bp, rice(Oryza sativa)
  misc_feature (71): n=t or c
tctgtttggcagtccaccaactgctaaatttaacttcaagagatgggtttgaagcagagtcgtagagcagnctaaacctagctctacttttacaggtagtc

SEQ ID NO: 43977 - DNA, 101 bp, rice(Oryza sativa)
  misc_feature (71): n=t or g
gtctatatacaaaatttgtctccacgttttcttggatagttagttgctcacccgatcctgtatccatggcngccgtgtcggaggtggaggtcgacggcgtc

SEQ ID NO: 43978 - DNA, 101 bp, rice(Oryza sativa)
  misc_feature (71): n=a or g
catttgacatcttactagaaatttaatataaagaggagaataatttgactgggcctgtttggttcccaggnacttattctaagtccctatcacattggatg

SEQ ID NO: 43979 - DNA, 101 bp, rice(Oryza sativa)
  misc_feature (71): n=t or c
gcgggccttgggccttttggccaactttattcatcatgtgtacctatctggtcacgtctattccctagttnagatatatggacatatataacacgatagag

SEQ ID NO: 43980 - DNA, 101 bp, rice(Oryza sativa)
  misc_feature (71): n=t or g
catgaacataccgcagtaatgacgttttctcacataacagctagaaagattacaacaatattttcagctgntggaaccagaagaaaagcacatagcaacac

SEQ ID NO: 43981 - DNA, 101 bp, rice(Oryza sativa)
  misc_feature (71): n=a or g
ctctacgatgcatggtgaatagatcaggttgtgttagatatacttgcatgagaaaaaaggtatgcataatnatttgctaatcatacttttgcatgatataa

SEQ ID NO: 43982 - DNA, 101 bp, rice(Oryza sativa)
  misc_feature (71): n=t or c
ttttcaaggttggcaaaacttggggatggggctaccggacataagatgtgagaccaacaaagcatacagangtagtttcaaagcttatgttggattgcaga

SEQ ID NO: 43983 - DNA, 101 bp, rice(Oryza sativa)
  misc_feature (71): n=t or c
gggcttttttttgtgcgataattactcttaataaaactggcgctatgttttcattagaaaccctttttcanatacaacatatgcttgatatccttactgag

SEQ ID NO: 43984 - DNA, 101 bp, rice(Oryza sativa)
  misc_feature (71): n=a or c
tcggtcccggttggaggcctggaagtgggttactgggcttgtgatgaggcctggaagtgctccaactgggntttctgggcttggcgctcagtaatgaggcc

SEQ ID NO: 43985 - DNA, 101 bp, rice(Oryza sativa)
  misc_feature (71): n=t or c
gaagtggttaaactaatggaggaatgcagcaatgcgatactcgacaaactccctgaaaagaagaaggatcnggggtgtcccacaatcacttgctcgatcgg

SEQ ID NO: 43986 - DNA, 101 bp, rice(Oryza sativa)
  misc_feature (71): n=a or g
acgtgggcagctggtcgcaaatccagcgaacaagcgagtccaggtcctttgcgaagtcgtgcatgttggantgtatgaggcttgggatcatcagcctcctc

SEQ ID NO: 43987 - DNA, 101 bp, rice(Oryza sativa)
  misc_feature (71): n=a or g
gaattggaggatagggtcatgcagtggcagagatgatgaaaaaaataccaactcgtgcaacactgaagacnacgataaatgataacaaaattatactaccc

SEQ ID NO: 43988 - DNA, 101 bp, rice(Oryza sativa)
  misc_feature (71): n=a or g
ctgaaatattcttgatgcggtttttttgtcacaaatatatcttcgatatcgctgaaagtgatggtggagtnacgacgtgggtggtctcgcacggtgaggac

SEQ ID NO: 43989 - DNA, 101 bp, rice(Oryza sativa)
  misc_feature (71): n=a or g
tgccgctacccaatatatatgtcgtggcagtacaaaaagaaaaatctcgacgacgcacatgtaaaacaccnaccagtcgacggagccacggcgagagagag

SEQ ID NO: 43990 - DNA, 101 bp, rice(Oryza sativa)
  misc_feature (71): n=a or g
cctccacgggctaagttgtacgctagtcgtacacactatgctagagttgtcttatggttacaacatgtgtncctcggtatttaacaaaagacctagacata

SEQ ID NO: 43991 - DNA, 101 bp, rice(Oryza sativa)
  misc_feature (71): n=t or g
caccgtaagatttctatgaaacctcatgacagttactacaaaattattctttgacatagactaccatatantatatgtacaaaattagttgcatgtttgta

SEQ ID NO: 43992 - DNA, 101 bp, rice(Oryza sativa)
  misc_feature (71): n=a or g
cttcccttcattctttccttcgtttgctcgtcactttgggccaaagcaagatggagaaaacgtgatggtcnctattcgctcgagcagttcatcttaggaaa

SEQ ID NO: 43993 - DNA, 101 bp, rice(Oryza sativa)
  misc_feature (71): n=a or g
gttcatcagctgatcggttgttgggagtcctattaatttgccattggtatgtctattaattaaactagatnaataccccgccgcgttgctgcgggaaatta

SEQ ID NO: 43994 - DNA, 101 bp, rice(Oryza sativa)
  misc_feature (71): n=t or g
ccggcttgcatgtccaattattgagatgtatattcttgcattgcatgatgcatattgattctgtgtccctnatctcgatccatatatcatgtgatcttttc

SEQ ID NO: 43995 - DNA, 101 bp, rice(Oryza sativa)
  misc_feature (71): n=a or g
gaagttccagtggtgcaagaatatttcgatgtatttcctgaagaactaagttcattacctccagatcgggnaatagaatttattatagaattacttcctgg

SEQ ID NO: 43996 - DNA, 101 bp, rice(Oryza sativa)
  misc_feature (71): n=a or g
ataatatttacttaaacagatgcttacgaaaaataaatcatacggaaagtagatgaaatttagcttactanttcatgctgaagtgccacaaatggtttggt

SEQ ID NO: 43997 - DNA, 101 bp, rice(Oryza sativa)
  misc_feature (71): n=t or c
gccatgaaaatgacggaattaattgatcctgtgtacacagcgaaagagcgatcgatgattgagaagacacnacagtaacagtaggagtaagtgtgtgtgca

SEQ ID NO: 43998 - DNA, 101 bp, rice(Oryza sativa)
  misc_feature (71): n=t or g
aaaaaatattgaaaaagactaagaaaccagagaaactaaccaaggattcacaacaatatcaccttgttgancagccgatccaacactagttggtatggttg

SEQ ID NO: 43999 - DNA, 101 bp, rice(Oryza sativa)
  misc_feature (71): n=t or c
cccaaaaggtcttgtaatgtgaaacaaaggaaatagcttctaactatcctggtagttcctggtaatacgcnagacctagcattaccagaacaacagacctt

SEQ ID NO: 44000 - DNA, 101 bp, rice(Oryza sativa)
  misc_feature (71): n=a or g
aaaggtgagcaaagaactcacttttgttcaggcaagcaggggcagagtttgatgctgcagagcaagcaggngggcatggttgcagggttggttggtctctc

SEQ ID NO: 44001 - DNA, 101 bp, rice(Oryza sativa)
  misc_feature (71): n=t or c
caggtgaagtcagacgggcaggacttgccacacttgttgaggattaggctgagatcgacgggaaggttgancctaatgccaaggacgttggccttcacggc

SEQ ID NO: 44002 - DNA, 101 bp, rice(Oryza sativa)
  misc_feature (71): n=t or c
tgcggtgtgcaggattggtcgaggcctcgaggagggagatcgagagggaggaattcttctctctctctctntcatttggagatgtcgatggatttttatcc

SEQ ID NO: 44003 - DNA, 101 bp, rice(Oryza sativa)
  misc_feature (71): n=t or c
ttaaatacaactatagttgcaaaacagtgaacatataacagactttcaaaggatcgcaccctactttgagntatcataatttcaacaacgaaacataacta

SEQ ID NO: 44004 - DNA, 101 bp, rice(Oryza sativa)
  misc_feature (71): n=t or c
tgccgactgagaaaatacaggaagaaacacacaagtaatgtgcagtttgacaaaattgtgttctggagtantctgaaatttcttacagtgaataaaaaaac

SEQ ID NO: 44005 - DNA, 101 bp, rice(Oryza sativa)
  misc_feature (71): n=a or g
aaacttaattaattgatagttttctcgtttcacgtacatgtacttaatcttcctcaacaattatgatggtnttttaacagcaagtttaatagtgtagccca

SEQ ID NO: 44006 - DNA, 101 bp, rice(Oryza sativa)
  misc_feature (71): n=a or c
gcagttgtctggaaagtagcccagccatcccttcctcaaaattttcccgcgtcatcatttttcccaccatnaagacgtgttccggcggcactagcccgatc

SEQ ID NO: 44007 - DNA, 101 bp, rice(Oryza sativa)
  misc_feature (71): n=t or c
cgtgtccgaagaagtccgaaccgcccgatgacaggcgtttgtttgttttaagaagagatagtagcttttanagggtgtggttagtttctgaaaaaagttga

SEQ ID NO: 44008 - DNA, 101 bp, rice(Oryza sativa)
  misc_feature (71): n=t or c
acatttaaccccctaaccttttcaaacaggataaattactcccttggacaggaagaaggtggttttaatcntatatggcacccactcagtcagcaataatt

SEQ ID NO: 44009 - DNA, 101 bp, rice(Oryza sativa)
  misc_feature (71): n=t or c
tcgtgaattcatatattccttatggtgaatggggctatctcccgagcgtgggttgaggttcgtcatcactnatcaatgaaaaaatggaacacttaacagca

SEQ ID NO: 44010 - DNA, 101 bp, rice(Oryza sativa)
  misc_feature (71): n=a or c
atcagaacgaagatttaagtagtacactgatcgggatgaggtggctgttcatattacagccaaaaaaaagncttatcaaattttggtaatgttaaaatttt

SEQ ID NO: 44011 - DNA, 101 bp, rice(Oryza sativa)
  misc_feature (71): n=t or c
agagacaacagaatgaatggccatatatcgatctagaaaaaaattataaataacaaagttatccctaatcnatggattagtaaattaccgatttaccttta

SEQ ID NO: 44012 - DNA, 101 bp, rice(Oryza sativa)
  misc_feature (71): n=a or g
ttattccatctcgggtcataaattgctagggtgcaacattgatagcgatgctagcaacaagtttgggatangattgttcaaactctcttgattccggtgaa

SEQ ID NO: 44013 - DNA, 101 bp, rice(Oryza sativa)
  misc_feature (71): n=t or c
cggtttcaattgttaagatgctaacatcagtgcaaacttaggtacctaatacccaatgtagtacgaggtanccaatacccaatatcaggtttggtacctac

SEQ ID NO: 44014 - DNA, 101 bp, rice(Oryza sativa)
  misc_feature (71): n=a or g
ctccaaacctatttggaagactcccccccctcgagatgcaggttctttgcctagctggtcacaatgaggcnctgttggacggcggactgcctgcgttccag

SEQ ID NO: 44015 - DNA, 101 bp, rice(Oryza sativa)
  misc_feature (71): n=a or c
gttttttcttgctgagatgaccaaaatacccttggatcctatctcatttctccctctatctcttcctcctntccgttgtagttggtgggcagcgccggcgc

SEQ ID NO: 44016 - DNA, 101 bp, rice(Oryza sativa)
  misc_feature (71): n=t or c
catgttagtgacacattctcttctccctctctacattttttctcggtggccgacgatgagactgtatggtngtccaggtgttggaagagggcattgacatt

SEQ ID NO: 44017 - DNA, 101 bp, rice(Oryza sativa)
  misc_feature (71): n=a or g
ccaaaatagacaacataagttcttatgctaacataatcgcttcaaacagacccgcattatcatgcacctantatttcacaaagcaaaatttggagggttcc

SEQ ID NO: 44018 - DNA, 101 bp, rice(Oryza sativa)
  misc_feature (71): n=t or c
gcacaaaaatatattcagtgatcatgaacagtaacctattctttgcaaaatgctgataaagaatgagtttntctctctcttttttctttttggtttctgaa

SEQ ID NO: 44019 - DNA, 101 bp, rice(Oryza sativa)
  misc_feature (71): n=a or g
atgcgatccgggttctcgggactcccgttcacttgctctatggcgattgcagctggatttttcacattttngtccttttaaaaaaattatttcacaaatag

SEQ ID NO: 44020 - DNA, 101 bp, rice(Oryza sativa)
  misc_feature (71): n=a or g
ctactccgccgtggcggtcggctacactgtcgccgagtgccgacacctccaccaagcgtcgtcttcgcccnggacatcggacgccgccgccgccgccgctg

SEQ ID NO: 44021 - DNA, 101 bp, rice(Oryza sativa)
  misc_feature (71): n=a or g
tggcacgtcctttacccagattccgttgcaaagcacaggaaacttactagtatatagaaaacagaggcatntgtttctcttatacaactttcaaccaaagt

SEQ ID NO: 44022 - DNA, 101 bp, rice(Oryza sativa)
  misc_feature (71): n=a or c
ttgaaaggggttaccccttccacttcgcatatccatgttcaaatttctccttgcatcgcagtttgatattnaacttttagttagattggggaggcaattga

SEQ ID NO: 44023 - DNA, 101 bp, rice(Oryza sativa)
  misc_feature (71): n=t or g
agtatcttggggtagtgggtctttagccgtgaaataatatggaaaaaaagcacttttggaggaattaccanattatactaatatggcttatatattatcca

SEQ ID NO: 44024 - DNA, 101 bp, rice(Oryza sativa)
  misc_feature (71): n=t or c
tttcatcaacataggcttcgacatttcgccccagctgcaaccccaagactttgtacaccaacctggtgaangtaacccctgcatttcttaagccgaaagac

SEQ ID NO: 44025 - DNA, 101 bp, rice(Oryza sativa)
  misc_feature (71): n=t or g
gacggagggagtaccttgcacaaacagtagcaactgtggtcaaaatagttcctgtcttcttttccttgttntcagtatgttttggaacaacaccgagtaga

SEQ ID NO: 44026 - DNA, 101 bp, rice(Oryza sativa)
  misc_feature (71): n=t or c
ttcctgtcttgttgattacaggatcaaaccatctaaacatgctccaagcctgtcttgttgggggccacgcngatgcaacttaagtcggatcggcataggca

SEQ ID NO: 44027 - DNA, 101 bp, rice(Oryza sativa)
  misc_feature (71): n=t or c
aaccgggttttcggtgtattcttccctcgacggtcactgacatgtggggtctctattgtgccggagtatanagggcccacctgtcagcgagagcgagcggg

SEQ ID NO: 44028 - DNA, 101 bp, rice(Oryza sativa)
  misc_feature (71): n=t or c
ctcccaataaaacttttactcatggttaaatgagagtaaaagttgtacttacggtggggtcgataaatctnaaacatccatatttacatcttatgatagta

SEQ ID NO: 44029 - DNA, 101 bp, rice(Oryza sativa)
  misc_feature (71): n=a or g
agaccatccatcactgaattagcagcaacagtacgtatcgattgatgatgcacatttctaatatgtatatntatatatatatggtcacgtgcactgatcga

SEQ ID NO: 44030 - DNA, 101 bp, rice(Oryza sativa)
  misc_feature (71): n=t or c
atgatttaatgggctttcgaattaaaaccaaggaagatgtaaaatttatcgcaatcaattttacctagtgnaatgcacgtgcattttactacaaaagtttt

SEQ ID NO: 44031 - DNA, 101 bp, rice(Oryza sativa)
  misc_feature (71): n=t or c
tagctcgaaacaccgaagcaagcgaaagagcatcgccgtgccgcgcggagcttttaaaacgccgcaacttncttccttccttcctctcctcccacgcttcc

SEQ ID NO: 44032 - DNA, 101 bp, rice(Oryza sativa)
  misc_feature (71): n=a or c
atgaaaaaacgctataggaccgaaattatcttcaatattagaagctctaactgctcgatcggaaggatgangaaatctatcagcggaggcattgtatttgg

SEQ ID NO: 44033 - DNA, 101 bp, rice(Oryza sativa)
  misc_feature (71): n=a or g
caactcctttttgctaaattatcctcggttaaaatcactcatttaaacaaaaaccacgtaaaaaaatcttnaacttaactaacatctttagtttctatatg

SEQ ID NO: 44034 - DNA, 101 bp, rice(Oryza sativa)
  misc_feature (71): n=a or g
gtctttttgggaagcacctaacatttggatcaatatctgtctttgccaatacttcctttgcagtatccctnaaagattgtgaaagtttatcataccaatct

SEQ ID NO: 44035 - DNA, 101 bp, rice(Oryza sativa)
  misc_feature (71): n=t or c
cttgtacattatactaacatagtataacatataagtacatttagtgaataaaaccatactccatccgtctnaaaatataacaacttttagctcttaagatt

SEQ ID NO: 44036 - DNA, 101 bp, rice(Oryza sativa)
  misc_feature (71): n=t or c
gagtcgtagggatcacaatctctatgccctgatcaagcgcacgaagctgcatagtgctattgcagttgtangcagtggcaaagaaggcttgagacgcacca

SEQ ID NO: 44037 - DNA, 101 bp, rice(Oryza sativa)
  misc_feature (71): n=t or g
gaggactttgcgtatcgtgtgtcccaacatacacctggtatacatcaaactatcattcaagagcatatcanatcatccaccctggctgaattggatagatt

SEQ ID NO: 44038 - DNA, 101 bp, rice(Oryza sativa)
  misc_feature (71): n=a or c
gcacccgccaagagtcaaatcggtggtaattaacagcgtatgtttcagcataattaattaatcaagtaagngaacactgcaaataaataaataagtaaata

SEQ ID NO: 44039 - DNA, 101 bp, rice(Oryza sativa)
  misc_feature (71): n=t or c
cacacaaaattagaaacaaattcatccgacctgagataatctctaaagaaacaaggaaaatagcatttgangttaagggtgtgtttagttcacgctaaaat

SEQ ID NO: 44040 - DNA, 101 bp, rice(Oryza sativa)
  misc_feature (71): n=a or g
ttatattttagctcctattttgtgggttgcagataaatgctggggctttcctcaactgtcagttagtcctnaaacataagaatagtacttgggacatctaa

SEQ ID NO: 44041 - DNA, 101 bp, rice(Oryza sativa)
  misc_feature (71): n=t or c
aggatgactaggtcattacatgcaaagctgacaccatgcaagccatatgccaggagatacattgatccgtngccgtcaacacaatcttctgatcaaatcaa

SEQ ID NO: 44042 - DNA, 101 bp, rice(Oryza sativa)
  misc_feature (71): n=t or c
ggggaggcctggcccaggatcaccgctcctaaagggcttcgtcgagcaggctgtgggctgggagccagctnaaccacttgaggagcgggaacggactcctt

SEQ ID NO: 44043 - DNA, 101 bp, rice(Oryza sativa)
  misc_feature (71): n=a or c
gttttggcttattatggataaagccaaacgatgggggttgcaatgtgttatcgggggagcaggtttccaantacggggtaccttgagccaaaaatacttct

SEQ ID NO: 44044 - DNA, 101 bp, rice(Oryza sativa)
  misc_feature (71): n=a or g
tgcccgaatgtcgtcgccacaagtagcacggaccgtagataatgcattttcgttttggggagtgtgtggtntcatcactcatcagtatgggatggactgcc

SEQ ID NO: 44045 - DNA, 101 bp, rice(Oryza sativa)
  misc_feature (71): n=a or g
cccgcatcactgccaccgcgcggacccgctcagccatactgccgctgcgagatcgttgacccaaaacaccncgcgcgacctccttctggcgccgtctcctc

SEQ ID NO: 44046 - DNA, 101 bp, rice(Oryza sativa)
  misc_feature (71): n=a or g
atagtaaaacaagatcttgatctccgttgctcggcttttaggcctccatagttttctgttgtttcgtgccntgtattgttgtaccgttttctttttatttt

SEQ ID NO: 44047 - DNA, 101 bp, rice(Oryza sativa)
  misc_feature (71): n=t or c
ctgcaattatgtgtcatgcatttactttaccgtaaccatatgtgcattgactaatatggttttcaatctgnaggtatggctgaacaatatgacatgcaact

SEQ ID NO: 44048 - DNA, 101 bp, rice(Oryza sativa)
  misc_feature (71): n=t or g
aaatgtcgattcggttttcagccaccatgatttttgggcgagattattctattttgcttggctgtcttttnctgccacagagttgttactataacacttat

SEQ ID NO: 44049 - DNA, 101 bp, rice(Oryza sativa)
  misc_feature (71): n=a or c
gagatagaaatgttaggcatcaggatggctgaacgttggcagaactacatggcatgtgaaaggaacaagtntttctcttctagcatcgacaaccttagtcc

SEQ ID NO: 44050 - DNA, 101 bp, rice(Oryza sativa)
  misc_feature (71): n=t or c
aatccatttttgtaggtggtcctcttaacatgtctgtttgtgaaaataggattattttcagaggcgggccngttaaaaggtccccatgtaaaaatcctttc

SEQ ID NO: 44051 - DNA, 101 bp, rice(Oryza sativa)
  misc_feature (71): n=t or g
ttagcattccaatacttttagtggtatataaattactaaggcatatcaatcataaaacactaagagatggngttagggtgatgaaaatggaatcgcctggt

SEQ ID NO: 44052 - DNA, 101 bp, rice(Oryza sativa)
  misc_feature (71): n=t or g
gccggcctagcaagggggcggcgcgggaggcgagttgggctgatgtcccaacaaaggaaaaggggaaaaanaaaagaggaaaaaggaaaaataatttcctg

SEQ ID NO: 44053 - DNA, 101 bp, rice(Oryza sativa)
  misc_feature (71): n=t or c
aacaaacagctgctgacatgactttatgagcttggtcctatgttatccatagctagatccatgagacgatnggtctgtttatgatatgactttactagctt

SEQ ID NO: 44054 - DNA, 101 bp, rice(Oryza sativa)
  misc_feature (71): n=t or g
tatcatgacacaactaagacaatggataccaatatgggagaatttcaggtactagagcacctgtgtaagtntttatccatatgtagattggatgtagattt

SEQ ID NO: 44055 - DNA, 101 bp, rice(Oryza sativa)
  misc_feature (71): n=a or g
agacacgcttgttgttgttcccccctgttaaccagttctttaccagttaccagacgccgatctcctcttcngtggctcttcccgtaacaccgactagaagg

SEQ ID NO: 44056 - DNA, 101 bp, rice(Oryza sativa)
  misc_feature (71): n=a or g
aattcatgagtagtgccaaagtctaaggcaaaatctgacactaccaaaatattggtagtattttagtaggntaaaattatttagttaacatttgaattgtt

SEQ ID NO: 44057 - DNA, 101 bp, rice(Oryza sativa)
  misc_feature (71): n=t or c
tatatccctactggaattagatttattatcatcgatctatcgcggttcttaaattataaacacggatcatnaatatacgacttgctaaaaacgtcatatgt

SEQ ID NO: 44058 - DNA, 101 bp, rice(Oryza sativa)
  misc_feature (71): n=a or g
ggcgatttgtcccaactcggcacatgaagaacgcaaggccgtcgagggggtggggagcccaatagtgagcnatgaagagggaggaggcagagaggccggtg

SEQ ID NO: 44059 - DNA, 101 bp, rice(Oryza sativa)
  misc_feature (71): n=a or g
gcagacaacctggcggtggccacggaaccacaggcccatgaggcatctgcgtctcacacttccaagaagcncctcacctcggttgacgaggtgcccgtcaa

SEQ ID NO: 44060 - DNA, 101 bp, rice(Oryza sativa)
  misc_feature (71): n=a or g
aaaggctccccagatttgactggtctaggtagccgtattgtttctccagtttttgggctgcagagttacantgacaaggtagcattcgactccttttatga

SEQ ID NO: 44061 - DNA, 101 bp, rice(Oryza sativa)
  misc_feature (71): n=t or c
ccctggatcaacttaattattggacatgctattaatcaaccactatctatgactcggctaattggtgcatntcggcattcatggtacatctaatttaaaaa

SEQ ID NO: 44062 - DNA, 101 bp, rice(Oryza sativa)
  misc_feature (71): n=t or c
tacataacttaaacacaaaataaaagggctgatatagggataaacacatgcccctaaagagtgccactagnagccctaaaagtttgacagaactaggcttc

SEQ ID NO: 44063 - DNA, 101 bp, rice(Oryza sativa)
  misc_feature (71): n=t or c
tgacctactcttccctgcatatccctcttttccatggatgtcaggctgggacgaaaccaactgagatcccntgcagtactgcaatagtaccacacaaattt

SEQ ID NO: 44064 - DNA, 101 bp, rice(Oryza sativa)
  misc_feature (71): n=t or c
gcaacaagagctgaggtaatatggggacaaacaaaactttagaggaaacaacagtcaggagccaaggtccnggttactaatgacattgcaatggagatgat

SEQ ID NO: 44065 - DNA, 101 bp, rice(Oryza sativa)
  misc_feature (71): n=t or c
ggttccgtccgctggttcggttgaccgttgggatggccccatgacacgatgagttaactcgttgagtcgcnaattcgtgaggcttgcttactggaggttta

SEQ ID NO: 44066 - DNA, 101 bp, rice(Oryza sativa)
  misc_feature (71): n=t or g
cacatattgcgatattaatgtgcacaacactaatacaaaaccggacatcgtgaatgacccatatgtgacgncagcatgcagccaattacagaggcactcac

SEQ ID NO: 44067 - DNA, 101 bp, rice(Oryza sativa)
  misc_feature (71): n=t or c
atgtacacatacgcttcagaaagttgatgtttaggcatacatccatttgataaaaagataggatgatgcanggtgattgtagagaaagaaatgaaaaatcg

SEQ ID NO: 44068 - DNA, 101 bp, rice(Oryza sativa)
  misc_feature (71): n=a or g
catcgaccatcctccagaacccatcaatctcaacagctgatatggaactcagttgttctgtcagctcaccntcactggcctgaacaagttcacaaaggtcc

SEQ ID NO: 44069 - DNA, 101 bp, rice(Oryza sativa)
  misc_feature (71): n=a or g
aagagaatgaccatatatgcaatgtaatagaaaaaaaaaatgtttctgcagcctaccaagtaatgcaaatngacatggcgagcttgtgcactgtggagaag

SEQ ID NO: 44070 - DNA, 101 bp, rice(Oryza sativa)
  misc_feature (71): n=a or g
tgtgcaatggatgtaccagaaaaaaaacatgcaataatcgatgctgcatgaagcaagaatgggataacgcncaattgagatccactcgctgacatgtgagc

SEQ ID NO: 44071 - DNA, 101 bp, rice(Oryza sativa)
  misc_feature (71): n=t or c
tttcaattacagtgtcaaggccaagtgtaccttccaggcttccatgtagttgtaatcttttctctctctcngttttttttttgggtgaggcatgtagttgt

SEQ ID NO: 44072 - DNA, 101 bp, rice(Oryza sativa)
  misc_feature (71): n=a or g
ggaaaactatatttttgtgaaccccacttgaggtactgcattgtgaagcttgtgcctcttagtgttcctcngcatatgtggcagctcaggtccggcatttt

SEQ ID NO: 44073 - DNA, 101 bp, rice(Oryza sativa)
  misc_feature (71): n=t or c
cctaggtaaacgaagattcctagtttgtaaacttaaaaagaagaatggacaactacatagcatcctggtcnaattagaatttagcatgtgtgacttatgat

SEQ ID NO: 44074 - DNA, 101 bp, rice(Oryza sativa)
  misc_feature (71): n=t or c
gtcagagaggaactgaagatgctatgctttatctatcacgagaagcccatgatggaagagtaaagagtgtnctcttccttatgccttgccattcgacacct

SEQ ID NO: 44075 - DNA, 101 bp, rice(Oryza sativa)
  misc_feature (71): n=t or c
gagagagtatgagtaaaaaatgcagtaaaagaactttctttttttctattgcaactaggagtaatccgttngtcctataatataataacttttaatactta

SEQ ID NO: 44076 - DNA, 101 bp, rice(Oryza sativa)
  misc_feature (71): n=t or g
tacctcagaggcataggtgccatgtgaaggccagattattcgacaatacagtagagaacgatctagctccngaaacacgaactggtggctctgtcttcgag

SEQ ID NO: 44077 - DNA, 101 bp, rice(Oryza sativa)
  misc_feature (71): n=a or g
aagcttctgaccgaagcttatcattttcactctcaatcatatccatgttgccctggatttcctctatcctnctcttaagatccacagattccatcatcatt

SEQ ID NO: 44078 - DNA, 101 bp, rice(Oryza sativa)
  misc_feature (71): n=t or c
gccaaggagacctctttcaactgctccgccaaccacccttgaacaatccagtttatctaaatccctgatcnctgatgaggttaattgacaggtctagatta

SEQ ID NO: 44079 - DNA, 101 bp, rice(Oryza sativa)
  misc_feature (71): n=a or g
acctaacttgttcaatataccttgccagttgtatttgttttagttgtgatatctacgcacctaatttgcantagctactcagtttcttttagcattttttt

SEQ ID NO: 44080 - DNA, 101 bp, rice(Oryza sativa)
  misc_feature (71): n=t or g
actaaaatgctatcttaaactggaggtgttcaccaaagtgctattttcactcttttgggtaaatagaaatntttttcctcaattttaacttttttctggac

SEQ ID NO: 44081 - DNA, 101 bp, rice(Oryza sativa)
  misc_feature (71): n=t or c
gataacctgatgcctaattgtattagcgtgtagggaggctttaatttggcttgtcacatgggcacaccgangacaaaaaacctgggtctgccactgcatta

SEQ ID NO: 44082 - DNA, 101 bp, rice(Oryza sativa)
  misc_feature (71): n=a or g
gtaatttcgtccgcacgaaattaataatgtttctgttacggacgcagtacttcattcgttaaagaaaaaancaaaagtaccacggaatgtaattcatctta

SEQ ID NO: 44083 - DNA, 101 bp, rice(Oryza sativa)
  misc_feature (71): n=t or c
aggttaaagtagtaacgataacgggtttacatttccaatggacggctcgatcccaacccttgtttttttgncaaattttcaaaaattcttatcaaattcat

SEQ ID NO: 44084 - DNA, 101 bp, rice(Oryza sativa)
  misc_feature (71): n=t or c
gaagtaaggaaattcaaacaaattttactggaactgaactacctgcatgttgcacatctttcttgtactcnggcctgaaccgaacatatacatatactgaa

SEQ ID NO: 44085 - DNA, 101 bp, rice(Oryza sativa)
  misc_feature (71): n=t or c
actggaacctcaaggtgtcggctcctaaaccggcacctatgagaatacgtcaaagttcccaactaatgagncccgattgggaaaacaccaccggatctggc

SEQ ID NO: 44086 - DNA, 101 bp, rice(Oryza sativa)
  misc_feature (71): n=t or c
taattttaacttgcatgttgatatccttttcactagtactcctactactttgcaacttgcaaaggaggaanagggtatctttgaggtcaccatgtgtcctt

SEQ ID NO: 44087 - DNA, 101 bp, rice(Oryza sativa)
  misc_feature (71): n=a or g
gaaggggagaggcggaagaaaagagaaggggtgggtctttatatatgtttgtgagttttaggaggcatacngcaaatattggacttatatgcgaataaaaa

SEQ ID NO: 44088 - DNA, 101 bp, rice(Oryza sativa)
  misc_feature (71): n=t or c
taaaggaaactctattattgcggttttttgaaaataaactttattactactgcctataattaagagtctcngaattttgtcaaaatttagactgaaattca

SEQ ID NO: 44089 - DNA, 101 bp, rice(Oryza sativa)
  misc_feature (71): n=t or g
cgcgccagctggcgccgcctcccccgcctgatttttttttcttttctttatctttccttttggcgcttttntcgattatttttttaatctttagcacacat

SEQ ID NO: 44090 - DNA, 101 bp, rice(Oryza sativa)
  misc_feature (71): n=t or c
agccaaggttggtgatctctgctcgcaaggaagatgttgtatacttgtatgttgtatcaatcaatatgaanatttcccttaaaaaaaaaaagaatcaatat

SEQ ID NO: 44091 - DNA, 101 bp, rice(Oryza sativa)
  misc_feature (71): n=a or g
acgctatgttaactgataaagtcctcggacatggattttttacatcccggtatcatgtcactcatcatttncatataacctaaatagttatagattttttt

SEQ ID NO: 44092 - DNA, 101 bp, rice(Oryza sativa)
  misc_feature (71): n=a or g
aattgggaattgatcctatcatcaacgttttcagaggaaacgagtagccgagtactccctccatctcatantaggtgacgttttcgattttttatttataa

SEQ ID NO: 44093 - DNA, 101 bp, rice(Oryza sativa)
  misc_feature (71): n=a or g
aagggaaatacgccgcgagaggggagcgaaactttttttttcgtgcagtagttgcggttgggggagaggangagtcgtgtggtggtgaggcgtgcggctct

SEQ ID NO: 44094 - DNA, 101 bp, rice(Oryza sativa)
  misc_feature (71): n=a or g
tcaactcaaggtcccaaaaaacagaatctaactgctcaatgcatgcagtggaccctgtgtaacgatcagtnttatggttgggttggtactgtggattggag

SEQ ID NO: 44095 - DNA, 101 bp, rice(Oryza sativa)
  misc_feature (71): n=t or g
tctctacatcgaaccgaatatatgcagccatttaaactcaggaccgatgcctttttttaatttttagaggnttttttacctttttatttttatttttttta

SEQ ID NO: 44096 - DNA, 101 bp, rice(Oryza sativa)
  misc_feature (71): n=t or c
gttttttgttttctggaactatttgttcgaatatatgtgtacatattatttaaaaaaatattaaaccgtcngtttcccataaataataattttgaaacatt

SEQ ID NO: 44097 - DNA, 101 bp, rice(Oryza sativa)
  misc_feature (71): n=a or g
ctccacaatccacatagctcatgacacatccctttttggtgtaactacatgatatttgcatgatgaagtcntgtttgcgtctcagcaatatactaattaaa

SEQ ID NO: 44098 - DNA, 101 bp, rice(Oryza sativa)
  misc_feature (71): n=a or c
catgggcaccgatctcagcatacatgtatatcaccacaaaattgcatacatatcattccttggtcgtcaangtactgcacttaattaatcagggtatatta

SEQ ID NO: 44099 - DNA, 101 bp, rice(Oryza sativa)
  misc_feature (71): n=a or c
ttgacgcacactaattaaagagatggaaaccaatgatacaccactgatcttactaaattctagttgaaacntatttatgtgtgtgcaatattcatggacat

SEQ ID NO: 44100 - DNA, 101 bp, rice(Oryza sativa)
  misc_feature (71): n=t or c
atgagcagcaaaaaccgccatgtagatgtggttcgcaaaactgaagagaaaatgcaggaaaaactttcttnaagctctcacacttagtcaggagcatgtgt

SEQ ID NO: 44101 - DNA, 101 bp, rice(Oryza sativa)
  misc_feature (71): n=a or g
cgaccttagggaaacgttcgacagcctccgacgatatcaaatgaagcttaaccaggagaagtgcacgttangagtaccgtcagggaaaatactcggcttcc

SEQ ID NO: 44102 - DNA, 101 bp, rice(Oryza sativa)
  misc_feature (71): n=a or g
aagcattggctcaattcgtcgagacggcttcatttctttctttggttcgtactccgtaaaatctattaggncagtcccaaccctccacctaggatggtgtc

SEQ ID NO: 44103 - DNA, 101 bp, rice(Oryza sativa)
  misc_feature (71): n=t or c
gttggagtaaagagatgaaagagtaactagatgctgaaactgcagcaagatacccttttcttgatgtctcnagcaaagagttttttacctttgagcagaaa

SEQ ID NO: 44104 - DNA, 101 bp, rice(Oryza sativa)
  misc_feature (71): n=t or c
gataaaagaaaattagtgtacggaatagtttatatggaaaagatgatatggtacacatcgtcgaaggcganccggtgccttcaaccttgcagggttggaat

SEQ ID NO: 44105 - DNA, 101 bp, rice(Oryza sativa)
  misc_feature (71): n=a or c
ctctgttttgagctattaagaaagaaatacttgtgttctgggggagtctttcagtgctctactgaaggtgnttctcagttttggtctgggattcttaatac

SEQ ID NO: 44106 - DNA, 101 bp, rice(Oryza sativa)
  misc_feature (71): n=a or g
caaaggtgcaagagggaaagaataatgcaaatgtccacccttgatcgctatgccttgatcatttattcctntggataccaaatcacacaagtaatataaga

SEQ ID NO: 44107 - DNA, 101 bp, rice(Oryza sativa)
  misc_feature (71): n=t or c
gttcattacaaaataataattaatcaataatccggagcctcagttccattctactttcacaaggtcaacanccttcagtagttttgataattaatacatgt

SEQ ID NO: 44108 - DNA, 101 bp, rice(Oryza sativa)
  misc_feature (71): n=t or g
ccttaagggggacctcttgtcgcacacagacagtgacctcacttttaaagacacttgtgtgcctaccacanacttttccaaactgtgcagcaaattgaatg

SEQ ID NO: 44109 - DNA, 101 bp, rice(Oryza sativa)
  misc_feature (71): n=t or c
cgaatgggatgtatcgtagtgctacgaatatagacagatatcgtatctagatttgtacaatactatgatanatctcattcgattctggattgatatattct

SEQ ID NO: 44110 - DNA, 101 bp, rice(Oryza sativa)
  misc_feature (71): n=t or c
tgttgaacagcttcaattttgcacatattttctgccaacatttacatgtatttttccgctacctccagagntgcaatgtcgttctaggctatcaacgtggt

SEQ ID NO: 44111 - DNA, 101 bp, rice(Oryza sativa)
  misc_feature (71): n=t or c
tatacaacgctccctataacccacctttcctccgctagtttttcgttttttaccaccacacattttgtatntctctcctttccatgttatccatgcttcat

SEQ ID NO: 44112 - DNA, 101 bp, rice(Oryza sativa)
  misc_feature (71): n=t or g
gatagataattgctcaaaacacggcgtacgcacggtgatggatcgatgaagcgaccgagagtcgacagacnatcgatggggcgtgtacgtctgtctgtcca

SEQ ID NO: 44113 - DNA, 101 bp, rice(Oryza sativa)
  misc_feature (71): n=t or c
aattcatgcaaatctcagataattccccaagaaccgaaaccctagctacagtaagaccccaaaatttcccnaaatcatgaaaccctaaccctaaaatcaag

SEQ ID NO: 44114 - DNA, 101 bp, rice(Oryza sativa)
  misc_feature (71): n=t or c
ggagatagaggagagttgctaccgtcaacaccacaccagtgagcaccgtggcctctcatgcccacagtatngccgccgtcaacaaagatagaggtggtgcg

SEQ ID NO: 44115 - DNA, 101 bp, rice(Oryza sativa)
  misc_feature (71): n=a or g
ttgtgctccccatgatgttagaaaatgtgccatcgaacttctattttaacatctgctaatattttccctcnatcccatattattacaagggatacaatacg

SEQ ID NO: 44116 - DNA, 101 bp, rice(Oryza sativa)
  misc_feature (71): n=t or g
ctataaatttgctcattcccttcttctttactcaaacattaaattggtcagtgtggccaatattgagtgtngcctgtgttacaaacaattttccagacaaa

SEQ ID NO: 44117 - DNA, 101 bp, rice(Oryza sativa)
  misc_feature (71): n=t or c
atcttcacctccttcgtggtggtctcggtcttttggacaacgaggtgagttgacacgtggcctcggtaatngaggaccgtgtcgacggtcgatacgagaag

SEQ ID NO: 44118 - DNA, 101 bp, rice(Oryza sativa)
  misc_feature (71): n=t or c
gggaggtattaagatatgatatatacgtgagagtatactatttggataggattccgtgctatagcaacccnaattaaatgacaactgtgtttagagtataa

SEQ ID NO: 44119 - DNA, 101 bp, rice(Oryza sativa)
  misc_feature (71): n=t or c
ttgtatagtggaacggagggagtaacttgttattctacctgctcttattagagcaaggttaatggtatagncaactactagctccaattcatttatagcca

SEQ ID NO: 44120 - DNA, 101 bp, rice(Oryza sativa)
  misc_feature (71): n=t or c
attggcccatcatatctcttggattccccaatctgcattccccctggaacgcgtagaacccgttacgcttncgcgtaccagaagtagtgcaacagtcgaca

SEQ ID NO: 44121 - DNA, 101 bp, rice(Oryza sativa)
  misc_feature (71): n=a or g
gatggtggtctaaaacccatttgctttcgaacatttcagctggatagactttgcttctgctgtgccgatcntttttggacatttgcttatcattttcctca

SEQ ID NO: 44122 - DNA, 101 bp, rice(Oryza sativa)
  misc_feature (71): n=a or g
ctagcagagaaaagggagatcagagagacatcgagagagagctcgccctctccctcgtcggaagctgatgngcgttcgtgttcgcatctccctgccgtcgc

SEQ ID NO: 44123 - DNA, 101 bp, rice(Oryza sativa)
  misc_feature (71): n=a or c
cagcttcgaagattgggccagcaaatcaatctggagattgacgacgtgtcacgccctgaagttcccctacnttgctttaaattcataaaataaatcgtcca

SEQ ID NO: 44124 - DNA, 101 bp, rice(Oryza sativa)
  misc_feature (71): n=a or c
acacttcgtccttccagcgcaaagcagcgaataagccgatttaaccgagaattccccatttgcgcaaagcngtggctaattagaactagctcaaagaacat

SEQ ID NO: 44125 - DNA, 101 bp, rice(Oryza sativa)
  misc_feature (71): n=t or c
gtggccccttcctcggggcagcctagcttgtcggcggctgctgcccgtacctccgcaacaccgactttcgngccgtttccacaacgacatcaatgccgcta

SEQ ID NO: 44126 - DNA, 101 bp, rice(Oryza sativa)
  misc_feature (71): n=a or g
agcatgcgcctgggacctcacttggcgacttgtccctaagctaaggagcgcgaaacttcgtcgaagcgagnaagcgcgcggcgccgaaaaagcaaggcgcg

SEQ ID NO: 44127 - DNA, 101 bp, rice(Oryza sativa)
  misc_feature (71): n=a or g
ttttcaaatttcactctgtctgcttgaatctgctagacctattctaacgcgacgcgcgacgatgactgccncgacgacgacggtgccgatgccttggtcta

SEQ ID NO: 44128 - DNA, 101 bp, rice(Oryza sativa)
  misc_feature (71): n=t or c
accgaagttaactaagctaggtttgtgtttgcatgtgacacggtcacagtgagcctcggtccaaggaaggnccttatcctataatgaaagtactttacttt

SEQ ID NO: 44129 - DNA, 101 bp, rice(Oryza sativa)
  misc_feature (71): n=a or g
accgtgcactcgatcgtagtacgtgctagcacaaatgtactccctctgtaacaaaataagttgcagccatnattttccgcgctcaactttaaccactcgtc

SEQ ID NO: 44130 - DNA, 101 bp, rice(Oryza sativa)
  misc_feature (71): n=a or c
atcagtccgtcctaaagacagcgagatctttccacgctaagcacatctcagccgtccacgtgtcgggaccncgtcgcacggatggcgtccagcgcacggcg

SEQ ID NO: 44131 - DNA, 101 bp, rice(Oryza sativa)
  misc_feature (71): n=t or c
gtcaataggcgagtgacggtcaatatttccatggcaaaaatgaactactctatctatttcaaatctatttncaagtagagagaatcccttatatgccattg

SEQ ID NO: 44132 - DNA, 101 bp, rice(Oryza sativa)
  misc_feature (71): n=a or c
ctatcacacatatattttgtacaatataagtatgattatcatggcatagaaaggatcggaaataaaatccnaaattaatttcagcatgcggtggcatgatc

SEQ ID NO: 44133 - DNA, 101 bp, rice(Oryza sativa)
  misc_feature (71): n=t or c
agtaacttagttgaaaggtaaattttgtacagtacaccgtgatttcgtagttttagtcttacgacactgtncgaactcacttttaggggaatgcactccat

SEQ ID NO: 44134 - DNA, 101 bp, rice(Oryza sativa)
  misc_feature (71): n=a or g
catttttcgggagatatatttgaatctccgcaggtggagaccatatgttttttctttgtgcgtaaccactnttagatttaattgggtaattaatccattta

SEQ ID NO: 44135 - DNA, 101 bp, rice(Oryza sativa)
  misc_feature (71): n=a or g
gctgtttttggacagcttggaagggactcataaaccatcatttctaccaagtttcatgtaactcgcatatntggtttgggagatgttagttgagaaccgaa

SEQ ID NO: 44136 - DNA, 101 bp, rice(Oryza sativa)
  misc_feature (71): n=a or c
gttcacagcaaccagcacaacaatgcataggttcagaaggcctgcatggctctacaaaaaaaacaaaaaanaaaaaagattagctgtcagctataagaaag

SEQ ID NO: 44137 - DNA, 101 bp, rice(Oryza sativa)
  misc_feature (71): n=a or g
aaggagtgaatcttacgccctgatctgtccttcgttgatgtaggattattttggattgatactaaaatgtngagtaatccctccattttaaattgatctac

SEQ ID NO: 44138 - DNA, 101 bp, rice(Oryza sativa)
  misc_feature (71): n=a or g
gtaaacaaatatagatgctacctcggtagaaacttgcatttcaaataattagggatagcatgtcgagctangagtttttgttctcagccaatacatatgta

SEQ ID NO: 44139 - DNA, 101 bp, rice(Oryza sativa)
  misc_feature (71): n=t or g
ataattaaatattggttaaaaagttaatcgtgtcaagtactccactagtttggtttagctccagcgatcancagccgatccggtgcttgttctcggcagcg

SEQ ID NO: 44140 - DNA, 101 bp, rice(Oryza sativa)
  misc_feature (71): n=t or c
aagctgccagcggcatagccgaagccaaactacacctcagtatgagctgcagcgccaagaagtgcgaaagntgctagcggcatggccgaagccaaactgca

SEQ ID NO: 44141 - DNA, 101 bp, rice(Oryza sativa)
  misc_feature (71): n=a or g
tctatagcgtgtggcctttagtgtttaccaaaccatttaggatgaggttaccgttagtccatggtttgacngttaccgtaaaaaccgtgcggttaccgtga

SEQ ID NO: 44142 - DNA, 101 bp, rice(Oryza sativa)
  misc_feature (71): n=a or g
gaaacaaccatcagatattattgtgcatgaaattaattccgacaagtaaatgcagaagggcccccacatcnctctcgtgcgggcagatcgggggcagaacc

SEQ ID NO: 44143 - DNA, 101 bp, rice(Oryza sativa)
  misc_feature (71): n=t or g
cactctacctcctatggacaccctcgcggaaataattttttaccaggaaacagtgggggagtcccccacgntaatttcattaataaaaagaaaaattgtac

SEQ ID NO: 44144 - DNA, 101 bp, rice(Oryza sativa)
  misc_feature (71): n=t or c
ggtttcaccattgattgggccgggctacttagcccattaggagcccatgcaagtaaaggacacaacgtgcntctagtaatgtccctatcataagggtaacc

SEQ ID NO: 44145 - DNA, 101 bp, rice(Oryza sativa)
  misc_feature (71): n=a or g
aacacccgagcgattcgattcgcgagagggcaaagcatcgaagcttacttgcggggtggagaagccaaaanaaaatttgttccaaatccaccggacgaatc

SEQ ID NO: 44146 - DNA, 101 bp, rice(Oryza sativa)
  misc_feature (71): n=a or c
aactttatgatctcaaacaacaaggtttcattgagaagcaagaggtatcttccttctgcttgttcataagncactctttcttgttttgctatttactatac

SEQ ID NO: 44147 - DNA, 101 bp, rice(Oryza sativa)
  misc_feature (71): n=t or c
tgtaggtattgaattataaaatctgttcttttaattaaggtatagctagtcagaaatattctctccgtttnatattttaagttgtttgattttttcttatt

SEQ ID NO: 44148 - DNA, 101 bp, rice(Oryza sativa)
  misc_feature (71): n=t or c
ccccggccggatcccacgggcgtcgatccaaaaaacagacgatctccatctcttacaccacttccctgcancaacaatcaatccatcaacatgcactacta

SEQ ID NO: 44149 - DNA, 101 bp, rice(Oryza sativa)
  misc_feature (71): n=t or c
ctaaccgaagaccgaattgctcggtcttaagttttgttggagaccgagatcagttttgagattctaaagancgaatttttaaaaagatcgagaaaccgaac

SEQ ID NO: 44150 - DNA, 101 bp, rice(Oryza sativa)
  misc_feature (71): n=t or c
ccgaagggatgtgattgtacacatagtttacaatggcatagagtagacatttactttttactactccctcngtttcaagttataagactttctagcattgc

SEQ ID NO: 44151 - DNA, 101 bp, rice(Oryza sativa)
  misc_feature (71): n=t or c
ctttcttttttgaggcagatttggattttcgaggtgtagctattaagtcacaaattgttctgctaagctcngcatcatccaagtcaacttcagaaacttcc

SEQ ID NO: 44152 - DNA, 101 bp, rice(Oryza sativa)
  misc_feature (71): n=a or g
ccgaattctctacctctggatctgctactgctgccgttgcccgagttgcctaccatcgctcgagcccgtcnttgttgcccatcgcaggcattctgagggcg

SEQ ID NO: 44153 - DNA, 101 bp, rice(Oryza sativa)
  misc_feature (71): n=t or c
taggtaactattactccctccgtcctataatgttacaacctaggatgggtctcaggactatgaatctgganatgcctcatagtcgtaggatggcatgtcca

SEQ ID NO: 44154 - DNA, 101 bp, rice(Oryza sativa)
  misc_feature (71): n=t or c
cttcttcaattacactaggaaaacgaattgtcctgaagttaattacgcaagcagttaattacccaagtgtnaaaaagaaaacgagttgacctacaattaag

SEQ ID NO: 44155 - DNA, 101 bp, rice(Oryza sativa)
  misc_feature (71): n=a or c
ccgacttacgctagtttaagggagaacgcatccaagagccgtccgattcacgcgcacgccatcagccatcnaacatcatcaagcatgcatgcatgcaaaaa

SEQ ID NO: 44156 - DNA, 101 bp, rice(Oryza sativa)
  misc_feature (71): n=t or c
gggacacatcctagtactataaatctgacaaggggcatgcccaaattcatattactagaataagtcccatncggttctagttactatatttgggacgaagg

SEQ ID NO: 44157 - DNA, 101 bp, rice(Oryza sativa)
  misc_feature (71): n=a or g
cacaaaagacgcgcactcacttctatcaatatgcatacaatacaacctactcctataaattaacacctctnaaatacatacgtcgtctatcagtgaaagaa

SEQ ID NO: 44158 - DNA, 101 bp, rice(Oryza sativa)
  misc_feature (71): n=a or c
gtatagcaaattcgtctgaaatcaactcctctcgggtaaacaaactcccatgatcccatcaacggtttccncatcaaccaccgccgatggtcactgccact

SEQ ID NO: 44159 - DNA, 101 bp, rice(Oryza sativa)
  misc_feature (71): n=t or c
ggaaatcctcgaattattgatcctggtgaggcatcttgatcatctcgtcaatgtcagcaccgtgttttatngtgttcatgcaagcaacttgagtggcctga

SEQ ID NO: 44160 - DNA, 101 bp, rice(Oryza sativa)
  misc_feature (71): n=t or g
ttccaatcatcaacaacatcttcttcttcaccatcacttgtgtctggtatattctgctctctgatatgatncattgaccaatataatcaatggtgctaatg

SEQ ID NO: 44161 - DNA, 101 bp, rice(Oryza sativa)
  misc_feature (71): n=a or g
ctgctggactgggctgggctttagcaggctctaatctagttgaaacgatggctccgatctactcattgacncataataattaattaagtattaactataga

SEQ ID NO: 44162 - DNA, 101 bp, rice(Oryza sativa)
  misc_feature (71): n=a or g
aagggatcttgtttgtactggtttcgtaagttgggagacccgtcatacctggtttttgcgaccaagggacnaaaatcgggttgagaacaagtagagggacc

SEQ ID NO: 44163 - DNA, 101 bp, rice(Oryza sativa)
  misc_feature (71): n=t or c
gaagaagagaggagatgaaaaagaggatagagggaggaaggggatggcacgccgccaacaccatgcactgntggtagtagcgtcgccgccagggacgagat

SEQ ID NO: 44164 - DNA, 101 bp, rice(Oryza sativa)
  misc_feature (71): n=t or c
gtcagaaacggagcttgccttatttgaagaaggcttaaggagtaatccgagtacttgaccggcatgatttngaaaatgcttggcgccgggcatcgatgcat

SEQ ID NO: 44165 - DNA, 101 bp, rice(Oryza sativa)
  misc_feature (71): n=t or c
atattcaatcatatgctaatcacatttaatcatattcaatcatctgctgcgcgacgccgtccgatgccgangccttcgcatccccaaacagtgattgcgcg

SEQ ID NO: 44166 - DNA, 101 bp, rice(Oryza sativa)
  misc_feature (71): n=a or g
aagctcagtaatcgacggtaagtcgaacctgtcgctttctcgattcgggagaattgattattaatagtatntatcgcgtgtgcttgtggtcgcttgcttga

SEQ ID NO: 44167 - DNA, 101 bp, rice(Oryza sativa)
  misc_feature (71): n=t or c
tactcaggtcaatataaccagtaggctacatgcccaactaaaaaatacttaaaaaaagaccggatttgttnatctttctgatcgtaaatataccggtggcg

SEQ ID NO: 44168 - DNA, 101 bp, rice(Oryza sativa)
  misc_feature (71): n=a or g
gaaagaaggagaaggagaattctacaccacaacctgctgcaccactggccaaagagtccaagaggactaanactagcaagaccagctttactgatttatct

SEQ ID NO: 44169 - DNA, 101 bp, rice(Oryza sativa)
  misc_feature (71): n=a or g
ttgctcaaaaaaacatttcaagttatcttacaggagcaaacaaaacaaagtactctcaatagccatcaatncggatttgatcaacatggattatataagtc

SEQ ID NO: 44170 - DNA, 101 bp, rice(Oryza sativa)
  misc_feature (71): n=a or c
cttatatttagaggttttctaactgaaaatttgtcaaaagtactatagctacttccaaacggagcggagtncagcctagcccagcgtgtaattgaatcgat

SEQ ID NO: 44171 - DNA, 101 bp, rice(Oryza sativa)
  misc_feature (71): n=a or g
aacagagaaatgatccaaactgtgatcgatcaatgcatcctcctcttatcaacaatacctcctccgtctcntattaaattcaattttagctatttctattt

SEQ ID NO: 44172 - DNA, 101 bp, rice(Oryza sativa)
  misc_feature (71): n=a or g
ttctaaaaaaacttgcaacacgtgatttttttccctttttgcacaaatatcgatgtgttctaatggtacanaaatcaaaattacgatgtagacaataaggg

SEQ ID NO: 44173 - DNA, 101 bp, rice(Oryza sativa)
  misc_feature (71): n=a or g
gttgcgagccgggctcgaactgaaaaaaaagctgccaacagttgattggtatacatattccattgagccanaagtctcgagttaatagagtttttatcgga

SEQ ID NO: 44174 - DNA, 101 bp, rice(Oryza sativa)
  misc_feature (71): n=t or c
tatcaatattttttttggttgatgacctcactttcgctatgagccacgtaaagaactgaacttttggcgangctctgtttaattttccagacaaagtccta

SEQ ID NO: 44175 - DNA, 101 bp, rice(Oryza sativa)
  misc_feature (71): n=t or c
taggaaaggctaagtaaaacagttataacacaataaacttaataaagttgacggagcttagggctcctcancgggagaccgcgcaggcccccctttgtcgg

SEQ ID NO: 44176 - DNA, 101 bp, rice(Oryza sativa)
  misc_feature (71): n=a or g
taaatagaccgatgtgcggcaatgaattaacggtgttgctcgtggtgcaacggtaagtttatttcttgctntatcttaggactagggttcgaatcccaggt

SEQ ID NO: 44177 - DNA, 101 bp, rice(Oryza sativa)
  misc_feature (71): n=a or g
gtccaccatgcaggcacgcgctcctgggtagttagcattaatcagcggctcaaggaccggtttcctagccngttttaaagaaaaaccggacggtccatccg

SEQ ID NO: 44178 - DNA, 101 bp, rice(Oryza sativa)
  misc_feature (71): n=a or g
tgattccaacaaaacacctgttcaatcacacatccacatattcagttcaaactgattcaaacatgtgctcntcatggttggactcttctgaagaatgatta

SEQ ID NO: 44179 - DNA, 101 bp, rice(Oryza sativa)
  misc_feature (71): n=a or g
tactacctgctgctcgtcgacgacctctcccactacatgtggttgatggttctcgtggcagcaagggagangctgcggacgccatcaggcgcgcacaggct

SEQ ID NO: 44180 - DNA, 101 bp, rice(Oryza sativa)
  misc_feature (71): n=a or g
ggactctgtccggttttttttggtttttttcgccttttttttctgtatcggactctgtccgcttttttttngtttttttcgcccttttttctggatcggac

SEQ ID NO: 44181 - DNA, 101 bp, rice(Oryza sativa)
  misc_feature (71): n=a or g
atgttgttctggcagagcccggcataaaattatgtgacgcatagtaaggtcattcacattacactaagttntcattcagccttcatcggtcagctcggaga

SEQ ID NO: 44182 - DNA, 101 bp, rice(Oryza sativa)
  misc_feature (71): n=a or g
ttcagagtatttcaaattaaactaatatataaaatggtaagctgagagcctgagagtccaagataaatacnactctatgtttattacaccctctatttttg

SEQ ID NO: 44183 - DNA, 101 bp, rice(Oryza sativa)
  misc_feature (71): n=a or c
tgagcaacaaatccccggtcagaaccaccaaaatccccccaaaaaatcgcccaaaaaaatgccgccctgcnaaaatcccgcacctgccgctgctcctcccg

SEQ ID NO: 44184 - DNA, 101 bp, rice(Oryza sativa)
  misc_feature (71): n=a or c
aagccatttcagtgcatcggctgttattgtggaacatcaattttcaaagatttgctagcagtatacacgcnattgtactaaggaaatcaagaccgtatatt

SEQ ID NO: 44185 - DNA, 101 bp, rice(Oryza sativa)
  misc_feature (71): n=t or g
aaaagctttcgacgccattaattaacagagaagctcgatccagcagatgagtttctcaagctaatatgtgntgtgctgagtacttgttgcttgctgaggta

SEQ ID NO: 44186 - DNA, 101 bp, rice(Oryza sativa)
  misc_feature (71): n=t or c
aaaaatttcagagattccctcctctcatctttatcttcttctatcttttccctcctctcatccttatctcnttctctccctcacatcctctatcttttcct

SEQ ID NO: 44187 - DNA, 101 bp, rice(Oryza sativa)
  misc_feature (71): n=a or g
tgccgtgccagcccacgggctgtacacacggcccatgcacggctcattatgactcgggccgtgccgtgctngaccgaaggcaccatagcccattgtgcttc

SEQ ID NO: 44188 - DNA, 101 bp, rice(Oryza sativa)
  misc_feature (71): n=t or g
ctactcctgcttcggttttctgctgttattttctctgataagttgtagctatgataactctaattgtgganattatggataccccatacccgcatggcgtg

SEQ ID NO: 44189 - DNA, 101 bp, rice(Oryza sativa)
  misc_feature (71): n=t or c
taagacaaatgctgagatgcactttggtagtgcaatggagtgtgtggttttagtcccgaagttccatgtgnaatcccaatacgctcacaatttcttttaaa

SEQ ID NO: 44190 - DNA, 101 bp, rice(Oryza sativa)
  misc_feature (71): n=a or g
ctattttggtgtccctcccctcagcgcgcatttttcattttcttttgcactctttccctttttttttctgnaaaagtccattatacaccctcgaactttta

SEQ ID NO: 44191 - DNA, 101 bp, rice(Oryza sativa)
  misc_feature (71): n=a or g
ttaactctgcacctaataacaaatccaaatctcgccaaaatcttatcccttttcaaaatctctcttttatntacatgtagctctccatctcatttcacacc

SEQ ID NO: 44192 - DNA, 101 bp, rice(Oryza sativa)
  misc_feature (71): n=a or g
tttaaaaaggcctcattttaagttttgcatcgggaccttaaaatcttggatatgatgtattgaccgctacngatcatttgattagaatgaaatttgaaacg

SEQ ID NO: 44193 - DNA, 101 bp, rice(Oryza sativa)
  misc_feature (71): n=t or g
gccacaggcctagcagcctagctatatgatcgatcagattaaggatcactggtgtctcttgtgttaaagtnactgttttatctctggggggagctaggtat

SEQ ID NO: 44194 - DNA, 101 bp, rice(Oryza sativa)
  misc_feature (71): n=a or g
ctaggtatgtacatacattaattaatttgtgatcagactggatctagtacttatacatattagcattgatnaattatgctttcatatatatgcatgtccgg

SEQ ID NO: 44195 - DNA, 101 bp, rice(Oryza sativa)
  misc_feature (71): n=a or g
acggcgagtcggaagcgacggcgtgatccagagtatcataatatatatatatagggaatctaaagcattanatatttttccttataaaaggaatcataata

SEQ ID NO: 44196 - DNA, 101 bp, rice(Oryza sativa)
  misc_feature (71): n=a or g
tggagtagagcttgatgagacgattttgcccctgcttgccggctaaaaggggatcgagatctcgcgagctnccggccatggctcgacgcgccgcagccgcc

SEQ ID NO: 44197 - DNA, 101 bp, rice(Oryza sativa)
  misc_feature (71): n=t or c
atagtaccaggattctattccatatatacatatttgaaattcatctttaataaattgtactccccgcatcntataagataaagcattgtcaaacttgacac

SEQ ID NO: 44198 - DNA, 101 bp, rice(Oryza sativa)
  misc_feature (71): n=a or c
ggtgatagattacatgcatgcagagcattaaatttcagtgggacaaaatatatatacgaaccaatgtaatncaccgcacgtctttgatacagaactcacgc

SEQ ID NO: 44199 - DNA, 101 bp, rice(Oryza sativa)
  misc_feature (71): n=a or g
atttcaagggaaagaagactatcatctcataccaagattcctgattcacctttggagcttccactcttatntcatatataggctatatagcttccatgtgt

SEQ ID NO: 44200 - DNA, 101 bp, rice(Oryza sativa)
  misc_feature (71): n=a or c
gttttgcaccgtggcagtgttgcattaagggtttctgcaatttgcctagcttattgacctcatgtgacganatgacctttcatttatttgttccgttgcag

SEQ ID NO: 44201 - DNA, 101 bp, rice(Oryza sativa)
  misc_feature (71): n=a or g
ttaacattaatattaccgaggctttgaatggatggtagtatttaggtggatatccaatgcacaaaaacttnaagatcttttcagaatcgagtggaaaccat

SEQ ID NO: 44202 - DNA, 101 bp, rice(Oryza sativa)
  misc_feature (71): n=a or c
gtaaaaaaaaaagtgctgcatcatccagaagaggaaaaaaaattaaaaataacaagggaagaaagctaagnaaagggattattaccaatgcagcgaggctc

SEQ ID NO: 44203 - DNA, 101 bp, rice(Oryza sativa)
  misc_feature (71): n=t or c
cactgttgtcctactgtcacccgcctttgttctcttctcgaactcctgccgccttgccaccgctgagatangggggcaatacaacttcctcaagctcctcc

SEQ ID NO: 44204 - DNA, 101 bp, rice(Oryza sativa)
  misc_feature (71): n=t or g
aaaactgttttcttagcatttggttttggcaaaatttcaccacgttcagtaatactgaaaacattaggttnatttttggtgaaatagacatgaacatcaaa

SEQ ID NO: 44205 - DNA, 101 bp, rice(Oryza sativa)
  misc_feature (71): n=a or g
tgcacaatgtatatattatgtgctagcttagcttgttaaatgaaaatatcggttttgtaccgacaattgancactttagtgggattaactagtttgacgaa

SEQ ID NO: 44206 - DNA, 101 bp, rice(Oryza sativa)
  misc_feature (71): n=t or g
agatatcaagattagaaaaaaattggaaaaaaaatacactgtgaattagactttagtttgtttaggtgatngcgtgatgcagttcagcagctgaggcccaa

SEQ ID NO: 44207 - DNA, 101 bp, rice(Oryza sativa)
  misc_feature (71): n=t or g
gagaggaagcgatgaatcttagcacaaggagaccatgacagccaacctctttgataaaattaagaaagaanctaggacgtacttgggctctggcatgagca

SEQ ID NO: 44208 - DNA, 101 bp, rice(Oryza sativa)
  misc_feature (71): n=a or g
acgtaggatatcgaattttgatcctgtcccagtctgtctacttgttaactgttcagttaaaaagtaacttntgtgtccggactctggtgaaaacaatgaac

SEQ ID NO: 44209 - DNA, 101 bp, rice(Oryza sativa)
  misc_feature (71): n=t or c
agaggactatgatttaattggttgcgctacaaataataaaccctagaaaaacatagcaatcaaacggtggnactaatatacgcggaattttagatcgagcg

SEQ ID NO: 44210 - DNA, 101 bp, rice(Oryza sativa)
  misc_feature (71): n=t or c
gaactgacaaatgtgagggtgtgctatcagacgaaacagacggcttagaaaattcttcatttttcgagtcngatccctgcaagttcaattaaatagttcaa

SEQ ID NO: 44211 - DNA, 101 bp, rice(Oryza sativa)
  misc_feature (71): n=a or g
atattaccttaacatgtgtctatatttatctctaaaatttaagtcttttggggacaaagggagtatgtcgnatccagatcctctgcattacagaagctaat

SEQ ID NO: 44212 - DNA, 101 bp, rice(Oryza sativa)
  misc_feature (71): n=t or c
gtggttgcgtgtggtggaaaaaggccacgggtgtgatgacgaccatctcaacgtcgaccatcccatagttnagccgctccacgccgttgggaggaaggcgg

SEQ ID NO: 44213 - DNA, 101 bp, rice(Oryza sativa)
  misc_feature (71): n=a or g
ggagatgggccgtggaatgcgttatgcgtagcgcgttgaggtgaagagtatcgccagcggaacgtgattcnatctatgttattacaatacaacttccaaat

SEQ ID NO: 44214 - DNA, 101 bp, rice(Oryza sativa)
  misc_feature (71): n=a or g
ggaaaggatggacaatatataaaggggaaccactaagctagtctcgtacgatcgatatgcatgccactatncctatgcttagttcagtgtaaagtttagat

SEQ ID NO: 44215 - DNA, 101 bp, rice(Oryza sativa)
  misc_feature (71): n=t or c
aataaataggtaagaaaagagatgttagaaaacagctcgaagatattatcacctactttacttgacatgtnggtaaaataaacataaatgttccttatggt

SEQ ID NO: 44216 - DNA, 101 bp, rice(Oryza sativa)
  misc_feature (71): n=t or c
tttaccgtgactagatctgaattaacatccacatcgacaacggcagccaacgcggtggtgcactttaattncttctgcagaaaggttagcaacacgcgcta

SEQ ID NO: 44217 - DNA, 101 bp, rice(Oryza sativa)
  misc_feature (71): n=a or g
gaaaccaaatcaatagctatggtcaacagaagagtgagaatctactactaccaataaaggaaacaagttcnttacatcagccattaggtagtaattaacca

SEQ ID NO: 44218 - DNA, 101 bp, rice(Oryza sativa)
  misc_feature (71): n=t or g
tcaccatccaaacagttcttcctccatagaaatgtgttcgacttattttattcattggtttttttgaatgngatatctaagatttaaacaaaaaagataaa

SEQ ID NO: 44219 - DNA, 101 bp, rice(Oryza sativa)
  misc_feature (71): n=a or g
gcgaatcacttctctttctctcgcaaagctgcttctccgtcctgcgacgatgacctcaccatcagtggcanctcacccgtataacaccctatcttctacct

SEQ ID NO: 44220 - DNA, 101 bp, rice(Oryza sativa)
  misc_feature (71): n=t or c
aattcaaatgcaagtatgcaataatgcaacgcatcaactgatgaattagtcctgtgtctcttttttttttnccctattttggcgggcaaatgacgcgcgtg

SEQ ID NO: 44221 - DNA, 101 bp, rice(Oryza sativa)
  misc_feature (71): n=t or g
ttgcgagcagtgagcctggccttcctatcccatgggccatggcgccgctgattcccggaacagatacccgncggcgcccatgccgcccatctcctgacgtt

SEQ ID NO: 44222 - DNA, 101 bp, rice(Oryza sativa)
  misc_feature (71): n=a or c
atataaattaaacaacactcgaattattattcattttgaatagcggtgttgatcgatcattccagtagggnagggcgtggatagggacctgtccggcacgc

SEQ ID NO: 44223 - DNA, 101 bp, rice(Oryza sativa)
  misc_feature (71): n=t or c
catcgccttttctctttaaaaaggaccatcatgtgcatctaacttaattatttgtttttagagaacttcanatataggcataaattaataacacaaaaccg

SEQ ID NO: 44224 - DNA, 101 bp, rice(Oryza sativa)
  misc_feature (71): n=t or g
gatttttacttgaaaatcaaggtttataggggtgttcttaaaaaagttgtggggttagctgaccccacagnctatgcatagacccatcactgggatccggt

SEQ ID NO: 44225 - DNA, 101 bp, rice(Oryza sativa)
  misc_feature (71): n=a or g
ctggaggggacggaggcagcgagggagaaggaccagcgacaaagacgggtatggagaggaacgggcgatgnaggagagggatggaggggaatgacgttgat

SEQ ID NO: 44226 - DNA, 101 bp, rice(Oryza sativa)
  misc_feature (71): n=t or g
tctccatcattggcaacgtcatgcagatggacttgcacgtgctctacgacctcgacggcgggatgttctcnttcgcgccggcggattgcgccaatgtgtga

SEQ ID NO: 44227 - DNA, 101 bp, rice(Oryza sativa)
  misc_feature (71): n=t or c
caccgacagtccgagaccactcatctctcgtttcttagttcttccttatccatccccctctctctctctcnctctctctctctctctctctctctctctct

SEQ ID NO: 44228 - DNA, 101 bp, rice(Oryza sativa)
  misc_feature (71): n=a or g
ataggcaactggtgagcatgatctttttcagtttactttgcatttcccgcccattatgttttcctgacccnctcataggaagctctttcgttgtttgtcaa

SEQ ID NO: 44229 - DNA, 101 bp, rice(Oryza sativa)
  misc_feature (71): n=a or g
gtttaatttaacggattaagatcgcacttccaccgaccaattgagttgaattccttagaattccaacatcngcacctgcttggaatgatttggcccctagt

SEQ ID NO: 44230 - DNA, 101 bp, rice(Oryza sativa)
  misc_feature (71): n=t or c
tatgcagcgttacaatagcttgcagccaaaccatcccatctttgctgatgcgtgtgcttccgagttattgnggctcatcgatccagatctcatctccgacg

SEQ ID NO: 44231 - DNA, 101 bp, rice(Oryza sativa)
  misc_feature (71): n=a or g
taagcacctgcttattcgacatttttatgtccatctatgtttggccttaatttgtggcatgcacaactttngttagacgattcatttcgttccaattactt

SEQ ID NO: 44232 - DNA, 101 bp, rice(Oryza sativa)
  misc_feature (71): n=t or g
attgttatgccctagtacaaagtactaagactctgactatgaggagtactaagatagtactactcctaagncctaagagattatatttccttccccaaaat

SEQ ID NO: 44233 - DNA, 101 bp, rice(Oryza sativa)
  misc_feature (71): n=t or c
ctacgtataaagttgcactatatcttttttcccggatgatcaacctgccaatcaaaaagtttgtaattttntgggtccgtatctcaattggtgaacaacac

SEQ ID NO: 44234 - DNA, 101 bp, rice(Oryza sativa)
  misc_feature (71): n=t or c
ccttgaccacgccggggtagacgtccacatgccggtactcgcccaactcaccaccaccgggtttcacccancgcatctcgtccacgcctgggtcgtcatcc

SEQ ID NO: 44235 - DNA, 101 bp, rice(Oryza sativa)
  misc_feature (71): n=t or c
ccttgacatcctctcggcatgcgcccgaagctcgcacgtcccagccaaacacctatgtgcctatcctcctntgatccgccgccacatcctcccattcctct

SEQ ID NO: 44236 - DNA, 101 bp, rice(Oryza sativa)
  misc_feature (71): n=t or c
ccaactattattttaggacaaaatatgttacgtctggattttatcatgcgatcagtatggaccgagacganaacgaaaaaacatgtggtttttcggtcgtg

SEQ ID NO: 44237 - DNA, 101 bp, rice(Oryza sativa)
  misc_feature (71): n=t or c
tgaggggacgtagttgcgttttggcgtgaggagagagaaacaccaacgtcctggatagcgtactgtcacgnccagaaattcctgaatagaattccaagcag

SEQ ID NO: 44238 - DNA, 101 bp, rice(Oryza sativa)
  misc_feature (71): n=a or g
tatataagcacaagaaataattaagatcagattttatatatgtaggcagaaaaccagcataaggaaaatcnattgaaatgatctaagtacattacgtactg

SEQ ID NO: 44239 - DNA, 101 bp, rice(Oryza sativa)
  misc_feature (71): n=t or c
atttttggtcccttctcccttccctcattgtcttctccacttttctctcactctacattaccatcctcctnatctccatcccaatcctccaaattaaactc

SEQ ID NO: 44240 - DNA, 101 bp, rice(Oryza sativa)
  misc_feature (71): n=t or c
tactgcctctcaaggtcttagctttataattttttcctgctcaatgaattatcgcacggtctggtgttgancattaaaaaataaatactacttaacatatt

SEQ ID NO: 44241 - DNA, 101 bp, rice(Oryza sativa)
  misc_feature (71): n=t or c
taatgttctgaagctgcagagatcaagtctgtgtaggtagagtagagctgtagaacagtagaagattatgnggatgggggaggtaaaggctgaatacttaa

SEQ ID NO: 44242 - DNA, 101 bp, rice(Oryza sativa)
  misc_feature (71): n=a or g
gaagacgggtggagacatgagcgccacccgtaactaagaaccttttgcgaaaactaaaaactaaatgatgnctaaatattttcgactaggtggcacatata

SEQ ID NO: 44243 - DNA, 101 bp, rice(Oryza sativa)
  misc_feature (71): n=a or g
atgtgtcaaaattcgacgatgttgttgtacctaggagctgcgccttataggctgaggtggccgtgtattcnccatggttgttgagcttccaggtgatctgg

SEQ ID NO: 44244 - DNA, 101 bp, rice(Oryza sativa)
  misc_feature (71): n=t or c
aagaaagcatctgaaaaattattaaatggttggaattatagaagttttatcaaagaggattgctcccatcnagcaggtaaccagcccggtaccaaatctca

SEQ ID NO: 44245 - DNA, 101 bp, rice(Oryza sativa)
  misc_feature (71): n=t or c
agagaccggttctcttgcgcgacgtcaaaccggaagacgttctccttcgccatctgcagttggagacggangctgccgatgtgacggtcactccaactctt

SEQ ID NO: 44246 - DNA, 101 bp, rice(Oryza sativa)
  misc_feature (71): n=t or c
ttaattccgcaccttaatcccgatgggattaaccaaagaaggccttaggataagtttagaggcattttggnaatttgataagggcaaataataatactccc

SEQ ID NO: 44247 - DNA, 101 bp, rice(Oryza sativa)
  misc_feature (71): n=a or g
ggctcagaaagtgaaaataaatggatgattgaacattaaattgtatggcctagatcgatttaaattagatnggggactgacatgtggggctagggggtatt

SEQ ID NO: 44248 - DNA, 101 bp, rice(Oryza sativa)
  misc_feature (71): n=a or c
actagtcgtcgtacttgccattttgcaacgtgtccaatattatgaggtttcgccaactctatcgttctcantgcaccacccatccactccctcctcatcta

SEQ ID NO: 44249 - DNA, 101 bp, rice(Oryza sativa)
  misc_feature (71): n=t or c
ttagccaacagaaagcttatccagaagagaccgagttcgagaggaaatcatgaagaccacaacatggcagnttgaatttatctataaattaggcagagtca

SEQ ID NO: 44250 - DNA, 101 bp, rice(Oryza sativa)
  misc_feature (71): n=a or c
acaaccatcaccaccaactaaatcgtcatctctcggctctaggtcattagctagctaatgaactctccccncacacacacacttcactgtccacttataaa

SEQ ID NO: 44251 - DNA, 101 bp, rice(Oryza sativa)
  misc_feature (71): n=a or g
ccgcagatttccgatcgatgagtggacacaagtcgcgtggtcctcgcattatgcttagtttcaacctcctngcccggctttagatggactcgatgctagcc

SEQ ID NO: 44252 - DNA, 101 bp, rice(Oryza sativa)
  misc_feature (71): n=t or c
cagtctatccgttttgtacgccggacaataactgctgatacgctcctgtcttccggacaaggattttctanacttgccatgtcacctatcatttacatgcg

SEQ ID NO: 44253 - DNA, 101 bp, rice(Oryza sativa)
  misc_feature (71): n=a or g
gggacatcaatggtgctatggggattcaaaccatcctggattacctcaatctttggtcgctcgtacaatcngttgatcaactaagtaaccaaccagactca

SEQ ID NO: 44254 - DNA, 101 bp, rice(Oryza sativa)
  misc_feature (71): n=a or c
tccatcggcaactttgggtcctccggctgaacatggcttttatgttcaagtagtctactacttcctctatnctagtttatatatgggtagtggacttgttc

SEQ ID NO: 44255 - DNA, 101 bp, rice(Oryza sativa)
  misc_feature (71): n=a or g
gcggtgctgccgcggtgaccatgtagctgatgatcctcctcgtcggcggtgatctgggtggtggtgcggcngcggcggcggcacgaatcccgtcgtgcatg

SEQ ID NO: 44256 - DNA, 101 bp, rice(Oryza sativa)
  misc_feature (71): n=t or c
gccttgttgaccggccagttagccatgcgttctgggccaccgttgcctttcctcgtcgccaactcacctgnccggtggctcgcaacgtcactctcgccgcc

SEQ ID NO: 44257 - DNA, 101 bp, rice(Oryza sativa)
  misc_feature (71): n=a or c
aacatcgactgcaacgggtgctaccacaagatcaggagggcgctgctccagatgcaaggtatcgctccgtncctaaatattcaacgccattttaaacatat

SEQ ID NO: 44258 - DNA, 101 bp, rice(Oryza sativa)
  misc_feature (71): n=t or c
gggcgtcttcgtttgttacctcctgtggggacaccccgaaaatccacacgtgatcatccaggatttcggtnatgcacagattgatatacagaacaactttc

SEQ ID NO: 44259 - DNA, 101 bp, rice(Oryza sativa)
  misc_feature (71): n=t or c
cggtggctgcggcgagcgagcagccctagaagcggcgaagatggatggctctgtttcttttaaggctgttngtcgccgcaccggtgagttgttcttgggca

SEQ ID NO: 44260 - DNA, 101 bp, rice(Oryza sativa)
  misc_feature (71): n=t or c
ctcaatttgggcaggaattaatggcggatagaatcagcaacttcgatcatctttattccggttggcatgtncttttcaaaagtaaaattgatccttataga

SEQ ID NO: 44261 - DNA, 101 bp, rice(Oryza sativa)
  misc_feature (71): n=a or g
ccaatgatgtgttagtgcatttttctcttgcatgcatccaagctgctactctcagccaattgtagaatctnagtgaacactagaaaaatcaaagctagcta

SEQ ID NO: 44262 - DNA, 101 bp, rice(Oryza sativa)
  misc_feature (71): n=a or g
gtagacatcctgatcacgcgtcctgttatatgttgtacataaaccgagccaccgcctcctcgcaatatacncgaaaaccaatctagggtttgcctccttct

SEQ ID NO: 44263 - DNA, 101 bp, rice(Oryza sativa)
  misc_feature (71): n=t or c
tggtacggacagtagtacataaacttaccccaaaacatggggaattcaacagcaaaacaaaaaaactcacncaaaagaaaagaaacagaactaagcttgaa

SEQ ID NO: 44264 - DNA, 101 bp, rice(Oryza sativa)
  misc_feature (71): n=t or c
gcatataatggttgcgaagtacattttatatgctaaaatcgttagggatttattggcatgatcttccttgntaggtacattttatcttagaaattctggta

SEQ ID NO: 44265 - DNA, 101 bp, rice(Oryza sativa)
  misc_feature (71): n=t or c
caacgtccgtgaaacataacttttggattttttctttaacaaatcctgggctagccgaggacggtgatggnggtagtttctcggccatgaagaaaattgct

SEQ ID NO: 44266 - DNA, 101 bp, rice(Oryza sativa)
  misc_feature (71): n=t or c
atgctgagtttcatactatttggcgtgctgtaggatgggataaatttgcatgtgtagaagagccgggttcncgtttgcttaccatgcagtttttatgtgcc

SEQ ID NO: 44267 - DNA, 101 bp, rice(Oryza sativa)
  misc_feature (71): n=t or g
tgacattgtctttcggaggttggaaacgacagtgggctatgcgagctgacctatagctccacttgacaagnaaggaatgaaatgagtttttggtccaaaac

SEQ ID NO: 44268 - DNA, 101 bp, rice(Oryza sativa)
  misc_feature (71): n=t or c
attggtagttgcttgatttgtgcgagttggaaaatagtgaaagaacacatccatccctggcctgtgatgtngataatacacaatcgcttgaaatgcggcct

SEQ ID NO: 44269 - DNA, 101 bp, rice(Oryza sativa)
  misc_feature (71): n=a or g
aaaaacaacagttatactaaaaaattcatatcgtctaaaccagttgagataaaaccgctctctttggtcanaagatagacataaatattatctacaacttc

SEQ ID NO: 44270 - DNA, 101 bp, rice(Oryza sativa)
  misc_feature (71): n=a or g
atcttgacctctccaccaaattctatgctctcgtttacgatgacgaaaacaacatcatgaagttcaccttngattcattttggcagctcaaagcgccaaac

SEQ ID NO: 44271 - DNA, 101 bp, rice(Oryza sativa)
  misc_feature (71): n=t or g
ttgcgtcatcgtattccttcgagcactttgtcccgcaccggcattgcgcatcttgatatcttatactactntaagtttgactaattatgtagaaaaaatta

SEQ ID NO: 44272 - DNA, 101 bp, rice(Oryza sativa)
  misc_feature (71): n=t or c
actatactattaaacttcctcttaagcaaccacaaattaaatcgctccgtccacacgggacagtgtacccnaataaataaagcatattttttttttctttt

SEQ ID NO: 44273 - DNA, 101 bp, rice(Oryza sativa)
  misc_feature (71): n=t or c
tgttcatgcttacctttccattctactttaagacaaataatttgtgtttaggaagtacacttgtgctcatnggtttctttttatacaacaatatgcaatat

SEQ ID NO: 44274 - DNA, 101 bp, rice(Oryza sativa)
  misc_feature (71): n=t or c
tgctccagtgttgtcacatagaagaggtgtggagacatcacaagaaacaccaaaatcagctagtagccaangcagccacacaatttctgaagtggtagtag

SEQ ID NO: 44275 - DNA, 101 bp, rice(Oryza sativa)
  misc_feature (71): n=a or c
acattatccttttcaaaaggaaaagggaaaattgtcgggtttttttataactaaaattgtcggtttgctcnacgttttatttcatgatggggagtacctat

SEQ ID NO: 44276 - DNA, 101 bp, rice(Oryza sativa)
  misc_feature (71): n=t or c
tgcacgaatctcaaagtgatccaatagtttagaatttccgagattttgggaggttttttctatcagaaganatttagatagtccctaaactatatgtcaac

SEQ ID NO: 44277 - DNA, 101 bp, rice(Oryza sativa)
  misc_feature (71): n=t or c
aatacattccatggctaatattacgagttttttcgacggttgcttagactcgacggtagcactggctcaanagaggggatttgcaattataacactgcaaa

SEQ ID NO: 44278 - DNA, 101 bp, rice(Oryza sativa)
  misc_feature (71): n=t or g
aatatggacctggttctccattaatgtttatgaacttccaaacaaaaatcattactatcaatttccagttnaataatccattaacttaataaacatatatt

SEQ ID NO: 44279 - DNA, 101 bp, rice(Oryza sativa)
  misc_feature (71): n=a or g
tgcatactatgtatgacgtactccaacggaccatcactaacctttaaacaatgatatccatagatattacntatgtatggtttgtgctatcaatagaaatt

SEQ ID NO: 44280 - DNA, 101 bp, rice(Oryza sativa)
  misc_feature (71): n=t or c
cagggttccagctgatgaaagcctacccacgtcgctacgaggctccaaatccttttcgtgtatttgcactnagcgatgaggtgcagagccgtttcatcctc

SEQ ID NO: 44281 - DNA, 101 bp, rice(Oryza sativa)
  misc_feature (71): n=a or g
acacctaccaggccaccaaacttcgcagctaacaaatgcagaaaacttaactcctccacacacacgatcantctaggcacaatcagtactagctagcagta

SEQ ID NO: 44282 - DNA, 101 bp, rice(Oryza sativa)
  misc_feature (71): n=t or c
gaagaaaaatatatagtgcaaaccccatatgtactaaaaatctaaaaactactactagatctaaaaataangtctgataccaatagtaaaagtttgagtta

SEQ ID NO: 44283 - DNA, 101 bp, rice(Oryza sativa)
  misc_feature (71): n=t or c
tcccaggcaaccgcccacccagtatatagtataaaggcctaaaaaatacatgatttttctagattggcctnctagctccatcttcacaagcgctacaacca

SEQ ID NO: 44284 - DNA, 101 bp, rice(Oryza sativa)
  misc_feature (71): n=t or c
tcggctttgcatcttcttggaggctgttggtgcaatctaactcccggtttgataggtagctgttgacggtngttatcgatcagtttcgaccgtcaatatta

SEQ ID NO: 44285 - DNA, 101 bp, rice(Oryza sativa)
  misc_feature (71): n=a or g
attggggacgtcttttatatgtcaaaggacgtcgttgacgatgaaaccaccacttttggttggtccttctncgtcgtgtagcggtcatcgcaatagtgatg

SEQ ID NO: 44286 - DNA, 101 bp, rice(Oryza sativa)
  misc_feature (71): n=t or c
cgtcgactcgtgttctcgctctaccattccctcctccagcatatcagtgagactgacgtgatcacgctatngccgatcttggttggcctattagacatgct

SEQ ID NO: 44287 - DNA, 101 bp, rice(Oryza sativa)
  misc_feature (71): n=t or c
ttaatacactactaaaaaaaagtattttcgtaggcggacaaaaatgatttttgcatgcggagggttggacngcttgtaacacaacgacggtgaaaatcaac

SEQ ID NO: 44288 - DNA, 101 bp, rice(Oryza sativa)
  misc_feature (71): n=a or g
atgatcttcgacctgaagatgggccaggaatgtagtcaaaattgtacatattacccctttccgtattctcnttttataaataggccctctagaaaatttat

SEQ ID NO: 44289 - DNA, 101 bp, rice(Oryza sativa)
  misc_feature (71): n=a or g
tggagaagcttgctctatcaagcaaactcctagaaactagctcgggtttcactgacttacttcttcccttntggaagtgaggaaaacctgttgacgatcct

SEQ ID NO: 44290 - DNA, 101 bp, rice(Oryza sativa)
  misc_feature (71): n=t or c
ccaaaaaacagacgcttgcgttcagatgcgtagcttctgatacaaaaatatattccatgtgtgtaattaantaaaacatgacagaccaacttaaaagttga

SEQ ID NO: 44291 - DNA, 101 bp, rice(Oryza sativa)
  misc_feature (71): n=t or c
aacactataaaaaacgatttagtacaccgttaaagacgaacaataattggtcgcatatgtaaaaatcgacntctattttcacacctatatacaaaaatcta

SEQ ID NO: 44292 - DNA, 101 bp, rice(Oryza sativa)
  misc_feature (71): n=a or g
tcatcttcttctccttttgcttcttcttcgtctcttctccggccgccgctgccgacgccttcttttctccngccgtctccgtcgctgccggcgagattacg

SEQ ID NO: 44293 - DNA, 101 bp, rice(Oryza sativa)
  misc_feature (71): n=t or c
tatcctaatataacgaatttgaacaaaaatgttgtacgagctatatttgtttgagttactcaaggtggtanaggatacgactacaacatattctaggtcga

SEQ ID NO: 44294 - DNA, 101 bp, rice(Oryza sativa)
  misc_feature (71): n=a or g
agggggtgaagtcagagaagcacagtacctctgacttcaccccatctcagccgtccgatgtaaatccgacngtcgaaatcaatcgctacagtaatttgcga

SEQ ID NO: 44295 - DNA, 101 bp, rice(Oryza sativa)
  misc_feature (71): n=t or c
tcactattatgtggatcctatggtttttcctaactttaagtgtgatgtcagccaaaaccaccgttcaaacnacctttcaaaccaccttgagaccttatttg

SEQ ID NO: 44296 - DNA, 101 bp, rice(Oryza sativa)
  misc_feature (71): n=t or c
ctttttttgtgatgtgtcatacggtcgttggcccccgccgataggggtacattttgtagcggtccccttgncgcccaaccagaggacgttttttatgcgag

SEQ ID NO: 44297 - DNA, 101 bp, rice(Oryza sativa)
  misc_feature (71): n=t or c
ctcttctacgaaacgtgcagtgccggtagttgcatgatgtctacgtgcttaattggagtattaaaagttgntgctgctgctgctgctgttgcttgttgctt

SEQ ID NO: 44298 - DNA, 101 bp, rice(Oryza sativa)
  misc_feature (71): n=a or g
ctaaccgcggaaacaacagacagatatcggtatttcgagcagtaccagagaaatccaacccacgattgcanccagtgaagaacggagatgagttacagcaa

SEQ ID NO: 44299 - DNA, 101 bp, rice(Oryza sativa)
  misc_feature (71): n=t or c
gagttggtaactactccttttgtaaggagtatagatttaaatagtgtgtttcccataaaaataacaagcanatataaaagaatttacgagaaccatttcct

SEQ ID NO: 44300 - DNA, 101 bp, rice(Oryza sativa)
  misc_feature (71): n=a or c
agatacaaaacatcggacacctaggaccagctcactcctttacttactagtttctcctttctccctgttgncgtcaaaaaaatgttgcaaatcggtagcct

SEQ ID NO: 44301 - DNA, 101 bp, rice(Oryza sativa)
  misc_feature (71): n=a or c
aatatatatatatacagtgaatactaggctgtgttatttctatctagtactccgtcttgtacaaaatattntgatattttattttgcaggaaacaaaatat

SEQ ID NO: 44302 - DNA, 101 bp, rice(Oryza sativa)
  misc_feature (71): n=t or c
ccagaatgatacattaaaccaagtttagatatatcgatgcgaattttgtaagttcgtagacttaaatgaancccgtgataagtttaaggactgctagagtg

SEQ ID NO: 44303 - DNA, 101 bp, rice(Oryza sativa)
  misc_feature (71): n=t or c
gtggcgagaggcgggacaaagaggaagagagaaggaaggtagagagaaaggaagagaggaggggtggtttnagagggtggggggtgggggggaggcagcca

SEQ ID NO: 44304 - DNA, 101 bp, rice(Oryza sativa)
  misc_feature (71): n=t or c
tacaagcttgctgattgattgattgaatgtccccttcttacatcaatactccaaagtatgtatcaccaagntgacattgttatcttgttacagcacaaggt

SEQ ID NO: 44305 - DNA, 101 bp, rice(Oryza sativa)
  misc_feature (71): n=a or g
ccttctctctcacctctcttttttccacaacctcttctctctccccgctcattttcctcctctctccctcngcttctcttctaacgattgatgggcatggg

SEQ ID NO: 44306 - DNA, 101 bp, rice(Oryza sativa)
  misc_feature (71): n=a or g
aggactttagtgattgggttctagtgcttggtgatggtaggttgactgcgacaaaaaaaatggtgaatcanaaccaacatgggtggatattcctgatgatc

SEQ ID NO: 44307 - DNA, 101 bp, rice(Oryza sativa)
  misc_feature (71): n=a or g
gaacacatacactaacactccaatagcacatatccatgcattaacagaagtactcaatccgtttcacaatntaagtcattctaatatttcccacatttata

SEQ ID NO: 44308 - DNA, 101 bp, rice(Oryza sativa)
  misc_feature (71): n=a or g
gagaaagaggagaggaagaggtggctgggctagtgggctgattaggggaatgggtggaatttttgtactgngctaccttggaccaggacacccattgtgag

SEQ ID NO: 44309 - DNA, 101 bp, rice(Oryza sativa)
  misc_feature (71): n=t or g
aggttatgtgcacgtcaagatggcaatgcatgagccacaccccagggttgtcggcgacgaaccggatgacngcccagccgtttgtcggcaccgcgacggtg

SEQ ID NO: 44310 - DNA, 101 bp, rice(Oryza sativa)
  misc_feature (71): n=t or c
ggctcctgccgtggaagggaggaggttggcagcaatggcatagaccatgcccatctcttcagcttgacgangctcgacggcttggaggtggaatccttggt

SEQ ID NO: 44311 - DNA, 101 bp, rice(Oryza sativa)
  misc_feature (71): n=a or g
atcaaaattaagttttaaaatttaaattttggctttaacttttttaagttaatcgataggggtctgaatantgaacctagctagttggctgaaacatacta

SEQ ID NO: 44312 - DNA, 101 bp, rice(Oryza sativa)
  misc_feature (71): n=a or g
acgtgaaactacctctgcctcacactgtcgcacacacaaaaccttagcccacatttaacctgtttcaatcngttttatttaagaaacatgatggttcactg

SEQ ID NO: 44313 - DNA, 101 bp, rice(Oryza sativa)
  misc_feature (71): n=t or c
tcaacgtggaaagacctcgatttaaataggttgctatcaaagaacacctgttgagttgttgaggtggtggngggattgccacgcgcgcgcgtagtggccgt

SEQ ID NO: 44314 - DNA, 101 bp, rice(Oryza sativa)
  misc_feature (71): n=t or c
gtatcgtttgtggagagctcatcgaggatgctgtggacgaagaaagagagatagacgtcgtctggtgctcngcatccgctcacgttgcctcaagccacgct

SEQ ID NO: 44315 - DNA, 101 bp, rice(Oryza sativa)
  misc_feature (71): n=t or c
ttctgttttgcagacaacagaatcttctcctcctcgccagagtaatagcggtaaggtcattaagtatgctncaggtctaatttcaaatggaggtgggccat

SEQ ID NO: 44316 - DNA, 101 bp, rice(Oryza sativa)
  misc_feature (71): n=t or g
gaattgtctattccatatgaattttaaaagatcaacatatgatccaatcatttgtttaaaaacattcacangaattttttcctataatattgaaatctttc

SEQ ID NO: 44317 - DNA, 101 bp, rice(Oryza sativa)
  misc_feature (71): n=t or c
actgaccactaacctgcggggaccacatagggtccatgttgactcagtgccacgttagtcgaaatcacganaatactgtcctgggacaccacatagggcca

SEQ ID NO: 44318 - DNA, 101 bp, rice(Oryza sativa)
  misc_feature (71): n=a or g
ctgattttagttttacactttttagattaactttaaagtttattttactagctgctaggtttattttactngttcttttcccaactcacctctctcctctt

SEQ ID NO: 44319 - DNA, 101 bp, rice(Oryza sativa)
  misc_feature (71): n=a or g
ggctagtcctttttgtccctttttggtactttgttcttatatatgtgatttctgtattatttttgtaacantaaaactttgtgttcaccaggtttgggata

SEQ ID NO: 44320 - DNA, 101 bp, rice(Oryza sativa)
  misc_feature (71): n=a or g
caggcaaagctggcacgcacggcgacggtgacaagcggcacggaggaaataagttttggaggtaaagaagnacaatagcttggatccaaatgcgaacgttt

SEQ ID NO: 44321 - DNA, 101 bp, rice(Oryza sativa)
  misc_feature (71): n=a or g
cagagaaacagtaagtcagaaagcaacgatagatccgctacaaacctgttaacctttctgaagtaactganaaaaaggatatttccctgcatatatgagcc

SEQ ID NO: 44322 - DNA, 101 bp, rice(Oryza sativa)
  misc_feature (71): n=a or g
cacctaatttgcaccattgatttagatattttttctccatctcgaataccaactagaaaattcctacgcantaaaatttgtttgacttttaattactagaa

SEQ ID NO: 44323 - DNA, 101 bp, rice(Oryza sativa)
  misc_feature (71): n=t or c
tactgtgtggtgggttaggctaccttggacaccccaaaacgacaccacttcagatgtcttcaaacaccatntttactacacttcttacattttcgacattg

SEQ ID NO: 44324 - DNA, 101 bp, rice(Oryza sativa)
  misc_feature (71): n=t or c
tcggttacacggcgtatgtcagcagcatgccctgtcgcgtccatcgaggcttgccccgaaagatgaacgtngcgtcgtcgttgttgttgtccttacgccac

SEQ ID NO: 44325 - DNA, 101 bp, rice(Oryza sativa)
  misc_feature (71): n=t or c
ttttctttttaaaaactagagataatttactagtataagatagatttacattcaaaaggacaaggattttntacacctaggtgccacggcacctatcattt

SEQ ID NO: 44326 - DNA, 101 bp, rice(Oryza sativa)
  misc_feature (71): n=t or g
aagggataaaacttcatgtttcgtggactggggataggtaagaagctagcaagtgatttattttgggacanatcgaagtatattttacattattgaatatt

SEQ ID NO: 44327 - DNA, 101 bp, rice(Oryza sativa)
  misc_feature (71): n=t or c
tccggtcaaatggaatcataggggacggaatatcgtccctaggggtggaaacgagccagcttggcttggcncggctcgtgaaagcttggcaaagaacatgc

SEQ ID NO: 44328 - DNA, 101 bp, rice(Oryza sativa)
  misc_feature (71): n=a or g
catcccgaaaatggatggaacatggatggaacttcatctcgagagtggtcccagtacaaggtatgatagantaacgagtagagcagtatgatacagaaatg

SEQ ID NO: 44329 - DNA, 101 bp, rice(Oryza sativa)
  misc_feature (71): n=a or g
ctcgtgcgaggcgtagtacagtacaaggtgtcagcgcgtagacaaatacttcttctatcccattttaaatncagttgtgagttttttatctaacgttaact

SEQ ID NO: 44330 - DNA, 101 bp, rice(Oryza sativa)
  misc_feature (71): n=t or c
gttattcgatttatccggcgctatttttcccaccgaatccgatttctaatctgatctgctatccaatcccnaaatcaattaatcaacgagacaaccaaaaa

SEQ ID NO: 44331 - DNA, 101 bp, rice(Oryza sativa)
  misc_feature (71): n=a or g
acgtcggcaatccacgcggcttgcccaagaccgtggagccaactttggctccccgttcctcctttgtttcncaggtggggcccacactcgtgggccgtgtc

SEQ ID NO: 44332 - DNA, 101 bp, rice(Oryza sativa)
  misc_feature (71): n=a or g
tactgctactgtcctaagttctcgggaagtcagaaaccatgaatgcatcaggattcaggagtaacaacacngttaaattaattatttactccatttcaaat

SEQ ID NO: 44333 - DNA, 101 bp, rice(Oryza sativa)
  misc_feature (71): n=a or g
atataaaaatgacagtgaggaggtgatttatgatgaagatgaaccaagagtgctgctggtgggaagtgagnagatcatggaatcacaagaatcaagtgact

SEQ ID NO: 44334 - DNA, 101 bp, rice(Oryza sativa)
  misc_feature (71): n=a or g
ccggtgagtgtgtgatatggtggttcctagcttgtttcccttttacgtttgacgaaggctagtcgttcatnggccaagaaatgaggcagcgactgttggct

SEQ ID NO: 44335 - DNA, 101 bp, rice(Oryza sativa)
  misc_feature (71): n=t or c
aatctaataatattattttgacttattataatgttagaatttgggagtaatttttcattattactcagagntaggttaattcaaattttatcactataggt

SEQ ID NO: 44336 - DNA, 101 bp, rice(Oryza sativa)
  misc_feature (71): n=a or c
cttctgcctccgtggaaggagaggcaacagaactcggagacgaggttctaccatctaccaccaaaggattntgctccatctaatttctgcagaactgttca

SEQ ID NO: 44337 - DNA, 101 bp, rice(Oryza sativa)
  misc_feature (71): n=t or c
cccaaaaggcctaccaagattaagaaaagaagttgtaaaagaaaggaaggaaaaatgaaagagaaagagcntgttcactttgatgaaaaaaaaccttaccg

SEQ ID NO: 44338 - DNA, 101 bp, rice(Oryza sativa)
  misc_feature (71): n=a or g
aaacttcgtcatcatagccggctatctctattgccgcaaatcatcatttccatcggatgtgtttgtcgtcnctgactattttcttcatcttcatgattgat

SEQ ID NO: 44339 - DNA, 101 bp, rice(Oryza sativa)
  misc_feature (71): n=a or c
cgttaattattaccttgccacgctgcccagtgcctaatatatctatcacacgggctcgatcgtgtcgccgncgcatgcagcggtgacaccggccggacaaa

SEQ ID NO: 44340 - DNA, 101 bp, rice(Oryza sativa)
  misc_feature (71): n=a or g
aattcattatattaactaaattaagtaggtggtcccactgctaatgaccgtacgtacatattgattagatnagctatacatgcacaaacacgaatcgaact

SEQ ID NO: 44341 - DNA, 101 bp, rice(Oryza sativa)
  misc_feature (71): n=t or c
tcctctatcacataatacaagggattttagaggatatgacatatcgcattactacgaatctggacactatntaaattcgtagtactagaatgtgtcacatt

SEQ ID NO: 44342 - DNA, 101 bp, rice(Oryza sativa)
  misc_feature (71): n=a or g
gttgaccaagagttatgaaaatataatgtggactaatcaatagtattccttccattttgaattacttatcnttataaatttctcctaagtcaaacatttta

SEQ ID NO: 44343 - DNA, 101 bp, rice(Oryza sativa)
  misc_feature (71): n=a or g
aagttatctttgacctgtttcattacaggctcaaccggagtcataacttatctttgacctatatatccaanagaccgtttgatggataaagattaccttat

SEQ ID NO: 44344 - DNA, 101 bp, rice(Oryza sativa)
  misc_feature (71): n=t or g
gcaacgctaggggcttttctctcccaaattaggaatgttgggaagttgacactctcaaagaacatcgcatngtaagcagatcacatcgagtagcatccagg

SEQ ID NO: 44345 - DNA, 101 bp, rice(Oryza sativa)
  misc_feature (71): n=t or c
gatttggaggggaaaaaccgagccaattcggtctcaggtaagctgccagaggttgaagacgatactgtagngacagggacggaaagtatactttccctctt

SEQ ID NO: 44346 - DNA, 101 bp, rice(Oryza sativa)
  misc_feature (71): n=a or g
cgtcgatgttccgttctctacttcgccgggaggaactttcgacgtggagccgtcttgggttacagccactncgttctcgtttctggtcatcgatggcccag

SEQ ID NO: 44347 - DNA, 101 bp, rice(Oryza sativa)
  misc_feature (71): n=t or g
aaaaaacattctagaagcatatggaaaatacatggcataagctcctgttacttttggtgacaaatagttancatttcaacgcaatattttcagattttata

SEQ ID NO: 44348 - DNA, 101 bp, rice(Oryza sativa)
  misc_feature (71): n=t or c
tccatcgtacactgggccataaatttggtcaacgctgcaggccgtgacagcaatgggcagtggcaagtacntaataggggatgtgacccctcctatattga

SEQ ID NO: 44349 - DNA, 101 bp, rice(Oryza sativa)
  misc_feature (71): n=t or g
ctgccctcctaattgttcctgatgattcacgcagaatgctaaggtggtcccttttttttcaaattgaatanttatattattatctttttaatttaatcatc

SEQ ID NO: 44350 - DNA, 101 bp, rice(Oryza sativa)
  misc_feature (71): n=t or c
tttgttgcggacatctagcaagccagagccttgtgtctgcgtatgcatcttgctaaaattaaagccatgcnatttatacgagaattaaatatgaaaataaa

SEQ ID NO: 44351 - DNA, 101 bp, rice(Oryza sativa)
  misc_feature (71): n=a or c
agacacaccgccgtacaccgcctgcctccgctactttgctaagcaactttatgccctagatgaacctatantgttggctgctatgccctgcatgttttaat

SEQ ID NO: 44352 - DNA, 101 bp, rice(Oryza sativa)
  misc_feature (71): n=t or c
ctggcattggaggcacagttgtggaataggcagccctgaacatgccactgaatagtaggggctgacatagncttctagctccacttctctcagggatccaa

SEQ ID NO: 44353 - DNA, 101 bp, rice(Oryza sativa)
  misc_feature (71): n=t or c
gaacaagaagggctacaaattccagggaaaggattaggggagactatgcacgaaaagctataaacaaatgngccatgcccatgcgtgactgtgactgggga

SEQ ID NO: 44354 - DNA, 101 bp, rice(Oryza sativa)
  misc_feature (71): n=a or g
gtttagatcccttccctaacctttccgttaattgattgttaaattcataccattttgtgccctttactatnaacaagctggagtcggactcatcccatagc

SEQ ID NO: 44355 - DNA, 101 bp, rice(Oryza sativa)
  misc_feature (71): n=t or c
aatctcaccaccgaggtcgccacagccgctacctctcggctccttccactaacctcaccgaagccctagtngatttagggattatttttaggggatttggg

SEQ ID NO: 44356 - DNA, 101 bp, rice(Oryza sativa)
  misc_feature (71): n=a or g
tcgcatgtggtagttctgatccagggggtgttgggaaccttgacggtgtgggtcccacagtagcacaaccncgaatgcaaatatgctatttttatgtaaat

SEQ ID NO: 44357 - DNA, 101 bp, rice(Oryza sativa)
  misc_feature (71): n=a or g
catttcatacgcttgctgactgctgagtagtatgtacgcaaaaaagtcctttgtgactccctcaaatatanggctgatttggtttgaagccaaaacttgcc

SEQ ID NO: 44358 - DNA, 101 bp, rice(Oryza sativa)
  misc_feature (71): n=t or c
aagtgtaggtccttctaataaagataaggctcgtagatagtgtccggaattggggatgggaagaaaccganagagaagtatctaagtcatcccttctctct

SEQ ID NO: 44359 - DNA, 101 bp, rice(Oryza sativa)
  misc_feature (71): n=a or g
gagcaccacactgctgcgccggcgacttgttcgaaggctcgagctctagggagtagggactcgacgagtcnacgtacgtgacatgtgcgaaccgcgatgtg

SEQ ID NO: 44360 - DNA, 101 bp, rice(Oryza sativa)
  misc_feature (71): n=t or c
aagcttagtgtcatttaagagcaatgttgaaaataatatacgggccatctaaagcttagtgtcggttaggngggacttctaaagtttagtgtcggtttgac

SEQ ID NO: 44361 - DNA, 101 bp, rice(Oryza sativa)
  misc_feature (71): n=a or g
attatatatttatagtaatgccgttaagaaataccaatagccaccgcaccatcgccgccccaatctggtcngggtcgtgggcatcgaccctgcgacctcga

SEQ ID NO: 44362 - DNA, 101 bp, rice(Oryza sativa)
  misc_feature (71): n=t or c
gaattacacctccgaaccacaataccagacattcttcatccctaactgtgcaaacggataaataactcccnccctcaatccgtggtggttttggtcctacg

SEQ ID NO: 44363 - DNA, 101 bp, rice(Oryza sativa)
  misc_feature (71): n=t or g
ccgattaactatgcgccgtgatcggtggcacccaatttatttcctattgagtcgcccccgattccccacantgctaaatataaaaggggaggccggcccaa

SEQ ID NO: 44364 - DNA, 101 bp, rice(Oryza sativa)
  misc_feature (71): n=a or c
gatgaggttccaacttgagacgcgggttcgagcgccacggcagcaaaaatccaatgtgtcgccccatagcnccggtccagggtggagcgctgtgaaaggcc

SEQ ID NO: 44365 - DNA, 101 bp, rice(Oryza sativa)
  misc_feature (71): n=a or g
attagctttagcctttttagccgggtcggacgaaagaaaacggccaagcaaatttcattaagaccaggaanggagcttattagaaattacatgatatcaat

SEQ ID NO: 44366 - DNA, 101 bp, rice(Oryza sativa)
  misc_feature (71): n=a or g
gtcgccggcgacgaggtggagttcgtcgagaagcaggagtagcggtgggcgagcagagcgtggtgggcctnaagaagagaatagaggaaagagaagagaag

SEQ ID NO: 44367 - DNA, 101 bp, rice(Oryza sativa)
  misc_feature (71): n=t or c
atttctagctgtgtcgttaatttctcttagcaaagctaatcctgtgctatatacaaacccacgttgtaagnaccagaaaataaggcttgatatttgaatga

SEQ ID NO: 44368 - DNA, 101 bp, rice(Oryza sativa)
  misc_feature (71): n=t or g
taaatatatggagatcaaccgttgaaaattttcatcgtagttgctaacacttcccaaaaagtatgtcatcntgattatttttgttttgaaacgcgtggtta

SEQ ID NO: 44369 - DNA, 101 bp, rice(Oryza sativa)
  misc_feature (71): n=t or g
gcctttgcgtagccactcgcatcttatctaaaccgcgagttctttcgtcgcatcgagggcacgcaacgcanaaacttgaggggcgcgtgtgctgtggagtt

SEQ ID NO: 44370 - DNA, 101 bp, rice(Oryza sativa)
  misc_feature (71): n=t or g
aaaacatctaaaattaagagcatatgtgatataccaggcgagtgcttatcggcaacgcagaagtcctgcanagggctagggtcagaagcgatggcctgcca

SEQ ID NO: 44371 - DNA, 101 bp, rice(Oryza sativa)
  misc_feature (71): n=a or g
tttctaaataatatttattgtgttcgtggttatacttagatcagtcaaacacccatcacaagagctatatntatataacatgtggatagttggatgagaag

SEQ ID NO: 44372 - DNA, 101 bp, rice(Oryza sativa)
  misc_feature (71): n=a or g
atgtaggtgtagggctcgcaacattcttaactaaataaaggcgagcaagtggagttaccttagatttggtnttcctaatgcttaccaagcctacatgatat

SEQ ID NO: 44373 - DNA, 101 bp, rice(Oryza sativa)
  misc_feature (71): n=a or g
atcaaacattaaaaattggagggagtagttcatatactccctttcatttttccaaatacaagcattagtangttatttagcagagataatttgagaagaaa

SEQ ID NO: 44374 - DNA, 101 bp, rice(Oryza sativa)
  misc_feature (71): n=a or g
agaccggaagtctgagtatatgaccgagaaagatccattggtattatggcaatccatgaatgatcatttcnactagcaaggatcaattgtgccccaaaggc

SEQ ID NO: 44375 - DNA, 101 bp, rice(Oryza sativa)
  misc_feature (71): n=a or g
tttttcaagagtaagcagctctctttgatcctttttgtaatcacttcattttttcggccgattactcacanactttatagttgcagaagaagaaaattgct

SEQ ID NO: 44376 - DNA, 101 bp, rice(Oryza sativa)
  misc_feature (71): n=a or g
aacaaaaggactatagaagggatccaaattaaaatttagacgtatgaaaagaaatgagcaaatctcagagntatagaagggattagacgaactttcagagg

SEQ ID NO: 44377 - DNA, 101 bp, rice(Oryza sativa)
  misc_feature (71): n=a or c
catatatagccttttctagcccatcaagcaacacaaccctgataggcagccaaccctagtcccaccttccntcctctagtggtctcacccatcacgtcatg

SEQ ID NO: 44378 - DNA, 101 bp, rice(Oryza sativa)
  misc_feature (71): n=a or g
atgaacaatcctttgcgggattggattagtttgctcgttgaaataccataaagcgcgaaccaacatccatnatacgaaaaccaaaatcagaatgaggaaga

SEQ ID NO: 44379 - DNA, 101 bp, rice(Oryza sativa)
  misc_feature (71): n=a or c
gttcgtgtgtgcttgttcgattgttgacaacgtgaattctaacacgttatcagcatgaggtgctcttcagncaaggtatattgtcaacatcgatatgttct

SEQ ID NO: 44380 - DNA, 101 bp, rice(Oryza sativa)
  misc_feature (71): n=a or g
tttgctgcgttgattatttagttgatattttgttactttgtcatatccttgtatggacaactggaaggggnctaggagctgcagacaatggcatctatggc

SEQ ID NO: 44381 - DNA, 101 bp, rice(Oryza sativa)
  misc_feature (71): n=a or g
gtgctgtatatgctatgagatgtgagacactgacttgaaatttatacaatgaatcaatgaaaagaaaatcnactctaaattcggcacgatgggctttgtag

SEQ ID NO: 44382 - DNA, 101 bp, rice(Oryza sativa)
  misc_feature (71): n=a or g
gaaaaataccgtatccccgtatctgggtaacataggatagacgtagtcccaacatagacattagcattcangtccaacttgacgtcaatcccattcacttg

SEQ ID NO: 44383 - DNA, 101 bp, rice(Oryza sativa)
  misc_feature (71): n=t or c
agaaaaatcaaaaattccggccgaaataatcacttgccggggaggggtgggtggcgggtgtccaaaatttnggaaatttcgaaccgaaattgcaatcactg

SEQ ID NO: 44384 - DNA, 101 bp, rice(Oryza sativa)
  misc_feature (71): n=a or g
acaaaattaagaacaaattggttcgtggtagtgaacttctttaagtcatcatatttttctgttcatacganggaaatgaatatgtgattttccaacgaaat

SEQ ID NO: 44385 - DNA, 101 bp, rice(Oryza sativa)
  misc_feature (71): n=a or g
agcagagaagcagggatgtgttgaggtcgtttggttttcttttctttttcggttgtgcgttctccttcttnttgaggtgtgagtctaagtactcttatatc

SEQ ID NO: 44386 - DNA, 101 bp, rice(Oryza sativa)
  misc_feature (71): n=t or c
gcaagctgacaacaaaccacttttgtcttcttgtcaaattcaagtcgattatagatctcgtaaccagatcnaaccttatgacaaaatttataatacatcga

SEQ ID NO: 44387 - DNA, 101 bp, rice(Oryza sativa)
  misc_feature (71): n=a or g
gcggtggggcaggaggaggagtcgatcgatgaggccacgtgatggcagcgaggaggaagagctgctcaacnagctctcccgctattgccgctactggacgg

SEQ ID NO: 44388 - DNA, 101 bp, rice(Oryza sativa)
  misc_feature (71): n=t or c
ctttataaagataaagaggtggtctaactatttgccactttttacccacgtggcgcgccagcgtagcaaantctggtgaaaaactccgtgggacccacccg

SEQ ID NO: 44389 - DNA, 101 bp, rice(Oryza sativa)
  misc_feature (71): n=t or c
acccacaaacccccaactcctcaccggctcctccttcgccgcttgacctctgggtcttcgtcgagctcggnggcggcggcggcagcggtgggggccgcgct

SEQ ID NO: 44390 - DNA, 101 bp, rice(Oryza sativa)
  misc_feature (71): n=a or g
tgctccaaagcagtagttagatagcatagcatggtacataggaagccattgtccagattcgtagtcctagnatgggtctaatcccatcctaggttgtaata

SEQ ID NO: 44391 - DNA, 101 bp, rice(Oryza sativa)
  misc_feature (71): n=t or c
cgatatcccagtgcgcagtgaacccgggcgagacgttcgtctacaagttcgtcgccgacaagccgggcacntacttctaccacggccacttcgggatgcag

SEQ ID NO: 44392 - DNA, 101 bp, rice(Oryza sativa)
  misc_feature (71): n=t or g
gtgctaatgaaaatcgatgaaaaatgggtaaagtttagaacggggcaagtggtcaaatcttgagattcttnagagagagagagagagagagagagagagag

SEQ ID NO: 44393 - DNA, 101 bp, rice(Oryza sativa)
  misc_feature (71): n=a or g
gaactcagaactcatcaatccaatcaaacaaatcttataaaaccaaccaaacaaaaactcatgcaatccanatttaactcatacaatcatcaatcaaccaa

SEQ ID NO: 44394 - DNA, 101 bp, rice(Oryza sativa)
  misc_feature (71): n=a or g
ctagtatagcactttattctagctagtgtcatgtagcagacgagatcaacgacgacttctctttggggctntcacttgcgttcagttgataagtcgctttg

SEQ ID NO: 44395 - DNA, 101 bp, rice(Oryza sativa)
  misc_feature (71): n=a or g
acagagggtcgttgtaactttgaaacgttgtaatatgctggatcagaaatgagtatccgtaatcagtgtcntaggcatgtagacttttgctaaacctcatt

SEQ ID NO: 44396 - DNA, 101 bp, rice(Oryza sativa)
  misc_feature (71): n=a or g
tataaaaatgccgaagatctttgcatggatcgaaaaaaaattgagtaaattttagaaactacgtaactatnttttaataaaattatcataaaacaatatat

SEQ ID NO: 44397 - DNA, 101 bp, rice(Oryza sativa)
  misc_feature (71): n=a or c
taaactaaagaaaccctactggaacatgcacccttcctactactacttcctactccttccattttatattncattttatattacaagtcatttgatttttt

SEQ ID NO: 44398 - DNA, 101 bp, rice(Oryza sativa)
  misc_feature (71): n=a or g
attcatctaggataaacatgtgcaggtagcaattgctagggaggtaggagtatgcattttaagcatgtgcntcgccgtttcgtggcatttggcaacgtgtg

SEQ ID NO: 44399 - DNA, 101 bp, rice(Oryza sativa)
  misc_feature (71): n=t or c
caccacctccttcatcgagccacaggggtgccatatccagcctcctcgaggtcaggaggtcggggggacantggatttgaccgcccccaacaccgtagtgg

SEQ ID NO: 44400 - DNA, 101 bp, rice(Oryza sativa)
  misc_feature (71): n=t or c
actctacaagctggaaagaatttacaaatttcttcttttcttttgcaatggtctgatggagcccacgtacngtaacaatccagcatttaacagttttatat

SEQ ID NO: 44401 - DNA, 101 bp, rice(Oryza sativa)
  misc_feature (71): n=a or g
cggagaaagaggtcgcagtcctcggtgactctctcctctgcccggttgaggcgttatcgtgcaagtatttngttgaggagttatcgtgcaagtatttgggt

SEQ ID NO: 44402 - DNA, 101 bp, rice(Oryza sativa)
  misc_feature (71): n=t or c
gcgtctttttcgatcccaacacgagactcacctaaaaggttggcggtgttaatggagtcaccaaccacctngatctagataactctaaatcaatatgggtt

SEQ ID NO: 44403 - DNA, 101 bp, rice(Oryza sativa)
  misc_feature (71): n=t or g
acaaattgaatcgcatcccagagtcaaccttcttcaatgggactgcctccacccattttgtgaaataatcngttcccaccaatataaacttatgtcatttg

SEQ ID NO: 44404 - DNA, 101 bp, rice(Oryza sativa)
  misc_feature (71): n=a or g
caacagtgatttgtgtggctgtaataaccgatacgctgtgctgcgctacacagcggttgtaccatgcaggnccctgtttggttccatgggctaatgtttag

SEQ ID NO: 44405 - DNA, 101 bp, rice(Oryza sativa)
  misc_feature (71): n=t or c
tcgtctcctttggctttcgaaccgagctcatttggtcgttcacaaaagtacttcaccaggtacactaaaanagtgcgattcaaacactccactaaaaaact

SEQ ID NO: 44406 - DNA, 101 bp, rice(Oryza sativa)
  misc_feature (71): n=a or c
actttgcttttttttcacctaacaatgatggctttcatcttgtatatggctttagcttttacactatcttnataaatttatgcgtagtgctacaacttcaa

SEQ ID NO: 44407 - DNA, 101 bp, rice(Oryza sativa)
  misc_feature (71): n=t or c
acatcagctagatttagcttaacaagagttagtgtgtacaatagttagctattatacatcatctacccganagatttatatacatttttttattttatatt

SEQ ID NO: 44408 - DNA, 101 bp, rice(Oryza sativa)
  misc_feature (71): n=a or c
ctcgagttcatggttatacttcagttgtgaaagcaggagcaacgagatatcatgctagtatattttacatntgcctgatgacacgatgtaatcactaaagg

SEQ ID NO: 44409 - DNA, 101 bp, rice(Oryza sativa)
  misc_feature (71): n=t or g
ttcagagtgtgtttcccaaaaatgattttgtgtggtgtcctacggttaaaaccacaaaattgtgatgtccngtagaaaaatttgctaataattaaagagca

SEQ ID NO: 44410 - DNA, 101 bp, rice(Oryza sativa)
  misc_feature (71): n=t or g
ctttcctcccgttctctctcctcccccatcctcctcccgaggccggccatggaaggtttcatttgcgtcgntggcagcgagcggcggctgagtcacgtcgg

SEQ ID NO: 44411 - DNA, 101 bp, rice(Oryza sativa)
  misc_feature (71): n=t or c
tactgccctagcaagtgcttctcacatgagtatgtatacttcatccgtcctataagaaatacacctagtgnaaattgtgatatatcagtattagaatatgt

SEQ ID NO: 44412 - DNA, 101 bp, rice(Oryza sativa)
  misc_feature (71): n=a or g
aatctagacccgcaaagataaacacactgttgagtttactagtccaccgtgctagctagctaggtgtcgcnttcaactacttgtgatgtctctggagatca

SEQ ID NO: 44413 - DNA, 101 bp, rice(Oryza sativa)
  misc_feature (71): n=a or g
ttggaatactaaaaatcttgtcactcagtgtgtgttcatttggtattcgggctcatttctcaggataggcnggaaaagggtgttttcctgtctatccccaa

SEQ ID NO: 44414 - DNA, 101 bp, rice(Oryza sativa)
  misc_feature (71): n=a or c
catgatgatgcctacatatcatggtagtgcacgcaacaatatattgccatcaatgtgatttgaaaaaaaanacaaaaataaaagttatcaccaagatagac

SEQ ID NO: 44415 - DNA, 101 bp, rice(Oryza sativa)
  misc_feature (71): n=t or c
acatgtacaatagcaggccataagccagctataaacccatttcaaagagataaaagaggaaaaagaagggnagcgggctacaaatttatagtcagctgcac

SEQ ID NO: 44416 - DNA, 101 bp, rice(Oryza sativa)
  misc_feature (71): n=t or g
ctaataccttatagatacctgatacctcacaagtatcataacatgcatcaggtataaccatcaagtatcangtgattcctaccacgtatcaggtgattgct

SEQ ID NO: 44417 - DNA, 101 bp, rice(Oryza sativa)
  misc_feature (71): n=t or c
ttgtgaggcgtctcataattctctacaagtatgatcaggaaacagggattaattggagaatgcccaggctnggccgaccgacgccctgcgccaggatcagt

SEQ ID NO: 44418 - DNA, 101 bp, rice(Oryza sativa)
  misc_feature (71): n=t or g
ggagatggtggctgctggggatgttggtggaggcttctttctctgcaggagggagggaaggggcgggtggnggaaggggagatgagatctacgtgaagaag

SEQ ID NO: 44419 - DNA, 101 bp, rice(Oryza sativa)
  misc_feature (71): n=t or g
atagccaacagatcgactatattattagccttgctcttagagtgtaagcatttcttgttaaaagagagaanattttcttttagtaataactttactggtca

SEQ ID NO: 44420 - DNA, 101 bp, rice(Oryza sativa)
  misc_feature (71): n=a or g
atatggttaaggcatgcaccggccagagtcaagacaaaagtgtaaagttaaaataaagcaatgaaatgaancagccttaggtttgggaagggggccccagg

SEQ ID NO: 44421 - DNA, 101 bp, rice(Oryza sativa)
  misc_feature (71): n=t or c
cgtctcttttccttctctcccaccgacgtggtgagagtcgatttggctgtagcaggagttgatttgggagnatactatagttatagtggaatgatctaaat

SEQ ID NO: 44422 - DNA, 101 bp, rice(Oryza sativa)
  misc_feature (71): n=t or c
ttgaacctcacatgccacataggttgaattaccatgttagacacaagtttcagtgctgtaacagggtttanaattccgagatggccttccgtttcgggctc

SEQ ID NO: 44423 - DNA, 101 bp, rice(Oryza sativa)
  misc_feature (71): n=a or g
gtttaatatatcgtgagcaattaatcaataaccacacactatttcccttcgctcttaatttgttgagccanaaaagggaaagttttgctgaaaagaaacac

SEQ ID NO: 44424 - DNA, 101 bp, rice(Oryza sativa)
  misc_feature (71): n=t or g
agattaaaattatgtgaaacttacatataagttttctacggtaacacgctattttcacgaaacggaggtcnttccaagttgaatgaatcttgaagtaaatc

SEQ ID NO: 44425 - DNA, 101 bp, rice(Oryza sativa)
  misc_feature (71): n=a or g
agtattaggactctgagtaaagaatgaagtttctgcgcgaggctagagtaattatcaataacttaggcgcngtgtctaggttagtggtttcctttatttgt

SEQ ID NO: 44426 - DNA, 101 bp, rice(Oryza sativa)
  misc_feature (71): n=a or g
ccaggtgatcacctgcgtactttgaagctttaatatggcacttggcgggcggagctagagcgaaacagagngtggtgccacttgcttaatttactctattt

SEQ ID NO: 44427 - DNA, 101 bp, rice(Oryza sativa)
  misc_feature (71): n=t or c
tcccaccgtagtggtggtggtagtagcagggatgagggcagtagcacggctccggcttcttctcctccggnttcttctcctccggcttcttctccttcacc

SEQ ID NO: 44428 - DNA, 101 bp, rice(Oryza sativa)
  misc_feature (71): n=a or g
tactcagcattaggagcaatggagaccgtccgatcaagatcaaatcgtgcactacggtaactatgctacantactctgtagtgttctacaacgttttcgtt

SEQ ID NO: 44429 - DNA, 101 bp, rice(Oryza sativa)
  misc_feature (71): n=t or c
ctcctgctagccctgcaagtgtgcaagaaccagttcaatggttgttgtaagctgtcactgcagaacgagcnaaacaatacgcagcagatcatcactcagca

SEQ ID NO: 44430 - DNA, 101 bp, rice(Oryza sativa)
  misc_feature (71): n=t or g
tgccgattcgtttgtcctacgacagagggggcatagccccttgtttggctagcctctaatcacaagccagnatgatgtccatgctctattttattttactt

SEQ ID NO: 44431 - DNA, 101 bp, rice(Oryza sativa)
  misc_feature (71): n=t or c
tgaaactcccaccaatcaggacgatgccatattgaggatgcaaaatacttcattcgtctcaatataagtanaatttaaaatagatataacatattatagga

SEQ ID NO: 44432 - DNA, 101 bp, rice(Oryza sativa)
  misc_feature (71): n=a or g
ggagcttgggtatggggatatcagccaggtgagaacagtagcacacttgctatttgtttgaattttgatcntgttggagattttcttaattggatggccaa

SEQ ID NO: 44433 - DNA, 101 bp, rice(Oryza sativa)
  misc_feature (71): n=a or g
actttctccattctaatattaggtgggcatggatattaaggaagtagctaggtaaaaatgattggatgaantttgtgattgattgagaagaaaaaataggt

SEQ ID NO: 44434 - DNA, 101 bp, rice(Oryza sativa)
  misc_feature (71): n=t or g
caaaatattatatgattatgaaaccacctagaatctatatatttaggtgtagctgtcagggtatcattatntcattattaaaaaaagaaacttagaccttc

SEQ ID NO: 44435 - DNA, 101 bp, rice(Oryza sativa)
  misc_feature (71): n=t or c
aggaaccgacacctatgtttggcaagactcataggtaccggttccttttaaaccaacacttatgtcattanataggtgtcggttcttgaaaatggttcccc

SEQ ID NO: 44436 - DNA, 101 bp, rice(Oryza sativa)
  misc_feature (71): n=t or g
tgtatccgtgattaatggagaaactgaggacaaatcaaggtttgcttacttgatacgagagctgcgtttcnctccagagaggagaaagggaagttaaaatt

SEQ ID NO: 44437 - DNA, 101 bp, rice(Oryza sativa)
  misc_feature (71): n=t or g
cggaatacaatgtgtaaaatagagaactataaatcaatttatagaaaagatcatttgacttataaactttnggtctctaaactttagatgtgtaaacttgg

SEQ ID NO: 44438 - DNA, 101 bp, rice(Oryza sativa)
  misc_feature (71): n=t or g
gaagatatacatttacatgactcgctcactcactcgagcagttacatttacatgaccatccgcggcagtantaaggccctgtttgtttcaacttataatta

SEQ ID NO: 44439 - DNA, 101 bp, rice(Oryza sativa)
  misc_feature (71): n=t or c
ccccttttagtattgccgaaattttgtttcgacactgcccgcctcgccgtggggcatcggccgactgccgnggtgcgccagtgccgttgccggcctgccgc

SEQ ID NO: 44440 - DNA, 101 bp, rice(Oryza sativa)
  misc_feature (71): n=a or g
ttgtttgtattttttttatagaaaagatgaagttaggatacgaataaaaaacattaacgcttaactaattnagttttaattattgtaaattttaaaaaata

SEQ ID NO: 44441 - DNA, 101 bp, rice(Oryza sativa)
  misc_feature (71): n=a or g
gaggagtaacgtactatttacaacaaacatggctgtttagggattaccctaacacaggaacacaagtactntttacaacaaacatggttgtttagggatca

SEQ ID NO: 44442 - DNA, 101 bp, rice(Oryza sativa)
  misc_feature (71): n=t or c
caaactgaacatttcatacatatgtacatactacccaaattattggttatttctatactcatcaatcacgncaaaaatgacatttgtagacttggattgaa

SEQ ID NO: 44443 - DNA, 101 bp, rice(Oryza sativa)
  misc_feature (71): n=a or c
acaccttcccaatttcaaatgagctagggtttcaatgccgccggcactcccaatttcatatgaactattgntgctgccaagacagctacaacttccatcgc

SEQ ID NO: 44444 - DNA, 101 bp, rice(Oryza sativa)
  misc_feature (71): n=a or g
ctaaatagcaagatacatttaatactcctttgttaggccttttaataattatccctccgaactaaacaggncccatatctatcagtagttgaaattgtcaa

SEQ ID NO: 44445 - DNA, 101 bp, rice(Oryza sativa)
  misc_feature (71): n=t or c
atgacttgaagctactccaacaactgcgtctacactagctttggcccaggagatccaacccagacatcgcngatgtggactcaagtcggatctattgtctt

SEQ ID NO: 44446 - DNA, 101 bp, rice(Oryza sativa)
  misc_feature (71): n=a or g
tgccacgacgtaaatccttcttcctgaagcaaaatgactccacatgtccatctttatcataataggtgaantgaaggtgacccctaccagatggcacaact

SEQ ID NO: 44447 - DNA, 101 bp, rice(Oryza sativa)
  misc_feature (71): n=t or c
gaacaagcgaagaagatgcccttgaccttatcaatgatgcctagaaggctgctgacaagattgctgcagangttgtagagagatttcatgataccaatctt

SEQ ID NO: 44448 - DNA, 101 bp, rice(Oryza sativa)
  misc_feature (71): n=a or g
caagatagtgagcacttccgacacctttgggaaatgagacggtgttgggtcccagcatactttatgcactntttcttccctttcctccagactacagcacg

SEQ ID NO: 44449 - DNA, 101 bp, rice(Oryza sativa)
  misc_feature (71): n=a or g
tagaacgccgtcagcgtcgcacagccaattatcggcgtggctgagaatgttcgcaacagtagaaacacgcnaatgcgtgcgtagatcagccctccctccgg

SEQ ID NO: 44450 - DNA, 101 bp, rice(Oryza sativa)
  misc_feature (71): n=a or c
cgcgagcctcgagcttttttgacagccctatataaaaccctcccttcctcttgaaaattctcatttattcntaaaaatcaagaaaaaaaagaaagaggggt

SEQ ID NO: 44451 - DNA, 101 bp, rice(Oryza sativa)
  misc_feature (71): n=a or g
aaaagaaaaagagagcccgaggctctcacaccacaggggcaaagcccaaaacatggagaatcacccacgcnccgaaccggacacactggttcaccacaggg

SEQ ID NO: 44452 - DNA, 101 bp, rice(Oryza sativa)
  misc_feature (71): n=a or g
caactggcaaacagctgtaagacaacaaacattttgttgcgaacagtattatattattccttcgaataacnaaacaacttttgaagactatacatgatggg

SEQ ID NO: 44453 - DNA, 101 bp, rice(Oryza sativa)
  misc_feature (71): n=a or c
aaaatgaatagaacaagtattagctgatacagtaagtctttggagggcgatgacgtctgcgcccgtttgcnaaattgttcaagcgaacttcaattccttaa

SEQ ID NO: 44454 - DNA, 101 bp, rice(Oryza sativa)
  misc_feature (71): n=t or g
ctcgtgggagttggggacgatttagtcagccggctgctcgtggccgttttttgtcgggtctctctctctcncgcgcacgcgcggcgggtttgagaaaaaag

SEQ ID NO: 44455 - DNA, 101 bp, rice(Oryza sativa)
  misc_feature (71): n=a or g
gcgctcgatcgcgcatgccggcagccggccacacatcgtcgtaactcatatacgagttcaccctctctacnactttgatccatccgctttgtcgtccaagc

SEQ ID NO: 44456 - DNA, 101 bp, rice(Oryza sativa)
  misc_feature (71): n=a or g
agtcttctaagggtcttgaacacatggccttgactgaatcagacatatacatagtcacagcaaagagattngggtagctggtgcacttaaaatcatcattc

SEQ ID NO: 44457 - DNA, 101 bp, rice(Oryza sativa)
  misc_feature (71): n=t or c
gtaaccggtgaatcagatgaacagttatgcctttatatactctctcattcactaggactttgttcctgatngatcatctgcgcttgacagtctttccatgc

SEQ ID NO: 44458 - DNA, 101 bp, rice(Oryza sativa)
  misc_feature (71): n=t or g
gtaaggcaagtagcatgtgtttttcattcatgaaccttcctggccctctcaggaagcagctgagtagtagnttgtgtttagatccaaactttgcttttttt

SEQ ID NO: 44459 - DNA, 101 bp, rice(Oryza sativa)
  misc_feature (71): n=a or g
taatgccttgcattgtgttagatagacatatttgaggcataaaatggtgggcttgctacctggtgcagacnctccagctccgttgctggcacacatgcccg

SEQ ID NO: 44460 - DNA, 101 bp, rice(Oryza sativa)
  misc_feature (71): n=a or g
cacccagttccgcttctattttaggtggtgttggaactcttttactaggcttcgctacaggaaagatgaanctagagttagagccattccaaataggcctc

SEQ ID NO: 44461 - DNA, 101 bp, rice(Oryza sativa)
  misc_feature (71): n=a or g
ctccataatatgatagttgaaaatgaaagaggggggggttaaaattcctattgatctgaatgtggaccctngagcatcggttgctcttcctcctgaagtaa

SEQ ID NO: 44462 - DNA, 101 bp, rice(Oryza sativa)
  misc_feature (71): n=t or c
agtcgaatgtgacatattctttttctgtctagattcgttattcgttattctaggatatgtcacgtttaacnaaaataacttatatttagggagggagggag

SEQ ID NO: 44463 - DNA, 101 bp, rice(Oryza sativa)
  misc_feature (71): n=t or g
tggttagccacatctctcacaatgcaacaatacaagttacaacttcttgtgggtcccatcaaccagctttnaccatttttttctctcccctcactctcctg

SEQ ID NO: 44464 - DNA, 101 bp, rice(Oryza sativa)
  misc_feature (71): n=c or g
aaaccgaacagcgaatccacctctcattattttgacgacatcctcgcagcttggattctcttctagcactnttgtgtcgttgccgtgcaaaggagtaatgg

SEQ ID NO: 44465 - DNA, 101 bp, rice(Oryza sativa)
  misc_feature (71): n=t or c
agatttggggcatatatactatatttatatgggatatattgttgtagacttatacatgccctaatgcatangtgaaatgtcaaacataatgacagtgtgcg

SEQ ID NO: 44466 - DNA, 101 bp, rice(Oryza sativa)
  misc_feature (71): n=t or c
accaccaaggcttagataccaccctatttcgtcagttaattcgttagacccattcgagaaatactagccangtagtcgtgctttgcactactatgataccc

SEQ ID NO: 44467 - DNA, 101 bp, rice(Oryza sativa)
  misc_feature (71): n=a or g
tatagtaagttaatagtctgctattgtacctgttctaatactactagtagtacatttggatggatgctctngaacaagttaagtactcctactaacatttg

SEQ ID NO: 44468 - DNA, 101 bp, rice(Oryza sativa)
  misc_feature (71): n=a or g
tttttcacatggtatcagagctatagacccacgtcgttcgatcctgggttcatcgacgccttccgaatgcnccccagggagatgagatcaatgctataatc

SEQ ID NO: 44469 - DNA, 101 bp, rice(Oryza sativa)
  misc_feature (71): n=a or g
taaaatataaatgaagaggcacaattaaagaatcattttcaaaacatgatgtatatactctattattgttnttgtttttgtcatggtgtgacaaaaaagag

SEQ ID NO: 44470 - DNA, 101 bp, rice(Oryza sativa)
  misc_feature (71): n=a or g
tttttgtgtgtcggaatatgtattagacggtagcaagataaaaatatgacgtgcaaactatatatgtgcangttaaactacaaaatggaaatccaagtgat

SEQ ID NO: 44471 - DNA, 101 bp, rice(Oryza sativa)
  misc_feature (71): n=a or g
atttggatcctcacttccacagtgccgccgggggcacggggcacagggaagttttttttttttaaccttangttctagatttaatttttttaaaagaaatt

SEQ ID NO: 44472 - DNA, 101 bp, rice(Oryza sativa)
  misc_feature (71): n=t or c
gagttaaggtttagggtctcggaattggggtaggggtgggacagggtagggagagggatgggggaggaggntgccagtttggggaaagagaagaggaaggg

SEQ ID NO: 44473 - DNA, 101 bp, rice(Oryza sativa)
  misc_feature (71): n=a or c
acagcgtttcagactaggcttggactttgaagataaagtagcccacggcccatttctgaagaactgaaagncgaaaagtttggaaaaggtccctctgcttc

SEQ ID NO: 44474 - DNA, 101 bp, rice(Oryza sativa)
  misc_feature (71): n=a or g
cagcaacagcaacgaacattctccgttttcagttagatggtttctgattacaaaacaagagttaaaaaatntactatttttaatatatcgcatttggtcta

SEQ ID NO: 44475 - DNA, 101 bp, rice(Oryza sativa)
  misc_feature (71): n=t or c
ttacctttgtatttattgaattagattacaaacaaaataataattattctaatagactcccgattcttttnctattagatccctaaattgttaggacgtgg

SEQ ID NO: 44476 - DNA, 101 bp, rice(Oryza sativa)
  misc_feature (71): n=a or g
aacaggagaggagatgaagaggcaagagctagtacctcgtcgacctcgcggcgtcggagagggagagatgnactccgcgcgccccgcggcagtttctagtt

SEQ ID NO: 44477 - DNA, 101 bp, rice(Oryza sativa)
  misc_feature (71): n=a or g
aaagggtgagtgtgacagagtttggatgggctctgcgacagtctttgtggcttccagattcacctgggcanaagagggggctgcttaccttggttttaagg

SEQ ID NO: 44478 - DNA, 101 bp, rice(Oryza sativa)
  misc_feature (71): n=a or c
gcgtgcggcgcaacagggagagagcaggcactcacgggagatagcagaagaggagaatagagctgaaaatnctttaggggcaaattagtcattttcataca

SEQ ID NO: 44479 - DNA, 101 bp, rice(Oryza sativa)
  misc_feature (71): n=t or c
ccccacgatcctcgcgcccgcagttgtctcttcgtttcccacgcccactcatcacgtgacccgttgtatcngcgtcccgcctttagtgcgcctgtcagtgg

SEQ ID NO: 44480 - DNA, 101 bp, rice(Oryza sativa)
  misc_feature (71): n=a or c
ctccctcggcgtcgtcgtcggggttgccgtcgcttggaatttgggggaatacatagcttccgcctcaacgngcaacgaacgccgaccgagggaacggcggc

SEQ ID NO: 44481 - DNA, 101 bp, rice(Oryza sativa)
  misc_feature (71): n=t or c
tgtttccgtgccgtctgtttggttgccgtatgttcgggcatagtcagcgccgtttttttgacaaattgacncttttggaaaacttatttcgaaactaaccc

SEQ ID NO: 44482 - DNA, 101 bp, rice(Oryza sativa)
  misc_feature (71): n=t or c
cttgttcatacttcctccgtcggacaaaagcacaaatctaagtattacttagatatgacatattctaatanaataaacctgttcagatttactgtacttag

SEQ ID NO: 44483 - DNA, 101 bp, rice(Oryza sativa)
  misc_feature (71): n=t or c
aaaacaatccattgcatactccacccctcaagatcttggaggtgttagttaacttgagggtggagaaatcnaatgggggttaatatccaatgaaattaaac

SEQ ID NO: 44484 - DNA, 101 bp, rice(Oryza sativa)
  misc_feature (71): n=a or c
ttctagtataataaatctgaacataggtatgtccagatttttagtattagtatcatactagaaaaaatgcncgtgcgttgcaacgggtaaaaccatttttg

SEQ ID NO: 44485 - DNA, 101 bp, rice(Oryza sativa)
  misc_feature (71): n=t or c
aaatattttgggaaacctttggaatttggatgatgcgtcttttgtttgcttcttggtatttcttttcttanggatattctctagatttatcttcaaagagg

SEQ ID NO: 44486 - DNA, 101 bp, rice(Oryza sativa)
  misc_feature (71): n=a or g
ggtttttttgtttccgtgcaggtgatattatttaaccgcagtatgcacggaataatcgattatcctatgcngtccacttaacctgaccgcacggaaaaatg

SEQ ID NO: 44487 - DNA, 101 bp, rice(Oryza sativa)
  misc_feature (71): n=t or c
ttggtggctttctccgggcttccggatccttttagggtgcgatcgtttcagcttttcatgattagattctncttattttcagttagcatgttttttaaact

SEQ ID NO: 44488 - DNA, 101 bp, rice(Oryza sativa)
  misc_feature (71): n=t or c
gagccttctacaataaaaggttcagatatatggtgctgacaattaggaaaaaaaaatccagatattgaaanaaacacttatacaactttggtgataaatgt

SEQ ID NO: 44489 - DNA, 101 bp, rice(Oryza sativa)
  misc_feature (71): n=a or g
actcagtttgtatcattgacatccagtgccaccgtcatcccttgtagcctcccagtcctcccccataccgncttggccttaaaagtttagatgggaataaa

SEQ ID NO: 44490 - DNA, 101 bp, rice(Oryza sativa)
  misc_feature (71): n=a or g
tttgttctagcaaatagtaatctctcgtatgtatgtactttttccttttcttgaaaaatattcttctctcntaggggttaggtgtgcatatgtgtattcat

SEQ ID NO: 44491 - DNA, 101 bp, rice(Oryza sativa)
  misc_feature (71): n=t or c
ggaagacggtaggtgggggattagatttataaagtatcccgttagaacggaatcccgtgctctagcaatcntcttattaatattaataaacttgcacaact

SEQ ID NO: 44492 - DNA, 101 bp, rice(Oryza sativa)
  misc_feature (71): n=a or c
tcaatctgtgcactcatgcacagcacagcagtagcaaagcttcaaactgactgtaatatgtaatcacatgntaaaagtccattgaacatcctacaaacact

SEQ ID NO: 44493 - DNA, 101 bp, rice(Oryza sativa)
  misc_feature (71): n=t or c
agggattatttaccaagagtagtagacataataattgactagaaaaaataaaaaaaatacccgtgcgttgnaatgggtaaagacgttttttcagtgatata

SEQ ID NO: 44494 - DNA, 101 bp, rice(Oryza sativa)
  misc_feature (71): n=t or c
aaattgccctctcctctgtccccatcttctcttccaactctggctatctcgtctttctcgtcctccggcgngacggcgcagatggggaaaaggcagcagcg

SEQ ID NO: 44495 - DNA, 101 bp, rice(Oryza sativa)
  misc_feature (71): n=a or g
gagggaagttgagctggtccggccactgctgcatctgccatgctcagctcgtcactgtggccatctcctcntcgctcttgttgcctggccgcttgcaaact

SEQ ID NO: 44496 - DNA, 101 bp, rice(Oryza sativa)
  misc_feature (71): n=t or c
cgtcaagttagtggatcacctcggtacctcatagaatggagtactttttttagtaaaacaaatccaattcnaagaataaattaaaattattattttttaac

SEQ ID NO: 44497 - DNA, 101 bp, rice(Oryza sativa)
  misc_feature (71): n=t or c
ttccgtgcgctggagataagttcccaactagtggtagcgaacacaatctactatactactccctccgtccnagaaagaggcgatttctggaggggaggatt

SEQ ID NO: 44498 - DNA, 101 bp, rice(Oryza sativa)
  misc_feature (71): n=t or g
ataaggagatgtgcatatgggcttgttaataaggatatttattaattgactagctgaatgcctgtgcattncaacagaattttggaaaagaagaaattcat

SEQ ID NO: 44499 - DNA, 101 bp, rice(Oryza sativa)
  misc_feature (71): n=t or c
ttcctcctttcctccacctttgcacactctcctctccaattcaacccaattcctcaaatttccactcatanccaccaatggctggcaaatccctaatccca

SEQ ID NO: 44500 - DNA, 101 bp, rice(Oryza sativa)
  misc_feature (71): n=a or g
cttggatttatcttgcccagctatattgttatagtagtactcccttggattttaagtttttacttgtaatntttaaccactcgtcttattcaaaaaatttg

SEQ ID NO: 44501 - DNA, 101 bp, rice(Oryza sativa)
  misc_feature (71): n=t or c
gctgcggacgacggctgtggtgtcggggaaggagacgacggaatgcggggtcaactagggcggcgagaagnggcggtcggaggcggtaaaggtggtggcgg

SEQ ID NO: 44502 - DNA, 101 bp, rice(Oryza sativa)
  misc_feature (71): n=a or g
ggcaatttgtggatgcatgggaagaggatcctcttatttatttttctctgactttgagtcactaacatatnaattcactgggtagagggcctatatgtcag

SEQ ID NO: 44503 - DNA, 101 bp, rice(Oryza sativa)
  misc_feature (71): n=a or c
aaatctgtctgactaacttatgttgtcatctttgtaacttcaattaattggagtcaaatgcagtgcaagcngccaagatatctcaattggagaaacgaatt

SEQ ID NO: 44504 - DNA, 101 bp, rice(Oryza sativa)
  misc_feature (71): n=a or g
aagggtattcttgacatttcgcgctatttttctctctccttccagcgaaagttattattttaatgggtgcngtgtcccttggcaaattaccacatttatag

SEQ ID NO: 44505 - DNA, 101 bp, rice(Oryza sativa)
  misc_feature (71): n=a or g
atcgaaaatggctgccaggtttaggtctcgatatcaagctagactatgcggtgtatctaccatattgaatnagttttcatcgatttgcttagatcttatgt

SEQ ID NO: 44506 - DNA, 101 bp, rice(Oryza sativa)
  misc_feature (71): n=t or c
gggcctactaggtgtatatattgagtttggtgaagggagaatgaagtattccctccgttccaaaattacanggtcgccgacatactactttgatcaacaaa

SEQ ID NO: 44507 - DNA, 101 bp, rice(Oryza sativa)
  misc_feature (71): n=a or g
gccaaaccttaatttccccaccctctaccctatcctcatttcctcacccacccagccatcactctccaccngcggccgagccgtcttcctccagcagtggc

SEQ ID NO: 44508 - DNA, 101 bp, rice(Oryza sativa)
  misc_feature (71): n=a or g
tatatgggcctaatccaaattgggtcgggctgtcacaccatgttaggctaccaggatgcacaagacacccngtaggttttcatttttcatctatagtgcct

SEQ ID NO: 44509 - DNA, 101 bp, rice(Oryza sativa)
  misc_feature (71): n=t or c
aagaaccttttccatgcaaggatggtcgttcatggaccccccatgtcgaagctctatgagcccagctattnggtgaggccttcatctcctgggtgccgctc

SEQ ID NO: 44510 - DNA, 101 bp, rice(Oryza sativa)
  misc_feature (71): n=a or g
gatatatggtcatttatgagtgctctggagggcgtttaattgtggagggcgtttaattgatttttgttacntacagtgatctagtataatataatacatat

SEQ ID NO: 44511 - DNA, 101 bp, rice(Oryza sativa)
  misc_feature (71): n=a or g
atctcatgataaactacgttttttgtttctatcccacatgagccatagtcattctcaattaatattcgtangcctggtcgagaagtcgtccttgagaaggc

SEQ ID NO: 44512 - DNA, 101 bp, rice(Oryza sativa)
  misc_feature (71): n=c or g
gaaaagttattttgacaggcagcttgttttgcacctatggaaatcttcgattttcatcggcacggccagantataggtgtttttattcccttaattaaacg

SEQ ID NO: 44513 - DNA, 101 bp, rice(Oryza sativa)
  misc_feature (71): n=a or g
taaccgggactaaagatcaaaatttttataaccgggactaccggttcttattggaaccggtattattgtgnaaaacagccgatccagcaaagatcattttt

SEQ ID NO: 44514 - DNA, 101 bp, rice(Oryza sativa)
  misc_feature (71): n=a or g
agaaaaatttaggaactatagaaacaatagaagtgttttaaaaaattatctagcctactgttatattggantttattaacttaaaattagatctcttgttt

SEQ ID NO: 44515 - DNA, 101 bp, rice(Oryza sativa)
  misc_feature (71): n=a or g
ttacacgaatcgaggacgaaagtgtaagtaggtctgcctgtcgagtgggctgggctacacgatcctggagngagggctattacaaatggtatcacagccaa

SEQ ID NO: 44516 - DNA, 101 bp, rice(Oryza sativa)
  misc_feature (71): n=a or g
cactaaaaagtacgcagcagcgagatggagaattggagatggtccaaggctgcgccctgctctggatctcncctggctgcgccctctcttgccactgttta

SEQ ID NO: 44517 - DNA, 101 bp, rice(Oryza sativa)
  misc_feature (71): n=t or c
gagggtctgatgctagcgccacatcctcgctagcctccgaggtccaacgacgccatgttgccctaggccgngatctgccgccttgctctctgcccagtgcc

SEQ ID NO: 44518 - DNA, 101 bp, rice(Oryza sativa)
  misc_feature (71): n=c or g
tgttgtcaaaaagactaaatttatccggtgtccaaccaacaacgaattcttttaaccacccttttagccancccacccccccccctccctaaaaaaactgc

SEQ ID NO: 44519 - DNA, 101 bp, rice(Oryza sativa)
  misc_feature (71): n=t or c
gagagagacgacgacgtctctaactacagaatggtttttttagataatgaactccagaatggttaacgtanggattgaattgacgaataattcgtaataat

SEQ ID NO: 44520 - DNA, 101 bp, rice(Oryza sativa)
  misc_feature (71): n=t or c
gctgacgcgactctggctcgagcacccgatgagaggagattaaaatcggacgttgacgttagcatgacgtnagtgtccgatttacgtgcaaaaccactcta

SEQ ID NO: 44521 - DNA, 101 bp, rice(Oryza sativa)
  misc_feature (71): n=a or g
ctggtgtgtgatacttgtgagcttggtaaacatactcgctctacatatgttgggcttggccttcatagctntgaaccattcatattaatacattctgatgt

SEQ ID NO: 44522 - DNA, 101 bp, rice(Oryza sativa)
  misc_feature (71): n=a or g
tgcacatatatataatctatataaactttatttatttcgttttatttgcacaatacatctgtgtttcactngtagagaaaccatctttggtcggtcgaccc

SEQ ID NO: 44523 - DNA, 101 bp, rice(Oryza sativa)
  misc_feature (71): n=a or c
tcgaatgacaggcgtgccccttgtgtcagccggataagatccggtggaccccacatcgcagcaaggcgtgnaagagacttccaagacaagcaacaagacat

SEQ ID NO: 44524 - DNA, 101 bp, rice(Oryza sativa)
  misc_feature (71): n=a or g
ttccccaccccctcgcaacggcactacatatgccggggggggggggaggcaacactggatggtagggatgnagacggcagcgccggttggccgagggtgga

SEQ ID NO: 44525 - DNA, 101 bp, rice(Oryza sativa)
  misc_feature (71): n=t or g
attaatccttacacggagagaggatatactccctccctccagttccatattagctgacgttttagacaagnttgaggtcaaacttttataactttgaccat

SEQ ID NO: 44526 - DNA, 101 bp, rice(Oryza sativa)
  misc_feature (71): n=t or c
actttaaaatttggctgatatgcataagcataagtgaaaagatcagaaaagctagttggcacgagcgcgcnagcaacgctgctggcgcgcgtgccacctgg

SEQ ID NO: 44527 - DNA, 101 bp, rice(Oryza sativa)
  misc_feature (71): n=a or c
ttttaatattcataagtaaattaatgatgaaatttctttaacaagtactactcggtccaaaaaaataaacnctaactacgaatctggacacgcatgtagat

SEQ ID NO: 44528 - DNA, 101 bp, rice(Oryza sativa)
  misc_feature (71): n=a or t
ctctataaaacagaaacattagttgctgttgttccaaaatcaccggcatcacccatcaaaatatttttttnaaaaaaacgccggcgtcagtttcagcgaca

SEQ ID NO: 44529 - DNA, 101 bp, rice(Oryza sativa)
  misc_feature (71): n=a or g
cgtcgtcgccgccctgctgatagaaggtcagaaggtgagaggaggaagatatgaaagagaaaggggaacanatgagggagaagatgagatgaggtggagac

SEQ ID NO: 44530 - DNA, 101 bp, rice(Oryza sativa)
  misc_feature (71): n=a or c
catgggagggtagaagcagaagaggagacggatcgttgacgcgtggcagatcagacaagaggggacggatngttgacgcgtggcagatcacacaagagggg

SEQ ID NO: 44531 - DNA, 101 bp, rice(Oryza sativa)
  misc_feature (71): n=a or t
aaaggaaaaatcagaaattgcaaaatcttctattgcctgctgctctttgtgtaatgaatccaaacttgaanttttttacttaaatggaggatgagtacatg

SEQ ID NO: 44532 - DNA, 101 bp, rice(Oryza sativa)
  misc_feature (71): n=a or g
ttgagatccacctgtcatagaattacaaatagttcttattatttcatctctaaaatcctcactatgaaagnaactggagagtcgtattgcaactttctaac

SEQ ID NO: 44533 - DNA, 101 bp, rice(Oryza sativa)
  misc_feature (71): n=t or c
tgctcttacgaaactgggaggaaaactaactcatttttcgtgcacatgcttcccgaactgctaaacggtgnatttttttaagttttctatatgaatattgc

SEQ ID NO: 44534 - DNA, 101 bp, rice(Oryza sativa)
  misc_feature (71): n=c or g
aaatcgttatgcgatctaggaccaaaaacaaaggggtcgacaaacacactcacgttgattgcggcttcacnctcagcttccccttctcgcaaagggggata

SEQ ID NO: 44535 - DNA, 101 bp, rice(Oryza sativa)
  misc_feature (71): n=a or t
tacaaaaagagaaaaatgagccaacctaattaattagcacggctactttaacaagtgtttttattaatttnaaaaaaaaagtttaacaagtgttcaactgc

SEQ ID NO: 44536 - DNA, 101 bp, rice(Oryza sativa)
  misc_feature (71): n=a or t
ttgccaatgcagactgaactaatagtggtgagatgccacactctcgcatctagagttttgaagaaaaaaanatgtgatccatttggaaaaccggtaaccag

SEQ ID NO: 44537 - DNA, 101 bp, rice(Oryza sativa)
  misc_feature (71): n=a or t
aaaggaaaacacattagcttgattatggcaaaatgagcggcaaactatctatagtttttctctaaaaaaanctatctatctttaacaagtatgagctattc

SEQ ID NO: 44538 - DNA, 101 bp, rice(Oryza sativa)
  misc_feature (71): n=a or t
ctcccttgagcaaatgactactagtacgactaccaaatgacttgagaggctcactccaatcccttggtccnttcagagaccgtcctgtgccaaccacaacc

SEQ ID NO: 44539 - DNA, 101 bp, rice(Oryza sativa)
  misc_feature (71): n=c or g
ccaaattcggcgagcttggcgttgaaattttcatccaagagtacattgcctggtttgatgtctctatgcangatatgtgggtcgcactcgtgatgtaggta

SEQ ID NO: 44540 - DNA, 101 bp, rice(Oryza sativa)
  misc_feature (71): n=a or t
cagccatatgcacacgcatcttcttgtattttgcagctaggctaccatatttaattttaggacttcgaganatatatacctaattttacactaaaagatag

SEQ ID NO: 44541 - DNA, 101 bp, rice(Oryza sativa)
  misc_feature (71): n=a or t
tttcatttcctaacttctactccttgtttgtcacgcgcaagcttgccgaactgctaaacggtgtttttttnaaaaaaaagttatatattaaagtttatttg

SEQ ID NO: 44542 - DNA, 101 bp, rice(Oryza sativa)
  misc_feature (71): n=a or t
tactgtgatgggatcgatatagtgcgattagccttgtggttggtttgcaccggatccagtcagattgaacnatattgagtgtttctctctccaatttcttc

SEQ ID NO: 44543 - DNA, 101 bp, rice(Oryza sativa)
  misc_feature (71): n=a or t
aaaaaccaaatgcaaagcatatggtgtgcattaatatgatggctttgtggactttccattgtgataacttnaagtaaatttgtattcttgagtcttgacac

SEQ ID NO: 44544 - DNA, 101 bp, rice(Oryza sativa)
  misc_feature (71): n=c or g
tcttgtaataaaaacctaaggctgtgttaagatgcagaggaggtgtaatattcccacttcttaaaaaacanagagatttttgcattttctctcttatataa

SEQ ID NO: 44545 - DNA, 101 bp, rice(Oryza sativa)
  misc_feature (71): n=a or t
tagcgcccaccgagttaaatgaaaattaagggatggattttattaacaccacatgtcagcttgagagcgtntttagagcgccatgtggcggcatgagagca

SEQ ID NO: 44546 - DNA, 101 bp, rice(Oryza sativa)
  misc_feature (71): n=c or g
ttgcgacttgacctcttcccttcctcctccatttccaacgccctcctccctcccttgttaattcctcctcntcgtcgtcgtcaacctcccgatcgagttcc

SEQ ID NO: 44547 - DNA, 101 bp, rice(Oryza sativa)
  misc_feature (71): n=a or t
cttttgcttagacaacaagaaagaacggcgtctgaagaaatggtttttgcagaaccgtgtaactttttttnaaaaaaagagaatcgcaacttaaaaggttt

SEQ ID NO: 44548 - DNA, 101 bp, rice(Oryza sativa)
  misc_feature (71): n=c or g
ttcgagggcgactcgctgagagatattttttgctgcaaaaccagttcagaatacgccatcacgtggccatnattgtcatcaaacgaaggctttggaacagg

SEQ ID NO: 44549 - DNA, 101 bp, rice(Oryza sativa)
  misc_feature (71): n=c or g
gagaccgcccaacacctatttaaagaatgtccttttgtgcaacagattcggagccagattaggccacggtncttccaacactactcgaatggtggcgcaac

SEQ ID NO: 44550 - DNA, 101 bp, rice(Oryza sativa)
  misc_feature (71): n=a or t
cctttcactatagggaatattgaccttatatgattttatacatgctatccattaagattcgattttttttnaaaaaaaacaaggagttcaagagataattt

SEQ ID NO: 44551 - DNA, 101 bp, rice(Oryza sativa)
  misc_feature (71): n=a or t
actgcatgagagttgtttatatatccattaggcattaatcaaatataggtatattctatattaaaattcangtatgtttttttatacccgaaatacatcgg

SEQ ID NO: 44552 - DNA, 101 bp, rice(Oryza sativa)
  misc_feature (71): n=a or t
tcgaaattttgtagaggttaaatcagagcaagtggcacggatgtcaactcgtggttaggtccaaaaaaaantgtctaaatagactataagcctgattttgt

SEQ ID NO: 44553 - DNA, 101 bp, rice(Oryza sativa)
  misc_feature (71): n=a or t
atgcatgcgtcctcttggtcagctcatgttctctacataggcctagtttaggcctgtttagttcccaaaantttttcccaaaaacatcacatcgaatcttt

SEQ ID NO: 44554 - DNA, 101 bp, rice(Oryza sativa)
  misc_feature (71): n=c or g
acaccaagccattttctcgagatttttttcttcccgtctaatacttgagttagcagtaatcatctactcangcagcaacagcaaaccaaacaagcaactcg

SEQ ID NO: 44555 - DNA, 101 bp, rice(Oryza sativa)
  misc_feature (71): n=a or t
tgcttaaacattttggacttgctctgaaattttgggacctaggcggctaatagagctgatgactataactnctaaccaccctgcccctgttgcttcacacg

SEQ ID NO: 44556 - DNA, 101 bp, rice(Oryza sativa)
  misc_feature (71): n=c or g
tctatcaaattggcagggcctaataaggctttttccttgcttccatagccttgcgaagagtttctacttcnagtcgttttgaatcgtattgttataagcgt

SEQ ID NO: 44557 - DNA, 101 bp, rice(Oryza sativa)
  misc_feature (71): n=a or t
ggaactaaagatttttgggatctttagtatcggttggtgaaatcaacttggtaataaagataatttacttnttatatgtctttttcctccttcagcccgag

SEQ ID NO: 44558 - DNA, 101 bp, rice(Oryza sativa)
  misc_feature (71): n=a or t
ggtagggcatcaggcccatttggctgcatgagaattttatttttattttgaaatcatcaagatattttttnaaaaaaaatcatcaatcaattatcatttca

SEQ ID NO: 44559 - DNA, 101 bp, rice(Oryza sativa)
  misc_feature (71): n=a or t
attgactcatataggctgacgcgtcagcctggatcggctcggctcggcttggataggtgctggtttttttnaaaaaaaacgatacctatagtttattattg

SEQ ID NO: 44560 - DNA, 101 bp, rice(Oryza sativa)
  misc_feature (71): n=c or g
gctgcagccgtccaatatccttgggcagctcggtaacatttacaccaaaaaccttcagatacttcaactgnaaaaggtatgttaggctgttaatatgctag

SEQ ID NO: 44561 - DNA, 101 bp, rice(Oryza sativa)
  misc_feature (71): n=c or g
tgcgtttcacaacgattgacagcgaacactggtgtgcacagatgcgagatgtgtgtgcatattcttcaacntattcgatcgaaaacgaccagtggcttctt

SEQ ID NO: 44562 - DNA, 101 bp, rice(Oryza sativa)
  misc_feature (71): n=a or t
ttagtggcatcatgttttcagacaatatagtacgtttattatgttgactaatcgtgttgatccgtgttggntgctgcctgctataaacaataaactaggag

SEQ ID NO: 44563 - DNA, 101 bp, rice(Oryza sativa)
  misc_feature (71): n=c or g
aatgtggcccgtcgtggttgacagggggcggcggggacagtggacagtgaaattttttcaccgcagtgacngagatgcggacgtgacccccgacggttaat

SEQ ID NO: 44564 - DNA, 101 bp, rice(Oryza sativa)
  misc_feature (71): n=a or t
tcccagccgtccaaatccacatcgacggctcagtcttccttttacccaaccaaatgccgaagttttttttnaaaaaaaattcccagaaagccgaaaagctt

SEQ ID NO: 44565 - DNA, 101 bp, rice(Oryza sativa)
  misc_feature (71): n=a or t
agtttttttattagtatcaaacactccatagtccatacgacatcctatgtgatacgtcagaaactttaccnagctgacctaaacacctctgagttgagggc

SEQ ID NO: 44566 - DNA, 101 bp, rice(Oryza sativa)
  misc_feature (71): n=c or g
ataaacacagaaacacgttacctcttttaaaatgggagggagggagtatatataagtcaaggagtaattgntgttggtgacgttaacctacgcggtagtac

SEQ ID NO: 44567 - DNA, 101 bp, rice(Oryza sativa)
  misc_feature (71): n=c or g
aacttccaattttagcgtgaactaaacacaccctaagtctgatcccaacacaactcatcgattcaggactntatttatatatataaaaaaactaagataca

SEQ ID NO: 44568 - DNA, 101 bp, rice(Oryza sativa)
  misc_feature (71): n=a or t
tggccatgccgaagtcttgatcaatgcagataattcactgaagaaaactggaagagcttgctgcagaatcngttggatgcagtagactggtctgggttgac

SEQ ID NO: 44569 - DNA, 101 bp, rice(Oryza sativa)
  misc_feature (71): n=a or t
ggaggaggagagggagagggagtatggggaagagggcatcttggtcatccgccatttccgagctttttttnaaaaaaaagaaaaaaatggagctcttgatg

SEQ ID NO: 44570 - DNA, 101 bp, rice(Oryza sativa)
  misc_feature (71): n=a or t
ttttgttgtgacttgtttataatcaaaggtactttaagcgtaacttgtatttttttgcataattgcaccanttttgtaaataaaacaaatagtcaaacatc

SEQ ID NO: 44571 - DNA, 101 bp, rice(Oryza sativa)
  misc_feature (71): n=c or g
gtacggcgacgccgtgagctaggggaacggctccaagacacccattgcttatgctctaaggctagtttcantgttcccgcgacagaaaaaaagatgtttgg

SEQ ID NO: 44572 - DNA, 101 bp, rice(Oryza sativa)
  misc_feature (71): n=a or t
gcttgactatgttccaccccgctcttaaaaagggttccagactggtcatccgatcagaaatagcttaccanagctttcggctcttgaacccaatgatcctc

SEQ ID NO: 44573 - DNA, 101 bp, rice(Oryza sativa)
  misc_feature (71): n=a or t
aatgttttagttaggaatataatcatattatttttatcatcggaaaaacaatcatgcgagatctttttttnaaaaaaatgcaatggtgcaattggattaca

SEQ ID NO: 44574 - DNA, 101 bp, rice(Oryza sativa)
  misc_feature (71): n=c or g
cacatgatttccatcatatctgaaaatgtcatcatggttatatttacaaagatttcacgaaatatttgganatatcatgaaaatatcgtaaatgttgttgg

SEQ ID NO: 44575 - DNA, 101 bp, rice(Oryza sativa)
  misc_feature (71): n=c or g
tgtttagagacatcttatttatagtctagagacgttttgaacccgtctttaggcatacatagagtcgcttnttcaaagcgtcccagaagcgtctccgttag

SEQ ID NO: 44576 - DNA, 101 bp, rice(Oryza sativa)
  misc_feature (71): n=c or g
taatagaatcgatgaagagctgtgaactctttcaaggccgcaatggccccaaatacgagctcttcatcagntaattaagccagggccacgatccgatccag

SEQ ID NO: 44577 - DNA, 101 bp, rice(Oryza sativa)
  misc_feature (71): n=c or g
taacaggcatgtattctcgatgtcatcttcattactggaaaattaatgattatccttgcttcgttgtcgtntatgatttttgttggtgcatcacatttgag

SEQ ID NO: 44578 - DNA, 101 bp, rice(Oryza sativa)
  misc_feature (71): n=a or t
tagtactgtttattcttgtacctcggttgtgttgttaagcctcttctctttgttgtaaatactgttagtcngtctgtctgtgtatacacttcctgtagtga

SEQ ID NO: 44579 - DNA, 101 bp, rice(Oryza sativa)
  misc_feature (71): n=a or t
tcccttattctgtttaaaaaaaaagtcccaagaagttattttgtccccataacagtgaaattcctcaccgntgatgaattgatgatgctgcttgcttgatc

SEQ ID NO: 44580 - DNA, 101 bp, rice(Oryza sativa)
  misc_feature (71): n=c or g
tccatcctgctataaccgtatgaatcaaactcctctatagcttgcttctcttgacactctacattcgactncgggctacctggtctgcctttcgctccgat

SEQ ID NO: 44581 - DNA, 101 bp, rice(Oryza sativa)
  misc_feature (71): n=c or g
ttaagcacgcccaatgtgaggaaaccgtcaacatccttgaagcaggtcacagtaagatctccctccatttncccaagctcccatacggtatcttggtttac

SEQ ID NO: 44582 - DNA, 101 bp, rice(Oryza sativa)
  misc_feature (71): n=a or t
gaaagccggtaacagttaaaaaggtcgaagtgctaaaaagaccgaaagccgacaatggtcaaaacgatcanagtacctaaaaatacctttgccaaaggcaa

SEQ ID NO: 44583 - DNA, 101 bp, rice(Oryza sativa)
  misc_feature (71): n=a or t
tcttttttcatctgtctttacaggtacagtcgtacagattcggtgtaaattacactcgaataatttctttnaaaaaaatgaaaatctctcctagttttagc

SEQ ID NO: 44584 - DNA, 101 bp, rice(Oryza sativa)
  misc_feature (71): n=a or t
caaatgcgcaacagtttcgaataagcaaccactgtaactattcagtatgaaaacggcatgaaatttcaaanttttttttgaggggaaacactgctggactt

SEQ ID NO: 44585 - DNA, 101 bp, rice(Oryza sativa)
  misc_feature (71): n=c or g
tgacactgctgaaatatatgtggtcacagtacaaaagcatcttcttcagtttagattggtccaaagtttanaatttggttgaaattagaaacgatgtgact

SEQ ID NO: 44586 - DNA, 101 bp, rice(Oryza sativa)
  misc_feature (71): n=a or t
caagaagcgcagtgtttcaatcctagagaaaagaggacttccgagtccgagtgtccgacacatcagttganaccttacacgtgcagttacatgtgcagggc

SEQ ID NO: 44587 - DNA, 101 bp, rice(Oryza sativa)
  misc_feature (71): n=a or t
tcgacgaggcataattctttggcatatgctgatagctgtgatgctcacatgctcatcatattgcaaaaaantcaaatatttgtagaaccttatccagttca

SEQ ID NO: 44588 - DNA, 101 bp, rice(Oryza sativa)
  misc_feature (71): n=c or g
tatccaatgtcacagaagcaactatcaacttggacatgaggatacaacgtttagcaagggaggtttgtganaggtgcaaaggacttcccctagcacttgtt

SEQ ID NO: 44589 - DNA, 101 bp, rice(Oryza sativa)
  misc_feature (71): n=a or t
cccaacatctaactccaggttcctgttacaccagtgaatgcaaaaaatatgtaaagagttagtgtgaaaantaaacataaatatgcaaattaattgtattt

SEQ ID NO: 44590 - DNA, 101 bp, rice(Oryza sativa)
  misc_feature (71): n=a or t
gaaggcgaaatgcttggggctgtgttgatggctagctcctctcttaccagtttaggcaagatggtggcatngtcacattaactgaggttctcatatgtcac

SEQ ID NO: 44591 - DNA, 101 bp, rice(Oryza sativa)
  misc_feature (71): n=a or t
aacaaaaacccttcccaacattctgtcagcatcctcccaaaaagtttacttaccaaaagaggtaactgccnggtgcacatgatggcgatcaatgaaatcaa

SEQ ID NO: 44592 - DNA, 101 bp, rice(Oryza sativa)
  misc_feature (71): n=a or t
ggcttcatatgtcctcacagaaaagctattgctgactttttattagaagtaggttaactcttgcatcaaanttttacattaactatggtgttttcctcatg

SEQ ID NO: 44593 - DNA, 101 bp, rice(Oryza sativa)
  misc_feature (71): n=a or t
cagggcgtacaggggtctagctgaccggtatgacatcatttcaggggaactgcacaaagcaaaccataccntcgcgacagctttccctgaccaagtgcagt

SEQ ID NO: 44594 - DNA, 101 bp, rice(Oryza sativa)
  misc_feature (71): n=c or g
ggagcagagcatgatctgctctctgatttctgaggaccagaacatgtggcagatttggtagtttctgcttntgtttgtatttgggtttagagatgtagcag

SEQ ID NO: 44595 - DNA, 101 bp, rice(Oryza sativa)
  misc_feature (71): n=c or g
tatgggacatcaagcgtgcgtgctgataaaaataagtgtggtgcccactaaactatgttagataagacatnttttccataaagaaatcttggagttgaaaa

SEQ ID NO: 44596 - DNA, 101 bp, rice(Oryza sativa)
  misc_feature (71): n=a or t
aataattctttgcaaatgccaattttgcatatgtagaaggacatgtcacattaccaacatggaggtggcangaaaatgacccatttgcccttgtttgatct

SEQ ID NO: 44597 - DNA, 101 bp, rice(Oryza sativa)
  misc_feature (71): n=a or t
atttctgcgcgggaggtttttatatagctgcctgtaagcataataaaaagaggcaaatacaacacttaaangtgatcaggtaaagcattactaaatcgatt

SEQ ID NO: 44598 - DNA, 101 bp, rice(Oryza sativa)
  misc_feature (71): n=a or t
gcctgcggcgcggacgaggggggtcgacggcgagctcgacaaacgttaaaattgaaagtttttaaaaaaantagaaatttacgtgtgtagaaaaattttaa

SEQ ID NO: 44599 - DNA, 101 bp, rice(Oryza sativa)
  misc_feature (71): n=a or t
agagaaggatgtacaattcctggaaaaagaaaagatttgcagttattttggcagcgtattcatatgcagcnattcaagtatttgagaaattaaatagcata

SEQ ID NO: 44600 - DNA, 101 bp, rice(Oryza sativa)
  misc_feature (71): n=a or t
tggagtgttgctgcagctggacagggaagagttggtggtggcgttgtagaccgtgaagccggcgacgtagnagtcggacgccggcgcgacgtcggtcttcg

SEQ ID NO: 44601 - DNA, 101 bp, rice(Oryza sativa)
  misc_feature (71): n=c or g
tcacagctccgtgcaaaaactgtagctgcgtttgtgtttggctcgggaattgggtgtgaagaaagacacanacagagagagagagagagagagagagatgg

SEQ ID NO: 44602 - DNA, 101 bp, rice(Oryza sativa)
  misc_feature (71): n=c or g
taggcaatctttgcggaacagcggcttggctcgagatgaacgaggatggccagacgacgatgatgccgaancggcggcgctccggtgcgtgctccagggca

SEQ ID NO: 44603 - DNA, 101 bp, rice(Oryza sativa)
  misc_feature (71): n=c or g
caaatgttggaatatttcattatttttattaaaaaaacagaagaatgaaaacggaattgtgttcttttgangacctgtgtgtaattctgaataaatgtggg

SEQ ID NO: 44604 - DNA, 101 bp, rice(Oryza sativa)
  misc_feature (71): n=a or t
ctccgtgtcccccgggccccggctatgtgggtagattgattttgaaaataaagttgggaatatattttttnaaaaaaaactacaaataagggaaaattaat

SEQ ID NO: 44605 - DNA, 101 bp, rice(Oryza sativa)
  misc_feature (71): n=c or g
aaacatacgcaggcgatcgagatagctatagacgctatagacgtggagcgatgtgagcaacacaagcaacngattttattagcttaaattgattccatggg

SEQ ID NO: 44606 - DNA, 101 bp, rice(Oryza sativa)
  misc_feature (71): n=a or t
gtgggcccgtagtgtttttattttcttactgactaagatgccacattagagaaatattgagggaacacaantttttggtattttgattcacaaactcgacg

SEQ ID NO: 44607 - DNA, 101 bp, rice(Oryza sativa)
  misc_feature (71): n=a or t
tgaagagtctagcaaaactattactcaacttcaagagaccttacaaaggtgcatatgcaatttttatttcntatttttacctatttgtcatgatggtatca

SEQ ID NO: 44608 - DNA, 101 bp, rice(Oryza sativa)
  misc_feature (71): n=a or t
aagataatacaattagactgctcctagcctcttcacaattaggatgaacacaatctatgcctttttttttnaaaaaaaagagaaggacgatatgatcacaa

SEQ ID NO: 44609 - DNA, 101 bp, rice(Oryza sativa)
  misc_feature (71): n=a or t
cgccacctaaagcactcttataggccattcatacgaattttgcgtaattctggttagaattatagacagtnacagtttatagcacaaaggatatagccctg

SEQ ID NO: 44610 - DNA, 101 bp, rice(Oryza sativa)
  misc_feature (71): n=t or g
accaggaaacctaggtagtaagaaagatccaaggaggagaggcttgacgaagaagatggaggagactatcnatcaagattgcaagaagcaggagcttggtg

SEQ ID NO: 44611 - DNA, 101 bp, rice(Oryza sativa)
  misc_feature (71): n=a or g
cttgttcgttcgtcagtgaagaactgggcagaggattaaatcatcaaacagaaatggaaggtggcgagacnaacaccgtggaatccagcagttcgcttcgc

SEQ ID NO: 44612 - DNA, 101 bp, rice(Oryza sativa)
  misc_feature (71): n=a or g
tgcattgctacccttttaagcaagtccatggcatacctttcttgtcatactagaagaccgtccttggttcntttcacttccattccaaggaagtaatgtaa

SEQ ID NO: 44613 - DNA, 101 bp, rice(Oryza sativa)
  misc_feature (71): n=a or g
cggatgcttctcatctgtctcagctcccctaagcgcctcaaggacacttcgtcttgaacttctagtccttnaagcgtctgtaactcattcagcttctctag

SEQ ID NO: 44614 - DNA, 101 bp, rice(Oryza sativa)
  misc_feature (71): n=a or c
ttagctgtgcacttttgtctctcctctatcaccgcaatatgattcctttcaaattccttccttttttttcntttttatttacaagtatttcatctgaatat

SEQ ID NO: 44615 - DNA, 101 bp, rice(Oryza sativa)
  misc_feature (71): n=a or c
ggtattaaaactattgtcgtctcgttccaacctaatggcatctgacctccattcaaaatatcaagaacttntgaggtcacctttcctccaaccacatccca

SEQ ID NO: 44616 - DNA, 101 bp, rice(Oryza sativa)
  misc_feature (71): n=a or g
agatgtccatcgatcttcatcgactttttactatcatcaaatttgactttcctttgttctatagctgattntatctgttgtctgaagactttgcgctcatt

SEQ ID NO: 44617 - DNA, 101 bp, rice(Oryza sativa)
  misc_feature (71): n=t or c
agtgatcggtgttgatgaagaactaaaaaatgaagttaaagcactagatgagaggaacatagcagagggcnagaggagcgaagaattataggcaatagtgt

SEQ ID NO: 44618 - DNA, 101 bp, rice(Oryza sativa)
  misc_feature (71): n=a or g
cagacatgctacctggccttgctcaaaacaagatgtaccaatggaccaaagaaagtctggccaaagagtgngaggaagctggtgtacccgcatatgtttct

SEQ ID NO: 44619 - DNA, 101 bp, rice(Oryza sativa)
  misc_feature (71): n=a or g
ggttctacggactggtcgtgtagacaaagaagattgtggtttactgactttcctccgtgcaagatccgtcntaacttatttctccatttggacaccaccgt

SEQ ID NO: 44620 - DNA, 101 bp, rice(Oryza sativa)
  misc_feature (71): n=t or g
ttgcgctggagcatggcaatgaagataatttgtcgctcagcattgctgtgcgagtgcacagaggaagatanagtggtagacatggggaggggaagtggagc

SEQ ID NO: 44621 - DNA, 101 bp, rice(Oryza sativa)
  misc_feature (71): n=a or g
ggatgaacccgtcggggtcgacgacgaccgacactcttaccataacgtccgcgttgtcgtccttcctgtgngagcgctccgtggtggagttcgacgatgac

SEQ ID NO: 44622 - DNA, 101 bp, rice(Oryza sativa)
  misc_feature (71): n=a or g
ttttgtagcttgtcgaaacataatccacactaaaatttagtgtgaattctgtaaggtcgtcactgggtttntcacttatcacctttgtatttttcagacag

SEQ ID NO: 44623 - DNA, 101 bp, rice(Oryza sativa)
  misc_feature (71): n=a or g
gactttatggtatgtggactgcttcacatctctactggtggcccacatgcttgctggcttgctgcagatcncaacttgactcccaccacttcctccccctc

SEQ ID NO: 44624 - DNA, 101 bp, rice(Oryza sativa)
  misc_feature (71): n=a or g
catgccggtgacctggctccccacaattcctacaacattcatcgtccctaattgtcgcgttcagtgccgcnagctcccgcagctgctgccgcttgtgctcg

SEQ ID NO: 44625 - DNA, 101 bp, rice(Oryza sativa)
  misc_feature (71): n=a or g
ctctatcgatctttcttctcccttctcgcgacggcaacacacaggagcaccgccactgagtcctccatgtngagtgtcactgccgagctcctcctcgagag

SEQ ID NO: 44626 - DNA, 101 bp, rice(Oryza sativa)
  misc_feature (71): n=t or c
aaaaaccactctcatcttcacacctagtcattgatgtaaacttactcgtgtagaccgcaagatcaaatccnaggccaaattcgacgtcttagttaataaaa

SEQ ID NO: 44627 - DNA, 101 bp, rice(Oryza sativa)
  misc_feature (71): n=t or g
agtatgtgtgtcgctcaataatctgatccactaaatgtgtttcagccacctgattaagcaagaaaggcaantgatttccatactttattccatagttatcg

SEQ ID NO: 44628 - DNA, 101 bp, rice(Oryza sativa)
  misc_feature (71): n=t or c
ggcggcgacgaccagtggcgaaaatgggcatcgaaggccgaacaaggaggtggaggggacatcggtggcanagcgccagtcttcggatggagtggatgcgg

SEQ ID NO: 44629 - DNA, 101 bp, rice(Oryza sativa)
  misc_feature (71): n=a or g
cacttacaatattttctcttccctagctccccagccgatgggattatgtgaccagcatgaagttgtatctntttctcccgaagtagcaaatcaaaaatctt

SEQ ID NO: 44630 - DNA, 101 bp, rice(Oryza sativa)
  misc_feature (71): n=a or g
atttgtggtcgatgtttagagaatggtcatctcttggcccaatgtaatgggccgtttcgttgccgtaactntaaggcttcgggacatgcagcccgtttttg

SEQ ID NO: 44631 - DNA, 101 bp, rice(Oryza sativa)
  misc_feature (71): n=t or c
cgacccattggagaaagacgctacccatatatacacagcagttatgttgaagaaaatccgtgcatggatanggctaattgttggacttgaattcatcagtg

SEQ ID NO: 44632 - DNA, 101 bp, rice(Oryza sativa)
  misc_feature (71): n=a or c
tctacaaggtatttatgcacattcacgatcttttctgcaacagtacctggactccctcaaggcagtaatcnaacacagtcatcagcgatccctttgatgtc

SEQ ID NO: 44633 - DNA, 101 bp, rice(Oryza sativa)
  misc_feature (71): n=t or c
tttggggtgataggtcacctggtaccaggcagaggccttcatctcgtacagcagattcttctcgtcatcancaatctcgcattgatccgatgctatgctct

SEQ ID NO: 44634 - DNA, 101 bp, rice(Oryza sativa)
  misc_feature (71): n=t or g
aaacctgatcatttagctcattgtatttctgcaaggcctcatcctttcctttcaccagctctatcttttcntgctctccaagggttcttagaccatcctga

SEQ ID NO: 44635 - DNA, 101 bp, rice(Oryza sativa)
  misc_feature (71): n=a or g
gcagcagtgtcttcttgtcctcaagtgccatgaactcctttcctgtaagactctttaaggtaatgtcctcntcatgtgaaaacacaccaatttcacggcat

SEQ ID NO: 44636 - DNA, 101 bp, rice(Oryza sativa)
  misc_feature (71): n=a or g
tgccatctgcttggtgaccatcgagttagtcaacgacactccactactcttatgtgtcagccgtaactcanaaagtttccagtttcccttgcgaaaatgtt

SEQ ID NO: 44637 - DNA, 101 bp, rice(Oryza sativa)
  misc_feature (71): n=t or c
tctattactttccccatccaaaccataggacatatgaccagccgtctgattgcaaattaaaacagcattgncagaattagtagcatccccattttgtcttg

SEQ ID NO: 44638 - DNA, 101 bp, rice(Oryza sativa)
  misc_feature (71): n=t or g
tgtagtctgtagtggccaagaacatcctgaagcagatttatcctatcaggctatcagcactaagttgatcngcacgtataggttttcttttgcgtcattct

SEQ ID NO: 44639 - DNA, 101 bp, rice(Oryza sativa)
  misc_feature (71): n=a or g
gagtaatttaaaacggtgagtagtaaaatgacaaatcctgccgggtaacgttcttgacagatactttcccnacggtattgacatctactttgacaatgtcg

SEQ ID NO: 44640 - DNA, 101 bp, rice(Oryza sativa)
  misc_feature (71): n=t or c
ctccgctttggtaggcttcctgatcgagagaggtagcccgaggtaagtaattgggaaatcttccaatctgnaggctagagtgttctgcgccaatgtcttct

SEQ ID NO: 44641 - DNA, 101 bp, rice(Oryza sativa)
  misc_feature (71): n=a or c
gcgattagatcatcttcttctgctaggtagcacaaagcaacattgtacgaccactctctgttgtgtaatantccaggtaataattcttcaaactgaatagc

SEQ ID NO: 44642 - DNA, 101 bp, rice(Oryza sativa)
  misc_feature (71): n=t or c
atttcaagccacaaacatgtacgacccattggatgattacatacgagcatgtccaaagaacgaaatacgtnattctgaaccaagggaactcctgggatata

SEQ ID NO: 44643 - DNA, 101 bp, rice(Oryza sativa)
  misc_feature (71): n=a or g
atttatatttccaataaattgacatttagtaagcattaacatagttaaactttgcgatgttgctgatgcantatggtatcctagttatcctgtcatttatg

SEQ ID NO: 44644 - DNA, 101 bp, rice(Oryza sativa)
  misc_feature (71): n=a or g
tgatgctgacggcgcagatcagtgctcttccaacgtgatggatgattcttccatggtgtttagtcaccttnaagacctgattaccctaccagcagaggaag

SEQ ID NO: 44645 - DNA, 101 bp, rice(Oryza sativa)
  misc_feature (71): n=a or g
tcctgtgttaaagcttcattctccaattgagatacttgaggaatatctacaaatttattctcatcaaactngagatcataatcatcaggcgggccaaataa

SEQ ID NO: 44646 - DNA, 101 bp, rice(Oryza sativa)
  misc_feature (71): n=a or c
gattttgatgttaatggtggtggtgtttgcagcagcggatctagagctcatcacctcgtggagcacacttnaagctcgagcgttccaagctcggtcatgga

SEQ ID NO: 44647 - DNA, 101 bp, rice(Oryza sativa)
  misc_feature (71): n=a or g
atgactaggaggagggtttttaggatcaggtattgggtcacgagggccatgtcggcttggatcatcatcgnatggcgtaactggcagccaaagcggaacca

SEQ ID NO: 44648 - DNA, 101 bp, rice(Oryza sativa)
  misc_feature (71): n=a or c
aaattgaggattcaggtgcatctctgtctgaactctgaggctttgcagtgttccaggagaggtcaccatcnaaactgcggtgcaattgatgaaaatcagta

SEQ ID NO: 44649 - DNA, 101 bp, rice(Oryza sativa)
  misc_feature (71): n=t or g
ggctcctctcacccacttttgcttcgcaaccacaacaattttcacaagtcacaagcgcagcggaatcgcgnagaggtgagggcttgatttgatctctctcc

SEQ ID NO: 44650 - DNA, 101 bp, rice(Oryza sativa)
  misc_feature (71): n=t or c
aaacacaggacagaaattacccgcaggatagcagtagtagagcaatgaaacacaccatgaatcgccatgcnaggtgggcttgtgcagagccggatctagat

SEQ ID NO: 44651 - DNA, 101 bp, rice(Oryza sativa)
  misc_feature (71): n=a or g
ctctcttgcagagatgggctttccttggcgctacaatggactcttcttccgattgtcgtagagacagacantctgatggcgaagcaacttgttcagtccga

SEQ ID NO: 44652 - DNA, 101 bp, rice(Oryza sativa)
  misc_feature (71): n=a or g
aattgaaaagggagaagggattttatagcatctccctcatgtggcgtgaagtgcactccaactccatctcntcttcttcttcctcctcacctcacctccat

SEQ ID NO: 44653 - DNA, 101 bp, rice(Oryza sativa)
  misc_feature (71): n=t or c
gaaacaaattagctagacgcaggcagtatcgtatggagtatgcaactcgatggccatcagcgttaacgcangtattaccttgacgtcgaactcggagcggt

SEQ ID NO: 44654 - DNA, 101 bp, rice(Oryza sativa)
  misc_feature (71): n=a or g
ctgggaatgtacctctttattccatcataaattgttgttttttgggggccatatttcaaaccgtctaggtnagttgtcatagcatcttcataattgtgcat

SEQ ID NO: 44655 - DNA, 101 bp, rice(Oryza sativa)
  misc_feature (71): n=t or c
cctgtaagggcattgtgagacatgttgagcccatgaagaagaataagctccccgatagtctcagggatggngccatggaatgcattattcgagaaatcaat

SEQ ID NO: 44656 - DNA, 101 bp, rice(Oryza sativa)
  misc_feature (71): n=a or c
aagcttactaatggggctcaagtacttgctgcatctggaagggatggcaatgacaatcttttccccttagnatttggggtggtacggaaagaagattacga

SEQ ID NO: 44657 - DNA, 101 bp, rice(Oryza sativa)
  misc_feature (71): n=a or g
tgcttcgccaatacttccgtcgcgccactggtggattccacctgtgtagctttgcccgcagtgccgcctcnccggtctacctcaccgcctttccccaacat

SEQ ID NO: 44658 - DNA, 101 bp, rice(Oryza sativa)
  misc_feature (71): n=t or c
ggaccaagtgtcaggaatattctctttgtgggttgatagggcgaaatggaccgttcaaggtatccctactngtccaaggtatctctactctctgtagattt

SEQ ID NO: 44659 - DNA, 101 bp, rice(Oryza sativa)
  misc_feature (71): n=t or g
tcatgatatgtggactgtgcaagcgaggacttgttgatgaggcaatgcagatttttgatgagatgggagancatggttgtgatccaacagttatgacatac

SEQ ID NO: 44660 - DNA, 101 bp, rice(Oryza sativa)
  misc_feature (71): n=t or c
ccaaccttcaacattacaagtgtcattgtcttcgcatgcttccattgtagcatcttctttctgcgctgaancatccttcttcttcattcttgagttgagtt

SEQ ID NO: 44661 - DNA, 101 bp, rice(Oryza sativa)
  misc_feature (71): n=t or c
caatgacggcgaagaggaggaggctaagggcaaggatgggagcgacaaccgtggaagccattggtatatcngagagatcgagtgagctattggtactcagt

SEQ ID NO: 44662 - DNA, 101 bp, rice(Oryza sativa)
  misc_feature (71): n=a or c
caccggattgctgtaggtagaaaatggagtgcctttgggagtcgctaggaaattgacatgagacctaaagnacttagcatcagtgccaactgggcccgaca

SEQ ID NO: 44663 - DNA, 101 bp, rice(Oryza sativa)
  misc_feature (71): n=t or g
actcccaagcaaaaaatgcctctcctccctcgaggctgagtgaggcattccggatcttgttcctgcttcanatactgttcattttcggactgtgaagcacc

SEQ ID NO: 44664 - DNA, 101 bp, rice(Oryza sativa)
  misc_feature (71): n=a or c
accttcctgaagtaatagtcagcaaggatttcataccttcccaccacgatgactttcatggtcttcacgtntcctcttgctcgatttgggaagatcatgtt

SEQ ID NO: 44665 - DNA, 101 bp, rice(Oryza sativa)
  misc_feature (71): n=t or g
tctctccccttgcatcgccggaacaccacgaccccggccaaccacgccctctgaaatcctctccggtctcnatatcctcgatcgatcgcaatcatgcgaat

SEQ ID NO: 44666 - DNA, 101 bp, rice(Oryza sativa)
  misc_feature (71): n=a or g
agttactcaagagttaaaagagattaaggctaaagtggaagaactgtcaatagcggaccccttgttgcatnatgcagaaattagaatgttatatgcgagaa

SEQ ID NO: 44667 - DNA, 101 bp, rice(Oryza sativa)
  misc_feature (71): n=a or c
tccattaaatctggactggcaaagtatagcaggtaacctacttcttgagcaacatctggcttctccatatngacaattactttagaaccctgttgcacaaa

SEQ ID NO: 44668 - DNA, 101 bp, rice(Oryza sativa)
  misc_feature (71): n=a or g
aggggttccatattgttatatttagtattattaactgatcattgttcatgcttttcctatagaggtgaccncctgttccatgcatcaactcttacagagag

SEQ ID NO: 44669 - DNA, 101 bp, rice(Oryza sativa)
  misc_feature (71): n=a or g
taagatccgcagatttcatgagcgttggtattaccctgctaatgctactttatatctggtaggagagatcnatgatattcccagagcaatacgagaaatag

SEQ ID NO: 44670 - DNA, 101 bp, rice(Oryza sativa)
  misc_feature (71): n=t or c
tgaagtctgtttgcctttagcttggttaggaactttaaactgagccccataagagatataggtccgtaatnattgaccgtctctggtgaattcttctttga

SEQ ID NO: 44671 - DNA, 101 bp, rice(Oryza sativa)
  misc_feature (71): n=t or c
agaatctgaaattctgaatctttcccctttttttagtggatcttctgggtagggcctcttgtcgggtccgncattgcgacgctataccacgagcatgtgct

SEQ ID NO: 44672 - DNA, 101 bp, rice(Oryza sativa)
  misc_feature (71): n=a or c
gcctcgctgctcctcatcctctccttctccctgtctaaccctccctctcgacgggggccgaccacttctcnggcgagcggcgccgcctgaaattccgtgtc

SEQ ID NO: 44673 - DNA, 101 bp, rice(Oryza sativa)
  misc_feature (71): n=t or c
ctatcacctctcctccctctatctcatccctactcgacgggagcatggctggcaatagcaccagcgacgangggagaggcagtggaggcttcgtcgcggct

SEQ ID NO: 44674 - DNA, 101 bp, rice(Oryza sativa)
  misc_feature (71): n=t or c
ctcctgacgatcgcctcccacatcttttctatgcctcaatatctcaacacccaaataatcgacgattccangtacagcaacatgaggtttcccaactttca

SEQ ID NO: 44675 - DNA, 101 bp, rice(Oryza sativa)
  misc_feature (71): n=a or g
tcagatccaaacaagtttttatagtattcataaatgtgagctttaagttcccctggatcactgatttcctnttcatctttttctagtgacagtatagtagt

SEQ ID NO: 44676 - DNA, 101 bp, rice(Oryza sativa)
  misc_feature (71): n=t or g
tctggaattcgccgatggcgataagaaggccactttggagatcccacctgagcactacctcattatctctntaagcattcaacaactcaaattacgataca

SEQ ID NO: 44677 - DNA, 101 bp, rice(Oryza sativa)
  misc_feature (71): n=t or g
ggttgatcgattgattggttggttgatatgatatttgcagtgaagaaattgatactgacgatgatggcatngacgacattgacggagctcaggaggaggac

SEQ ID NO: 44678 - DNA, 101 bp, rice(Oryza sativa)
  misc_feature (71): n=a or g
atgggcgaattgcagattgctagccttgagcttggtgatgggaatccaactctccgcatacgcatttcatngttatgggaataccatgaccaaaatgatga

SEQ ID NO: 44679 - DNA, 101 bp, rice(Oryza sativa)
  misc_feature (71): n=t or c
aagataattcctttcacaacctttgcatccttgtcaaggcaaaatgccattgtagcgtaagcaacataganatgataagtgcagcctggcaatttccgagc

SEQ ID NO: 44680 - DNA, 101 bp, rice(Oryza sativa)
  misc_feature (71): n=t or g
tgcgcattatcccagtccgattcggacttcgtatcggcgaaaatctgagtccgcattggattttgttgcanatcacgtatatggatcagacggcgccctgt

SEQ ID NO: 44681 - DNA, 101 bp, rice(Oryza sativa)
  misc_feature (71): n=t or c
atatcgtctgcaacaaaacgaaaccatcaagcgcatcagattaaacgtggaaacgcagcaacacgctcatnggagctcgagctacggcggcggtttcacct

SEQ ID NO: 44682 - DNA, 101 bp, rice(Oryza sativa)
  misc_feature (71): n=t or c
gtactgcagtgttaaatttcaccggaaggatgtgtgcaagattttgctacgtactgtacacacatatgtantatactaactttgttgtagcaattataatt

SEQ ID NO: 44683 - DNA, 101 bp, rice(Oryza sativa)
  misc_feature (71): n=a or g
gtgttgagtgtgagcataaccaccaaccaaagcttcgaacttgttctcagctgtcacgaaaggtagttccntttcctcagctactgcagcagcaattttga

SEQ ID NO: 44684 - DNA, 101 bp, rice(Oryza sativa)
  misc_feature (71): n=a or c
tatttgacactatgcttcttcttaatatctcacgtcgaaaaaattgagcttccttaattgctacctaccgnggaccatagaagctgatgcgctgtaattct

SEQ ID NO: 44685 - DNA, 101 bp, rice(Oryza sativa)
  misc_feature (71): n=a or g
taatgaaaatactaattataaaaaaattttatataagagggagtactgctatagcctatagcgctgtgccntgccgtgcagcagctacatgcctcctgtct

SEQ ID NO: 44686 - DNA, 101 bp, rice(Oryza sativa)
  misc_feature (71): n=t or c
agctcatccattggcccatcaattccaacaagctctgtggccattctgaatagattcaggagtcgaggatngatggttgcttggtactcaggttttgcgac

SEQ ID NO: 44687 - DNA, 101 bp, rice(Oryza sativa)
  misc_feature (71): n=a or g
taccaaaaagagaaagggcaagaggagcgtgaatagaatagacgatgggttgtacgttgtcacccacatangtccaaatggtgagccgctcgcgccctcca

SEQ ID NO: 44688 - DNA, 101 bp, rice(Oryza sativa)
  misc_feature (71): n=a or g
ggagatggagagttggagacacattggtatctcgacgatgcaagccgctagagacgggaaaggttgccacncctcagcttcgggcgaaagaagggataggg

SEQ ID NO: 44689 - DNA, 101 bp, rice(Oryza sativa)
  misc_feature (71): n=a or g
gcctaaatagtcccaaatttcatttgaaataagaggcccaagaagattcgccttagttgtcgaagaccttnacctattgcagtcttgagtccttggctctt

SEQ ID NO: 44690 - DNA, 101 bp, rice(Oryza sativa)
  misc_feature (71): n=a or c
caatgtagctacatgaccagaaggacgagagcaaaattagatcaattgcagaaactgtttgattagcggancaaaaattaagtgaaaatgtatgcattata

SEQ ID NO: 44691 - DNA, 101 bp, rice(Oryza sativa)
  misc_feature (71): n=t or c
gcaatacctattatctttatcttaaggttggtatttttaattcgtagccattcgatccagccacaacctangtaataattggttatagcttctttgtagca

SEQ ID NO: 44692 - DNA, 101 bp, rice(Oryza sativa)
  misc_feature (71): n=t or c
tcaaaactatggtacgtcatccgtatccgattcccattacacgtaacatttatttagaagtcacgactcgngagcgaactacaaaagagagtccgtgcaat

SEQ ID NO: 44693 - DNA, 101 bp, rice(Oryza sativa)
  misc_feature (71): n=t or c
gcactattcaccctgttaaggctaagaaagacaaggtttggcacatagggtgcaaggaggagtagaggatnttcctgaagacggcaccagcttatggccag

SEQ ID NO: 44694 - DNA, 101 bp, rice(Oryza sativa)
  misc_feature (71): n=a or g
gagaccttcagtcctgtggtaaaaccggcaacggttcgcactgttctcagcttagccgtctctcagaactnggccattcgacagcttgacgtgaagaatgc

SEQ ID NO: 44695 - DNA, 101 bp, rice(Oryza sativa)
  misc_feature (71): n=t or g
gaacgggagaaccaagctattaactgttggctactaagtaaaccttaggcacataactaaccattgtccanaagaatgaccttctcactatcaagaactga

SEQ ID NO: 44696 - DNA, 101 bp, rice(Oryza sativa)
  misc_feature (71): n=a or g
atgatcggtataaagcaatggatttttttatttcgtgaatcgcagctctgacatacagaacacagtgctantggtcataatctggaacatttggtaggcga

SEQ ID NO: 44697 - DNA, 101 bp, rice(Oryza sativa)
  misc_feature (71): n=t or c
gcacaactaaatttgttaaactagttcatgtgtatatagtttctcctgcggtggtgaacaggccgatttcntagaaccacgattttgtgcagggtatagtc

SEQ ID NO: 44698 - DNA, 101 bp, rice(Oryza sativa)
  misc_feature (71): n=t or c
acctctgcaatcattttgatcatatctcgttgcaggcttggcagcataagcgccaatgacctatgaaaacncttaatgaaagtgatagcagacaggatgcc

SEQ ID NO: 44699 - DNA, 101 bp, rice(Oryza sativa)
  misc_feature (71): n=t or c
gagactctgcagcttacggacccctgaaagcttctccatgtgagtgaaggaccaaactatcttttcaagcntatcagggtttcggtaaccaaaggtgacgc

SEQ ID NO: 44700 - DNA, 101 bp, rice(Oryza sativa)
  misc_feature (71): n=t or c
tggaccacagaagagaagacgatctagctagcacgaggcgagtgttgatctagcgagtaaatgcgatggangggatgagcaagtgaaactacatagggttg

SEQ ID NO: 44701 - DNA, 101 bp, rice(Oryza sativa)
  misc_feature (71): n=t or c
agaaattaacctgatattggacatcatattgggttaccgctaccacttgccaagaactagtgagcatgcangacctgatgatcaaccaaaatttggtcaaa

SEQ ID NO: 44702 - DNA, 101 bp, rice(Oryza sativa)
  misc_feature (71): n=a or c
acttgctgctcgttgccgtccccgccacctctctcaccttcagctatgacgcggactccttcgtctccgangatttcaggcaggaggacgacgccatggtc

SEQ ID NO: 44703 - DNA, 101 bp, rice(Oryza sativa)
  misc_feature (71): n=t or c
tcgaaaaggacatgagcaaatcaaaagtaaagttgagatcgcagctcgaatcaccacctgatacctcaaancttgctagctacaaggacgcggcaaagcaa

SEQ ID NO: 44704 - DNA, 101 bp, rice(Oryza sativa)
  misc_feature (71): n=a or c
tgtgcccttgcggcttagccttggtggctggctcaatgcagaaataccctttgcattctgagcacaccatnatgtggtgctccccggtggttaggcacgtt

SEQ ID NO: 44705 - DNA, 101 bp, rice(Oryza sativa)
  misc_feature (71): n=a or g
ctttgctcctttgttcttcagttgcaggtgtagtggctttcacttcaacctgatctccaacttattgctantacatgtgtacagctactgtagaatcataa

SEQ ID NO: 44706 - DNA, 101 bp, rice(Oryza sativa)
  misc_feature (71): n=a or g
gtaagttgcttgaatggatatgagaacaattattctcttttgtttgtggatatttcagaggatgctcaatngtggatccatcaattactgggcatgcttga

SEQ ID NO: 44707 - DNA, 101 bp, rice(Oryza sativa)
  misc_feature (71): n=a or g
tgcaaatcatagtcccaagcatgcaacgagtttactaatccgtgtcgtaaattttttacctactccatccntcctagaatataaaagattttgggtggata

SEQ ID NO: 44708 - DNA, 101 bp, rice(Oryza sativa)
  misc_feature (71): n=t or c
atctattaggctatattcgggaggtgaaggtgagaactccatataaaaaacggattgtttcattaacacanaattagttaagtattagcttttaaaaataa

SEQ ID NO: 44709 - DNA, 101 bp, rice(Oryza sativa)
  misc_feature (71): n=t or c
atgtatctgcctgccaaactctataaagtaattataggttcctgttggagaccgattgttgcagcaagttnaacaccaggtaacaacaatgaataaggaat

SEQ ID NO: 44710 - DNA, 101 bp, rice(Oryza sativa)
  misc_feature (71): n=a or g
gatctggaacctgacctcctcctacaccgacaagagcaatgaggcatccatggtgtccgcctccctcatcntcttcgccctcgccgccctcttcttcaacc

SEQ ID NO: 44711 - DNA, 101 bp, rice(Oryza sativa)
  misc_feature (71): n=a or g
ggtttatatgtcaaactgaaccaaactgaaatggtttatattgtggatcctagctggttcgatgcaccctngaggtgctcaaaactacgaggaatttaaaa

SEQ ID NO: 44712 - DNA, 101 bp, rice(Oryza sativa)
  misc_feature (71): n=t or c
gccgagattgacgacgacgatgagacggttaccaggtagctcttacctagggccacgagctgggacgccgngtcgaacaccttccggacggcagcgctgac

SEQ ID NO: 44713 - DNA, 101 bp, rice(Oryza sativa)
  misc_feature (71): n=t or c
ttcatttggcctgatcagtgagcaattcttttcgttttcgccatctactcttcatcgtcccattcatccgncgattcatttcgctcatatattattacgga

SEQ ID NO: 44714 - DNA, 101 bp, rice(Oryza sativa)
  misc_feature (71): n=a or g
ctctagttctattttggctcgtcagcagattcttgttcaaaatgttctccgatcatgggttattgctgcancagttctctcaggctattgctgggggtaca

SEQ ID NO: 44715 - DNA, 101 bp, rice(Oryza sativa)
  misc_feature (71): n=t or c
ttgatctcggaagagctgaagtattagcttctgtaaccccaacaagccgttttgtttttgatgcaaacttngaaccgaccatacaaagtgggcacgttaac

SEQ ID NO: 44716 - DNA, 101 bp, rice(Oryza sativa)
  misc_feature (71): n=a or g
ctcctcttcttgattccataggtcaagctatggtcagatcgaatcaggaatattggaggctggtggctagntggagggcccgataacctcctcctacctat

SEQ ID NO: 44717 - DNA, 101 bp, rice(Oryza sativa)
  misc_feature (71): n=a or g
ggagcagcagccatccttgttgctgatgacaagactgaacccctgattacaatggacacgcctgaagagantggaaatacagactatttagagaatatcac

SEQ ID NO: 44718 - DNA, 101 bp, rice(Oryza sativa)
  misc_feature (71): n=t or c
tgttgtggagaaaaaactgtcgtctttgttgtctcgaagctactactacattttcttctgacagaggcaangtggcatgctgcatgtgtggtaggtataat

SEQ ID NO: 44719 - DNA, 101 bp, rice(Oryza sativa)
  misc_feature (71): n=t or c
tagaagtagttgcaatatggagctacgtaccatcgggctctatatccctactccaactcatctacttttantggcattttcaaacatactacactatcttg

SEQ ID NO: 44720 - DNA, 101 bp, rice(Oryza sativa)
  misc_feature (71): n=a or g
tcgccgttgaaattagagaccctgaaaaccgtgtggacgaacacgaattgaatatatgtacgatcgatggncgacgacgacggatttgcaacaaacctgtc

SEQ ID NO: 44721 - DNA, 101 bp, rice(Oryza sativa)
  misc_feature (71): n=t or c
ttgaaagaaatagatagtaacataaaaacatgcctacgaataagaagtccccatatcctggaatgccacangagatactaaggtaaaatctccctacttct

SEQ ID NO: 44722 - DNA, 101 bp, rice(Oryza sativa)
  misc_feature (71): n=t or c
acagatcaaatgccatcccaagctccacttccgtcttccttcagtacaaggaacaaggagaatggtatttntgaagctggtcaaaccaacacagtagcacc

SEQ ID NO: 44723 - DNA, 101 bp, rice(Oryza sativa)
  misc_feature (71): n=t or g
acttggctgactttcataacaaacggttttgtgtattgtgtgtttaatggttcctcttgtttttgcagacnctcttgcgtgcttatttgtcaaatcagatc

SEQ ID NO: 44724 - DNA, 101 bp, rice(Oryza sativa)
  misc_feature (71): n=t or c
acaggtttcaaagtataagaagggcctgaggaatgggccaaaagccctgaagcctgttcctgtaattgtcngctgcaagtaagtctttttgcattgcattt

SEQ ID NO: 44725 - DNA, 101 bp, rice(Oryza sativa)
  misc_feature (71): n=a or c
tagagaaaagccattctcgcgactaaacatatggttgagaaggccatgaaaggagtattcatggaacttanaccgcagtcaatggtcgtcgctgacctagg

SEQ ID NO: 44726 - DNA, 101 bp, rice(Oryza sativa)
  misc_feature (71): n=t or c
acaatttcacatccatacgcgggtgacatatattatgcagctctcgtgggcatagctcgccagccaagaangagctgaagctctcgtgcgcggcgcggcca

SEQ ID NO: 44727 - DNA, 101 bp, rice(Oryza sativa)
  misc_feature (71): n=t or c
gtcatcgcgctcgctcgatttctcctcctcctctctctcgatcccctctactgcgagagattcccttgctngaattctcctcctcctcctcctctccctcc

SEQ ID NO: 44728 - DNA, 101 bp, rice(Oryza sativa)
  misc_feature (71): n=t or c
acacaatagtggtgcaattgattgaatgattggcctaatcctttgtctgacacagaaatggacccattgtncccttccattttctgctaagctgtctccac

SEQ ID NO: 44729 - DNA, 101 bp, rice(Oryza sativa)
  misc_feature (71): n=a or g
cggagaaaaggacctacctagtgccaagtcctggtcatctacagcagcctctgccatagcagcatcagccnctgcagcccctgaagaaccctcctccattg

SEQ ID NO: 44730 - DNA, 101 bp, rice(Oryza sativa)
  misc_feature (71): n=a or c
cttgtgactgtggtcggatcaactgtttcctacccgatgagactaatgaaatcgaaagataagcaagcaancttcacaactggatggaataagttggttgg

SEQ ID NO: 44731 - DNA, 101 bp, rice(Oryza sativa)
  misc_feature (71): n=a or c
gttgaccattctcctcacacccaagggaaaggtagtgcccgtccatcgaagccacgaagattgttctaganatacagccagcttgacctgttgctagcgtc

SEQ ID NO: 44732 - DNA, 101 bp, rice(Oryza sativa)
  misc_feature (71): n=a or g
ttattttgtcccaaatttctcgcgtgaatggacaattcttgaataaatgttgcgccgtttccaagttcctntagcagagttggcaaaagtagttattgggc

SEQ ID NO: 44733 - DNA, 101 bp, rice(Oryza sativa)
  misc_feature (71): n=t or c
atggttcctgcaagatgctgattacaacagttggcatgcgaacccaatggggaaaactaatggctactctnagtgaaggtggcgatgatgaaaccccacta

SEQ ID NO: 44734 - DNA, 101 bp, rice(Oryza sativa)
  misc_feature (71): n=t or g
tcgtgcggtgaggacgacgccaccatgctgctcctctcttgccgagaacatcgctcaagggaagaagacangagaaagaaggaagaaaatgggggaaaaaa

SEQ ID NO: 44735 - DNA, 101 bp, rice(Oryza sativa)
  misc_feature (71): n=a or g
acaagtgatcacctggctcccaggtaggcttgattgcctttgttcatgtatgtttatgaaagaggcagacncatgtgggaagcacaagtgcagaataaatg

SEQ ID NO: 44736 - DNA, 101 bp, rice(Oryza sativa)
  misc_feature (71): n=t or c
tatgacggttataggaaggggaattgtccgaagtgcccctcaactaccatcaggagtgcatctggaccatncctgccaaaccccaggatcaacggtgttga

SEQ ID NO: 44737 - DNA, 101 bp, rice(Oryza sativa)
  misc_feature (71): n=t or c
ttgtgaaaatcttctatcaattgaagaggagatgatggtctaaataatccttctcttacttctgtctgcancttttcttcattcacagtagaaagctgata

SEQ ID NO: 44738 - DNA, 101 bp, rice(Oryza sativa)
  misc_feature (71): n=t or c
aaagtgctacgtttgaagtgataaccatgaggtcctttctcaatctgttgtttgtcttctcccattaccangagtgctaaaagcctttgtattgtcacctc

SEQ ID NO: 44739 - DNA, 101 bp, rice(Oryza sativa)
  misc_feature (71): n=a or g
catagatgatcccaggacattaaacaatacgctgtatctgagaccctcgggaaatgtctactcaatgaacnaattggttgacctctgggagaaaaaaataa

SEQ ID NO: 44740 - DNA, 101 bp, rice(Oryza sativa)
  misc_feature (71): n=t or c
gccaaccacgacgacgtcgactttcttcccggcatgatccgttgtcatttcagtattaattagtatctcantctgaccgggcggttaatcttcttggacca

SEQ ID NO: 44741 - DNA, 101 bp, rice(Oryza sativa)
  misc_feature (71): n=t or c
gcagcaacttgagcaacagacacagagggcgtcccaacatttccaaaatcacttccttctacacctgaacntccaccgccgtcaacaccgacggccaaaca

SEQ ID NO: 44742 - DNA, 101 bp, rice(Oryza sativa)
  misc_feature (71): n=t or c
ctgagaacatggctgagaatcagttttgatttacctgggcgcaatggggaagaactgggcgtctggtggcnaggggcgaagctacagcaaagcgttggggt

SEQ ID NO: 44743 - DNA, 101 bp, rice(Oryza sativa)
  misc_feature (71): n=a or g
acgggaggccatacagacatgcgtgctgtccactaggtggcgtcacatttggaaatctgtacagtgcctcnagatcaaagcatctgaattcaccagcaaga

SEQ ID NO: 44744 - DNA, 101 bp, rice(Oryza sativa)
  misc_feature (71): n=a or g
ggatgctccagctttctaccagaagtccagaacacacatacatcagcatgaagatgagatgattcaggtcnttgaattgctttgcattcatgctatcatat

SEQ ID NO: 44745 - DNA, 101 bp, rice(Oryza sativa)
  misc_feature (71): n=t or c
tagcaaccacacgaggtagaagatccacgaggaggacggcgaatgcgcacggtgaacttcttccaggtctngtggtggcgcctctccacctgtgactcgta

SEQ ID NO: 44746 - DNA, 101 bp, rice(Oryza sativa)
  misc_feature (71): n=t or c
cgcgcgcatgcgtgcacacacacctgttcgcaaaaccctgcctttcaccacagttggatagcaggcacccnacctggtgtcaccgcagccaacgtcacaac

SEQ ID NO: 44747 - DNA, 101 bp, rice(Oryza sativa)
  misc_feature (71): n=a or g
atgatagtgttagtaaggttgcttcaataatgcacataaactggagtaaccattccagcatgagctatgcnaatcaaacagcattcagcatatcaacttgt

SEQ ID NO: 44748 - DNA, 101 bp, rice(Oryza sativa)
  misc_feature (71): n=t or c
actagtaaaaggtcaacatccttcgcacatggacttcgacaggatttgcagaacaaccaatctggaaaagnttccttcgaagcatccagtaaaaaaggatg

SEQ ID NO: 44749 - DNA, 101 bp, rice(Oryza sativa)
  misc_feature (71): n=t or c
acagctagctcgtacacaacaaacaaaccaagagctaaaatttcagtcagtgatgatgaggaagcaaagcngctctccttgttcatcttcttcttctgctg

SEQ ID NO: 44750 - DNA, 101 bp, rice(Oryza sativa)
  misc_feature (71): n=a or g
agaaagggaattgacgactggcttcaatggcttcacatcaaaggttagtagatcgattgaattccgcatgngtaagaggtgatcatgtttaggctaagaac

SEQ ID NO: 44751 - DNA, 101 bp, rice(Oryza sativa)
  misc_feature (71): n=t or c
cgattgttttgaaccggtcaaattgaaccggccacaaaccatgtcacagtacatgcatttgatcttttttnccctccctgagtaatatgcgtgcaataggc

SEQ ID NO: 44752 - DNA, 101 bp, rice(Oryza sativa)
  misc_feature (71): n=a or g
accatctgataatgggccaatggttgggcctaactcctgaggagggatgttaaactacaggcacattttcnggtcgggcatggattatccacgggcgaaat

SEQ ID NO: 44753 - DNA, 101 bp, rice(Oryza sativa)
  misc_feature (71): n=a or g
gctatgcacaagaaagcacacccaattcctcactcagtattacgtattccaacaaggagaacacatcaaancagagaaaagcacacaaagtgcgcaaatta

SEQ ID NO: 44754 - DNA, 101 bp, rice(Oryza sativa)
  misc_feature (71): n=a or g
catcgagaccgacatcagctgacacaaaaccgatgttacggcatgtctccctgacaatcttctcatagtcnacgttagccttggtggtgatctcaccaaag

SEQ ID NO: 44755 - DNA, 101 bp, rice(Oryza sativa)
  misc_feature (71): n=t or g
ctgcacatgatacttggctcgcttatgcaccaatttaaatggacaatgcctcaaatggtgaacaggaatgntttagacatggctgagaagtttggattagc

SEQ ID NO: 44756 - DNA, 101 bp, rice(Oryza sativa)
  misc_feature (71): n=t or c
aaatatcctctgcatttctcagccttatatacctctacaatgagctagtggccaactcttgcgtactgggncaaatgctaaaggaaaaagtatagtttgac

SEQ ID NO: 44757 - DNA, 101 bp, rice(Oryza sativa)
  misc_feature (71): n=t or c
cctgtcctccatatagacccctattctgatccaagatatgtaccccagaattcccctgaaaccttctaggnattcctcccacacggtcaaacccctgctga

SEQ ID NO: 44758 - DNA, 101 bp, rice(Oryza sativa)
  misc_feature (71): n=a or g
atttggcacaagaatagatccaacacccacaaccacattatggaggagagggtttgttagtgagagcctgngaggacagatgtactctagtaacccaagcc

SEQ ID NO: 44759 - DNA, 101 bp, rice(Oryza sativa)
  misc_feature (71): n=t or c
tggctactcagccctcatattaccattaaccacaacaaaacaccaacaaattaggatgagttctttccccnaagttcccaactcatttccctcgttttccg

SEQ ID NO: 44760 - DNA, 101 bp, rice(Oryza sativa)
  misc_feature (71): n=a or g
atatgatcctgattatgctatatctgagttggttaaattgattgctgtagaggatctaccacttaattttngtcaatctcctgcttttgaggagtacattc

SEQ ID NO: 44761 - DNA, 101 bp, rice(Oryza sativa)
  misc_feature (71): n=a or g
agaagagacgatttctagcttgttttgcgatgagctaggggtaggagaaggatcttggtgttggcatggcngccattggcgatgaagaaggacagaggaca

SEQ ID NO: 44762 - DNA, 101 bp, rice(Oryza sativa)
  misc_feature (71): n=t or c
atgtcaacttatcttatgtaggagtatgccatgtgtttctataagtgaaaacataagccatatttttgccnctctctacgaggcacgtgtagttggtctaa

SEQ ID NO: 44763 - DNA, 101 bp, rice(Oryza sativa)
  misc_feature (71): n=t or g
taaacctatcttacctgttcatgctttaactttggttgtatccatcctagctcgaccagtttgtttttaangaaaacattttttttttcatattgctgtgg

SEQ ID NO: 44764 - DNA, 101 bp, rice(Oryza sativa)
  misc_feature (71): n=a or g
ctaacatttgatcggcgttggttggttgctacaatgtaaacaacaattgatcgatattttgaacccaaatnatttattcattatcatattacatgagttta

SEQ ID NO: 44765 - DNA, 101 bp, rice(Oryza sativa)
  misc_feature (71): n=t or g
gccagcatgccgcccccaaatgagatgctggagatctcggagcctgtcggtgtcgatggcgagcaggatgngctgttctctgggcacaggttcttgccaag

SEQ ID NO: 44766 - DNA, 101 bp, rice(Oryza sativa)
  misc_feature (71): n=a or g
caataacgcttattattagctttgctccatgtatttggcatggtagcgtccatgacaaggaattcatcagnagcaattattgttgcgagatcatgcactaa

SEQ ID NO: 44767 - DNA, 101 bp, rice(Oryza sativa)
  misc_feature (71): n=a or g
actcttctcatcaagtaccgtcaatggggtgacagttgagaaattcggtaatacctataagaaatttccanccaataccaaggtcctttcctgtatagcag

SEQ ID NO: 44768 - DNA, 101 bp, rice(Oryza sativa)
  misc_feature (71): n=a or g
taatgaactgttccaatggttttttatagaattgtctgtcctggagataagaacaaacaagcatcagtgtnagctgaatatttagaagcctaactgttcga

SEQ ID NO: 44769 - DNA, 101 bp, rice(Oryza sativa)
  misc_feature (71): n=t or c
aaaatttaagttcaacaaaagaaatagatggccatctacatatttttatacccggcagatggtgccatcancaccacgatagacctccattatccatccat

SEQ ID NO: 44770 - DNA, 101 bp, rice(Oryza sativa)
  misc_feature (71): n=t or c
actggaaactttggttatacgtgatgtgaagaaactggccaaatttggggcttgatgtagggtttgagaangcaaatactcaagtgaaaatgacaaatctt

SEQ ID NO: 44771 - DNA, 101 bp, rice(Oryza sativa)
  misc_feature (71): n=a or g
ggtggaagacgacggcgagttggggtcttgctgaggcatggggaggagctgcttggtagagggctccattnatgcctccctcccctcctcgcccgcacttg

SEQ ID NO: 44772 - DNA, 101 bp, rice(Oryza sativa)
  misc_feature (71): n=a or g
ccacttctccaagtaagcgtctatcccgaacggcttcttctcctgccgaggctgtttctcctcctccttcncgtcgccgacggcggaattctccaccggcg

SEQ ID NO: 44773 - DNA, 101 bp, rice(Oryza sativa)
  misc_feature (71): n=a or g
ctcaggtaacttatctcgacgtttaacagagggatactgagtagttttgacgacatttgcagcagggtctntatgttctaatccattgcaaccatttgtca

SEQ ID NO: 44774 - DNA, 101 bp, rice(Oryza sativa)
  misc_feature (71): n=a or g
catataattcatgaagtatacgaatatttgtgtttgagaacagcttctctgcgttcagcttcttccaaacntttatgttgtacatccatatgttccaaagc

SEQ ID NO: 44775 - DNA, 101 bp, rice(Oryza sativa)
  misc_feature (71): n=a or g
ataacgatttcctcccaaatccgctttggttttgacttcaaatctaatttatgatttaccaaacttggtcnttaacaggagcccagcaagctcaagctcgc

SEQ ID NO: 44776 - DNA, 101 bp, rice(Oryza sativa)
  misc_feature (71): n=a or c
ttctttgtttataccaatgacactaacatgaaccacccccacccctaaatttgtaatccttctcagaactnaacggaaaaaagaacctcagcaagtagtac

SEQ ID NO: 44777 - DNA, 101 bp, rice(Oryza sativa)
  misc_feature (71): n=t or c
acttgctgtagcaaatctagccatttgttctggattaaggtagcaacatagcaaaaccaatactcttgtangaaatgtgaagcaggtggaaagaaaaaata

SEQ ID NO: 44778 - DNA, 101 bp, rice(Oryza sativa)
  misc_feature (71): n=t or c
ttaagacgtatgcatgcgaaaattaatctttgtaggtgtccctaactatatagggtcatctgtgaaaattnattccacctttggcatatataaattatagc

SEQ ID NO: 44779 - DNA, 101 bp, rice(Oryza sativa)
  misc_feature (71): n=t or c
tgacgccatgatccaacgcactcaggcccacatgccaatgacacagaatggacgcgggacgcgtcctccangggcagagctcatgcaaccgcggtgtgctt

SEQ ID NO: 44780 - DNA, 101 bp, rice(Oryza sativa)
  misc_feature (71): n=t or g
tatggtcaagttcgtactgtgaatggcacggttggttgtgaccacatctatgaaattcagtttgaattcgnacaaaatttaagaccacgacgtcgtataaa

SEQ ID NO: 44781 - DNA, 101 bp, rice(Oryza sativa)
  misc_feature (71): n=a or c
aggccacgacctaagaagatcgatggcctagtttgctggaatttgaaaatatagggggaagcaatggcacnaatgattggaaaagcagatatggcaaaata

SEQ ID NO: 44782 - DNA, 101 bp, rice(Oryza sativa)
  misc_feature (71): n=t or c
tcaatgaagcagtggctgaagaagcagcagtggctgatcaagaggatgaccagcttggaggtgatctccanggaggtgccatccatgtgcttccttttgat

SEQ ID NO: 44783 - DNA, 101 bp, rice(Oryza sativa)
  misc_feature (71): n=t or c
atagcagcgacgaggtccagtccaatcccatggttctaaaatcaggccctgtttgttccccaaaatttttnccaaaaaaatcacatcgaatctttggacac

SEQ ID NO: 44784 - DNA, 101 bp, rice(Oryza sativa)
  misc_feature (71): n=a or c
acaaacgacagattctcaattctcccattgtgttgcatatgctcccagaaacattcattacaagaatcaanaaccgcaccttctcggtctgaacggcggct

SEQ ID NO: 44785 - DNA, 101 bp, rice(Oryza sativa)
  misc_feature (71): n=a or c
accatcatgctccatcatctctcttgtggttacaagtattcactaaacttccaaaccttcattaacagtanatgtgtacaattattctcagtaataattca

SEQ ID NO: 44786 - DNA, 101 bp, rice(Oryza sativa)
  misc_feature (71): n=t or c
gcctatccagtttgtttgtccttctttgtaggatagcagttttgcacgattcagtatggaggctacaaccngtgaggctacaaccccccacgaacataaaa

SEQ ID NO: 44787 - DNA, 101 bp, rice(Oryza sativa)
  misc_feature (71): n=a or g
acatgtcaaatcaatgtgtactattgccaatgatatccccagttccccatgatctataaagaaaatctatnacattgttattgttctaaaaaaaatgaatc

SEQ ID NO: 44788 - DNA, 101 bp, rice(Oryza sativa)
  misc_feature (71): n=t or c
tgctgatcacaaacttgaaatagggtttaacagcattcggcaaacacatttggcagatgaacaggaagatnatgtagtagtttgtattgtccagtccaaat

SEQ ID NO: 44789 - DNA, 101 bp, rice(Oryza sativa)
  misc_feature (71): n=t or c
tgcattgtccccatattagcaatttggtgaggtgtataagtgttatttccccaaaaaaaatctctccaatnattgagcttaaaaggtttaaataatgaacc

SEQ ID NO: 44790 - DNA, 101 bp, rice(Oryza sativa)
  misc_feature (71): n=t or c
ccagctctccagctgatcgatatcatatgagaggctgcgacgcattgccgtcatctaacttcaccctagcnagctgcaccacacgtacacgaatctaccta

SEQ ID NO: 44791 - DNA, 101 bp, rice(Oryza sativa)
  misc_feature (71): n=a or g
ttgtcatattttcctttcgatggtatctatgatatgatggggctaaaagataagcaactcacatttcgtgngtcccgcatgatagttgggtggtggtggcg

SEQ ID NO: 44792 - DNA, 101 bp, rice(Oryza sativa)
  misc_feature (71): n=a or g
agtcaggtgtgttgcctccaccatgcattcagggtcacatttgagatgcataaggtgcaagtgtgttgctncgcagattcacgccgccgcctcttaaagaa

SEQ ID NO: 44793 - DNA, 101 bp, rice(Oryza sativa)
  misc_feature (71): n=a or g
ctatgcaagatgggacaagctctcgaagtcttgggacgaaaatttttccttgatcgagctatcaaaccctnaaaagccagatcggctaactgataatcggt

SEQ ID NO: 44794 - DNA, 101 bp, rice(Oryza sativa)
  misc_feature (71): n=t or c
accttcacagtgtttccattctttccagttgaggcatgaagtctccacttgcagccatcactcctttgtgngcatttcaccctatatctccctgtatcact

SEQ ID NO: 44795 - DNA, 101 bp, rice(Oryza sativa)
  misc_feature (71): n=t or c
agatctatattcagcactgtctgttttggagccggaggaatattttctcactgtagcgtatcttttggtangattttcctgttcttgtaatccttacattt

SEQ ID NO: 44796 - DNA, 101 bp, rice(Oryza sativa)
  misc_feature (71): n=a or c
ccgccggcagttgtattagagtttttagtccatctgaagatctctaccataagggtgctatttcattaggnttggatggttggccaacacatagtggacgc

SEQ ID NO: 44797 - DNA, 101 bp, rice(Oryza sativa)
  misc_feature (71): n=t or c
tacacaacgctgcgcgcgtggagcgtgcttgtcgggttgactggttgcatgcaagatgaaatggatcgatnagtgcgacctccgtgtggtgtggcaacacg

SEQ ID NO: 44798 - DNA, 101 bp, rice(Oryza sativa)
  misc_feature (71): n=a or c
tcatttgatttgccatcaagtttctcggttggtcatactagacattcaagtgaagatttaagttcccttanaattaataatttacgcataaatcatagaga

SEQ ID NO: 44799 - DNA, 101 bp, rice(Oryza sativa)
  misc_feature (71): n=a or c
tctaaacaatagcgacttgagtcacacaaaacatagcatacatttgaagcatgccaaagccacagtgtagnggcagttgaagagaaatgtgtatccaacca

SEQ ID NO: 44800 - DNA, 101 bp, rice(Oryza sativa)
  misc_feature (71): n=t or c
ggaagtagtacaattttggagggtaattagagagaggttatggtgggacaaaatgtaggggtcacgggagnggtggtaagacagaggtgaggccaaaggta

SEQ ID NO: 44801 - DNA, 101 bp, rice(Oryza sativa)
  misc_feature (71): n=a or c
tcttaattcaagctatttcagtggtccaccaaatgatgaatcttttgctgtaagttttcatgcttgccttnttttactgtcaaaactagatgtatgtatct

SEQ ID NO: 44802 - DNA, 101 bp, rice(Oryza sativa)
  misc_feature (71): n=a or g
taccaatatatagcttagaggttgaatagagatttctcactggacactgattgaaccataacaatacttcnactaacatatatgagaatgatggagtggat

SEQ ID NO: 44803 - DNA, 101 bp, rice(Oryza sativa)
  misc_feature (71): n=a or g
atcataaagtttcaccgaatgaacacaggtaaataagatgtaagcaaataagacacagtgaggtggtgcantacttaattaattagcactgattcacgtga

SEQ ID NO: 44804 - DNA, 101 bp, rice(Oryza sativa)
  misc_feature (71): n=t or c
caaatttgaggacttcatgggcatcctacgagttcctacaccggtgctcgttctcaagaattcttcaagcngagttgtttctttctttttttttatctgat

SEQ ID NO: 44805 - DNA, 101 bp, rice(Oryza sativa)
  misc_feature (71): n=a or g
aacatagtcaaagtgaacttattccgatgagctaccttcttttcccgtgagtgtaattaaattgctaaacntaattttttttaaaaaaattacgtatactc

SEQ ID NO: 44806 - DNA, 101 bp, rice(Oryza sativa)
  misc_feature (71): n=t or c
gtccttttcggtccaggtggctaaagataagggaaacttggattttatccccgaaagaccaccgaacacanactgatcatggcaacgttaattattgtttc

SEQ ID NO: 44807 - DNA, 101 bp, rice(Oryza sativa)
  misc_feature (71): n=t or c
aaaatctaatcattgaataacttcatcatgaggcaactccttgcattgcagttcaagaagcagattggaantgataacgcaggcaagtaccctaggggaga

SEQ ID NO: 44808 - DNA, 101 bp, rice(Oryza sativa)
  misc_feature (71): n=a or g
aatctcttaaaaatccatcttccattggtttgatatggattagggaaatagggcctgcttacattggtttnatttggaggaggaacaggaacatgagagca

SEQ ID NO: 44809 - DNA, 101 bp, rice(Oryza sativa)
  misc_feature (71): n=a or g
tgatgaggggtttaccatggcttctcctgcagaggcagcatccacttcaggatgtgataagactagtgtcngtagcggattgaatggccgaagctgcaatg

SEQ ID NO: 44810 - DNA, 101 bp, rice(Oryza sativa)
  misc_feature (71): n=a or c
cagaatccagatgaatctttaagggactatatacggtgattgaatgaaatcacggatgcttttgttttacncgtgttcaaattaggtgcccgagatacacc

SEQ ID NO: 44811 - DNA, 101 bp, rice(Oryza sativa)
  misc_feature (71): n=t or g
tgggaagtggaagcgtgatccacctttaccgcaaggattctacggcaacggattcgtctaccttgttgtgnagacggacgctagtgagctatgcaagcagt

SEQ ID NO: 44812 - DNA, 101 bp, rice(Oryza sativa)
  misc_feature (71): n=t or c
caagtcgtgttgacagggacagacctggcaaagatgttctaggttattcatgcaattccgagacagatggnttgtcttgccatgctcgttcaaagaaagtg

SEQ ID NO: 44813 - DNA, 101 bp, rice(Oryza sativa)
  misc_feature (71): n=a or g
ggtgaatgattaggcaaggtcaaaagtcaaaaccatgtttggatttgtaggagtatgttctactactactntctccgtcccaaaataagcacagtcataag

SEQ ID NO: 44814 - DNA, 101 bp, rice(Oryza sativa)
  misc_feature (71): n=t or g
ctctacccgcccacgagcctctgtcgccaaccgccacccttgctggccaccactcttctcccttctctccnatggccgccgcccactgcgcacctctccct

SEQ ID NO: 44815 - DNA, 101 bp, rice(Oryza sativa)
  misc_feature (71): n=t or c
taacatggtaatcttggtattgtaaagattaagagtacgcaatgctttgcaggcaaatgtgcttggcaggncatggaagttgtggcaattagataagttga

SEQ ID NO: 44816 - DNA, 101 bp, rice(Oryza sativa)
  misc_feature (71): n=a or g
atgctaatgatgcaaagaaggtgaagaagttgtatatttacaggacagttgctggaccgaggggtgatgcncctgaattcatctcaacgttctaaatccat

SEQ ID NO: 44817 - DNA, 101 bp, rice(Oryza sativa)
  misc_feature (71): n=t or c
tcgttgatgatgttcatgtttggtatctcgagattgtccaccaatatggcacccatcttactttcagtttnatagcatccaggaatcaggagaaaggaaag

SEQ ID NO: 44818 - DNA, 101 bp, rice(Oryza sativa)
  misc_feature (71): n=a or g
caacgggcacccatatacgttccagagagctacacagagaaacacgaggggggaagaggggcgagagatcnccggaacccgggaaacccaccttcttccgc

SEQ ID NO: 44819 - DNA, 101 bp, rice(Oryza sativa)
  misc_feature (71): n=a or c
attaaagcaacaaattgcactttgtcttgcagaggctgtagctgatgctaacaaggccattgaacttgacncatcaatgcacaaggcttatcttcgtaaag

SEQ ID NO: 44820 - DNA, 101 bp, rice(Oryza sativa)
  misc_feature (71): n=a or g
ccagaagaagtgatgcagggttatataaagagccacagctgccctcccttcaaaagaagaagccaagtatnaagagcttttagtatctaatattatcacct

SEQ ID NO: 44821 - DNA, 101 bp, rice(Oryza sativa)
  misc_feature (71): n=a or g
attacttgcgtgtggacgaaatgggatgaagagcggtagtgcagagctaagaggagttataaattaactgntagttagtatgtggctatttatggtggttt

SEQ ID NO: 44822 - DNA, 101 bp, rice(Oryza sativa)
  misc_feature (71): n=a or c
catgtatcaaacaaccaggtgtatgaactctttgtctcatccatcagcagacagcacccgaatatgatccnctgcaaatgatggttgattccccggaacac

SEQ ID NO: 44823 - DNA, 101 bp, rice(Oryza sativa)
  misc_feature (71): n=t or c
actcaaaagtgttgattttatttgactagagattttctagacattactgtagcaaaaacccgtttggaatntgcatttttcacttcagaacattatgaaaa

SEQ ID NO: 44824 - DNA, 101 bp, rice(Oryza sativa)
  misc_feature (71): n=a or g
ctctcgccatttcattatatcttggccgttccatttctctatctgatcctgtctttgtggttggaattgtnctcctgagacatacatcttcaccactaacc

SEQ ID NO: 44825 - DNA, 101 bp, rice(Oryza sativa)
  misc_feature (71): n=t or g
gtctaatcaatagaagtaagcatgcactgttataggccctttgtgtcatattttcctttttagggatgggngcagatctgttataatgccactgctcaata

SEQ ID NO: 44826 - DNA, 101 bp, rice(Oryza sativa)
  misc_feature (71): n=a or g
atagttaaggtacaacgtgcgttggctgacggatacacctattgttgtaagcagtggtatgctgttcactncaccggaaggtgaaagatcccttgaggaga

SEQ ID NO: 44827 - DNA, 101 bp, rice(Oryza sativa)
  misc_feature (71): n=a or g
taccccttttttttatgtcagtgaacttgaacacaatggatgctacctctttaatcacatcccatcaggtntaaactctggattcaaggttagtgtaccac

SEQ ID NO: 44828 - DNA, 101 bp, rice(Oryza sativa)
  misc_feature (71): n=t or c
gagacgatgatggtgagacctttggtcatccgctcctcctggtatctactcaactccacctcatttggcanaggtgtgcactgttgcgctaaagcccgcga

SEQ ID NO: 44829 - DNA, 101 bp, rice(Oryza sativa)
  misc_feature (71): n=a or g
aaaactttcgatttcttgtcaggccatgtacaaagcgtggctctggcttgtggtcttaaccctccatgtcngacacgcgcatccatggcagtggggaccgt

SEQ ID NO: 44830 - DNA, 101 bp, rice(Oryza sativa)
  misc_feature (71): n=a or c
tcgtagagacgtagacaaatggaggttagtacgtaccttacaatttattcagattggcatcttcgagaagncattttttcatcttggactcgagcatttct

SEQ ID NO: 44831 - DNA, 101 bp, rice(Oryza sativa)
  misc_feature (71): n=a or g
agaggtagaggtatgggcagtggcataggtcgtggaaatggtcaaaacggagatcgaggaatcaacagtgntggcagaggcaaaataaaaggatctaatgg

SEQ ID NO: 44832 - DNA, 101 bp, rice(Oryza sativa)
  misc_feature (71): n=a or c
ctcccagtcttgaatgctcttcctctccttctcttgtactgtgcgattaccatgttcttgtttccttgcancagcagggtggaaggggccataaacaaaat

SEQ ID NO: 44833 - DNA, 101 bp, rice(Oryza sativa)
  misc_feature (71): n=a or g
gtgcacggttcaagttataagaattcgtccattgaaggtccttcgattgacgatattcaatcaaattccangcagcccaggcccaaggccgtgcacgcccc

SEQ ID NO: 44834 - DNA, 101 bp, rice(Oryza sativa)
  misc_feature (71): n=a or g
ttcttccataggaattccaagcaaccgttcaatcatatcaacccatgagccatcagcttggccagtaattngtctaccatggataggtaaaccccataagc

SEQ ID NO: 44835 - DNA, 101 bp, rice(Oryza sativa)
  misc_feature (71): n=t or c
agaagaatggaccgatattctccacatactttcacatcagaatttatattttttagtacttttaacagtanccctggagtaagagatgccatatcttcaag

SEQ ID NO: 44836 - DNA, 101 bp, rice(Oryza sativa)
  misc_feature (71): n=t or g
ataatatgctgattctattaataagcatgtgcgactagagatggtttttggagtgaaattaagtaggggtnggttttgtaacaaaataacttatagatatt

SEQ ID NO: 44837 - DNA, 101 bp, rice(Oryza sativa)
  misc_feature (71): n=t or c
gggaggtgaaccagccatgaacgtgcaaatcccttcaacgccactggcaaataatttgctagtgtgttgtngtctgctccggcagcgtagagtactgtgga

SEQ ID NO: 44838 - DNA, 101 bp, rice(Oryza sativa)
  misc_feature (71): n=t or c
aatctttaactgagacaagcagttgagagggtccgagccacagtcgaacaactgggccataactgccatgnaacttcgataggtagcctgtttaataatgc

SEQ ID NO: 44839 - DNA, 101 bp, rice(Oryza sativa)
  misc_feature (71): n=a or g
acaaaatactattattcctatcagtccagttagctcggtcagcaatgctcaccggagggccgccgaagctncctaattcctccacctcatcgtcccatgca

SEQ ID NO: 44840 - DNA, 101 bp, rice(Oryza sativa)
  misc_feature (71): n=t or g
actgagaggatataaattgcacaaaccaatcaaagaactgagaggaaggtgctattttcactcgaatactnagaggaagccaagaactacaccccaaatgg

SEQ ID NO: 44841 - DNA, 101 bp, rice(Oryza sativa)
  misc_feature (71): n=a or g
accaaactttcaattttaacgtgaactaaacacagcctcaacttgaagagagaattggagaggaagatggncccctgctttgagatgcgtaaatgctacgt

SEQ ID NO: 44842 - DNA, 101 bp, rice(Oryza sativa)
  misc_feature (71): n=t or c
caatctcaagtacatctatgatagcctcccacattaccaaaatacgaaacaaagttttaaaatgtgacccncatctagtatctccaggcctagctaggcta

SEQ ID NO: 44843 - DNA, 101 bp, rice(Oryza sativa)
  misc_feature (71): n=a or g
cgtggatcaccgctgatggctcaccggaaacgagcaattggatgaaggagatcctgcgcggtgtactccancaagtgcgtcccggcgatgccatggatgtc

SEQ ID NO: 44844 - DNA, 101 bp, rice(Oryza sativa)
  misc_feature (71): n=a or c
gtacgtgcgtgtgtatatgaacgctcgtaacgtgtttccagaacaaaaaaattcataggaaagccactctntccatttgtttatatttattaaaccgagca

SEQ ID NO: 44845 - DNA, 101 bp, rice(Oryza sativa)
  misc_feature (71): n=t or c
aaaattttaaaatgaaaaaaattctattgttccaggcttccagcatggagaaggtcaacatgtcacgtcangccacgcaaatcgccaggtcgcccactcca

SEQ ID NO: 44846 - DNA, 101 bp, rice(Oryza sativa)
  misc_feature (71): n=a or g
tttctttcagaaatatactggatgttgtttgattagcataaatataccatcgaaatcgcggttagaaaacncgataccgaggttcgctacgggaaagcgcg

SEQ ID NO: 44847 - DNA, 101 bp, rice(Oryza sativa)
  misc_feature (71): n=a or g
ccaaaatgcagcagctgactgctaacctgaacatctccattcaacagcaaaaaatcatacgatccctcacnggagcacatatataatagtattaaaggatt

SEQ ID NO: 44848 - DNA, 101 bp, rice(Oryza sativa)
  misc_feature (71): n=a or g
tctattccttcacttttaggtcatgttcagttaatatttaagaggttgggattgtcacacatactgtggtntgaaattatttcccttccattccctccaaa

SEQ ID NO: 44849 - DNA, 101 bp, rice(Oryza sativa)
  misc_feature (71): n=a or g
catcgttgttcacatgtcgttgagcatcttcttttggatatttcttcttcattctatgtcgcataattctnttgatgctcattactttcatcattattttc

SEQ ID NO: 44850 - DNA, 101 bp, rice(Oryza sativa)
  misc_feature (71): n=t or c
caggggcgatcgcccgcagtacaatcaagacaatagagggcggcagagaagcagagctacagacgagagcngaagccgaagccgccatctctcgcgctctg

SEQ ID NO: 44851 - DNA, 101 bp, rice(Oryza sativa)
  misc_feature (71): n=t or c
ggcgagagcgagccgagccgagagcgcaacaaaaggaaagcagggaaacctcgccgtcctctctctccatncatgccctagcacgcgccgcgcagcctacg

SEQ ID NO: 44852 - DNA, 101 bp, rice(Oryza sativa)
  misc_feature (71): n=a or g
cctcggatgaacttattccattattctaagatgtgtttacctccttggggtggatggggctttgggcctanactatgggctggtttagggaagcttctagc

SEQ ID NO: 44853 - DNA, 101 bp, rice(Oryza sativa)
  misc_feature (71): n=a or g
tagacatattatctttatagggcactactgtgttctgcttttcaaattgagcgtctaaatagaagatattntgcctatgtaccttttctatatattcgatg

SEQ ID NO: 44854 - DNA, 101 bp, rice(Oryza sativa)
  misc_feature (71): n=a or c
atgatgacgtttttgtgacctcgaatcgtccgtgacaactcaaacaagactaatactccctccgttcatcntattttagcttgacactaaaaccgaaaaca

SEQ ID NO: 44855 - DNA, 101 bp, rice(Oryza sativa)
  misc_feature (71): n=a or g
ggagtgcgtgtgccctgcatgttctttgatcgtgggatggcgcaatcacctcaggagacatggctggggcnccgggttagtaggaacgcatggcgcacacc

SEQ ID NO: 44856 - DNA, 101 bp, rice(Oryza sativa)
  misc_feature (71): n=a or g
aaccgtaatcttgtcttctccagtgaagagagtagcatctccttgtacttcttgcggttcaataatgaaanaatttccttccttccctgctctccatgaga

SEQ ID NO: 44857 - DNA, 101 bp, rice(Oryza sativa)
  misc_feature (71): n=a or g
ctttcactgatttggtggctgacatgtgggcccaagaatgatagggcccacatgtcagtcacggtgaacantgacgtcagaggatcctctcccactacacc

SEQ ID NO: 44858 - DNA, 101 bp, rice(Oryza sativa)
  misc_feature (71): n=a or g
gtacaaactagtctccgggcaattatatcgcatcggcgtgctacaacctatgcttcgctgcatctctttcnctgaaggtgaggagatggtgaaagaaatac

SEQ ID NO: 44859 - DNA, 101 bp, rice(Oryza sativa)
  misc_feature (71): n=t or c
tttgcctgatattatgaaactattttctagttgcctgatattattttcctaaataaaattcagaggtggantttcaaatatttactacaagccaaaaaaat

SEQ ID NO: 44860 - DNA, 101 bp, rice(Oryza sativa)
  misc_feature (71): n=a or c
gaatcatattttactggtggtattttcgtatcgacaaaagtgaccatgcgtcctttattcgtcgctcaagnaagatggccaccccttcccatcgatgagct

SEQ ID NO: 44861 - DNA, 101 bp, rice(Oryza sativa)
  misc_feature (71): n=a or c
catccgcatgcacgcgggctcatgtgggaaaggggagaagtaatagagactgacatgtgggacccactatnagattggagagtgagatggagagactattg

SEQ ID NO: 44862 - DNA, 101 bp, rice(Oryza sativa)
  misc_feature (71): n=t or c
ttgctatgattcttttgacggttttctacagatgaagcacttcttgctttcaagaaggcagttacaacttntgatgggatattcctcaactggcgtgaaca

SEQ ID NO: 44863 - DNA, 101 bp, rice(Oryza sativa)
  misc_feature (71): n=a or g
agtatttagatatcactgctagaattccatgggttacctagaggcaaatacactagctagggatcatatanatataattctagggaacatatttccctaga

SEQ ID NO: 44864 - DNA, 101 bp, rice(Oryza sativa)
  misc_feature (71): n=t or c
ctccagctcatcctcaatgggtttcccgcggaagaatcttgcatccttcggtagatgtttccgcgccatcntcaccgtgagcttggcattattccgccgcc

SEQ ID NO: 44865 - DNA, 101 bp, rice(Oryza sativa)
  misc_feature (71): n=t or g
gtgcaaaataaaatccaaaaaagcattcaggaaaccctagcttggtcgttgttgttggatccatgcctagngagctccctactgtctgatccctgccctac

SEQ ID NO: 44866 - DNA, 101 bp, rice(Oryza sativa)
  misc_feature (71): n=t or g
agatatcgcatataggaggccgaatacacgtttcctgcaattataagaacctgtgaaaattagaactaacnccgattttttttaatctaagaacatgcaac

SEQ ID NO: 44867 - DNA, 101 bp, rice(Oryza sativa)
  misc_feature (71): n=t or c
tccacgccaatcacagtggcgctgagattattgactcaacgccattccgattgacgctgatccgctgccangtacacttggggatcggcttggctgccacg

SEQ ID NO: 44868 - DNA, 101 bp, rice(Oryza sativa)
  misc_feature (71): n=a or c
ttttcacaagtccctctagaactattcagaaaaatctttttgacctgatgaacaggtgaacacaagaaacncaggaccaaaatgctacataatactacaga

SEQ ID NO: 44869 - DNA, 101 bp, rice(Oryza sativa)
  misc_feature (71): n=a or g
ccctgtcctttaattcctcatgtacctatactaactacctaggagtagtgcttgtttactgaaggaaactnttggtaccataaactgtttaattatgagag

SEQ ID NO: 44870 - DNA, 101 bp, rice(Oryza sativa)
  misc_feature (71): n=a or g
ttctcttgggattcaattggagaagttgaagttagcagatgacaagcacctgcgtatgtggatcatctacnccatttcttctgttttagcaccaacgacag

SEQ ID NO: 44871 - DNA, 101 bp, rice(Oryza sativa)
  misc_feature (71): n=a or g
agcctagagagattggatataagccacaccaagataagtgatctcccctctggagtgtgccggctacctantctggagacgctagacctaagaggcacact

SEQ ID NO: 44872 - DNA, 101 bp, rice(Oryza sativa)
  misc_feature (71): n=t or c
aagtagaacttgccacggcatgctgcgatcgggacaatatgtatcttttcagtgaagccatacttatcacnctggattccgatgtcgtattcatgccttgt

SEQ ID NO: 44873 - DNA, 101 bp, rice(Oryza sativa)
  misc_feature (71): n=t or c
attatacgtacgtaatatcctaagcttctttgaaattaatatgatccgtatgatactttgaagtatgatcnatatgatactattgatgcagatacatacgt

SEQ ID NO: 44874 - DNA, 101 bp, rice(Oryza sativa)
  misc_feature (71): n=t or g
atgaatccatccaaccaactgctatgattctctgatctcatcctcttgcatgtttcggttagaagatacgnttccgagctggtggagagggggtcactata

SEQ ID NO: 44875 - DNA, 101 bp, rice(Oryza sativa)
  misc_feature (71): n=a or g
ctcataaattctcgtatctacgacggatcatatgtgacagactaaacgaactaaacagtgggataactggnagatatatgcgattagagcctcaccttact

SEQ ID NO: 44876 - DNA, 101 bp, rice(Oryza sativa)
  misc_feature (71): n=a or c
gcatccctgttgcgcgccgcaatattggtcgaacctggacaccgccgttgataggcattgtgcacatgtcngcggcgataggtcccgcgtgcactgtgcga

SEQ ID NO: 44877 - DNA, 101 bp, rice(Oryza sativa)
  misc_feature (71): n=a or g
tctcctttaacgtgatactagctttctattccatttatccattttgaatacaagtatttctaggttgtttngcaaaaattaaaattgaggagaatttttcg

SEQ ID NO: 44878 - DNA, 101 bp, rice(Oryza sativa)
  misc_feature (71): n=t or c
cctcaccaacacctgtatcctatccatcttcccggcgcctccacagccgccattgactgcctcagctgcanccatcttgtcccactgcaccagctcgtcgc

SEQ ID NO: 44879 - DNA, 101 bp, rice(Oryza sativa)
  misc_feature (71): n=a or g
cattgacttgacttgacccggcccctcagttccacaaccattgacaattaattagacccaacgcaactcanctgcttctctgctgcttcctcttctccctc

SEQ ID NO: 44880 - DNA, 101 bp, rice(Oryza sativa)
  misc_feature (71): n=t or c
aggcactgaatatgatcaaaccggtaagactacaaatatgatggccatggacaagtggatcatggatgganagaatggatgttgttcgctacctttaattt

SEQ ID NO: 44881 - DNA, 101 bp, rice(Oryza sativa)
  misc_feature (71): n=t or c
agaaatatgactatgtttttacagtattagagaaactttgctaccactagcggagagccgataataattgntgatttaaaaaccgatatataaatgggcaa

SEQ ID NO: 44882 - DNA, 101 bp, rice(Oryza sativa)
  misc_feature (71): n=t or c
catttactccggtataaataaatgaataggcactgattagatgttgatcaatttggaaagactaaaaaatntaaggcgaagatcaaattaggattgaaggg

SEQ ID NO: 44883 - DNA, 101 bp, rice(Oryza sativa)
  misc_feature (71): n=t or g
acgatgatgggcccatccagcacaatgcaagggctcgcattgtcaccaccaccaccacctgcattctgctnctgctgcccctgcatgatcggtcgatcgat

SEQ ID NO: 44884 - DNA, 101 bp, rice(Oryza sativa)
  misc_feature (71): n=a or g
attaacattaacttcaaaaggatcaccgtttcctatgacaaatttccttacttcttccacgtaggactcangagaaatactacccccttgttcattgccct

SEQ ID NO: 44885 - DNA, 101 bp, rice(Oryza sativa)
  misc_feature (71): n=a or c
atcaacagtaagcaaaactatctcaaattctgcattccttgcaacagcttcattagtttcagattcaattngggtatattatcactacctgatgagagaaa

SEQ ID NO: 44886 - DNA, 101 bp, rice(Oryza sativa)
  misc_feature (71): n=t or c
aaatagctgggagggggcagagccactaccttcccaatagaaccccaaaattagtgataccagctaaagancaaaggtggccctcagagaggatagactca

SEQ ID NO: 44887 - DNA, 101 bp, rice(Oryza sativa)
  misc_feature (71): n=a or g
cggtgactcttggttgcaacataagcttgacaagcttgcatctatgtaaagtcgatatttgtggggagganttagggcagttcctttccaattcattctct

SEQ ID NO: 44888 - DNA, 101 bp, rice(Oryza sativa)
  misc_feature (71): n=t or c
acctttgggacatatcctaatacaataaatctaaatacattcgttgcattaggacgtgtcctatatagtanaagcttgctttattttgggacggagcgagg

SEQ ID NO: 44889 - DNA, 101 bp, rice(Oryza sativa)
  misc_feature (71): n=t or g
ttggaggagatcgatgcaacagtgagacaaggatgatgccaacaaatgtgcacatctctgctgcactaatngtgtcgctagtgctggcagctacggttgtt

SEQ ID NO: 44890 - DNA, 101 bp, rice(Oryza sativa)
  misc_feature (71): n=t or c
aagagatagaagtagaagaaggccatgttcagtcctagtcttggacgaacatcgtattctcctcccaccangccctatgcaggaggatgtgatcccagctg

SEQ ID NO: 44891 - DNA, 101 bp, rice(Oryza sativa)
  misc_feature (71): n=a or g
gtatctagtagaaccgaatggaggtcctgttaggaattatggatcaaaggcattcattgtatctgcaaatntgttggacaggatatacaactgtgaatgct

SEQ ID NO: 44892 - DNA, 101 bp, rice(Oryza sativa)
  misc_feature (71): n=a or g
ttatgtactcgttcttgatcttgttgagtgcttctgtttcagaaggatggtgttcaagtttgcaagagatngagaaactaatccattattgccccctctct

SEQ ID NO: 44893 - DNA, 101 bp, rice(Oryza sativa)
  misc_feature (71): n=a or g
tggattgcttcttgtggggttcatgattgtcaagagatggtttaggcatgccgagctgagagaagattggnaggttgagtttggaccacaaaggttttctt

SEQ ID NO: 44894 - DNA, 101 bp, rice(Oryza sativa)
  misc_feature (71): n=a or g
gctgaactggtggtgcattggaagtactctgttggttacctgtttctgtaatttgggaagacgccacccgncaagtagattggccccgtggtctgatgctc

SEQ ID NO: 44895 - DNA, 101 bp, rice(Oryza sativa)
  misc_feature (71): n=a or g
cgaatgtgcccctggtgactgtgtcttcttcctgctccagcacaatactgagcagcaaaggatgggtttgngggccagctttttagccaaacggcgacaac

SEQ ID NO: 44896 - DNA, 101 bp, rice(Oryza sativa)
  misc_feature (71): n=t or c
gaccggctgcgttggttcgagaatgagcacgcatcaaaactagccaaatactccctctccaaaataagtgnagccttgagtttccgtgtataaatttgacc

SEQ ID NO: 44897 - DNA, 101 bp, rice(Oryza sativa)
  misc_feature (71): n=t or c
caatcctatctccctcaaacacagcctaagtgttcattcggagaagataaggagaagaaattccttggcgngcacacttcccgaactagcctgtgttcggc

SEQ ID NO: 44898 - DNA, 101 bp, rice(Oryza sativa)
  misc_feature (71): n=t or c
actgcacagaaattagacaggattgaaataacaacatacgtgtttacatctggtggaaggtgaagtccaanaggaactgggacttgttggtacagtcccat

SEQ ID NO: 44899 - DNA, 101 bp, rice(Oryza sativa)
  misc_feature (71): n=t or c
ttataaatattattccaatatggattctaaacccttcattcaatacacaatacataagtagtagattcacngtgctgatccacctatcttgtagacttggg

SEQ ID NO: 44900 - DNA, 101 bp, rice(Oryza sativa)
  misc_feature (71): n=t or g
atcgtttcaaccgggggcccattctgtgttcccacctatattgccctcgatgcgtatataaaaatggtcgntgccactgccaacggagctcgatctggaac

SEQ ID NO: 44901 - DNA, 101 bp, rice(Oryza sativa)
  misc_feature (71): n=t or g
tcgttagcaagggcccgccgccgttgatgtcgccggtggggttgacgatgaccgtcagcttgttggggaanttctcctcgtacacgccgcggccggagccg

SEQ ID NO: 44902 - DNA, 101 bp, rice(Oryza sativa)
  misc_feature (71): n=t or c
aaaattaaagcagtacaggagtggtcagtgctaaagaccctgaaacaactgagaggatttctggaacttgncggctattacagaaaattcatacaacacta

SEQ ID NO: 44903 - DNA, 101 bp, rice(Oryza sativa)
  misc_feature (71): n=t or g
gactccagctctccaacatcaaacctatcccttatagagcttgtgaagctgaaaagaaagattcagaatgnatcaatgcatctaggaaagatgatagtgat

SEQ ID NO: 44904 - DNA, 101 bp, rice(Oryza sativa)
  misc_feature (71): n=t or c
aaaattcagagtagcttttagcgattcattcattgggccaaattttgagtttgggcccaactattccttcnatttcctgacagaataagtcgacttgtcgt

SEQ ID NO: 44905 - DNA, 101 bp, rice(Oryza sativa)
  misc_feature (71): n=t or c
ctttgctgctaatgggcatccactcaatttcctagtaattttcttgcctatctcctgtaggttgaaataancatcaggatttacttcgaaaaaagcatgcc

SEQ ID NO: 44906 - DNA, 101 bp, rice(Oryza sativa)
  misc_feature (71): n=a or c
gcctcctactagggctcgagaaggcagagagttctgcgccacctctaccatgaccaggccacatgtcctcnatgccgtcaagtggcatcaccacttgccga

SEQ ID NO: 44907 - DNA, 101 bp, rice(Oryza sativa)
  misc_feature (71): n=a or g
ccatgctggtcttgttcagaaagggcgacagctttttgagtcaatgaagaatgagtatggcatcactcctngattgcagcactacacgtgttatctggatc

SEQ ID NO: 44908 - DNA, 101 bp, rice(Oryza sativa)
  misc_feature (71): n=t or c
aaatctgtatcacatcatgctctaactgaaccaaatgctgctcagctaccagtttagatattactattcantactttaaacatcaaatattcactattctt

SEQ ID NO: 44909 - DNA, 101 bp, rice(Oryza sativa)
  misc_feature (71): n=a or g
tgcaggagatgtctgcaccatcactagtgctgatggatctgaagttggcaaagggcgtatggttagtgatnaaatctttcaggtggatttcctccgagttc

SEQ ID NO: 44910 - DNA, 101 bp, rice(Oryza sativa)
  misc_feature (71): n=a or g
agagtgtcagttggcaccttgcatatatgaatagcttattgtcacaaatacaacacatctgaaccatgctncagcattcaggtcaggaagacttcaaataa

SEQ ID NO: 44911 - DNA, 101 bp, rice(Oryza sativa)
  misc_feature (71): n=a or g
gaagcattgcactgtattgctataggccagagtttgggttcattttgaaacagcagtcatgggataatttnaccgacaataaacaaagttagctggtaatt

SEQ ID NO: 44912 - DNA, 101 bp, rice(Oryza sativa)
  misc_feature (71): n=a or g
agcctcagtactcccaatagaaagactcatcagcacttttacttagcactagtgagcgtgcacgtgcaagncacgtcgatatatatactaagcgaagtata

SEQ ID NO: 44913 - DNA, 101 bp, rice(Oryza sativa)
  misc_feature (71): n=a or g
ggactgacatggaagtggatgacattttggagggaagcgaactccgtttaccaaatgcccaattgggatangaaaaagaaaaaagggaaatacgcttttca

SEQ ID NO: 44914 - DNA, 101 bp, rice(Oryza sativa)
  misc_feature (71): n=a or g
gggtatgagaaaaatggtttcccagataaagcccttgaagtttatgcactgatggaattgcataatgtaantcctgatgatgttacaattgcaagtgccct

SEQ ID NO: 44915 - DNA, 101 bp, rice(Oryza sativa)
  misc_feature (71): n=a or g
aaacgatgcacttcatctttcagctttggacagttactctttttgtttgctggacaaaaaggaaacaaganagataaatgccaacagaacatacaaatcca

SEQ ID NO: 44916 - DNA, 101 bp, rice(Oryza sativa)
  misc_feature (71): n=a or g
atcccacgtgtaactctcacgtagaaaaatcaaaaaaaattgttctttgtgagagttgcatgtgggacccncatatttatttttctttttcaaaagaaaca

SEQ ID NO: 44917 - DNA, 101 bp, rice(Oryza sativa)
  misc_feature (71): n=t or c
tttttttcaatattatttgtgctcgcggcatctaaactaagagtggctatttcattgaatacaggaatttnataccattcaagatggctccaacaaggaaa

SEQ ID NO: 44918 - DNA, 101 bp, rice(Oryza sativa)
  misc_feature (71): n=t or c
gtctggccttaagcgcaccgcagttgcaggaaccaaatgctgcagacagttggtgtgctaagagcaggtanaatagcaggctataagccagctgcaaacat

SEQ ID NO: 44919 - DNA, 101 bp, rice(Oryza sativa)
  misc_feature (71): n=t or c
acataatatccttgtctacctgctttggtatatgcaagctactggagtacttcattcgtcccataaaaaanaaatctagaatcggatacgacatattctag

SEQ ID NO: 44920 - DNA, 101 bp, rice(Oryza sativa)
  misc_feature (71): n=a or g
ctgcagcatggttttttgagtacgcgaacatctgaacgaacttagattatccatgaaatttgtttcaaaanaatattcttctgtatatgtatgacggattt

SEQ ID NO: 44921 - DNA, 101 bp, rice(Oryza sativa)
  misc_feature (71): n=a or g
tttcatgctaaccacgtgcactagtaaaaaaacaattttaacatacgggccaaaagtaattttcgcgtgcngaccttcatcccgtctgtctgaaaaggtct

SEQ ID NO: 44922 - DNA, 101 bp, rice(Oryza sativa)
  misc_feature (71): n=t or c
tgaaataaatatttttttttgactctggtgatttgcagcttgtagaatcactgttgagcagagttattcangaatttgagcgtcgtactgcaaaccagaat

SEQ ID NO: 44923 - DNA, 101 bp, rice(Oryza sativa)
  misc_feature (71): n=t or c
aatcagatcttctgacgcattgtcaccatgatgtcgtagctgacatgtggactctagacgattggtctcanatgtcaatgaccatatcacctataggatga

SEQ ID NO: 44924 - DNA, 101 bp, rice(Oryza sativa)
  misc_feature (71): n=a or c
agatccagatcggctccccctcccggcctcggatgaggctcctctaacttaaagttagaaggacactgtcnctacagggcccacatgtcagtgacagtgtc

SEQ ID NO: 44925 - DNA, 101 bp, rice(Oryza sativa)
  misc_feature (71): n=t or g
ataaaatcctatcagttttaagatgttgaagtgaaaccgtcctgtctaatttagtactagtacttcctcanaatttgattcattttggatagagggtagct

SEQ ID NO: 44926 - DNA, 101 bp, rice(Oryza sativa)
  misc_feature (71): n=t or c
cgctcatatggtcggcgtgctgcgccccggttgtccgtcttgagagcaaatgtatgcggcgtcgaaggtcntgaggcttggacgatctcgacacgtcgaat

SEQ ID NO: 44927 - DNA, 101 bp, rice(Oryza sativa)
  misc_feature (71): n=a or g
cttctcacaatattgaactgctttttcagaaggcatcaattctccactagccaatgtgctttctccaagtnaaaaaggacatgtcattactacctaaaaaa

SEQ ID NO: 44928 - DNA, 101 bp, rice(Oryza sativa)
  misc_feature (71): n=a or g
caaatatgtaccagacatgatacataggtatcaacatcacaggtgaagagttctagttgagaaagaacctngtgtgcattggtgcggtggcttgttgggat

SEQ ID NO: 44929 - DNA, 101 bp, rice(Oryza sativa)
  misc_feature (71): n=t or c
cggccactcgcgggatgtggccataggaggaggcggcggcagcagcaaactccactcgatttttcattganttggtttttttatctccgtttgctgttctt

SEQ ID NO: 44930 - DNA, 101 bp, rice(Oryza sativa)
  misc_feature (71): n=t or c
acgaatatatgcatggttggctagctaagctaagctaacacacttttcttgagcgtgtaacgcactcacgnatgctcgtcacgacacaccatgcacagctt

SEQ ID NO: 44931 - DNA, 101 bp, rice(Oryza sativa)
  misc_feature (71): n=a or g
cgaggtgcatttggggttgctatttggcgcgcgcgcgcacgcgttttcgttttcttttgccatctttttcncgttttcttttttttttctgccatcttttt

SEQ ID NO: 44932 - DNA, 101 bp, rice(Oryza sativa)
  misc_feature (71): n=a or c
ccgagttaaccaaggggccaaaagagatcaaagcatatggttggtatattaggtccaactagattacctgnacttctaaatccattatttgggcactacag

SEQ ID NO: 44933 - DNA, 101 bp, rice(Oryza sativa)
  misc_feature (71): n=t or c
acacgaattgcgttgcttggtatgtgaggaacctcacccacaatgacatcgtgaactcctcccacacgcgngcttagttgggaagattctcctctgcgcgt

SEQ ID NO: 44934 - DNA, 101 bp, rice(Oryza sativa)
  misc_feature (71): n=t or c
tcatgttcgctacttgttgctgctcatatgcatatgtttttgagcatgtaaagcactactaccttcgtccnagaatatatatagtagatacttcctctgtt

SEQ ID NO: 44935 - DNA, 101 bp, rice(Oryza sativa)
  misc_feature (71): n=a or g
cacatagtcacatgtaagtggcttccaccccttccctctcttcctcgtgagctcgcagacggggagaatcncaacggtggcaatgatagtgagaagttggc

SEQ ID NO: 44936 - DNA, 101 bp, rice(Oryza sativa)
  misc_feature (71): n=a or g
tgccaggcatacccaattgtacacacctaagggagtacctgaggtggttgctgaggtggttctggaggggncgcagccatggttactgcgaggtctaccat

SEQ ID NO: 44937 - DNA, 101 bp, rice(Oryza sativa)
  misc_feature (71): n=a or g
aaaccagtctgtaagagactataataggggaaaaaaatgccacgtagagtacagctactctaaaggcaagnaacaagtttagtcagcaatcatttgtgatt

SEQ ID NO: 44938 - DNA, 101 bp, rice(Oryza sativa)
  misc_feature (71): n=a or g
gtgtacttgttggtacgtgcgtaatagtgcgtgtgaatgtgcgattgtgggtctcaatgtaattgaaaganaaatcccaattgtgaatgtcaacaaattac

SEQ ID NO: 44939 - DNA, 101 bp, rice(Oryza sativa)
  misc_feature (71): n=t or c
catccaatatcaaacagggggatctcctcaaccccagtttgttccttagcttaaccaatttgatccgatanagcagcagatgcaaggagtgccctagcaga

SEQ ID NO: 44940 - DNA, 101 bp, rice(Oryza sativa)
  misc_feature (71): n=a or g
catttgtaaaataatttttttgcggggcatttgtaaaataaatttaaaagcatcgtaaaatacaaacatgnatttcatcactgcacacaatatcttaatca

SEQ ID NO: 44941 - DNA, 101 bp, rice(Oryza sativa)
  misc_feature (71): n=t or c
tggtgatggtttgagtcttctgaaactgactgacgatgcataagcatgtggtttagaaactctggaaaatnacccattgcacgaatgggcaaggggggggt

SEQ ID NO: 44942 - DNA, 101 bp, rice(Oryza sativa)
  misc_feature (71): n=a or g
tatacatcgttcttaattctcctacttgtctttgtcatgaaagaggattcacagaaaaaattctcaacatnagatgttggctaaatctttgctaggagcat

SEQ ID NO: 44943 - DNA, 101 bp, rice(Oryza sativa)
  misc_feature (71): n=a or g
ctaggcaggcggttcagggccaacgactaagtaataatgccaaggaatctaccgtagtgactagcaaggangatggacggtcattggtgaatggcctgccc

SEQ ID NO: 44944 - DNA, 101 bp, rice(Oryza sativa)
  misc_feature (71): n=a or g
caaaaaaaagggttaattaaatggagaattggtttgcaaatctcgtttcgacccaatgcaactcataatgngccgtacgactacaggcccaaccagatcag

SEQ ID NO: 44945 - DNA, 101 bp, rice(Oryza sativa)
  misc_feature (71): n=a or g
aatcgttttcctctttaaagaggaccattaggttacagcagtaccatactcctaagtggccatgcttgaanaaaccgatccccaaaaccgattgggttgga

SEQ ID NO: 44946 - DNA, 101 bp, rice(Oryza sativa)
  misc_feature (71): n=t or c
tgcgagaggcgcgacccctagctagggtgtgcgcggactagcgagggaacgacgcagacggaaaaattganggagggtgctagggacacgacctaggggta

SEQ ID NO: 44947 - DNA, 101 bp, rice(Oryza sativa)
  misc_feature (71): n=a or g
acaatgaccattgccaggatgtgggacaagaaactactgctaccgatgttacacactttcttaagggcccntttagttccctaaattttttttccaaaaac

SEQ ID NO: 44948 - DNA, 101 bp, rice(Oryza sativa)
  misc_feature (71): n=t or c
ggggacaaaaaaaatcaaacacgtcacaagcgggcggatgcaggtgaaattcagggcgacgaaggatccanggctccgatggcggcggttgcaggcggagt

SEQ ID NO: 44949 - DNA, 101 bp, rice(Oryza sativa)
  misc_feature (71): n=a or g
agatcatgagcagcactggcctccgatcattctgttcccttctcttaattacctcactcttcttcctgttncctttccggctttccttcccttcttatgct

SEQ ID NO: 44950 - DNA, 101 bp, rice(Oryza sativa)
  misc_feature (71): n=a or c
agagtgttgaacttacttgcaacttaataaaacctaacacttgatggcttgatgtgggaggccatggcaanaatcttcggtgggtgctctcccctttggct

SEQ ID NO: 44951 - DNA, 101 bp, rice(Oryza sativa)
  misc_feature (71): n=a or g
tagctctgtgcttcagatgcaaccacaccgaggttgagaagttgtacaaggaacataaaagtggaaattcnaacaagaatttctatgatatgctgcagtag

SEQ ID NO: 44952 - DNA, 101 bp, rice(Oryza sativa)
  misc_feature (71): n=t or g
tcctataattgaaaattagttgggtgggtgtattgagcgtaaagcatgaaacttttaaggatttattttancaagctaagttttaagcgcctgggagattt

SEQ ID NO: 44953 - DNA, 101 bp, rice(Oryza sativa)
  misc_feature (71): n=t or c
gtgcactcagatcatacaatgcaactgatccacatacgtacatgttcaatattaggtaggagtactaacantactgtctactgggccgcactgatgcagtg

SEQ ID NO: 44954 - DNA, 101 bp, rice(Oryza sativa)
  misc_feature (71): n=a or c
tcgatcttggcccatccttccttgagctgagcctgcatctcggcctgatcggcgtagtagctctcgtcganctcgtagaaccccttctcctcgacctcgcg

SEQ ID NO: 44955 - DNA, 101 bp, rice(Oryza sativa)
  misc_feature (71): n=t or c
agcaatagcaggaaggacttcctcaatattggaggtagcaacattaaatgcgtattcatttctatgtttcnagatttcccaagcgaccaaaatgatcaaga

SEQ ID NO: 44956 - DNA, 101 bp, rice(Oryza sativa)
  misc_feature (71): n=a or g
gtttgggcctatttggtgccatcatgagctttccgcaggaaatgtgtttgttttggggaaaaattacatcnaaggtccctcaacctgtcatcggattacaa

SEQ ID NO: 44957 - DNA, 101 bp, rice(Oryza sativa)
  misc_feature (71): n=t or g
gggacatgggggttcagttgaacccccccaaacttttgggggaacaacaaacaaactcaaactgttacttntattaaggttaaaggctctggaactaagag

SEQ ID NO: 44958 - DNA, 101 bp, rice(Oryza sativa)
  misc_feature (71): n=a or g
atgaaaaaaccaaccccaaaaggatgaggagagcaatgggtaaccataacacctaattcattttgcagatnattgcgaatctgaagcagatgaccatccaa

SEQ ID NO: 44959 - DNA, 101 bp, rice(Oryza sativa)
  misc_feature (71): n=t or c
aagttgagcttgtcatcagatgtgtttctggactttggaacgacgtacgtgttaccattgttgcattcgcngtaaagcgtacgttctgcatttctatgagg

SEQ ID NO: 44960 - DNA, 101 bp, rice(Oryza sativa)
  misc_feature (71): n=t or c
ttataggactgcggcggcagcaccacagcaacaacaacaataatcctctctccctttcactagcatcgtcnactttcattaacatctatgtgaatgtggac

SEQ ID NO: 44961 - DNA, 101 bp, rice(Oryza sativa)
  misc_feature (71): n=t or g
gccgcggtagaacaacatgctcttcttcaatccgacgggatgtctatctgcagagtacacgaaactggctntgcctgcggtcttccaataccctgatggtg

SEQ ID NO: 44962 - DNA, 101 bp, rice(Oryza sativa)
  misc_feature (71): n=a or g
ccagtgatcgttacgtgcctcaaatgtccgtgaacaagaggtagtcgagggataaacaactgctgccactnttggagccatccgacgaaggcacggggatg

SEQ ID NO: 44963 - DNA, 101 bp, rice(Oryza sativa)
  misc_feature (71): n=a or g
tgtaaacgagaaggggcccgatggttagccactaaagaggggcacggaagtttcatcctcagaccttcaantgagtactctaccgaggatagtatggtttc

SEQ ID NO: 44964 - DNA, 101 bp, rice(Oryza sativa)
  misc_feature (71): n=a or g
ataccttatttggaactccttctatatacgagatatgattttgtagaagacatggtacatggtgggccctnctgagtttagtcaactactattaggtatgt

SEQ ID NO: 44965 - DNA, 101 bp, rice(Oryza sativa)
  misc_feature (71): n=t or g
tcatcttgagcactatcaaggtcatcctcttccacatcagaaggtgctaatgtagtcttcatcttctttancaatgtatgcccattgactggggcaatttc

SEQ ID NO: 44966 - DNA, 101 bp, rice(Oryza sativa)
  misc_feature (71): n=a or c
gcctaccccgaggatacagggtaacccgagcacaacggccatctggagatatgttttcgaccactcggggnaccaaactctacttagaagccccgagggca

SEQ ID NO: 44967 - DNA, 101 bp, rice(Oryza sativa)
  misc_feature (71): n=t or c
tcgcgatggagcaccattctatacgatttgttgttcgcaattgctcttcgcctgaaggatttggccgtgcngaggcttgtgtgcaagccatggtgggatgc

SEQ ID NO: 44968 - DNA, 101 bp, rice(Oryza sativa)
  misc_feature (71): n=a or g
ttgtacatgtatgtactctctccgtcccagaaagactcaatttctaggttttggtgttcaacgtttaaccntccgtcttatatgaattttttttatgatta

SEQ ID NO: 44969 - DNA, 101 bp, rice(Oryza sativa)
  misc_feature (71): n=t or c
aggcagcccaacacaaagtattctactcacttcgttccattttaagcatagctataagttttttcgtgtcnaactttgatcgttcgacttatttaaatttt

SEQ ID NO: 44970 - DNA, 101 bp, rice(Oryza sativa)
  misc_feature (71): n=a or g
cggtagtttctgactccgttcaagtggaccggaacgaggtcgaccattgagaaaggcggctggggaacacngcggaaggactcgtcggcgagcgagaaaga

SEQ ID NO: 44971 - DNA, 101 bp, rice(Oryza sativa)
  misc_feature (71): n=a or g
ccaaacatcaatccatccaccatagctccaacatctatcccttctcaactagggcacaaccaaaaaagaantgatgcccttcttagtgcacagccaaaaaa

SEQ ID NO: 44972 - DNA, 101 bp, rice(Oryza sativa)
  misc_feature (71): n=t or c
ctggatgaaacatttgatagtcctccgaacatggacatgcaaccacagtcctataaacctagatatgcaancgtagtatttaaaaacatctcatccggttt

SEQ ID NO: 44973 - DNA, 101 bp, rice(Oryza sativa)
  misc_feature (71): n=a or g
gttgctgttttatcagatggcaagagactgttcctttctacatcaggtgggagtagttcagttggacttancactggtttgcagaggccaagctgtctaaa

SEQ ID NO: 44974 - DNA, 101 bp, rice(Oryza sativa)
  misc_feature (71): n=a or g
taaattgtactgggatatttcctttgatcacttgtcttgactttattctacatcctcaaatatccttgcantccagtgtgctgatctgaaagaactccttc

SEQ ID NO: 44975 - DNA, 101 bp, rice(Oryza sativa)
  misc_feature (71): n=a or g
ggtctatttatagtcttggtataaagtcatgtaccctaaagctaataaatacatgagaatttacatggatnccctagtgaatagggacatttataaaggta

SEQ ID NO: 44976 - DNA, 101 bp, rice(Oryza sativa)
  misc_feature (71): n=t or c
tttgcctgttttgttcactggttacgtgtgtttgtcaccgatctacttgcattgcaagttttgtatgtcangtgtttgccccttctttttgggctttattt

SEQ ID NO: 44977 - DNA, 101 bp, rice(Oryza sativa)
  misc_feature (71): n=a or g
acacctcggcggcgccgatgatgaagtactgcggcacctgccagaagatggagatgggcacgacgtccttntcgccgtagagcccgtggcgagcgatggcg

SEQ ID NO: 44978 - DNA, 101 bp, rice(Oryza sativa)
  misc_feature (71): n=t or c
tgctggctgtgagctggtactcgagtagatagtccggatcaatatagcctggtgtaccttttggcacaacntgggttttctcatcgattgttgaacaacca

SEQ ID NO: 44979 - DNA, 101 bp, rice(Oryza sativa)
  misc_feature (71): n=a or g
tatcagaaaatgtgtgaagggatggaagtacgtgcctaaaccgtgtaagtgacctatttttctgattaagntacatatattctatctcgattttcgttagc

SEQ ID NO: 44980 - DNA, 101 bp, rice(Oryza sativa)
  misc_feature (71): n=a or g
gcaggatacatgtgcctgaattctgtctcgtcttcccatgtcgcgtctgcagccggcttgccttcccgctngatgagaacctggcgcacaccgcgtgccaa

SEQ ID NO: 44981 - DNA, 101 bp, rice(Oryza sativa)
  misc_feature (71): n=t or c
gtcttcaaaatcacctccatggctcttgatctaaacaagccagtagatgagggagatgaacaggctttgcntgacctcaatgacgaaattgctgaagttga

SEQ ID NO: 44982 - DNA, 101 bp, rice(Oryza sativa)
  misc_feature (71): n=t or c
tacaaatagcaaatcccaaaaattgaaacaacccttaaccttttcgacgcccctccataatctctcgaggntcctccacctacgccgatcggcggatggac

SEQ ID NO: 44983 - DNA, 101 bp, rice(Oryza sativa)
  misc_feature (71): n=a or g
ccgcatcttcaacatttctgcctcctcccctttcatcactcgttttatcgtatttgcaatctcttcattcnttataaacctttcatttccgacattaatcc

SEQ ID NO: 44984 - DNA, 101 bp, rice(Oryza sativa)
  misc_feature (71): n=a or g
caaccgtgtcgtgttccgatacaagatgggcaggaagctctgccggatcgtgcagaatattgaagtgctantcgcagagatgaatgcctttgggtttaaat

SEQ ID NO: 44985 - DNA, 101 bp, rice(Oryza sativa)
  misc_feature (71): n=a or c
caaaaatgcagctaaatattattgttagtagtattacctctagatgatgaatgttagtgtgaggccatgcnccaaagcttacgtcggagcctcgcagtcca

SEQ ID NO: 44986 - DNA, 101 bp, rice(Oryza sativa)
  misc_feature (71): n=t or c
ttggcggtggcctttatatcctactagtaacgaactggagaaccctgcctgaagcggctcttttcaccaanttttgtcaatttttgggcaaatattgagaa

SEQ ID NO: 44987 - DNA, 101 bp, rice(Oryza sativa)
  misc_feature (71): n=a or g
tcagacggacaaggtctccgttctcggcagcaccattgagtatgtgcaccatcttagggagagggtgaagntcctgcaggacatccaaagcatggggagca

SEQ ID NO: 44988 - DNA, 101 bp, rice(Oryza sativa)
  misc_feature (71): n=a or g
tgaggattcactcgatgagttggcttaccacaggttgaaggaagaagttaaagcccgtgatgaacaagagncgagtggcagtgtctcgaagctaaaaggga

SEQ ID NO: 44989 - DNA, 101 bp, rice(Oryza sativa)
  misc_feature (71): n=a or c
cgccgcattagcaaattagggacgacgatgatccgtcgcttcctctacatggtcgacatcttcgacaaagncggctacggccctcaaccctacaggctacg

SEQ ID NO: 44990 - DNA, 101 bp, rice(Oryza sativa)
  misc_feature (71): n=a or g
atttcaatcgatccatgcatgcatatgaattgatcgatcttattagctagctgctgactgaagccctgaantttcaatcagctgcagggcatgcattgcat

SEQ ID NO: 44991 - DNA, 101 bp, rice(Oryza sativa)
  misc_feature (71): n=a or g
agtgctggatgccatcatggaaacaagataaacgtgtgctaggacatacaagctaacaaaagaataaaagnaaccatatggtttttaataaatatgctaca

SEQ ID NO: 44992 - DNA, 101 bp, rice(Oryza sativa)
  misc_feature (71): n=t or c
tggatatgcaaccttgtagttaaattaagagggtaaaagatgattatctaaattttcctgttcggtgctgnaaggagggcgcggcggcgagggaggctcga

SEQ ID NO: 44993 - DNA, 101 bp, rice(Oryza sativa)
  misc_feature (71): n=a or g
ggggattgaagggaaatgtttttttcttctctttgtttttgcaaccgacaaccgaatcaggtggtgtttgnatccagagatttaactttagtctctatatt

SEQ ID NO: 44994 - DNA, 101 bp, rice(Oryza sativa)
  misc_feature (71): n=a or g
aataaaaaaaactcccttaagcagtacaaactttttcatccagcttataaagaaacaataattatataaantcaaaaaaataaactaaaagccagaaacta

SEQ ID NO: 44995 - DNA, 101 bp, rice(Oryza sativa)
  misc_feature (71): n=t or c
catcgacaggtgatatgtgagggaataaagtagtataaaaggtgtgttggtggtaggtcatcaggcactanaggatgaggatatccaactttgctaatctt

SEQ ID NO: 44996 - DNA, 101 bp, rice(Oryza sativa)
  misc_feature (71): n=t or c
gaccataatatatagggttacgtgtcgcgtgcaaaaaataatcactgtagtttggtgtaaattgtactccntccgtttcaagttataagatattttggctt

SEQ ID NO: 44997 - DNA, 101 bp, rice(Oryza sativa)
  misc_feature (71): n=a or g
aagacgaaggagaatttaatcattcctgtaaattatgcatgcatgctgatttattaatggggacttgatanccctagacatcaagactgtgcatgcataca

SEQ ID NO: 44998 - DNA, 101 bp, rice(Oryza sativa)
  misc_feature (71): n=t or c
cattcgtttcgcatgttttccacaatgtttttttttttaaaaacaaactagcaaaggcaaaagctttgtcnttttttgtattgatagagcaaggacatatt

SEQ ID NO: 44999 - DNA, 101 bp, rice(Oryza sativa)
  misc_feature (71): n=a or c
caagtttaatttgcaaattactatacgcgtcggcttcaccggctggtggttaatttggtcgaatttaacgngcaggagtagtcgttgcagcagggaggcgc

SEQ ID NO: 45000 - DNA, 101 bp, rice(Oryza sativa)
  misc_feature (71): n=t or c
ttgctgacacatgacagtgtatgggagggaacaattcaactttccttgtcatcactcacaaatgttgttgngatcttcaaaaggtttgtttcatccgcagt

SEQ ID NO: 45001 - DNA, 101 bp, rice(Oryza sativa)
  misc_feature (71): n=a or c
ttgcttagacctcctcagccacttccactggttaatgttccacgctttcaacctagtgcaatgccatatcncccacaccaacaacctcatctcatgcaagg

SEQ ID NO: 45002 - DNA, 101 bp, rice(Oryza sativa)
  misc_feature (71): n=t or c
aggtcgaggcgagcgcgggcggcttcttgaagcagaaaagctggagcagctcgcgagaagaagaggagggngaggaggcggcgtcggagatggcggcggag

SEQ ID NO: 45003 - DNA, 101 bp, rice(Oryza sativa)
  misc_feature (71): n=t or g
tttttcattttaccaatgcgaagcagggctacaatctcgaaaatgtgatttttgcctttcggtattttttncccgatttttttaaaatttgacgaatttga

SEQ ID NO: 45004 - DNA, 101 bp, rice(Oryza sativa)
  misc_feature (71): n=t or c
agcatcggcagcgttgtcattggcggtgtcctaagcttgatgtttttcgttttgtctgactccttttactnctttttaatatatccggcagagctcctgcc

SEQ ID NO: 45005 - DNA, 101 bp, rice(Oryza sativa)
  misc_feature (71): n=a or c
gtaggagcccaacctttcatatgtcgtaaagcccaatcttgtacattacctaagggcaatttggtcctatnatgatttttggcagttatttcagacaagcg

SEQ ID NO: 45006 - DNA, 101 bp, rice(Oryza sativa)
  misc_feature (71): n=a or g
tcgatcaatcttcatcaagacgtagccaccatggaggacggcaaatcggtattgccgcccgcgcgacttcngcccagatcgaacacggtgccgattcccac

SEQ ID NO: 45007 - DNA, 101 bp, rice(Oryza sativa)
  misc_feature (71): n=a or c
caagatatattcctatttcctactactccttacactgtagctgtagtagaattggtggagaggcagtcttngaagtgaagtactacctccgtcccctaata

SEQ ID NO: 45008 - DNA, 101 bp, rice(Oryza sativa)
  misc_feature (71): n=a or c
atgtgtctggcagattccggtagctctcctcaaacagctagaacaagtgaacaaccaccgccaaaatcaangcgttgtgtggctactgcttgatcagtcca

SEQ ID NO: 45009 - DNA, 101 bp, rice(Oryza sativa)
  misc_feature (71): n=t or c
gtgtcctggttgactagtggaacacaacttggaacacaaccatctctcggtattgtggtatgatagaaacntaccgtgtgggatttcttcataattttgtg

SEQ ID NO: 45010 - DNA, 101 bp, rice(Oryza sativa)
  misc_feature (71): n=t or c
gtagcaggtctattggtggatgagaagacaggaaaaatcaacacatgtgagaaactccatggaagcgcganagcagcagaagctcgtttcacccgagctat

SEQ ID NO: 45011 - DNA, 101 bp, rice(Oryza sativa)
  misc_feature (71): n=t or c
ttgaaatttcagaacgaaattttcaaaattttgataattttgtcccccaccggaaagcacatgtctcgccngtaattttcagctgtttgtaattttttgtg

SEQ ID NO: 45012 - DNA, 101 bp, rice(Oryza sativa)
  misc_feature (71): n=t or c
cagtttaggaccactggaagaaactaagatgatattgaaaatggtagactctatatgggcatctgattgtncaacttagggtttgatttgtttatgttgat

SEQ ID NO: 45013 - DNA, 101 bp, rice(Oryza sativa)
  misc_feature (71): n=t or c
tgaccactcaacaatggaaaagtgttttcatctctcgagaagatatccccttgtttcacctaaatagttanaaaaattgaaattctttttaacaagataaa

SEQ ID NO: 45014 - DNA, 101 bp, rice(Oryza sativa)
  misc_feature (71): n=a or g
agaaaaatattaattataaaatattttaaataaaacggattatcgaaattgggcacgaaaactaatggctncacttgaaattaaaatggatctgagggagt

SEQ ID NO: 45015 - DNA, 101 bp, rice(Oryza sativa)
  misc_feature (71): n=t or g
ttcggagttattcttcttgagcttctaactagtaagaagccgctgtcaaaagataggaagagcctcacctngatgtttcaggaggcaatggcagagggcac

SEQ ID NO: 45016 - DNA, 101 bp, rice(Oryza sativa)
  misc_feature (71): n=a or c
cgtacatgtgagagataaaaggtggctgagaaggaagcgattacgtggcgatatggaataggtggctgagnaggcgcctgatgtttagttagccatcaggc

SEQ ID NO: 45017 - DNA, 101 bp, rice(Oryza sativa)
  misc_feature (71): n=a or g
aaatatctgaacactgaaggtgattacataaggagtcatatgcataccttcagagaccctcctttcacatnctccatcataattgtggactgtaatatctt

SEQ ID NO: 45018 - DNA, 101 bp, rice(Oryza sativa)
  misc_feature (71): n=a or g
ttttctgcgtcagttgggctcgatctgtctgctgcgagttagtgagttacagtacaaaaatattcggtttnggcccggtcagagccagaggctcgcttgtt

SEQ ID NO: 45019 - DNA, 101 bp, rice(Oryza sativa)
  misc_feature (71): n=t or c
tgtggtgcctctagcatgttgttgtcgtagcagaagatgatgtacttagacacatggccccagttgtgganaagcttccacagatcacttggaaactccag

SEQ ID NO: 45020 - DNA, 101 bp, rice(Oryza sativa)
  misc_feature (71): n=a or c
cggaacatccactttgtcactcaatcctagcagcagcgaagcgagcaacattgttaagcccgagccactantagcattttcagatgatcaactaattttta

SEQ ID NO: 45021 - DNA, 101 bp, rice(Oryza sativa)
  misc_feature (71): n=a or g
ggagaatgaatgtctggcgtacatataggcaggtgggctaagacacaaatattctcagttggggtcactanagcaagtgagtaattggggatgcataccct

SEQ ID NO: 45022 - DNA, 101 bp, rice(Oryza sativa)
  misc_feature (71): n=a or c
ccgcgacacaaaaatcagatacccaccgatccaaaaattgctctatgttgtagttatgacctcgagaaagntacgccactacttccaggctcacaaggtca

SEQ ID NO: 45023 - DNA, 101 bp, rice(Oryza sativa)
  misc_feature (71): n=a or g
gaattagaaaggatccagtcggcagtaacctgtgctttataaaatggccccaagcattccaataaaatcangttctctgctgaagctatgagtctattacc

SEQ ID NO: 45024 - DNA, 101 bp, rice(Oryza sativa)
  misc_feature (71): n=t or c
tgtcccatgctctcttattccactctcgcgtattccttggtatcagtcgtaccttacgtcccttaaatacngcggtcgggtataacccgtcaacaatgatc

SEQ ID NO: 45025 - DNA, 101 bp, rice(Oryza sativa)
  misc_feature (71): n=a or g
gcactcataatgcacgtgcacttacctctataaacacacgcacgcaaattctatttcaaagactaggccgntaaatccttgagataacttgtgtgtttgca

SEQ ID NO: 45026 - DNA, 101 bp, rice(Oryza sativa)
  misc_feature (71): n=a or g
aaaaactacagctatgacctccagaaaaagaacaatgagatgttcagagacaatccaacaatgaaataaangaacaatgaattgttcagagacaatccaac

SEQ ID NO: 45027 - DNA, 101 bp, rice(Oryza sativa)
  misc_feature (71): n=a or g
aaaaaagatttttcccaaggaggcccatatcattatataggcaggccacattttcggccacaaacgttacntttgcctgtatagttatgaacggggataca

SEQ ID NO: 45028 - DNA, 101 bp, rice(Oryza sativa)
  misc_feature (71): n=t or c
aaaatcaattttttagacttccccttattagaactgcctatattacctagctagccataatctgttactanatccgtaccaaaatatatcaacttttagct

SEQ ID NO: 45029 - DNA, 101 bp, rice(Oryza sativa)
  misc_feature (71): n=a or g
aatatccaaaactttatccaccctttgtagtggaaacgaacagaggggcttaccgtttggaggactaaggncagtcccaaccctccacttagaatagtatc

SEQ ID NO: 45030 - DNA, 101 bp, rice(Oryza sativa)
  misc_feature (71): n=a or c
gcgatatttagtcttccaaaaattacaataatagagtaatttcaaaacagccatgtactagttaatacccnaagttcttctgcaagctccgtcattcaatg

SEQ ID NO: 45031 - DNA, 101 bp, rice(Oryza sativa)
  misc_feature (71): n=t or c
ttaaataatattatccgttttgtaactatttgtttttacccttttgcccaatgctattgcatttacgtgcnatatcggatgaaaattatatcaacgcgcca

SEQ ID NO: 45032 - DNA, 101 bp, rice(Oryza sativa)
  misc_feature (71): n=t or c
cttactggtccgagaaccatgagtagtctcatctctcggccgattgatgtcgatgtacgagagatcgctanggcctactggtccgagaaccaggagtagcc

SEQ ID NO: 45033 - DNA, 101 bp, rice(Oryza sativa)
  misc_feature (71): n=t or c
ctttggataggaacatcgatgatcatcttcagtttgtgttaggaacagaatccggaatgatcacttctatngttgctgctgtccgtgaattatttgattcc

SEQ ID NO: 45034 - DNA, 101 bp, rice(Oryza sativa)
  misc_feature (71): n=t or c
acctgtaaatgatttttcctatctttttatttaataacctgttctgtcctgtttggtagagctccaactcnaaaatttagcttcaggagttgggtctgaag

SEQ ID NO: 45035 - DNA, 101 bp, rice(Oryza sativa)
  misc_feature (71): n=t or c
atctttaaagtggtaagagacatattcgcccatagaaaaacatcgtggtgatttcgtcacaatttcaaaanatattggctcaatctatatattcgtccata

SEQ ID NO: 45036 - DNA, 101 bp, rice(Oryza sativa)
  misc_feature (71): n=a or g
tgtgtttcctgacccattttttcatttaatcccttcagtgcagttgttacattcggccttaacgcgcttcnagggcgacagcagatgggcagaggtgtttg

SEQ ID NO: 45037 - DNA, 101 bp, rice(Oryza sativa)
  misc_feature (71): n=a or g
aaataattgagattgaaatgataattgcaccagggccggctctgtataccatagcaatggtactaccacanctgtcaactacaggccctccaacaccaccc

SEQ ID NO: 45038 - DNA, 101 bp, rice(Oryza sativa)
  misc_feature (71): n=a or g
tgcactctagaagatctagttctcacaagatactttggtcgaaagtatccaacatggcttggtactacctntttgtgctcactagaatatctgactctaag

SEQ ID NO: 45039 - DNA, 101 bp, rice(Oryza sativa)
  misc_feature (71): n=a or g
gtttcggtttgaaatataggtcacactcatgcatgacccacattttactagaagtgattttgttgggattncaaaaatcacattagttccatttctaatag

SEQ ID NO: 45040 - DNA, 101 bp, rice(Oryza sativa)
  misc_feature (71): n=t or c
ctccacgttcacccacctcacaaaccccctatggagatatgagagattaggatgattgagagaggagggcnaccttgacccccctacaaatctgcttctcc

SEQ ID NO: 45041 - DNA, 101 bp, rice(Oryza sativa)
  misc_feature (71): n=a or g
gaagtctgcaaacatcactgatatggattattatcgtacgaatacatttgctataactgatatatgcacantgaataaataaacaacacatttcccttgta

SEQ ID NO: 45042 - DNA, 101 bp, rice(Oryza sativa)
  misc_feature (71): n=t or c
tagccgtgcgttgtcgcatcggcgtaggtcgccacggaagactctctgccgactacgtgagagatgtgtcngacggttgggtagctagagggcttctttac

SEQ ID NO: 45043 - DNA, 101 bp, rice(Oryza sativa)
  misc_feature (71): n=t or c
atcaccacgatagacctccattatccagccatctggaagccaacctggtcggtcatcgacatcatcgtcgncactttgcaaattttttgttgcttcctcag

SEQ ID NO: 45044 - DNA, 101 bp, rice(Oryza sativa)
  misc_feature (71): n=t or c
aaaggaaccaagttcatgtttgcaaaacaaaaatacacataccgatataaacatggtgacgtactggtggngtcagtgtgctatatgtgctagtaatgtat

SEQ ID NO: 45045 - DNA, 101 bp, rice(Oryza sativa)
  misc_feature (71): n=a or g
ctcaataggtatgcaatgggtgcagagagcgggactaatgcccttgagatcttgaagagagcagctcatgntagagtgatgtttctctaacacagttacaa

SEQ ID NO: 45046 - DNA, 101 bp, rice(Oryza sativa)
  misc_feature (71): n=a or g
agtagaaaaaagatctcatgtttcaaagcagtatatatacaatgtgcagtccactactattcctatatccntatataaataaaatgtaaatttgtttggta

SEQ ID NO: 45047 - DNA, 101 bp, rice(Oryza sativa)
  misc_feature (71): n=a or g
atagtccttctaggcttgtaattttctgatttatctttagggaagttcgagtcgtgtccgataaggacttntatctgcctatgggtataaataagtacacc

SEQ ID NO: 45048 - DNA, 101 bp, rice(Oryza sativa)
  misc_feature (71): n=t or c
atgttcatggaggctctcggggtccttgctgagatggacgttacaccgaacgaggtaacactggcaagcgngcttgtcgcttgtggaaatctggggacggc

SEQ ID NO: 45049 - DNA, 101 bp, rice(Oryza sativa)
  misc_feature (71): n=a or g
tatggcatgtgctatgtaagcaactaggttgttgtttgatgttttactcttaagaggggattaggttgaanacttgaaacacataaagatggaatgggagt

SEQ ID NO: 45050 - DNA, 101 bp, rice(Oryza sativa)
  misc_feature (71): n=t or c
cagtcatggaattcagagccagaaagaaaagaaggtgccactgccacagatgttggtcatgatgtcaaaantgagaaggtgactaatcagctaattgtctc

SEQ ID NO: 45051 - DNA, 101 bp, rice(Oryza sativa)
  misc_feature (71): n=t or c
aagaagaggaggggacaacaggacgagctgtcagcaaggaagggggaagagccatcgtcttccaagcaagngcaagcgcaggctccatccgcgtgtggtgt

SEQ ID NO: 45052 - DNA, 101 bp, rice(Oryza sativa)
  misc_feature (71): n=a or g
cccttggtggttggttcaattatggttgatgatttacaccaactccatagccaacagaccatctttgctcnaagcaacgttcccctccgatgatgattacc

SEQ ID NO: 45053 - DNA, 101 bp, rice(Oryza sativa)
  misc_feature (71): n=a or g
atttgataccgaaatatgctgggactcgagtttaactatgcgacggcaagggattgcatcggccgagaacngaagccagcgaccaggaccagccgagtcgg

SEQ ID NO: 45054 - DNA, 101 bp, rice(Oryza sativa)
  misc_feature (71): n=a or c
tgcgcaggggagaagttcccaaccaatagccccgaacacaagcctaaaagaactgaatacagagatcggtnaatattgttcaaagcagtaacgtcatcaat

SEQ ID NO: 45055 - DNA, 101 bp, rice(Oryza sativa)
  misc_feature (71): n=a or g
ctaccatcgcagtatcacggtcaacgtcccggcggtgcacgccgattttttaccgctacgacctaaggagnttctctactacatcttacgggagctcgagc

SEQ ID NO: 45056 - DNA, 101 bp, rice(Oryza sativa)
  misc_feature (71): n=t or g
ccatacgattagacacgcagttacgcaccgacggtgactcctggtctccacggagaacgattctaaagtantaaaactcctagtctcctagtactaaacag

SEQ ID NO: 45057 - DNA, 101 bp, rice(Oryza sativa)
  misc_feature (71): n=t or c
ttcaagcatatcctggaacaaaatgatgacctgaccctggtcctccttgttattcttttgctgcatttaangaatgagaattagtggtactgcaatccaac

SEQ ID NO: 45058 - DNA, 101 bp, rice(Oryza sativa)
  misc_feature (71): n=t or c
atatatacatttctagaagttgtctttttttacggaggatataggtggtaatagaaaacaatgtaaaatcntttttttaaaaaaagagtttgtaataatta

SEQ ID NO: 45059 - DNA, 101 bp, rice(Oryza sativa)
  misc_feature (71): n=a or g
caggccataaggtgatttcttccacacatctgtttactagcctagtattgattgtggttgcccacaaaagnccacatcatgtcgatgatatcatatactac

SEQ ID NO: 45060 - DNA, 101 bp, rice(Oryza sativa)
  misc_feature (71): n=a or g
tacttggtggatgaaagaatcatggtgaggtgatgaaaactacttttccttccttaaatatagcaacttancaaatgatagtatacatattctaatactat

SEQ ID NO: 45061 - DNA, 101 bp, rice(Oryza sativa)
  misc_feature (71): n=a or c
cggcctggactttttattggcaaaaccatttgcagttggtcgtctaaacatagcattttcgctggtggtcngtttaagagatcctcgtgcaaaaagttggt

SEQ ID NO: 45062 - DNA, 101 bp, rice(Oryza sativa)
  misc_feature (71): n=t or g
tctcatcgagagaagccagatccaaacaagcgtcaatagcatggcagtgaattaattaatggaggaaaatnagtagggttttgggtacacctgggaatgtg

SEQ ID NO: 45063 - DNA, 101 bp, rice(Oryza sativa)
  misc_feature (71): n=a or g
aacgaagaaaacaccaccaccaccaccaccaccaacaccaacaccgggttctaacacacttaagctaagcncaggctcctccacgagcctgaagaaatcaa

SEQ ID NO: 45064 - DNA, 101 bp, rice(Oryza sativa)
  misc_feature (71): n=t or c
actggccagactggcagccagggatcagcggtatctggttcatttggggaactatcaattagcacaagcanaagtgaaaatttgcctgttattcatgaatc

SEQ ID NO: 45065 - DNA, 101 bp, rice(Oryza sativa)
  misc_feature (71): n=a or g
aaaagaacacggcctgacactagatcctattcagggtcggctatcacggcatagatcgaggtaggaaaatncacactgcacttttgcaaaagaggccctaa

SEQ ID NO: 45066 - DNA, 101 bp, rice(Oryza sativa)
  misc_feature (71): n=t or c
gccatttggaccagcaggcatgtcatttgcaaagctaccgatcggccctccttccatttcatctacttgantgctctttaggagagaattgacagccaaat

SEQ ID NO: 45067 - DNA, 101 bp, rice(Oryza sativa)
  misc_feature (71): n=t or c
gggataagtctaaccgccatgaggccatgacatcaaaatacttccaacgcagcaaacaagccatcaacatnttaagccattcccaacccagaaactatcga

SEQ ID NO: 45068 - DNA, 101 bp, rice(Oryza sativa)
  misc_feature (71): n=a or g
gaataaaatttatgaatagaaagatttctaagatgaaaaatacttcacttggcatttctaaattatgatcnttctaaatttactcactaattttgaattga

SEQ ID NO: 45069 - DNA, 101 bp, rice(Oryza sativa)
  misc_feature (71): n=a or g
caggccaaatcggtctcggcctccttccagaatcaaaaagcccaataaccctttcacccaaattaaatagnaataagtccactatagatccctcatcttga

SEQ ID NO: 45070 - DNA, 101 bp, rice(Oryza sativa)
  misc_feature (71): n=a or g
gagactatgactttgagtggtactaagcgcaaaatggaccaaactgaagaggcagagggcaagcaggcaangatctccaagtagcatcaatttatcaagta

SEQ ID NO: 45071 - DNA, 101 bp, rice(Oryza sativa)
  misc_feature (71): n=t or c
cagtcttgtgtgatgcgacgcgagatgggtggtgtcgtgcgttggcgcgaaatggacgacgttgtcacggncccaagatgtcatagtgttggcacgcaaga

SEQ ID NO: 45072 - DNA, 101 bp, rice(Oryza sativa)
  misc_feature (71): n=t or c
cccttttctccagccaccgaatgctacaaagtggttcttggtgacatttggtacagagaaccgatgttttnttttttagaaaaaaaaaagtcagtaagacc

SEQ ID NO: 45073 - DNA, 101 bp, rice(Oryza sativa)
  misc_feature (71): n=t or c
aaatagttaaaagaagccaccactttagaaggaaaaaaaagagaggcaaatctaggccctgtttagattcnaatttttttttcaaactttcattttttctg

SEQ ID NO: 45074 - DNA, 101 bp, rice(Oryza sativa)
  misc_feature (71): n=a or g
tatgggatgcgacatctgttagtactacttcctctgtcaaaactaacctcatattaggatgtaaacatttntatgtccagatttgttgcactagtatgtat

SEQ ID NO: 45075 - DNA, 101 bp, rice(Oryza sativa)
  misc_feature (71): n=t or c
ccatcaaactcctcatcagaagcagtcaacccatcatattcaggtaacaaactcaactgagcagaaggtanggacgatccaccacctccactagactgtcc

SEQ ID NO: 45076 - DNA, 101 bp, rice(Oryza sativa)
  misc_feature (71): n=t or c
tttgtaaacaatccgatgccatattgtatttgtgcagaggactcacgttcggacaaatgctctgcttttgncgctctgctcttcttccgaacagtccacat

SEQ ID NO: 45077 - DNA, 101 bp, rice(Oryza sativa)
  misc_feature (71): n=t or c
gatgtgtttgcttttgatggatctcactgatttgtttcatctgtttgtttggtttcaggcagttctgcacnggagagcacaggtagggaggcccggcgatt

SEQ ID NO: 45078 - DNA, 101 bp, rice(Oryza sativa)
  misc_feature (71): n=a or c
gaaatagcttccccgtatatagtatatgcatgcatttcggatacatcaatcgatcgacacaccggcactantatattagatttaactagtactagctagtg

SEQ ID NO: 45079 - DNA, 101 bp, rice(Oryza sativa)
  misc_feature (71): n=a or g
agggagtcaaagtggacttattccttgtgtggtctaccgtaatggcctgatagtaagcccagcaatgcttnatgtgctgatagtaccacagtccagcccgt

SEQ ID NO: 45080 - DNA, 101 bp, rice(Oryza sativa)
  misc_feature (71): n=t or g
gatcccgaagaagatttgtactcaccattcagcatctttgactaagccattctttaaaatgtgcccagtantagtttatttattgaacacaattggcccag

SEQ ID NO: 45081 - DNA, 101 bp, rice(Oryza sativa)
  misc_feature (71): n=t or c
gtgtttaaaggtgtctataatatatttattcgcacacgtgtgccaaggctctagcagcctcatcattaggnatattttctcatatttgcaaatgaaaatca

SEQ ID NO: 45082 - DNA, 101 bp, rice(Oryza sativa)
  misc_feature (71): n=a or g
ataaacaatgatgtgtccgaccgagcctcagagaagccaagtgtgagtaagaaactggcaaaccggctgtnccatgcacgaggcgcttgcttcaaaccata

SEQ ID NO: 45083 - DNA, 101 bp, rice(Oryza sativa)
  misc_feature (71): n=t or g
tgaagacagttaaatttcaaagcgaattatatagccgatctaagatttatgacaatgaaagacttactggnatggcaggagcagctcgttgttcttcctcc

SEQ ID NO: 45084 - DNA, 101 bp, rice(Oryza sativa)
  misc_feature (71): n=a or c
ggaaattttgcgaaccctgtcatcaacctcatcacacatgaattcaaccttcttaagatggtcaaatgcanatgactgttctcgtggcttgtatctttcag

SEQ ID NO: 45085 - DNA, 101 bp, rice(Oryza sativa)
  misc_feature (71): n=t or c
gaggccattgccttcgttggtggaatccatggatttgttagtggcgctcgatcctccacctctacggcatnggaggcgagggtttccgtcgacagccagtg

SEQ ID NO: 45086 - DNA, 101 bp, rice(Oryza sativa)
  misc_feature (71): n=a or c
cacgcattgaggtggatcgaggaagctgatcagtggctacgttttccgcttgatctacgaattacgatgangagtgcccgttgatcgttgagtgatctgtg

SEQ ID NO: 45087 - DNA, 101 bp, rice(Oryza sativa)
  misc_feature (71): n=a or g
tgtataattcagttagaaccacttggaccacaacattcatgggaattattctgcaaggaagcattctgganaaatgaagaaaaagtttgcccaccagaact

SEQ ID NO: 45088 - DNA, 101 bp, rice(Oryza sativa)
  misc_feature (71): n=a or g
tacagagccgtgtgtggttggggatcagcggcgacatagtcgtggatgacgagcggtgactcgtagaggcngcgatggaggatcggcaggcagagtggtca

SEQ ID NO: 45089 - DNA, 101 bp, rice(Oryza sativa)
  misc_feature (71): n=t or c
tccgacgatcaagatgatcaatcgatgaatctcgatccggccggtgtggttcatatttacacggtagtatncattgctagatcgagctaagctagctgatc

SEQ ID NO: 45090 - DNA, 101 bp, rice(Oryza sativa)
  misc_feature (71): n=t or c
ttttaaggttgtaagacgaacaaattgaccgaccagcgaaacaaattgatcgtcgccttccatttcaacgngtagccattgagaattcgtatttgctataa

SEQ ID NO: 45091 - DNA, 101 bp, rice(Oryza sativa)
  misc_feature (71): n=t or c
gtcggggcggttaccttcacgtgtgcgacacacccaaatgtgcgcaagtgatggacagccggcgtgactcnattccagagctcatacggcgtcttgccatc

SEQ ID NO: 45092 - DNA, 101 bp, rice(Oryza sativa)
  misc_feature (71): n=a or c
agataggatcatgttcttccttgtcatgcatacctgagttttggtgtctgctcttcttcttggctagctgnctccttgccttcacctcctccccttatgaa

SEQ ID NO: 45093 - DNA, 101 bp, rice(Oryza sativa)
  misc_feature (71): n=a or c
caccgcttgcactccactggcccggtcctgctctaactacggatgctctgacgaattattcactcgccgcngattaaggtttttactgcttatgtattata

SEQ ID NO: 45094 - DNA, 101 bp, rice(Oryza sativa)
  misc_feature (71): n=a or g
ttctcgacaaaaaatcggcacctttatttcaatagtgctttttaagtctgatggtgggccctacacatagntgccggttttttatgacaagacaaaggtac

SEQ ID NO: 45095 - DNA, 101 bp, rice(Oryza sativa)
  misc_feature (71): n=t or c
tttgaatttcccgcagcaaaaagaggctggcatgtgcgcaagagtgagaaaccaattttttggcagaacgngcgccgccatgccaagcgaggcaagcaagc

SEQ ID NO: 45096 - DNA, 101 bp, rice(Oryza sativa)
  misc_feature (71): n=t or g
tcatcccgatctcgtcgcccttcggagctcatcaccggccgctgttttcatcgcccgtcgccatgtaagtnccggtaaggaccgtgctgatcttctcttcg

SEQ ID NO: 45097 - DNA, 101 bp, rice(Oryza sativa)
  misc_feature (71): n=t or c
gagaggatgcatggcagcatcctcgactcactactagaaaatggtcttctgtaatgtcccgaatttcgttngggattaaaattcattaaataatgcatttc

SEQ ID NO: 45098 - DNA, 101 bp, rice(Oryza sativa)
  misc_feature (71): n=a or c
ctagtggatcaagacccataattatttttcagtgaaaagcatgttgatatattagctccattcatcacttngttgatcgtgcaatagtacagggtgggtca

SEQ ID NO: 45099 - DNA, 101 bp, rice(Oryza sativa)
  misc_feature (71): n=t or c
ctggaggaccatcacaatcagcatcaatagaaccggaaccttacgaccctagccggtctgactgcacgtcntgtgccggtctgactgcacgtcctgtgccg

SEQ ID NO: 45100 - DNA, 101 bp, rice(Oryza sativa)
  misc_feature (71): n=t or c
atttttcggagtgtctagtaaaggcccacctataaaaattgaatttcacatgcgagcttcttaagagaccngcatgcgaaaatagatttattttcacatgc

SEQ ID NO: 45101 - DNA, 101 bp, rice(Oryza sativa)
  misc_feature (71): n=a or g
attgcttcctcaccgcaaccatttgtagcatatccagatatcattgaggaccacatgacctgatctttgcntggagttgcatcaaaaattcttctagctgt

SEQ ID NO: 45102 - DNA, 101 bp, rice(Oryza sativa)
  misc_feature (71): n=t or c
gaaccatgtattgaaggatgaatgagagggccaggaggaggagaggagaaagtggacaaggaagaggagtngaggaaatcgaggaagaagttggtaattca

SEQ ID NO: 45103 - DNA, 101 bp, rice(Oryza sativa)
  misc_feature (71): n=a or g
ttcctgtgtattcgaggaaaaaaaaagtatgagttgacttgatttcttgttggccgtcgctgatcgagttnctgacttgtgggtaccagttgctgctaaac

SEQ ID NO: 45104 - DNA, 101 bp, rice(Oryza sativa)
  misc_feature (71): n=a or g
cgaacataacaacatttaatctgagaattgagaggggagaattgattttttttttcctggtcttacatacntaggtattatgtatgtctttttgggagaat

SEQ ID NO: 45105 - DNA, 101 bp, rice(Oryza sativa)
  misc_feature (71): n=t or c
tcttgacgcctttgggatggagcttgggtctgaaatccagatccacacatcaaaagtgctgttgttgttgngacggcgggagtattcttctacatagtgca

SEQ ID NO: 45106 - DNA, 101 bp, rice(Oryza sativa)
  misc_feature (71): n=a or g
taatttcataatgaggatgtcttggtgttcctagtctttgtgtcatttggttatatgatcaatttgggatngagaaagtaatttccagtatttaagattta

SEQ ID NO: 45107 - DNA, 101 bp, rice(Oryza sativa)
  misc_feature (71): n=t or c
ccccaaacccaaatcccgcacgaactccacagatatttcacggcttttccccgtgcaccgtccatattttngtttatatttatgtttattagttaaaattt

SEQ ID NO: 45108 - DNA, 101 bp, rice(Oryza sativa)
  misc_feature (71): n=t or c
aattttcgcagagtgcataactgtgttatgcaagatgcaaatttccttccttttgccggggccgcaggtgnagttgacgggacccacatcccaattcgtgt

SEQ ID NO: 45109 - DNA, 101 bp, rice(Oryza sativa)
  misc_feature (71): n=a or g
tattgtagctagtattttaacacgattgccaccaagcacagagcaatggaatgttgtaaaaaaaatcattnagttctaaattggaagggattttggacctc

SEQ ID NO: 45110 - DNA, 101 bp, rice(Oryza sativa)
  misc_feature (71): n=t or g
taaaactgattgcaccaggattctcctaccttcagatgtgaagtatcgacctttccaacctgggagacgcnatccaatcttttcaatgagcggtaagaagt

SEQ ID NO: 45111 - DNA, 101 bp, rice(Oryza sativa)
  misc_feature (71): n=t or g
gttcatgtccttgacggatggttttgtcaggacatccaaaaacgttccgggctgaagcggttctcacctgnaagcgcatcgtctggttcgacgttgtcttt

SEQ ID NO: 45112 - DNA, 101 bp, rice(Oryza sativa)
  misc_feature (71): n=t or c
caataagcacgtgctcgagatgccaaaccttgagagtagggcaaaactagatgctacaaatatcagaaggngagcctcgagcttaacaatgaaggcgcaaa

SEQ ID NO: 45113 - DNA, 101 bp, rice(Oryza sativa)
  misc_feature (71): n=a or g
gcaagtaattaagctgctcgatcactgacagtgacagagcttgatgaattcgctgattaaatcattggtcnattagtaagcaaaatttcaggattcggact

SEQ ID NO: 45114 - DNA, 101 bp, rice(Oryza sativa)
  misc_feature (71): n=t or c
agcccgaacagctctgaggtcgttggaatcatcactgagaattgcacgccgtagcaaaggccaacggtggncgtgcaagcgtaggcgacggctgggccgag

SEQ ID NO: 45115 - DNA, 101 bp, rice(Oryza sativa)
  misc_feature (71): n=t or c
attggctttggcacatagatcaaccagccatctaagcacagaaaagctttcagcttttctgcttagtttanatgtgtagatctaatgatgcgttcaatcta

SEQ ID NO: 45116 - DNA, 101 bp, rice(Oryza sativa)
  misc_feature (71): n=t or c
ggaactcgtcaccatttcaccaaatgatattttctcttttctttatatttacgcctagtcgggtctgcgcnggcagcaccgcaatgcaaccgaatagacta

SEQ ID NO: 45117 - DNA, 101 bp, rice(Oryza sativa)
  misc_feature (71): n=t or c
ttaaagtttccaatccatgtaggcaaagtcccagagaatttattccatgacagatcaaggaaacttaactntgtccaaccctgtaaaaaagatgggaagtt

SEQ ID NO: 45118 - DNA, 101 bp, rice(Oryza sativa)
  misc_feature (71): n=a or g
actacttcctcggcgttcgggtctctagcagtcctctagcctcctgcttagccagcgccagtactgtctcnacattcgggatcgggctggcaagacaaact

SEQ ID NO: 45119 - DNA, 101 bp, rice(Oryza sativa)
  misc_feature (71): n=t or c
cacggactaaaaaattgatctttagtcccaattggtgacaccgacccagactaaaggatatttttagtccngattggtgttaccaacctgtactaaagatg

SEQ ID NO: 45120 - DNA, 101 bp, rice(Oryza sativa)
  misc_feature (71): n=a or g
ctgagctttccatggttggcttgctcaattgtgttttgttctggctcggcaaagagcatggaacaggacanccaaagaaacgggaggggaacagtttgtat

SEQ ID NO: 45121 - DNA, 101 bp, rice(Oryza sativa)
  misc_feature (71): n=t or c
ttgtgctggttgcaagatcaatgtcagtaagaccatatagaagcctatggtcaaaccagagtgttgtcganggatacaacgccttgctcctacatgcctgt

SEQ ID NO: 45122 - DNA, 101 bp, rice(Oryza sativa)
  misc_feature (71): n=t or c
ttaccttgcaagctctctcctgtggcgatgtcgacatccgggcccacctcatcgccgtccattccatcagncgccggcacgtgccccggggaagccttgtg

SEQ ID NO: 45123 - DNA, 101 bp, rice(Oryza sativa)
  misc_feature (71): n=t or c
tttttcttgcattgtgatgtgttgattctgttgtggggtgtggatctcaatctctagatgcatgtggattngaatcgatgctacatgtattgttcattttt

SEQ ID NO: 45124 - DNA, 101 bp, rice(Oryza sativa)
  misc_feature (71): n=t or c
ctaatatactgttagatgcaaattacactaccaaagtttcagattttggtacgtcaagattggtttctatngatcaaacccatattgtcacaaaggtgcaa

SEQ ID NO: 45125 - DNA, 101 bp, rice(Oryza sativa)
  misc_feature (71): n=t or c
ctgtagcgcctcctcaaacaatctgaaagccgccctggtgtacagtctcgacatctgtataacaaatggcnacctcacagccaacattggctttccctgca

SEQ ID NO: 45126 - DNA, 101 bp, rice(Oryza sativa)
  misc_feature (71): n=a or g
atgtcagctatcatatctctcttctcttctcttctatctctatcttcactccaacgccgtcgtgctgcccntcgtcttcgtcatcgtccagccctccctcg

SEQ ID NO: 45127 - DNA, 101 bp, rice(Oryza sativa)
  misc_feature (71): n=t or g
ccttttcggcctgtttaccatgagatgttgattaatggcaatagctataaggttgtaaacgttgctaaatngatgcgcgtgcatccaggccgaaccttaga

SEQ ID NO: 45128 - DNA, 101 bp, rice(Oryza sativa)
  misc_feature (71): n=a or g
accatatatggatcagaacttgaccatgtcgccctatagccagctactatagtagtactctagtataggancagtagacatgtacatgtaattctacgtga

SEQ ID NO: 45129 - DNA, 101 bp, rice(Oryza sativa)
  misc_feature (71): n=t or c
ctccaaatgaaccgtcgatgttctttaatccaccattatctacagacgcacagtgtactatatataaatantacctccttttttaatagatgacgccgttg

SEQ ID NO: 45130 - DNA, 101 bp, rice(Oryza sativa)
  misc_feature (71): n=t or c
ccaattccacgtagtccatcaacgtggtcccagcatggatcagagtgactaaagaagcttgtgacaagttncaaatggcgtagtaatttcaaccttcccat

SEQ ID NO: 45131 - DNA, 101 bp, rice(Oryza sativa)
  misc_feature (71): n=a or g
aaatattagtatatatgcgtataaggatacggtagactgtcacggaaaaaaaatatttgggtcatgacacngcccctcccctctactcccctcggctcccc

SEQ ID NO: 45132 - DNA, 101 bp, rice(Oryza sativa)
  misc_feature (71): n=t or c
gtacatgcacacacaccactacacacataacatcacacacacacctcgcatatgcttcccctaacacacgntccaaaagacataaccaacggaacatcttt

SEQ ID NO: 45133 - DNA, 101 bp, rice(Oryza sativa)
  misc_feature (71): n=t or c
gcttcaaagccccaaggccttgtgttcctgcattagtgctatgagagaaccacgagcacgacgtgtaaaanagtagcaaagcctgatcaagttaacaaata

SEQ ID NO: 45134 - DNA, 101 bp, rice(Oryza sativa)
  misc_feature (71): n=t or c
aactgaacaggccgacacaaattctgtgactgtagctcgtaattgaggccaagcaaacaattgcttaatcngttgataagtgacatttatacccgaatggc

SEQ ID NO: 45135 - DNA, 101 bp, rice(Oryza sativa)
  misc_feature (71): n=a or g
aaatcagctaaaggaaatggtttaaggctcaagatacttacaagcttggtcgccgccttcagtagagactngtaaaccctctggtgtgcctttttgtttag

SEQ ID NO: 45136 - DNA, 101 bp, rice(Oryza sativa)
  misc_feature (71): n=a or g
tgtcatctacaatcgccgtcgaggcaacgatgaagatgaccagacagatatggtaaagtttgctgctcttnccacttcccttagggaactgggcagctgca

SEQ ID NO: 45137 - DNA, 101 bp, rice(Oryza sativa)
  misc_feature (71): n=t or c
aatcctcccctcaaatccactcgatcacctctttccgtttctttcaaaaatcagcgctgagggtatgtctnggcggtggcgggatgcacgtgagatggatc

SEQ ID NO: 45138 - DNA, 101 bp, rice(Oryza sativa)
  misc_feature (71): n=a or c
taatatgtgtaacttttataaatgaagagagtgtatgctaattaagctagactggagtccttacatcaganagaacgattgatctaattaagcttaattat

SEQ ID NO: 45139 - DNA, 101 bp, rice(Oryza sativa)
  misc_feature (71): n=a or c
caaacgtccaatgaaggaggaaaaatcggacacctcaacccaacagagtagtagtagcgcaggtgcatganaagtgcatgcagccaatggagcgtgcatgc

SEQ ID NO: 45140 - DNA, 101 bp, rice(Oryza sativa)
  misc_feature (71): n=a or c
acaagatgggcaataccaatactcgttgccctgttgttcactgctcgcgatctgttcgtaccttaggcacntgatatggtagaacttgtatggacagaggg

SEQ ID NO: 45141 - DNA, 101 bp, rice(Oryza sativa)
  misc_feature (71): n=t or g
taacaatgtcttcaaattcattgtatagatctttctttgtactgtcagtgaatgtgttacctgttctctcnctgcaattttcttgatatgaaataggcagt

SEQ ID NO: 45142 - DNA, 101 bp, rice(Oryza sativa)
  misc_feature (71): n=t or g
tgccaattatgtcggtggataggaggtgagggttgtggagatgcgatgtatttaggatctttgtcaccacnaaatgttagaaatatctatcttttggaata

SEQ ID NO: 45143 - DNA, 101 bp, rice(Oryza sativa)
  misc_feature (71): n=a or g
tggtgagaagaatctggtggagagtccagctaaaaattcagctccttttgagtcaattaaaggagagccanttgatcaggagggtgttgtgcacaccagag

SEQ ID NO: 45144 - DNA, 101 bp, rice(Oryza sativa)
  misc_feature (71): n=t or c
tgacggatttgcccctgccctcctttcatgcaggaatgacgtgtcgtgtaaccgtgtataaagcattactncagtgggaaaagaagacaaactcgtttggc

SEQ ID NO: 45145 - DNA, 101 bp, rice(Oryza sativa)
  misc_feature (71): n=a or g
aacaatctggtaggacaaatccctgcagatttgcctcaacgctttcaaagcttgcaactttcagttaacantcttactggacccatccctgtttctgttgc

SEQ ID NO: 45146 - DNA, 101 bp, rice(Oryza sativa)
  misc_feature (71): n=a or g
ccccctcctccatcccggtctactagaggtttagcttcagccgctccttcagttgctcctcagcgctcganctcttcttctaccatcaagaaggcacttca

SEQ ID NO: 45147 - DNA, 101 bp, rice(Oryza sativa)
  misc_feature (71): n=a or g
gtgttcatcctgcacctgctggacagcaattccctgccattgcacaaccatcagttcacaattagaaaacngcatgatcagagagctctggcatctacagt

SEQ ID NO: 45148 - DNA, 101 bp, rice(Oryza sativa)
  misc_feature (71): n=t or c
accgacacgcgtaagctcttgaacacatgacacattccttctcccaccaaccactaacgattgctctgcantgtatttgtatgtactccaccattatataa

SEQ ID NO: 45149 - DNA, 101 bp, rice(Oryza sativa)
  misc_feature (71): n=a or c
gagttcctttcttaacaccaccttgtgtccctaagaccaagaaacaattcgaaatccaaatccaaaacccnaattcgaatccactccaaattagtcttctc

SEQ ID NO: 45150 - DNA, 101 bp, rice(Oryza sativa)
  misc_feature (71): n=a or c
ggaacttcctgttacgaacctccatcatggtctcagttaacacaatgctttggcaaatccacactggatanatgtgctacagatacaatacagagaaatgg

SEQ ID NO: 45151 - DNA, 101 bp, rice(Oryza sativa)
  misc_feature (71): n=t or c
tttttagttaaaactgctaagtcataagttcatgaactgaattatgaaatctagcttttatgcaaataagncgagccatccttgaacccatgtgtgcacta

SEQ ID NO: 45152 - DNA, 101 bp, rice(Oryza sativa)
  misc_feature (71): n=a or c
agctcgtagcagcagcatcgatcgatctctcggatggatgggtagggatacgcgtgcaagtacggcgcgantcacgatgacacgtgggaccccctgccctc

SEQ ID NO: 45153 - DNA, 101 bp, rice(Oryza sativa)
  misc_feature (71): n=t or c
tatgctaaacagatcgacttgttagatgttcatatctctcactggcaatgcgaatggcagaacaaatagtnttattcattcgagaattaagcacgcagaag

SEQ ID NO: 45154 - DNA, 101 bp, rice(Oryza sativa)
  misc_feature (71): n=a or g
actatcggttaaccgatctgtcggtcagtactcttctataggtgagttcggtttccttttctcaaagaccnatctttttaaagaccgaattaaccggaccg

SEQ ID NO: 45155 - DNA, 101 bp, rice(Oryza sativa)
  misc_feature (71): n=t or c
attaaattctctctttttatatgctcaaaagacactgctttccttcatgtgatatggttaccttttgggcnaatataggagagaaagaatactatgagaaa

SEQ ID NO: 45156 - DNA, 101 bp, rice(Oryza sativa)
  misc_feature (71): n=a or g
taacattcagggacagaatgacagtgtaagtgagtttgaaatctggcaaggacttgcaaacctgtactccngtctctcaatctggagagacgctgagatat

SEQ ID NO: 45157 - DNA, 101 bp, rice(Oryza sativa)
  misc_feature (71): n=t or g
atctcatatccaagtttaatttcaacatggcatgatcaagttcaatgaaccgtaaccatcctatgcttgtngcaatgcagcatcatagctggctgtcggtt

SEQ ID NO: 45158 - DNA, 101 bp, rice(Oryza sativa)
  misc_feature (71): n=a or g
gaataattgtttaaaacctttgtgattaaaaaaatcattcaatcaacatttatcgaacacgacattacccngtgcaacgcacgggcattttgctagtaaat

SEQ ID NO: 45159 - DNA, 101 bp, rice(Oryza sativa)
  misc_feature (71): n=a or g
aggtagcacccaaaaactgaggcaaacagtgatataatcttatcagtaccaggcagggagctatatcattntatattattactgataatgcagattaatta

SEQ ID NO: 45160 - DNA, 101 bp, rice(Oryza sativa)
  misc_feature (71): n=t or c
taaatgcctggagttatttgggtcatcactgttaaagacagggggtttcaacttttaaggactatattcgnagtcttctcatatcagtgcatgtgcatcct

SEQ ID NO: 45161 - DNA, 101 bp, rice(Oryza sativa)
  misc_feature (71): n=t or g
ttttgcctaatttggtctacttcatcgataatctgggcctcggttgcatcagatccagagatcactttcanggattttgttaatttggctaagtatttgac

SEQ ID NO: 45162 - DNA, 101 bp, rice(Oryza sativa)
  misc_feature (71): n=t or c
ggcgtcggatccggacactcccgagcgttggtgggaaggggtggagaactggaagggcagtgccggatctngccgttcctttgcggcggtgggaaggggcg

SEQ ID NO: 45163 - DNA, 101 bp, rice(Oryza sativa)
  misc_feature (71): n=a or c
tagtaaaaccaaatcttaggtagggaatatggtccataaatgtggttatagtaaaatgctggccaaacttnggaaaacttaatatgcaataaacgaatctt

SEQ ID NO: 45164 - DNA, 101 bp, rice(Oryza sativa)
  misc_feature (71): n=t or c
ataagagctttcacgcaaatgatctgagcataacagtttgggcaactggatttgataatgaactgccgtcngaccgcaatttctatacagtcaaactagag

SEQ ID NO: 45165 - DNA, 101 bp, rice(Oryza sativa)
  misc_feature (71): n=a or c
gaaattaggacactgaggagggcactagattcagttccggtaaagttccaaaattcggtggctccagtgantcagtgagtccctcgctccgccatgtgctg

SEQ ID NO: 45166 - DNA, 101 bp, rice(Oryza sativa)
  misc_feature (71): n=a or g
agggataggggatgaacgatagacttgtaggtaggcctttaagaggcctcttagcacatgacacgaaaatnggagaccgatttttacatacgcacgtgaaa

SEQ ID NO: 45167 - DNA, 101 bp, rice(Oryza sativa)
  misc_feature (71): n=t or c
tttatcctgctgtcgatcctttggattccacatccagaatgttgtctccccatgtactgggtgaggaccantacaacacagctcgtggtgttcagaaggtt

SEQ ID NO: 45168 - DNA, 101 bp, rice(Oryza sativa)
  misc_feature (71): n=a or g
gggagggcatctcccttgtgggtgcatcaagaattgtcatcctagatgttcacctgaacccgtctgttacncgccaagccatcgggagcacattcaggcct

SEQ ID NO: 45169 - DNA, 101 bp, rice(Oryza sativa)
  misc_feature (71): n=t or g
acttagcttaattgatagattcctatttgatgacttcatttaatggttaaaatcaaggggcgccacaaatnagctttaaagaaagctaaagaaaggctttg

SEQ ID NO: 45170 - DNA, 101 bp, rice(Oryza sativa)
  misc_feature (71): n=a or g
tactgagcaacactcaccatgttaattgcacggtgaaaagaaatgcaaccttttctatcatggagtacagngaaaaattaaatcagcattgcttgatcgtt

SEQ ID NO: 45171 - DNA, 101 bp, rice(Oryza sativa)
  misc_feature (71): n=a or g
ggaagccgaggctgaccgagctgcccttgagtaagctaaggagattatcatcgaggacaagagccccgtcnctgctcgtgatgaggtagtgttgtagtgga

SEQ ID NO: 45172 - DNA, 101 bp, rice(Oryza sativa)
  misc_feature (71): n=a or g
gaggagcatcgtgcaagggatcttttctatgcactctgggttcctgatctattcatgcaaagagtccaaantaaccaagaatggtcattgttttgtcccaa

SEQ ID NO: 45173 - DNA, 101 bp, rice(Oryza sativa)
  misc_feature (71): n=t or c
aacattgatttaattaggataggtttttggatcaatacattggatggaaaggtttgtttgtctaagcctanccactcaacaagtgcaagttgcatctcaga

SEQ ID NO: 45174 - DNA, 101 bp, rice(Oryza sativa)
  misc_feature (71): n=a or c
cctccattgccgcaaacaagacggtgtgcgacgacaagtgaggcctcaatcacacaatgcaggtaaagtcnctggacctgcaacaccaggaattccatgtt

SEQ ID NO: 45175 - DNA, 101 bp, rice(Oryza sativa)
  misc_feature (71): n=t or c
ttatgtgcgctaaaaattttacctagattagagtcgcaccccgagaaatttcaatcgtgcaatcttactcnatcgtgatatataataacatacgactggat

SEQ ID NO: 45176 - DNA, 101 bp, rice(Oryza sativa)
  misc_feature (71): n=t or c
gctgatgcctccggcgagacttgccagcatccatcctgcaagaaggaggatcgaaccttctccatcatgtnccagatcgcgtcgctcagcttcttcctctt

SEQ ID NO: 45177 - DNA, 101 bp, rice(Oryza sativa)
  misc_feature (71): n=t or c
ctgagacaaatgactgaaggggtaagaaagagttacccctagggaggttaagtccccttgcccttggcccnacgtcgaatagtccgatttgaaatcggact

SEQ ID NO: 45178 - DNA, 101 bp, rice(Oryza sativa)
  misc_feature (71): n=t or g
gtttgctttccacaactaaatagaagcatcagtagcaaactttgcatccttatgtggagcatctcttccanctttccatatcccaactgcactgaatgcag

SEQ ID NO: 45179 - DNA, 101 bp, rice(Oryza sativa)
  misc_feature (71): n=a or g
aatgtagtcaagataaacactctggacattgataaacatgcaggacagctcaaagtccttaatccatatcnactgtgcacgatcgaatatcatctgttaac

SEQ ID NO: 45180 - DNA, 101 bp, rice(Oryza sativa)
  misc_feature (71): n=a or g
ataactatttatatcgaatttattagaaaaaggtacacagaagaacaacccattagaatcgatgcgtcagnggccttcgcctagcctcacccacactgcat

SEQ ID NO: 45181 - DNA, 101 bp, rice(Oryza sativa)
  misc_feature (71): n=t or c
acagcaagctgttgtcgttttctctcttctttggcaagggttctgagctctttcctgatgtccctttttgnattcttatccttagctttcagcaatttgct

SEQ ID NO: 45182 - DNA, 101 bp, rice(Oryza sativa)
  misc_feature (71): n=t or c
atatatatatatatatatatatatcatatgcgcacaagcttctcttacacactccgtacacaccaaataanaaatgtcatgaaaaactatacaaaatattg

SEQ ID NO: 45183 - DNA, 101 bp, rice(Oryza sativa)
  misc_feature (71): n=t or c
agcagacagtgttggcatatctaccacccgaggcaattgttgccactttatttgaataaagaatcgttgtnatattgattttagggattgggcttgttttg

SEQ ID NO: 45184 - DNA, 101 bp, rice(Oryza sativa)
  misc_feature (71): n=t or g
caccctaccaccccattgacagcctagtgatcacctcaatcaatggacaatggtagtagtaagtaagtagnccatggcgccatgcatgcatgcatgcattt

SEQ ID NO: 45185 - DNA, 101 bp, rice(Oryza sativa)
  misc_feature (71): n=t or c
gatgaacctttccccttggccaagtacttctgctgtatggcccttgaaatactccgacttgccgatggcangatatcgtggtgtctcgccgagttctggta

SEQ ID NO: 45186 - DNA, 101 bp, rice(Oryza sativa)
  misc_feature (71): n=t or c
gggcacctaattttggggcctgttcgatcactcatttcacacgccctcattgacggtcttgatgtaaagtnggaggtatataggtcactgacaaacaagac

SEQ ID NO: 45187 - DNA, 101 bp, rice(Oryza sativa)
  misc_feature (71): n=t or g
tttcctggcagcggcgtggtctcgtcgtcgtcgttgttggtgtcttgcagctagtggaagtggaggatatnctggatttgaagcttgaggtgatggggcgg

SEQ ID NO: 45188 - DNA, 101 bp, rice(Oryza sativa)
  misc_feature (71): n=a or c
agcaagcatgttggctaataatcgaaggaaggaagaatgggaaagagtgttgaagtctataggttccacanatgagaaatatggagagtgggataccatac

SEQ ID NO: 45189 - DNA, 101 bp, rice(Oryza sativa)
  misc_feature (71): n=a or c
atcgacccacttatatgctctcagtacgtgcaacccgagttcaaagtatgcccatgttatcaccatgtgcnagcaacaacgacgtacacatccagcgcggt

SEQ ID NO: 45190 - DNA, 101 bp, rice(Oryza sativa)
  misc_feature (71): n=a or g
aaatcgaatttatttaccctttaagtgacgggcccttctactaaaaaacttggcccaaaatatttggcagncctggttccagtcaattccccatgggtggg

SEQ ID NO: 45191 - DNA, 101 bp, rice(Oryza sativa)
  misc_feature (71): n=t or c
cgcatgggagccggggacgagtccattggagttagttgcatgttatatgttcaacacacgcgattttgaangtgcgcacgagcccataaactcatgcacac

SEQ ID NO: 45192 - DNA, 101 bp, rice(Oryza sativa)
  misc_feature (71): n=a or c
gtggtttctccaacgctttggatcaaactaatagcccaacctacaacatggttacgggcatagagaaaaangagttggacaatgaccatgatgatgatatt

SEQ ID NO: 45193 - DNA, 101 bp, rice(Oryza sativa)
  misc_feature (71): n=a or c
cgagtgaccaacgatactcgactcgcttggcttgccatgcgttatttctcggccaacaatcctttgcttgngccaatcttctttggcaagctaaaagtccc

SEQ ID NO: 45194 - DNA, 101 bp, rice(Oryza sativa)
  misc_feature (71): n=a or g
ttgtgacgtccgtttcagtgcgtatatgcatgttgtactcctccttacttgattacatgtatgcatgcaanttaatgaatcaatcaatggtcggattttct

SEQ ID NO: 45195 - DNA, 101 bp, rice(Oryza sativa)
  misc_feature (71): n=a or g
atggtctcgtagataatggcattatcattggtcgatctttttgtgtaccagggtaccagcccagaagacanagaaaatgatgcccaatatcatgttgtggc

SEQ ID NO: 45196 - DNA, 101 bp, rice(Oryza sativa)
  misc_feature (71): n=a or g
cctccaatatttagctagaacaaggttatttttcttggttttgttaagagtaaattccctatatacccttnaaaacttgcccaatccttttcattcccctg

SEQ ID NO: 45197 - DNA, 101 bp, rice(Oryza sativa)
  misc_feature (71): n=t or c
ccagaaagatatttttttcctcacggtttttaacatcaggaatggcacaaaaccgtcaaattgatcatccntgtcagccatcgtcgtgaatgtcccgtaga

SEQ ID NO: 45198 - DNA, 101 bp, rice(Oryza sativa)
  misc_feature (71): n=a or c
aacgtgttgccagaactactttctgcttatttaggccattaggatatggaatgccagcttcagctaaatcnaaataaccccataaatcatctatcagaagt

SEQ ID NO: 45199 - DNA, 101 bp, rice(Oryza sativa)
  misc_feature (71): n=a or g
acaagacacagccccaaatgttgggatctatcatccatagcctattttttcacatggtcagttgtatgtcncattgttaaggggtgtgtcaagacaaacaa

SEQ ID NO: 45200 - DNA, 101 bp, rice(Oryza sativa)
  misc_feature (71): n=t or c
ctctgaagctcttcagcaagattcttgttttcttccccaaaagtgttcaccttctgcaggaaatctgcttnattcctcttgctgttaaccagttcttccga

SEQ ID NO: 45201 - DNA, 101 bp, rice(Oryza sativa)
  misc_feature (71): n=t or c
ttccgctcgcctcgcacctcttctcttcctctaagtcctctcattagctcccttagaccgctccggacgtngtccacccactcatcttgccgtcgccgtct

SEQ ID NO: 45202 - DNA, 101 bp, rice(Oryza sativa)
  misc_feature (71): n=a or g
aagtcgattccccatacatcaaatagctcgacttgaagattgtttgtcagtggcattgcatcgcgagcagngatccctccatgcttctggcaacttgtaca

SEQ ID NO: 45203 - DNA, 101 bp, rice(Oryza sativa)
  misc_feature (71): n=a or g
gtgtatgttctgattaattaattaggttcgttttctctctgcaatataactatggtacgatacgtactatngtaatcgtcactttgataatgatggatgct

SEQ ID NO: 45204 - DNA, 101 bp, rice(Oryza sativa)
  misc_feature (71): n=t or c
caattgatgcagacgcatttgttcttctacctcggttgaagctctgaaatcgtgacctcattctctgaaanggggttactggacatcttgttactgctgat

SEQ ID NO: 45205 - DNA, 101 bp, rice(Oryza sativa)
  misc_feature (71): n=t or c
agctatagctccttatagaatttctcagctttcgaaacacatcagattttcacccaagtttaagaatatanagttatagaattcagaaaataaattaaaca

SEQ ID NO: 45206 - DNA, 101 bp, rice(Oryza sativa)
  misc_feature (71): n=t or c
atggcattcgtgattggttttacccaggagccggagtacaccaggattcaccccctcagtggcgagtttcngcatcaggttcgcttggaggtccatggcat

SEQ ID NO: 45207 - DNA, 101 bp, rice(Oryza sativa)
  misc_feature (71): n=t or g
tttgagatgaggaaagcccattagacccaaagtaccagcaccataaaaaccctagccgccctcctcccctncctcacagccgcctccactcctctcctctt

SEQ ID NO: 45208 - DNA, 101 bp, rice(Oryza sativa)
  misc_feature (71): n=a or g
tggtcgtctaccgtcaccaattggtttcttcttctgcatagttggtggagttcgccatcgctgctgatggncaacttcgtctccacaaccgacatcttcgt

SEQ ID NO: 45209 - DNA, 101 bp, rice(Oryza sativa)
  misc_feature (71): n=t or c
ggacgtgttccggctgccggtgacaaggacgaagacacgcatgaaagtggcttaattaagcaggtgctgtngttaggaaacgataggcaaacaaacgataa

SEQ ID NO: 45210 - DNA, 101 bp, rice(Oryza sativa)
  misc_feature (71): n=t or c
ggctcgagcgtgcgcacgagagggaggccgagcttgagatggcattgggcaggatggtgccgtccttcctngccctcaactggagcctcatggtggccaag

SEQ ID NO: 45211 - DNA, 101 bp, rice(Oryza sativa)
  misc_feature (71): n=a or g
ccgagtcagtcaaacgcaccgtgattttgtgcaacgacgacccacagaaaactcatggcagctagtagtantacgtgattatatatatacatatctcttcg

SEQ ID NO: 45212 - DNA, 101 bp, rice(Oryza sativa)
  misc_feature (71): n=t or c
acaataagatccggcactctggccttttcgccgatcgcaacaacaagattcgacatatgcggcaggctcangacatggctgatgtcgagcctgtcaagatg

SEQ ID NO: 45213 - DNA, 101 bp, rice(Oryza sativa)
  misc_feature (71): n=t or c
atgaaccaccaacgcccttccctgccctgcctgtactctactgctccctccgtaacaaaaataagtgcagncatgattttccgcgtccaattttaatcgtt

SEQ ID NO: 45214 - DNA, 101 bp, rice(Oryza sativa)
  misc_feature (71): n=a or c
tagtattcttgttaccggctcttatgttgatgaggcctatctggttcaaggccacgcactcaaacatggtncaaatgattttgtttcccggctatacaaat

SEQ ID NO: 45215 - DNA, 101 bp, rice(Oryza sativa)
  misc_feature (71): n=a or g
acacctcccgccattatatgtattcctattatattaatatattcccttgtctcaaaatataagtgtttggnttggatagggcacatcctagtattatgtgt

SEQ ID NO: 45216 - DNA, 101 bp, rice(Oryza sativa)
  misc_feature (71): n=t or g
acgagctaaaaggctatcttgctcggctcaaaagctggctcgttagacttgttaccgagctatttatcttncttattatatattgataatttcaaatttat

SEQ ID NO: 45217 - DNA, 101 bp, rice(Oryza sativa)
  misc_feature (71): n=a or g
agacaggttcagtttgctgtcgttacttgtgggttgcttttttgtgaatttgctctggagaaaatggcggnaaattaaacatattaatatgagtcaatgga

SEQ ID NO: 45218 - DNA, 101 bp, rice(Oryza sativa)
  misc_feature (71): n=a or g
gattactattctgtatttatgctatgctggcatcaataataaagattactacactcatataaactgaaggncagcgatctctacgcaaagaagagaataaa

SEQ ID NO: 45219 - DNA, 101 bp, rice(Oryza sativa)
  misc_feature (71): n=t or c
ccttcaataccatttgtgaaacgctcgaactgacccaaggcttgtctgagaaacatctccacaccgctganaactttaaccccacattcttctgcttctcg

SEQ ID NO: 45220 - DNA, 101 bp, rice(Oryza sativa)
  misc_feature (71): n=a or g
aaaaaagctgctccctagagggacgcccatcaccatctatcattatcatatcgagccatctctatcagganaaatccttagctgctcataaacatacatat

SEQ ID NO: 45221 - DNA, 101 bp, rice(Oryza sativa)
  misc_feature (71): n=t or c
agtcgtataagaaatcattttaaaaaactcgcatattaatttgggatgagagtcggacttctgattacttnagaatttttgccagatcataagaaagcaat

SEQ ID NO: 45222 - DNA, 101 bp, rice(Oryza sativa)
  misc_feature (71): n=t or g
gaaatctggaatgttggttgaaagctgatagatgcaagattgcaaggggaaggaaatattacccttttgantattgtctctttcttccacgtctcaacacc

SEQ ID NO: 45223 - DNA, 101 bp, rice(Oryza sativa)
  misc_feature (71): n=t or c
tttgagaactgctagagtacggaatcccgttcgaacgggatacattatgaatctaatcccctgtttttttncgttcctatgctctttgcctcctcacctct

SEQ ID NO: 45224 - DNA, 101 bp, rice(Oryza sativa)
  misc_feature (71): n=t or c
gaaggtgaggtggccatgggtgtttgagcaggtcgacgctgccatggaggagtggatcgtggagcaaatgnataccgtgagtcccttttggttccccgcac

SEQ ID NO: 45225 - DNA, 101 bp, rice(Oryza sativa)
  misc_feature (71): n=a or c
ctgattccggttattaaaccgccttgtccgcattcaactcgctgaatccccccaccggcatagttttcccnttttctttttctcactttgtttcaaggctt

SEQ ID NO: 45226 - DNA, 101 bp, rice(Oryza sativa)
  misc_feature (71): n=t or c
gattttttgtgctccacaaacctctcggtttgttttctcccctataatagctctatcccctcatttccccnctctctctctctctccctcatccaggtgtt

SEQ ID NO: 45227 - DNA, 101 bp, rice(Oryza sativa)
  misc_feature (71): n=t or g
gcagatttaatgcaatcaaatgcagacagaaaccaaatccgccaggctactgaccatatgaatgagatgcnttatagggaggagatgctgtggctacaacg

SEQ ID NO: 45228 - DNA, 101 bp, rice(Oryza sativa)
  misc_feature (71): n=t or c
atgtttccttgatagttcaccaactaatatgatttcccttttctcaatatctaattatatatatgagcganaaaaaatattgttgtaaaaaaatatatttt

SEQ ID NO: 45229 - DNA, 101 bp, rice(Oryza sativa)
  misc_feature (71): n=a or g
tgaactatttctaatagagatgctcttgctctccagagtagatgggtgattgctataactaccttaatccnagtagcgcgttttggaaggatcttatcagg

SEQ ID NO: 45230 - DNA, 101 bp, rice(Oryza sativa)
  misc_feature (71): n=a or g
tttatacatatgcccatatggaagatacaattgcataaatatcgaaaagattgccacgtttcaatccagcngtccaaaatataataaaatatatttgttta

SEQ ID NO: 45231 - DNA, 101 bp, rice(Oryza sativa)
  misc_feature (71): n=t or g
tcttgctttcttatctcttctctctcgttcttttttctctctcgacaaagcggcaagggcgggctggcaanggcggggtgcggcgcacggcgcgcggcgag

SEQ ID NO: 45232 - DNA, 101 bp, rice(Oryza sativa)
  misc_feature (71): n=t or g
cgcaaactgttagggcagtgagagaactgaactgtaccgaaaagaatggtgtcgaggctcttatttggcangtactcgtacaccagtagtttctcgccttc

SEQ ID NO: 45233 - DNA, 101 bp, rice(Oryza sativa)
  misc_feature (71): n=t or c
aggagtgcttacaggtttacaatcttgcatccaactcggcgcagaatgtcattggcatacttttcctgagntaaaattattccactgttcacttttgctca

SEQ ID NO: 45234 - DNA, 101 bp, rice(Oryza sativa)
  misc_feature (71): n=a or g
gtcttgcgaggcagcgagggatctgaagaattctgatattctgttgactctgcattgagcactacattcantaattgctaaagtattctttgtataaacac

SEQ ID NO: 45235 - DNA, 101 bp, rice(Oryza sativa)
  misc_feature (71): n=a or g
cgaggactactcgagaggtttcatcccctacgttgcctcaatcgccgaaatctccaggtacctagctactngctactgcattcgattcgaatttgccgctc

SEQ ID NO: 45236 - DNA, 101 bp, rice(Oryza sativa)
  misc_feature (71): n=t or c
gtccagtattcattacccaggatggaaagctgatgctctataaccctctatcacaaacttctttaaagtgnttggtggtaccatctctcccaatacattca

SEQ ID NO: 45237 - DNA, 101 bp, rice(Oryza sativa)
  misc_feature (71): n=a or g
gaattatgggtaatgttgcaatcggccaagctttggttgtcgtccaactgcctcgcgttgaagacgaaacnctgatctctcggatggattcctgccatcca

SEQ ID NO: 45238 - DNA, 101 bp, rice(Oryza sativa)
  misc_feature (71): n=a or g
tgatcgtatatatgattcttttttgacgaattcgatgtgtggtgatcaatggatggatggtcaggtgctcngcgacgccgggaagagggcgctgtacgacc

SEQ ID NO: 45239 - DNA, 101 bp, rice(Oryza sativa)
  misc_feature (71): n=a or g
aaaaagatttgaccaattcacaatgcgattctgccaagaacgttgtcgtcggtatcccaatgctagagtcntgctttgtagtgtcttctcttgagggcgaa

SEQ ID NO: 45240 - DNA, 101 bp, rice(Oryza sativa)
  misc_feature (71): n=a or c
tattctgatctagggctacagtgagagctagtagcatggatagtgatttacctgattctgcaactgccaanctcccagatgtagaggaagctttgtcgcca

SEQ ID NO: 45241 - DNA, 101 bp, rice(Oryza sativa)
  misc_feature (71): n=a or c
ttggggccggcgtcgcgggcggtgacggcgaaggagaggacgttgttgctgtcggcctcgatgtcgatggngaggcccgggggttggagggcccggttgcc

SEQ ID NO: 45242 - DNA, 101 bp, rice(Oryza sativa)
  misc_feature (71): n=t or c
actttcctggcgcgactgcacggtgtgatggctgtcaattccacgcaagtttcagactacaaaattgtttntaaagacagataagcccaaattttgtcaag

SEQ ID NO: 45243 - DNA, 101 bp, rice(Oryza sativa)
  misc_feature (71): n=t or c
agccagcgtgggacccacgtggaccccacatctcaggatgccacgcgtaagcaggcgatcctctcccttcntctcctttcctcctctctctcctctctaga

SEQ ID NO: 45244 - DNA, 101 bp, rice(Oryza sativa)
  misc_feature (71): n=t or c
gatagaaacccagctagctcaattggcttcataggtacctgcaagtgaatctgggagaattccggggcagnctgactcctccattgaaaatgtcaaggcga

SEQ ID NO: 45245 - DNA, 101 bp, rice(Oryza sativa)
  misc_feature (71): n=t or c
atgtcctagcagaccttgaagaagttttcagtgtagccgtctagccctagtgccttatcaattggcatctncttaattacccggtagatctcctgctctgt

SEQ ID NO: 45246 - DNA, 101 bp, rice(Oryza sativa)
  misc_feature (71): n=t or c
acaaaacatgattaactgatcagtgactaaaacatcttaattaatttatttaaaagcatactactctgtcncataaaaagacaaacttacgtgttcagatt

SEQ ID NO: 45247 - DNA, 101 bp, rice(Oryza sativa)
  misc_feature (71): n=t or g
acataagattctaatttgcgtatacaacaagatagatcctaataacactcaagctgttttcatcgtttatnattacaattacacaacattatatacagcag

SEQ ID NO: 45248 - DNA, 101 bp, rice(Oryza sativa)
  misc_feature (71): n=a or g
tccttcttttataaagtgctggtaattcaaaaactagtggtgatgccagttatgtactggcgttgattggntattactattatgagccttattttcccttt

SEQ ID NO: 45249 - DNA, 101 bp, rice(Oryza sativa)
  misc_feature (71): n=t or c
ctgcgagaggaagtcggcgatcttcgtcaacaattggatctcacagtcaaggcgaagcaagcttctccacngtcgtcttcccctcgagttccgttgacgga

SEQ ID NO: 45250 - DNA, 101 bp, rice(Oryza sativa)
  misc_feature (71): n=t or c
agttctcaagcaaatgagaccattttgcaggaacatgagacacgacctgaaagtgtcatgagcaatgatgntcaaaccattgacagtcagtccaattctag

SEQ ID NO: 45251 - DNA, 101 bp, rice(Oryza sativa)
  misc_feature (71): n=t or c
gagtagtcatgtacggattacaaactactccccgtcttcatctcaaacttttccaagagagtgaaatatanatgattagttcttaaatttaagggtagtgt

SEQ ID NO: 45252 - DNA, 101 bp, rice(Oryza sativa)
  misc_feature (71): n=a or c
agtacaaagattgtaagaccttgtttgttgtaaaagaataatgaggtatctgccttggatccctgaaatcnaagttgctgcaatttctgactcaacctagc

SEQ ID NO: 45253 - DNA, 101 bp, rice(Oryza sativa)
  misc_feature (71): n=t or c
tacccctcccacctcacccaccccaggaccctaattcgtcggcctacgccagaatttgggttgtcgcccgngccagagaaggagaggagttcgtcggagtt

SEQ ID NO: 45254 - DNA, 101 bp, rice(Oryza sativa)
  misc_feature (71): n=t or c
gtactgtatgcctgattcaagtcaacctgatcagtctcggtttgatacggaatatatggaattttcgatangcacaaggcagagatgatcactagttggac

SEQ ID NO: 45255 - DNA, 101 bp, rice(Oryza sativa)
  misc_feature (71): n=t or c
atttccaggaataccgcattgaactcagagttaagatttgcttcgcttcgttctcctatcctcagagtaanggacaagtcgagcgggctaacggtattgtg

SEQ ID NO: 45256 - DNA, 101 bp, rice(Oryza sativa)
  misc_feature (71): n=t or c
ggcagggaaaggcatcatcaccttctgcaaaagcttcgaatctgacattattggagcaagagcaggaagcngatggagtgagagcgcatcaagcagcacga

SEQ ID NO: 45257 - DNA, 101 bp, rice(Oryza sativa)
  misc_feature (71): n=t or c
gggctggcatctctagcagggaagatagagaatggcagcgttcgggagacgggagacgacggtatgtcggnagcaataacaatactctcttcgttcaaaaa

SEQ ID NO: 45258 - DNA, 101 bp, rice(Oryza sativa)
  misc_feature (71): n=a or g
gggggagcttctagctattgcagctttctctagtagaagctccaattcttccaaacaatttatattgtcanaaaatgaactacagtcaaaaactgggtttt

SEQ ID NO: 45259 - DNA, 101 bp, rice(Oryza sativa)
  misc_feature (71): n=a or c
cagggggaatcctgcatatgcatgcatgcatcgctatcttcttactgttcatgcagcatccatccacttgnttggaataatcacatcattacatacagcta

SEQ ID NO: 45260 - DNA, 101 bp, rice(Oryza sativa)
  misc_feature (71): n=t or c
ccaatcttttctttttcaacgtgagcgatttggggaactagaataaccgagtcaatcttagatagtaatgntctgatgttgcacagtaactgaagcaagcc

SEQ ID NO: 45261 - DNA, 101 bp, rice(Oryza sativa)
  misc_feature (71): n=a or g
tgtgtaaagctctctttacctaaccccctcttctgcccccctcacagatctgtctccatgctttatacatntacgtatacagagtgtacaagtacagtctg

SEQ ID NO: 45262 - DNA, 101 bp, rice(Oryza sativa)
  misc_feature (71): n=a or c
gggtcttatgataacgtgtatcgcatccctatcttatccaaattttgccacctatcaagtagtaatatcgnttcaactgtacctcccaaatctcctgttca

SEQ ID NO: 45263 - DNA, 101 bp, rice(Oryza sativa)
  misc_feature (71): n=a or c
caagaagttgcatgttgactatatctacaagatcatccatctgttgtgcctccctgagatgatttgtctanaatcttcctcttcactaattactcctttta

SEQ ID NO: 45264 - DNA, 101 bp, rice(Oryza sativa)
  misc_feature (71): n=a or g
aagtcctccctcctcacccagaggcatggcggtggacttcaagcggtgatgtcagtcttcaggaggcgtcnaggagcttaggggtggtggactcaccggcg

SEQ ID NO: 45265 - DNA, 101 bp, rice(Oryza sativa)
  misc_feature (71): n=a or g
gaagagcagatcgagaccgcgatcgatcggctgggctggccacctttttcgcgaacgcgcaaaaaaaattncatgttgatatattagaagaaaaaaagttt

SEQ ID NO: 45266 - DNA, 101 bp, rice(Oryza sativa)
  misc_feature (71): n=t or c
atttggtaatatagtgcgtgagggttgtggtcctgaaggctatgttgaaggatgtcttttgacccgacaancatgcggaaggatattttataaaatgcgta

SEQ ID NO: 45267 - DNA, 101 bp, rice(Oryza sativa)
  misc_feature (71): n=t or g
aaaggagtgatcgtggtcaaggggcttcagctttcgcctgcttcaaaatgcgttttggccataatcaaganagcagtacgcaatgttgaggccgaaccgca

SEQ ID NO: 45268 - DNA, 101 bp, rice(Oryza sativa)
  misc_feature (71): n=a or g
gactcccagctaattacacgttttttggatgtcccatggcaaactttgcctaaaatactccctcaatttcnaaatgtttgacgccgttgactttttatcac

SEQ ID NO: 45269 - DNA, 101 bp, rice(Oryza sativa)
  misc_feature (71): n=a or g
gccccaccccctcttctccccatcacccgcgttgtcctatcgtcgcagattcacaggaccccaacctttcntggcttattcggaatatagatagtaaaaac

SEQ ID NO: 45270 - DNA, 101 bp, rice(Oryza sativa)
  misc_feature (71): n=a or c
ccatggtggccgtcctactccactggctactcctcggtgaagtttgtcattggtgtcaagcggcagcagancggcgatgccggctcgccgctgtcgcggag

SEQ ID NO: 45271 - DNA, 101 bp, rice(Oryza sativa)
  misc_feature (71): n=t or c
gatgtaaatatcaggcattacgtgaaccgtaaacaagcttgatttgtacaaaataaaatagagcgagcccncggcattaaaccgtagtcggtttaacatca

SEQ ID NO: 45272 - DNA, 101 bp, rice(Oryza sativa)
  misc_feature (71): n=a or g
ccgtgggaactgtgggtggcgttgactgccatctacaaattttgaaaaagagaaaagaagtcagtaaccanttttataaacagagtaagagaagaagaaaa

SEQ ID NO: 45273 - DNA, 101 bp, rice(Oryza sativa)
  misc_feature (71): n=a or g
taatcatctctttttttgggggaagtcaaacttggtcccaccaacctgcctcacaaagtcagaattaaagnacctgaatgcagctggagaccagccgcata

SEQ ID NO: 45274 - DNA, 101 bp, rice(Oryza sativa)
  misc_feature (71): n=t or g
gagcccggccttcggcgtcccgggcctctcctcccaatcgaacggcacggacgaggcgttaacggtgtacnacgcccgcggccggaacccctcgtcgtcgt

SEQ ID NO: 45275 - DNA, 101 bp, rice(Oryza sativa)
  misc_feature (71): n=a or g
tcctcgagatcgcgttgtgacttcacgttatgtaggttctccctctgcggacgtcatcggaccactcgcgnaccaccaggcagcggcgtcattgaaggagg

SEQ ID NO: 45276 - DNA, 101 bp, rice(Oryza sativa)
  misc_feature (71): n=t or c
ttctttggcgaaatttcataggatgacactcgaacaagataaagaagacagattttcaggggctattaganatggaattgggatcaatgataatgacatgg

SEQ ID NO: 45277 - DNA, 101 bp, rice(Oryza sativa)
  misc_feature (71): n=a or g
tgatggtagggttcattactcaattaaaccccggataaagctcatatgcatgaatcatcattcatatccangagcacgcctagtcctgattccaggaggca

SEQ ID NO: 45278 - DNA, 101 bp, rice(Oryza sativa)
  misc_feature (71): n=a or c
tgtgtgttgaagtgtggatggagacctcattttataagctccatatgacagttatggctatgggaaatgtncaaactgccctccaaccgacattgggaaat

SEQ ID NO: 45279 - DNA, 101 bp, rice(Oryza sativa)
  misc_feature (71): n=t or c
cgacgtacgcagtggtcgcttcgacaacaccaagaaattggagaagaccccttctggtctaggacctggangaacttgtcacaaacggttcgatttcttgt

SEQ ID NO: 45280 - DNA, 101 bp, rice(Oryza sativa)
  misc_feature (71): n=a or g
tcggtagaggtggatgaggcatgcttctaccttatgggccttgactatgggcctaaaagagatggatttgntcctcggtgatggtggcgggcaatggacga

SEQ ID NO: 45281 - DNA, 101 bp, rice(Oryza sativa)
  misc_feature (71): n=t or c
gcggcctcgagcaacgacgatgaccttcgattggcatccgcctgacaacgacgacgacaaccttcaagtangacaggggcagggagatctggaggtgaaca

SEQ ID NO: 45282 - DNA, 101 bp, rice(Oryza sativa)
  misc_feature (71): n=t or g
tctcacaggtaaagcaccttttcttcctctcacattcgtcttcctcgatgcaccctctccttttcattttnacgcaatctttccttccgccatctcctttc

SEQ ID NO: 45283 - DNA, 101 bp, rice(Oryza sativa)
  misc_feature (71): n=t or g
tcgccgccgccgcatgagcgccctcgtcaagcctggccagccgcaagatcccacaccatctttgatcgcangagtcatcaaaggtaagaaagagcaagtta

SEQ ID NO: 45284 - DNA, 101 bp, rice(Oryza sativa)
  misc_feature (71): n=t or c
aaagtatactagtcactcaattaattgaacaactaccgttgtctttacagtactaccatactagcactagncccatgtgctccacaaaagtatactagtca

SEQ ID NO: 45285 - DNA, 101 bp, rice(Oryza sativa)
  misc_feature (71): n=t or c
cctacctccgccagcctcctcggccttgtcgtcattgccttcctcatccctttccctctcaacatctcccnggtgcagtggccgcacggtggctcgggatc

SEQ ID NO: 45286 - DNA, 101 bp, rice(Oryza sativa)
  misc_feature (71): n=a or g
tagatcttgttgggcttgaattgcttcccgtttctcctcttcaaagaaagccttttccttctccaaatccnatttaatcctttgtatttcttccctttctt

SEQ ID NO: 45287 - DNA, 101 bp, rice(Oryza sativa)
  misc_feature (71): n=t or c
ttttcttttcagttcctggagatcttgcgggagtttggaagagaggaccagcgggcgttcttgcattttangactggagctcctcagctcccacttggtgg

SEQ ID NO: 45288 - DNA, 101 bp, rice(Oryza sativa)
  misc_feature (71): n=a or g
ggaactacaatagatgatgcaattggtgaggcttatgacaagtcagcgagatggttaggtcttgatatgcngaaaggtggcggtcctgctcttgaacagct

SEQ ID NO: 45289 - DNA, 101 bp, rice(Oryza sativa)
  misc_feature (71): n=a or g
ataagtcaaagattgattgccgaaagtgtggcaaatttggacacttcaccaacgagtgcgaagagtcgaanaagaaagtgatgtagggtgtggcgcaactc

SEQ ID NO: 45290 - DNA, 101 bp, rice(Oryza sativa)
  misc_feature (71): n=t or c
ccattgttgctcacctaactggttatttggtttctcaccctcaggtggccatgacttcaaaaccatctcantgaaaactccactagagatatgattagtta

SEQ ID NO: 45291 - DNA, 101 bp, rice(Oryza sativa)
  misc_feature (71): n=a or g
gtgacagtcgattggcccttctgagtggtggtgagagccaatctgacgttgatcgcgcctgcgcgagatcntgtcgagaacacgttctcgatcgtcttcca

SEQ ID NO: 45292 - DNA, 101 bp, rice(Oryza sativa)
  misc_feature (71): n=a or c
gtaaacaaaaggaaattccctttaggcaaatatctgataggctatctttaacagatgctgaattctgcatnagctaaaattgctgtcaactctgcaatcgg

SEQ ID NO: 45293 - DNA, 101 bp, rice(Oryza sativa)
  misc_feature (71): n=t or c
gtcgtccttactgacacaggaatctgtacccaaacggcttgagtttcaaaggagtatggaggtagatgatnaaggttaatgctgtcggatttctggttgtt

SEQ ID NO: 45294 - DNA, 101 bp, rice(Oryza sativa)
  misc_feature (71): n=a or g
ctcagaaaatgaagtacactaggaaaaacaattgccagttttaatagacataccacccatggagtgcgccnatgtccaagcaacactttcaaacatttccc

SEQ ID NO: 45295 - DNA, 101 bp, rice(Oryza sativa)
  misc_feature (71): n=a or c
ctaagcaattcatcaatggacatgatcatagtaatgtcgatcgacgtgcagtgtcactcattgttgggagnacggtcaaaacctccagttcatatcatatc

SEQ ID NO: 45296 - DNA, 101 bp, rice(Oryza sativa)
  misc_feature (71): n=a or g
gccatttcaaccaactgctgcaatgttagcaactcttattgaggcttgccgaatccatggtaatacggaantcggggatcgggctgcaaagaagttgctgg

SEQ ID NO: 45297 - DNA, 101 bp, rice(Oryza sativa)
  misc_feature (71): n=a or g
ctccggcgttgtgctcgactggctgtggttgataggaaaaggctggtgatcgtgttgtaatatctctggcntgagagacccattggttctccctgctcgga

SEQ ID NO: 45298 - DNA, 101 bp, rice(Oryza sativa)
  misc_feature (71): n=t or c
agtattatcatacgtggaggagggagaaagcatgagagagagtgaagcgagagcttctgcaagcgccggangataacacgacaaattaggcaagatgaaat

SEQ ID NO: 45299 - DNA, 101 bp, rice(Oryza sativa)
  misc_feature (71): n=a or c
ttagagctcagtaaagcatatgttactcaggacgatctcgaaatgcttggagacctgaaagctctcgaatntcttgcccttcccttttcagacacacaagg

SEQ ID NO: 45300 - DNA, 101 bp, rice(Oryza sativa)
  misc_feature (71): n=a or g
tgacttcaagccgccctgacaatcttgtctacatcagcccctgctcaggagatccaacctcaacaccgctnatgtggacccaagtcagatccatcgtcttt

SEQ ID NO: 45301 - DNA, 101 bp, rice(Oryza sativa)
  misc_feature (71): n=t or c
agcccaattgatgtgttttatttggttgatgtccttcaccaaagcaaggtaatttgagctgacaaatggtntagttgtcggacatagaatgtatcctattt

SEQ ID NO: 45302 - DNA, 101 bp, rice(Oryza sativa)
  misc_feature (71): n=a or g
acgttaagtactcaccctttcccaatataaatctatagagtatgaagatgaaggcgtcgactcgaccgctnaggagtgcctctaggagtaagccgagcatg

SEQ ID NO: 45303 - DNA, 101 bp, rice(Oryza sativa)
  misc_feature (71): n=t or c
gtatccctctattccgaactctactcttcttctctgaatcctctgaacatttttctctgaacttcttctgntttcttctctgaattctccacttctgacag

SEQ ID NO: 45304 - DNA, 101 bp, rice(Oryza sativa)
  misc_feature (71): n=t or c
atgattgtagaagtgttcaggtgtgtaaagtacttcggctgtgtttagtttggttgtgtttagttcagcgnaaagtttagattttggttgaaattggagat

SEQ ID NO: 45305 - DNA, 101 bp, rice(Oryza sativa)
  misc_feature (71): n=t or c
catcacgggtacaccaacttttatatatttagaaataatggccacacaacaacaacacaagatgaccaagnggtagagctagcacattaatcaatatattc

SEQ ID NO: 45306 - DNA, 101 bp, rice(Oryza sativa)
  misc_feature (71): n=t or c
ctttcatggaagaatcacccacatgatctgtcctcagagatttgatattttgacaccacaaattgggcttngattattcgacatcgtgacccactgtaacc

SEQ ID NO: 45307 - DNA, 101 bp, rice(Oryza sativa)
  misc_feature (71): n=a or g
tgctgagattgctaaatcctgtggtcaggatgaaatctcaggcccttcatcatcacaaatcagaacagtcnatcgcaccgatggaagtggttttgatggtg

SEQ ID NO: 45308 - DNA, 101 bp, rice(Oryza sativa)
  misc_feature (71): n=t or c
tcaccagcacctctacttcatcggcattgacatctccgtcgttgctaaggggggcctacatcttcgctttnggttgcttctgtcatcaccgacttgttatt

SEQ ID NO: 45309 - DNA, 101 bp, rice(Oryza sativa)
  misc_feature (71): n=a or c
aagacacaatggctcatacctttcgcattctctcagcaagctccacatgggcagctttgacagcataatcntctcctgttttagtcaaaccctgtacaaca

SEQ ID NO: 45310 - DNA, 101 bp, rice(Oryza sativa)
  misc_feature (71): n=t or c
taagagacccggttgatggccagcatcatcgccggtggagtcaggaaagccggtaactgcgcggagaatancctgtccttgaacggctccacctcgccggc

SEQ ID NO: 45311 - DNA, 101 bp, rice(Oryza sativa)
  misc_feature (71): n=t or c
ccagcaggccgtcaagttggtgagcagagtttcaatgcaaatttctgcttggccttctgctgaataatgtntacagtcagtgttgcaagcattcaaaaaac

SEQ ID NO: 45312 - DNA, 101 bp, rice(Oryza sativa)
  misc_feature (71): n=t or c
ctagggtgtcaaaacgcaagcgtatactttgagatttatatttatacagggcgaatcgacttttgctgggncgtatcgggccggaatttcgctggagctga

SEQ ID NO: 45313 - DNA, 101 bp, rice(Oryza sativa)
  misc_feature (71): n=t or c
tacctaggtgtttctccactttaggtgtcgtaatttgtcaccgagttcaaaattaattcctaaaccgtcgnatccaagggtggagctagaacgaaatgggg

SEQ ID NO: 45314 - DNA, 101 bp, rice(Oryza sativa)
  misc_feature (71): n=t or c
tccaatacttctcccgatggattgaggccgaacccctcaaagcgatcacttcagcagcagtgcagaagttngtgtggaaaaactttgtttgccgtttcgga

SEQ ID NO: 45315 - DNA, 101 bp, rice(Oryza sativa)
  misc_feature (71): n=a or g
tggcatgaatagatcaaattacatgttaatctcttcaatgaaaatctgctccattgataggaaatcctccnttaaagctcttcccctcaccttcacctcac

SEQ ID NO: 45316 - DNA, 101 bp, rice(Oryza sativa)
  misc_feature (71): n=a or g
atcaaacacttttttcccctcctcgccaaatgatctttttaaaaactttttggtagacttttctggcctcngataaaagcgtgtaccttttacttgaagaa

SEQ ID NO: 45317 - DNA, 101 bp, rice(Oryza sativa)
  misc_feature (71): n=t or c
tgaactctatgtaaagcttaattcgacatctaggtaacacaactaaaaccacacaaagtagatgttaaaantgttgattctcttaagatagcacttggata

SEQ ID NO: 45318 - DNA, 101 bp, rice(Oryza sativa)
  misc_feature (71): n=a or g
gccgaaacaaatgcaagtagggccaccaccgtccctaaaagaccttatttctaattacgcatctcaacaantacttattcagatgcataactaaaattaca

SEQ ID NO: 45319 - DNA, 101 bp, rice(Oryza sativa)
  misc_feature (71): n=a or g
ggaataattaattcttttgttaccagcttcttcctattaaaaaacaaggtgaatattacgggatgacctcntatcaaataattagaaggggtgagccttcg

SEQ ID NO: 45320 - DNA, 101 bp, rice(Oryza sativa)
  misc_feature (71): n=a or g
ttgattagcaaataccagaggaagcatgacaggcgagttcgaagttttagacgtcaccaagatgataactnccacagttttgccgtcgtcggacgagacgc

SEQ ID NO: 45321 - DNA, 101 bp, rice(Oryza sativa)
  misc_feature (71): n=a or g
tatcattcaaccagaggcagtgatttaataagaagttgcccctttcttgcacaccttaatcagtgaagtcnttcagatagcagcggtactgtgaaatccag

SEQ ID NO: 45322 - DNA, 101 bp, rice(Oryza sativa)
  misc_feature (71): n=a or c
aatatctgcacacaagttgagaatggttttttttgtcgaacaggtttgctacccatggaattgacatgatntgtttaagaaaaatacatattgaaagttag

SEQ ID NO: 45323 - DNA, 101 bp, rice(Oryza sativa)
  misc_feature (71): n=a or c
tcacccgcacacgcaacagaaaaaaaaatcccaaaacagctgcgcacggaattctcacccacaccaccccncaccggagctccgccaccgagccgccaccg

SEQ ID NO: 45324 - DNA, 101 bp, rice(Oryza sativa)
  misc_feature (71): n=a or c
agttgcaactgagtagtcagcgatggccggaacttcttgactatcgttctctgtcttttctatgaagctancgtcagcagcaggagactggggcatgtcac

SEQ ID NO: 45325 - DNA, 101 bp, rice(Oryza sativa)
  misc_feature (71): n=a or c
gcagttggatcgagaggctaattaagctaagtagaagcacacacgtacaccaccatggctggaggaagacncttggagtcggtgctcgtggcccccggggt

SEQ ID NO: 45326 - DNA, 101 bp, rice(Oryza sativa)
  misc_feature (71): n=a or g
gctccatggacgatgtcgaggatggtacaaagttgtggtgttggaggtattggagatagaacaccatgtgntggaagcgaggacaattgtactccaatacc

SEQ ID NO: 45327 - DNA, 101 bp, rice(Oryza sativa)
  misc_feature (71): n=t or c
gttctagtatgcatctcttatttctcaatcatatatggtattacggttcagtgatgaaatttagattcgangataaattgggagacccaaagtaaacttat

SEQ ID NO: 45328 - DNA, 101 bp, rice(Oryza sativa)
  misc_feature (71): n=t or c
gacacctatgggtataaatagaccccctaggaggagggggaggaaacaacaacaacaacagatcgacacanaatacacacgccaagacaagccgccggtta

SEQ ID NO: 45329 - DNA, 101 bp, rice(Oryza sativa)
  misc_feature (71): n=t or c
tcttgttttctgtcccattcccattgtttgataagcatcccagcaagtttgttctgttgctcgatcgtctntggagaaactcgccacagatcgcgtagccg

SEQ ID NO: 45330 - DNA, 101 bp, rice(Oryza sativa)
  misc_feature (71): n=a or c
gagatgagcagcatgaatgctctgcttgtgacgctgacaaacatggatgggctcagcgatcaacaaaaggngtggaggaacaaggttcgcaagctctcctg

SEQ ID NO: 45331 - DNA, 101 bp, rice(Oryza sativa)
  misc_feature (71): n=a or g
acttcaggctttcttgatctcagataccttagcaatgtgttcctcatttgttgtcgcattcatatgcatcntagcaaagtgggaggatcttcggttcttgc

SEQ ID NO: 45332 - DNA, 101 bp, rice(Oryza sativa)
  misc_feature (71): n=t or c
ggatcatacctccatacacatttcatcgccgagcctctagagaatccacctaaaacatagatgcacccgtngactgtcccaattgcacaaccgcagaacgg

SEQ ID NO: 45333 - DNA, 101 bp, rice(Oryza sativa)
  misc_feature (71): n=a or g
ttatgcttagaactgaatctacccagttaattattcgccaaagtttggcccataagtaccggctgtgtttngtattgggtgtttacaactacatacacata

SEQ ID NO: 45334 - DNA, 101 bp, rice(Oryza sativa)
  misc_feature (71): n=a or g
ctactatactccacaggtttctcaaccacaacttaaaacaattctttccacggtccacgacaatggcgcancatgtccagtcttctttagtaaattggtac

SEQ ID NO: 45335 - DNA, 101 bp, rice(Oryza sativa)
  misc_feature (71): n=t or c
atgttcaccagcacccaaaggcacgctgtggacaagggtttgatccactacgcatgtgccattgcggatgntgagccagagaacgtgccatagtggagctg

SEQ ID NO: 45336 - DNA, 101 bp, rice(Oryza sativa)
  misc_feature (71): n=a or g
gccattaagaagcaccgaacgccgttaagtgtatcaaagccagctatgaagaaccaaaagaaaagagaagngaagaaagcggaagaggtatgctaaacttc

SEQ ID NO: 45337 - DNA, 101 bp, rice(Oryza sativa)
  misc_feature (71): n=a or g
ttggctttgaatacaacgtgcataaaacatgataaattggccatcagcatacactggatgtgtgtgtgagnaactactcttctgtactgcaatatatagtt

SEQ ID NO: 45338 - DNA, 101 bp, rice(Oryza sativa)
  misc_feature (71): n=a or g
gctaccaccccgaatgcgaaaacatcaaccttttcagtcaaatgtcgtctcatcgcatactcaggagccanataaccacttgacaaaaggttagataagtt

SEQ ID NO: 45339 - DNA, 101 bp, rice(Oryza sativa)
  misc_feature (71): n=t or c
tagagaaaagtaaaccaatagctaaatataaaaaactgaacgaggcaaacacaagttacccggagaataanattcaaaggtgcttgtagttcaagaccatt

SEQ ID NO: 45340 - DNA, 101 bp, rice(Oryza sativa)
  misc_feature (71): n=a or g
catctgaaaaataagggaaaacctcgtgtttcgtcggaattgagtgattttgtttgctccattgagcaatnttattttgtcccatgagcccaaacaatatc

SEQ ID NO: 45341 - DNA, 101 bp, rice(Oryza sativa)
  misc_feature (71): n=t or c
agaaccaagttgtcgtttatcacttaaggagaagttttccaattggggttctacttctcctactacccatnggaagggtcaaactggattaagtaacccat

SEQ ID NO: 45342 - DNA, 101 bp, rice(Oryza sativa)
  misc_feature (71): n=t or c
cttcaatgggagatagcgattcagtttttagtgtccgtttggttggtggaggaaggtaaatatggcggtcnggatagagaatattctatgaaaatgatgga

SEQ ID NO: 45343 - DNA, 101 bp, rice(Oryza sativa)
  misc_feature (71): n=t or c
gtttgtttgtttactagtagttttttttggttttgacgtttgctgtccctgggagggaaattctgttgacntgtccgaaattcagtctgtggcaggatgcg

SEQ ID NO: 45344 - DNA, 101 bp, rice(Oryza sativa)
  misc_feature (71): n=t or g
tgattgagaaatgtcatgtaatcacgttggttcgaaaaactgaagttggcctcctatcaatgtctggactngaatcccttctgattaataacaaaattaga

SEQ ID NO: 45345 - DNA, 101 bp, rice(Oryza sativa)
  misc_feature (71): n=a or g
ctcatccagaccactccgaacaccttcaaagaagctagtgtgcccatcagccttatccttaatggacaacnaacctttggagttgatgtcctgattagagc

SEQ ID NO: 45346 - DNA, 101 bp, rice(Oryza sativa)
  misc_feature (71): n=a or g
attgaaattgatgaaaaatattttcgaaatggaagaaaacctgaagtggcatttcagcgaatacccatatnttatgagtggcgtttgggcaaatcccatct

SEQ ID NO: 45347 - DNA, 101 bp, rice(Oryza sativa)
  misc_feature (71): n=a or g
gggagagatttgattgtctgcatatatacgactctagtacggtgtacagaagacagatcactgtgtataanggtgggtttagttcctgaaaaaaagttaga

SEQ ID NO: 45348 - DNA, 101 bp, rice(Oryza sativa)
  misc_feature (71): n=a or g
atttgcagaactcagttttggatggaatctggcccatgtatgagtcatttggacattcagtttgttgattnctctagtgtacaatactatacagccgctat

SEQ ID NO: 45349 - DNA, 101 bp, rice(Oryza sativa)
  misc_feature (71): n=t or c
aacagaagattgtgaaagcaggtgcttgtcttcaagatcttcatcttcaaaatgctcattgctggatgtgngggaatcatctaaaggaaaaaaatgcaaca

SEQ ID NO: 45350 - DNA, 101 bp, rice(Oryza sativa)
  misc_feature (71): n=t or c
tctccagctgcatctctactctcttcaccctccacattgcttccttctaatactctctgcatctctgccgnacatgccctttgcttttcctccatctccac

SEQ ID NO: 45351 - DNA, 101 bp, rice(Oryza sativa)
  misc_feature (71): n=t or c
tgtcgaatgggcaatggcagagttgatgcaaaatccaaagtccatgtctagagtttgtgatgagctttcanaagttattggcttaggaagaaatatcaagg

SEQ ID NO: 45352 - DNA, 101 bp, rice(Oryza sativa)
  misc_feature (71): n=a or g
gacgttcaattagcagacatgctgtgttcgattacagaggttgggaacacatgctctgtacacgaaaaacngagtggtctattagtacgtgattaattaag

SEQ ID NO: 45353 - DNA, 101 bp, rice(Oryza sativa)
  misc_feature (71): n=a or c
aactatatgattctgttcaacatttgtgcttaagatgggtggtttgtcctttttggttgcgtgaattttangcggagtgggctcaattggttgtaccatct

SEQ ID NO: 45354 - DNA, 101 bp, rice(Oryza sativa)
  misc_feature (71): n=t or c
agacggacacaggtacattgaaacggcagaaccgcgcgcacgacaactcgacaagcgatgcaacacgaagnagggtggagcaagaggccgcgtcgcatgca

SEQ ID NO: 45355 - DNA, 101 bp, rice(Oryza sativa)
  misc_feature (71): n=t or c
gggggtcgacctagttcgcgattgatcgcgagaccttatgacccacgatcaggtccccccacatggtttcnttttttggcaccacattacttctctatttt

SEQ ID NO: 45356 - DNA, 101 bp, rice(Oryza sativa)
  misc_feature (71): n=t or c
actgtttctgctcggccaccttgccctttccatctttccacctgagagcgtctgcgtgattaaccattagncgaaacttaaaattctgtgctcataaggat

SEQ ID NO: 45357 - DNA, 101 bp, rice(Oryza sativa)
  misc_feature (71): n=t or c
tttccttgtacaaaagatccaaatgttgcaacaagtattttttgcaggtgatctgcgcttgtctaggcggnggcggcgtggcgcctctcgacggcggtgag

SEQ ID NO: 45358 - DNA, 101 bp, rice(Oryza sativa)
  misc_feature (71): n=t or g
caagcaaataaatagttcgccaattaatggcgtgtgttcatcaatcgggatcaggacacgaacgacacatnaggagacgcactagctatctagctcctttt

SEQ ID NO: 45359 - DNA, 101 bp, rice(Oryza sativa)
  misc_feature (71): n=a or g
aggagaagaattccagcacgtcagccatggcgtcgcgagtccccaagcttgcctaacccgtcttgaccacnacaaacacgcagagagagagagagagagag

SEQ ID NO: 45360 - DNA, 101 bp, rice(Oryza sativa)
  misc_feature (71): n=t or c
ggacagatctaaatcaattaattcctttgtttctgcatacattatgatcgacccaggtgcaaaagggatgnatagataaaggtaaaacattgactgtagct

SEQ ID NO: 45361 - DNA, 101 bp, rice(Oryza sativa)
  misc_feature (71): n=t or g
gagagagactagagaggagaagaagaaatcaagaaagaggaagagctataccattggagctcagccgtaanaacctggacgttgcagatggggcaagatga

SEQ ID NO: 45362 - DNA, 101 bp, rice(Oryza sativa)
  misc_feature (71): n=a or c
tattacctagactatagtttgaaacgaagtgtgatgaagctaggttgacttctcgctgttgatgttctgcncccggccacctgatgattaatttgatatta

SEQ ID NO: 45363 - DNA, 101 bp, rice(Oryza sativa)
  misc_feature (71): n=a or g
gttaaaggtgtcggttcatagcatatcagccaccttttaaattataagtacttgctacgagacaaaaccantagctattattaattatatataggtaacag

SEQ ID NO: 45364 - DNA, 101 bp, rice(Oryza sativa)
  misc_feature (71): n=t or c
cccaggaactccattcagtagaatttgagatgtcgatgtcgctagaagattagaaatccaatttaatgatngagttccaaaaccaaaataacgcatgactt

SEQ ID NO: 45365 - DNA, 101 bp, rice(Oryza sativa)
  misc_feature (71): n=a or g
aacaaagaagcctaagacactatggtcaagctacaagattgaactacaagcttcagagatgtacaacttgngaattttcaaaaaatttcaagatgagttgc

SEQ ID NO: 45366 - DNA, 101 bp, rice(Oryza sativa)
  misc_feature (71): n=t or g
tgcaggggcagcagcgcacttgctcgcactctctgggttgtcgcgttcccggtgtcaccgagccgattctntggacaagcgagtagccagccaaaggcaaa

SEQ ID NO: 45367 - DNA, 101 bp, rice(Oryza sativa)
  misc_feature (71): n=a or g
ttgtgagacaaccagtctgtccacccatgctctgtatttcttcccttgtttgtcaccgtaacatgaccccnatgcatcaattgatgcatgaagagaacact

SEQ ID NO: 45368 - DNA, 101 bp, rice(Oryza sativa)
  misc_feature (71): n=t or c
gtgattaatcacactaattctaccattaatcatgcactaattatgtactagtaactgagctggagatcaantgactgagctggtatatactccctcagttt

SEQ ID NO: 45369 - DNA, 101 bp, rice(Oryza sativa)
  misc_feature (71): n=a or g
aaatatattttcccattctttttcctctctctcaaccccatctatgtacatcatgtagagatcaaacaatncttgcgtctctttgaagatgtccctctgtg

SEQ ID NO: 45370 - DNA, 101 bp, rice(Oryza sativa)
  misc_feature (71): n=t or g
ggtggggggaaccgcgagcaaagattgatgggcatatgacttgtgacatgtcctatatatacacgagatanaatatatttcttttttagtttggcatatta

SEQ ID NO: 45371 - DNA, 101 bp, rice(Oryza sativa)
  misc_feature (71): n=a or g
tcaaaaaaaaaagactttgtatcgactaaagtatatccacttaccaataagaagacttccgctacatacanattcgtagtaataggatatgtcacatacat

SEQ ID NO: 45372 - DNA, 101 bp, rice(Oryza sativa)
  misc_feature (71): n=a or g
atctgtatatgtatcatgctatcaataactctttgatttcaaatataagtcaaattgagaaatatctcatnctatcattcatttattattactatatattg

SEQ ID NO: 45373 - DNA, 101 bp, rice(Oryza sativa)
  misc_feature (71): n=a or c
tcttcttcttcttcttcttcttcttctttttctccgttgaaggcgccttaccttggtcgttagtgggatcnatcaccttgtcaaagctactcgtctcactc

SEQ ID NO: 45374 - DNA, 101 bp, rice(Oryza sativa)
  misc_feature (71): n=a or g
aattagaactaccttatgcttgaggcgacttttttttgtgctctttcttttacatatacccgaaaacgacntatatacgcacgatcattatactgtttttt

SEQ ID NO: 45375 - DNA, 101 bp, rice(Oryza sativa)
  misc_feature (71): n=t or c
cttaattactaaaatttcttccctttttgccccaattattctcaaaccccccattcatcctaaatgagcantattttttttctcctcgaccttaaatatcc

SEQ ID NO: 45376 - DNA, 101 bp, rice(Oryza sativa)
  misc_feature (71): n=t or c
ttgactgcaacacaataattgtatggtagcatgtctagagaagattgcagactgtcacaccctgaagtttnctctttttctagccttaattcaattaataa

SEQ ID NO: 45377 - DNA, 101 bp, rice(Oryza sativa)
  misc_feature (71): n=t or c
gtgagtggctctgcgccacctccacccccattgcccaacattatgtcagcaggttttccaagactaagtgngcctccacctctgcctctgcctacacaatc

SEQ ID NO: 45378 - DNA, 101 bp, rice(Oryza sativa)
  misc_feature (71): n=a or g
gtcatccgtccttcatttgccgtatagaaggggaaaaatcagctcgagcagatacgctaacaggccctccnaaaggggcggatgcgccaaattaggagaga

SEQ ID NO: 45379 - DNA, 101 bp, rice(Oryza sativa)
  misc_feature (71): n=a or g
ttgctttgatggttttgaagtttgaggttgggtgtggttttcttcgagttggaggagaaggttgatgagcnccgaagcttcatggtgatctccgttcgctt

SEQ ID NO: 45380 - DNA, 101 bp, rice(Oryza sativa)
  misc_feature (71): n=t or c
atataagatgcagagcttgcattcttttcatcatcaagcgagggaaacacatgattaatcaatttgtgtantgaatcctcgctatccccataagcaatcac

SEQ ID NO: 45381 - DNA, 101 bp, rice(Oryza sativa)
  misc_feature (71): n=t or c
aagtgaaccaatcggccagtccactcgacgtaggtcgagtgtaaaagcggaacaccttcatcgcctctctngggtgaatgcctttggccgtcacggtaggc

SEQ ID NO: 45382 - DNA, 101 bp, rice(Oryza sativa)
  misc_feature (71): n=t or c
aatgaaccattaacatcattacctgactgcggctccaggttctttcgtgcctttctctttgtagccttttncaccgagtgttctccttcacttgaggctag

SEQ ID NO: 45383 - DNA, 101 bp, rice(Oryza sativa)
  misc_feature (71): n=t or g
taacaaccgccgacaccgcgatgggcgaaagaaaaccgagggcactgccgatggcgagcgcggtgcgcgtnacacgcgcgatcaagggcgtgacaagtgca

SEQ ID NO: 45384 - DNA, 101 bp, rice(Oryza sativa)
  misc_feature (71): n=a or g
tagaccagctcctagcaactaattggcaatttggtgggctaggtggctggcttttagaacacagttactanactttgtttagtgtgtttgaggtgttctgt

SEQ ID NO: 45385 - DNA, 101 bp, rice(Oryza sativa)
  misc_feature (71): n=t or c
acgacgccatctgcgggactgcccaaggctgtctcttttcgggtgcattcccagccagcgagcaagcgacnagctgcatctggagcttctacggcaccaaa

SEQ ID NO: 45386 - DNA, 101 bp, rice(Oryza sativa)
  misc_feature (71): n=t or g
cctcaaaaggggtggtggggataggaatcccttcccctttgcgggccttgtttcaatgtctgctgcagtgnccacaatggtggtggactcattggctgctg

SEQ ID NO: 45387 - DNA, 101 bp, rice(Oryza sativa)
  misc_feature (71): n=t or c
gtatttccagaatattgttaggataggctgcctgacatagtcgacaagacttgttgtaccatagttaaaantgtcagttggtcttcttccagtaaacattt

SEQ ID NO: 45388 - DNA, 101 bp, rice(Oryza sativa)
  misc_feature (71): n=a or g
acactgggttccaaggcaatattgctcctggttttaggtgattcatcgtcagtgtgggaaccacatgtcanggtatttcagtctaaaaaataaataaaagt

SEQ ID NO: 45389 - DNA, 101 bp, rice(Oryza sativa)
  misc_feature (71): n=a or g
ctcatgaacaacactatccacttcaacccagctgcaccctgctgttttgtcaataacctttctcctcatcnatagctgcacatcctcaacagcatcccatt

SEQ ID NO: 45390 - DNA, 101 bp, rice(Oryza sativa)
  misc_feature (71): n=t or g
attagctatcataactatagctattgtgttggctagaactagaaacatggcagaagagtggtacaaggtgnataattcaattggctatggacttggaaaca

SEQ ID NO: 45391 - DNA, 101 bp, rice(Oryza sativa)
  misc_feature (71): n=t or c
tattgtccaaaataacatgcaaagaagaaggggcaataaagaagaaggatgcagggagtagctatatgccnagtaccttagtttaatttgtgaacattgac

SEQ ID NO: 45392 - DNA, 101 bp, rice(Oryza sativa)
  misc_feature (71): n=a or g
gctggggtgcaaccgtttcaagaaaaaggaacgcacccataggcaaagtaaaaacatatattaagtccctnatatatttgcgcatttcagcaatagttttg

SEQ ID NO: 45393 - DNA, 101 bp, rice(Oryza sativa)
  misc_feature (71): n=a or c
gttgaggtatctgaacatcaaagggacagatataagtgatctgccatgtcagatacgggaacttcaatatntggagacattagacatcagatcaactcatg

SEQ ID NO: 45394 - DNA, 101 bp, rice(Oryza sativa)
  misc_feature (71): n=a or c
gggaggagctcgacttgctgttcttccagttgcaggagacagctagaagggttgctaaccttcagcttgantgcaaggtaattgatataactaagccatca

SEQ ID NO: 45395 - DNA, 101 bp, rice(Oryza sativa)
  misc_feature (71): n=t or c
ccacataccaacgaggaagtttctctctccatctctatgatctatggtctccaccaataagcgtggagcgnatcgatcagcaaccagcaggcggaggtagt

SEQ ID NO: 45396 - DNA, 101 bp, rice(Oryza sativa)
  misc_feature (71): n=a or g
ccccacaaactcctctgcgtgtcctccttctcttaggcgctactgtggttgttggtgaaccgtcaacgctntggtgaaccgccttcacgaatgccgtggcg

SEQ ID NO: 45397 - DNA, 101 bp, rice(Oryza sativa)
  misc_feature (71): n=a or g
atccgacatagatccatccagaaaggattccaatccagctaacacggagacaagttcatctaaagaagctnggccgactactgaggaccacccgactggcg

SEQ ID NO: 45398 - DNA, 101 bp, rice(Oryza sativa)
  misc_feature (71): n=t or c
ttttccatgcggagggaatgagttcccaactagagaaaacaaacgcagcctataaggaggtgtttagatanatgggtgtaaagttttgatatatcacatcg

SEQ ID NO: 45399 - DNA, 101 bp, rice(Oryza sativa)
  misc_feature (71): n=a or g
gacataggacgaaagtcggacgacgtgaagctaggtgaaacaacggactgaactactgaagcaccaggtgncgaaagcccagcaacgcaaggcgaagcagg

SEQ ID NO: 45400 - DNA, 101 bp, rice(Oryza sativa)
  misc_feature (71): n=t or c
agagcccgtcaaatatcactcacctttgacatgctctctttggagcctgtctagaatgagcatcctttgangggctctactctttagcccaacacggatga

SEQ ID NO: 45401 - DNA, 101 bp, rice(Oryza sativa)
  misc_feature (71): n=a or g
cggctaaaccctcgcgagtccccactcttcctctccccgttctgcatcaccatgttcgccgccatctgccnccgccggctcgccgccctattcccccaaat

SEQ ID NO: 45402 - DNA, 101 bp, rice(Oryza sativa)
  misc_feature (71): n=t or c
ctaccgtttttaaaatattactcatgggatgtcattgaaacattctttatccaccttctttgatcacatgnctacttagcagtacttaccataattttcat

SEQ ID NO: 45403 - DNA, 101 bp, rice(Oryza sativa)
  misc_feature (71): n=a or g
cccagcaaacaagtttgccaaaagtgtttactaccctttcaatgtgggattcatttctaaaatcagggggnacaccaagaataatgatccaaccttccttc

SEQ ID NO: 45404 - DNA, 101 bp, rice(Oryza sativa)
  misc_feature (71): n=a or g
acatttgttgcaatcttcagaagctaaaccaactgcagtgaaggagacaatgcaagctatgggtgtcacangccttacgacccacaacatcaagagtcacc

SEQ ID NO: 45405 - DNA, 101 bp, rice(Oryza sativa)
  misc_feature (71): n=a or g
ggcactgtaacatattggcgacctgccaatgagacaaaagtattaggttttctatgtacgggatttgctcnaatgtttgtcaaataaatgtacaagtgatt

SEQ ID NO: 45406 - DNA, 101 bp, rice(Oryza sativa)
  misc_feature (71): n=t or g
caattttggaaacaccatcggtacgcacacacgaaaacagatcttcgtcaaggcttgtctcaacttccttnatccggttaggaaaatctgtgaacaaaggg

SEQ ID NO: 45407 - DNA, 101 bp, rice(Oryza sativa)
  misc_feature (71): n=t or c
accagtgcttatgcaggtcacactgacatgtttgaaaccatgccttttcatttttttagcttgaatccaangcagaggtttgagatcactttccacggtgg

SEQ ID NO: 45408 - DNA, 101 bp, rice(Oryza sativa)
  misc_feature (71): n=a or g
tcttgtatggagacaaccagaccaattagtgtcaaaataggccactaactcgattggagtggagcactgangattaagtccatgatctcgagtgccacgtg

SEQ ID NO: 45409 - DNA, 101 bp, rice(Oryza sativa)
  misc_feature (71): n=a or g
taacccgccttccgcagcttccctgaaacaacactcgaaaatgcacagccccacaaagtttgacaaggtanaaagaaagaagatagctctctctgtaaaac

SEQ ID NO: 45410 - DNA, 101 bp, rice(Oryza sativa)
  misc_feature (71): n=t or c
tttttcttcttttttcagcgggtgaaattattcaaacatcgtgaaaaaatctgaacgcttttcagggtganctactagttagaaatcaggtgacgttggta

SEQ ID NO: 45411 - DNA, 101 bp, rice(Oryza sativa)
  misc_feature (71): n=a or c
aaacgacgccgaaatcgggaacagaaccagactagcaattgagcaaatcttagatgggggagggaaactcngagcgaccctcaccttcgacggtcatcgcc

SEQ ID NO: 45412 - DNA, 101 bp, rice(Oryza sativa)
  misc_feature (71): n=a or g
tcacaaatactacatgggtactacaggatggaacacatccagtactacgtctattctaaaaatacaagaanttttagagttaaacatggtattaaaaaagt

SEQ ID NO: 45413 - DNA, 101 bp, rice(Oryza sativa)
  misc_feature (71): n=a or g
catcagtcccattttccagcaaatgcatgacctacaatgcatgcaggtcacaaccgtgggtaagtgtaagncaagccgtctccttcatataattttatacc

SEQ ID NO: 45414 - DNA, 101 bp, rice(Oryza sativa)
  misc_feature (71): n=t or c
gagtggaggttttctaacattcttcatttccatgtcgatgcttcttgggcgttttatctgtagcattagtnggaaacattggaacaaacaatcaccaaagt

SEQ ID NO: 45415 - DNA, 101 bp, rice(Oryza sativa)
  misc_feature (71): n=t or c
tggagctcagtcacttcagctgtatcatccgctcccttcatgactctcatgttggctaaacctctagttgntgcctttagttgtgtgacaattgcaggtaa

SEQ ID NO: 45416 - DNA, 101 bp, rice(Oryza sativa)
  misc_feature (71): n=a or g
gtcgactccgtagtcgccgaaccccgccgtctcctccattggcatcacagcgataacagcaagcccggcanccacctccacgaagccgcaagtcgtcggag

SEQ ID NO: 45417 - DNA, 101 bp, rice(Oryza sativa)
  misc_feature (71): n=t or g
gccaagatataccagatgactatgccaaggaagaggtgcggacggtaaatgaggatcataggatgtacganatagactttccaacacccgaggatatcgtg

SEQ ID NO: 45418 - DNA, 101 bp, rice(Oryza sativa)
  misc_feature (71): n=a or g
gcttgcccaccgtcgtcttaagcatcatatcggtgacgacccagttgccgtcgtcccgtatcctggccgcncacgatcctttcaccgccgccatcggcgag

SEQ ID NO: 45419 - DNA, 101 bp, rice(Oryza sativa)
  misc_feature (71): n=t or g
catgaactgaatgatgagatgatccgtctaattacctggattgggcgatcaggagattggagttgttctcntcatttcttcccctttcttctccttggatg

SEQ ID NO: 45420 - DNA, 101 bp, rice(Oryza sativa)
  misc_feature (71): n=a or c
agcagcagcagggtgtactgcaaagctcgaaagacaggagtggacaaccaagattaggagccacgaggatnggagagttcccaaaggaggcacaggtcttc

SEQ ID NO: 45421 - DNA, 101 bp, rice(Oryza sativa)
  misc_feature (71): n=t or c
gtccattcctatttctttcaacttccattgcagaatttttaacggttgtaataaccctgctggcttttgangtttagcttttactctttggaatatatcac

SEQ ID NO: 45422 - DNA, 101 bp, rice(Oryza sativa)
  misc_feature (71): n=a or g
agtcctgcaatcagaaaggcatgtgactttttgttgtcaaaagagcttccttctggaggctggggagaaanctatttgtcatcccaagatcaggtaaattc

SEQ ID NO: 45423 - DNA, 101 bp, rice(Oryza sativa)
  misc_feature (71): n=t or c
tcattgaccttttttatctacttttacctggaagaccattcatttttgtcactgagagaaattttaataanttcagtgttctttatttatgaaaaatattc

SEQ ID NO: 45424 - DNA, 101 bp, rice(Oryza sativa)
  misc_feature (71): n=t or c
ccgccaccgccgggacgggaatgcaaggcttaccgcggattgctcgtcggcttctctcgcgaaggcatcanggcggcggcggagcggaggcgaaaccctag

SEQ ID NO: 45425 - DNA, 101 bp, rice(Oryza sativa)
  misc_feature (71): n=t or c
ccaggatttggatctacagcgtatttgtcacatctggcgtggtgattaccatcgttggatgcattagggcngagtttagttctaaaccttttttttttcaa

SEQ ID NO: 45426 - DNA, 101 bp, rice(Oryza sativa)
  misc_feature (71): n=a or g
tcgggggataacctcgtccccgaggaggagttcctgatctcctcaatcctccttaccacttcctccatccnaggccgctggtcgggaacaattgcaacgca

SEQ ID NO: 45427 - DNA, 101 bp, rice(Oryza sativa)
  misc_feature (71): n=a or g
gatgaattttatgaagaaatatgtgtcaagaggcataactggcgagaaataggcatttgggatttgaaaanttgcaaactgcagagccttggtgatgtgga

SEQ ID NO: 45428 - DNA, 101 bp, rice(Oryza sativa)
  misc_feature (71): n=t or c
cggggtactcctcgccgatggcctccgagccccagatctgggactggaacaacgtcatgtcccggcctagncagaaggaggggatagagaagagagatggg

SEQ ID NO: 45429 - DNA, 101 bp, rice(Oryza sativa)
  misc_feature (71): n=a or g
ccattgggccgagcaacgataacattcaacactccagctctgattttctagaggctctacaccttttgagnaagtcttagacgaaagcctagtctggtctc

SEQ ID NO: 45430 - DNA, 101 bp, rice(Oryza sativa)
  misc_feature (71): n=a or g
ccactaaccattatgatgtaggtccttctcttcatcatagcaatggaaagtctccaacttctggttgaccncatgcaaccaatccaacacatctgtttggt

SEQ ID NO: 45431 - DNA, 101 bp, rice(Oryza sativa)
  misc_feature (71): n=a or g
ttgacggagctcctctgcaatcagcatgatctcattttcgagaattacacaaccacttaacatgatcaagnaatgtcgtgatatatgcttgtgtctgtcca

SEQ ID NO: 45432 - DNA, 101 bp, rice(Oryza sativa)
  misc_feature (71): n=a or c
ccacctcctattgctagtaaaatgatatctcctgaatcctgatacgtacaagatttttagggattaggagnactaggcttggacgcaggagccatgggggg

SEQ ID NO: 45433 - DNA, 101 bp, rice(Oryza sativa)
  misc_feature (71): n=a or c
ttgttcttagtctgtggcgagcaacaagactactaataacacaatatgtttcttgcacatggagagcgtgnataccataggaattttgatggtgttcgtat

SEQ ID NO: 45434 - DNA, 101 bp, rice(Oryza sativa)
  misc_feature (71): n=a or g
acataaattaagttgctcttttgcagtttgttacatgttgggagcaccaaccgtagttcacggcatggttnccatgattaattccaggactattataaaaa

SEQ ID NO: 45435 - DNA, 101 bp, rice(Oryza sativa)
  misc_feature (71): n=t or c
tgacagtttgagttaattttctctgaatcatgtatgtgcttaaataattaatcaaataatttcaggtaagnggcaagcgtgtgggcatcatcgggcttggc

SEQ ID NO: 45436 - DNA, 101 bp, rice(Oryza sativa)
  misc_feature (71): n=t or g
aaggaacatctccaacgagcatccagtcaccatccctgtcctcgtaggtgagctggtattcggcagagttntctagtagtttcagcgagtttgtattatct

SEQ ID NO: 45437 - DNA, 101 bp, rice(Oryza sativa)
  misc_feature (71): n=t or c
tcttgctgacacaaatcgaaagctagcaaatgacctccaactgacattgagatgcagcatcactctaatgngaagatgcgtgagaaaaggcccagactggc

SEQ ID NO: 45438 - DNA, 101 bp, rice(Oryza sativa)
  misc_feature (71): n=t or c
aggggaactatgacattatcagatttttcaaggagatccagaatgctggcttatacgctattcttcgcatngggccatacatttgcggcgaatggaactat

SEQ ID NO: 45439 - DNA, 101 bp, rice(Oryza sativa)
  misc_feature (71): n=a or g
aggacatcactctggttgcttaggcctgccttgaatgctagcaagatgttctcatcagttgtgttatgatnttccattgtcgatgtcgacactgattggag

SEQ ID NO: 45440 - DNA, 101 bp, rice(Oryza sativa)
  misc_feature (71): n=t or c
ccacagtgtacatgccaattattgttgtcatatttggtaggcttctcctgcattcctgatcattcctgatnatcgacgcatgctgacaccactatagaatc

SEQ ID NO: 45441 - DNA, 101 bp, rice(Oryza sativa)
  misc_feature (71): n=a or g
ctgccatgcatgcatgtctcccatgttaaagaggtcctaggaaatctatgtgttcacggaatcgacttggngctcaccggtgaaagaggaattaaagatgg

SEQ ID NO: 45442 - DNA, 101 bp, rice(Oryza sativa)
  misc_feature (71): n=t or c
acgatgacagtgatagaagccatgaaggaagtggagttgctgtagaagaaagtattgtatcgtcgcatgtnaatgtcatagaggaccggattgcccgcaga

SEQ ID NO: 45443 - DNA, 101 bp, rice(Oryza sativa)
  misc_feature (71): n=a or c
attgttgggatgtccttagcaaagaatcataataggacgcctcctttgtaacgtcttgaagatttggagcnagacaagaggaagttcaatgttaaggagga

SEQ ID NO: 45444 - DNA, 101 bp, rice(Oryza sativa)
  misc_feature (71): n=t or c
caatacaataatatatagctggatacttactcgtcatcactgcaatagtcaatctcctctgctgacaggtnttttcttgcctgtaaagaatgtatttaccc

SEQ ID NO: 45445 - DNA, 101 bp, rice(Oryza sativa)
  misc_feature (71): n=a or c
agcaccaatgataggatatgtcaatgctccaaaacattttctttttttatgtagaaaccctttacagtcanctacattgctaactgtagtctaccttattt

SEQ ID NO: 45446 - DNA, 101 bp, rice(Oryza sativa)
  misc_feature (71): n=t or c
cttctgtaatgcgcgtttgggctatctagaaaatgcaggagattgttctcctccatcctctcctcctcggnctccttcgtcctcacgtcctggcgatgcat

SEQ ID NO: 45447 - DNA, 101 bp, rice(Oryza sativa)
  misc_feature (71): n=t or c
ggttggggtatgtcagaactgatgcggagcccgatggtgatgagcaaattacagggtgagatccgagaagngttctatggaaaggcaacggtgggagagga

SEQ ID NO: 45448 - DNA, 101 bp, rice(Oryza sativa)
  misc_feature (71): n=a or g
gacacggtgcacaaacaacgtggcatgcacttctgcgtcccatggcaagacacgaaatggcagagcacttngaggtccctgcagctcctctggagaaacgt

SEQ ID NO: 45449 - DNA, 101 bp, rice(Oryza sativa)
  misc_feature (71): n=a or c
gggcctactagtgatgagccgactggaggatctaatccagataagaagaggaagagaaccccggctttggntgaaggtgaagttgctctcatcaccaacat

SEQ ID NO: 45450 - DNA, 101 bp, rice(Oryza sativa)
  misc_feature (71): n=a or c
ctgtgcaacaagccacagtcgttcactttccggacgacaaaactatctcagattctgaggatcagtaggancaagctgttgggtatcatccaggagaacag

SEQ ID NO: 45451 - DNA, 101 bp, rice(Oryza sativa)
  misc_feature (71): n=t or c
cacatgtgagatgatagcaacctttcaagctaaactaccccatctaaggctggtcgaaatggcgtgccatntatataatagtacatcgttcatatttgcat

SEQ ID NO: 45452 - DNA, 101 bp, rice(Oryza sativa)
  misc_feature (71): n=t or g
ctcttctgacgaaggagaggaagacgatgacgagggcgacagccgcgacgaggccgatgatgattgcaagngttttcccagattcatctgatgaacaattg

SEQ ID NO: 45453 - DNA, 101 bp, rice(Oryza sativa)
  misc_feature (71): n=t or c
tacttcaaattctcaaccaaagcgacatcattcaatgtaaacttgtcacttactttgacagatccagtagnagtgatcatactagtagaagcatcgccaaa

SEQ ID NO: 45454 - DNA, 101 bp, rice(Oryza sativa)
  misc_feature (71): n=t or c
ttttagtttgttgagcattagcatatctataggcttgttcactggatcagtttggaagtttggccatgtgnaatgacgacgttgaacccaaagaaggcatc

SEQ ID NO: 45455 - DNA, 101 bp, rice(Oryza sativa)
  misc_feature (71): n=a or c
agaacatgagaagaataaatggatgtagtcttttgtgatggtcaggttgcagatgttacaagtggtccctncctgagtgttgaaatgctttctctgaagta

SEQ ID NO: 45456 - DNA, 101 bp, rice(Oryza sativa)
  misc_feature (71): n=a or g
ggataacgctcgggttctcgagaacttgtcgtcgcctagcgtgattgtcccagcgccgatctccgtcgtcntcatcattacggcgtcgtcctcgaccggta

SEQ ID NO: 45457 - DNA, 101 bp, rice(Oryza sativa)
  misc_feature (71): n=a or g
gttggcatggcaatcatatgtgtcatccataatgacagctagtacaaataacttggcaaataccatccttntgaccgctaagtcttcctcatagaacacca

SEQ ID NO: 45458 - DNA, 101 bp, rice(Oryza sativa)
  misc_feature (71): n=a or g
tctgttaagggcatttaacggttttaacaaaaacctaaaaaaccacttctaccatgactcatctgacgccncaccacccttctcactgcgggtaacagcga

SEQ ID NO: 45459 - DNA, 101 bp, rice(Oryza sativa)
  misc_feature (71): n=t or c
tccagattaacttgctaggttattatatgccacttggacatgaaacatcagattgatcaagtctcaaccancttctgttagtaattctcagaagataatga

SEQ ID NO: 45460 - DNA, 101 bp, rice(Oryza sativa)
  misc_feature (71): n=t or c
gcgtgcatgtaaaaaaagttgcagttttctcatttgttgaaacgaacacagccaagaacacaattcaattnccatataaaaactataaagtttaaaacaaa

SEQ ID NO: 45461 - DNA, 101 bp, rice(Oryza sativa)
  misc_feature (71): n=t or c
actcaggcctgacgaaacaaatgtggccaaagcgatgacgcgtaacccagtttttgttatgtccaactcancagccattgaagcattacaaaagatggtca

SEQ ID NO: 45462 - DNA, 101 bp, rice(Oryza sativa)
  misc_feature (71): n=a or c
agatttgggtggtgagatcagggttttcaagcatcaaaaaagttctgcaaaggaacacacggaagcaccgnagctgtggttgtcgagacacggaaagagcg

SEQ ID NO: 45463 - DNA, 101 bp, rice(Oryza sativa)
  misc_feature (71): n=t or c
cacgcccccgcccgcgcccccgccccgccagcctccttactgttttgccaatatttactggccaccttttngatcaaccttttcccggcgaagtaggacac

SEQ ID NO: 45464 - DNA, 101 bp, rice(Oryza sativa)
  misc_feature (71): n=t or c
gatcctcgtaatctgtctccgagcaaatgtagaatcggctcgtgaagagcgacgacggcacgcagatttcngatatccagcgggccgtctggctcagcagc

SEQ ID NO: 45465 - DNA, 101 bp, rice(Oryza sativa)
  misc_feature (71): n=a or c
ctcctagcttcgccaaacagcctctcctgcacgccctctatctgttccaaatgtgaactgaggaattcatnctctggttcaccgggaaatggatgcattgc

SEQ ID NO: 45466 - DNA, 101 bp, rice(Oryza sativa)
  misc_feature (71): n=a or c
cttactttgccccaacctggtaaacgtttcactgtctattccaatgcttcatgtcacgccccgagctagtnccgaccggaactagcccgtgacgctccaaa

SEQ ID NO: 45467 - DNA, 101 bp, rice(Oryza sativa)
  misc_feature (71): n=a or g
gcgcaggaaaaattgaagcactcggatttatcattcttgggcaagttacttgactgcaaaggtctcagggnctactgtggagattatggataccccatatc

SEQ ID NO: 45468 - DNA, 101 bp, rice(Oryza sativa)
  misc_feature (71): n=a or c
caaaggcccaataaccttcgatgattcgtttcatcagtgcaaattgtccacggtccctccaccgaaccagntcgaagccctccacatcccagcaccaaaca

SEQ ID NO: 45469 - DNA, 101 bp, rice(Oryza sativa)
  misc_feature (71): n=t or c
agagtactgatatacttactttttttttcctggaactgagtatatactagatttaatttcttggaacgagnatatcccgagttcttttctaaacaagtttg

SEQ ID NO: 45470 - DNA, 101 bp, rice(Oryza sativa)
  misc_feature (71): n=a or g
cctgcgagagagcatttttgaaataactttatacaccacattgcaaagactgatagggcggaattgagccnccatatctgggttagacacctttggtatca

SEQ ID NO: 45471 - DNA, 101 bp, rice(Oryza sativa)
  misc_feature (71): n=t or c
gacaaccatcacatgtattcaggtcacaaaacatgatggtcaatcccacagctgctgttgcttcacaaaanacaatcatccagatgcagagggagggctgg

SEQ ID NO: 45472 - DNA, 101 bp, rice(Oryza sativa)
  misc_feature (71): n=t or c
attcgcccctacatacaaaggctgcctcctataagatccacttacccggaaaaatatgtggtgaaaaccanatgtggaaacttagaaactatctttggatc

SEQ ID NO: 45473 - DNA, 101 bp, rice(Oryza sativa)
  misc_feature (71): n=a or g
aagcccaaaaaccaaaaccacaatttgcgaattaagcaaggcccaagcaaaattacgttttcccttctganccaatggacattcctgcaaattattgatat

SEQ ID NO: 45474 - DNA, 101 bp, rice(Oryza sativa)
  misc_feature (71): n=a or g
agaatcgtcgccacagtcaccaaggacactattgtcacatctgtctgcataatcgtcatcaaatataacanttgcagctaccaaggatggcatgctttcaa

SEQ ID NO: 45475 - DNA, 101 bp, rice(Oryza sativa)
  misc_feature (71): n=t or c
gttatcacaggtggaccacataaggggccgcccgcgataatcatcttcgcaggcgggatacttataagcgncgcctgcaatcttcgcaggcgggcagctta

SEQ ID NO: 45476 - DNA, 101 bp, rice(Oryza sativa)
  misc_feature (71): n=a or g
ctcagctactctgtccgatgatgtgaagagaaatcttgaagacatatctcatcagctagggtcatcattanacagcttggtagctgattgtgcttcaatcc

SEQ ID NO: 45477 - DNA, 101 bp, rice(Oryza sativa)
  misc_feature (71): n=t or c
cctgaccatgaaccacctcatcttcttcctctcctcctcccactccctcgcatgctgcctccttccgtcgncgccgctgccatggaggaacccgctggctg

SEQ ID NO: 45478 - DNA, 101 bp, rice(Oryza sativa)
  misc_feature (71): n=a or g
gtgacatgtgcattagcaagcactccgtctcctcaaataacttaggacatttgcgaatgatttggggcctnttcaggttgtaaccaaaataaaccttacca

SEQ ID NO: 45479 - DNA, 101 bp, rice(Oryza sativa)
  misc_feature (71): n=a or g
taacatgctgcatggcagcatcccttctgacattggtcgcatgcttcccggtatacaagtgtttggattgnatgttaaccggtttacaggagtcatccctc

SEQ ID NO: 45480 - DNA, 101 bp, rice(Oryza sativa)
  misc_feature (71): n=a or g
gttctaagcgagaaacagctccttgagatatttttgttgagcacctttatgagccgacagtaccacggaangatgtgatcaagatagcgggcacccaagaa

SEQ ID NO: 45481 - DNA, 101 bp, rice(Oryza sativa)
  misc_feature (71): n=a or g
atgggtttgcgctggggtggtcgatgcccaggtatttgtattgttttgctcccaggaagaaacccagtatnagcacagagcactcttaattcaaatgtaat

SEQ ID NO: 45482 - DNA, 101 bp, rice(Oryza sativa)
  misc_feature (71): n=a or g
gctcgagtgtaaggtggcttctttcatctcatgtatgcattaatttcgtgtcagatttctgcgtgtgccgntcggagcagccgacggcgctgctgcagaag

SEQ ID NO: 45483 - DNA, 101 bp, rice(Oryza sativa)
  misc_feature (71): n=a or c
aaaaattgaaacgaggtccgatgacggatgaatcaatagcagcccagaaggaagttcttttacaactgganttgcagttagaacaggaggagatttactgg

SEQ ID NO: 45484 - DNA, 101 bp, rice(Oryza sativa)
  misc_feature (71): n=t or c
acggctcgctatctggcagcttgcgcagacaaattcccatatgcatgctggcagagtggcagtaagttttnccctaaattttatcctagaaacttcaatgt

SEQ ID NO: 45485 - DNA, 101 bp, rice(Oryza sativa)
  misc_feature (71): n=t or c
agcataattccgtagccatagccaccaaaaccgtcgagattgtattcgattcttccgactacgatctcgcnggattcctgtttccacatattgtactctgt

SEQ ID NO: 45486 - DNA, 101 bp, rice(Oryza sativa)
  misc_feature (71): n=a or g
gacaaaaagcctgttaagtttcaccaaggttggtctttattgttcattgcttcatgtgtaccttctttcanacaagtacatcttcttgagttctagttcat

SEQ ID NO: 45487 - DNA, 101 bp, rice(Oryza sativa)
  misc_feature (71): n=a or g
ctcttctcctacctcctagtcgtagtcactacatcacactagagggcatgagtcaaacgaccaaaaaattntcttgccatctccgctgcgccaccaccggc

SEQ ID NO: 45488 - DNA, 101 bp, rice(Oryza sativa)
  misc_feature (71): n=t or c
tttcgtttggcaccggatgacttcgcaggaggagctttgatcttgccaatggcgtccgcctttgttggacnggagctgcaggttgccgctgctgtcgccga

SEQ ID NO: 45489 - DNA, 101 bp, rice(Oryza sativa)
  misc_feature (71): n=t or c
gtttatatcttgaaaaacataactaaacaaataggggcattacaaggaacataccttcttctgttcccacntcgagggtacaaatcgcctctttggctccg

SEQ ID NO: 45490 - DNA, 101 bp, rice(Oryza sativa)
  misc_feature (71): n=a or c
tcgtctccagctcactcgtccatgatataacatgggctcactattcactaacatgatactagtaatgtagnacatgcatatttaaaaacattattagtttc

SEQ ID NO: 45491 - DNA, 101 bp, rice(Oryza sativa)
  misc_feature (71): n=t or g
tggtgctagcttgatgctcgatggcctgcatgacggtgattagacagaggcagatggatggatggatgtgntcatctgatttcatggatgcattaggctgg

SEQ ID NO: 45492 - DNA, 101 bp, rice(Oryza sativa)
  misc_feature (71): n=t or c
cgacgacgcctcgctgcgggagatggcccgcttcacgccgctcccgttcttggacatgccaccatccctcntactgcttccgccgccgctgctccacgtcc

SEQ ID NO: 45493 - DNA, 101 bp, rice(Oryza sativa)
  misc_feature (71): n=t or c
gtatcttttcaaggggtgcagtattgcagtggaaatgttggagtattattctgtgaggggaggcgggcaancatggatatccacagtttgtccttttattt

SEQ ID NO: 45494 - DNA, 101 bp, rice(Oryza sativa)
  misc_feature (71): n=t or c
taagaaagttgctttaaaaaattatattaatccatttttcccacttatttagctaacactccctccgtccngctcattaaggcgcacacattttaaaattc

SEQ ID NO: 45495 - DNA, 101 bp, rice(Oryza sativa)
  misc_feature (71): n=t or g
tgtgctttacaagttctgactcttaacatggtcttctgctcattctctttcatcagatatgcgacatggtngtaattgcgagatatttgaatgtcactttg

SEQ ID NO: 45496 - DNA, 101 bp, rice(Oryza sativa)
  misc_feature (71): n=t or c
gtttacaaattgaacctaaaaagcttattccaggaataaaccattttcttctcggtgccggtgaccttggngcccttggcacccaacaaggctagcaccga

SEQ ID NO: 45497 - DNA, 101 bp, rice(Oryza sativa)
  misc_feature (71): n=t or c
atggcctatatggtatgagttggcttgtgtttacggctaacgaatgtcgtcggggcgttacatacaagcangaggatttgccgactgaggttgttcaggtg

SEQ ID NO: 45498 - DNA, 101 bp, rice(Oryza sativa)
  misc_feature (71): n=t or c
aatgtgaaagggcatgtaccccagtagttataagagtctcagtgataccttaggttctggcttcgactccncatgggagtgaatttaaatttttcaggatt

SEQ ID NO: 45499 - DNA, 101 bp, rice(Oryza sativa)
  misc_feature (71): n=t or c
aggatataagtgctatgttattgcatacaggtagacaagtctactgaaaacagctcaaatttggcaacaantaattatacaatagcttgtttgctttaagt

SEQ ID NO: 45500 - DNA, 101 bp, rice(Oryza sativa)
  misc_feature (71): n=a or g
atggtcagattccagcaatacatcgagtgagttcagttcttcgctgtctttgatgatcaggattctgagancccggaggccaagcagaaatggatccatat

SEQ ID NO: 45501 - DNA, 101 bp, rice(Oryza sativa)
  misc_feature (71): n=a or c
agaggaggcacaaccaccgatgttggctgaatggaagccataactgctgcattcaggaggtcaactcagantaatcaaaacggtgtcatggcactacattt

SEQ ID NO: 45502 - DNA, 101 bp, rice(Oryza sativa)
  misc_feature (71): n=a or g
gctacctgattgattgcgagcatcttctaggtaggaatccctctcatcctctgtggttatagaggaaatgngcttgattaagctgtagcgtgtattcctgt

SEQ ID NO: 45503 - DNA, 101 bp, rice(Oryza sativa)
  misc_feature (71): n=a or g
gagtccagagcgaacaaggattgtattaggagttttcgacatccaaaatctgggcagtaattcaccgcacnggctgctggttgtaatggctcttctctttc

SEQ ID NO: 45504 - DNA, 101 bp, rice(Oryza sativa)
  misc_feature (71): n=t or c
taacctcccttatcttgttgtcgagttttaactgttccgaacttgaagatataatgtatccctaatcttgnaaaaccgggtcacatttgatcccaaggtat

SEQ ID NO: 45505 - DNA, 101 bp, rice(Oryza sativa)
  misc_feature (71): n=t or c
tccgggtaccgtgtgccccatagcatgcatgacggtggaaggaggtgacgacgcgcctcgccgtgatcagnagtcgacgagcgggatggttgcctggttgg

SEQ ID NO: 45506 - DNA, 101 bp, rice(Oryza sativa)
  misc_feature (71): n=a or c
ttctatataatcgtgtcatactccatgtttcttgcatgcatgtcatactaatagtaatagttagtactccntccgtcccaaaatataagtatttttagcat

SEQ ID NO: 45507 - DNA, 101 bp, rice(Oryza sativa)
  misc_feature (71): n=a or c
agtggacaaaatatagagttaccatattttggtagagcaatgaagtttaatcacgatgaggggagggtganggcgtccatgaactcctcgtcggcgacgag

SEQ ID NO: 45508 - DNA, 101 bp, rice(Oryza sativa)
  misc_feature (71): n=t or c
tagaagaatattaagtaaacaaacatgaggcttcatctgaatgcagaaagtggttacctgcaattctactncagtcgacgatagcacagacctctgtacgg

SEQ ID NO: 45509 - DNA, 101 bp, rice(Oryza sativa)
  misc_feature (71): n=a or g
gtgctcgtgcaggcaggccgatcatatctctgtctcgtagggatagggatgcaagcaggaagcaggacggntaaacgggatttttttttacccgtttatct

SEQ ID NO: 45510 - DNA, 101 bp, rice(Oryza sativa)
  misc_feature (71): n=t or c
ggcggcggggccatgttccatcgaggtattagtctcatctaaatctgttactaccaaattcacggcgtggntccgtggcgcgcgatttctgtactgattgc

SEQ ID NO: 45511 - DNA, 101 bp, rice(Oryza sativa)
  misc_feature (71): n=a or g
tctcgtgtgttgagtcttgtttggagattttgtggcagttgcagtttctctcggaattataaacttttttnttcagattttaaaaagttgtaattcataaa

SEQ ID NO: 45512 - DNA, 101 bp, rice(Oryza sativa)
  misc_feature (71): n=t or c
ggtgaactgcggtggtgttaagtagtaagttggcgagtaaagtcattttgtttcttaaggtgatgtccctngtttcttgcgtaccattaaaagagttataa

SEQ ID NO: 45513 - DNA, 101 bp, rice(Oryza sativa)
  misc_feature (71): n=a or g
cagagttcgttacatcagttatcattaatgtgttagtggaatcacacctaagatgtattaggtttttctcngttgctaatgtagtgtattcatatgtcatg

SEQ ID NO: 45514 - DNA, 101 bp, rice(Oryza sativa)
  misc_feature (71): n=t or c
ccaactcacaagaacaccatatgggaggcgtttcgctaacaaggtccagatttttgccctagctgtttgcntgcacttgaaattctttttacttacaaagg

SEQ ID NO: 45515 - DNA, 101 bp, rice(Oryza sativa)
  misc_feature (71): n=t or c
tgcagcaatcaaaagcttccccatttcgtcatgagcaaatacgaaggctagaactagtccgcctaattgtnggctctcttatctcttcatctattttcatt

SEQ ID NO: 45516 - DNA, 101 bp, rice(Oryza sativa)
  misc_feature (71): n=a or g
gtcgatttatctcctttctgatcaacaagtttttatataatctgttctccgaggaaaaggtgaaaaggctngagcaactccttcgaagagttcacatggtc

SEQ ID NO: 45517 - DNA, 101 bp, rice(Oryza sativa)
  misc_feature (71): n=a or c
ttatcttctcctctccctctctctcaccttttaacctcctctcctctcttctcctctttagacggctggcngctccggtggttaattcgagaatgatactt

SEQ ID NO: 45518 - DNA, 101 bp, rice(Oryza sativa)
  misc_feature (71): n=a or g
agtagggcacttcacctctctatttgtcaaaactattagccaaatattgcaactcacatattggcgtgtgnccctgtaattgagagaggtagaatgatatt

SEQ ID NO: 45519 - DNA, 101 bp, rice(Oryza sativa)
  misc_feature (71): n=t or c
tctagcgactctggatgcaaatggactttctcgatgtcatcattatcttgtcctcctgcgtggttagtggnagctaaagcatattcatcatcacaatcact

SEQ ID NO: 45520 - DNA, 101 bp, rice(Oryza sativa)
  misc_feature (71): n=t or c
aattctatctgcaccaactgatcgagaacgggctgttgataaatgttcatctggttttggactgttgggtngttcttgtcgctcacttgaagatctgacta

SEQ ID NO: 45521 - DNA, 101 bp, rice(Oryza sativa)
  misc_feature (71): n=a or g
acgttgtcaggaactcatcagaatgctgtttttaggatcatgtacatagagtacacattgagaaaaacaantctgaagtttaatgattgtaactctggaca

SEQ ID NO: 45522 - DNA, 101 bp, rice(Oryza sativa)
  misc_feature (71): n=t or c
aagaccgagtagtttgtagctttctgacctggtcaagaaagtttggatttcaccggttttcatcggttttntaaacacagggcatacacctatggcttatt

SEQ ID NO: 45523 - DNA, 101 bp, rice(Oryza sativa)
  misc_feature (71): n=a or g
aaagaaaaaggaaaaagaggaggaaaggggaaagtaaataaatgggagagggaactcagaaaaaatgtganaaaatgggagaaagtaggaaaaatattcga

SEQ ID NO: 45524 - DNA, 101 bp, rice(Oryza sativa)
  misc_feature (71): n=a or g
acagtaagtgtagacacagaggtgaacaataggtccaaatcctttggacctggcttaccctggggcttganattcttcagagcaaggaaaccagcaaatga

SEQ ID NO: 45525 - DNA, 101 bp, rice(Oryza sativa)
  misc_feature (71): n=a or g
atcaaacaacaaacttacaggggatctcccaacggcaataatgttgatgccaatgcttcaacctgacaagnttgcaacccaattggatcccagggcatttg

SEQ ID NO: 45526 - DNA, 101 bp, rice(Oryza sativa)
  misc_feature (71): n=a or g
cgcccttctcctagcggaggaagaggaagccatcgaggagagaggtggtggtggatgaactggtggcattncagcgaccgaagatgcagcgggagaggaag

SEQ ID NO: 45527 - DNA, 101 bp, rice(Oryza sativa)
  misc_feature (71): n=a or g
ttatcttaataaaggcagggtggtcgagaaggcttgtttttctattcctagtttctatcactcctacatcntaagttgtcaaagacgatagatttgagaac

SEQ ID NO: 45528 - DNA, 101 bp, rice(Oryza sativa)
  misc_feature (71): n=t or c
gagacctggagtcaagcttgctccagccgaagaggatagaataatgagaggataaccaacggactccgctncagtgacttagctaaggcaagtcacagcgt

SEQ ID NO: 45529 - DNA, 101 bp, rice(Oryza sativa)
  misc_feature (71): n=a or g
agtgaatatttgaaggttgcattagttctaatatatgattgcttgtattctggaagtgcataccacccacntgttttatattgtcaggctaacttatctct

SEQ ID NO: 45530 - DNA, 101 bp, rice(Oryza sativa)
  misc_feature (71): n=a or g
cgcgttaaacactagacattatattatccggggtacccacagcaccagtatcttaacctctagacattttntacgagcagctatataggtattgtatattc

SEQ ID NO: 45531 - DNA, 101 bp, rice(Oryza sativa)
  misc_feature (71): n=t or c
caaataacgatgtaaaataatgtgtcaaatgatttaagtgaaaaccaaatggatgaatgtttctctaattnaagagtgtcacacaatagtttagaaatatt

SEQ ID NO: 45532 - DNA, 101 bp, rice(Oryza sativa)
  misc_feature (71): n=a or g
gaccgtgttcgtgttcagcgacatggagttcgacgaggcgtcgaccaaccactgggagaccgactacgagnccatctgcaggaagttcgggagcgccggct

SEQ ID NO: 45533 - DNA, 101 bp, rice(Oryza sativa)
  misc_feature (71): n=a or g
gacagcaccagcggcagtgccaggggtgacagcggcgagctcgtcaacaacgacaccaccgttgctgacancaatgccagtggcgttgctgacagcaccac

SEQ ID NO: 45534 - DNA, 101 bp, rice(Oryza sativa)
  misc_feature (71): n=t or c
atatcagaaatctcaacttgcaagctgtaaaaaccttgcccagggaacccaaacccacacagcttaatacncttctttcccaaaagcaatggacagtgaga

SEQ ID NO: 45535 - DNA, 101 bp, rice(Oryza sativa)
  misc_feature (71): n=a or g
ttgctgatggacttcgagcttttcttggtgacctgacatggtaaagcattatacattgaaccgattctcancatcaatcttctccaaatgcattccccaca

SEQ ID NO: 45536 - DNA, 101 bp, rice(Oryza sativa)
  misc_feature (71): n=t or c
tccagggcaccgaataagtatagatgaagttacccacaaagagatcaaaagcacgggagcaataatcaacngatatattagcacgccagaagaagaattgc

SEQ ID NO: 45537 - DNA, 101 bp, rice(Oryza sativa)
  misc_feature (71): n=a or g
cttgcagatttgtttgtgaactggaaaccatcacccacacagatggaagatacagatgttggtgaccaggnctggctcttcagctgccgggcgacccctaa

SEQ ID NO: 45538 - DNA, 101 bp, rice(Oryza sativa)
  misc_feature (71): n=a or g
actgccaaagttgccgccgattgccacagctggctttgcggcaacaacaacttcatcatcgctgccgcccnccagatctactctcctcctcttcctccacc

SEQ ID NO: 45539 - DNA, 101 bp, rice(Oryza sativa)
  misc_feature (71): n=a or c
gtgtaccgtgtaccgcagtaccgtgtactatgagctgcagtgcaaatgtcaccctcacctgcatgcttggnaaggtggtgcgcctccagtgcctcccactt

SEQ ID NO: 45540 - DNA, 101 bp, rice(Oryza sativa)
  misc_feature (71): n=a or g
aagaaaaggaaaaggaagaaaaggaaaaaaagagaaaggggaaggctaatcagcaaaatggcttggattgnaattttgaattgagatgtaaccctacatat

SEQ ID NO: 45541 - DNA, 101 bp, rice(Oryza sativa)
  misc_feature (71): n=t or c
gtccgaagctgtttgtatattttattccaaacaaattctgctgctggtcttgaagacagaaggcttcctancgttacaattgctagtggtaggccatgaca

SEQ ID NO: 45542 - DNA, 101 bp, rice(Oryza sativa)
  misc_feature (71): n=a or g
gcgaacacaaatccgaatccccttcgttttcttcgtgcgggccaagtggtgcatcaaggaagtgatttgcncatttcgagagttgatctcactactgctac

SEQ ID NO: 45543 - DNA, 101 bp, rice(Oryza sativa)
  misc_feature (71): n=a or g
aaagaagaaatcagcgagagagaaaaaaaagatgagccacttcgccgccgccatgaagagccctctccccntcgccgcctccgccgccgtcgccaccggcg

SEQ ID NO: 45544 - DNA, 101 bp, rice(Oryza sativa)
  misc_feature (71): n=a or g
gaggaaaaaggagcgctgaaagatgtaccggccgctgccatgctgaagaatagaaatgataacgagaaganacggagtaggaggaggaagcctggaataac

SEQ ID NO: 45545 - DNA, 101 bp, rice(Oryza sativa)
  misc_feature (71): n=t or c
cctacactatggacgctggtgaagacagcccacaatggaggcaactggcgacaaccgggttcccgagcatnggtccacctccgaggctcgatcatgtcgcg

SEQ ID NO: 45546 - DNA, 101 bp, rice(Oryza sativa)
  misc_feature (71): n=t or c
gtagagctattactcatcctaaggacccaaaccagtataaaaacatgtctcccatctagttactataatcngtgtataccttagtaccaacgattctcata

SEQ ID NO: 45547 - DNA, 101 bp, rice(Oryza sativa)
  misc_feature (71): n=t or c
attgaataaatatgactagggtctagggacgtcatagggtttccctaggatgtacacccccttggttgacnttggaagattagatagagaggccattgttg

SEQ ID NO: 45548 - DNA, 101 bp, rice(Oryza sativa)
  misc_feature (71): n=a or g
cggcctctccctccacctgagaagagcaaggaagatattcttctgttcttcaaactctataatcccgaaanggaagaactctggtacatttatttgattaa

SEQ ID NO: 45549 - DNA, 101 bp, rice(Oryza sativa)
  misc_feature (71): n=t or c
ttcaaaactccgacctcctttggcatctccacaaaccgtatattcatcaagcattcgcggccagattattnaacactgaaccgataatgctatcaagcatt

SEQ ID NO: 45550 - DNA, 101 bp, rice(Oryza sativa)
  misc_feature (71): n=t or c
catacaatttcataccactagtaaacaatcgtctgtctaaactaaattcatagtactagaatattctaatntggattctaaattgctatattttaataatg

SEQ ID NO: 45551 - DNA, 101 bp, rice(Oryza sativa)
  misc_feature (71): n=a or c
agcattttgggatcccatataagacaggtgaagttgccaacagaatttggcaaactctaccatttgcagancctagagttccctctttcatattatttaga

SEQ ID NO: 45552 - DNA, 101 bp, rice(Oryza sativa)
  misc_feature (71): n=t or c
ctccaaattcttgataccagggtgatcaataaaggtaattcagctgtatctcaggtgctaattcattggtntggtactgcagcagaggatgccacctagga

SEQ ID NO: 45553 - DNA, 101 bp, rice(Oryza sativa)
  misc_feature (71): n=t or g
gttttctaatattatagcatctgcatcaaggactagatttctacttgcagagttccattccagactgagcnccctaagatgtcgtttcttgtacaactcgg

SEQ ID NO: 45554 - DNA, 101 bp, rice(Oryza sativa)
  misc_feature (71): n=a or g
caaaattcagacattgtttgttattttttataagactctttttgtctgttgggctttctttcaaagccggntcaatataattaatctgtttcaaaaaacaa

SEQ ID NO: 45555 - DNA, 101 bp, rice(Oryza sativa)
  misc_feature (71): n=a or g
gccatccggcacagggtacgtacgtacgcgtgcaggagttaattaaaacattttggatggtgaggacgaangattaattaattggcagctatgtacgtacg

SEQ ID NO: 45556 - DNA, 101 bp, rice(Oryza sativa)
  misc_feature (71): n=a or g
tgtatgcagcttttttctggtggatggggtttggctagccaatcaattccttggaaagaggtagaagttcnaatgtatgcacttagcatggtaagtgcctc

SEQ ID NO: 45557 - DNA, 101 bp, rice(Oryza sativa)
  misc_feature (71): n=t or g
tgacatttggtctttcttttttttttcgccttttactcgaatcaatgtgtggcacgcattttttcacaaanataattttggtcaaatacatatatacttga

SEQ ID NO: 45558 - DNA, 101 bp, rice(Oryza sativa)
  misc_feature (71): n=a or g
caaggatctggagctgaagcggatgcaggctttcgtggacgtgcagcttcagcttgcaaaggcaaagcacnggaagcatcctgatggtgccacggagatgc

SEQ ID NO: 45559 - DNA, 101 bp, rice(Oryza sativa)
  misc_feature (71): n=t or g
acaatcataaggaggaacattcagccaaagcccagtttatatatcaccaaacaacatccatcatccaaccntcttattgataggcaatcagcaaacaatca

SEQ ID NO: 45560 - DNA, 101 bp, rice(Oryza sativa)
  misc_feature (71): n=t or c
aggaatttcacttgggctaacaatttagcaaacccaacctatgagaagctggataggattttagtgtcaanagagtgggagcaaaagttttctttatcttc

SEQ ID NO: 45561 - DNA, 101 bp, rice(Oryza sativa)
  misc_feature (71): n=a or g
ctccatggttccttcaacaacatctggtaatgcggggaccttcttatctgaagaactcatatcaacatttntagttttcacttcgctatggctctcaacat

SEQ ID NO: 45562 - DNA, 101 bp, rice(Oryza sativa)
  misc_feature (71): n=a or g
gtttgatggcttctccggtgaattgaagcaaatttatatggcgcgcgaagccaatcgatggatcgacgtgntcgcttgcggttacgtgtgtggattaaagg

SEQ ID NO: 45563 - DNA, 101 bp, rice(Oryza sativa)
  misc_feature (71): n=t or c
acaatatcgtgcctatccgttacctacaatatcatgctgacgtcagcacacattagctattctgttacaanagtataccattctatagtctctctaatact

SEQ ID NO: 45564 - DNA, 101 bp, rice(Oryza sativa)
  misc_feature (71): n=a or g
cataccatgtgttgtgatgtggcctcctcttgatgagaacttccaagaaattcatgaggatagagcacagncatcaacatcgggagtgaatgaccggaata

SEQ ID NO: 45565 - DNA, 101 bp, rice(Oryza sativa)
  misc_feature (71): n=a or g
ggggtttttaagttccaactagcccaatatttcgatcaaacgctgactccatatcgccttgttggttatgnccaaatattgtactgcatagacaatatttg

SEQ ID NO: 45566 - DNA, 101 bp, rice(Oryza sativa)
  misc_feature (71): n=a or g
aacatatccgaaggaactcaccatctgggttaggaggttttgtacctgaaagagattataatcggtaaaanaaacctttttttcctgaataaagcgatata

SEQ ID NO: 45567 - DNA, 101 bp, rice(Oryza sativa)
  misc_feature (71): n=a or g
catgcgaagttaagttaggctgtgttcgatacccttgagttcctcgtgtacgcttttcaaattgctaaacnttttttcaaaaagtttttatacgaaagttg

SEQ ID NO: 45568 - DNA, 101 bp, rice(Oryza sativa)
  misc_feature (71): n=a or g
aacagaagtgtcgggccggcgacattgacgggtttcagcgactctgacatggctggagatgttgacacccngaagagcaccatgggagtcctcttcttcct

SEQ ID NO: 45569 - DNA, 101 bp, rice(Oryza sativa)
  misc_feature (71): n=t or g
ttgctggagatattcattacctgtagtggaagggaaaggctaggatttgatgactgcagctcttgaagtgnaccatctaggtggttgaagctgacatcaag

SEQ ID NO: 45570 - DNA, 101 bp, rice(Oryza sativa)
  misc_feature (71): n=t or c
gcagaaatataaggcccatctattaatgagcccttcgttctcttccatttccatttccatctccctctctnctccctccagcaaaatcctgctaataccga

SEQ ID NO: 45571 - DNA, 101 bp, rice(Oryza sativa)
  misc_feature (71): n=a or c
aaaactttacaccctggatctaatcatctaaacacccccttaatatatgttggacgaaactgttgaggagncaggaagtctaccactccattactggttgc

SEQ ID NO: 45572 - DNA, 101 bp, rice(Oryza sativa)
  misc_feature (71): n=a or g
ctttatattgttcggaatttctaaaaagggaatcactccccccttcaaaataggcagatacgagggtacgntttataaatagccccctccacctccaagct

SEQ ID NO: 45573 - DNA, 101 bp, rice(Oryza sativa)
  misc_feature (71): n=t or c
acgagttttacttatatgcatatacacgtatatttatccaacaatgtttttcaggtttatatatgtggttnaaattatatattttttctagaaaaaagagg

SEQ ID NO: 45574 - DNA, 101 bp, rice(Oryza sativa)
  misc_feature (71): n=a or g
cgtaactgaactcatggtggatgtatggttttttccttgtagaccccaaaaggcccattcaagatgttacnaaggaccttgtgggttcttccatttctgtc

SEQ ID NO: 45575 - DNA, 101 bp, rice(Oryza sativa)
  misc_feature (71): n=a or c
gacggattctaacagcgactagatgtcttggtcataaaaaaaaagttcacgacaacaaacaggatcgtcanaaaagtggtgattcgtcatcagaagttgga

SEQ ID NO: 45576 - DNA, 101 bp, rice(Oryza sativa)
  misc_feature (71): n=a or c
cgcatgctttctttctccttcacgagaaaaaaaaaaatggcccgctcaggtaactccgatgataccctctntagtctctatgtacataggaagaaagtgct

SEQ ID NO: 45577 - DNA, 101 bp, rice(Oryza sativa)
  misc_feature (71): n=a or g
aaatagtacagtgttttgaggagcctggacatttcattaagaattgtatgccctcttttggctaaaaatcnatctctcttttaactatttcaatttttgaa

SEQ ID NO: 45578 - DNA, 101 bp, rice(Oryza sativa)
  misc_feature (71): n=a or g
agctaacacctcaacaacacaggtgcacagaaatgttaactctattgtctgaatttcaacctgtacacaancaagccagatagaacagtgaagcctagtat

SEQ ID NO: 45579 - DNA, 101 bp, rice(Oryza sativa)
  misc_feature (71): n=t or g
atggacatgataatagaagcaaaagagaattttcaatttcctttcttcatggagacttttgcaatctgctnttggaacatttgaagcagaagaaatgattt

SEQ ID NO: 45580 - DNA, 101 bp, rice(Oryza sativa)
  misc_feature (71): n=t or c
gaataatcaggaacatggcctttcaattgcgaaacatgaaagaccgaatgaaccatatactcccttccagnagtgccaatttataagttgctgctccaatc

SEQ ID NO: 45581 - DNA, 101 bp, rice(Oryza sativa)
  misc_feature (71): n=a or g
tcacgcaaatcacacggtattgctaacatattgcccacgcccctctcgtgatctaatttcctatcggagangagggaagctgacgtgataacgcaaaattt

SEQ ID NO: 45582 - DNA, 101 bp, rice(Oryza sativa)
  misc_feature (71): n=a or g
cagcttcatgtgcctctcattcgtgacggtgggcatggttcaccttgtgcttgttcttcatcttacgatgntgaggggagtcggcggttttccaaggctga

SEQ ID NO: 45583 - DNA, 101 bp, rice(Oryza sativa)
  misc_feature (71): n=a or g
gggagcacattgattggttcgtcgatctctagtctttagagaaatcaatgcgcgtcattgcaaattctgtntaaatgaatatgctagtatctgaaatacta

SEQ ID NO: 45584 - DNA, 101 bp, rice(Oryza sativa)
  misc_feature (71): n=a or c
gccgacctgtccaccaacctaggtgaccagctcaacgagctcttctatgatgtcctgccggagctgtcgcnggcggcgcgcgaggtcctgtccgggctgct

SEQ ID NO: 45585 - DNA, 101 bp, rice(Oryza sativa)
  misc_feature (71): n=a or c
aagatccatagaattttctttgacagcatgaacaccacctgtcccagcatgcaaaatcatctaaatactgnaatgttaaaagtatgttactaaaatattat

SEQ ID NO: 45586 - DNA, 101 bp, rice(Oryza sativa)
  misc_feature (71): n=t or c
taccagacgattattggttctcccgctttgtatggtcgatccacaaccaaccgaacagaatcaccaacagntgtcagcattgctttgcagttgctcttgta

SEQ ID NO: 45587 - DNA, 101 bp, rice(Oryza sativa)
  misc_feature (71): n=a or g
aaaaagtcaaatctgattgaattttaaaggcatgatatattatatggaagaacagccgctactagaaaaantattttcgcaggcggccaaaaatgattttt

SEQ ID NO: 45588 - DNA, 101 bp, rice(Oryza sativa)
  misc_feature (71): n=a or g
gggccccacactttttttcccttgtcaccccatgtctattttaatcttcacaacgactgggctgctatatngattcgcgcattgccatccacctacgaaat

SEQ ID NO: 45589 - DNA, 101 bp, rice(Oryza sativa)
  misc_feature (71): n=t or g
ctccagccaaggcccttgccgaagactatggattgtactggacagtgcagcagaagattgatgaccttttncagcgatctgagcgcaatatcatgccaaag

SEQ ID NO: 45590 - DNA, 101 bp, rice(Oryza sativa)
  misc_feature (71): n=t or c
gtcttccgatgctactttctctaccacatagctcaagtaatctctggtcctttcgtccttgtcatgagtgnacttgtgtaacaagttatactgtccaattt

SEQ ID NO: 45591 - DNA, 101 bp, rice(Oryza sativa)
  misc_feature (71): n=a or g
atgctcgagatcaccaattcttgatggcatcaccttgacatctgtacctctcaagctcaagaaccttaganggtacatccggcagatacaactcatatgct

SEQ ID NO: 45592 - DNA, 101 bp, rice(Oryza sativa)
  misc_feature (71): n=a or g
aagaactagacaggtggagcggagtttgggctgctccgtggctctattgctaaagttagatttagtagttngtgccctaccaaacagatcattgataactc

SEQ ID NO: 45593 - DNA, 101 bp, rice(Oryza sativa)
  misc_feature (71): n=a or g
gttttcttcatcactattagtacattggttgtccaaagtcaaatgctttcttaatcatttttctctttttncaaaaacaaaggacaaacgcaggcgcttgc

SEQ ID NO: 45594 - DNA, 101 bp, rice(Oryza sativa)
  misc_feature (71): n=a or g
gccctaccaatgaatagagaagtttgggcataggttgatgataagcatcttatcctgccagaagcaggtcngaggtttgagcacctgaagatgcgtttttt

SEQ ID NO: 45595 - DNA, 101 bp, rice(Oryza sativa)
  misc_feature (71): n=t or g
aaatgcactaattaggcgtgcaccctacctaagtagacctccttttgcagctcccatgacttgtggttganggtgccccccaggagatcaaaaataggcat

SEQ ID NO: 45596 - DNA, 101 bp, rice(Oryza sativa)
  misc_feature (71): n=a or g
cagcttcgtagaaattaaggaagctgtgaactgacgcttttgcccttcctcttctacgcgtgacggcagcngccgccccatcctgcttctccgagcgccgc

SEQ ID NO: 45597 - DNA, 101 bp, rice(Oryza sativa)
  misc_feature (71): n=t or c
cctaagtggtgtgacaagtaggattgccagcatgggtggtgtgaaaaagtccattttgcctcttgtagacnctacaactcagccacaacctttccccacac

SEQ ID NO: 45598 - DNA, 101 bp, rice(Oryza sativa)
  misc_feature (71): n=t or g
aacttttgacaagtgacaaccattccgtacataagatggttgttttcacatttatcactcatctaactttntagggaaagaacatattttaatcaatacgc

SEQ ID NO: 45599 - DNA, 101 bp, rice(Oryza sativa)
  misc_feature (71): n=a or g
agccggccacacctggcgcatagccttctaccccagcgatggcaatttggtctccttctacctccatctcntcgacggtaggttctcgaaggatgtcaccg

SEQ ID NO: 45600 - DNA, 101 bp, rice(Oryza sativa)
  misc_feature (71): n=t or c
ttggcgaccaggagaaaagccaacacacaaaaaaaaatcccccatatatattttttttcttctctctcctncttggaaacaagacaactcatttattgttt

SEQ ID NO: 45601 - DNA, 101 bp, rice(Oryza sativa)
  misc_feature (71): n=a or g
ttacatttgtagtttcaatgtataactaatgtaagagaacaaactgcaagagcatagctatatttatgacnccatattttgtaccaaaaaatagtcggcat

SEQ ID NO: 45602 - DNA, 101 bp, rice(Oryza sativa)
  misc_feature (71): n=t or c
gacgatgagatggacgctggcgacaatggcgaaagggatacgggcgacgaggcgaggatggtggccacggntcggcgtatgcgggtgaggacgacgcaggc

SEQ ID NO: 45603 - DNA, 101 bp, rice(Oryza sativa)
  misc_feature (71): n=a or g
cagggtaccgaaccccgcgccaagagagaacaagccgcttgagtcatttgatatggaggaggaagaacctntcatggacccggcttggccgcacttgcaga

SEQ ID NO: 45604 - DNA, 101 bp, rice(Oryza sativa)
  misc_feature (71): n=a or c
gttgccaactcagtcattcataatgcattactatgttctttttatagagagggaatgattgcagaggctgngcaattcaaacaatacatgtctaggatgaa

SEQ ID NO: 45605 - DNA, 101 bp, rice(Oryza sativa)
  misc_feature (71): n=a or c
ccgtcagtatgattgtgatagctagtacacgcaaattgacgtcgcaactaaaacttcaactctagagcgancaagagggatagaattaatgaggatatata

SEQ ID NO: 45606 - DNA, 101 bp, rice(Oryza sativa)
  misc_feature (71): n=a or c
taaattcacattcatagtgaaggttttgccgaacataactatcaatgctgatgaaccttcatttgagatgntgacaattaaagaaagatttggaaggcaac

SEQ ID NO: 45607 - DNA, 101 bp, rice(Oryza sativa)
  misc_feature (71): n=a or g
tcagcgttgattacaagtttgtgcgttgtccaggtttatgtaattggtggtgatggcactcaaaaggggcncaggagtgatttttgaagtaagcacgatta

SEQ ID NO: 45608 - DNA, 101 bp, rice(Oryza sativa)
  misc_feature (71): n=a or g
taatttagatgaaaaaaatcatttaaagaggcgggggcatattaattatataaaggatggggtgcaccgtncagccatgcatgtgtagaggactcctgcat

SEQ ID NO: 45609 - DNA, 101 bp, rice(Oryza sativa)
  misc_feature (71): n=a or g
cagcgacacaagtcccaaagttggcacagtacccttagaaaagttgtccaatagcaaattttgcgccgggngggggggggggggagtaaaataaacaacac

SEQ ID NO: 45610 - DNA, 101 bp, rice(Oryza sativa)
  misc_feature (71): n=a or g
tccaccccagctaaaacaatctaggagtaaaagcaaaaccagcctccacctctctcatccccaacacaccncacaccaggggcaatcccgtaaatcgacca

SEQ ID NO: 45611 - DNA, 101 bp, rice(Oryza sativa)
  misc_feature (71): n=t or c
tgcatactgctatcagggtagagtagtctagctagacacttcggatggtaaaagtgtccacatttttcatnttcacattggaatacctgctgagacatgca

SEQ ID NO: 45612 - DNA, 101 bp, rice(Oryza sativa)
  misc_feature (71): n=t or c
tgcaggaggaagctggaaaccacgatgaattcgatctcccacgcattcacgaactgcaccgccacattgtngttgtactttaccggggatccaactccaac

SEQ ID NO: 45613 - DNA, 101 bp, rice(Oryza sativa)
  misc_feature (71): n=t or c
tcccaagttgcagtgactgtgtggaatagtggtaaaagcaatcccatgtaacctctaacagatctgtcctntcgctaaatttgaaaatatacctctttttc

SEQ ID NO: 45614 - DNA, 101 bp, rice(Oryza sativa)
  misc_feature (71): n=t or c
tggagggacacatggcaacatggcagatttttagaggggtccaactaaatttataggttgccacgtggctnaatgggaagccagatcctacaccctgcaat

SEQ ID NO: 45615 - DNA, 101 bp, rice(Oryza sativa)
  misc_feature (71): n=a or g
attcttttctgcactttttttcccctaaaaatattatcttatagtgggattcttacttgagaccctgcatngtgtgtatttccctagaaagcaatatgtca

SEQ ID NO: 45616 - DNA, 101 bp, rice(Oryza sativa)
  misc_feature (71): n=a or c
ttaaattgtagtcgttgacgatgtcttcaccaacaagcttgttggtatctagccaagaattctaggtactncttccatctaaaaaacgaatctagtactga

SEQ ID NO: 45617 - DNA, 101 bp, rice(Oryza sativa)
  misc_feature (71): n=t or g
aggcaatcgacggtgtgaaaattgagaacaacaagttctgtgtatcggtgcactaccgcaatgttgagganaaggtgaagatttatcttctcaaaatcatt

SEQ ID NO: 45618 - DNA, 101 bp, rice(Oryza sativa)
  misc_feature (71): n=t or c
gtctgcagattgatgcataccgtccttatagtttgtagcatgttgacttttttcagatgggtgctgtgtgntggatatagattcctctgcggttggttggg

SEQ ID NO: 45619 - DNA, 101 bp, rice(Oryza sativa)
  misc_feature (71): n=t or c
ttaattttgtacacataactatgtaaatatctttttttttatagtagggtaggagcctctcctgttgtttnctaaaaaaaaaagattgtttgggcggttca

SEQ ID NO: 45620 - DNA, 101 bp, rice(Oryza sativa)
  misc_feature (71): n=a or g
ttggcagcacaatctggaatccatgcgcaattacataatacacccccctaaaaactgaacttacaagaatnccatatgattttttttccacaattactctt

SEQ ID NO: 45621 - DNA, 101 bp, rice(Oryza sativa)
  misc_feature (71): n=a or g
gcctgtggaaatgtatttcgcaggcggtcagttgtcttcatttttactggcctttactgaggcggcttacnccaccatcagcgaaaaccttttttctatta

SEQ ID NO: 45622 - DNA, 101 bp, rice(Oryza sativa)
  misc_feature (71): n=a or g
caatttaaattttgtaattaaataaggatttttctccgtgctttcattacttagcttcaactttttgaatntagagtaaaaaaaaatcctaaattatttat

SEQ ID NO: 45623 - DNA, 101 bp, rice(Oryza sativa)
  misc_feature (71): n=a or g
cctcgcctcccgcgcgaatcccccctctcagattggaaccggaagaagcagcaaagcaacaaactgatctngggtactactgattagagagagagagagaa

SEQ ID NO: 45624 - DNA, 101 bp, rice(Oryza sativa)
  misc_feature (71): n=t or c
atcttgagaaatatgtacatatgctttaatcaaacctgtagaaaggtggctacggatctcgaataaaatgnacgagaagaaaagacaaaactcacggtgat

SEQ ID NO: 45625 - DNA, 101 bp, rice(Oryza sativa)
  misc_feature (71): n=a or c
cgggctaaatgtacctgcacagggtggctttctttctcctctaatccacattactgcgacaagcttcccanaccccttactggttttctctaccaaaaaag

SEQ ID NO: 45626 - DNA, 101 bp, rice(Oryza sativa)
  misc_feature (71): n=t or c
atacatggtaccagtactaccaattaagcttacaccactaagaagagcagtcttcggatagcaataacctnttccttgccagtatgcaaaccccacacagt

SEQ ID NO: 45627 - DNA, 101 bp, rice(Oryza sativa)
  misc_feature (71): n=t or c
tttattatgaatatgtaaaaatataagccatgttcaaagtaactataggtatcacacggatatgtggatcnccaataccctcacaaccagattgggaggca

SEQ ID NO: 45628 - DNA, 101 bp, rice(Oryza sativa)
  misc_feature (71): n=t or c
catacaacctaaggtgtgccttcaagtccgagatcttagatgccacaaagcaagcagcggagctgttgcgnggtttggcaaaagatttaaacaacatgaag

SEQ ID NO: 45629 - DNA, 101 bp, rice(Oryza sativa)
  misc_feature (71): n=a or g
acatgagtatgacataatttcattatttaaaaatatgataacttatacgagtataatatgtacttcgttcnttaaaaaaacgaatctacaacgggatatga

SEQ ID NO: 45630 - DNA, 101 bp, rice(Oryza sativa)
  misc_feature (71): n=t or c
ccttgttacaaaaggaaatcttggaagggagtaagagaactacttataggaagactgagggtactaatttnaacaaagttttttctagaacagctcaggtc

SEQ ID NO: 45631 - DNA, 101 bp, rice(Oryza sativa)
  misc_feature (71): n=t or c
tcaggaaagtctgcaggcactggttcaggggctaatcctgcaatgcccaagcaagccaaatcatcaaaagnttctcagaagaaagatgtgccccaagctgc

SEQ ID NO: 45632 - DNA, 101 bp, rice(Oryza sativa)
  misc_feature (71): n=t or c
ctttagcccaagcttctgtaacccttttattgctggatgtgccctcagattgtgaatgagacgattccggngctccagaagatcaaggagagcgggaaggc

SEQ ID NO: 45633 - DNA, 101 bp, rice(Oryza sativa)
  misc_feature (71): n=a or g
actgctgatgggggatctcatctctgtcaccgactagtggcctcaccaccacaccggctgacttcacactntcactgatgagcgacctcgtctccactgcc

SEQ ID NO: 45634 - DNA, 101 bp, rice(Oryza sativa)
  misc_feature (71): n=a or g
ttgtgaatttcttatccctaggtttctttgcccccatattttggtgattggagaaattaagggcccctttnatttggaggaaaaacataggaattttagag

SEQ ID NO: 45635 - DNA, 101 bp, rice(Oryza sativa)
  misc_feature (71): n=a or g
acgggaggattactgaccaaggaaaccggtcttcaagccattttcggttaatttctaagagaaaagaattngagggatttattttacaactattatgatgt

SEQ ID NO: 45636 - DNA, 101 bp, rice(Oryza sativa)
  misc_feature (71): n=t or c
gggcttatatgccccccccaccatcgcagacggtcggcttacgtgggctgcacggcttaatgcgttatccngtgcggccctaaccccggcgccggccttcg

SEQ ID NO: 45637 - DNA, 101 bp, rice(Oryza sativa)
  misc_feature (71): n=t or g
aaagctaacatatctaggtcatactgtctgtcggtggattccattaacgacaggctactcagggacacacnctttctatcggtaaaggtcttttccgacag

SEQ ID NO: 45638 - DNA, 101 bp, rice(Oryza sativa)
  misc_feature (71): n=a or c
aatatatactttccacagatcagatgtgtgattaattggttcttataaggccatccccaaccatccatatnatctagtgtccgtagcatttaatgcattgc

SEQ ID NO: 45639 - DNA, 101 bp, rice(Oryza sativa)
  misc_feature (71): n=t or c
atttacagaactgtgccaacgtgtgcctacattgtttgatttaccagttccgtgacgattcgctcgctatntgaggcattaatttacttactaaaatatcg

SEQ ID NO: 45640 - DNA, 101 bp, rice(Oryza sativa)
  misc_feature (71): n=a or c
gtcaagtgggccatcgagctttcggagttcgatctccactttgagctacgctacacaatcaagagccaggncctcgccgacttcatggcagaatggacccc

SEQ ID NO: 45641 - DNA, 101 bp, rice(Oryza sativa)
  misc_feature (71): n=t or c
gctgcaaagctttctccctggccgggtttactccatgttcttcttcctcctttgaaatgaagcagagtgangagcatccaccgaattttaaacttgtgaga

SEQ ID NO: 45642 - DNA, 101 bp, rice(Oryza sativa)
  misc_feature (71): n=t or c
ttaaagatatcttctgcattctcatcatcatcttcatcatcatggagatgctccctttgcatcttctcccncggcttatcctcaagatagtatttcctcga

SEQ ID NO: 45643 - DNA, 101 bp, rice(Oryza sativa)
  misc_feature (71): n=a or g
gtacgagcggcggacactgaagcccacatgctcagcgtaccggttgtagaaagcatacgcgtcgtcctccntctcaaagtgcatatcggtgcgtggcccat

SEQ ID NO: 45644 - DNA, 101 bp, rice(Oryza sativa)
  misc_feature (71): n=a or g
ttaaagtgtcctctactgatactctgatacagacttctccaaactggcgctactatagtcgtcgacagacnacgcgtccatgacctggcttaacactttgt

SEQ ID NO: 45645 - DNA, 101 bp, rice(Oryza sativa)
  misc_feature (71): n=a or g
agatccaacctcctcatggtcaaatagagccaccattctcacaccagattcatgcgcaagagattcttcanaagaagtcgattctattagggcctgaaaca

SEQ ID NO: 45646 - DNA, 101 bp, rice(Oryza sativa)
  misc_feature (71): n=a or g
gaacttcttgtgttataaatggttgtttatttgtgaatttgtggttatagtagtcgttgctccaaatgccncagtagcattagcacgaacatgctattatt

SEQ ID NO: 45647 - DNA, 101 bp, rice(Oryza sativa)
  misc_feature (71): n=t or g
tggtggcttatcgtgtaactatgtctcttcttccgttggactgcgaggtcatctcagatggccccattccnataccagctttttattactccggttatatc

SEQ ID NO: 45648 - DNA, 101 bp, rice(Oryza sativa)
  misc_feature (71): n=a or g
ctgctttgagtagactggttactggtcagtgaccacttatgggctaaagtgcttaaaccttgcagctagtngttgttctttacaggaattccaaaaaaaaa

SEQ ID NO: 45649 - DNA, 101 bp, rice(Oryza sativa)
  misc_feature (71): n=a or g
cgagaacgttgcctggtcgtttgcatcgtcggttcagtcgtatgagatgtttggtgatgctgttgtattcnacacgacacatcggttgcctgctctggaca

SEQ ID NO: 45650 - DNA, 101 bp, rice(Oryza sativa)
  misc_feature (71): n=a or c
tgaaccacaagccaagcaaatgacttggcacaagtatggccataggtaccatcctaacaagatagtacacnccgctgatgctgaagcatggaagcaatttg

SEQ ID NO: 45651 - DNA, 101 bp, rice(Oryza sativa)
  misc_feature (71): n=a or g
gaaggccctgaatgtttctggtttcccagaggtcctcttcactaatgcagggaagatagttcaccgtgacnaaggtatttgtatgagcataggagcataat

SEQ ID NO: 45652 - DNA, 101 bp, rice(Oryza sativa)
  misc_feature (71): n=t or c
agttaaagggaaaatgacagaggaccatacacatttgcaggcagaatcccatgaatgaataaaaacagtgnggttagtgagaaaagctttgccattgctgt

SEQ ID NO: 45653 - DNA, 101 bp, rice(Oryza sativa)
  misc_feature (71): n=a or c
actcaaatcactatacactgcatgctgatcatcaattggaagatcataacaagagaagggagcgaggaaanaccaaatggtggcaggtgttacgttgatgc

SEQ ID NO: 45654 - DNA, 101 bp, rice(Oryza sativa)
  misc_feature (71): n=t or c
aactggtgaaggtgttaatcacagatgactacatggagatccacaggcatttacccagtagaaaaaaaacnatacttttttcgcagggctaaaaaaaaggg

SEQ ID NO: 45655 - DNA, 101 bp, rice(Oryza sativa)
  misc_feature (71): n=a or g
cctcccgctctccgactctgacagcgatgcggatgaggaggatgacgaagacatggcattgctggctgcgntgggtttagaattcgattgagaagagaaat

SEQ ID NO: 45656 - DNA, 101 bp, rice(Oryza sativa)
  misc_feature (71): n=a or g
gaagcgcgtgacttagagtttggcacggaaggataaggatgtcaacgctattttgaagaagagcagtgcgncaaaggtatatttcattatgccactgagct

SEQ ID NO: 45657 - DNA, 101 bp, rice(Oryza sativa)
  misc_feature (71): n=a or c
aagatttaaataggtagttaaagtcattgccaggtagatcattcataaaacaacagggcggtgacctatcntttgacaatattcgctggtcgcttttatca

SEQ ID NO: 45658 - DNA, 101 bp, rice(Oryza sativa)
  misc_feature (71): n=a or c
ggtctatatcttgttcccgatatgtgcataactgtacttgaaatgtactatccctcaacttgccatcgganggtaagccaaatttcgattttgcagacgac

SEQ ID NO: 45659 - DNA, 101 bp, rice(Oryza sativa)
  misc_feature (71): n=t or c
ccgaccatacaaccacattccccgcacagaattttacggcgcggcgctgaatcaaaccaaaattagaatanggaagcgtgaaattgcaatgtaccttcggt

SEQ ID NO: 45660 - DNA, 101 bp, rice(Oryza sativa)
  misc_feature (71): n=t or g
gccctcgccttcaacttcacctttatcaggagcgcccaattggagtaattggtcttagtgagaacgggtanatactcccgcccacctcgaatgacccgctg

SEQ ID NO: 45661 - DNA, 101 bp, rice(Oryza sativa)
  misc_feature (71): n=a or g
tccttaaatccccttcaaaatctaagctgtacatgaaatgcaattccattcttattttatctcggtttccnttagcactttttcaaactactaaaggctat

SEQ ID NO: 45662 - DNA, 101 bp, rice(Oryza sativa)
  misc_feature (71): n=a or g
attggctcttcctccaattccacttacaatcttgacggagagccaacacgatggaaggggtaaacgcactntgggcacaaccccttgcgacagtgcacagc

SEQ ID NO: 45663 - DNA, 101 bp, rice(Oryza sativa)
  misc_feature (71): n=a or c
ataagccacaccattattagttcagtgatgaacttgattgaggtgcatattagttcctcaggctgtccatntaatccttctttattaaaaaaaatgctcct

SEQ ID NO: 45664 - DNA, 101 bp, rice(Oryza sativa)
  misc_feature (71): n=t or c
aaaaaatttgaaactgatgagatggaagagatgtgggaggataaacttgtagacggacctttaagaggccngcacgtgaaaattgattttcacgtgcggac

SEQ ID NO: 45665 - DNA, 101 bp, rice(Oryza sativa)
  misc_feature (71): n=a or g
cttccccgtcggattcacggccaatggcaaggcctgcgcgtagaatggtaaatatcattcagttaggaaangattaaaccgaaattgggattgggtctcga

SEQ ID NO: 45666 - DNA, 101 bp, rice(Oryza sativa)
  misc_feature (71): n=t or c
atcttcatggcaaggaagtccttgggaatggtatcaagatccataaaacatttcctggcctttgcatctgntatcagtaaagcccagtcctcagactgcat

SEQ ID NO: 45667 - DNA, 101 bp, rice(Oryza sativa)
  misc_feature (71): n=t or c
aagcaagcatggggcctaaggtgtatcagactcctaagctttggtacatcatgttgatgcgaaaaacacanactggcctgggagatctgcttagctctagt

SEQ ID NO: 45668 - DNA, 101 bp, rice(Oryza sativa)
  misc_feature (71): n=a or g
gcaaagatttaaaaatcttaaaaataatgcaatgaacagtttatatatgcttgcaccctgtaattggcaangttttttgattttcttgcataatataatcg

SEQ ID NO: 45669 - DNA, 101 bp, rice(Oryza sativa)
  misc_feature (71): n=t or c
ctgggatggttattcgagctccagattgtgtattcagtgttctggccaatggtctgtagcatgcttgttgntatcagtaatatgctgaactgttgcttcag

SEQ ID NO: 45670 - DNA, 101 bp, rice(Oryza sativa)
  misc_feature (71): n=a or g
taaaacaacaaaaatcgattacaattgcgacaaacatcatacctagcgacgtgggtacagatcccaacctnagtctggctcttttcgcttcaatactggca

SEQ ID NO: 45671 - DNA, 101 bp, rice(Oryza sativa)
  misc_feature (71): n=t or c
tcgatcttcagtgggcggagtatccgacatttgaggttcatcgaagctgtctgtcaaacttccattttcanagctttctataagatagcctgcaagcttgg

SEQ ID NO: 45672 - DNA, 101 bp, rice(Oryza sativa)
  misc_feature (71): n=t or c
caccaacagaaaaaaaaaaacagcatatacctgatattcataccactggtacacacacttagccttcgatngatcctctaggagtgccttcgggtcagata

SEQ ID NO: 45673 - DNA, 101 bp, rice(Oryza sativa)
  misc_feature (71): n=t or g
accgagttaagaagaaccaatatcccaccataggagttatttttgcccttccatgtgctcagttttctttnaaacctatcctccacacatttccaatcaga

SEQ ID NO: 45674 - DNA, 101 bp, rice(Oryza sativa)
  misc_feature (71): n=a or g
caacaatgtcatcaacataggcctcgacgtttcgccccaattgggatccaaagaccttgtataccagcctngcgaacgtagcccctgcatttctcagaccg

SEQ ID NO: 45675 - DNA, 101 bp, rice(Oryza sativa)
  misc_feature (71): n=a or c
ggtccaccacgaatgaagaggaggaaagcatcagaaatttctaaattttcagagtggattgagaaggaacnaaaggagaagtgggctttattgttcgataa

SEQ ID NO: 45676 - DNA, 101 bp, rice(Oryza sativa)
  misc_feature (71): n=t or c
gagcccacgcgtaagtagacttccacctctccccacctatcccctttcttgcccatctctccatctctccnctcttttccctagcagcttgccggcatgga

SEQ ID NO: 45677 - DNA, 101 bp, rice(Oryza sativa)
  misc_feature (71): n=t or c
cctccattcacatgaggaaaccactaatcgtgcaagatcaatgaaaatacctctccattaactatcctgtnccaaaataaaataattataattctagattc

SEQ ID NO: 45678 - DNA, 101 bp, rice(Oryza sativa)
  misc_feature (71): n=t or c
gtgtgatgctgcactacaaaaatgatgcagatatgggagcgttggatggccggaaccgtggatgagatggnagacccggccatgagcaggtacgtctcggc

SEQ ID NO: 45679 - DNA, 101 bp, rice(Oryza sativa)
  misc_feature (71): n=t or c
tatatatatagcacaacgtaacgtcgaggatgttttttaatgaccaacaacaccacacaggctacgatgantaattgaatagagcaggaaaaaaaactagt

SEQ ID NO: 45680 - DNA, 101 bp, rice(Oryza sativa)
  misc_feature (71): n=a or g
cacaaagccaacctctattatttctattggaggctagaagcctagaacatgagcagtgtacgcgtgatatntactgctagatgatataggcgtgagaggtg

SEQ ID NO: 45681 - DNA, 101 bp, rice(Oryza sativa)
  misc_feature (71): n=t or c
agaatcacaaatcacagatccctcaacaatttcatagaaacaatcactgttgccactgcgtcgcaggatcnatcgcaagacccgccgcagacgccgacccc

SEQ ID NO: 45682 - DNA, 101 bp, rice(Oryza sativa)
  misc_feature (71): n=t or c
caactccaaccatgtggccaaagattgcttcatctacaagaaatttgcggaacaatatgccaagaacacangtaagccttcagacggagatcaaggcacat

SEQ ID NO: 45683 - DNA, 101 bp, rice(Oryza sativa)
  misc_feature (71): n=t or g
gatttacagaacaagaactttattgttgtcaagttggagaaggaaggctcacccaaccaagagggatattnggaactctcatatctctgtatgatcagttt

SEQ ID NO: 45684 - DNA, 101 bp, rice(Oryza sativa)
  misc_feature (71): n=a or g
tgtcgcatcatggcctattcagactccgcatggatttcacgtttgctgcatattcgttgtgtctgtttgantgcatgactggatgcattgcatgcatcgct

SEQ ID NO: 45685 - DNA, 101 bp, rice(Oryza sativa)
  misc_feature (71): n=t or c
gacccgaaataaatcagaaacaaaacttgacaacgccacagaaggaatacaggagtgatgacactccaaanggtctattgtacatgtggttaaaagaacag

SEQ ID NO: 45686 - DNA, 101 bp, rice(Oryza sativa)
  misc_feature (71): n=t or g
catgcgcgtcagctctgggatggaagacgtcaagctgatcgaagtcgccctcgcgaagttccagaagcgcnctgctatgatgggcagaatccttgacggga

SEQ ID NO: 45687 - DNA, 101 bp, rice(Oryza sativa)
  misc_feature (71): n=t or c
gtgttggttagcagcattcttttagccatggattgaacaatgagctcctgcttcgtagtactcactccgtncaaattatagagcgccccttttttaggaaa

SEQ ID NO: 45688 - DNA, 101 bp, rice(Oryza sativa)
  misc_feature (71): n=a or g
gggtgattaatctcgtgtcgtgtcagcttaactagtggcctggtctagtgcatgggatgatgataattccnaggtacgccctgtttagttctaattttttt

SEQ ID NO: 45689 - DNA, 101 bp, rice(Oryza sativa)
  misc_feature (71): n=t or c
tatcaacacgtgcgtaaaatcataccttagatagatcacatctttctataatttgttgtcacgtcgcatcntctttgggggcaccgctttggagaaacctc

SEQ ID NO: 45690 - DNA, 101 bp, rice(Oryza sativa)
  misc_feature (71): n=t or g
gcaacagaacaggaatggctaagtgggggtgtcaagactcaagaagttcagaaagtaaaatacttttcatnccacatgtaagaatttacttacaatcagac

SEQ ID NO: 45691 - DNA, 101 bp, rice(Oryza sativa)
  misc_feature (71): n=t or c
atgaatgacagtgcagtacagagaatgaggcaaatcctagattattttcatatgtgttgcatgaagatggngacttagtattttatagagatatcagaacg

SEQ ID NO: 45692 - DNA, 101 bp, rice(Oryza sativa)
  misc_feature (71): n=t or c
atgtcgataggttttttttgcctcagttgatttttgagccacttgatattctcctatattcgtgcaggtgnggtacgggtacattgtaaatacatgctgac

SEQ ID NO: 45693 - DNA, 101 bp, rice(Oryza sativa)
  misc_feature (71): n=t or c
cagggattagcaaaaatcatggtatccacatgtatcaaagtggaaccataatcatgatcaagtaacacaanaatgcagacccttaataatagactaaatga

SEQ ID NO: 45694 - DNA, 101 bp, rice(Oryza sativa)
  misc_feature (71): n=t or c
taggtgttgctatcacttttagagaccgaaatatttaggtgctagaaataaccgtgatttttttataactntttagaaattatttcggtcgtatatagttt

SEQ ID NO: 45695 - DNA, 101 bp, rice(Oryza sativa)
  misc_feature (71): n=t or g
ttgccagccattagtgggtatgagtggaaattcgaggaattgggttgaattggagaggggagtgtgcaaangtggaggaaaggaggaagaagaagtgttct

SEQ ID NO: 45696 - DNA, 101 bp, rice(Oryza sativa)
  misc_feature (71): n=a or g
ggactttgtagcctcgtccctggaaagagttccagactacaataacaccaaccctattagagcaggtacantagcagactataagctagccataaacacat

SEQ ID NO: 45697 - DNA, 101 bp, rice(Oryza sativa)
  misc_feature (71): n=t or c
ccatcaagggtcgacgcacttgtgctttgctttttctcatccatgctgctagcatctttcgtcggtgtcangaagagcttcgtcctagcagatcgcttcgc

SEQ ID NO: 45698 - DNA, 101 bp, rice(Oryza sativa)
  misc_feature (71): n=a or g
catcaactaatattatcatcgaattgattgcacgctcggtgccgtgtctcaaattctttgttgtgctagtnttttctcgctatccaaataaatgcgccgac

SEQ ID NO: 45699 - DNA, 101 bp, rice(Oryza sativa)
  misc_feature (71): n=t or c
gtcctcgaatctgtttcttccgtgccaaagaatggtgacaaatcaaccacattgaatgtgttactaactgngtaatcaccgggaagatctatcttgtaagc

SEQ ID NO: 45700 - DNA, 101 bp, rice(Oryza sativa)
  misc_feature (71): n=a or g
ttagaacgtttctgttctgctacagaaaattggcggtaaccacacgaaatcgtattgtaactgtgaaactntcgattttttaattcaaatatttagggacg

SEQ ID NO: 45701 - DNA, 101 bp, rice(Oryza sativa)
  misc_feature (71): n=a or g
attcagatgtctaggccagtccgaccaagaccaatttatcacggttcagtaatcaatgccaactatgctcngtagtaatcaatgccaactcgtctctctcc

SEQ ID NO: 45702 - DNA, 101 bp, rice(Oryza sativa)
  misc_feature (71): n=a or g
aaggtttacacttggagaattcccttgaagtacagttgaacgagaactccaatagcaacgccttcaagaangttaacggtgcccaacggcatcaccgttgc

SEQ ID NO: 45703 - DNA, 101 bp, rice(Oryza sativa)
  misc_feature (71): n=t or c
ggattttcaatgacctggtccagatggtcatcttcagaaaataccacactattttcgagtgggagatgcanaggtaagcgctccatagatggatcagtgtg

SEQ ID NO: 45704 - DNA, 101 bp, rice(Oryza sativa)
  misc_feature (71): n=t or g
ctacctccggtgatcagcaatggagggtggctacaacctgggatcgcatcaaccaccgttcttctacattnccattccatgggaagctttatgtgctgctg

SEQ ID NO: 45705 - DNA, 101 bp, rice(Oryza sativa)
  misc_feature (71): n=a or g
caagaacctgtcccggtccttgaaccggctccctattagggcgcgcatcgtcgagtcagccgagtaggccnaaatgagctcgctaaggttcacggcgcgcc

SEQ ID NO: 45706 - DNA, 101 bp, rice(Oryza sativa)
  misc_feature (71): n=t or c
acagaagctagtctccttattgcatttgattgctgcgtacaaggatgaaaccgagtatactgtgctcgccngtgtcatagatgtatagatctttctacccg

SEQ ID NO: 45707 - DNA, 101 bp, rice(Oryza sativa)
  misc_feature (71): n=t or c
ccatttatcgtctccttttttgcatctttgcaggacagagggagtactcattcttcttaaaatatagcaantttatactggatgtgatatattcttctaca

SEQ ID NO: 45708 - DNA, 101 bp, rice(Oryza sativa)
  misc_feature (71): n=a or g
ctgctggttctcaataatatagagtatgaatgtcggttttgtttttacaaatccgcattgacagaaagggngtatttcagaactcacatgactatctttca

SEQ ID NO: 45709 - DNA, 101 bp, rice(Oryza sativa)
  misc_feature (71): n=t or g
gggaaatgaatataagggcccatctagttggtaaaaatttttgccccctgcacgtcagatcgaatatacanacacatatttaaagtaataaacatagttta

SEQ ID NO: 45710 - DNA, 101 bp, rice(Oryza sativa)
  misc_feature (71): n=a or g
tccaccaaccaatcagagcctgcacataaaatataggtgaccgtagccacttaattccctctccaccccanccaccaactctttagaacccgcgtataaaa

SEQ ID NO: 45711 - DNA, 101 bp, rice(Oryza sativa)
  misc_feature (71): n=a or c
ttatccatgtgatgcacattttgttttgaggtgtcataatgtccaattactgatgaaacatctggggtacnaagattgtccacaaaacctttcatctgtaa

SEQ ID NO: 45712 - DNA, 101 bp, rice(Oryza sativa)
  misc_feature (71): n=t or g
gtgccacaaccaccatcgtcatcgtccttctcattgtgcttgtcgcacgagaaatggagcgctatagtganaatcgatggtaattgtgaatgtattcgacg

SEQ ID NO: 45713 - DNA, 101 bp, rice(Oryza sativa)
  misc_feature (71): n=a or g
ctgaacaattttttggaaggaaagagaaaactgagttttaagtgggaaccggcaaaccaacacctatacanatcaactatgttagactgacagactatctt

SEQ ID NO: 45714 - DNA, 101 bp, rice(Oryza sativa)
  misc_feature (71): n=a or g
agcccataataaaataattggctaaaaaaaactcagtttttacaaacctatccccagcaacttcacgaaanccaagtgattttcgcaaaaaaccaatcgtt

SEQ ID NO: 45715 - DNA, 101 bp, rice(Oryza sativa)
  misc_feature (71): n=t or c
acccaccccaaccgagcgtgtaaataagattaagatgacacattcacaaccgagcgtgtaaataagatganacattcacaaatatatacccctttaaatgt

SEQ ID NO: 45716 - DNA, 101 bp, rice(Oryza sativa)
  misc_feature (71): n=t or c
atatcgaaactgaagaactactgcactagtgacttgccatgaggtacttgaatctcaggttagtcagtggnttgaagatcattttagaatgccatggttag

SEQ ID NO: 45717 - DNA, 101 bp, rice(Oryza sativa)
  misc_feature (71): n=t or c
agatcttcccatttctttgcttccgaatgtgccaagcagtaataaagaagatttctagaaacccttctgtntgaattgaatgcgagccgaaacaacaaatc

SEQ ID NO: 45718 - DNA, 101 bp, rice(Oryza sativa)
  misc_feature (71): n=t or c
ctgcagcatgacggccagcatccttgtgctgttgttgtagctcaccgacgcaaccatcggctcggtgacgntggagaggctgcggtcagacagcaacttca

SEQ ID NO: 45719 - DNA, 101 bp, rice(Oryza sativa)
  misc_feature (71): n=t or c
tctggtactgaaatggagtgcgagaacggccgcgtttctgccaatggcatgagtggtctctgcgtcgcggngccccgcgccgacccgctgaactgggggaa

SEQ ID NO: 45720 - DNA, 101 bp, rice(Oryza sativa)
  misc_feature (71): n=t or c
agtatggagaggtattggctggtaccgactaggaatcaattggtacctgcgatgggtactggacgatgccnatgtcgcacataggtattagaaatatgata

SEQ ID NO: 45721 - DNA, 101 bp, rice(Oryza sativa)
  misc_feature (71): n=t or c
gctgttatatatgagaaaaatataaatgtcaatatgataattaagcagccaaatcatcttaggctgcgttngacaacaacggttgggagcttctccatcca

SEQ ID NO: 45722 - DNA, 101 bp, rice(Oryza sativa)
  misc_feature (71): n=t or c
ctccagcatcttccctatgagtaacaaagagaaggctctgaataatatcttggaagaagggagttagcggngaagcggatcctgcatccacatagccttga

SEQ ID NO: 45723 - DNA, 101 bp, rice(Oryza sativa)
  misc_feature (71): n=t or c
aacacaggggcctctgaacaaaactaattttgcaatagaaaaattcagagccggcagtagaccgagccaangcatcccactgttgcgtgggccccacacgc

SEQ ID NO: 45724 - DNA, 101 bp, rice(Oryza sativa)
  misc_feature (71): n=a or g
agatcgttcaaagaacacaaagaaagatcacctaactcttcctccctgacttcttcagaccgtccccatcnaggccgccgccgccaccgccgtcgcccagc

SEQ ID NO: 45725 - DNA, 101 bp, rice(Oryza sativa)
  misc_feature (71): n=a or g
caatgatctttagtcccggttggagtacatcatatgttaagcttaacattgacttctgataacactactgnagaagtgatctttgtcaggtgggagtcccg

SEQ ID NO: 45726 - DNA, 101 bp, rice(Oryza sativa)
  misc_feature (71): n=a or g
gctgcaggggttgcacagtcttggcagcatgaatctccgtcacaattacctcactggatcgattccggacnatctgttcaacaacacgcctttgctaactt

SEQ ID NO: 45727 - DNA, 101 bp, rice(Oryza sativa)
  misc_feature (71): n=t or g
tcttatcgtgaaaagaatatttcagagttgtaataggttttaaagttgtagttgttgtactaaaaaggaanagataagattgttgcaaacttgcaatcatg

SEQ ID NO: 45728 - DNA, 101 bp, rice(Oryza sativa)
  misc_feature (71): n=a or g
tgcgccgagagcagtttcagttgattcaacatgcctgccggagcaagcggcaacagaaagggtaaccggantcacggtcaccgctacctcggcagcgcttg

SEQ ID NO: 45729 - DNA, 101 bp, rice(Oryza sativa)
  misc_feature (71): n=a or c
aaacgaaaaaggagatcgagatatatacactcgaaacatggcgtccacagctgctatactagccctcatcntcctcctcctcccgccaatagctctcgccg

SEQ ID NO: 45730 - DNA, 101 bp, rice(Oryza sativa)
  misc_feature (71): n=a or g
atgcgacatgaattataccaccatgaattttcagtgcatatttttttaacagtgacagtgactataaaacntgtactctgcaaaagcagacaatgaagatt

SEQ ID NO: 45731 - DNA, 101 bp, rice(Oryza sativa)
  misc_feature (71): n=a or g
gcacatgaacttgctcagattgctatccgttcggggcaaagcgcggtttggcgtaataatgcaccgaattntgttatgcaatgtctgcagcatgactgtaa

SEQ ID NO: 45732 - DNA, 101 bp, rice(Oryza sativa)
  misc_feature (71): n=a or g
aagaaacaaatcttgagaaaaaaaaaagcttgcacttgcacctttgccagcctttgacatcacagttcgtnagtcaccaacatttgccacatagatatggt

SEQ ID NO: 45733 - DNA, 101 bp, rice(Oryza sativa)
  misc_feature (71): n=a or g
tggattgtgcaatgtaggaactgattcagatacatttactcttgaggtgcatcatggtggtttttttctcnggcatggccagaatcggtcttacgtagatg

SEQ ID NO: 45734 - DNA, 101 bp, rice(Oryza sativa)
  misc_feature (71): n=t or c
accaacaccggcacccgctccagcaccaacacctattaaccttactccgacaccatcacgtgcacctccanatgcaccaccaccacaaagggttccaccgc

SEQ ID NO: 45735 - DNA, 101 bp, rice(Oryza sativa)
  misc_feature (71): n=a or g
gggagaaaagtaagccgcgctgccacgtggtcagataggaagattctttccctttattgtgcgtacccccnggcccgtattaccgacaaataccaattatc

SEQ ID NO: 45736 - DNA, 101 bp, rice(Oryza sativa)
  misc_feature (71): n=a or g
tggccgtggcctgaaagcctccctcttctcatcgaagaagaaggcccattccttcaactcttcctcttccntcttcacccacattgcaggctgggatgaca

SEQ ID NO: 45737 - DNA, 101 bp, rice(Oryza sativa)
  misc_feature (71): n=a or g
acgttgcatgcatatagtatgtgttggagccgaatagataattagaatacaaaactaattactaattacanaattccccgtccatctatgactgaataaaa

SEQ ID NO: 45738 - DNA, 101 bp, rice(Oryza sativa)
  misc_feature (71): n=t or c
cacatctttatctattataaaaattaaagatatttttgcctatttttcatacgtcatctcagtccgattcnctccccgtatgcgcccgattactcctagat

SEQ ID NO: 45739 - DNA, 101 bp, rice(Oryza sativa)
  misc_feature (71): n=a or g
caaaactagatagtaaggtaggcccatactaggtggtaataagagatcggagagacaccacaatgtatatntatgtgtaaagtgggtaataaggtgggacc

SEQ ID NO: 45740 - DNA, 101 bp, rice(Oryza sativa)
  misc_feature (71): n=a or g
ggtaatggtggcggtggtggaggaggacaagccgggggttcgtatggatcttacggtcaaggaggtggtgntggcaccggatcaggttctggtatggctaa

SEQ ID NO: 45741 - DNA, 101 bp, rice(Oryza sativa)
  misc_feature (71): n=t or c
agtcacaggcacatatgttgtgttgcacaggacagagagagaggctttgcagttgcaggcggatgcatgtngtctgtaggactgcacatgctcactgacat

SEQ ID NO: 45742 - DNA, 101 bp, rice(Oryza sativa)
  misc_feature (71): n=t or c
aaatcccaacgaccccaacagaccaaatcccaacctgcaattcgcatggtctcctgcctttgccatactcngaattcccattgcgtggaccgacgacgaaa

SEQ ID NO: 45743 - DNA, 101 bp, rice(Oryza sativa)
  misc_feature (71): n=a or c
gtccgtggcagtggcagtgatgaccatgacaagggaacaacccagctgcacaatgacatgaagggagtgcncttgagtcttggggaagggcaccgcaccgg

SEQ ID NO: 45744 - DNA, 101 bp, rice(Oryza sativa)
  misc_feature (71): n=t or g
gattgtacttcatttagtaattgatgctacaacctagtactccctcggtcctttaatatatgacgccgttnatttttgttacaagttttgatcattcgttt

SEQ ID NO: 45745 - DNA, 101 bp, rice(Oryza sativa)
  misc_feature (71): n=a or g
tgcatcatatgatgtaccacctactgacctagctacaatggtgtaccttgagtgagtgaggccctatttanttcgcgaaaagaaaatttttgtgtgttaca

SEQ ID NO: 45746 - DNA, 101 bp, rice(Oryza sativa)
  misc_feature (71): n=a or g
ggctgaaaacatcgcagtgcattgtgaaacttgaattgaaatttggataggtttcagaggttgccatggtncaagtttgccactggcagtaggttcgtgcc

SEQ ID NO: 45747 - DNA, 101 bp, rice(Oryza sativa)
  misc_feature (71): n=a or g
gactcccgtagtttgagtttgcaacgtgcagcaccggatgataccgaccgatatatcgatctcgtttatcngatgttgagattcccaacctgtttctagca

SEQ ID NO: 45748 - DNA, 101 bp, rice(Oryza sativa)
  misc_feature (71): n=a or c
atcagtttaaaaagcatgcgcgcggaaaaataagaagaaagtgagttggaaaagaaagggaaggacagaancttatttaattttgcctatcatctaatcat

SEQ ID NO: 45749 - DNA, 101 bp, rice(Oryza sativa)
  misc_feature (71): n=a or g
attataaaacaatcatatatatgaatagatagcacaaaagtaatagtgtgcacatagagactcatactcanggtcaatataacccatagatccagctgcaa

SEQ ID NO: 45750 - DNA, 101 bp, rice(Oryza sativa)
  misc_feature (71): n=t or g
aggcgatcgatcgattaaactactggttgtccaatccgaatcagattctgagaccgtctcgatgatctcgnttgcttagctgctgcccagcagcccagctt

SEQ ID NO: 45751 - DNA, 101 bp, rice(Oryza sativa)
  misc_feature (71): n=a or c
tcagccgcttcatctacatcttctaccgttgcttcatcctccaggaattccgttacatctggatctatggntggcaattcatcggcagtggtcttttgctt

SEQ ID NO: 45752 - DNA, 101 bp, rice(Oryza sativa)
  misc_feature (71): n=a or g
aatttaatgcaagttttgctcacctcaggtgtcacatgctatgatgctaatgcatggaggaagataagcanactgtactatctagcacatccagagatgaa

SEQ ID NO: 45753 - DNA, 101 bp, rice(Oryza sativa)
  misc_feature (71): n=t or c
agaaactgtgatcttttgatgacggtcaacactcaacaccagagccatcaccaataacaggagatgaccgnatcccccgtcagaacagcagataatgaaga

SEQ ID NO: 45754 - DNA, 101 bp, rice(Oryza sativa)
  misc_feature (71): n=a or g
gcgggaggtggaagccggagagagaatcacaaatcacatcgataaacatctccagaagtccagatactccntcgtggaatcttgttcagataatcacggta

SEQ ID NO: 45755 - DNA, 101 bp, rice(Oryza sativa)
  misc_feature (71): n=a or g
tctacttcctctcaacttttttttgttgttgctgggggatttcgtctgggctgctcccccagtttatatcnatttttcttttacttgttcttgctgtgatt

SEQ ID NO: 45756 - DNA, 101 bp, rice(Oryza sativa)
  misc_feature (71): n=a or g
atatctaaagatagctttgcggcgattaaacgagttcatcacgtcgttgaatgactacacattgttgacgnccactgtgccctttggccattgtccattgc

SEQ ID NO: 45757 - DNA, 101 bp, rice(Oryza sativa)
  misc_feature (71): n=t or c
ttaattggataaatgtagccataatgcgaataatcatctgtgaatgttataaaggtagttgccaggtcaanaatgatgcatttgttttaaagattctagat

SEQ ID NO: 45758 - DNA, 101 bp, rice(Oryza sativa)
  misc_feature (71): n=a or c
accagtgcagttgatcgtatctcacattcacgcgatcgctttggcaccacggtcatttgctcatgttgatncaaattcatttgcatttaataaaggccagt

SEQ ID NO: 45759 - DNA, 101 bp, rice(Oryza sativa)
  misc_feature (71): n=a or g
tgctccacgcagtagctcgatgtcgaagtacttggacatgagggggaggatgttgttgtagagcttcctcntctggctgagctcccgcgcgagctgtacgt

SEQ ID NO: 45760 - DNA, 101 bp, rice(Oryza sativa)
  misc_feature (71): n=t or g
tattaatattgttagatggtacatggttgactggctattactatcaaattataccactacacatccagagnaacatataaaacacaaaagaattaatatga

SEQ ID NO: 45761 - DNA, 101 bp, rice(Oryza sativa)
  misc_feature (71): n=t or c
agggtcgagatactctctagtcgaagtcaagtgacaaaacatgtggatccgatcttaatcattggaactanatgtcagtgacaaatgtacatttaactgca

SEQ ID NO: 45762 - DNA, 101 bp, rice(Oryza sativa)
  misc_feature (71): n=a or g
agactgaaaaaatacgataatacccctacgcgatttttttcccttaacaaaaacaccctttcacatttctncttccactaatactggtgggagtagaacta

SEQ ID NO: 45763 - DNA, 101 bp, rice(Oryza sativa)
  misc_feature (71): n=t or c
tttttgtttttgctcgcggacgacataacacccgcccgcgaaaatactttttgcaagttgttgtgctaccngcctgcaaaaattccttttttcacaaacac

SEQ ID NO: 45764 - DNA, 101 bp, rice(Oryza sativa)
  misc_feature (71): n=t or c
cgccgacgccggtgagggtggtagccgggtaggtgagtacagtgttttatactaattgtacagtattcacnccgtattctaacgtataacgctgttcattt

SEQ ID NO: 45765 - DNA, 101 bp, rice(Oryza sativa)
  misc_feature (71): n=t or c
ccaaactttgcatctccttttgggctcctcgagcagctgcacagatcgtagaaaaagctcgtagatttgcnttttgtcccctcgaattggtgttgcgctct

SEQ ID NO: 45766 - DNA, 101 bp, rice(Oryza sativa)
  misc_feature (71): n=a or c
ctactgatgtgttgttgtgtcgagagcacaggagtttgctgtctgacaaactattggaatattcagataangcttgatatatcaatgaagaaaatattttt

SEQ ID NO: 45767 - DNA, 101 bp, rice(Oryza sativa)
  misc_feature (71): n=a or g
cctgtttggtgtagatggtcgacacggaacaactgtgttggcttgctttggtgccaactcccgggtggcanggcgcctttcagcagtagaaggccggcaca

SEQ ID NO: 45768 - DNA, 101 bp, rice(Oryza sativa)
  misc_feature (71): n=a or g
caatgagatgagatatgtcccggattcttacacacatagcatagagggggtttctgacaattcacctgatnatgaccactttccccacaattgaaacattt

SEQ ID NO: 45769 - DNA, 101 bp, rice(Oryza sativa)
  misc_feature (71): n=a or g
tgtggcatgatttaagtgtaaataacaggccgcaagtttccccaaagcgttttggggtgggtttaccgtgntcccacggtctagcggtaaccgcgtggtta

SEQ ID NO: 45770 - DNA, 101 bp, rice(Oryza sativa)
  misc_feature (71): n=t or c
tagttttattttgtcttctaatttttgccaccatgttacttataaccacttgtcagggttatggatactanatacctaatagtaattgactaaatctcggc

SEQ ID NO: 45771 - DNA, 101 bp, rice(Oryza sativa)
  misc_feature (71): n=a or g
ttcttacacaagaattttgctggaatgttatgacaagcattttgttttttaatccctccatactcgtaaanaaagtcgttttggacagcgacacgatctcc

SEQ ID NO: 45772 - DNA, 101 bp, rice(Oryza sativa)
  misc_feature (71): n=t or g
gtggatccaaaccacattagtacagcaatccaacaccacccagttgaatcgctcaagagcacagttcaganttcagacaccaattgcagcttccctaatcc

SEQ ID NO: 45773 - DNA, 101 bp, rice(Oryza sativa)
  misc_feature (71): n=a or g
atatggaagaaaaatgcgccatatatgaagggaaataggatcatatgtcattaggaaatatgtacttgccntgtgattgcaaatcatttatacatttcatg

SEQ ID NO: 45774 - DNA, 101 bp, rice(Oryza sativa)
  misc_feature (71): n=a or c
catcttgcgcatgtaagtgctctctcactctctgactctatctatctatctactctccgtcccataaaaantattccctccgtagttaaaggaagtcgttt

SEQ ID NO: 45775 - DNA, 101 bp, rice(Oryza sativa)
  misc_feature (71): n=a or g
tgagatctgccatagtctgcatatgaatcgtagatatggacgaaatccacaggttctgcagtagccaaganccgcccgtctgaagagaacttgatgcaacg

SEQ ID NO: 45776 - DNA, 101 bp, rice(Oryza sativa)
  misc_feature (71): n=t or c
ctgctatgctcggtgactccgtttcattgtcgcacccaattagaggtgggcactcggtttatttggtgttntataagttcagtttctcaaaatttctacct

SEQ ID NO: 45777 - DNA, 101 bp, rice(Oryza sativa)
  misc_feature (71): n=a or g
ctgtccgttctgttacactccggatgtcgaccacgagattcttcgatgcaaccactcgtccatgagcatcnttgttgacaacggtcatccgtgaccttcat

SEQ ID NO: 45778 - DNA, 101 bp, rice(Oryza sativa)
  misc_feature (71): n=a or g
tgtgacctcatggcaagggtacgacatcggcagatataggttttacacgatgttcaaggacaggaaaagcncagctcagaacagcggagttcgggtggagg

SEQ ID NO: 45779 - DNA, 101 bp, rice(Oryza sativa)
  misc_feature (71): n=a or g
cataaaaacgtatcacggttgaaagatacttttaaaactggtaatttagtgggacacctttggctcaattngagaaagatttttttcaaaaagacgagaat

SEQ ID NO: 45780 - DNA, 101 bp, rice(Oryza sativa)
  misc_feature (71): n=a or c
taccaaacaggcccttagtgctatattggttggcttcgactgttaattagtagtggaaaaataagcagtgnaatgagaaaaaattttaaggtatgaatatg

SEQ ID NO: 45781 - DNA, 101 bp, rice(Oryza sativa)
  misc_feature (71): n=t or c
aggagatatttgagattggtgggatagacccaacaaagttattaactgcaaggcttatgagattaagtgangagctattaaaaagagcaaaaggaatctcg

SEQ ID NO: 45782 - DNA, 101 bp, rice(Oryza sativa)
  misc_feature (71): n=a or g
gttcgtactattcataatgttttgcaggtgatgtctcttcaaccatactcccagtcccataaaaaaatgancgggacattattacaacaaatctgaatata

SEQ ID NO: 45783 - DNA, 101 bp, rice(Oryza sativa)
  misc_feature (71): n=t or c
ataaaaactaaccaggtacagtactatacttttttttttcacgagtgcaaaactacctgcaaggctgcaanaacttaactggagccatggaagttgtggat

SEQ ID NO: 45784 - DNA, 101 bp, rice(Oryza sativa)
  misc_feature (71): n=t or c
attataagccaccttttgtttgctgatgatagcttgttactattcaaagctactagtgtttgtgcagatgnagtgagtagagttttaactaactattgtgc

SEQ ID NO: 45785 - DNA, 101 bp, rice(Oryza sativa)
  misc_feature (71): n=t or c
ccaccacctccgccacctccaccgcttccataaccaccagctccaaaagcaccagagccatatcctgatcnagaaccttgtccagaaccatacccggagcc

SEQ ID NO: 45786 - DNA, 101 bp, rice(Oryza sativa)
  misc_feature (71): n=t or c
gtataaactcactagacaactgatgctgcaaccctcttcagggatgcagatactttgaagatgtcagattnagtgtgaccagctgacacgaataagcggat

SEQ ID NO: 45787 - DNA, 101 bp, rice(Oryza sativa)
  misc_feature (71): n=a or g
atgtggcgtgatgtgaaacaaatttcattatcgcccgacattttttgtagggaacgtgccaacaactaaancatactatgcaaattgatctttcaaaaaag

SEQ ID NO: 45788 - DNA, 101 bp, rice(Oryza sativa)
  misc_feature (71): n=a or g
gagtccatattcggcaagatgatatttattttgggctacctaggtgctacataacggttagcacttgggtntggctggtgctagtggtggtgctggcttta

SEQ ID NO: 45789 - DNA, 101 bp, rice(Oryza sativa)
  misc_feature (71): n=a or g
agtcagatagatctgcagggcaaggaaagcacagatgctgatgacaaccacaggaagcaatcaatcataancacaattactaagttaactcctactcgata

SEQ ID NO: 45790 - DNA, 101 bp, rice(Oryza sativa)
  misc_feature (71): n=a or g
gtcttctgcagcacccacttggcaacacctccagaacagactttcctctcccacatttgaaggctgctgcnagacaaagtggcggcgccaagacaatcacc

SEQ ID NO: 45791 - DNA, 101 bp, rice(Oryza sativa)
  misc_feature (71): n=a or g
ttacgatgatatctattgccttcgttttaaaatataaccctatccgacatccatttctctaaatacatagnaagaagttggtatatttgggaaattaaatt

SEQ ID NO: 45792 - DNA, 101 bp, rice(Oryza sativa)
  misc_feature (71): n=a or g
gccatgatccagaaaacagtggaacagccgatgcaggattgttgcttggggacaatactggagaagggacncatgttggttctttgtgaggagcatagtgc

SEQ ID NO: 45793 - DNA, 101 bp, rice(Oryza sativa)
  misc_feature (71): n=a or g
gtgttgccctcggcacctttagtacagccttcaaatatacaccgtttgcctccaccatgggacttgcaaancatggtgcctccttgtgctcccttactgca

SEQ ID NO: 45794 - DNA, 101 bp, rice(Oryza sativa)
  misc_feature (71): n=a or g
ccctattttgctgtgcacggtgcataccatgtgacaactattgctgttgtgcaggtctttgttcattattnctcctattgttttacttttgctgttttatt

SEQ ID NO: 45795 - DNA, 101 bp, rice(Oryza sativa)
  misc_feature (71): n=a or g
gatcctcaaaatggagaaaggcaagcaacggtgaagcatcaattgaggtgtagattaatgtgtgcaccagnaagcttgagtgcttgacccttctctcagac

SEQ ID NO: 45796 - DNA, 101 bp, rice(Oryza sativa)
  misc_feature (71): n=t or c
cttcttgcccttcgatggtactaaatggtacaagatcgaggatcactgcaacggcctactgctgcttgacngcaactgcgtggttaaccctgccacgcgat

SEQ ID NO: 45797 - DNA, 101 bp, rice(Oryza sativa)
  misc_feature (71): n=t or g
gtattctttgcgtatatgcttggctggtcattcatgcagggaaagagatccggctacttaactgtgtagangtaattgtgggattagattgagtttgatta

SEQ ID NO: 45798 - DNA, 101 bp, rice(Oryza sativa)
  misc_feature (71): n=t or c
aagacggatgaagtattaactaaatatatatgagcacacgtgctaaatttaaaactttatcctagctttangtcgccgttgcaagtgaccgtgtttgctta

SEQ ID NO: 45799 - DNA, 101 bp, rice(Oryza sativa)
  misc_feature (71): n=t or c
ctcgattgctccagcgtggcaccgttgtctgatccgttcagctcgacgccagtgaatagcgacggctgtcntcaacgtccaatccagagccaaccaagctc

SEQ ID NO: 45800 - DNA, 101 bp, rice(Oryza sativa)
  misc_feature (71): n=t or c
ttacagcaccctcggtggcgaagctcgcagcaacctgcatcgtcgaacaaacgttcattgtcactaattcnatgtaattatacatgttagtcaggacagga

SEQ ID NO: 45801 - DNA, 101 bp, rice(Oryza sativa)
  misc_feature (71): n=a or g
ttttcattaacatgtgagcccgataaaccctagacccacatgctagtgacaaaaaaaacatggcaactttnaaggtagaggacctcaatctttgatgagct

SEQ ID NO: 45802 - DNA, 101 bp, rice(Oryza sativa)
  misc_feature (71): n=t or c
ctcataggatcccgatactattatatgatactggctaggatccgggtcctgacaacgttgatggcaaggcncgggtgccgtgtagcgaaatgccaccctgg

SEQ ID NO: 45803 - DNA, 101 bp, rice(Oryza sativa)
  misc_feature (71): n=a or c
aagtgatgaatcttgtcgctttaacagtgaatctacagcattgctagtcaagtgtctttctccttttattntaggcacattaatatctttagtgcctaaaa

SEQ ID NO: 45804 - DNA, 101 bp, rice(Oryza sativa)
  misc_feature (71): n=a or c
tagatgtcctcactgtggtccacccagtttgaaactctcattaccataatatgtgaatgtcatgggtcatntctataagtgaatggtgaatcttgaaacat

SEQ ID NO: 45805 - DNA, 101 bp, rice(Oryza sativa)
  misc_feature (71): n=a or g
tgcaagcatcgatggatgctgcagcacagccacagcgtatgtcgcagacaagggccattgtgtgttgtacnccactgatggggcacgcttcgaggttccac

SEQ ID NO: 45806 - DNA, 101 bp, rice(Oryza sativa)
  misc_feature (71): n=a or g
aacaactcggaatcgaccagctatccgccgcccgtgctccaccgacaaatatctccttctcctctatacgntgaacacctagaggaggaacccaccgatag

SEQ ID NO: 45807 - DNA, 101 bp, rice(Oryza sativa)
  misc_feature (71): n=a or g
ttagaagccataaacataaattatccactgatatcgaaagaatcaactagaaactgacacatcgtcagccngtctgaccgcacacattccacagactgact

SEQ ID NO: 45808 - DNA, 101 bp, rice(Oryza sativa)
  misc_feature (71): n=t or c
tcattgcctcgttagatccgtcaacctacttggcttctccgtctccgacatcgacaccaatcaccaccagnagcagcaacaaccgtctctggcaccgccgc

SEQ ID NO: 45809 - DNA, 101 bp, rice(Oryza sativa)
  misc_feature (71): n=a or c
aagatggtttatttgatatgattcggaaatcaaagcctgcaaaggctactgtggcaaaacatcaaagcganaaaaattcagaaaagcagcaaaaatcacca

SEQ ID NO: 45810 - DNA, 101 bp, rice(Oryza sativa)
  misc_feature (71): n=a or g
gtgtttttggtgaaactctgatggatcaacaagacctgtgtggtgtggttaactgaagcaaacctcaaaanccttgaatcgatgagcttgcgtgtgggtta

SEQ ID NO: 45811 - DNA, 101 bp, rice(Oryza sativa)
  misc_feature (71): n=a or c
tagctagctttagtcccacctcgccaatttgagaagagagggagcagcttataaggatggttgcccggacnaaaaaacgcagtgagttgcagtattaggcc

SEQ ID NO: 45812 - DNA, 101 bp, rice(Oryza sativa)
  misc_feature (71): n=a or c
caactaacaggatgagggatctgagtcccttcttcggaacaccgcacatgtttgccatgttctcccaccantgctgcattgagtgggcttcctcccaattc

SEQ ID NO: 45813 - DNA, 101 bp, rice(Oryza sativa)
  misc_feature (71): n=a or g
aaaacggacctgaataagaaatatgtccagaagggactcacgccatttaaggctacggaaggataacacangcccagtgggatgagttcgttgcccttaag

SEQ ID NO: 45814 - DNA, 101 bp, rice(Oryza sativa)
  misc_feature (71): n=t or g
cctggtattattacaatcaacaggtgggtggagaggatgttggggaacaaatggttaagaatacatgagcngattcaagattagtgatattgcgatgtgtt

SEQ ID NO: 45815 - DNA, 101 bp, rice(Oryza sativa)
  misc_feature (71): n=a or g
cattgctacaggacaggatcctgcacaaaatgttgaaagctcacaatgcatcaccatgttggaagaagtanatgatggagatgatcttcatatctctgtca

SEQ ID NO: 45816 - DNA, 101 bp, rice(Oryza sativa)
  misc_feature (71): n=a or c
agatatagatatctgttacgaatggcaataatatagatatatgtgtactttggagaggacgatgggcactncatatgcttttttgtcgacatatttcaaac

SEQ ID NO: 45817 - DNA, 101 bp, rice(Oryza sativa)
  misc_feature (71): n=t or c
gtaaattcccaatccccttctctcgagtttccacacaagccgacggagaaaaatatctctcttctatccancgcaaggccaacgcagagcgcgactcgccg

SEQ ID NO: 45818 - DNA, 101 bp, rice(Oryza sativa)
  misc_feature (71): n=a or g
gtatgcgcgtgagtctcttagtccttgtgttgtccccatgcttttagttcatggctcatggcgcatgtgtntggattgtagagcaattaacaacatcacaa

SEQ ID NO: 45819 - DNA, 101 bp, rice(Oryza sativa)
  misc_feature (71): n=t or c
tgcaattggctgcttaaccaaccatatccttagtacattggtgatgaggcatcgtgtcaaaaaaatccaangacaaaagcgatatagcttcaacagagttg

SEQ ID NO: 45820 - DNA, 101 bp, rice(Oryza sativa)
  misc_feature (71): n=t or g
ggtgtcaaatatttagaaacaaatggagtattttacgtatgtacggcttagacgacggttagaaagaaaancactcggactggcattttattgtgacatca

SEQ ID NO: 45821 - DNA, 101 bp, rice(Oryza sativa)
  misc_feature (71): n=t or g
ttgtaggctttgtacgtctgttgggctggtctgctcgggaatcagggtgaggccttgtatgatgtcttagncttgagcacaacaagccaagcttaggccga

SEQ ID NO: 45822 - DNA, 101 bp, rice(Oryza sativa)
  misc_feature (71): n=a or g
taagaatcatatgtggattggcaagaatacagagttgcaattaaaaattttgagcaatctgcacacagctnccattggtgggcattctggggtgaatgtga

SEQ ID NO: 45823 - DNA, 101 bp, rice(Oryza sativa)
  misc_feature (71): n=a or g
agggacaaatgttgtaaaatctctggctgcaaaattgttgatgggaaatgcaagcctcctttcattcaccncacccttcaccctgactctggtaaattaaa

SEQ ID NO: 45824 - DNA, 101 bp, rice(Oryza sativa)
  misc_feature (71): n=a or g
tgatatggttctacattacaatgcaaagtatgatcgctaaattataaacgtgttctccagcgcactatatncatcccacagccaacctgggggaatcaccc

SEQ ID NO: 45825 - DNA, 101 bp, rice(Oryza sativa)
  misc_feature (71): n=a or g
ggccaccagcagatacatgatcgccgaactgcaaccgttctccaatgatctgggagaactagccatttctngttccgacatcttgcaggagcttgtggcca

SEQ ID NO: 45826 - DNA, 101 bp, rice(Oryza sativa)
  misc_feature (71): n=t or c
cgcgtcggccactaccgcgtcgtcgtgttcgtcgaggtggaggtggagctcgtgttcagcgagcccaaggngctcgtcgccgacgtcgtggcggccggcgg

SEQ ID NO: 45827 - DNA, 101 bp, rice(Oryza sativa)
  misc_feature (71): n=a or c
gcctcaagatatgccgaaagatgagacttcctggtcagacaagaagctctgcattgaaaatgaggttaganatcgccaaattaagcaccaggcatccatga

SEQ ID NO: 45828 - DNA, 101 bp, rice(Oryza sativa)
  misc_feature (71): n=t or c
agcaataacatgagctttgaagaagccattgatgtcgccgcagtcgctctgtcattatagatataggcatnggtgatgcagaggttgagagtcggcatgag

SEQ ID NO: 45829 - DNA, 101 bp, rice(Oryza sativa)
  misc_feature (71): n=t or c
gccacagccctgtactccgctttggcactagaacgagacaaagtgtgctgacgcttggaagaccaggagancaggttgtcaccaagaaacacagcgtatcc

SEQ ID NO: 45830 - DNA, 101 bp, rice(Oryza sativa)
  misc_feature (71): n=a or g
ggagtgggaagcgatgacggtgccgatggcctagggcatgtgcaggaagaggcaacggcttagtatgcgcnagacgggcagttgattgggccagtgaggca

SEQ ID NO: 45831 - DNA, 101 bp, rice(Oryza sativa)
  misc_feature (71): n=t or c
tttgactcaaacggtatttactggtattgcgcatccatctgttcgacatgtaataccagcgaatgtaaggntagtttctattgccaaaatgtatttccttc

SEQ ID NO: 45832 - DNA, 101 bp, rice(Oryza sativa)
  misc_feature (71): n=t or c
aaactctagagtatctggaaggatgggtggacttcatatacaagggccgcaatacaacactcagtttggtngttccattcgaataacccttttactggtgt

SEQ ID NO: 45833 - DNA, 101 bp, rice(Oryza sativa)
  misc_feature (71): n=t or g
acctccccgtggttgagcgtacggccgatttagaggaattcggacgatattgccgctgccggcgtcggcgncggcgtcggcgtcggtcgagcggttcaagt

SEQ ID NO: 45834 - DNA, 101 bp, rice(Oryza sativa)
  misc_feature (71): n=t or c
cacaagctctccatatactttgatatggttggttggtcagcccaatatggcattgccactagcggtacacnattaacaattgcctccaacgtcgagttcca

SEQ ID NO: 45835 - DNA, 101 bp, rice(Oryza sativa)
  misc_feature (71): n=t or c
tctaactcaacatatctttaaaaccatctctcacttttaatatgcagtggttacaatctaaatcctactgntaatgcaaactgtgctgcttcagaatatac

SEQ ID NO: 45836 - DNA, 101 bp, rice(Oryza sativa)
  misc_feature (71): n=t or c
gttctcttcgggattgtgtcggcaccggcatttgatgcctgtggtaaaatttgtttttttttcattgcaanatgtagaagttgaattttaagttgtatgtt

SEQ ID NO: 45837 - DNA, 101 bp, rice(Oryza sativa)
  misc_feature (71): n=t or c
atctatttgtctaccctatcttaactttaggggatgcataggatactgtgggagatatatatggcacgagntgtgtcttacggtctcagtcggtcgtcggt

SEQ ID NO: 45838 - DNA, 101 bp, rice(Oryza sativa)
  misc_feature (71): n=t or c
aatctcaaagggctgccaactgcagcatgcacatcagcagccgtgcaagaatcactatgagtccattttcnactaccagctatgttatccagttgagcatc

SEQ ID NO: 45839 - DNA, 101 bp, rice(Oryza sativa)
  misc_feature (71): n=a or g
tagctccctcttcctcggcaccccgtgccaatccccctctctcctattgatcttgaagaggagcggcggcngtgccctccccacccccacggaccctgatg

SEQ ID NO: 45840 - DNA, 101 bp, rice(Oryza sativa)
  misc_feature (71): n=t or c
ttgctagtattatgttgccatgctacaaggctttgattacccatcatcattctgtgcactactagctcctngatttacaacaaatgtttgttaaaattgct

SEQ ID NO: 45841 - DNA, 101 bp, rice(Oryza sativa)
  misc_feature (71): n=a or g
ttcgaaaataaatatcgtgccgtgttcgttggtctctcgttcctcaacctatccaatccgagccgaaccgncctcttgcaatataatgctggtggttcgaa

SEQ ID NO: 45842 - DNA, 101 bp, rice(Oryza sativa)
  misc_feature (71): n=t or c
gacttttaagtcactacgaacaaatatataaatgttttgcctgcaaactaattgctattctctaataaatngttttggtttattagagaatatgggtaacc

SEQ ID NO: 45843 - DNA, 101 bp, rice(Oryza sativa)
  misc_feature (71): n=t or c
ttatttacggatgaacattgtatatgacggagccaacctagaatcgggcacgcaatggggagggaaaaaancaggcacggatgtcggttagcatgacgtat

SEQ ID NO: 45844 - DNA, 101 bp, rice(Oryza sativa)
  misc_feature (71): n=t or g
gtagtttcgtcagcttttggtgaggaacgggcgaggagctgtgttagggagatgcctcaccccgagtcatngccctgtgctggtgctgctcccgcgccggg

SEQ ID NO: 45845 - DNA, 101 bp, rice(Oryza sativa)
  misc_feature (71): n=a or c
gctagctcctaactaattttacacccacttgacagatggtgcatgctagggtaacgagctgaaattagttntgtttattgttttagagaactgcctcaata

SEQ ID NO: 45846 - DNA, 101 bp, rice(Oryza sativa)
  misc_feature (71): n=a or g
ttcacgaagactgccagaataagcgtcgtcaaaaggaacaaggctgataagctcttcaagattgctggtcnaattttttggtcccctgcaaagcagcatgc

SEQ ID NO: 45847 - DNA, 101 bp, rice(Oryza sativa)
  misc_feature (71): n=a or g
atacccgattccttagaaccacgtgaacgacgacttcaatgcaatgttctttccaatatcgcaataagccntgtatatatcctcgttggatgtagaggtcg

SEQ ID NO: 45848 - DNA, 101 bp, rice(Oryza sativa)
  misc_feature (71): n=t or c
gtggtgagtgttgacctctatattaacaaatgcatgaacatgagaggatttgcacggcaggatacggaggnctgcctgcctaactgtagaggatttgcatt

SEQ ID NO: 45849 - DNA, 101 bp, rice(Oryza sativa)
  misc_feature (71): n=t or c
gtgaacaaggctgctcagcacggcgctctcgatgcgatgcctgttggcgggtgagtgaacagaacgctccngatgatccctgccctcatgatgtgatctcg

SEQ ID NO: 45850 - DNA, 101 bp, rice(Oryza sativa)
  misc_feature (71): n=a or g
caacggcagatctttctccttcaaccattcaggaaatttctgtttctgttctttacaaatccaaatgtccnttattctagggttgcgggctcttatctcgt

SEQ ID NO: 45851 - DNA, 101 bp, rice(Oryza sativa)
  misc_feature (71): n=t or c
ggatctatgtacccttccgtgcctacggcaattgtctgtacacctacatactcttctgcattgcctaccanagttgtttgcaacattgcattgttgtccgg

SEQ ID NO: 45852 - DNA, 101 bp, rice(Oryza sativa)
  misc_feature (71): n=t or c
ggagtgaagccctatttcctcatggcatatgggcctacaactcttaacactgcataatacattaaacaacngataagtctgataaatcatttagtaaagaa

SEQ ID NO: 45853 - DNA, 101 bp, rice(Oryza sativa)
  misc_feature (71): n=t or c
ccaagtgttccaaccctgtctccttagagtcatactgcttgaactcgttggcattgaaccttagatttaanctttgcacactcggcattgctccttccaca

SEQ ID NO: 45854 - DNA, 101 bp, rice(Oryza sativa)
  misc_feature (71): n=t or c
gtgaattacactttccattaaagaaacaacttctaaggctgtgttacattccaacttttcttcaaactttnaacttttcgtcatatcaaatgtttggacac

SEQ ID NO: 45855 - DNA, 101 bp, rice(Oryza sativa)
  misc_feature (71): n=t or g
tgtgctgagatgcaaggtgcgcatggtgatggttacactatgcgctagcacctcgatctctctctctctcncgcgaggatgtggctagcacccttgatgtg

SEQ ID NO: 45856 - DNA, 101 bp, rice(Oryza sativa)
  misc_feature (71): n=t or g
aacatatttaatttttgtaatagtagagaaatgtgaagtcattttgccggacctgaaatgcgatgtcatgnaactcattttttttttgagaagaagtcatg

SEQ ID NO: 45857 - DNA, 101 bp, rice(Oryza sativa)
  misc_feature (71): n=a or g
aagcaaaccaggattggacaccagaagccattatacgtgctgcgcaactgttctccttttaggagattccncgaaagaaaatgaggccatcaatgtcatct

SEQ ID NO: 45858 - DNA, 101 bp, rice(Oryza sativa)
  misc_feature (71): n=a or g
gaaaccacgaatggaaacataaagaaagatatacatcctcgacattaaagttgtcaatgtcaatatcatcnatagttcatagcctacaataataccagaac

SEQ ID NO: 45859 - DNA, 101 bp, rice(Oryza sativa)
  misc_feature (71): n=a or g
ccgatgtgcttgtggttgctgattcaggttctgattgcgagcatcagcgatggtctgattcctccctactnaaagaagtaagaactattatatcaattatt

SEQ ID NO: 45860 - DNA, 101 bp, rice(Oryza sativa)
  misc_feature (71): n=t or c
tactactaaaaaagatcataaaagaagtcccatgtggctacatcagcaagccatgtctaagctgacgcatnagccacgtggagcagtatgtcacatcattt

SEQ ID NO: 45861 - DNA, 101 bp, rice(Oryza sativa)
  misc_feature (71): n=t or c
gggtgaaatactttggctttcttcatttagactggtgacaattgaagatagcccccaaattgccttaaganttggtaagtgttggctgtttttaaggcaat

SEQ ID NO: 45862 - DNA, 101 bp, rice(Oryza sativa)
  misc_feature (71): n=t or c
catcacgaaaataaaatataaagccttaatttgacatatacttcttgttccttcgtgctccttgcgacccngagccattgctcaaatacccacttcaccag

SEQ ID NO: 45863 - DNA, 101 bp, rice(Oryza sativa)
  misc_feature (71): n=a or g
taattgctgtgggataggaagcctaccacccaataccgagatctttaggcactgcctgacacttacccttnagaatgtcccgaatatgaagacactatctt

SEQ ID NO: 45864 - DNA, 101 bp, rice(Oryza sativa)
  misc_feature (71): n=t or g
ccctcacacaatcttcttgcttcaacacaacagtaatattgtattcactgcaaccttgggctattgctcgnacattaatatttgcctgaatccattgttac

SEQ ID NO: 45865 - DNA, 101 bp, rice(Oryza sativa)
  misc_feature (71): n=a or g
aaaatcaatttccctctctaacaccgttatgtattttgtacattctgtttgatacaggacaaagttcttgnccatcaataataaaacatgtcttagatatt

SEQ ID NO: 45866 - DNA, 101 bp, rice(Oryza sativa)
  misc_feature (71): n=t or c
aggagcatatgtcatgctattgcaggttcatggatgtcttctttcttagggaaccgctattgtatctgttnttactagtttgagtatgtaaaattctgtta

SEQ ID NO: 45867 - DNA, 101 bp, rice(Oryza sativa)
  misc_feature (71): n=t or c
acaatctaatctgaaacttgctactacgattaaactctagatctttaggatacgcttaggacattgcaacnacaattgcatcttcttttcttttctagttg

SEQ ID NO: 45868 - DNA, 101 bp, rice(Oryza sativa)
  misc_feature (71): n=t or g
ggaagagatccaaatccaatgtgcaactgcaccctcttgcttaagagaaggggcaaagtatccaaagcatnttccctgtttatccgagtataatttttttt

SEQ ID NO: 45869 - DNA, 101 bp, rice(Oryza sativa)
  misc_feature (71): n=a or g
taataaattgtcacgtgtagttccatgtgacaagtcgagataacacttgtgcttagttcacgctaaaattntaagtttggttgaaattggaacgatgtgac

SEQ ID NO: 45870 - DNA, 101 bp, rice(Oryza sativa)
  misc_feature (71): n=t or c
taggaatcaaccgagatcgataattagcacacgtacgtgatatctcgatcggatggcatcgttgcggctantggccggagtgctgctcattctgatgtcct

SEQ ID NO: 45871 - DNA, 101 bp, rice(Oryza sativa)
  misc_feature (71): n=a or g
acagtctacagatggtggatgcaaggaatctgtttgagaaaatgccagagcgcaatttggtttcgtggacngtaatgatttctgggtacggtcgaatcgag

SEQ ID NO: 45872 - DNA, 101 bp, rice(Oryza sativa)
  misc_feature (71): n=t or c
agccaatatcctctaactataccctcctggtgtattgagaaaccacccttacttgccgagttcattacganatcctgtcatggccatccaaccggtaatga

SEQ ID NO: 45873 - DNA, 101 bp, rice(Oryza sativa)
  misc_feature (71): n=t or c
cacccagcggtggaggaggtggagcccaaggtcgtcgaaccggccgttgctcgccaccgtggtagatctgncgtgccgcagctggatccacgcgcgtggga

SEQ ID NO: 45874 - DNA, 101 bp, rice(Oryza sativa)
  misc_feature (71): n=t or c
tgtttttttatttatctccttcggcgaaatccctcgttctgttcctgagaccaatgttaggatctgtttgncactttcaactatactatttttcaaaaaaa

SEQ ID NO: 45875 - DNA, 101 bp, rice(Oryza sativa)
  misc_feature (71): n=t or c
caaattttccctaaaaattatatgtgctgggattcccttattgccttctattgatggtatctctaatcaanaaaatacaaatatcggctatgggctctttt

SEQ ID NO: 45876 - DNA, 101 bp, rice(Oryza sativa)
  misc_feature (71): n=a or g
tgacactaagcctgagatatttcaaaagagagccctggaccctggtatgatagcagcagaagagtacaagncagagacagataggctctctgtgctagtgg

SEQ ID NO: 45877 - DNA, 101 bp, rice(Oryza sativa)
  misc_feature (71): n=a or g
cgaacaaaccctagataacacgtgacaaaaagcccaccccacatcttatatttacttaaaccattggatcngctttgagattcgtgatactctcgcaaccc

SEQ ID NO: 45878 - DNA, 101 bp, rice(Oryza sativa)
  misc_feature (71): n=t or c
gttcatatccagtgcaaaacacaccaagtaggtaaacagcagccaagtcggagaagcttttcatcttgtanaggagtctatggtgatgaactgagctatta

SEQ ID NO: 45879 - DNA, 101 bp, rice(Oryza sativa)
  misc_feature (71): n=a or g
tagaattattacctgcgaagtaaactggagcagcaacaggagttccgttcgtatgagaaaggtaaaatagngtataaatgtgtggtaatagccggtaccgt

SEQ ID NO: 45880 - DNA, 101 bp, rice(Oryza sativa)
  misc_feature (71): n=t or c
ctcataggcctatgtaaagaaccattaaaatttatcgcagtagaagctatgtttccatcaattttgaccgnacgaaaaaatcaattatgtactagtgttgg

SEQ ID NO: 45881 - DNA, 101 bp, rice(Oryza sativa)
  misc_feature (71): n=t or c
attttctaataaatgttaagagtcgactctgaactagtgttatgcgtaatgatcatgtttctctttccatncctctctttgttccatgtcatcaaatttat

SEQ ID NO: 45882 - DNA, 101 bp, rice(Oryza sativa)
  misc_feature (71): n=a or c
actgtgtgccttgtatgtttcttcctcttttcgttctcttacaaaattgaagttgtacttgtgttcaaggnaagatcttggcaaaagcttttccctggtcc

SEQ ID NO: 45883 - DNA, 101 bp, rice(Oryza sativa)
  misc_feature (71): n=a or g
gtaaaaatcgattttcgctgcgggcatcgtaacaaggccgcatgcgaaaataaacacatttttcagcaccntcgaggagggcggcgaggaggccaaggtga

SEQ ID NO: 45884 - DNA, 101 bp, rice(Oryza sativa)
  misc_feature (71): n=a or g
atattaaattaaataagttaggcctagcaagttaccctgttttcgctacctgcttccttcaaacaaagatncagctgaacgaaaaactgtgaaaagaaaag

SEQ ID NO: 45885 - DNA, 101 bp, rice(Oryza sativa)
  misc_feature (71): n=t or c
acaccccactcacagtatccttaatcccatcaatcccatgcatttatgagggggtattttagagttttcancctaatccttatgccctaaaatgctagtat

SEQ ID NO: 45886 - DNA, 101 bp, rice(Oryza sativa)
  misc_feature (71): n=t or c
atgatgagtcttgttaaagtctttcgatccaaatgagggagaatgtttccccgtcggttgatggggggagngcgccgataataaaaaagggcacctctccc

SEQ ID NO: 45887 - DNA, 101 bp, rice(Oryza sativa)
  misc_feature (71): n=a or g
acttcagatcgtggcccagctcaaaacatgaatggttaatcatactacctccttcctatattatattcctntattatataggacggaggtagtatctgctt

SEQ ID NO: 45888 - DNA, 101 bp, rice(Oryza sativa)
  misc_feature (71): n=t or c
ggaggatgacctgattgtaagaaaacaattggtgtggaaatgggttgcggaagggtttattagaaaagtgngtggtaaaagaccagatcaagttgcagaga

SEQ ID NO: 45889 - DNA, 101 bp, rice(Oryza sativa)
  misc_feature (71): n=t or c
atatttatttgtggaatgtccctatgcaagatttctttggagagctcaattttcttctggtttaaatactntgcttattatatctcatatgtttgagaatt

SEQ ID NO: 45890 - DNA, 101 bp, rice(Oryza sativa)
  misc_feature (71): n=t or c
caaagcagacaagctggtaacatcatgcagccatgttgataatcaagaccgagcaacattctcaacctcgncagctttgaagttcggtttggacctctgac

SEQ ID NO: 45891 - DNA, 101 bp, rice(Oryza sativa)
  misc_feature (71): n=a or g
catctgaggttgaggaggtgttcggcgcacttaagcgatacctcgcaaatccacccgtgctcgttgccccnaagccaaaggaggaactcttcctctatatt

SEQ ID NO: 45892 - DNA, 101 bp, rice(Oryza sativa)
  misc_feature (71): n=a or c
cgaagtttgaaccaatcataaacccttaaaacgaatgccacaccacgtgataatagagcacaaacatcatnaaaaattgggataaactcgacacgaattaa

SEQ ID NO: 45893 - DNA, 101 bp, rice(Oryza sativa)
  misc_feature (71): n=t or c
aaaaaagcaccttcatttctgcgatccaacacggtaactggcttcatgacagcttcctgaactcggacacnggtgttttcgctcttgcatactcttgctcc

SEQ ID NO: 45894 - DNA, 101 bp, rice(Oryza sativa)
  misc_feature (71): n=t or c
accctggatgcaatgggaatcccacgaagcgagctgacaccgtcagatcaaccattccatgggattatccnagaatcttcgtcaaaaccactaggcaaaat

SEQ ID NO: 45895 - DNA, 101 bp, rice(Oryza sativa)
  misc_feature (71): n=a or g
ctgatggctgatgaaatcgagagggaggtgggcgccagcaagtgagcccaacccgttagcgatgcaaggcnggcggtgcactgtggaccgagtccatcggg

SEQ ID NO: 45896 - DNA, 101 bp, rice(Oryza sativa)
  misc_feature (71): n=a or c
aatgttttcgcgatgtcaattcacacacaaataaccaacagtaattttcaatgaccacatagtttccattntattgagttatatgtgcaattataatttgg

SEQ ID NO: 45897 - DNA, 101 bp, rice(Oryza sativa)
  misc_feature (71): n=a or g
ttcattattccgtctttttttttacctgtggccctgcctatatgttgaagctgacaagtagaaaacaaaangctggtttgtttgttccctttagcttgttt

SEQ ID NO: 45898 - DNA, 101 bp, rice(Oryza sativa)
  misc_feature (71): n=a or g
cgcccggggcgaatcattttcgataataactaacttgaaaccatgtttcaatacaccatactgagagaatntcgaaaatgacttgagtatccgaaaatata

SEQ ID NO: 45899 - DNA, 101 bp, rice(Oryza sativa)
  misc_feature (71): n=a or g
gatcaatgcaacgatcgaaatgaaaggattgttctacttacatatcctcttcattttgtccttcagctcantaagatgctcgctcttggttagaccaaagt

SEQ ID NO: 45900 - DNA, 101 bp, rice(Oryza sativa)
  misc_feature (71): n=a or c
tttggaccaaacaaaatacaagcgtcacctaagtatatgtgatagaagtgtgatagatatcatgggcgctnacagtgtgtccctgatatttaccattcctc

SEQ ID NO: 45901 - DNA, 101 bp, rice(Oryza sativa)
  misc_feature (71): n=a or g
ccctccctaaatcgaagccaataagtctagtttacatcggtctacgaaagagccctagtccacccctgccnctgccgatgtcgttggtgctgatagatgcg

SEQ ID NO: 45902 - DNA, 101 bp, rice(Oryza sativa)
  misc_feature (71): n=a or g
aattttgtatttaagcccctccactacattatgcctccagatcgactcccatcacgctcgtgaaagagggngcaaagggggtacccggaggacaacaaaag

SEQ ID NO: 45903 - DNA, 101 bp, rice(Oryza sativa)
  misc_feature (71): n=a or g
gcccatagttgttgtcccggcgtcgatctccgtcgtcgtcattgtcacggcgtcgacctcaactggtatcncgcggcacccgctgctcgcgtttagtatgt

SEQ ID NO: 45904 - DNA, 101 bp, rice(Oryza sativa)
  misc_feature (71): n=a or g
cgtgtgcacataatccatgcgcttatgttgattgtaatagctgtactttcgtactttcgcggaaaaaaaanagagctgcacgcctatcagcaaacccacaa

SEQ ID NO: 45905 - DNA, 101 bp, rice(Oryza sativa)
  misc_feature (71): n=t or c
cacacgatcgtgtccaaatagagcataggcatgtacccgtagttccattcaccacagatgtatgggccganacgaagaatagcgtacattccggcgttttg

SEQ ID NO: 45906 - DNA, 101 bp, rice(Oryza sativa)
  misc_feature (71): n=t or c
taacgtccttttctctacacgtttaatttggcatatcctaccattgacagtgttgtgttgacatggtttgntctttcgcagcaaatcacattgatgggaca

SEQ ID NO: 45907 - DNA, 101 bp, rice(Oryza sativa)
  misc_feature (71): n=a or g
caatacataacttttatgcattgttttgtagccctccagtaagagttcaacatgatacgcatgtgtatgtnctatatactaaggacatgttcactttgata

SEQ ID NO: 45908 - DNA, 101 bp, rice(Oryza sativa)
  misc_feature (71): n=a or g
gatgaaatggcatttcaaaattgaatataaaaggatatctccagtaaagagaggggaaatattcgcttctngccatttccacaattctgctagcaaaatta

SEQ ID NO: 45909 - DNA, 101 bp, rice(Oryza sativa)
  misc_feature (71): n=t or c
ttcgtctacaaacagttcgtagagcaatacgctaagaactcacgcaagacgactaacggagatcaaagcangtcaaagaagaaggatgacgaagatgatgc

SEQ ID NO: 45910 - DNA, 101 bp, rice(Oryza sativa)
  misc_feature (71): n=a or g
ggccgcaaaccagaagaatcatgcaaatgcttggttgtcctcactcggtacaaaatacttcaggatcactncacatgactcgagtggctaagagagcatta

SEQ ID NO: 45911 - DNA, 101 bp, rice(Oryza sativa)
  misc_feature (71): n=a or c
atatccgttgactctttacaaagggacacaaggaaatctcaggactcgatttttgaagtgtctctggaccnataatacaaggtctcaaaaaggatgtgcta

SEQ ID NO: 45912 - DNA, 101 bp, rice(Oryza sativa)
  misc_feature (71): n=a or g
gatgttagggggaagcttgtggagatcgctgatcggctgggcagctctttagactccttagtggataactncgggccgatcagagataggtttgaagaaat

SEQ ID NO: 45913 - DNA, 101 bp, rice(Oryza sativa)
  misc_feature (71): n=a or g
atgggtgtaattaattcaggctcaaactgtaacaaaacattcaggacggaggcatatggttttcttaagcntcttgttgaaccatgaagtataaaattttg

SEQ ID NO: 45914 - DNA, 101 bp, rice(Oryza sativa)
  misc_feature (71): n=t or c
gggaaaggaaatcccttgccgaagccaagccatttgcacctgcacaccaaccggacatcttctagcaacanaaaccttgtatgcttacactgtaaatattt

SEQ ID NO: 45915 - DNA, 101 bp, rice(Oryza sativa)
  misc_feature (71): n=t or g
cgccgcggagcgccttagccatttggtgtgggcattgaatatgcaatgactggtcaagtcttgtcaccggngacggtctttggaggctgcctccggagggg

SEQ ID NO: 45916 - DNA, 101 bp, rice(Oryza sativa)
  misc_feature (71): n=t or c
tatggatttcacgcagactggaacaggatgcggatctcggggaacatcatcacgcagaaccgtgccaagtngctgcggcggctgctggcgtcgctgcggaa

SEQ ID NO: 45917 - DNA, 101 bp, rice(Oryza sativa)
  misc_feature (71): n=a or g
cactagaaatgcctctacctcacaatacctccagaggaggcgtagaccgcaaaaaaacactctagcatgancacatcatactctgtgtaagactaacacaa

SEQ ID NO: 45918 - DNA, 101 bp, rice(Oryza sativa)
  misc_feature (71): n=t or c
gcaccagcagccgtagactatggtcagtcgcattgcaccatgaggttacctttttttttacggatgacaanatagtacaagttatcatggtgtttagaaaa

SEQ ID NO: 45919 - DNA, 101 bp, rice(Oryza sativa)
  misc_feature (71): n=a or g
caatggtactcttactggatcactatgcttctcccttaaactcaggttatccaagaatgacaccaaacacnaagatgatgcatactcgtctattgccactt

SEQ ID NO: 45920 - DNA, 101 bp, rice(Oryza sativa)
  misc_feature (71): n=a or g
accactaccttccatcccacttcgaagagttgagctcaagtagtggtcaatagttttcaactttaattttnaaattttcaactcaagagatcatggattgt

SEQ ID NO: 45921 - DNA, 101 bp, rice(Oryza sativa)
  misc_feature (71): n=t or c
attttagaataaaacatgatcttagtgctattcccaataaatatgcagcccaaaatctcagcgctagatgntttgacgctaacaccccttccgcattagcg

SEQ ID NO: 45922 - DNA, 101 bp, rice(Oryza sativa)
  misc_feature (71): n=t or c
gcagctttgctggactctgttaaggcaagcttggacaaagctcaatctcgtatgaaacaatatgctgatantaaacgttctgaaaggacatttcaagttgg

SEQ ID NO: 45923 - DNA, 101 bp, rice(Oryza sativa)
  misc_feature (71): n=a or g
aaccaaatcgagaagctcaaagcacgcgttgaagatgcaagcaagcggcgattgaggtataagcttgatgngcgcaccttcaatcttagtactgcaggggc

SEQ ID NO: 45924 - DNA, 101 bp, rice(Oryza sativa)
  misc_feature (71): n=t or c
tagtaattaaaaatctcggtccgtcaacgtgcattgagctagacatggtcgccggcgacccgctcctcgtngacgctccggtgctgggcccgtacaccgcc

SEQ ID NO: 45925 - DNA, 101 bp, rice(Oryza sativa)
  misc_feature (71): n=a or g
tctgcaaaccaaacattgtatatgatgagcttttggaaactggttccagacttgactaaggatctgggttnccgagtatagcatcatccccggagtcatct

SEQ ID NO: 45926 - DNA, 101 bp, rice(Oryza sativa)
  misc_feature (71): n=a or g
atcaatcctcactggcgaccgcggccggacgacggagcgaaagaagagaacatctctagcgcccctgcctntccagaagtagttgttgccgtacgcgacac

SEQ ID NO: 45927 - DNA, 101 bp, rice(Oryza sativa)
  misc_feature (71): n=t or c
gtagcccaccaccaccactactactaccacttatacagtagtcataagagtatgtaggccccatttgtttntgattatgatgcacattttagctcggtttt

SEQ ID NO: 45928 - DNA, 101 bp, rice(Oryza sativa)
  misc_feature (71): n=a or g
atgacggcgtccctagccaccccatggaagctaaaccactcatatcatatatgaagcctatgatgttggcnccgcgaaaaaggttcattattgggataagt

SEQ ID NO: 45929 - DNA, 101 bp, rice(Oryza sativa)
  misc_feature (71): n=t or c
acaaaaactaccgatgttaggaatccagttctaggccgatcaagtgacgtggggcctgttcactttgatgncatttttaatcttaccaaattttggtatag

SEQ ID NO: 45930 - DNA, 101 bp, rice(Oryza sativa)
  misc_feature (71): n=t or c
atacagattgatctctaagctaaaaatgaggttatcacattgttgctctgacttaaaatggcatgggtagngatgaggacttggggatggtatgcactgcg

SEQ ID NO: 45931 - DNA, 101 bp, rice(Oryza sativa)
  misc_feature (71): n=a or c
aatgtaccatccatgtagcactttggcttgcgaataccttgctgtaacctagttacaggacgttgtggtgntggcgctggtacaagggaagcagcagaagt

SEQ ID NO: 45932 - DNA, 101 bp, rice(Oryza sativa)
  misc_feature (71): n=t or c
tgcatgttggaccaaaatctgcaaacaagtacataaaccagcaccataggactggatcagttcaacgctgnttggatctctggcacacatacacatcgaca

SEQ ID NO: 45933 - DNA, 101 bp, rice(Oryza sativa)
  misc_feature (71): n=t or g
gctgcacattgcttccaaaaaactgatcagcagggttagcaggaatattagccatattgtcatctaactgntgttccccaggattaggtgctggatttaga

SEQ ID NO: 45934 - DNA, 101 bp, rice(Oryza sativa)
  misc_feature (71): n=a or g
ctcccgccgtcgactcgcgtccgaccgagatcgtggactacaatgagttcggctttcacaacaacgacccngatctcgacgacttcgatgaaagcttagaa

SEQ ID NO: 45935 - DNA, 101 bp, rice(Oryza sativa)
  misc_feature (71): n=t or c
agattcaagaaccactcacacaccacgccggataggaggatgtagctgtgtaatacctcaccctgctcagntgcttcttgatcggggactggggagccttg

SEQ ID NO: 45936 - DNA, 101 bp, rice(Oryza sativa)
  misc_feature (71): n=t or c
cgacggcgagcacggcgggatcggaggagcacaaactaacacacggcgaatcgccagggagatatcatatngttcgtcaggtcggctagatcctccacaca

SEQ ID NO: 45937 - DNA, 101 bp, rice(Oryza sativa)
  misc_feature (71): n=a or g
aagccattgcattggcttttggaaaagccggctgcaaggttaacacttagtaattgatttatgcttatacntctatagaaattttatcaaaagggctgatg

SEQ ID NO: 45938 - DNA, 101 bp, rice(Oryza sativa)
  misc_feature (71): n=a or g
caaacgttgctagcacctaattttgcaataaacattgagatgccctaaactggattaggcgtactggcatntgggcgtagtcactgcatgtgggccagctc

SEQ ID NO: 45939 - DNA, 101 bp, rice(Oryza sativa)
  misc_feature (71): n=t or g
aaaaaatatataggtcagaaatagtttagaaatgcatgagtaaaatagagtaaacaaattttggaccgagnacagaaataacatgaattttaaaatttgtt

SEQ ID NO: 45940 - DNA, 101 bp, rice(Oryza sativa)
  misc_feature (71): n=a or g
tctagttttagttgtttaagcactgtagtctaatttatccaaaagttctatgttggggagagaagtagagnaggagctcggcgttttgagggcgtcgacac

SEQ ID NO: 45941 - DNA, 101 bp, rice(Oryza sativa)
  misc_feature (71): n=a or g
tccccggccgtaaacacgccagcgggttgatctacttcctcggtgatcttcttgtctcagcaaaggtaatnatgatcaaggacggcaccaaagctgcgcgc

SEQ ID NO: 45942 - DNA, 101 bp, rice(Oryza sativa)
  misc_feature (71): n=a or g
gttcacctcgggaggcgtgcgacgaacagatgggattataaaaccggatgagacaaacaaaaagtacacgngagaaaaaaccggtgacaaaaaatattgac

SEQ ID NO: 45943 - DNA, 101 bp, rice(Oryza sativa)
  misc_feature (71): n=a or c
aaagattcatagagagtgcatgtgtgtgttcaaagaaagataatgcaaagaattatgatggattgacctcnctaaagtactatccctcctatactcagata

SEQ ID NO: 45944 - DNA, 101 bp, rice(Oryza sativa)
  misc_feature (71): n=a or g
ggaagatgatcaattttcaaagagtttcatgtataaatggaacagtcccactgttgccttctttggtgtcngcagaggagctttgttctacatgtaaggta

SEQ ID NO: 45945 - DNA, 101 bp, rice(Oryza sativa)
  misc_feature (71): n=a or g
agccacaccataacttccttgccataatttgttgtcactatgagatagggccaagttgaagaaaactttgntatgactaacttatagctagaaataaacac

SEQ ID NO: 45946 - DNA, 101 bp, rice(Oryza sativa)
  misc_feature (71): n=t or c
tcaccttcttgcgaaggccgcccggctggcacgttgttcttttaatgtaatgatgtataattattttgcgngttcgtgaaaaaaaaaaattctctggctgt

SEQ ID NO: 45947 - DNA, 101 bp, rice(Oryza sativa)
  misc_feature (71): n=t or g
tatcacaacgaagaataaattgtcattccgaacggacaccaatgtacatccataatattcccaacttacanaatgatatattccccccttattataactat

SEQ ID NO: 45948 - DNA, 101 bp, rice(Oryza sativa)
  misc_feature (71): n=t or c
gctggatttcagacatcgcaagcacattttcagccgccgtcgccgccaccgacgttgaagatgtcagtggncctgacgaagcgccctttcacccgcgtcct

SEQ ID NO: 45949 - DNA, 101 bp, rice(Oryza sativa)
  misc_feature (71): n=a or g
atccatgaacatattcaaagaggaggccactgtcgctactgctatcaacatcattgagcgggccatacccntgctcccagcagtggatccagctgccctct

SEQ ID NO: 45950 - DNA, 101 bp, rice(Oryza sativa)
  misc_feature (71): n=t or c
tcgaggatggcgatagcggtggtttctcggccatgaggaaaacttgttggttgactccttatcggtcccancgggcgtgccaaaagcatgttgatgtaaaa

SEQ ID NO: 45951 - DNA, 101 bp, rice(Oryza sativa)
  misc_feature (71): n=a or g
ggtcatgggctcatggcatccgcatgatgggactctcgagttgcacagcaccaacctccaaataaaaaccncagccctcccccctctaataacatcgcaca

SEQ ID NO: 45952 - DNA, 101 bp, rice(Oryza sativa)
  misc_feature (71): n=a or g
atcctgtggaggagaaaggaagaaggatcatgattatgggagtttaattagcagcgttgacgataccgacntgttcttcaatcaaaccaatgaggtgggct

SEQ ID NO: 45953 - DNA, 101 bp, rice(Oryza sativa)
  misc_feature (71): n=t or c
cgtgtcccagaatacaacttagtcccaaatctttgtgtttactaaacagtactaggtagtcccaccgtttnagaatgtaagtcattctagcatttcccaca

SEQ ID NO: 45954 - DNA, 101 bp, rice(Oryza sativa)
  misc_feature (71): n=a or g
gttgtaatcatatgtgtagtggctgttatgtttgagccgatcgataatccttcgttgttgtgtgttgttancttaactctactagtactaagtaccgcgtc

SEQ ID NO: 45955 - DNA, 101 bp, rice(Oryza sativa)
  misc_feature (71): n=a or g
tatggacggagaaaatactattagaatattatcagagagtaaagtgttgagctacactcttgcttttcagngttcgtgagcaaaatcgtatgtccagccga

SEQ ID NO: 45956 - DNA, 101 bp, rice(Oryza sativa)
  misc_feature (71): n=t or c
tggggttgcacggatgattcaagaacagggatacatgcactgttgcttcatgtgtttactctctgtcaganatacgatctggtcggttgcctaatgttgga

SEQ ID NO: 45957 - DNA, 101 bp, rice(Oryza sativa)
  misc_feature (71): n=t or c
atagcaagtaagacgttggatattatagggtggcgtactacattgcataaataacaaagctcttctgtaanagtactccctccgtctctaaatatttaacg

SEQ ID NO: 45958 - DNA, 101 bp, rice(Oryza sativa)
  misc_feature (71): n=a or g
catgatgtacttttgcttcatgcacaaccaagggggaaggttgtaaacacatagggtcacaggccaagcantggcggatccagaaaatcgattcattggtg

SEQ ID NO: 45959 - DNA, 101 bp, rice(Oryza sativa)
  misc_feature (71): n=t or c
tgcagtaagacaagttcgttagataggacaattacaattgactgttgaatagaataggggagacatagaangtagttgggataattatattgagaattagg

SEQ ID NO: 45960 - DNA, 101 bp, rice(Oryza sativa)
  misc_feature (71): n=a or g
cgtagaccccacctgtcatcctcattacccttctctctcatcctctctctccctctctctagccggagtgncggggaggagtggcggcggccggagtgggg

SEQ ID NO: 45961 - DNA, 101 bp, rice(Oryza sativa)
  misc_feature (71): n=t or c
catccatggcatctacgagctctggccaccggagccaccgcttgacctgctcgaactcctacctcgttagngaagcagatcgaaaaatccttgacctgctc

SEQ ID NO: 45962 - DNA, 101 bp, rice(Oryza sativa)
  misc_feature (71): n=t or c
aatcctaatgtagcaaaggagaagcgaccatttgttttcctcatgctctcagaaaaggtttcggaataaanagggtgctcaatacgttcaggatggcgact

SEQ ID NO: 45963 - DNA, 101 bp, rice(Oryza sativa)
  misc_feature (71): n=t or c
gctagtgggttgggctggtgtgggatgcttccaggtgatatttataaggcaataagttcatattgattccnttaactagtaattgaatctgattcgtatcc

SEQ ID NO: 45964 - DNA, 101 bp, rice(Oryza sativa)
  misc_feature (71): n=t or c
gcggaggcgatggcggtcagtggaggtagaggcggtgaggagaagcggacagattggaaggctagagccgngccctcctcgagccccattggtgggctcgt

SEQ ID NO: 45965 - DNA, 101 bp, rice(Oryza sativa)
  misc_feature (71): n=a or g
ttttgtagtttggggtgaaatagtttgaacaaaaagttcaaagggctaaagctggactttaacccttattnaaatatggatatgatagtatttacccatat

SEQ ID NO: 45966 - DNA, 101 bp, rice(Oryza sativa)
  misc_feature (71): n=a or g
tcaggttaggatagtgcacgtacagtgagtccctgcattgcacaaaaagcaagccggtctcaagattatcngtatattcaagatcttgaatatattgatgt

SEQ ID NO: 45967 - DNA, 101 bp, rice(Oryza sativa)
  misc_feature (71): n=a or g
gagctgctcgatcgatgacgttgtaggtgactcgatcagagaagggaggatctaccagaatcccaaattanactctgaaactctgaatgtcaaatcaaatt

SEQ ID NO: 45968 - DNA, 101 bp, rice(Oryza sativa)
  misc_feature (71): n=t or c
tacgtatattcactattcagattggatgtaacatgtaacccacaatcttaggtagttatgcgggctgtaanaagtaacattaacgtgcgtcccatagttta

SEQ ID NO: 45969 - DNA, 101 bp, rice(Oryza sativa)
  misc_feature (71): n=a or g
ggtggatgcaaggatacaatttcagcagtaatttcagattgctgtatttggggggttatgatattattctnggaatggactggctagaatcatacagtccc

SEQ ID NO: 45970 - DNA, 101 bp, rice(Oryza sativa)
  misc_feature (71): n=a or c
cacgagctcatcgcttgcgttggatcttccgttatatgcttcttgaaatccatcagggagagcagatcagntgtgttgttcagagttgcttcacaacggat

SEQ ID NO: 45971 - DNA, 101 bp, rice(Oryza sativa)
  misc_feature (71): n=a or g
tactactttctgcattatctgcctctcctaaaaatgtccgtccttgtttttcctcgaaatattttctgacnggagcttttgaagagcttggacatgcagcc

SEQ ID NO: 45972 - DNA, 101 bp, rice(Oryza sativa)
  misc_feature (71): n=a or g
aagcatgacggaaaatattgtgaggaacaaatatgctacttgttctatcgtttcacgcatgccttccagcnctggaacagggcagtatttcagggagtcct

SEQ ID NO: 45973 - DNA, 101 bp, rice(Oryza sativa)
  misc_feature (71): n=t or g
agagagagagagagagagagatctctaaagagagatgagtaataattggatcagtaggagatgtggcaggnggtggggtggaagtggtggggattatgatt

SEQ ID NO: 45974 - DNA, 101 bp, rice(Oryza sativa)
  misc_feature (71): n=t or c
tactgtgaaattcttttgaattattcaatacataaggattttagatgaaatttaacatggacctaacctcnttttttttccgtgaacacgcaaaagcattg

SEQ ID NO: 45975 - DNA, 101 bp, rice(Oryza sativa)
  misc_feature (71): n=a or g
cgaagcttggcatccacttttatcacctcttctcttttgaaggtgaggtagaaccttcacaagggttcctnggcacaccacactccttggcggctccgaga

SEQ ID NO: 45976 - DNA, 101 bp, rice(Oryza sativa)
  misc_feature (71): n=t or c
taggtgttacctgaagaacggtctcttttagtctgacgttggtattcttcaaatctgtgttggctctatcnacctacattcatcagtacaccatataaata

SEQ ID NO: 45977 - DNA, 101 bp, rice(Oryza sativa)
  misc_feature (71): n=t or g
atttgcatgcattgcacgcacgtattcgtttatagacacctcattatattctgatcacctcctcctgtgancacaatgatccacagtttttgaatgctacc

SEQ ID NO: 45978 - DNA, 101 bp, rice(Oryza sativa)
  misc_feature (71): n=t or c
tttctttcttgatgatactaatcattagggcagagagattgtgtcgatagaaacatacatgctgaatcccntattgtttgacaaaatgttaaattgtgtac

SEQ ID NO: 45979 - DNA, 101 bp, rice(Oryza sativa)
  misc_feature (71): n=a or g
aaattactgcggatagaaggagcattcacatctcatattactgccgacttcagttcaaaggaacccttgcngtccagaaaatactttttactgcattttca

SEQ ID NO: 45980 - DNA, 101 bp, rice(Oryza sativa)
  misc_feature (71): n=t or c
tatggcaggggtgtgggtgtttgaggatgggatggtgaggagggcagatagcgaggcgccgtcgagagggngcggtgtcggtggtggaggtgggggaggga

SEQ ID NO: 45981 - DNA, 101 bp, rice(Oryza sativa)
  misc_feature (71): n=a or g
ttatcttttgaggatggatggatggatggttggttagttattttaattcgatgagcagaaaatatccagtntttttctccatttttggatttttaccatgc

SEQ ID NO: 45982 - DNA, 101 bp, rice(Oryza sativa)
  misc_feature (71): n=t or c
tcttttcaaatttggactccatgaaaatttgacacctcatctcatatacacacaatctcccatcgtatgcngcatggaattttcaccaaccacgtgtgttg

SEQ ID NO: 45983 - DNA, 101 bp, rice(Oryza sativa)
  misc_feature (71): n=t or c
agaggaatactcctttgttggtcttcttgctgtacattgacctcgacattcttgcacttctctaacagtanagacagtgctgcagcaggtgataccatcag

SEQ ID NO: 45984 - DNA, 101 bp, rice(Oryza sativa)
  misc_feature (71): n=a or g
ttatatctataatacggattgatctcaggttgttgagagtgatccgttccctctgtaatgcgccacggcanaggcttttcctgcctatatcaacaaaggtg

SEQ ID NO: 45985 - DNA, 101 bp, rice(Oryza sativa)
  misc_feature (71): n=a or g
ccatgatgctctataagtctagaactactacaacatatataatttcatttttatatcgagcactactacancatacataattttcatttttatatcggcat

SEQ ID NO: 45986 - DNA, 101 bp, rice(Oryza sativa)
  misc_feature (71): n=a or g
aatcaacacttatgatttgtgttagaagctcagttccatccaatgcttttattgcagcctgagcttcctcnaaagtttcatactcaataagagcatatccc

SEQ ID NO: 45987 - DNA, 101 bp, rice(Oryza sativa)
  misc_feature (71): n=t or c
tcgccgtgagaatgccggtggcagcaagacaaacggggaagggcagagagggctctagactcgacgaggtngcgacgggagcgggagcttgaggaggcagc

SEQ ID NO: 45988 - DNA, 101 bp, rice(Oryza sativa)
  misc_feature (71): n=a or g
ttaggaatgggagtgtggttcacatgtcaacgagagaaatgaaacaggttggattggtccatcaatttttnaggtatgaagctaacctggatctagaggaa

SEQ ID NO: 45989 - DNA, 101 bp, rice(Oryza sativa)
  misc_feature (71): n=t or c
tcttaaaaaaatccaaggatttattgctggtccaagcatgcattaattaagaaaggtacactcatatgccngcgatgccgacttattggctataaagtttt

SEQ ID NO: 45990 - DNA, 101 bp, rice(Oryza sativa)
  misc_feature (71): n=t or g
cgcttgagacattttgactttagaaccctcgaagatttaggctgtgtttggcattagagcaagtatagtantaggctataagctggctaaattttgggtgg

SEQ ID NO: 45991 - DNA, 101 bp, rice(Oryza sativa)
  misc_feature (71): n=t or c
tctcttttgtttttccagaagatgtgataaacattcttgcaattccaattcatggtagctgggaagattgnttggcgtggcatccggatgaaagagggtgt

SEQ ID NO: 45992 - DNA, 101 bp, rice(Oryza sativa)
  misc_feature (71): n=a or g
tagatgttaagtacaatgattgattaatgtttgatagtaacagccatgagagacatcaaatgctcactctntcttaaaatataagcatttttaaaaataaa

SEQ ID NO: 45993 - DNA, 101 bp, rice(Oryza sativa)
  misc_feature (71): n=t or c
atgtatataatgcaaacaaatgaatttctgcacctctagggaagctatagattagcaaactaacctcattnggaaccacatcccacagcccatcactagct

SEQ ID NO: 45994 - DNA, 101 bp, rice(Oryza sativa)
  misc_feature (71): n=a or g
tattagttttgagtagggtttacaaaatcctttagtcattgaaaaccacatcctagctgttttattgatanccatgataaactgttgaaattatacgaaaa

SEQ ID NO: 45995 - DNA, 101 bp, rice(Oryza sativa)
  misc_feature (71): n=a or g
cacttaggggttcaccaacatcagtagcaacctttatagcctctagagcttgcaggcagccaatcactccnggaactgtaggtcaacaaagagtagttagt

SEQ ID NO: 45996 - DNA, 101 bp, rice(Oryza sativa)
  misc_feature (71): n=a or c
atcgagacttaaaagggaaaagaaagaaccaaatggctggtgtatgcgttgcctgttggtggacccacccnagcggaggtcctacgcccacgggtggcgac

SEQ ID NO: 45997 - DNA, 101 bp, rice(Oryza sativa)
  misc_feature (71): n=a or g
tactacacgtcctcagtcccacgtactgcgcaaccccccttccccccacaccaccaatgtatatccccacnacaccacatatattgattcacaagttaaat

SEQ ID NO: 45998 - DNA, 101 bp, rice(Oryza sativa)
  misc_feature (71): n=t or g
gtcctcgcggagacgaagcgttggcgcaacgatgcggtagcgagaaggcgaagtagtggtatggggggtgngggcgtggggcggcgcgggccgtagctggg

SEQ ID NO: 45999 - DNA, 101 bp, rice(Oryza sativa)
  misc_feature (71): n=t or c
tgccaaataatcttatctgaatctgattagatgtgtctacagataatcgctcacgtgctgtcctgaatagntgaacaattggattatttgtattgaacatt

SEQ ID NO: 46000 - DNA, 101 bp, rice(Oryza sativa)
  misc_feature (71): n=a or g
ctaactggaggtacataaaaggatagaaacaaagttatgttgggccaaatggtggaggctaaagtgattcntgtataataaacactttctaggatggtact

SEQ ID NO: 46001 - DNA, 101 bp, rice(Oryza sativa)
  misc_feature (71): n=a or g
gcgccgacaccctcaacccctcgtgatagctaagttgctgacacgaaggaggtcggcgccaaagagatttntgctaaggacctatttgtaaaataaatttt

SEQ ID NO: 46002 - DNA, 101 bp, rice(Oryza sativa)
  misc_feature (71): n=a or g
gattgataatacttgacggttggaggaaaacacgatataaaaatctcaacaaaattattattttattgaantactttttaaggcaaagctgtatatatcgt

SEQ ID NO: 46003 - DNA, 101 bp, rice(Oryza sativa)
  misc_feature (71): n=a or g
tgtccttcagttttacatgattcatttgaagcaggaagctctggaagaagatagatcttggcctatacatngaacatcaatacaaaattgcagtcattaca

SEQ ID NO: 46004 - DNA, 101 bp, rice(Oryza sativa)
  misc_feature (71): n=a or c
gtgaaccctatttaatagtgattgtctttggcttcgtgcaaaaacacctgcttcattctgtgatctttctntagtagaatcaaacacttgctaattcatag

SEQ ID NO: 46005 - DNA, 101 bp, rice(Oryza sativa)
  misc_feature (71): n=a or g
tcgtcgcctgatctcctcatttgtttttcacgccgccgtgtatgtcggggtggatgaaaggggaatgagtngatgtgccgatgggggtggtggtgcccgga

SEQ ID NO: 46006 - DNA, 101 bp, rice(Oryza sativa)
  misc_feature (71): n=t or c
tttggcccaatggtacacatctatgtagctttcatatctgcaacaaagcaattatatccttgtaacatccnggcctagggcttaataggattaatagaata

SEQ ID NO: 46007 - DNA, 101 bp, rice(Oryza sativa)
  misc_feature (71): n=t or c
atttatgtcataccaaccatccccattctctaatatgtgagttcactacgaggaatcaattatcaggtctncattgccatccctacttgcagcacaccaga

SEQ ID NO: 46008 - DNA, 101 bp, rice(Oryza sativa)
  misc_feature (71): n=t or c
tcccagcatcgcggaggtgtgtccctacatgtcagtgacgggtaggtgtcgctaccgtgtcgtggaaggtnattattggttgggatagcgtagcgtgcttg

SEQ ID NO: 46009 - DNA, 101 bp, rice(Oryza sativa)
  misc_feature (71): n=t or g
tacccaaagacatggcataaataaaatctgtcatctcactggcagatggcacaactgtcacagctcatccngaaaaagctcaagctctactagaatctttc

SEQ ID NO: 46010 - DNA, 101 bp, rice(Oryza sativa)
  misc_feature (71): n=t or c
ctacctagggattgcacatgtatatctctcgccatggatggtccctgccgagagctctaagtcctatgtantatccatatatacatgcattcatgcatcat

SEQ ID NO: 46011 - DNA, 101 bp, rice(Oryza sativa)
  misc_feature (71): n=a or g
ggcacccaaatcgccaacttgtaaaaatgtgcatacagtcatcggcaaaaaaaaagaagaagaaagagagnaaaaagagaaaaaactggatgtagggctat

SEQ ID NO: 46012 - DNA, 101 bp, rice(Oryza sativa)
  misc_feature (71): n=a or g
gagaaggttagtaatcttagatggaatgtggatttttcatcctttgagaacatcccgtcgtttcgtacatnttactaaaaaaatcataggaaaaattgata

SEQ ID NO: 46013 - DNA, 101 bp, rice(Oryza sativa)
  misc_feature (71): n=a or g
gcatttttcatgtgatcgaatattatccgtatggttaatataataaagttaatgttaggaagagcagccanccaaccacgacacgccactcctcgcccttg

SEQ ID NO: 46014 - DNA, 101 bp, rice(Oryza sativa)
  misc_feature (71): n=t or c
taccactattttttcaattttgcaaagatgtcacacgaatgatagtactaatggtattttttgtaattttntagtgataattttacaataacgattcaaaa

SEQ ID NO: 46015 - DNA, 101 bp, rice(Oryza sativa)
  misc_feature (71): n=a or g
ggtccgtgctgagactcgtagtcaacatgaggctcatgtttcactatttccgtgcctatctttttgtttcnttgatgttgagaaaaaaaaggacatacttc

SEQ ID NO: 46016 - DNA, 101 bp, rice(Oryza sativa)
  misc_feature (71): n=t or g
aggatctgaagacgcttggcgatcatccaagattcgaagcgtcgagatgatcgatcatgagaaagaaacgnacgcgagatatgatcgatacggggatcgat

SEQ ID NO: 46017 - DNA, 101 bp, rice(Oryza sativa)
  misc_feature (71): n=a or g
tcacttggttggagtagacgagtgatcggcgatttacgaggcaaaaccgagggcgacatggtctccggcgntgcggcggcggtggaacctggagacggcgc

SEQ ID NO: 46018 - DNA, 101 bp, rice(Oryza sativa)
  misc_feature (71): n=a or g
acttgctgggaaccatgcaagggcttgagaagtggattccaagtgttgatgcgggaatcaaggatctgcgnagcacggtggaaggaattgccgctcgcgtg

SEQ ID NO: 46019 - DNA, 101 bp, rice(Oryza sativa)
  misc_feature (71): n=a or g
gtcttacaaacatcgtttgaaggatagatactataatcttgatgtgagaactctgaatgaaataccagaanatgtcccaaaaggtgttaatgcaattcaat

SEQ ID NO: 46020 - DNA, 101 bp, rice(Oryza sativa)
  misc_feature (71): n=a or g
ctgctcgtcggtggttgggcgcagatggacaaggcgtcgatcatcaaggacgcgatcgagtacatccagcncctgcaggcggaggagcagcagatgctccg

SEQ ID NO: 46021 - DNA, 101 bp, rice(Oryza sativa)
  misc_feature (71): n=a or g
gccttttactaattagtggtttttattgaagggtgatgagatctatgatgccaccatgaaccagactaatnttggagacaacaataataagttctatatca

SEQ ID NO: 46022 - DNA, 101 bp, rice(Oryza sativa)
  misc_feature (71): n=a or g
ctgttgctcctgctgtatgtagcccctgcaactgggtcatgttaaaagggggaaaaaaggaaatggcaatnagggatcagtcctgtcctaaacagatactc

SEQ ID NO: 46023 - DNA, 101 bp, rice(Oryza sativa)
  misc_feature (71): n=t or c
aggctgcctctggccttttcggtggtccaacagaggtatgtgtttgtgtatgctagccttggtattctganttatgagttgcaaatgagaatatatttttc

SEQ ID NO: 46024 - DNA, 101 bp, rice(Oryza sativa)
  misc_feature (71): n=a or g
caaattctatagttcaacatataaattttctgctgagctcaacacctataaggtatgttcaagacttctantggagtaacatccctgtctacgtttcctga

SEQ ID NO: 46025 - DNA, 101 bp, rice(Oryza sativa)
  misc_feature (71): n=t or g
aagaaaaggaaaagggttgcaaggagagaaggaattacctatgggccaatagatgagagagataggaaaanatttgattatctcaatgacaagatttggaa

SEQ ID NO: 46026 - DNA, 101 bp, rice(Oryza sativa)
  misc_feature (71): n=t or g
tcgtatgatctgggattcaaagcaacactatatgatgaacatcacaattagccaggcaaaactgccgcccntggagcgtctcaagtatctaatttcctcaa

SEQ ID NO: 46027 - DNA, 101 bp, rice(Oryza sativa)
  misc_feature (71): n=a or g
aatcaatgtgaatgatgttagggaatcaattaaaaaggaatcactttatctctttctctctctctttagantacggtgtggagacatagtgaaaagacatg

SEQ ID NO: 46028 - DNA, 101 bp, rice(Oryza sativa)
  misc_feature (71): n=a or g
aaggtacttgtgttttgtctggatcatcgtcatatcagcaacaaagtctgccgaccaagaggactaggttngttgtggtttgcgacttgaatatttacgga

SEQ ID NO: 46029 - DNA, 101 bp, rice(Oryza sativa)
  misc_feature (71): n=a or g
ctgcagtttgcatgcgaaattctcatcccaggtgaaggacacaggtcaactttggtcaggaatttcacacnggatcagagctgtattgcatttcatcgtca

SEQ ID NO: 46030 - DNA, 101 bp, rice(Oryza sativa)
  misc_feature (71): n=t or c
ttctttggagcacgtcaagctccacttggcgcggcccatttttccgctagcgcgaaatagaaggagtattnccgtatttagggcctgttttaaaacctcca

SEQ ID NO: 46031 - DNA, 101 bp, rice(Oryza sativa)
  misc_feature (71): n=t or c
gcgatagtattatggatgcagctagtgggaagcaaatcctcttaactacttatgtggactctacttcactntaactgatcatatatgatgattggctcaac

SEQ ID NO: 46032 - DNA, 101 bp, rice(Oryza sativa)
  misc_feature (71): n=a or g
atgaccccgaggatgaatcagaggagtaatctggaaggaattaaggaagcaatgaagcactaggcgaccancctacggggatctccaacaatgtgaagcct

SEQ ID NO: 46033 - DNA, 101 bp, rice(Oryza sativa)
  misc_feature (71): n=a or g
ccatgcacgagcgcacgcaaagagggagaaggtcgaggggcggtggccatagggtgtcgtgatgtacctcntcgcgatgcggggtagttgttgtcgccgct

SEQ ID NO: 46034 - DNA, 101 bp, rice(Oryza sativa)
  misc_feature (71): n=a or g
tatgatctttagagtcgtcataaaataccatgaataccatgaacatgaattggctcatttaacaaatcgtncatactaaataaatttcaatgttgttgaat

SEQ ID NO: 46035 - DNA, 101 bp, rice(Oryza sativa)
  misc_feature (71): n=a or g
ggagtagttatcaagtgtcatgttggcaaaacggcgaagtagggagaggaaggagaaagagagtgatgggntaggccccaaatagagggaacggaggacag

SEQ ID NO: 46036 - DNA, 101 bp, rice(Oryza sativa)
  misc_feature (71): n=t or g
agatagtaccgtacagtagaggttgtctgaaactctgaataatacgctcgtgatagctaatactcgtccgnattggtaatacttattattttaaacaagaa

SEQ ID NO: 46037 - DNA, 101 bp, rice(Oryza sativa)
  misc_feature (71): n=t or c
cttttttaaaaaattgatgactggactgtcacgtgtgctatttgaagcctaatccactcgcaactgtgctnagggggtgttttgtccggtattaaaagttc

SEQ ID NO: 46038 - DNA, 101 bp, rice(Oryza sativa)
  misc_feature (71): n=t or c
atgacttcgaatggagacaaactttatatgaaaattatatgaaaagtattatcactgatggagaaatgatntttgctgggtcgacccaaaacgacaataat

SEQ ID NO: 46039 - DNA, 101 bp, rice(Oryza sativa)
  misc_feature (71): n=t or c
gaaattatccgaatcactttcaaccctcgcgcgcacccctctcgcggttgagcgagttttccatctttttncccttttttcgtttctgttcggtttgcctt

SEQ ID NO: 46040 - DNA, 101 bp, rice(Oryza sativa)
  misc_feature (71): n=a or g
taagtatattagtaaattttttttcatcattgctcctctgtccatgaagagtattgtagcgtgcttgccgntatgtaaggcaataggtataatttttggta

SEQ ID NO: 46041 - DNA, 101 bp, rice(Oryza sativa)
  misc_feature (71): n=t or c
atcgttcggaaagggcccacctatcccgtaccgaataagaagagaagagataaaatttgctcgtgtgacanaaacaatttttttctttttaccaaatcacc

SEQ ID NO: 46042 - DNA, 101 bp, rice(Oryza sativa)
  misc_feature (71): n=t or c
cattataatagttgatgaacatagaatgttctcttcatgcagacgatgttgacatcaccggacctaaatantgtgaacaacaggctgagaccttctagagg

SEQ ID NO: 46043 - DNA, 101 bp, rice(Oryza sativa)
  misc_feature (71): n=t or g
atcacatttatagttctacaaagaggctgaatatgaaaaccaccccctgatttcctacttgtacttatgcngttttctagattgaaaagaattagttttgg

SEQ ID NO: 46044 - DNA, 101 bp, rice(Oryza sativa)
  misc_feature (71): n=t or c
tgtcacgatgaaattattgtctagcttaattcaccgatcgatcatacgatattacatagactgacacacanggtcacgcgaaaaaaaaaaagagatttgct

SEQ ID NO: 46045 - DNA, 101 bp, rice(Oryza sativa)
  misc_feature (71): n=t or c
tctgtcggggtcttactatttttttttcccgacgaagtaataatatacgtaaacacggcgacaacggtggnggcatctcgggatcatccgtcctcgccttc

SEQ ID NO: 46046 - DNA, 101 bp, rice(Oryza sativa)
  misc_feature (71): n=t or g
acagtggcgaaactacggttaacctagcttgagtcccataatagaaaatgtccatacagtggcagatctanaaatttgtgtgagcctaggcaaacctaatt

SEQ ID NO: 46047 - DNA, 101 bp, rice(Oryza sativa)
  misc_feature (71): n=a or g
ttatatacataacatttttaaatatggtccttaaaaggaaagagtgcacgaccccaaatttaaaccgcttngaaataattccacttgacgtccctcatatt

SEQ ID NO: 46048 - DNA, 101 bp, rice(Oryza sativa)
  misc_feature (71): n=a or g
tgagagatagaaactagagagagagagtagttaatttctatcaaatcctttcacgggccgtttggttaggnggagtttttaggagggattaggagtttagt

SEQ ID NO: 46049 - DNA, 101 bp, rice(Oryza sativa)
  misc_feature (71): n=a or c
cagcaaccaaagcagaacaggagagaacgggccagggccacattaactgaattaattgaatgcaactatgnaaggagactttttacatgggcgacattgca

SEQ ID NO: 46050 - DNA, 101 bp, rice(Oryza sativa)
  misc_feature (71): n=t or c
agcttttcttttttttccagaattttctttccggagacgcgttcatctaaactaactaatccggttagtgntagataatgacgataattaaggtaagattt

SEQ ID NO: 46051 - DNA, 101 bp, rice(Oryza sativa)
  misc_feature (71): n=t or c
ccgaatcctctctaccctaaagccctaattcaatcgcccgatcaattttatcactggaaaggattcgtgangtatgtcgcaagaagaaaaagaaaagagaa

SEQ ID NO: 46052 - DNA, 101 bp, rice(Oryza sativa)
  misc_feature (71): n=t or c
cttaaatttgcggtttgcagactcctacgaatgaaaaaaactccataggagactttaagggctcctttgantcaaaggaattatgaaagaattttatagga

SEQ ID NO: 46053 - DNA, 101 bp, rice(Oryza sativa)
  misc_feature (71): n=t or c
aagctcttgcagcgcattatgggagatggcaagctggtcaccatcacgaaggcgtgtgatgaagttcttcngcctacgagctctggcgtgcatgtggaaga

SEQ ID NO: 46054 - DNA, 101 bp, rice(Oryza sativa)
  misc_feature (71): n=a or g
ccgcctgccctagtgcctcagccacaaatgccgccagatcataataaagcagggccatcaaggtggtgacnagcttcgccgccaggtcagaatgaagcaag

SEQ ID NO: 46055 - DNA, 101 bp, rice(Oryza sativa)
  misc_feature (71): n=a or g
ggtgcgtacgaccgccaccaccaccgcggtttatccgttagagcagtttaataatataagccaactactanctttattaatataattaacacatcatctat

SEQ ID NO: 46056 - DNA, 101 bp, rice(Oryza sativa)
  misc_feature (71): n=t or c
gaaatttgaagaaaaaagttggaatctaaacagggtcttagaactgctggttcacatctcctatttctcgntttttgtgcacacgatttttaaactgttaa

SEQ ID NO: 46057 - DNA, 101 bp, rice(Oryza sativa)
  misc_feature (71): n=a or c
gccggactcttttccatttcattggattattgcagcggccgattaatggctccgagcttttacggtgtttntaaggtacttcgaaatactaagagatagga

SEQ ID NO: 46058 - DNA, 101 bp, rice(Oryza sativa)
  misc_feature (71): n=a or g
ctaccagtactcgcatttgcagatttgctagtatgctgtacctctagcacaaataccactcttactaaggncatgttaagttccccaaaaagaaaattttt

SEQ ID NO: 46059 - DNA, 101 bp, rice(Oryza sativa)
  misc_feature (71): n=a or c
gcttatggaacttgcattatacggccatcacactcaagctaacattggcaaagacaggatagcaaacctgnaattatttgttgacataatttgggaaaaga

SEQ ID NO: 46060 - DNA, 101 bp, rice(Oryza sativa)
  misc_feature (71): n=t or c
aaggagtaacttttttatcgtgttcgactacctccgtcctgaaaaaaaaagtcttcttgactacttcctcngtttctaaatatttgacgacgttgattttt

SEQ ID NO: 46061 - DNA, 101 bp, rice(Oryza sativa)
  misc_feature (71): n=a or g
ctggctttggaaaggccttgccgtgaaccttcctcatcaacgggaatgggaagtaagcttgcgtcgtgtgngtaaaacatacagcctctacagaggttacc

SEQ ID NO: 46062 - DNA, 101 bp, rice(Oryza sativa)
  misc_feature (71): n=t or c
ttttattattatatatgaaaataactcacaattgtctacttagttgtgtaaggagcatgtgaaaacaaaanaatgactctctcttgaacttctaacaatac

SEQ ID NO: 46063 - DNA, 101 bp, rice(Oryza sativa)
  misc_feature (71): n=t or c
gatgtcaaggttgttaaggagcatatttatctccttttaacaccgatggggagtcaatgtaaccctccctncgtggctacaatcttcctacagttgttgtc

SEQ ID NO: 46064 - DNA, 101 bp, rice(Oryza sativa)
  misc_feature (71): n=t or c
taggctatatatatacacctgtcgatggctagctgagatgacaactggccaacaaaaaaatcatacgatanattatgaatatttttgtttgtggagcgttc

SEQ ID NO: 46065 - DNA, 101 bp, rice(Oryza sativa)
  misc_feature (71): n=t or c
ccagtgttttgtccttggcatgtgagtgtgtttgtgtccctgcttattcaaagttcacatgcccacctaanctatcaagttagactgggatcccttggtcc

SEQ ID NO: 46066 - DNA, 101 bp, rice(Oryza sativa)
  misc_feature (71): n=a or g
atcgcatcttcttagcctggcccatctctctcgtccagaccgagtttagcctggccaagtagatacacatncagctgtttggttggttgtattggtttagc

SEQ ID NO: 46067 - DNA, 101 bp, rice(Oryza sativa)
  misc_feature (71): n=t or c
aaaatattaggtgaactagtaggtgggatcttgcatgtatgaatctaaaaaagaaaagaaaaaatgacctnggaccaaatagatggatcttcagaggctgg

SEQ ID NO: 46068 - DNA, 101 bp, rice(Oryza sativa)
  misc_feature (71): n=t or c
caatgttgtgccctgtggtgtttttgaaggggagacgccaagacgagaggacacgtctcgtcaatttttcngttttagacggtgtgtcggcgactcggcgt

SEQ ID NO: 46069 - DNA, 101 bp, rice(Oryza sativa)
  misc_feature (71): n=a or c
atctagtggtatcagctgattcctaggtatcagataggacttctgaggtattatcccgttcgaacggagtnctgtcacgtagcattaaaaatacgatgttt

SEQ ID NO: 46070 - DNA, 101 bp, rice(Oryza sativa)
  misc_feature (71): n=a or c
agagcagatgactttctacatatcaacagcagcatttggcttggccaatagttgcaagaaactagaaagancggcaaattgtaggcttgggcgacactggc

SEQ ID NO: 46071 - DNA, 101 bp, rice(Oryza sativa)
  misc_feature (71): n=t or c
acacgttcgacgcattcatcatggcaacaaccttagcattcatctgctcctcgattgccacccttgatctnatgtactccgggatctccatggtcaacctg

SEQ ID NO: 46072 - DNA, 101 bp, rice(Oryza sativa)
  misc_feature (71): n=t or c
ggttttacggttacaggagacgattcaaccaggagcaaagagataaaggaaggtaaaatggacttattccncaatagaatccatccaaataagaataggtg

SEQ ID NO: 46073 - DNA, 101 bp, rice(Oryza sativa)
  misc_feature (71): n=a or g
tagctgccagccgctgtaggtgggccctctccatcttactctgttcctctcttgcatttcatgcatattangcctggtttagttcctattttttttcaaaa

SEQ ID NO: 46074 - DNA, 101 bp, rice(Oryza sativa)
  misc_feature (71): n=a or c
agtatacatataattatgcagcccaaagacatcaaaatggccataaagccaagcaccacagatcaaaatcntctgcagttaaagtcatgtgacgttatcat

SEQ ID NO: 46075 - DNA, 101 bp, rice(Oryza sativa)
  misc_feature (71): n=t or c
agctactagctgagcttattggcggccgtacctctcctaatcgacgcgcatgcatcttaataaactactcnctcctgtatgacgtcgttgacttttttata

SEQ ID NO: 46076 - DNA, 101 bp, rice(Oryza sativa)
  misc_feature (71): n=t or c
gtagaatttggagttaacaccttaacctttgcaattaaggtgacacatgatgtacgtgccttatggtttanaatattgcaccgttatctttcagtttccac

SEQ ID NO: 46077 - DNA, 101 bp, rice(Oryza sativa)
  misc_feature (71): n=t or g
gtgaggagcgcatctgattgttcgatgcgatagcgggatagctttcgttttcttgtttatccggtgtcgcntcaggttccgcccgttggggaatttcgtgg

SEQ ID NO: 46078 - DNA, 101 bp, rice(Oryza sativa)
  misc_feature (71): n=t or g
ccccatcgccaaggacctgggcgtccagtgccacgtgctgtacgtctcctccgcggccatgatgtccctcngctcctacttccctatctacctcgacaaca

SEQ ID NO: 46079 - DNA, 101 bp, rice(Oryza sativa)
  misc_feature (71): n=a or g
cacctctcccccaccccaaatcatcctcaccattctctggagtagtttagactgcttcaacacacaccaanccaagccaagccaaagccaatctagccgtg

SEQ ID NO: 46080 - DNA, 101 bp, rice(Oryza sativa)
  misc_feature (71): n=t or c
aatttgttgtttggtagcactataggagaattctgagagacaaggagagaaaacataagatcttgcctctnggtaaatttcttccaaaattcctaggaatt

SEQ ID NO: 46081 - DNA, 101 bp, rice(Oryza sativa)
  misc_feature (71): n=t or c
aagaaaaaaaaggatgaaagctagattcaatctacataatgcagcagaaaacggtgggaaataaaagcggnaggggttgttacctttgggaccgcactcga

SEQ ID NO: 46082 - DNA, 101 bp, rice(Oryza sativa)
  misc_feature (71): n=t or c
tgtcgttatggatgtcccttgatttatggacatcatccatatgggcccttgatgccgctaaggtcggctcngtcgccatgaagcgtgggctcatagtgggg

SEQ ID NO: 46083 - DNA, 101 bp, rice(Oryza sativa)
  misc_feature (71): n=a or g
ctttcaagagaatctcaagatcatcgataacaggctccaagctagaatacatcaatatcattgccaggttnttttgattcttggattaccaagcacatcaa

SEQ ID NO: 46084 - DNA, 101 bp, rice(Oryza sativa)
  misc_feature (71): n=t or g
ttagttccaagcatatttagtagtgtaattagcaaaaatattaactatacggcaatgttatcagtatcccnatacgtattctagtatcttacgatactacg

SEQ ID NO: 46085 - DNA, 101 bp, rice(Oryza sativa)
  misc_feature (71): n=a or g
gagcaatacgaggtgcattgctaggattggcaatagttgggcaacctgatgctggcaacacttgctgcggntgctgacgaaggagcatactgcctctttgt

SEQ ID NO: 46086 - DNA, 101 bp, rice(Oryza sativa)
  misc_feature (71): n=t or c
taagaattttaaagaaataagtattgccccttgaaaggaacaaagggttgtttcctactggaaacaaatcntttagaatttctatgttttttctttgtttc

SEQ ID NO: 46087 - DNA, 101 bp, rice(Oryza sativa)
  misc_feature (71): n=t or c
gtttatgtgtgcaagtccaagaagctggacaagatgggagcttgtcggcccaaggaaacgcaaagtaaggncgggtccacagtcagtccatcctacccgtt

SEQ ID NO: 46088 - DNA, 101 bp, rice(Oryza sativa)
  misc_feature (71): n=a or g
gccgccgtcagaggagcagtagcagtaatgttaggccctgttcagatgtcatcctaaaatttttcaccatntcatatcgaacatttgaacacttattaaag

SEQ ID NO: 46089 - DNA, 101 bp, rice(Oryza sativa)
  misc_feature (71): n=a or c
atatttggaactaataaatacttgacgaacatatcttctcttctaagtctacatttatggcttccactgtncacatctatgtatttgtgaattatattata

SEQ ID NO: 46090 - DNA, 101 bp, rice(Oryza sativa)
  misc_feature (71): n=a or g
gagccggccacaggaaggggcggattggcggcggcttcaatggaggaggaaggaaggaaggagcgagagangaacggtcggccagaggaggaagacgaccg

SEQ ID NO: 46091 - DNA, 101 bp, rice(Oryza sativa)
  misc_feature (71): n=a or g
cacgtgatggccagagttgttcaacaacgcgttcacaattccgggtggtgcataactgtaacagaaaaaangatttacattttgaagtgaaaatcatttta

SEQ ID NO: 46092 - DNA, 101 bp, rice(Oryza sativa)
  misc_feature (71): n=a or c
tgtcatttatgcccttgcttatttgacactactttctcacaggttctgttcatttggttcaattttgtgcncttactgtgtagtataaaatttgtaatgaa

SEQ ID NO: 46093 - DNA, 101 bp, rice(Oryza sativa)
  misc_feature (71): n=a or g
ggatctgaaggaaggatactggtggcccaacatgaaaagagacatagcagaatatgtagcactttgcgacntatgccagaaggtgaaggctgagcaccagc

SEQ ID NO: 46094 - DNA, 101 bp, rice(Oryza sativa)
  misc_feature (71): n=t or c
ccatctctaaccacctttagctgcaactatggctccgctacaggtttaaacgcacaatacaccaacattanaagtttacaacacaatcacatgactatata

SEQ ID NO: 46095 - DNA, 101 bp, rice(Oryza sativa)
  misc_feature (71): n=t or c
gttttttatcaaaattaaatacttctatagtcttaacatccacaaatagagttattgatgagagctttaanattgttgcactaagttttgctatatgaaaa

SEQ ID NO: 46096 - DNA, 101 bp, rice(Oryza sativa)
  misc_feature (71): n=t or c
ggttgtttctcgtctagtttagtagctacaaaaataaggaatgggagggcactgttctctacatgtgaganggaggaggaggtggaaggattttagtgaaa

SEQ ID NO: 46097 - DNA, 101 bp, rice(Oryza sativa)
  misc_feature (71): n=t or c
aatatggcccgattgagatgactttaaagcccgtcaccgatgattcatatcggtatcgggcttttgttgangcccgttagagataacttttacttaggtca

SEQ ID NO: 46098 - DNA, 101 bp, rice(Oryza sativa)
  misc_feature (71): n=a or g
aggctcacgccagagaaaggtagctgcaaattaaggcgatggatggctaagaggagaagacatgggcaagnccacgccaggctgctgcctgacaacacgaa

SEQ ID NO: 46099 - DNA, 101 bp, rice(Oryza sativa)
  misc_feature (71): n=a or g
aggtattctccgttttgaccccggtgacctaatccttccgttcttgctgttccaaggagttctttgtgccntcaagccgccctctggttcttccatccgtc

SEQ ID NO: 46100 - DNA, 101 bp, rice(Oryza sativa)
  misc_feature (71): n=a or g
agtagaacaagatgaaccagccccactgtacagtatgcaaacgaactgccattttatcatgcccaatcctncatatagatcatattggctagctaaaagcg

SEQ ID NO: 46101 - DNA, 101 bp, rice(Oryza sativa)
  misc_feature (71): n=t or c
ttttaaaggaactttgcacccccaaatctctgttatctctttgtccacaacacccccaaactttaacaacntatacatagatttagtagtgaacttcttat

SEQ ID NO: 46102 - DNA, 101 bp, rice(Oryza sativa)
  misc_feature (71): n=a or c
ctgccaacacatcctagtgagctccataagtaccaaatgttgtgaagaaccggccgaatgtacttcttaancgacatatatgagccttccaatgcacccta

SEQ ID NO: 46103 - DNA, 101 bp, rice(Oryza sativa)
  misc_feature (71): n=t or c
gaagtctgctcttgttactgtactcgttgttcttcttttgattacaagttccactgctctggcaaggaagntggctgcagatgatggacagcagaaagccg

SEQ ID NO: 46104 - DNA, 101 bp, rice(Oryza sativa)
  misc_feature (71): n=a or g
ctcgcggatggctggctccctcgcctcccttctcttttcctccactatggctgaccaccagagccacctcntcaccgacctcccaccgttgcctcgtgcgg

SEQ ID NO: 46105 - DNA, 101 bp, rice(Oryza sativa)
  misc_feature (71): n=t or c
gcgtcgtcgtgtgctcgctcgtgtagtcgtgcgcctagacgtggccaggattttaatctttttttccgttngctttgtccatctcctcctctcccgtgcat

SEQ ID NO: 46106 - DNA, 101 bp, rice(Oryza sativa)
  misc_feature (71): n=t or g
tagtggtatggttttttcttgtcattcctccgttgcatatttctgacgtcagttgtaacacgacaacctcnattcaactctgacaatgtgtaattgagttg

SEQ ID NO: 46107 - DNA, 101 bp, rice(Oryza sativa)
  misc_feature (71): n=t or c
aggacatgcatgcagcatttaatttcgtcgtgtcgttaataatagcgagagcaacccacgtacatgtatgnaaccaagtagcttacggtcgaagttttatt

SEQ ID NO: 46108 - DNA, 101 bp, rice(Oryza sativa)
  misc_feature (71): n=t or c
atatatgatatatctctctactcttttatgttcgttactcacttttcccaactcctactcttttttgacgngcacggttcttgaactcttaaatagtattc

SEQ ID NO: 46109 - DNA, 101 bp, rice(Oryza sativa)
  misc_feature (71): n=t or c
cataatttatttatttgtactgccctttttgagttcatgtttcgagccttagcacgcttctgagttctgtnttcaatcacaccgtggcacatgatgtatca

SEQ ID NO: 46110 - DNA, 101 bp, rice(Oryza sativa)
  misc_feature (71): n=t or c
tacagaatttgaaccataacagccgccatgatgatatataactctggttattgttcactttacaacagtanaaaaaatgatggactttctcggacaacaat

SEQ ID NO: 46111 - DNA, 101 bp, rice(Oryza sativa)
  misc_feature (71): n=a or c
tcatacagttcatacacaattgagggagcaacaatagcaacaggcatggctagctacatgcagtcatcaangacagctagctagctccagggagccattcc

SEQ ID NO: 46112 - DNA, 101 bp, rice(Oryza sativa)
  misc_feature (71): n=t or g
atcagcatgaattcttggaggtttatcagctgtgctagggaagttacccaagcttggggtagatgaggtantttttttgcttggggaagctatagatttat

SEQ ID NO: 46113 - DNA, 101 bp, rice(Oryza sativa)
  misc_feature (71): n=a or g
ctctgtggactaaatgtatctatctactaccttgtatgtatactgtatggaccagcccacaaaacacacancactacattatattcagagtttcagacaac

SEQ ID NO: 46114 - DNA, 101 bp, rice(Oryza sativa)
  misc_feature (71): n=a or g
ggattttatcacatgcactgacattctcttggacctctgttcttcctgcttgtaggccggaagttccggtnttcttggcccggaacttccggtctctgtcc

SEQ ID NO: 46115 - DNA, 101 bp, rice(Oryza sativa)
  misc_feature (71): n=a or c
tacaccatttatgctcaattacgccatttacggtcgaaaggtagtctacgcgtacaggtgaatgggttacntatcaattacgcctacgtgaggaaaccata

SEQ ID NO: 46116 - DNA, 101 bp, rice(Oryza sativa)
  misc_feature (71): n=t or g
cggtgactatggtttatgtgtgttgcaccatcatccaactagggctatccagattagcctcttactagatnccaccccatctatattttaaaattacatct

SEQ ID NO: 46117 - DNA, 101 bp, rice(Oryza sativa)
  misc_feature (71): n=a or g
gcggtgacggcaggcgtacggcgcggagatggcagcgacagccatccataccccttccgtctcctcgtcgncgggggtatggcgcgaagacagtgacgacg

SEQ ID NO: 46118 - DNA, 101 bp, rice(Oryza sativa)
  misc_feature (71): n=t or c
ggagggagtatatatgcttattaaatgtgcaccaacactgatcgatttattacttaggctgtgtttagttnccttcaaactttcaacttttccgtcacatt

SEQ ID NO: 46119 - DNA, 101 bp, rice(Oryza sativa)
  misc_feature (71): n=a or g
tgtccttttcagcgagtagttgtacaactgagatataatccttctcaatggcaagaggcaacaatatcccngcactaccatcgatttttagaagcattttt

SEQ ID NO: 46120 - DNA, 101 bp, rice(Oryza sativa)
  misc_feature (71): n=t or c
agcgtgtggaattcgatggcggaggagacggagatggaggctggagcaacgggagagggggaaggacatgnagacgacgacgacgacgacatggaggtggc

SEQ ID NO: 46121 - DNA, 101 bp, rice(Oryza sativa)
  misc_feature (71): n=a or g
ttcgcttgcacaatttgtgctcggtccagttcatccttagaaaaatttgagatgggggcccctaagtctanacgccaattatgatactagatctattttct

SEQ ID NO: 46122 - DNA, 101 bp, rice(Oryza sativa)
  misc_feature (71): n=t or c
ccatgctatatcatggcttgggctattagtatcatgcaacgtcaaagacaaagacaggttggtgactgttngaaatccttttgttcttttatgtatccgca

SEQ ID NO: 46123 - DNA, 101 bp, rice(Oryza sativa)
  misc_feature (71): n=a or g
tctgtacagctatctaagaaagtacatacatatttaagcaagcatatttaagcaagccatggaatgcttcngataaatttcaagtaaattgcatgatccac

SEQ ID NO: 46124 - DNA, 101 bp, rice(Oryza sativa)
  misc_feature (71): n=a or g
tgcgctattaaaaatatcatgatgtccgtaaaagattgggatctcgcaagcactcttgagggttagcatanaagtagtcctcttccttcggtttgtcatga

SEQ ID NO: 46125 - DNA, 101 bp, rice(Oryza sativa)
  misc_feature (71): n=a or g
atcaaggaagaaatttgaattatcaatatcagcctctgtcacctcatgtttagtatcagcaggcaggatcncctcaacctcagtttgctcctcagttcaat

SEQ ID NO: 46126 - DNA, 101 bp, rice(Oryza sativa)
  misc_feature (71): n=a or g
cacgggcgctaatgatttttatgctgtctcgctgaattcaaacaacgctgaccttgtatgaacttgtgctncagatcttcctggacccaaaggagcgcaac

SEQ ID NO: 46127 - DNA, 101 bp, rice(Oryza sativa)
  misc_feature (71): n=a or g
gtgatcttgttccaaccaaacttggcaccagggagcacaacatctgttggggagtcaaagctttcccacancactacatttgttgtgctttctatcacaag

SEQ ID NO: 46128 - DNA, 101 bp, rice(Oryza sativa)
  misc_feature (71): n=t or c
tgacagttttctaagcgtagttgagcagggagcagattgggacagtagtgcgacatcgcttacgtcgcttngcttcattcccagttcggtcggtcggtcgc

SEQ ID NO: 46129 - DNA, 101 bp, rice(Oryza sativa)
  misc_feature (71): n=a or c
cattatcagcacaggtggcacttggtggttcatacaactatggctaaacttgcacactgttaaggttttcnaaagatcagcattgaatcaagcaagtttcc

SEQ ID NO: 46130 - DNA, 101 bp, rice(Oryza sativa)
  misc_feature (71): n=t or c
agcgaccccgccgccgccgcacttcttgctcttcttgttccggttcttcgccatggctagtcctagggttnggaggcttcggctcggtggtggtcgtctcc

SEQ ID NO: 46131 - DNA, 101 bp, rice(Oryza sativa)
  misc_feature (71): n=t or g
gctaccgagagtgcaacagaaatacatggtatttgaagataacaaacttagaagcatacatgcatgcttgncaatcttaatttttgaagagctgcaaggca

SEQ ID NO: 46132 - DNA, 101 bp, rice(Oryza sativa)
  misc_feature (71): n=t or c
gctgtaccaaacagttcataatactctcgcactatttcccccaataagaaatgcttatcacttattccctngctctgaacaaacaggtcaatcactgatta

SEQ ID NO: 46133 - DNA, 101 bp, rice(Oryza sativa)
  misc_feature (71): n=a or c
attgctttaatgacgcatttggttaatgttccgttagaacattggattaccaggtacctcaagttattttntttacataaaaatgaaactaggatttatga

SEQ ID NO: 46134 - DNA, 101 bp, rice(Oryza sativa)
  misc_feature (71): n=a or g
tacggtctccagtgtcgaacagcttgcactagtccgatgagctcccgttcatatgccgccagtgcttggtntcgagcggcgaccggccgactgaagtacgc

SEQ ID NO: 46135 - DNA, 101 bp, rice(Oryza sativa)
  misc_feature (71): n=a or c
tttttgaggtagaagtgaatccgacattttttatttgatgcttacgtggaagactgtggtgcaagataganaatatttaatgctaattagtaggctgcgat

SEQ ID NO: 46136 - DNA, 101 bp, rice(Oryza sativa)
  misc_feature (71): n=a or c
ccaacagacttcttctttttaggatggttagggcacttaggtttattgtaatcctcatgttcctgttgacntaatgaacacctattttgcatcggtgtggc

SEQ ID NO: 46137 - DNA, 101 bp, rice(Oryza sativa)
  misc_feature (71): n=a or g
ttagttcgaattagtatcagtacctccagtattgaaaaggcacgaatgtcgtattcaccaaaaccttccancagtgaattcacattgggatgatgtggaat

SEQ ID NO: 46138 - DNA, 101 bp, rice(Oryza sativa)
  misc_feature (71): n=t or c
tgtggtagaactagccgcacacaccaaaggatatgtgaaaatcgctatttttgtatatgggtgcttatgtngtctgtacacaaaaataaaaaataaaaaat

SEQ ID NO: 46139 - DNA, 101 bp, rice(Oryza sativa)
  misc_feature (71): n=t or c
gaacagttgatatcaaaccaaacaatgtcattccatatcatcgtccaacgccaagttgccaagtcgttgtnctcatcgatatctgccgcccgcgtgcaaag

SEQ ID NO: 46140 - DNA, 101 bp, rice(Oryza sativa)
  misc_feature (71): n=t or c
gttgtaccctcctacccccagccttaaccgcctagctctagctttgttatcgatgtatgctactctttttntaatatattgacatataaagcttttacgtg

SEQ ID NO: 46141 - DNA, 101 bp, rice(Oryza sativa)
  misc_feature (71): n=t or c
cgccgtagtggagtactggaggaggcacgtccaaacgaacgaaccattattattcctttaaccgctcacgngcgcgcgcaaccccttcgtttccccacgcg

SEQ ID NO: 46142 - DNA, 101 bp, rice(Oryza sativa)
  misc_feature (71): n=a or g
ggcaatgagtgacacggctcctaatgatgctactgttcatgttcaggatgcagcggcgacaacttatggtntagcttctgttggtgctcaaactggtatac

SEQ ID NO: 46143 - DNA, 101 bp, rice(Oryza sativa)
  misc_feature (71): n=t or c
aatctcttcagaggtggtggcttatgaaaaccacctggaaaacgaagtgagatcacatatcagtgagaatncacatttgtacgggtcaactttatcattga

SEQ ID NO: 46144 - DNA, 101 bp, rice(Oryza sativa)
  misc_feature (71): n=t or c
gctagtggtataatttcactttgattctctaaactggttgtcggatccggttcgtatccctaaactataanatcggatattttgactcctcctcaattatt

SEQ ID NO: 46145 - DNA, 101 bp, rice(Oryza sativa)
  misc_feature (71): n=a or g
gtcgcgtgttgtaatctattacagtctactcccttgctaaggaaaaaacccgcttatttcatacacgaatntggacatagatatcttatgttcatatatat

SEQ ID NO: 46146 - DNA, 101 bp, rice(Oryza sativa)
  misc_feature (71): n=a or c
gcatcttggtgttggaaatttgggtcgatttggcttcgatatacctctagtgatctccgttcaatggcgtnctggaggcattggctcactctgtggcgctc

SEQ ID NO: 46147 - DNA, 101 bp, rice(Oryza sativa)
  misc_feature (71): n=a or g
ttcattttcacatattaatctgcacatgtgtacccttggatatacatcaattaagattccttgcagtactncatgtgcagtactgctcactgacatatggg

SEQ ID NO: 46148 - DNA, 101 bp, rice(Oryza sativa)
  misc_feature (71): n=t or g
cttcatgcacctactacaagcactgccatcatcacaagacgccaaactgtagcctgtagagcgatgagctnaagacttcaaattctgtttgtgtagaaaag

SEQ ID NO: 46149 - DNA, 101 bp, rice(Oryza sativa)
  misc_feature (71): n=t or c
acggtttcccgtggatttgcgctaccaggacgcgtcaggttacaaaggggctttgttaggctatgttcttnctagttttcctaactcacatctatcgtttt

SEQ ID NO: 46150 - DNA, 101 bp, rice(Oryza sativa)
  misc_feature (71): n=a or g
tcgaaatgatgtttctgttgaattttctaaggaaagtctttagcaagtatcctctacgtggtttaagccancaccagtaaagttaggttgaacattgtcga

SEQ ID NO: 46151 - DNA, 101 bp, rice(Oryza sativa)
  misc_feature (71): n=t or g
acaaaacaaatgtatgttgactctattggttactgatcttgttacaggaatatgctctatagctgccagtnttatgtgtgtggaagcacaacataggctag

SEQ ID NO: 46152 - DNA, 101 bp, rice(Oryza sativa)
  misc_feature (71): n=a or g
gtagggtagactcatttttttggaaccgcagtagaaagggttttactgcaggaagaatgagatgttagcanactaagggcttgtttagtttccattttttt

SEQ ID NO: 46153 - DNA, 101 bp, rice(Oryza sativa)
  misc_feature (71): n=a or g
tataacagagaggagcaatgatcgatgagggttagatttttgtttaatggaccgggtgcgaaaattgattncgcaagaaagctatagaaactcaattttaa

SEQ ID NO: 46154 - DNA, 101 bp, rice(Oryza sativa)
  misc_feature (71): n=a or g
cgtttattcgtgcgatttttcacatcaacatttacgtccctctaactttaagttactgacacgtggacccnttgagtagaggatcatatatcagtgaccca

SEQ ID NO: 46155 - DNA, 101 bp, rice(Oryza sativa)
  misc_feature (71): n=t or c
cctgaacattctacaaaaccaaaattgtctcccgctacgtaaattacattgaaattttatcaatcaccagncttaaaaactaattaacttgacaagcactc

SEQ ID NO: 46156 - DNA, 101 bp, rice(Oryza sativa)
  misc_feature (71): n=a or g
tggcacgcaattaaataaaaattacaacccatctttattccatgctagagactcaagaaggcctcgcgtgngggggagtgcatgcaactcaataaatattc

SEQ ID NO: 46157 - DNA, 101 bp, rice(Oryza sativa)
  misc_feature (71): n=t or c
cactagaaaggtgcacggtgcatcgctacaggctacagccaagtagccaacagatagaatcattcaagtanaagcactcctacagaaacgggataggtgcg

SEQ ID NO: 46158 - DNA, 101 bp, rice(Oryza sativa)
  misc_feature (71): n=t or g
tccattcttggttaaattccaccagattttatcaggacacccctcaatcaagtgaacctccccacaagagntttttaaagtgttccagtccattttgtcac

SEQ ID NO: 46159 - DNA, 101 bp, rice(Oryza sativa)
  misc_feature (71): n=t or c
tcggaaagggcgaaactacattgcctttgattttggcccgaaatgcgacaataaggggcccttcgtgggcnggtatgctcctctcggattttggcctgtac

SEQ ID NO: 46160 - DNA, 101 bp, rice(Oryza sativa)
  misc_feature (71): n=t or c
gatttctatgcagattgacagggtcagcgaaaacaagtgggtccttgaaagatagccatccggagttagcncggcaaaccacggcgcagctgacgcatccc

SEQ ID NO: 46161 - DNA, 101 bp, rice(Oryza sativa)
  misc_feature (71): n=a or g
tggcgccggagcagtgtattacgcatctgtagatggtgtgtaggtcgcacgagcttgggatggatggatgnatgaattattacccctctgtacttctcaaa

SEQ ID NO: 46162 - DNA, 101 bp, rice(Oryza sativa)
  misc_feature (71): n=t or c
atgttgcctaaggtggacgatcttgtgtttccaacgttccataggattctttcccttgtttacgctttgcnactctttggctaccatctcaaagaatccat

SEQ ID NO: 46163 - DNA, 101 bp, rice(Oryza sativa)
  misc_feature (71): n=a or g
tggcactggtacaaatacttctaagacgtcacgggtgctctaataaattggagaagattttagaaattctntactaacaaataataagtacactcatattt

SEQ ID NO: 46164 - DNA, 101 bp, rice(Oryza sativa)
  misc_feature (71): n=t or g
ggcgacgggccggcgcggcaggcgtgcaggcgtctgagtttttccttcttcttttttcttttatatttttnatttggatatgagatgtatttgtgtgtgat

SEQ ID NO: 46165 - DNA, 101 bp, rice(Oryza sativa)
  misc_feature (71): n=t or c
atactacctataaaaattgcgcatgctcatcagtcgatacccgttaaaaagatatataagttaccacccgncaaagatgactggttatttagtgacgctat

SEQ ID NO: 46166 - DNA, 101 bp, rice(Oryza sativa)
  misc_feature (71): n=t or c
gccgtaatactaatacacaccatgatgttccccccatgcctaaaccccaagctacagattatccttagaancctaattgatccccaaaattttctcccacg

SEQ ID NO: 46167 - DNA, 101 bp, rice(Oryza sativa)
  misc_feature (71): n=a or g
aactttggttcggtggctgcagtgtgcacatcgatttataggactcacatacagcaagaaaagttaagggnaaaatgtaaattatttgattgggctcgaat

SEQ ID NO: 46168 - DNA, 101 bp, rice(Oryza sativa)
  misc_feature (71): n=t or c
caatcgtgcaattatatgttcaacagaagaataggaaggaagaaaatgaggccagaaatgctacagcaatngttgcttgctggagatgcaagagagagatc

SEQ ID NO: 46169 - DNA, 101 bp, rice(Oryza sativa)
  misc_feature (71): n=t or c
ttgctactagcttaattttaagcttttagcctagctagctagctgctgctaccactgtttattactacctncgtttcagattataaaattttatagcattg

SEQ ID NO: 46170 - DNA, 101 bp, rice(Oryza sativa)
  misc_feature (71): n=t or g
aaccctacctgcattgatgacgaatagaattccttggcaaccactgtctttcctttagaaagcctcatccncaattttccaatattgagaacatgaacaga

SEQ ID NO: 46171 - DNA, 101 bp, rice(Oryza sativa)
  misc_feature (71): n=a or g
gtgcttggtcacaacatccacaatgtatgtgctccctctctcttctacttggaaaacaccttttccagccngcaacacatagcaaatgttagcctgctcag

SEQ ID NO: 46172 - DNA, 101 bp, rice(Oryza sativa)
  misc_feature (71): n=t or g
aataaattcgtttgtttcttcttttacccctgaatgtctacagctattgaaatgaaataggtgttccacanatcgaattagttgtagtgactacgtatagt

SEQ ID NO: 46173 - DNA, 101 bp, rice(Oryza sativa)
  misc_feature (71): n=t or c
gagctggatggcggctcgcatccctatgctccagatggccggatccaccagcgagtttttccttaattttnttcccgttgcaacgcacggacacttcgtct

SEQ ID NO: 46174 - DNA, 101 bp, rice(Oryza sativa)
  misc_feature (71): n=a or c
cccggggtacttttttaccaaccgggacaaattgtcaggctggtgtcatgcttatactatttttagtcccngttggtaataccaaccgggacaaaagaaaa

SEQ ID NO: 46175 - DNA, 101 bp, rice(Oryza sativa)
  misc_feature (71): n=t or c
ggattctgttggggtgcctagtgcattggatagttggatgcaggatcgtcataatatgcaaagcttgattnatcatcatttggttcgagctcaacaacgaa

SEQ ID NO: 46176 - DNA, 101 bp, rice(Oryza sativa)
  misc_feature (71): n=t or c
tataatataccacagtgaccagctaagaagacatttacttctagggtaatttacttctatgggtaggtacnaggtagatctgtagttgtaacagtaggcca

SEQ ID NO: 46177 - DNA, 101 bp, rice(Oryza sativa)
  misc_feature (71): n=t or g
ccatgagaccaagcagcgcgaaggcgatggccacgttcagcgccgatagccttctcccgttgttgcccatnctggtgctcaggagcaacatgatgacagtg

SEQ ID NO: 46178 - DNA, 101 bp, rice(Oryza sativa)
  misc_feature (71): n=a or g
gcattcaaataatttgttccacttttattaagtattggtatgattcaataccttgtgttgagaattgatcnaaaaccttatcaaacttgtattgttttctc

SEQ ID NO: 46179 - DNA, 101 bp, rice(Oryza sativa)
  misc_feature (71): n=a or g
gttccccgctacgtagaagcctctctcagcaaacgttcgaacagaacatcgctgctttccgaaatgccgantgccgagttgccgttgcgtgctctgctgct

SEQ ID NO: 46180 - DNA, 101 bp, rice(Oryza sativa)
  misc_feature (71): n=t or c
atatggagtgtataccatatgcatgcatccaaaaacatttatgtacgcaagactacaaagcacatgccgancccacaatgcgtcgcatgctaactccaata

SEQ ID NO: 46181 - DNA, 101 bp, rice(Oryza sativa)
  misc_feature (71): n=t or c
aaacaaggaagagaggttgggaacaagctaggggtgctgaacacaacctaagagatgctatattttgggangaagaaaatatttaacatctaaaattattg

SEQ ID NO: 46182 - DNA, 101 bp, rice(Oryza sativa)
  misc_feature (71): n=t or c
cttacaattacaagaagaaaactcaatcgaccacaccctaatgcggtcagtgacatactaagaaactcgcngagctttgaagctccagccatgcaccaaag

SEQ ID NO: 46183 - DNA, 101 bp, rice(Oryza sativa)
  misc_feature (71): n=a or g
atattcttagaatctaggtgggaatcaatctggattgttcaacgtaattagtgattttagaagaagttgcngctactaaaagttaacttctataaacatga

SEQ ID NO: 46184 - DNA, 101 bp, rice(Oryza sativa)
  misc_feature (71): n=t or c
taagctgaaagaagcatggcctaagtaatgcgtgtgaagagaactaaaggaacacacgtgggaaacccacnacctcccctctcaccggatctggcgaaggg

SEQ ID NO: 46185 - DNA, 101 bp, rice(Oryza sativa)
  misc_feature (71): n=a or g
atggccctctactcaacattccacaacagtgagcattgctctgcctaacaacaaaaaatggtgtcctgatncactgatttgatttcttgttagggaaagat

SEQ ID NO: 46186 - DNA, 101 bp, rice(Oryza sativa)
  misc_feature (71): n=t or c
taactagcagcaacccatctacaaaccctagattgtggcgatttaacagatggagatataaacaccattgncacaacccaagaaagcatacttaactagca

SEQ ID NO: 46187 - DNA, 101 bp, rice(Oryza sativa)
  misc_feature (71): n=a or g
cacatatccatatctatctctatagttatagcatacatagccagtgaaaaggaggagcttagtaataacangatcccccattgcacccctgtgcttctgga

SEQ ID NO: 46188 - DNA, 101 bp, rice(Oryza sativa)
  misc_feature (71): n=t or c
ggtacgcccgtgatctctaatatgttgaaatacaatcatctttgttctaagaacattggcatgacgaccgntggctctgccctcgtgtctgtcgctcattg

SEQ ID NO: 46189 - DNA, 101 bp, rice(Oryza sativa)
  misc_feature (71): n=a or g
ttcgcccctcccccggcccgccaaaaaaaaccctaatttggagattgcaaaccctgctgaaggaaaggatnatgaaggtggtacacaggacatggaggctt

SEQ ID NO: 46190 - DNA, 101 bp, rice(Oryza sativa)
  misc_feature (71): n=a or g
ttttgtgtttgccggtagaggcgaacgatgtaaattcggtgagctgttcctaaccctccttactgtacccnaaaaaggccccttggatatttggaatatat

SEQ ID NO: 46191 - DNA, 101 bp, rice(Oryza sativa)
  misc_feature (71): n=t or c
atgatgagcaaaaatgcaaaatacgcgcatggtgctctagggtagcagtgatataaaatgcaaaacgttgnctcacctcaatgttaggaagttcctccagt

SEQ ID NO: 46192 - DNA, 101 bp, rice(Oryza sativa)
  misc_feature (71): n=t or c
tcgtgtgggcccgtcctatcagaacagccgggtttggcattttgcagagcttctcttgctacctccgtccnaaaataagcgcaactatgagtttttgcgtc

SEQ ID NO: 46193 - DNA, 101 bp, rice(Oryza sativa)
  misc_feature (71): n=t or c
ctgcttggacaccgtcatcctcacctcccagtgcaacgacctcaggatgctctccacctccgccgccgtgncgcggccgtcccgcacgatcagcttcccct

SEQ ID NO: 46194 - DNA, 101 bp, rice(Oryza sativa)
  misc_feature (71): n=a or c
ttaatcaattcctgcacgaactggagcaacactactcctatggagtacaagaacatataatttgtcctctnaaaaaaaaacaatataattcgtcgctcgtg

SEQ ID NO: 46195 - DNA, 101 bp, rice(Oryza sativa)
  misc_feature (71): n=a or g
ccaccagtcgtagttcattgcgataacccttgaagtttgtcatcttgaccaaccgaaggttttctaatccnccttcaggcggttcttcctctgctacctcc

SEQ ID NO: 46196 - DNA, 101 bp, rice(Oryza sativa)
  misc_feature (71): n=t or c
ctcgtcagcgcgcgcactcgtcatccactccgaactatggctagttgtggggtggcccacctgtcagttangcagttgaccagacttgaccgtttctgggc

SEQ ID NO: 46197 - DNA, 101 bp, rice(Oryza sativa)
  misc_feature (71): n=a or g
ataccctgtgaggaggaggtggaggagggaagagatcgaccaagaactcgaccggaagatatggatcgagnaggcggtcgctcggcttctgctagtcgcgt

SEQ ID NO: 46198 - DNA, 101 bp, rice(Oryza sativa)
  misc_feature (71): n=t or c
agaggaggaaggagaaaggggaagaaggaagaagatgggaaaaggggtattttggtctttttttttaatgnatccaagggataagaagtggtatcttttga

SEQ ID NO: 46199 - DNA, 101 bp, rice(Oryza sativa)
  misc_feature (71): n=a or c
gatctcctctgatgatgagtaggggcaagaaaaaacacggccttgacgaagatctcttctctgatgataancatggggagacaagctagcctaaagtagct

SEQ ID NO: 46200 - DNA, 101 bp, rice(Oryza sativa)
  misc_feature (71): n=a or g
agctcgcgtgacgcggcggtgggtagcctagcaaagcaacaaaggccaaagtttaggccctttattcaaangaaaaaccatagaaattctagaggatttta

SEQ ID NO: 46201 - DNA, 101 bp, rice(Oryza sativa)
  misc_feature (71): n=t or c
tttccaaatatgccataatttctcaaaattctggctatcacaatgtaggtgaaatggcaaccaaagagttngatatcctcgctcttgatggttccaatttc

SEQ ID NO: 46202 - DNA, 101 bp, rice(Oryza sativa)
  misc_feature (71): n=t or c
aaaaaagaagaagagaaactctgaagtctgaaccaacctgtccctcttttgttccgcctttcttttatggncgtcgatttgacggtggtagagcctgggcg

SEQ ID NO: 46203 - DNA, 101 bp, rice(Oryza sativa)
  misc_feature (71): n=a or g
aactacaatgtttgcaaattgtgatctcattatttctatcttgcaggcctatggtaggaagagatgactgngaagatgaatgaagaagggtcctgtgaaga

SEQ ID NO: 46204 - DNA, 101 bp, rice(Oryza sativa)
  misc_feature (71): n=a or g
gcccatggttcggttgttcctgcctttctacatgtattccaagcttctggcagaggtcatcagctttcttntatcgggattgaacttcctgataaatagtg

SEQ ID NO: 46205 - DNA, 101 bp, rice(Oryza sativa)
  misc_feature (71): n=a or g
atgagaggaccaccgtgtacgcctaaacatgccatattcaagatagagagaagacaagggaggggaagaanaggctgacatgtggggctcatttgggtccc

SEQ ID NO: 46206 - DNA, 101 bp, rice(Oryza sativa)
  misc_feature (71): n=t or c
ctgtgatggatgaattatatgatttttgggggagaatggtatgttgggattaatgtttagatatgggctgngatggatgaattattgtgggctatgatgga

SEQ ID NO: 46207 - DNA, 101 bp, rice(Oryza sativa)
  misc_feature (71): n=t or c
taatacttactcatatttttccgtggcaaaataacctgaatttgttcagccgagcctaacataccctaaantgtatgtgccaatggtttaatcataaaaga

SEQ ID NO: 46208 - DNA, 101 bp, rice(Oryza sativa)
  misc_feature (71): n=a or c
gttgagagaactcactctctcctttccacccaactatagctttatttagatctccctcagcttttttgtcncttggtctttggttacaacccctgttacaa

SEQ ID NO: 46209 - DNA, 101 bp, rice(Oryza sativa)
  misc_feature (71): n=t or c
tcgagagccctctccaattagatgttacgtcctaatctcgtagtaatttcatcgaacgtgcgattctgacnaagaatcctactccatgtcgaagaacttca

SEQ ID NO: 46210 - DNA, 101 bp, rice(Oryza sativa)
  misc_feature (71): n=a or g
gcggagatagctcgacgccatccttggcccaatccaaataccattccgggccccaaaaagaagaagaaaangaaaaagcgaaaccctcgcgctccgtcttc

SEQ ID NO: 46211 - DNA, 101 bp, rice(Oryza sativa)
  misc_feature (71): n=a or g
gttttttggttgagatgatggaaacaaggtgggaacagttttgcatatcaggctgccactatatctgtaanctgagtctgaatggctgtgctcaacttaca

SEQ ID NO: 46212 - DNA, 101 bp, rice(Oryza sativa)
  misc_feature (71): n=a or g
ggagctcgagaacaacctgtcaaggatccgaggctcgctgcggatatcgcacaccggcctgcaccaactcnccggcgagtgtggtgtcacgactaccatcc

SEQ ID NO: 46213 - DNA, 101 bp, rice(Oryza sativa)
  misc_feature (71): n=a or g
caaggccttggactcacacgtcacgtgtgaggtctgcagtggcacatgtcattctgggaatgactacccanaaacccgtgaggaggcaatgtacatgggaa

SEQ ID NO: 46214 - DNA, 101 bp, rice(Oryza sativa)
  misc_feature (71): n=t or c
tttctatcctacgatctaacattctctttcaccgtcaaaatagtgacagaatcagttgtatacacaccagnaaaaaaaataattttccaaatggtcggatc

SEQ ID NO: 46215 - DNA, 101 bp, rice(Oryza sativa)
  misc_feature (71): n=t or c
ttgatcatgtcatcaactaaaggagctgtagtaacatcgcgcctgtcaatatagcttaagctctaatgatncatagccaaattttaattttagaattaact

SEQ ID NO: 46216 - DNA, 101 bp, rice(Oryza sativa)
  misc_feature (71): n=t or c
agaagaaagaagaagagtgacgtgatccattcattcgttcgttcaccttgactgaccactgcaacttcgtntcctctccccttaaattccccttcactctc

SEQ ID NO: 46217 - DNA, 101 bp, rice(Oryza sativa)
  misc_feature (71): n=a or c
gttgtaaatttgattgttttttttaccaccacatatgttatgaaatttcatccctggagtaatggtatcgnaaaaacccggatataggatgcttagttttt

SEQ ID NO: 46218 - DNA, 101 bp, rice(Oryza sativa)
  misc_feature (71): n=a or c
gcggttaacttctcaaacagctatagcggtagctatagcatgctaaatagagttttagcggctaaattgtncatgagagcaaataactagaacccttctca

SEQ ID NO: 46219 - DNA, 101 bp, rice(Oryza sativa)
  misc_feature (71): n=t or c
gtgatgtaccagcaaaatgagtgagaaagcaacattccatgtgacacatgagaatttctgaagtgtatcanaaatgctcagaattaggatagttatttacc

SEQ ID NO: 46220 - DNA, 101 bp, rice(Oryza sativa)
  misc_feature (71): n=a or g
ataaaatattttttccctcgaggaatgatttttcttttatgttacctaaatatttatgatttcgtaaagtngaaagtgtagctcaactaattaggttccta

SEQ ID NO: 46221 - DNA, 101 bp, rice(Oryza sativa)
  misc_feature (71): n=a or g
ccgacaacaccgtcgtcgctttctcttgcagcgagagcggcacaacggccggaggaacatccccaatgagnatcgcgaccgtccaccccgggacgaccgac

SEQ ID NO: 46222 - DNA, 101 bp, rice(Oryza sativa)
  misc_feature (71): n=t or c
gcacatgtaaactcatgcttataagttataaacgtacatgtacatcctatctctatatatttttggaagangagtccagcatattttgagattaacgaagt

SEQ ID NO: 46223 - DNA, 101 bp, rice(Oryza sativa)
  misc_feature (71): n=a or c
gttcagtttacatcatcaccaattattttgtctaaagtgccttccattttgcaacccttccacttgtcaancattgtcgcgagaatagggtttaatgttct

SEQ ID NO: 46224 - DNA, 101 bp, rice(Oryza sativa)
  misc_feature (71): n=t or c
ggaagggacgacgccacatgctgccacttgatgaggaggttggtggcggactggtttcttgagcggtgganggtgaacaccgtgacggtggccggaatggg

SEQ ID NO: 46225 - DNA, 101 bp, rice(Oryza sativa)
  misc_feature (71): n=t or c
agaaacaaaaaacgtagtttaccatgaaatcctggatgctacgttagcagcggtaatatgttgcgtctttnttaacttctgcaaatctccttcattgatat

SEQ ID NO: 46226 - DNA, 101 bp, rice(Oryza sativa)
  misc_feature (71): n=t or c
ggaggaatcagagcataaacttagactccagcagcaatcagaatctgaggttgcagttcaaatttaacatnaaactgttagtggctattaattgaaaaggt

SEQ ID NO: 46227 - DNA, 101 bp, rice(Oryza sativa)
  misc_feature (71): n=a or g
ccttatccccaacatatgctagagatggaggaaaaaggaccggtggggtgatgaggtggacattaagagcnagttgcgagagacaaagaaatgtttactta

SEQ ID NO: 46228 - DNA, 101 bp, rice(Oryza sativa)
  misc_feature (71): n=t or g
cccgtctaccaccatagaagtttcttgctgcggagaggctagcacaagcatcatacgacacattgtgacgngctgacggcaaagtcttcgtagctggagta

SEQ ID NO: 46229 - DNA, 101 bp, rice(Oryza sativa)
  misc_feature (71): n=a or g
aactgcgaggaaaaaaccgtcaccaccatcaataatgggcttaattccatttattccctccctacaattcntcctccgtttagatgaacctcaagcaccat

SEQ ID NO: 46230 - DNA, 101 bp, rice(Oryza sativa)
  misc_feature (71): n=a or g
aagtgccgatgcagttgttgggagcttgggagagtcggggagaagatgcggtttgggggaggagtagggcngaggggagcaaggcggggcatggggagggc

SEQ ID NO: 46231 - DNA, 101 bp, rice(Oryza sativa)
  misc_feature (71): n=t or g
tcgtaagacgtgctaccgcccgacgatagatcaatcgcctgcttgcttctctttccttacttctctctaanggcaagtacaataacttgaaattatcggct

SEQ ID NO: 46232 - DNA, 101 bp, rice(Oryza sativa)
  misc_feature (71): n=t or c
caatgtattgtactatagtgatatacttttgttcgtcatattctaaccatttagagcatgtttggtacagntccaactcctaaatttagcttcaggagttg

SEQ ID NO: 46233 - DNA, 101 bp, rice(Oryza sativa)
  misc_feature (71): n=a or g
ggaaccgacctgtgcaagttgccatctgctgatgtgcaaacggagcaatttaagggtaatgctcttctctnattttagaatttgatttttcatttgacctg

SEQ ID NO: 46234 - DNA, 101 bp, rice(Oryza sativa)
  misc_feature (71): n=a or g
catcagttgagttcacagagaagtttggcatgacaagggcatcattcaaaaaccttccaaaatggaagcanaacaggctaaagtctgatctccagctcttt

SEQ ID NO: 46235 - DNA, 101 bp, rice(Oryza sativa)
  misc_feature (71): n=t or g
taatctgatagcattcaatttgtgatttgcaatttggtagtagctggaaagaacaggaaatcacagagatnatcctgatttaaaaaggtagctaatgttta

SEQ ID NO: 46236 - DNA, 101 bp, rice(Oryza sativa)
  misc_feature (71): n=t or c
atatggagtcaaagatcccagcatgagaatccgcaatagtggcataatgctcacaagtttgttatcccctnatattggactagggataaaataaacagaac

SEQ ID NO: 46237 - DNA, 101 bp, rice(Oryza sativa)
  misc_feature (71): n=a or c
acatctctgtgccaatcatcatccgatatacccttaggattctttcggcttctcttatgagcttatccccntaacaatgaattataatttgataacaatat

SEQ ID NO: 46238 - DNA, 101 bp, rice(Oryza sativa)
  misc_feature (71): n=a or c
aaaattatccatgggatacccaatacccacaagctagcactgtaaaacaatgattagctccttatctgttnatataactaaaggtctaagcacactcttgg

SEQ ID NO: 46239 - DNA, 101 bp, rice(Oryza sativa)
  misc_feature (71): n=t or c
ccccctctatgatacacatgtatatatctagtgatttctgccacagagaacaatgttactccttccgtccnattttaagtgcaaccatgagttttcatgtc

SEQ ID NO: 46240 - DNA, 101 bp, rice(Oryza sativa)
  misc_feature (71): n=t or c
aaagtctcactgaatttgaagatctcgtggatgacagttctgcagttcacttctgctcaacagttcagaantgagatttattcttcaccaaccaaaaaaag

SEQ ID NO: 46241 - DNA, 101 bp, rice(Oryza sativa)
  misc_feature (71): n=a or g
tggggcttggggaaggatttgcgcgcagggtttgggtttggagaatgattcgcgcgtgactagggagatanaaaggaaacggatgcgttgggtttgatagc

SEQ ID NO: 46242 - DNA, 101 bp, rice(Oryza sativa)
  misc_feature (71): n=t or c
aagacttggtaaaatgagaatgcgctgcaattgttctcaaatctcaacttacctgtgcaatttcccttctncaaaccaaatgaatagatagacaagatgat

SEQ ID NO: 46243 - DNA, 101 bp, rice(Oryza sativa)
  misc_feature (71): n=a or g
aacttgcaaactctcaatcaacaccacataatcaccatctgatggctagggatagaggtgggctaattttncacttaagcgcccaccattagccatactaa

SEQ ID NO: 46244 - DNA, 101 bp, rice(Oryza sativa)
  misc_feature (71): n=t or c
attctggaatcgtcgcagcaagcgcagcgagcggtctggtccaatctcgtgcggcacagtaaaagggattnggctcctgtagcgccctttccgtcgtagcg

SEQ ID NO: 46245 - DNA, 101 bp, rice(Oryza sativa)
  misc_feature (71): n=t or g
tattgtagtgcccaaaattggtctattcagctgactagcccgattaatcattggttggtagaaaagcactncataaaggctaatgggtgctctagtgcatc

SEQ ID NO: 46246 - DNA, 101 bp, rice(Oryza sativa)
  misc_feature (71): n=a or g
cctcaggtatcgattacatggtaccttgatacttgatacttggtattgggtatcggatacctaggtatcangtacttggtatctagatcggtctgatatcc

SEQ ID NO: 46247 - DNA, 101 bp, rice(Oryza sativa)
  misc_feature (71): n=a or c
cctcagttccactaccattaatgcagagcttaagttgcaactggttactgtagacccacaagtacgtgagngtttttgtttgtatagctggattaagggct

SEQ ID NO: 46248 - DNA, 101 bp, rice(Oryza sativa)
  misc_feature (71): n=a or c
tttcagaacttccggaaagtaccatttccgcatttacttaaaaattttaatcacctattcaacccccatcnctctctaggcctaattgaccctttcagtcc

SEQ ID NO: 46249 - DNA, 101 bp, rice(Oryza sativa)
  misc_feature (71): n=a or g
aacacatgttctcatctccgatctccaaatcatactctagcacatgcatagagacttcacatcacaatccntgctttcttagttgtcgagttccgcttcct

SEQ ID NO: 46250 - DNA, 101 bp, rice(Oryza sativa)
  misc_feature (71): n=t or g
acgagatctaaagtagatggatgcatggggagaaagggtttagacagtttcaaaccctattaacaagagtnaggaccctactcttatttaaggattgtatc

SEQ ID NO: 46251 - DNA, 101 bp, rice(Oryza sativa)
  misc_feature (71): n=t or c
gatgctttacgtagcggtgggtttagcatgttggtgatgactcacacgccggcgtcggaggcaaaaatggnggcggtgggggtcttcgcgcgacgccgccg

SEQ ID NO: 46252 - DNA, 101 bp, rice(Oryza sativa)
  misc_feature (71): n=t or c
ctttggggcagcgtatctggacaaggacggcgacgggaatatctcctcgagctcgtgggcaggcaaacaangaccacaacgaagatgcggcgccaaggcgg

SEQ ID NO: 46253 - DNA, 101 bp, rice(Oryza sativa)
  misc_feature (71): n=t or g
cctcgtcttccccgcctccgtaaaaaccctagcttgtcaatctccgcccttcctccagcgatctgtagtcngcgatggatctcggcacgtctacttccacc

SEQ ID NO: 46254 - DNA, 101 bp, rice(Oryza sativa)
  misc_feature (71): n=a or c
tgttaaggttgaaattgcagctatgacggccgatgattggcagtatgatgtgcaacggtatttacagaatncatctcaatcggcttctaggaaattgagat

SEQ ID NO: 46255 - DNA, 101 bp, rice(Oryza sativa)
  misc_feature (71): n=t or g
acgttagggctttttaaagtacaccaatagggtggtgtcagaaaaaaagtaaagcaatagggaaaagacangattaaaatgtcatggaatcaggaatatga

SEQ ID NO: 46256 - DNA, 101 bp, rice(Oryza sativa)
  misc_feature (71): n=t or g
gattgcagaaaattgaagtcatgactcatgactgacaggcacctttaatttctagatatggacatcgaacngataaggtattactaatagattaaacataa

SEQ ID NO: 46257 - DNA, 101 bp, rice(Oryza sativa)
  misc_feature (71): n=t or c
gaccgcgctccgtggggatgcgtgtggcaacaacagaggcacacgggtttaaaacgacgtgattagagcangtacaatagtatgctataagccagctataa

SEQ ID NO: 46258 - DNA, 101 bp, rice(Oryza sativa)
  misc_feature (71): n=a or g
aatcagtctcgaatcaacaaaagcatccaatcatcgcattcacatcgattcaatttcaattgggcttctcnagcagctgtcgccttcctccagaagcccgt

SEQ ID NO: 46259 - DNA, 101 bp, rice(Oryza sativa)
  misc_feature (71): n=a or g
cttattttcttataacagtatatggttgtcttaaggtgtggtgtggagggtgcaagcttttacaatatganacattttgatgaaaataagatacatgcaca

SEQ ID NO: 46260 - DNA, 101 bp, rice(Oryza sativa)
  misc_feature (71): n=t or g
ggtgtataagttggtatgccacaaacccacgcatatatagatcataataagatattcgtagcttattttantttataactggatttagtggattagtcact

SEQ ID NO: 46261 - DNA, 101 bp, rice(Oryza sativa)
  misc_feature (71): n=a or c
accatcgcataacatgaagatcggcataccacattatgcaggcagtagttgtacttgtcccactttcttantgcatcctttatttgctttaaaataaacaa

SEQ ID NO: 46262 - DNA, 101 bp, rice(Oryza sativa)
  misc_feature (71): n=a or g
tcatgcatgtagatttcggtattgagctggtgggagtatagcaggcgagcgattaatttgtatttcctccntcccaaaataaatagatgagatactaccta

SEQ ID NO: 46263 - DNA, 101 bp, rice(Oryza sativa)
  misc_feature (71): n=a or g
catgaatgtgacataaaaggcattcacaaaatccttcttcagcgcaagtttttttaagagcatgcaaattntgaaaacaagatcatattttctgagcccag

SEQ ID NO: 46264 - DNA, 101 bp, rice(Oryza sativa)
  misc_feature (71): n=a or g
ggagacagcacgaggttgagctcgaaaagctggagctgtagttggggaaaagtttaagagcttttgaaatnaactttttttgattttgatttgtttttgtt

SEQ ID NO: 46265 - DNA, 101 bp, rice(Oryza sativa)
  misc_feature (71): n=t or c
agtttgtgaccttcgcactggcctcagagttctctggtctgaaatattttgaggttatcttgcttccaaanttccagtcgatggtgggataaggttgtaag

SEQ ID NO: 46266 - DNA, 101 bp, rice(Oryza sativa)
  misc_feature (71): n=a or g
cgaatcgccgccaggtgttgcgcgcggactgaattggttttggtggattgcgtgagataatgaattgagangatttagatttaggattagtagcttgctgc

SEQ ID NO: 46267 - DNA, 101 bp, rice(Oryza sativa)
  misc_feature (71): n=t or c
tagtcctccttgatttcctttttgtttctgggactgtaagttttttttttttctcctatcaattaaattcnggcagctctcctgccgtcgtttccctcaaa

SEQ ID NO: 46268 - DNA, 101 bp, rice(Oryza sativa)
  misc_feature (71): n=t or c
ccatggcgacaacaaccgagcatggagtattgtgcgatggaagcctcaaccaatgagctttccaccccgtngcccacaaatgaagttgtcaccgcatactc

SEQ ID NO: 46269 - DNA, 101 bp, rice(Oryza sativa)
  misc_feature (71): n=t or c
acagagcagcaccatatgctgctcattttttctctctttttttgttggaaagaacaggtagccgctgctgntcacttcttggagatgtaggcgtagtactg

SEQ ID NO: 46270 - DNA, 101 bp, rice(Oryza sativa)
  misc_feature (71): n=a or g
tatttctaccaatattgagttgttaatcgattcattttcatcgttaccattctgttgtactagtagcccgntacatctaggtgatactccaagcctataat

SEQ ID NO: 46271 - DNA, 101 bp, rice(Oryza sativa)
  misc_feature (71): n=a or g
ctcgtatgcatcatccttgagcagcaaggagtagttagaaatggttgaagtgaactgagttcaaatttctntaggaacgaaatttagattgggttgtttga

SEQ ID NO: 46272 - DNA, 101 bp, rice(Oryza sativa)
  misc_feature (71): n=t or c
acataattgatgtttacatagcttcagcaaaacatcttaatgtatactaattggagtctctcctagcaacncctacattaatctaaaaggtaaacaagcta

SEQ ID NO: 46273 - DNA, 101 bp, rice(Oryza sativa)
  misc_feature (71): n=t or c
ttttgtctcagttcttattggaacagggactattgtgggtttttctcaacccatcaaaagatgcattctcnagtagtggcaggaatacaaaaatggaggaa

SEQ ID NO: 46274 - DNA, 101 bp, rice(Oryza sativa)
  misc_feature (71): n=t or c
atatacacggttagtgggatgaatccactaagcatgtgtttttcatgaatgacgaattgatggacaaaccnaatcggtttgtcaaacaaacatgtcaagcc

SEQ ID NO: 46275 - DNA, 101 bp, rice(Oryza sativa)
  misc_feature (71): n=t or c
ccgtgatagcatatatggtacattagtatatgctagcgctgtttcttccgagtgctgtaccaacaatatgnatcttttatgtgctctgcaacctaggagac

SEQ ID NO: 46276 - DNA, 101 bp, rice(Oryza sativa)
  misc_feature (71): n=t or c
ttgttggaggtggagctagacatcctatgaaattttaccaactggagcagatggtatgacccgagaggtgncatgtttgatcggggggagggggtgcgact

SEQ ID NO: 46277 - DNA, 101 bp, rice(Oryza sativa)
  misc_feature (71): n=t or c
cctatagcctatcctttgtgaatatcttgcatcataccttgttccggacattgaggatccctgtgggttangaaggaagcaacgtgttttggtcgtgaaga

SEQ ID NO: 46278 - DNA, 101 bp, rice(Oryza sativa)
  misc_feature (71): n=a or g
gttcatactcacaacttgaaagaagaatcaatcgacttgaatcgcactgttccacacaggacttatactgntctggacttcgatcctccatcatttgatct

SEQ ID NO: 46279 - DNA, 101 bp, rice(Oryza sativa)
  misc_feature (71): n=t or c
cagtttacctccaaagtgattcttatcctctctataaagacaagagagaatctcagattgtgctacttgcngtgcgtcttgctcaaactttcagaaagaaa

SEQ ID NO: 46280 - DNA, 101 bp, rice(Oryza sativa)
  misc_feature (71): n=t or c
ttcctaaattgcacctaattaaacgggatgtgaatggtttgtaacggctacatgcatgtacaagttaatcntcctggtcccacgcatcatgcggctggcca

SEQ ID NO: 46281 - DNA, 101 bp, rice(Oryza sativa)
  misc_feature (71): n=a or g
cgcgagagaagacgagtttaacaaatgagttattagtagtaaagtggcgtgcgcgtgcgcgcgcgggaggnccaaaaaaggcggcctaagctaagcaacgg

SEQ ID NO: 46282 - DNA, 101 bp, rice(Oryza sativa)
  misc_feature (71): n=t or c
agaaaacattaactaatcaaattacaccggagtattaccacagcattattactccagaattaccgtgacantataggtgacttgtcaaactcatgtcacac

SEQ ID NO: 46283 - DNA, 101 bp, rice(Oryza sativa)
  misc_feature (71): n=a or g
actcattcattataatccaactgtaacatgactaatcatactgagttctattatctaacatcttacctagnttatcatcgagagaaaattcaatctgtagc

SEQ ID NO: 46284 - DNA, 101 bp, rice(Oryza sativa)
  misc_feature (71): n=a or g
aataaagagttaagtatgacaacacaaaaaacatcccctgcaacaaagagcccacatagagagtatacatnaagtccaaaaacaatgtttttgttaaatct

SEQ ID NO: 46285 - DNA, 101 bp, rice(Oryza sativa)
  misc_feature (71): n=t or g
aaaagttttagcccatctaaacactacataacgttgttaagttaacattgcacttcgagttccgattcagnaaggaatgaatgcaaagcacgaacgacacg

SEQ ID NO: 46286 - DNA, 101 bp, rice(Oryza sativa)
  misc_feature (71): n=a or c
atcaacagcccacctcttcttcggtgatggataatgtcgctatgcatgcagcgcgaggcagattagttagntgggactaaaacttcttttaaagactatta

SEQ ID NO: 46287 - DNA, 101 bp, rice(Oryza sativa)
  misc_feature (71): n=t or c
ttttaaaatcttccagggttccaacgtaaaccaatgcacatgacacattgacaccatattcttgcattttnccaatcccattttggataatccaaatctaa

SEQ ID NO: 46288 - DNA, 101 bp, rice(Oryza sativa)
  misc_feature (71): n=a or c
ggtgcaaagctttgtggatgcactgtttcagggtgaagagaaaaaagcagaagaggatatgtatatgtagnctcttctgtttcaggtggtgaataattcga

SEQ ID NO: 46289 - DNA, 101 bp, rice(Oryza sativa)
  misc_feature (71): n=a or c
tttggcttgaagagtgggatgtggaggctgttggagatgctttaggaccttgagttaggtagctcaagatnattccatttgtccattttcaaatttttcaa

SEQ ID NO: 46290 - DNA, 101 bp, rice(Oryza sativa)
  misc_feature (71): n=a or g
taaaagacttgacacaaataaagaagcaaaaataatcattacattacataccacactattgtcattttganaggctcttatccagcttgaagcacaaacca

SEQ ID NO: 46291 - DNA, 101 bp, rice(Oryza sativa)
  misc_feature (71): n=a or g
atcttacgaatatcaccttgtacaacaacaacttcactggtgagctaccacaggaattggggctgaacacnacaccggggcttcttcatattgacctcact

SEQ ID NO: 46292 - DNA, 101 bp, rice(Oryza sativa)
  misc_feature (71): n=t or g
caactcaagaggtggtggtagcaaaataaccgtgcattgcaatggatttgaaaaaaaagaattaccataanttgcaatcaaacatcaatccacaaaaagcc

SEQ ID NO: 46293 - DNA, 101 bp, rice(Oryza sativa)
  misc_feature (71): n=t or g
tttccaaagtactgtagctaatcaaggagtagttaataatccgatctgccggtggccgtgagacgggtggnataacaaaggttgtccgcatgtttattttg

SEQ ID NO: 46294 - DNA, 101 bp, rice(Oryza sativa)
  misc_feature (71): n=a or g
aagaccctacgtagtaaaaattgatttttactagcagggtctaccaccaccataaaaaatcatgggatagnaatatatatatcacgcgcagagactaagtc

SEQ ID NO: 46295 - DNA, 101 bp, rice(Oryza sativa)
  misc_feature (71): n=t or c
catgaaagctctgaggaatttcccaatgcaagtttatatctcttccaatcagcggcggattgatagctccngggcaggttgggcgcgcggccgcccgacct

SEQ ID NO: 46296 - DNA, 101 bp, rice(Oryza sativa)
  misc_feature (71): n=t or c
tgcctcacacgagagatggcaaaatgcagcatgcacttttgacttccttgtttcatataaatgggatcttntgagcactagtattgtgtctaactaactat

SEQ ID NO: 46297 - DNA, 101 bp, rice(Oryza sativa)
  misc_feature (71): n=a or g
gagggggcagtccctcaacttgcaaaacctgtacccgagattctaaacagtatagtgtccagttttaactnacatgactaggtgggtctcacatgtcaggc

SEQ ID NO: 46298 - DNA, 101 bp, rice(Oryza sativa)
  misc_feature (71): n=t or c
gatccggtcgactagcttggagaaagggcagcgttggaatcagaggtcaccgacgagattgaagacaagtngtcggcgagctttgccctcatcgctgcctc

SEQ ID NO: 46299 - DNA, 101 bp, rice(Oryza sativa)
  misc_feature (71): n=a or g
aagaggggaggtggtaatcacgtcgtcagtatcacgtaggatccctaatgtcttgtgacaatgttgtattnggatgatattttagtaagtttcggttctga

SEQ ID NO: 46300 - DNA, 101 bp, rice(Oryza sativa)
  misc_feature (71): n=t or c
gttgtaagcaagaaggccctcttcttagtatccatgctgatgaacgaaattaaaaccttcatttttcgtgnaatattctccctactgtgaaccttttacat

SEQ ID NO: 46301 - DNA, 101 bp, rice(Oryza sativa)
  misc_feature (71): n=a or g
tgcagccattgcttcgtatcagtcaatgagtcaaattaaaacacatcggagcaattgaacatggctaggangtgattgtcagaggacatcccagttttatg

SEQ ID NO: 46302 - DNA, 101 bp, rice(Oryza sativa)
  misc_feature (71): n=t or c
attgggggcggcagagtctcgagcccccactattaatgtaaagataataagagcctctacgaagatcccantaaaattttttatcatatgtagatgggaga

SEQ ID NO: 46303 - DNA, 101 bp, rice(Oryza sativa)
  misc_feature (71): n=a or g
gtgtgcatccacatgcacggaactagtggtctacatgggatcccatgcagacatatacgatgatatttcanagaaagaataagatggttgattaattaaac

SEQ ID NO: 46304 - DNA, 101 bp, rice(Oryza sativa)
  misc_feature (71): n=t or c
cgccgcatttggacgtgcgtcgtcgtagctgagggcatgaggctgagctgtgctaggacgacgatggcagnggcattgctgttggcaccagtggtggtgct

SEQ ID NO: 46305 - DNA, 101 bp, rice(Oryza sativa)
  misc_feature (71): n=a or c
cttttcctcctattccactcagcatcaacatcctcgcgtgaacccagaatttgggtaggccccgagccagnccattatacttttggcctatctatcaaata

SEQ ID NO: 46306 - DNA, 101 bp, rice(Oryza sativa)
  misc_feature (71): n=a or g
ttcctctgtctcaaaatatagaggattttaaatgaatttaacacaaccaggttgtactacgaatttggacnttgtgttacattaatctaaaatctcttata

SEQ ID NO: 46307 - DNA, 101 bp, rice(Oryza sativa)
  misc_feature (71): n=a or g
gtatttggtagtaacacaataagttgcattgaagcagcagtgtactgctagctactactcctccatgcaantaaacaaggtgaaagaagatattgaatgct

SEQ ID NO: 46308 - DNA, 101 bp, rice(Oryza sativa)
  misc_feature (71): n=a or g
cattatgcaagcaaagaacgctgttgttcttcgtttcttttttaggctgggcacggttcacgttaaaattnaaagtttagttgaaattggaacgatgtgac

SEQ ID NO: 46309 - DNA, 101 bp, rice(Oryza sativa)
  misc_feature (71): n=a or c
ttgagagtttgagaccctcttcctcatctctcacctactttctccctcttcttgagatttccttgatttgnctccaccgataggcttgctccatccgtctt

SEQ ID NO: 46310 - DNA, 101 bp, rice(Oryza sativa)
  misc_feature (71): n=t or c
atcttcccgcacttcaaaaatctcgcttgtgggtggtaatgacatgattgatgatgaagactctgtcccanagggcataccaagagcgtgttactgtgaaa

SEQ ID NO: 46311 - DNA, 101 bp, rice(Oryza sativa)
  misc_feature (71): n=t or c
cttcaagttaaaatttagcaagtttgatgaaaaaatacacttcaacagcctggctaatcggatggccaaancatccggctggccaaattagctcccggact

SEQ ID NO: 46312 - DNA, 101 bp, rice(Oryza sativa)
  misc_feature (71): n=t or c
cagactccagaagctcattcagtgcctctgtgtggaacttgttgtcacacagatacagcgaagcgttaatnggcctgaacggctcaaagtcgaaggtgacc

SEQ ID NO: 46313 - DNA, 101 bp, rice(Oryza sativa)
  misc_feature (71): n=a or g
ctgctgaaattctaaaaccccataaagcaggcaacaatctgtagagtttaggcttagttagtcaacgcatnaagttttatgatgattacatataagaaaac

SEQ ID NO: 46314 - DNA, 101 bp, rice(Oryza sativa)
  misc_feature (71): n=a or c
aaccaattgtcaatctttacgaatggagtattttgcctaatatacccactaaactagagttgacccggtgnggccaaactgctagtctttggcaatacggt

SEQ ID NO: 46315 - DNA, 101 bp, rice(Oryza sativa)
  misc_feature (71): n=a or g
atcagagggaagaaagaaagtgcagcagttgcattcacaattggatctgtttcatgcactcctatacgacntatgcattggcattgcatgtactttatact

SEQ ID NO: 46316 - DNA, 101 bp, rice(Oryza sativa)
  misc_feature (71): n=a or g
tagattgtgcattctaactatacaaaagccgaggaattcacggctcccatggttaaacgaaaaataatttntaaataaagcttttatatacgtgttcttag

SEQ ID NO: 46317 - DNA, 101 bp, rice(Oryza sativa)
  misc_feature (71): n=a or g
gcacgctgggcctggcccattgggttggcgaccgagaaacgaaacgccacaagcagaaggagcgcgataangcgatagttagggcgcgcgacagaaggagt

SEQ ID NO: 46318 - DNA, 101 bp, rice(Oryza sativa)
  misc_feature (71): n=t or c
tttgctggctggaagcctgcaactggcccccacataactttccttttgaatttggggatgctagttggcgnagctctgcgtcaactttcccaagtcacacc

SEQ ID NO: 46319 - DNA, 101 bp, rice(Oryza sativa)
  misc_feature (71): n=a or g
tggaaaaggccgaaaataatttaggaattaatcgtagaactgacacttgaattagtccaactataactganaatgtcgaaaatatacataggagaaatgga

SEQ ID NO: 46320 - DNA, 101 bp, rice(Oryza sativa)
  misc_feature (71): n=a or g
gcatggtagctaagctacatgcaggttatatcggggacaaaagtacaacctaagcatgacagtaagaccgnccgtattcagtttggaatgcaacaagttag

SEQ ID NO: 46321 - DNA, 101 bp, rice(Oryza sativa)
  misc_feature (71): n=a or g
aattaaagccatgcaacgtacaacaacttgcattactttaacagcatatgaacggaggctttgtttagttngggaaaatttttaggtttgattttcacatt

SEQ ID NO: 46322 - DNA, 101 bp, rice(Oryza sativa)
  misc_feature (71): n=t or c
tgtgttttcgtattgatctgcaggtgtgtactgcatattgtgttacatgtgtgcgcatcacaaagcaatanatatactacaaaattaatgctttgacgata

SEQ ID NO: 46323 - DNA, 101 bp, rice(Oryza sativa)
  misc_feature (71): n=t or c
aaaaagaaaccaatgacaaaattctgacagcatttcacataacaatgtgaaaaacagattcgctgtgacantgatgttgtgaatttgtttttttagataac

SEQ ID NO: 46324 - DNA, 101 bp, rice(Oryza sativa)
  misc_feature (71): n=a or g
aactcgtaaaaccgtgttaactttcgttctaatatagtatggctcctgatttcgtccgatgtggcgctttnactctggtcagttgtgctgagttagcgtgg

SEQ ID NO: 46325 - DNA, 101 bp, rice(Oryza sativa)
  misc_feature (71): n=a or g
cctcatgtgaagaaccagtcaatgatgcaggcagcattggatagttatccaaaagaataaggtaggctctntgacaatactgttatgtcaagtgttcatca

SEQ ID NO: 46326 - DNA, 101 bp, rice(Oryza sativa)
  misc_feature (71): n=a or g
gtacaacatctgaaagagtatgcattgcacaacctaatatgcaagtatacagcaatcattatttttgggtnaatacaataatcgaactggcgcttacacac

SEQ ID NO: 46327 - DNA, 101 bp, rice(Oryza sativa)
  misc_feature (71): n=t or c
tatcaccaaactaggttgggtcgatgagatttattcgatattttagctcagccctgaaagttaaacagaancagggattataggacaggaaattaaccaga

SEQ ID NO: 46328 - DNA, 101 bp, rice(Oryza sativa)
  misc_feature (71): n=a or c
ggtatctaggattccttgcttcttggctatgcaaatgcaatgcacatcatcttctaccgtatctggtactncatcattgtgttcaattcaattcaatctac

SEQ ID NO: 46329 - DNA, 101 bp, rice(Oryza sativa)
  misc_feature (71): n=a or g
actggtatcaagacaatgacccctaggtcccatatcgtcctttgtaacgaatgattttaggataataagtnctccctccggtttttaatgcataacattgt

SEQ ID NO: 46330 - DNA, 101 bp, rice(Oryza sativa)
  misc_feature (71): n=t or c
tttagccaaagacgcggcgagcaaatcgttcgccacgcttgcggcacgactgttgcgtgcggagagagcgngcgctacgctcaccttcttgaatagcacga

SEQ ID NO: 46331 - DNA, 101 bp, rice(Oryza sativa)
  misc_feature (71): n=t or c
cagagaaaatgcaaatgctagcagtatatatatatctctcgtgccattaattcgccgcattgcattcatgnagctgttatgcttgtattgcagctgcaaac

SEQ ID NO: 46332 - DNA, 101 bp, rice(Oryza sativa)
  misc_feature (71): n=t or c
aattgaaccatagtcggccaccagattatctaatgatgactctaaccgaagggatatatcttcaagtgttntcttgaaagtttcatctagaggggctagag

SEQ ID NO: 46333 - DNA, 101 bp, rice(Oryza sativa)
  misc_feature (71): n=t or c
tcatttgttttaacctaaagtcacaaaatatagctgttgctctatcctgagagtgaataggtaggcatttngttctttactggtatcgttgatgaccgctg

SEQ ID NO: 46334 - DNA, 101 bp, rice(Oryza sativa)
  misc_feature (71): n=a or g
acgcccgcaaatggcgggggatttgaaatccccaaccccactctctcttctcctccaccttccccatttcnccggcgcaatagggccccctcccggccacg

SEQ ID NO: 46335 - DNA, 101 bp, rice(Oryza sativa)
  misc_feature (71): n=a or c
ccaaaatgacatgtaatatattctgtctgtaaagtagtgacacaggttttatacactctatagtctatagnttgtataaatctatcatgcattatagactt

SEQ ID NO: 46336 - DNA, 101 bp, rice(Oryza sativa)
  misc_feature (71): n=t or c
tgaaattccccaaacctgatgcctacttgttccaaaaatattcagacactcccgggctctggcggagggangaccaatgtcaacgcgctgcgctaatcacg

SEQ ID NO: 46337 - DNA, 101 bp, rice(Oryza sativa)
  misc_feature (71): n=t or g
gtgaaattactctgaatttgtgaaaaaggtcttatactgtgaaacagggaacaaaatggtggatataattngtgttttaaatcgaactatgctcctttgga

SEQ ID NO: 46338 - DNA, 101 bp, rice(Oryza sativa)
  misc_feature (71): n=t or g
ctccctaaaaaaggacaatcaactggccaataatttgtaccatttcaatattgtattaatatgacccggcnaaaatcttgtattaatatgtttctacaagg

SEQ ID NO: 46339 - DNA, 101 bp, rice(Oryza sativa)
  misc_feature (71): n=t or g
ggggagaatagaagagagagaggttctatgtgtgccgccccggcctccacataatattttctgaccaacgntgtggggttctatgtgttatgtctaattct

SEQ ID NO: 46340 - DNA, 101 bp, rice(Oryza sativa)
  misc_feature (71): n=a or g
ctctgctgaggcctattcgcctcctctctctcgcgaagtccacttcacctcccttctcccttcagccgccnataggtagggcccacctatcagggtcatcc

SEQ ID NO: 46341 - DNA, 101 bp, rice(Oryza sativa)
  misc_feature (71): n=t or c
agagctatacactttgcctcctacacttttcgcaattgagatggatgtaaaatcgcttacataatcatgcntgtatgtatgtgaaaccttcagtctcaatc

SEQ ID NO: 46342 - DNA, 101 bp, rice(Oryza sativa)
  misc_feature (71): n=t or c
tgacttcaggccgctccgacaacttcatctatgtcagccccagcttgggaaattgttgatgcgaaaaacanacacttgcctaagagatctgcttagctcca

SEQ ID NO: 46343 - DNA, 101 bp, rice(Oryza sativa)
  misc_feature (71): n=t or g
tggctgcaggagaaaatcgatggatatggatggatgggatgagaaatcgaagcagagagagagagagaganagagggcggaggagaatgtatttactggtg

SEQ ID NO: 46344 - DNA, 101 bp, rice(Oryza sativa)
  misc_feature (71): n=t or c
cttcagatggagacatgctcgataccaaagttgatgggatccataaatttgttgttatgacctttcaattnaaaattatctagagtgttaaatatgtacta

SEQ ID NO: 46345 - DNA, 101 bp, rice(Oryza sativa)
  misc_feature (71): n=t or c
cttttcccctgtcaatcgatctgtgttctggtggaacagaaagctacgtactccatacaagcatctccccntttttttttttggaccttttgaagttagga

SEQ ID NO: 46346 - DNA, 101 bp, rice(Oryza sativa)
  misc_feature (71): n=a or c
ctagagcggccgcgctgctctgagaatgcaatgtacctttcaagggttcggtattttagttccttgcttgntaattgctactactgcgacaatctcgcggt

SEQ ID NO: 46347 - DNA, 101 bp, rice(Oryza sativa)
  misc_feature (71): n=a or g
cacgcctacacgagagtgggaccaaatcacgcatgacatttcccctcttttaagggtgtgtttaattcgcnaaaaggaaatcgttaggtatcacatcaaac

SEQ ID NO: 46348 - DNA, 101 bp, rice(Oryza sativa)
  misc_feature (71): n=t or c
ggtttggtggagaagctgaaatctacaatatctgtgctaggaccccgtagagtgggtgttggttgatgttngattagggctttctataggatgcttttatt

SEQ ID NO: 46349 - DNA, 101 bp, rice(Oryza sativa)
  misc_feature (71): n=a or g
taacttcaaagaattcttcaaaaaagttcccatgaaaaatctaagagcaaggtgaataggagagccagctnctggctccaattagtgtacatatcatctat

SEQ ID NO: 46350 - DNA, 101 bp, rice(Oryza sativa)
  misc_feature (71): n=a or g
agcggtcgccggagttgaagaacacgaggagtttgttgaatcggcggcgaaagggttcgaatctggatctntgcggttttcaggttagacctagcaaaaag

SEQ ID NO: 46351 - DNA, 101 bp, rice(Oryza sativa)
  misc_feature (71): n=t or c
gtttcttctggtccgaggctacacatttgcaactatgagctcggcatcatcctcattattccaccatctgncatgtcaaagcagatcagtggaaggaggca

SEQ ID NO: 46352 - DNA, 101 bp, rice(Oryza sativa)
  misc_feature (71): n=t or c
attaatacagggttcacttgtctctctcacagagtttctggtttttatatccaaaccggctgtaagtttanaacccgcttctcttttcttctctcctccac

SEQ ID NO: 46353 - DNA, 101 bp, rice(Oryza sativa)
  misc_feature (71): n=t or c
cagcctgtatatttctttgttctatctaaaggaatggagaaatggatcaatgggcctgagctccttaacgntgtggttttcgcaaaagtttttcatttctg

SEQ ID NO: 46354 - DNA, 101 bp, rice(Oryza sativa)
  misc_feature (71): n=a or g
catgcatgtacatgctagctagtgtagggctatctcgatttctacaggtggttccttagaacatccgcctntgtaaatcctattaacatgaacggtagctt

SEQ ID NO: 46355 - DNA, 101 bp, rice(Oryza sativa)
  misc_feature (71): n=a or g
tcctggcagcggcgaggcaatggtgttcccctggtgtcattgagctataaaaagcacaaggagatgaggcngcccccactgcggtgctccctcgatgctag

SEQ ID NO: 46356 - DNA, 101 bp, rice(Oryza sativa)
  misc_feature (71): n=a or c
gccacaacggtggtaaaaatcgccgtgttccttaccgattaattatttgcctattagagtgtgtgtaggtnaagggaaatagaaattcacgtactaaacca

SEQ ID NO: 46357 - DNA, 101 bp, rice(Oryza sativa)
  misc_feature (71): n=t or c
cttcacggcgctagactacctcggcgcattctccatctccgactacttcccgtcgttggttctcaatggcntgatgagtacattcagacggctgcatgatc

SEQ ID NO: 46358 - DNA, 101 bp, rice(Oryza sativa)
  misc_feature (71): n=t or g
tcaataacaagctctctgggcccctacccgcggagcttggaaagcattcggaattggggaattttgaggtntccaacaacaacctctctggtgagctgccg

SEQ ID NO: 46359 - DNA, 101 bp, rice(Oryza sativa)
  misc_feature (71): n=a or g
tacatgcaattgatctgtctctcattgattgggaatacatgaactaggctgtttggttgcatgtatggtcnaacaggcgcggttgacataaaaaataatgc

SEQ ID NO: 46360 - DNA, 101 bp, rice(Oryza sativa)
  misc_feature (71): n=a or g
ggaaagagagataggagagaggggggggggggccatgaaaaagtgaaaagatgtaaaaggtggtattggtnggacccactataaacaacttgcactgtgca

SEQ ID NO: 46361 - DNA, 101 bp, rice(Oryza sativa)
  misc_feature (71): n=t or c
tgagacctaccataagaatgttgacatgacatcttcaccaatcctacaaacccttaaaaagttaaaagttngaagaaagttggaagtttagaaaaaaagtt

SEQ ID NO: 46362 - DNA, 101 bp, rice(Oryza sativa)
  misc_feature (71): n=a or g
ctccagatgaagatgccaggtcccgctggccccatcaccatttttggtgatgtcaaggttgctctcacctncgcagagcagcgtgcggacaacctggcggt

SEQ ID NO: 46363 - DNA, 101 bp, rice(Oryza sativa)
  misc_feature (71): n=t or c
atttaagtaacttatggtatggttgtattgaagatacaacgaagaagcatctgtatgtatacctttacagnattttgtgaatgattattttaagggcatat

SEQ ID NO: 46364 - DNA, 101 bp, rice(Oryza sativa)
  misc_feature (71): n=t or c
atgaaaataagtgtatggttatgattaaatgtggtgaaagaatgaatggttaggattaaactttaccctanggtggataggaaatcttttcctaaacctat

SEQ ID NO: 46365 - DNA, 101 bp, rice(Oryza sativa)
  misc_feature (71): n=t or c
tggcagctgacttgcattatgatagttcacaaatggatgtgtctgggtaaatggagagatcttattactcngtaaataatttaggaaaccacctggtggat

SEQ ID NO: 46366 - DNA, 101 bp, rice(Oryza sativa)
  misc_feature (71): n=t or c
gatcaaaccggggtttgtgtaccagtcggaccggacaaatattgtgaatagtggttgacgataaataggtntttctgctagagtggattcactggaacagg

SEQ ID NO: 46367 - DNA, 101 bp, rice(Oryza sativa)
  misc_feature (71): n=a or c
ctccatgaagcttttatttaagactcataattagtatattaaaactaagaacacagtacacgaaggggganatgaaattatactccatgaagctggcttgg

SEQ ID NO: 46368 - DNA, 101 bp, rice(Oryza sativa)
  misc_feature (71): n=a or g
caaattcgggttacacttatatgtgtgtgtatatgttgtttcctccactgtagcttcctgtccgctaaaanaacatatttctaaacttcaagaaaggtctt

SEQ ID NO: 46369 - DNA, 101 bp, rice(Oryza sativa)
  misc_feature (71): n=t or c
aacgcccaacaataatgtccttttcctctctgaattgctagttacgaattgttttagattggattgtttgngatactaagttttcaatttaaatagttgta

SEQ ID NO: 46370 - DNA, 101 bp, rice(Oryza sativa)
  misc_feature (71): n=a or c
atatagtactgacactataaatcaaaattgtgtttttttttgtgtgatgtgtagattgaatttagtacttnttgtttgtaaacaatgtaattttatgtatg

SEQ ID NO: 46371 - DNA, 101 bp, rice(Oryza sativa)
  misc_feature (71): n=a or c
agtttatacagtacctcccatgggcctcagaaaggcttattagttttgcttccttagaagtatctgatagnaaaatccctttttcttaaaatctttagaac

SEQ ID NO: 46372 - DNA, 101 bp, rice(Oryza sativa)
  misc_feature (71): n=t or c
cgactagcactcacctctctatcacaagccctacatacgggtgctcccgccaataaggtcgtagccgtctnagcctccacctctagatcctcttatgttgg

SEQ ID NO: 46373 - DNA, 101 bp, rice(Oryza sativa)
  misc_feature (71): n=a or g
attaaattaatgtttcaccccgccattaattattcagtcctcttgaaaggatatacacgcctaggggctgntctaactgttgttttatctcttgtagaaat

SEQ ID NO: 46374 - DNA, 101 bp, rice(Oryza sativa)
  misc_feature (71): n=a or g
gagtagctactgatgaggacaaaatcatggctgttcggaattggattactcctacatcagtcaaagaattncgcagttttcttaggttatcaggctattac

SEQ ID NO: 46375 - DNA, 101 bp, rice(Oryza sativa)
  misc_feature (71): n=a or g
gtgggacgacgtcccccattgccacgttagcccatccacgtttgcctttctgccgcggtggcatggtgacngcgccagggtggctgactctgtcatgttgg

SEQ ID NO: 46376 - DNA, 101 bp, rice(Oryza sativa)
  misc_feature (71): n=a or c
ccctattcaccatacaactatttccaattgtatatgctatcaccagtatttcactgaaccagctgatttgnctatggatctattcctctatatcataagta

SEQ ID NO: 46377 - DNA, 101 bp, rice(Oryza sativa)
  misc_feature (71): n=t or c
gagcaggtagcggccggattggttccccaacagaaggttgagcggccttgcgaagttgcgatacatgcacngccggatgaatggtacagtcctccggaagc

SEQ ID NO: 46378 - DNA, 101 bp, rice(Oryza sativa)
  misc_feature (71): n=t or c
caatcagcagcggcatcgtccgacgtgttctatagagaccatggcaaatttggcggtggctctaacaatanatgtaaagagacaaaaatagtctctagtta

SEQ ID NO: 46379 - DNA, 101 bp, rice(Oryza sativa)
  misc_feature (71): n=a or g
tgtgctcgttggtgactgattattaccggactctttttacctctcagcaaggtacccggtgcgatgagctnctacagcaagttccaacaaaggtcactgat

SEQ ID NO: 46380 - DNA, 101 bp, rice(Oryza sativa)
  misc_feature (71): n=t or c
atacatcagtcagtgatgatggacagaatcacgtgaattctgacctttgatttgctctataattcgtgtcncgacggatctacagaaggtggaaagtcgac

SEQ ID NO: 46381 - DNA, 101 bp, rice(Oryza sativa)
  misc_feature (71): n=a or g
ttggtttatcaaccactagcacagcaaagcttacaaaagatgcaggttgtatggcagaattgaggattttngcaaagatgcttatgaatgtagtcctatca

SEQ ID NO: 46382 - DNA, 101 bp, rice(Oryza sativa)
  misc_feature (71): n=a or g
tttgagtaataaccagaatccaaataccaggctataccatgagctcaatggtatgcatcaagccaccaacncagtgagtctgctgtatagttctatgttaa

SEQ ID NO: 46383 - DNA, 101 bp, rice(Oryza sativa)
  misc_feature (71): n=a or g
aaattggatccaacatgttggagacatgacacgagaaccttcgaccgaggttgctgaaactagataggccnaggtgaatagctaaccgaagaccaaggttt

SEQ ID NO: 46384 - DNA, 101 bp, rice(Oryza sativa)
  misc_feature (71): n=t or g
aatcgccacacctacatccatacagacactataatgaggaactaaactcaataatcatgctagtttcgacnttctgacatctccagggagaagatttgtcc

SEQ ID NO: 46385 - DNA, 101 bp, rice(Oryza sativa)
  misc_feature (71): n=t or c
ggaatatctcaaataaatgaatgttcacgtgcactgtcggatttgtggtgcaatcaaggccatcctctgcnttcgcccttcgtggtacaacgtcaaagttt

SEQ ID NO: 46386 - DNA, 101 bp, rice(Oryza sativa)
  misc_feature (71): n=a or g
caaaggaagcaagtttcagcaaactaaatggtttcacatttgattgccgtgtgccttgggtaacctttaangaagaagctatgccaagtctgcaatacctc

SEQ ID NO: 46387 - DNA, 101 bp, rice(Oryza sativa)
  misc_feature (71): n=t or g
aatctgccacacctgactcatcaagtgcaccgtctaagtcatctgcaactgcttctctcactggttctttngatcgccctaaatcagtaaaaggtatgtga

SEQ ID NO: 46388 - DNA, 101 bp, rice(Oryza sativa)
  misc_feature (71): n=a or c
accgtggaagccctgaaaacttgtcgatctgtttcatcacaaggaagggtagatccctgctaaggtttatntactgcagtacattcttgccagagccagcg

SEQ ID NO: 46389 - DNA, 101 bp, rice(Oryza sativa)
  misc_feature (71): n=a or g
tctacggtcaccagtttggccaaaaaagcctactccagctagctttacctgccatctagaagtagctttcnttagggtacaacttcacaaccataaattta

SEQ ID NO: 46390 - DNA, 101 bp, rice(Oryza sativa)
  misc_feature (71): n=a or c
gggtggggaagtggggaagagagaaggggatttagggtttagttggctatcggttgcattatatacccacnatagtttttgtgtaggttttggcttgaccg

SEQ ID NO: 46391 - DNA, 101 bp, rice(Oryza sativa)
  misc_feature (71): n=a or g
ggacagccgcgatagttccaggggggattcgtactttttcctttgcgaatttgcgatgattatgaggcccnggctattgctgctgactttgtgccgatgga

SEQ ID NO: 46392 - DNA, 101 bp, rice(Oryza sativa)
  misc_feature (71): n=t or c
ggattttaattgaagtcacatgaattgcaaatatagaagaatgctccaaaaggaaagtccaagccgcaacngaagctgaagctacagctgccgtgcgcacc

SEQ ID NO: 46393 - DNA, 101 bp, rice(Oryza sativa)
  misc_feature (71): n=t or g
ctcatctaggaatcacaaatcctttacattgatggataaagtaaaaaaaacatagtcccttatatttaccnatagagaaagtaatcattgcaaataaataa

SEQ ID NO: 46394 - DNA, 101 bp, rice(Oryza sativa)
  misc_feature (71): n=t or c
cagatagactccacctttgacttgctgactagatgagactaacgacgacatagctaccgccgtcgctaatnagatcgactcttcgatccgagaaatcgcac

SEQ ID NO: 46395 - DNA, 101 bp, rice(Oryza sativa)
  misc_feature (71): n=a or c
actatcatttcagcacgtgctcacaattcaattctacagcatgtcatggctatgttctatattgcctgaantcgaaaagatacttacagcaagtataataa

SEQ ID NO: 46396 - DNA, 101 bp, rice(Oryza sativa)
  misc_feature (71): n=t or c
tttacgattcaagacaagaaccatcaaaaatgtattaaacctgcttagattaggtcatatatacaataganttttttgaactagaacaaattatttcattg

SEQ ID NO: 46397 - DNA, 101 bp, rice(Oryza sativa)
  misc_feature (71): n=a or g
tacattgtgaaacgaagggagtaatgttttagtaagtttattttgagatgtataaacctaggttgtgttcnttggccatggttgggaaccttaccctcccg

SEQ ID NO: 46398 - DNA, 101 bp, rice(Oryza sativa)
  misc_feature (71): n=t or c
tgtctgcataggatacattcctgcattccatagtacaaaccagaccaaactaataattatgtactcctctnatacttttgtaatgtaaatgtgataaatca

SEQ ID NO: 46399 - DNA, 101 bp, rice(Oryza sativa)
  misc_feature (71): n=t or g
cggctgtcgccttgcctgtgctccttaccgttgcagtaattgaccgagtaggatcaggttggtttggtttntggcctaaatagaccttaccaaattttatc

SEQ ID NO: 46400 - DNA, 101 bp, rice(Oryza sativa)
  misc_feature (71): n=t or c
tgccgtccgacggaacgaaaaatatcggacgcttccatcctaccgcgcagaaacagtcaacgctgaaacanatcggcatccatccatccagacttatccat

SEQ ID NO: 46401 - DNA, 101 bp, rice(Oryza sativa)
  misc_feature (71): n=a or c
acaggaaggtcccacacatacaaaatgcagcgacttattaacgcatgattaatcatgtactccctccattncataatataaggcacagccacttttttcag

SEQ ID NO: 46402 - DNA, 101 bp, rice(Oryza sativa)
  misc_feature (71): n=t or c
ttttcatacaaaaacaacatttcaaactaccgtttcaattcctccgagtcaaattcccttaaggagatacnacataaaaatcttaatcttaagaggcatct

SEQ ID NO: 46403 - DNA, 101 bp, rice(Oryza sativa)
  misc_feature (71): n=t or g
catattgtaaaaaaattatcaaagtcggtggcctattatagagagataaagtcaatgacgccaaatcgttnaactggagtaaactcaggagtatagaatag

SEQ ID NO: 46404 - DNA, 101 bp, rice(Oryza sativa)
  misc_feature (71): n=a or g
acagaagcaacaaagaagcaagtaacaaagcaatgcgatatctctatttaccttgtaagctagcagagctntagctgcattacctttcaactagcaatcat

SEQ ID NO: 46405 - DNA, 101 bp, rice(Oryza sativa)
  misc_feature (71): n=t or c
cccagcgccaggatgtagtgctggaatcccagtatgatcgcctcccctgaaacagcaaaaatccaagacgnggattcagaatgcgaaatcccgagcaggaa

SEQ ID NO: 46406 - DNA, 101 bp, rice(Oryza sativa)
  misc_feature (71): n=a or g
aaaatgtggagatgcaaccacactatataaggaaggaaggatatatatgattcaattttgctatatatttntcgacaaattttcttccaaaaatttaacag

SEQ ID NO: 46407 - DNA, 101 bp, rice(Oryza sativa)
  misc_feature (71): n=a or c
catatggtacggtctgaccgggcgtcatgcacggtccgaccgttggctaggttctttgtataaccgattcntgtggaatcggctgtgtgaacgcccgttga

SEQ ID NO: 46408 - DNA, 101 bp, rice(Oryza sativa)
  misc_feature (71): n=t or c
attttgttttttctcaccttcacactcttatgagatctaagagctacaaccagggctgggttttcgctttngattttgctcaaaatttcggccatttcagt

SEQ ID NO: 46409 - DNA, 101 bp, rice(Oryza sativa)
  misc_feature (71): n=t or c
aagtgattttgtggttttctttttccatttaattttttaggagccacgtggtttttggcagtcaccattgnactcgccaataacctcccagcggatggtag

SEQ ID NO: 46410 - DNA, 101 bp, rice(Oryza sativa)
  misc_feature (71): n=t or g
ggcattcgccttcttcaaagtctccgccaccacatgcctttcgtcttccttgtggtgaaattcttcttcgnacttgcgaaggcgaaggcgatacccatcta

SEQ ID NO: 46411 - DNA, 101 bp, rice(Oryza sativa)
  misc_feature (71): n=a or g
aaaattctcagatttttgccatagattcgtgtgaagatttgcctcttgtacttcaccttttccgatattgnttttgctatttcacttatatgatagaattt

SEQ ID NO: 46412 - DNA, 101 bp, rice(Oryza sativa)
  misc_feature (71): n=a or g
ctcaaagcctcaaacagcccttcgtcaagattgccctaaaggtgggttgctatacaacagaatcctatttnaacatgatgatagcgattaggtatcaggtt

SEQ ID NO: 46413 - DNA, 101 bp, rice(Oryza sativa)
  misc_feature (71): n=t or c
gcaaagttgagtaagagcaagttagaggtgaatccgtgaatggatcatggatgaagaatgcatgttagggntgcgtttcaagatcgatccagtgcggttct

SEQ ID NO: 46414 - DNA, 101 bp, rice(Oryza sativa)
  misc_feature (71): n=t or c
gattcagggtcccggtttgcaacctgagactaaaggggttgcaaattaaaccggcactaaaaaccacttcnccagcagtgatatcaatttatgtagccaca

SEQ ID NO: 46415 - DNA, 101 bp, rice(Oryza sativa)
  misc_feature (71): n=t or g
cgctgagggacctcgggtgtccggttttgtaaagttaggggacctcgggtgtctggtattgcgattcaagnatgttttttaatctcggtgacaagttcagg

SEQ ID NO: 46416 - DNA, 101 bp, rice(Oryza sativa)
  misc_feature (71): n=t or c
aattgaatcacaagttgagcccagcagatcttcatgtcagtgatggcccacaaaaatggcaattgcacagntgcataactaaaattccattgtaccaaatg

SEQ ID NO: 46417 - DNA, 101 bp, rice(Oryza sativa)
  misc_feature (71): n=t or c
actgtttccaaggattcgacacccattatttttgttcgcatcaaatacatccttgttgtcaagactgattncaagaattcggaattctttttttctcttat

SEQ ID NO: 46418 - DNA, 101 bp, rice(Oryza sativa)
  misc_feature (71): n=t or g
tgcttatggaacatgcttgattcactctagattcagacatctgcctcttgttgaggcatacttcgttactncttgttgctagttgcttccggagatcaagg

SEQ ID NO: 46419 - DNA, 101 bp, rice(Oryza sativa)
  misc_feature (71): n=a or g
ggagttaacaagtaattgtttttaggcatgacctgctggatctcctatatatctagatctgctgtttgttnttcgccactctgatgcatgccttacctgac

SEQ ID NO: 46420 - DNA, 101 bp, rice(Oryza sativa)
  misc_feature (71): n=t or g
cctaataagcataagcatgtggtgtctaccctgttttgtagctgggctaaatgtctttctgtaaaaagatnttcaaagcaacgctaacaatacttggcatc

SEQ ID NO: 46421 - DNA, 101 bp, rice(Oryza sativa)
  misc_feature (71): n=t or g
tatattatgaaatggagggagtaggaatttaacctattaaacatggaacttagccaaagatttgaacttangaaacagggtgttactcagatcactacaac

SEQ ID NO: 46422 - DNA, 101 bp, rice(Oryza sativa)
  misc_feature (71): n=a or c
actctcaaagtagtagagataatacatggtagcttgaggcatcactagcagcagcaacaaacaattctcancggttatacactatcagtgttgaagggaat

SEQ ID NO: 46423 - DNA, 101 bp, rice(Oryza sativa)
  misc_feature (71): n=t or c
ccctccacctgcgctctcccctgaacgctctctttcggtgcgccccgcacctcgccttcctccctctcacnacgctcacccttctcagcacaggagctagc

SEQ ID NO: 46424 - DNA, 101 bp, rice(Oryza sativa)
  misc_feature (71): n=t or c
ttctctcctccatctttgttaattcatatattaatttatagtgcagaagggctcatgtggattttatctgntgtttgcatatcttgtcagttgcaggatca

SEQ ID NO: 46425 - DNA, 101 bp, rice(Oryza sativa)
  misc_feature (71): n=a or c
tcagcacagcgacgataaacagtaagataacatgccaaatttcaccggaaagactactggagcatgtgtanaactaacctactttttagactttttaccct

SEQ ID NO: 46426 - DNA, 101 bp, rice(Oryza sativa)
  misc_feature (71): n=t or c
gtatttgttctaacaaatttgatattggtggcccctctccaaatacgtctacatttgttcttaaaaatttnagtgcaaagagtgtttcttaacatgcgcca

SEQ ID NO: 46427 - DNA, 101 bp, rice(Oryza sativa)
  misc_feature (71): n=t or c
gacaacgaattctttttcagtcatcatttaccctcgatcgagacaattaacaaaacctcgaacagaataanccaggctcctaattttcctttttcaaattt

SEQ ID NO: 46428 - DNA, 101 bp, rice(Oryza sativa)
  misc_feature (71): n=t or c
ctgacttggctatgctatgatgacgcccatgtgttagatgaaacctatatgacagtcacatataagcaatntaaaattaaatgtttaattgtaagaaatac

SEQ ID NO: 46429 - DNA, 101 bp, rice(Oryza sativa)
  misc_feature (71): n=a or c
gagatgaggatgaccttgcccccttaactagattattgactatgtgatcgttgatttatttctcctttatnaaccaggttttgttatttacttctattgtt

SEQ ID NO: 46430 - DNA, 101 bp, rice(Oryza sativa)
  misc_feature (71): n=a or c
aatcatatattgatgcctaaatcaatacagcagaacatgctagatcgatgcctaggtcaacaaaatcatcntatctaaaaattgaatcaaaccggaaagat

SEQ ID NO: 46431 - DNA, 101 bp, rice(Oryza sativa)
  misc_feature (71): n=t or c
ctgtttattcatcataattatgactctaacattgttgaacgaaagcttgacttacatttactgttcttctntcaatcgaacttcattctttcatatagata

SEQ ID NO: 46432 - DNA, 101 bp, rice(Oryza sativa)
  misc_feature (71): n=t or c
ctagctcaaggtgcatctggatacaagctgattttgaaagatgtagagattgaaattgttgctatacaagncgatgattggaggtatgaaatgtttgaata

SEQ ID NO: 46433 - DNA, 101 bp, rice(Oryza sativa)
  misc_feature (71): n=a or g
agaaagcccgagtgatcgctgagttgtgatcacaccaaagcctaagcttttacttttctttttacgaacangcgacaacgtaccaatttcattgaatatag

SEQ ID NO: 46434 - DNA, 101 bp, rice(Oryza sativa)
  misc_feature (71): n=a or g
gaggcgtcggtatgactgaactttgtttgccgagcaattttatcctatgtttggttgagctgtagtctttnaaaaagtagatgtgggttatggcttttcga

SEQ ID NO: 46435 - DNA, 101 bp, rice(Oryza sativa)
  misc_feature (71): n=t or c
atagtttgttcctcattgtgagtagcaactgcagcccatagtggtccattgtgatgtggacgagggttacngatcttccgaaaggttctaataggcagtca

SEQ ID NO: 46436 - DNA, 101 bp, rice(Oryza sativa)
  misc_feature (71): n=t or c
gtactgttgtgtatcagggcaggccgtttacctttactatccacagctccattgcttctgatctgaacaanagactcccacagaccctgcagaaagaccac

SEQ ID NO: 46437 - DNA, 101 bp, rice(Oryza sativa)
  misc_feature (71): n=t or c
tcgttgtgctccatcaagatatatatattcttgcaatcaaattagtcctgataaacacctaggggtcttcnggctagctccacaatgtggtgggctagatg

SEQ ID NO: 46438 - DNA, 101 bp, rice(Oryza sativa)
  misc_feature (71): n=a or g
aaaaaggagcctatgacacatgagcaagcgagttagtaatgtgtggtttgccatgttagtttttctggctngctagctagttaatttcatgaccagttctc

SEQ ID NO: 46439 - DNA, 101 bp, rice(Oryza sativa)
  misc_feature (71): n=t or c
gctgcacaaaagcaaccatagaaaaagattctgcattcagtttttagaaggggcagaaatttaaaaaaatngcgcagcattttgtgaagaaatctaaaatt

SEQ ID NO: 46440 - DNA, 101 bp, rice(Oryza sativa)
  misc_feature (71): n=t or c
ctgtggtatacctgtaaagaagcaaggggggagtgacagcgagtagcaaaaccgctgaaacccatagcacngatcttgatgtgataaataacattgataat

SEQ ID NO: 46441 - DNA, 101 bp, rice(Oryza sativa)
  misc_feature (71): n=a or c
cgatattctttgtcccgtgaagttggaactgtaccaaacgctttcgagatccttactcgctatttttatcntgtagaattgatgctgtaccaaacactttt

SEQ ID NO: 46442 - DNA, 101 bp, rice(Oryza sativa)
  misc_feature (71): n=t or c
ccacgccgctcctccttgccataaaccgctagcggaacacggtggtgcagattggcgacgatgacattagnggctccgctaggactggagggaggggggta

SEQ ID NO: 46443 - DNA, 101 bp, rice(Oryza sativa)
  misc_feature (71): n=t or c
ttaattgcatcacattctattagattcacagagctcttgctgaggttcaccttcagtccggtggctccacngaagttgtgtaggatagaaatcaggttgtc

SEQ ID NO: 46444 - DNA, 101 bp, rice(Oryza sativa)
  misc_feature (71): n=t or c
ttcagatcttcaagttaatccacagtgttaaggtatgtattgcttgttttctgtatttctctcgtgtttanaatcgtctcccaccactcctacactgtagt

SEQ ID NO: 46445 - DNA, 101 bp, rice(Oryza sativa)
  misc_feature (71): n=t or c
ttaccttctatgcaagatgtgatagactatcaaactcctgagactagaatttctccttgattggagctatnaaaccctgaaaagccaaatcagctaactgg

SEQ ID NO: 46446 - DNA, 101 bp, rice(Oryza sativa)
  misc_feature (71): n=t or c
ggtcagtcacccactctacggcccacggcggcggaggctcgccagagaaatggaagaagatagtaatactncttcagttataaaagacgttttgactttga

SEQ ID NO: 46447 - DNA, 101 bp, rice(Oryza sativa)
  misc_feature (71): n=t or c
gtactatttgagagggacctatatcgaattacagaaaaatagaaggaccttttagcaaaaaaaccacccgngcactgttcctatccgacgtggcatagccg

SEQ ID NO: 46448 - DNA, 101 bp, rice(Oryza sativa)
  misc_feature (71): n=t or g
gagttcgaccattcctggaacgctgcttcccttagacgattctaagtgtaatatgagtggaacccaatttnccaattgtaaatatgtatatattatataag

SEQ ID NO: 46449 - DNA, 101 bp, rice(Oryza sativa)
  misc_feature (71): n=t or g
ttggccatctatacttgaagggacgaggcttctctgtttccttcgtccatacacattattttcctcgattntgcatatatgtatacgcgtttgaaaatttt

SEQ ID NO: 46450 - DNA, 101 bp, rice(Oryza sativa)
  misc_feature (71): n=a or g
ggggtggatctttttttttcttttggtcggttttttattttcagttttgggacaggactagaggagtaganggggcaagggcgtgtgcccaggcgccgatt

SEQ ID NO: 46451 - DNA, 101 bp, rice(Oryza sativa)
  misc_feature (71): n=t or c
aaagatgcaaactctgttcttctaatctacaggttaaatgtcattaactctaatgagaacttcattttccnattgtgctcctaggtttaacaattggagtt

SEQ ID NO: 46452 - DNA, 101 bp, rice(Oryza sativa)
  misc_feature (71): n=t or c
gtgatttggtatccacaggaataaatgatcaaggcatagcgatcaagggtggacatttgcattattctttncctcttgcacctttgccgccaccttggtga

SEQ ID NO: 46453 - DNA, 101 bp, rice(Oryza sativa)
  misc_feature (71): n=a or g
gaagctctgctgtttcttctttcgagcagaactgaaatatataatatacaaactcttcgttacaacagctnctacattgtaaacaaccgcaactagggtac

SEQ ID NO: 46454 - DNA, 101 bp, rice(Oryza sativa)
  misc_feature (71): n=t or g
tttacaattgaaggacacgtatcacatccaacctaaaaatagttgaggaactcaaattgtactattttttnagggtttttatataccagtatctcgttcaa

SEQ ID NO: 46455 - DNA, 101 bp, rice(Oryza sativa)
  misc_feature (71): n=a or c
gaaggagtcctccagcgttgtcgaataacatagcgcatggcggcaatatcgttgctgccatcatgcccacnagtgaatagcaatgcctccgtgaatcccat

SEQ ID NO: 46456 - DNA, 101 bp, rice(Oryza sativa)
  misc_feature (71): n=a or g
aagctggtacctctccaatactacagtcttagtccacaaattaatgctgaaaatctttgtacatccccaanaactgtaaaattattctcatgaattaactt

SEQ ID NO: 46457 - DNA, 101 bp, rice(Oryza sativa)
  misc_feature (71): n=t or c
ttctaggcatggggtctgtctttgaaagagaatcgtagctaccatcagtaactatacacgtctatttctanatggtatccactttaactataccatttaca

SEQ ID NO: 46458 - DNA, 101 bp, rice(Oryza sativa)
  misc_feature (71): n=t or g
aaaattatcatgctatatatttaatgaaatgagcacatctaagcgccgattggttccaaaaaaaaaaatcnttcttttcaagagatcaacgaaagaaaggt

SEQ ID NO: 46459 - DNA, 101 bp, rice(Oryza sativa)
  misc_feature (71): n=a or g
acatcacacatactccacctgttccaaaaaatataaatatcgtactaatcaagacatatattatggtactntattggtttttttacagagagagtatacta

SEQ ID NO: 46460 - DNA, 101 bp, rice(Oryza sativa)
  misc_feature (71): n=a or g
gtgctgacgcgccgccaccccctccctccacatgtcggcacaccactgcccgtgcttccctcctcccttcntgcgctgaccgccccacctccctccttgcg

SEQ ID NO: 46461 - DNA, 101 bp, rice(Oryza sativa)
  misc_feature (71): n=t or c
caggcgcgtacgcgctgctagccctcactttcctgaccacctaattatctatattagttaacacttaacantaatgatagtaattagaaaatatttttaag

SEQ ID NO: 46462 - DNA, 101 bp, rice(Oryza sativa)
  misc_feature (71): n=t or c
ccagctttggcgctacctcattgatgctgaacccaccgcaccactcgtagctgtagaaccatgtcgtgaanagcacgagcgcaacattggtgaagccaagc

SEQ ID NO: 46463 - DNA, 101 bp, rice(Oryza sativa)
  misc_feature (71): n=t or g
gatcaacatacaagagtaagctagaacaataattgcacgcacaaaggcgattaagattcagttttacacancatgtcttgggagtacaagaggtcctactc

SEQ ID NO: 46464 - DNA, 101 bp, rice(Oryza sativa)
  misc_feature (71): n=a or c
ttgccgtttgcaccctgctgttttgtgggcttaattaaatatttacatttatgtttctcccgctaacaatnaatacatgcaatccaaacatgtacagtgct

SEQ ID NO: 46465 - DNA, 101 bp, rice(Oryza sativa)
  misc_feature (71): n=a or g
ataacttgcgatcgtaggtgcagttcatatgagaaagttatgacattcgtagttcaaccttttctcagaancccggaataagttatacaatacttgtcttt

SEQ ID NO: 46466 - DNA, 101 bp, rice(Oryza sativa)
  misc_feature (71): n=a or c
agaccggcccccctcctctactcgcacggctcgcacctcgcaaatccaaccatgtcgcaactcacgtcctncatccgttccaaaataaaccaatctcgtgt

SEQ ID NO: 46467 - DNA, 101 bp, rice(Oryza sativa)
  misc_feature (71): n=a or g
tgtgacacaatggcatgatgtgcgtcattgggctataactcgcattagtgcatgacggatgtgccaagcgnagatcattagaatgtaacacttttgttccc

SEQ ID NO: 46468 - DNA, 101 bp, rice(Oryza sativa)
  misc_feature (71): n=a or c
acccttataagattggactttggaaccaatcacacaatggtcgaactttgcctcgttactcctatgcagantattgtctctcgttgattgcttgcttgccg

SEQ ID NO: 46469 - DNA, 101 bp, rice(Oryza sativa)
  misc_feature (71): n=a or g
caaaaaatcatacttgcctgcttagtggaaaacacctcttttgagaaaatcgttgtcgaaacatgaattcngcaataataaaacggggtagcgcacgagac

SEQ ID NO: 46470 - DNA, 101 bp, rice(Oryza sativa)
  misc_feature (71): n=t or c
taaaaagatacctcagtgtcttgtgtgggtgatatgtgtggatcagtggatggatcgacatgcttgttcgngacgaataactacaaaatttagtgccaccg

SEQ ID NO: 46471 - DNA, 101 bp, rice(Oryza sativa)
  misc_feature (71): n=a or g
tgttttgcttcatatgtcgtcttgggcagcgagttctcctcaaaaaacaaggcattcaacaaatccatcanttgtatcaaactcttgtctatccatccatt

SEQ ID NO: 46472 - DNA, 101 bp, rice(Oryza sativa)
  misc_feature (71): n=a or g
ggtatagatcgcacgtagcactgttcatagcactgtagcaatagatactgtagcacaaagtactgttcacntgattgctgtagcaataaatctaaaccatt

SEQ ID NO: 46473 - DNA, 101 bp, rice(Oryza sativa)
  misc_feature (71): n=t or g
tggcttaactgtttgccacttttattcatgcggcatgccaatgtggcaacccagtgtaaaaattaatgtgngacccacttgtcagtctcacagctcccctt

SEQ ID NO: 46474 - DNA, 101 bp, rice(Oryza sativa)
  misc_feature (71): n=t or g
cggtagtgtgagttcccaactcccacatttttcgttttttgtgcgcacgctcctcacgaactgttgaacgntatttttttgaagaaaaaatttctatacga

SEQ ID NO: 46475 - DNA, 101 bp, rice(Oryza sativa)
  misc_feature (71): n=t or c
tgtgtgataatgtatgagcttatgcgtcttccctgtaatctcaaaaaaacagctatattgatggcaaatantgaaaccatttattttatttttctattttg

SEQ ID NO: 46476 - DNA, 101 bp, rice(Oryza sativa)
  misc_feature (71): n=t or c
gaaagaaaaaccatggaaattctagaacttttgcctgccaatataatagactatgatgaagaggggaaaanggattgttgttttatgcctagctcatctgc

SEQ ID NO: 46477 - DNA, 101 bp, rice(Oryza sativa)
  misc_feature (71): n=t or g
aactccggccgctgccccctaacgagcaacagagaggtgggtgcccatagctaggaccagtcccatcaccnccggcgccgccgcataagctccatcactgt

SEQ ID NO: 46478 - DNA, 101 bp, rice(Oryza sativa)
  misc_feature (71): n=t or c
tcatttgtcttattcactgtcaaatggtactttgaactaaaaaaattcttaccacattcaattattcgcgnggcgcggctctaattactagttaaatttcc

SEQ ID NO: 46479 - DNA, 101 bp, rice(Oryza sativa)
  misc_feature (71): n=t or g
acaaaaaaaaactgcttttgtacctgaacattcattatttcctaagtcagatgacttttgtctgtgttttnctgttgctaatacacctttctcttttatgt

SEQ ID NO: 46480 - DNA, 101 bp, rice(Oryza sativa)
  misc_feature (71): n=t or c
tcggtacgcacccatatgtccatctcactcccacctctagtcgagatcccatttgatttagattattgaanggaccatttacttgaatattgggatatatt

SEQ ID NO: 46481 - DNA, 101 bp, rice(Oryza sativa)
  misc_feature (71): n=t or c
aaaggagaatcaaatggtcggtccgcctgtagtctgcttgagcgagtcttcgtttccgagcttcgactttngcgtgtgcccttctgctgactaacatcttg

SEQ ID NO: 46482 - DNA, 101 bp, rice(Oryza sativa)
  misc_feature (71): n=t or c
atggccggccatatattcgatcgctttgatccataatccattgttgttcatgcatgcatgcatgtgcatgnaatggactcgcctgcgtacgtacgccgcgt

SEQ ID NO: 46483 - DNA, 101 bp, rice(Oryza sativa)
  misc_feature (71): n=t or c
gaaagcagccttatcaattttattcggtacgtagtagcctaaccagtactatgtattactccctccttccntaaatgtttgacatcgttgacttttttaaa

SEQ ID NO: 46484 - DNA, 101 bp, rice(Oryza sativa)
  misc_feature (71): n=t or c
tccatacctgctccattggtggtgtgcacatgatcattacccttgtatttgtcgcggatggaaagtttgtngagctcgctggtgatgtgatctgtggcacc

SEQ ID NO: 46485 - DNA, 101 bp, rice(Oryza sativa)
  misc_feature (71): n=a or g
gattccttgaaataattctgtgatgatctgattccttgaaataattctaagacctgggcgagaaaggcccngggtcttcctggctagcaacgcaagctgcg

SEQ ID NO: 46486 - DNA, 101 bp, rice(Oryza sativa)
  misc_feature (71): n=a or c
aagtgggcttttaatttctttatggttgtgggcttttaacatagacatgtgcacatggacctaactacacnggccccatggggattcggggacggggagct

SEQ ID NO: 46487 - DNA, 101 bp, rice(Oryza sativa)
  misc_feature (71): n=t or c
atgcatgaataatagttaaaggcaaaatgcaattaagaccatgttaagctagccaatttatacaaggagtnaccggtggagaaaccatctttactcccggt

SEQ ID NO: 46488 - DNA, 101 bp, rice(Oryza sativa)
  misc_feature (71): n=a or c
gcaatgcaagctgcatccatgcatgctgatcgagaggttaacgacctacctactagctagagatcgagagntagctatctactagcgggaccatgcatatg

SEQ ID NO: 46489 - DNA, 101 bp, rice(Oryza sativa)
  misc_feature (71): n=a or c
agtatttttctgaagtgatatattggcaatggcacggatcaacccaatttttattgcatcactctatactnccccgttcaaaaaaaaccaaattattattg

SEQ ID NO: 46490 - DNA, 101 bp, rice(Oryza sativa)
  misc_feature (71): n=a or g
aactagggtttttgcgggagtggagaagacgagaggcgcttgggggctggagaatttttccactacaggcngacttcaaatgaatccccaaaactccctta

SEQ ID NO: 46491 - DNA, 101 bp, rice(Oryza sativa)
  misc_feature (71): n=a or g
ttctataacactgaaagttcccgacatcagatatatgcaccgaaagattctaattcactttaatagcatcnaaagttaacctccgttcttcacagtagcac

SEQ ID NO: 46492 - DNA, 101 bp, rice(Oryza sativa)
  misc_feature (71): n=a or c
ttttgatatataaagaaaagtgcatgtactgtgacaaaacacttgagtggctcagtggttagtccttaggnttattgttcatgtagttgtaggttcgaatc

SEQ ID NO: 46493 - DNA, 101 bp, rice(Oryza sativa)
  misc_feature (71): n=a or c
agtggttttgtgttttcctgaagaaatttgagttctttctttttcttggagctgttctagcagtctaggtntcaagagtgaagcagcctgcttccactggc

SEQ ID NO: 46494 - DNA, 101 bp, rice(Oryza sativa)
  misc_feature (71): n=a or g
gaagagattcgaacaagtgagcggggcttaaggctgtgttcttacccaagtttcccaacccatctcccttnttttccgcgtgcacatttttcaaactgcca

SEQ ID NO: 46495 - DNA, 101 bp, rice(Oryza sativa)
  misc_feature (71): n=a or g
cgacaataaatggagctgagaggacgacaatattgatcatttgttcggagagcttctctcatattaccgantaattttaccatccaacatttagtatctcg

SEQ ID NO: 46496 - DNA, 101 bp, rice(Oryza sativa)
  misc_feature (71): n=t or g
gtttgcagtttgagacggcaaaagtgtcatttcaggactggaagcgcgaccatatcctccaatctgtcttnacagttttcagatttttctgacaccatgct

SEQ ID NO: 46497 - DNA, 101 bp, rice(Oryza sativa)
  misc_feature (71): n=t or c
agcacaataaatagagggaaaaaaatgttgatcttgccacaaacacccaactacatggccaatttgtaggnggttattgcgaccaatttgtcccacttatt

SEQ ID NO: 46498 - DNA, 101 bp, rice(Oryza sativa)
  misc_feature (71): n=t or c
gaattcttaatgcgggtaagttgtaatactcccttcagtttttaagttatgatgtcattatatttttatangtttgagctttcgtcttatttaaaagtttt

SEQ ID NO: 46499 - DNA, 101 bp, rice(Oryza sativa)
  misc_feature (71): n=a or g
attagctacatggttgatgcaaaaaaaggaaagaagaactccagccaaattgaaaatatccaccaattgcncctgtcttataatagatacttgcaatggat

SEQ ID NO: 46500 - DNA, 101 bp, rice(Oryza sativa)
  misc_feature (71): n=t or c
tataccactatactacataaatgatcttttcatgccgacaaaaactaattttcacaggcgagtgagcactngcctggagcgccaggtgtctgcaaaaatcg

SEQ ID NO: 46501 - DNA, 101 bp, rice(Oryza sativa)
  misc_feature (71): n=t or g
cctcctcgttgttgttgcggagaaagaccgtattcacgtctagttaaaatagatgcaagtcccctcggccnctactatatcgagaatcattcggatggttt

SEQ ID NO: 46502 - DNA, 101 bp, rice(Oryza sativa)
  misc_feature (71): n=t or g
agtttccaaactcatgtacatctagcgcacgtaataatggtatcgtgcgcatcttgttcttaacagatttnccttgaatccagcgctataaaaacgagagg

SEQ ID NO: 46503 - DNA, 101 bp, rice(Oryza sativa)
  misc_feature (71): n=a or g
ttagttagttgataacattatcaaatttcgatatgatagattaaatgtgttgttgccaaaaattttaggcngtaccaatatttagtaacaaactaaataca

SEQ ID NO: 46504 - DNA, 101 bp, rice(Oryza sativa)
  misc_feature (71): n=a or c
ttcgcatatatcagcttttgcaaaaagggctagctaagctagcgtaatctctgctattcattctggctcangacagccacaagattgccccaagaggctag

SEQ ID NO: 46505 - DNA, 101 bp, rice(Oryza sativa)
  misc_feature (71): n=t or c
ggctactatctgcatgaatatgataaggctactatctgtcgaaaatgggtatggatccctggagttccgtncaaatccactgggtggatttcactaaatcc

SEQ ID NO: 46506 - DNA, 101 bp, rice(Oryza sativa)
  misc_feature (71): n=a or c
aagttaacttgcttttgaatactcaagatgaatcataggaaaagaaaaacagcctgactcatactttaatnaacattcccttttccttacataactgccat

SEQ ID NO: 46507 - DNA, 101 bp, rice(Oryza sativa)
  misc_feature (71): n=a or g
gtgtgagagtgaactaataaaagaagattgttgatatttgtgtattagtaacaactaatatattgtacatnttacctcttaattaatgagtggatgatata

SEQ ID NO: 46508 - DNA, 101 bp, rice(Oryza sativa)
  misc_feature (71): n=a or g
tcccaaagccccttgtccgaccgttgggaggtggtcgctaggagcttcgagctccttgtgtgcgtagcgcnggagatgagggagagagcaccgacttgggg

SEQ ID NO: 46509 - DNA, 101 bp, rice(Oryza sativa)
  misc_feature (71): n=t or c
ggcgtcttcagtgcgacggggtcgagacgggatcactcaaaaatcggctaagatggataataaactatggnggaaactggaaagcatcagtcgttttcgag

SEQ ID NO: 46510 - DNA, 101 bp, rice(Oryza sativa)
  misc_feature (71): n=a or c
tagggagttgcttgaaaggagggtagaaggcccagagggcggcagcggcgcatggtggatgtttttttgcngtcgtagcccgtcgatgacacttgcttgtg

SEQ ID NO: 46511 - DNA, 101 bp, rice(Oryza sativa)
  misc_feature (71): n=t or c
agctctaccaaaatcagtttgagaaggactttttgcaattcctccggatgcgatgcaaagagatcgtgccnagaggccggatggtgctaactcttgttggg

SEQ ID NO: 46512 - DNA, 101 bp, rice(Oryza sativa)
  misc_feature (71): n=t or c
cactgttttcacagggtattcctttatttgaatttaatacatatacagtgtaaaaaaagcatgtgcgcccnagcatggaaaattaattcagaattaatttt

SEQ ID NO: 46513 - DNA, 101 bp, rice(Oryza sativa)
  misc_feature (71): n=a or g
caggctttagccgattgtacttccctcatgaactgcgactttgcgtttgttagtagaaggcgatgtgtggntgtgttttttttgttgacagtctagctgat

SEQ ID NO: 46514 - DNA, 101 bp, rice(Oryza sativa)
  misc_feature (71): n=t or c
ttttttttcattaactcattcagcagcaattcaggctcacaaaatttgcctgaactaactcccaggcaatngcttgcggctaccaccttgctgatcgcatt

SEQ ID NO: 46515 - DNA, 101 bp, rice(Oryza sativa)
  misc_feature (71): n=t or g
tgtcaaattacaatgattttaaggaagcttagccgtgtggcagtaactttttttagatgcatttgcgattngacagtaataacttagtaaggacataattg

SEQ ID NO: 46516 - DNA, 101 bp, rice(Oryza sativa)
  misc_feature (71): n=a or g
taaagaaatagataaataaaggaaataaaggttttttgaatttgtataccttttcattacgagaaaaaggntctaagagtgtctatctaagactatccagg

SEQ ID NO: 46517 - DNA, 101 bp, rice(Oryza sativa)
  misc_feature (71): n=a or g
aatgtttagtcttaaattgataagctaaatattagtctagagtgacatgtttgaatccatggactaaaagntgaagagagagtagatagagagggagatag

SEQ ID NO: 46518 - DNA, 101 bp, rice(Oryza sativa)
  misc_feature (71): n=a or c
gtcactattatttgtgatatcggctgagtgccattgggtacgagtccgggtcaggtaacggctaggttggnctgtggaatctttcacaactgaagatgccc

SEQ ID NO: 46519 - DNA, 101 bp, rice(Oryza sativa)
  misc_feature (71): n=t or c
taaaagatggcatatctaatgagcccttaagaaaaaaaaaacaaaccgaatataatattgcttaggacctngagtgattcgattttgtaagtttagggacc

SEQ ID NO: 46520 - DNA, 101 bp, rice(Oryza sativa)
  misc_feature (71): n=a or c
aaacttatgtgggttaatcttgccaggcagtcagcaattaggccccaagtatatttggtttgagaagtganaactgattaaaattatcaagatctctgaaa

SEQ ID NO: 46521 - DNA, 101 bp, rice(Oryza sativa)
  misc_feature (71): n=a or g
cgtgcagccagtcgccggcctttgaccaggaagagaagattcagccaccgctcggttagccgccgccgccnccgccaccgcccgccggcgacgaacagacg

SEQ ID NO: 46522 - DNA, 101 bp, rice(Oryza sativa)
  misc_feature (71): n=t or c
cctaggttgctcctcccgcccccgatctagagtcgtgccggtcccagtagcctatcgtttccaatagtagngatgctgtggcctatggggtgagccaacga

SEQ ID NO: 46523 - DNA, 101 bp, rice(Oryza sativa)
  misc_feature (71): n=a or g
tatatgttggtcttttggattttattcagatgaaatcaaaatcccggtttatttttctcgaggtcgttccnctcgggtatgaaactattttaaaattcatg

SEQ ID NO: 46524 - DNA, 101 bp, rice(Oryza sativa)
  misc_feature (71): n=a or g
ttttccttcaaaatgtctacgaccaaaacgaggcctgatcaagtggaattcatgcctcatctcagttctcngtataacttcatagttacaagatgtttgtg

SEQ ID NO: 46525 - DNA, 101 bp, rice(Oryza sativa)
  misc_feature (71): n=a or c
atggagaaactgggaaaagtagcttctcagaatctaaaagctagaatatttgggggaagtttttttgattntgctagaaactgcatctgccaaaagctttc

SEQ ID NO: 46526 - DNA, 101 bp, rice(Oryza sativa)
  misc_feature (71): n=a or g
agaaagactatagtgtctctcattaaatggtgcgtaggtaagtgtacccgagttggggagtggttgtctgnttgagggtaaaatagggagaaatttgcatg

SEQ ID NO: 46527 - DNA, 101 bp, rice(Oryza sativa)
  misc_feature (71): n=t or c
tacgagtatgatgtagtagactccacgttttctctatattcagttaagacaaaaacgagaactctctgaanagattttacgtaatagtaattacgagaaaa

SEQ ID NO: 46528 - DNA, 101 bp, rice(Oryza sativa)
  misc_feature (71): n=a or g
ccatgaagaactaaacctaggaagttggaactcaacataaaattgaaatgagcaaagctactaatggacancaattgtacaaggagtctcaaatgcaagtc

SEQ ID NO: 46529 - DNA, 101 bp, rice(Oryza sativa)
  misc_feature (71): n=t or c
ggaggtcgttttagcgttgaagcaatgtctcacaaagagtgtcgctgagagcctgtcttcgtagttcaganctactctaccacaactcaactagtctgaaa

SEQ ID NO: 46530 - DNA, 101 bp, rice(Oryza sativa)
  misc_feature (71): n=t or g
taataagagcacaatttgaatgcatttgtatattattacggtgcagtccaaatgtatctgttgacaacttnttgtgacaagtcgacaagcacgatcgcgac

SEQ ID NO: 46531 - DNA, 101 bp, rice(Oryza sativa)
  misc_feature (71): n=a or g
agcactgctgtagtgataacgtagtaatgattatcatttagataaaaatgcagaagtccagatgtaggtgntatatgtggttcttgctatattttcttaaa

SEQ ID NO: 46532 - DNA, 101 bp, rice(Oryza sativa)
  misc_feature (71): n=a or g
tcagaattcagaaagaggagagaagggacttctgtattttgtggacccctttaaaactacagtactgtaanggcaattactataatgcttcatatgctacc

SEQ ID NO: 46533 - DNA, 101 bp, rice(Oryza sativa)
  misc_feature (71): n=a or g
ggatttcctggtgtactgtgacgcttcgtgccaaggtttggggtgtgtgttaatgcaagaaggtcatgtgntagcttatgcttcacgccagctacgacccc

SEQ ID NO: 46534 - DNA, 101 bp, rice(Oryza sativa)
  misc_feature (71): n=a or g
aatataaggctatcaatctgaacgtaaccttagcctctaaaagttttctatttttttaggctatctatatntttatcgataaattttattatagaaaattt

SEQ ID NO: 46535 - DNA, 101 bp, rice(Oryza sativa)
  misc_feature (71): n=a or g
caaatttcctctcggcggtagcgtgtgatagcgtaaagactacaatgaccgctgccatgaggctgaggctntgtttagttggatccaaagtttggattttg

SEQ ID NO: 46536 - DNA, 101 bp, rice(Oryza sativa)
  misc_feature (71): n=t or c
cattgccgatctgctggcaaccacactagctagcatccagtactatcctttcgatagcatgcacagcatcncgagagacccacaagagtgttcactgttca

SEQ ID NO: 46537 - DNA, 101 bp, rice(Oryza sativa)
  misc_feature (71): n=t or g
ggtggttaactcgtttctatttttccaatcttgtctctgcactgtgcaactattgtgtgtgtgtgtgtgtntttttttctctctctactgttttgttttgt

SEQ ID NO: 46538 - DNA, 101 bp, rice(Oryza sativa)
  misc_feature (71): n=a or g
ggtagccattacgacccatttaaatggatttggactcctaatttgggaggtcgttgagtactttgaattanactccgagcccctgtattttcacgaattaa

SEQ ID NO: 46539 - DNA, 101 bp, rice(Oryza sativa)
  misc_feature (71): n=t or g
atacatcgaatggactctagccaatcgacaaaacacactaatgttcaatcgcgtaggaaaactagaacagnagaattccatatgaaaattcattattgttt

SEQ ID NO: 46540 - DNA, 101 bp, rice(Oryza sativa)
  misc_feature (71): n=a or g
tggtaaattcaatcagttaggattaacataatacataatcaagccaagtcattctcatgctcctactccgnccggtagttcgccggaggagcagtgtgtac

SEQ ID NO: 46541 - DNA, 101 bp, rice(Oryza sativa)
  misc_feature (71): n=t or c
tctctcggtaccctcttaagtacatacagtataatcactccaatcaaatcttggtaaagcaatacagaggnaaaaggatttccacccaagaaaaaattagt

SEQ ID NO: 46542 - DNA, 101 bp, rice(Oryza sativa)
  misc_feature (71): n=t or c
aagatttcttattataccctggaaatggatttttgtcctttgaggggacatcctctcattttatgtatggngttcagaaagttattaaaaaatttattaag

SEQ ID NO: 46543 - DNA, 101 bp, rice(Oryza sativa)
  misc_feature (71): n=a or g
aatgaggcatgcagctaattaacaaatacccctaaaacacacatcccatcaaacagcatgcagcgagccantgtcagtctgtcagagcatgtatgtgttgc

SEQ ID NO: 46544 - DNA, 101 bp, rice(Oryza sativa)
  misc_feature (71): n=t or g
aaaagaaggaatacgacaaagtgatatttttaaaaaatttaacttgagtgtggaaggtgatgcatatttanaatttggtgttgtcaattcgaatagtttat

SEQ ID NO: 46545 - DNA, 101 bp, rice(Oryza sativa)
  misc_feature (71): n=a or g
tgtcttatatgttgggtctgccgatagctggggcagcagttggcctaacaatggtacatgttggatgggcngacgaccttctggccagttttggtgttgtg

SEQ ID NO: 46546 - DNA, 101 bp, rice(Oryza sativa)
  misc_feature (71): n=t or c
gataatcatttcagacttgtcaagatgaggcgatgaagtagagcaatccccaaatgatgcttccactttcngctgcatatttaagacattatttatttgta

SEQ ID NO: 46547 - DNA, 101 bp, rice(Oryza sativa)
  misc_feature (71): n=a or g
actattgggcagttgggggctgggcttaagttagttctgcagctgcgtttggcggttggcaacacgagcanaattttaaaatctatctgactatccggtct

SEQ ID NO: 46548 - DNA, 101 bp, rice(Oryza sativa)
  misc_feature (71): n=a or g
ttcttgcattaaggctgcactgacagcgacggacgaagctgcaagatagagcaacagctcacttcctgccnctgggctaaccaatgctagcggactctgca

SEQ ID NO: 46549 - DNA, 101 bp, rice(Oryza sativa)
  misc_feature (71): n=a or g
catatcaaaacccagagaaaagcaaagaaaaagcgaaggaaagaaagcaagcaagcatctaagtaaaccanaccaccattgttattattcaaatcactgaa

SEQ ID NO: 46550 - DNA, 101 bp, rice(Oryza sativa)
  misc_feature (71): n=t or c
gggggaattggagcatttgaaagaagtagcagtagctagaagctctttcaatcagggcctctagtttctcngcgcattaatttctcagttgcattgaaaaa

SEQ ID NO: 46551 - DNA, 101 bp, rice(Oryza sativa)
  misc_feature (71): n=a or g
tttgcatgtatgaatgcttgatgacgtcgggtggctgatagcgtgtgtgcggatcagacggctcatggatncgtccgatttttcgtctcacgccgtatgtc

SEQ ID NO: 46552 - DNA, 101 bp, rice(Oryza sativa)
  misc_feature (71): n=a or g
gataataaaataacaatataatccaatgtaaatcaatcggctgacaataatatcatagaatatgtgatccnatggttaaatcatacatcggctgtgtcgac

SEQ ID NO: 46553 - DNA, 101 bp, rice(Oryza sativa)
  misc_feature (71): n=t or c
gcacaaatctcggggggtgtttggatcgagggattaaactttacactatgtcacatcggatgtttgggtantaatttagagtattaaacatagactactta

SEQ ID NO: 46554 - DNA, 101 bp, rice(Oryza sativa)
  misc_feature (71): n=a or g
aaaatttgaatttcaaatgttgggaaatttcaaatgcaaacttccttggatagatgagccaaattaaaatnttgttaactacaaagttgtatgacttttta

SEQ ID NO: 46555 - DNA, 101 bp, rice(Oryza sativa)
  misc_feature (71): n=a or g
ggcacctgccactggcagcaggcggcttcaagaaccaaagaatcttgacacacagagatagagagagaggnaattaaaggtaatattagtagtagtgagta

SEQ ID NO: 46556 - DNA, 101 bp, rice(Oryza sativa)
  misc_feature (71): n=a or c
taaattcctaataggtatagatgggtttgatgggaactttgaatctttaagtgtggtgtttgtaatacccncacaatattatatgggtaccccgcgcgttg

SEQ ID NO: 46557 - DNA, 101 bp, rice(Oryza sativa)
  misc_feature (71): n=a or g
atgctggcacacacactgtgacactgaagggatcgatacaaggttcatgtgcttcaccttatttaccggcnactccagattgataagcagaaacgagtaca

SEQ ID NO: 46558 - DNA, 101 bp, rice(Oryza sativa)
  misc_feature (71): n=t or c
atatggctagctagcaaggctaaacaaaaggaccttgattattcctacagtatttgtttccctcttctctntcttgggccttttggcctgggcctggccca

SEQ ID NO: 46559 - DNA, 101 bp, rice(Oryza sativa)
  misc_feature (71): n=t or g
gtttaggactagccagctactctagtagataatatccaatcatataaagataagccagctgttcaggactnggtattggtactagaattattcgtgaaagc

SEQ ID NO: 46560 - DNA, 101 bp, rice(Oryza sativa)
  misc_feature (71): n=a or c
atgtaactgcggacatgaacacaaaagaaaataactactaatggtatgatcaaacaagaaaatggatgtgnaactgtagtaaatatgatttaggaagccag

SEQ ID NO: 46561 - DNA, 101 bp, rice(Oryza sativa)
  misc_feature (71): n=t or c
ttaggctgagtttgatactaccttctcctgacttttactctatcgttccgcgcacagccgtgcacgttccncgaattgtaaatgatgtgttttttaaaaaa

SEQ ID NO: 46562 - DNA, 101 bp, rice(Oryza sativa)
  misc_feature (71): n=t or c
tagtaaataccatttgcaactgatgaataatatgaattgaatacttcactagtacatgttttgtttctccnttgtcaatagcaaacatgtaggttgtatgt

SEQ ID NO: 46563 - DNA, 101 bp, rice(Oryza sativa)
  misc_feature (71): n=t or c
tatcggatgagtgcatcgacaaacagttcaagggatcaaaatgcactcatttttttctttaaggaaataanagcttcactggtacgtagtttaaaacctaa

SEQ ID NO: 46564 - DNA, 101 bp, rice(Oryza sativa)
  misc_feature (71): n=t or c
tctttattacccgcacatacacactatttgctgttgcatatggttaatatataaaccactagcaaaagtgngtgtgcgttacactgggtgattacggagtg

SEQ ID NO: 46565 - DNA, 101 bp, rice(Oryza sativa)
  misc_feature (71): n=a or g
tacaatgaaaaagccacaggcttacctgatatacaaccccaaaagaaccagttccgaccacatgctcagcnatataagtgacagactgttccattaccata

SEQ ID NO: 46566 - DNA, 101 bp, rice(Oryza sativa)
  misc_feature (71): n=t or c
tgggctgcaggccgagcagagaaaggtgacggactaggcggggctgaaaagaaatgatttaatgggctttngaattaaaaccaaggaagatgtaaaattta

SEQ ID NO: 46567 - DNA, 101 bp, rice(Oryza sativa)
  misc_feature (71): n=t or g
tacaccttctaacaatagcatgcacctgtgctagctgctgtaattaaccacctaattaaactaaaccacanacacaaacacacacatattctctctctctc

SEQ ID NO: 46568 - DNA, 101 bp, rice(Oryza sativa)
  misc_feature (71): n=a or g
agctgttgtcatcaatcaccttgcatttcgtgtcaaactacatctgtggccagcgcacagtagtgttagtntagtgtacaccgtagagtcacctcgctgtg

SEQ ID NO: 46569 - DNA, 101 bp, rice(Oryza sativa)
  misc_feature (71): n=a or g
gcagctcgaaccacacattagtgggagttaggaactctccgccaaacatgcaaaacagaacgatccattanggtatgattaattaagtattagcatttttt

SEQ ID NO: 46570 - DNA, 101 bp, rice(Oryza sativa)
  misc_feature (71): n=a or g
ctaaccgtttctctagcctttaaagcagaactataaattaaaactagcacgggccagcacggtggcccatncagattgcgcggctagtatcattatatttt

SEQ ID NO: 46571 - DNA, 101 bp, rice(Oryza sativa)
  misc_feature (71): n=a or c
acatgccaagatattcatggaaaagtggtgaatacttatataactgtactggagaaataaataactttgcnatgatgtgattatttttatgggctgttata

SEQ ID NO: 46572 - DNA, 101 bp, rice(Oryza sativa)
  misc_feature (71): n=a or g
cacggtatcaaatcatttttgatctttttaatttaacaatgctcatcctatccagttagattcaataatcngaaacgatttagtaccgtgaggtaccggta

SEQ ID NO: 46573 - DNA, 101 bp, rice(Oryza sativa)
  misc_feature (71): n=t or c
tttgctagatttcaggcacgtgtttcatccccgaaattaagtctagtttacctcactcaactcttgtcccngttcaaatggcattcctcaatcacaaaccc

SEQ ID NO: 46574 - DNA, 101 bp, rice(Oryza sativa)
  misc_feature (71): n=t or g
cattgataactctctcatatatccactcaggaaagtagaactcattttggctctcgacggttgggtctgtnttcctcctcccactcaccatttctaacacc

SEQ ID NO: 46575 - DNA, 101 bp, rice(Oryza sativa)
  misc_feature (71): n=t or c
gtttccactcaggttggttttgattcagtggctgctttttagcgtcctttctttctttttagcacaggtangaaccataggttattcgaggaagatatgag

SEQ ID NO: 46576 - DNA, 101 bp, rice(Oryza sativa)
  misc_feature (71): n=t or c
ggaaggacaagggcctttagcctagtggttacaagcctcaatagcaccttaggtcctagattcaactttgngaattttctaatatttaacggctttgtgct

SEQ ID NO: 46577 - DNA, 101 bp, rice(Oryza sativa)
  misc_feature (71): n=a or g
tgtcgcaccccgattgttctgccaaccaaaccggtagtgcgaaagtggaagggcctaattaaaaatatgtngccacgctggatagccacatatgacagtca

SEQ ID NO: 46578 - DNA, 101 bp, rice(Oryza sativa)
  misc_feature (71): n=a or g
cctcgcgggtgggggaggagaggggcaaagagagagagggaagagagtcgccagagagaaagaggggctcncgagagcgagagaggtgggctcgcgcatgt

SEQ ID NO: 46579 - DNA, 101 bp, rice(Oryza sativa)
  misc_feature (71): n=a or g
tgttggaccgtcggcccgcgtcccgaaagggaatcgcgcgcgaaagtgaaacgggagaaggcccatgaatntaaactgcaaggcccaacaaccggcccgcg

SEQ ID NO: 46580 - DNA, 101 bp, rice(Oryza sativa)
  misc_feature (71): n=t or g
gacaaactttgaactcgtcaagccttcgcacataaaggatgaaccaggccaactaattaggcccattctcnctctctctctctctctctctctctcgatcg

SEQ ID NO: 46581 - DNA, 101 bp, rice(Oryza sativa)
  misc_feature (71): n=t or c
tgcagagatgccgcatccgtgatttctgtgtggaggggaatatggggataagtgataaggtgtttttttcnctttaaaggagggttagcttgtgggctgta

SEQ ID NO: 46582 - DNA, 101 bp, rice(Oryza sativa)
  misc_feature (71): n=a or g
cccatgacccgatgcccgacgggtttttactctattaggagttattcacgttctaactcttatacccatgngtctattgatgggtgaaaactcttacccat

SEQ ID NO: 46583 - DNA, 101 bp, rice(Oryza sativa)
  misc_feature (71): n=t or g
cagtgttggtttgccaaaccaaacgggctggcgtgattaaaagattcagattctagaaaagttttagaatngtttatttttaaaaataaaaaaagttcaaa

SEQ ID NO: 46584 - DNA, 101 bp, rice(Oryza sativa)
  misc_feature (71): n=t or c
ggcgggctattgccccggctgcaaaaatagatgattttcgcagtcgttgagctactggcggtccaaccctncgcctgcaaaaatcaattttgaccgcttgg

SEQ ID NO: 46585 - DNA, 101 bp, rice(Oryza sativa)
  misc_feature (71): n=a or g
tcgcaacatctgtcccagttgtcatctttgagaagcccttgctgagtttcactttcgccgatctcttggcngcgacgtcaaattttgataggggaactctg

SEQ ID NO: 46586 - DNA, 101 bp, rice(Oryza sativa)
  misc_feature (71): n=t or c
tgctgtccatagtggcttggctgcagaaatgatcagatagcctggaccagactggggaaagcactgggtcnggttttttcgattcaaaccgccagtccagt

SEQ ID NO: 46587 - DNA, 101 bp, rice(Oryza sativa)
  misc_feature (71): n=a or g
gaacccacttcttgcatttattgttagatgttgtattttccttaggtcctcatatattacgtacaagggcnaatcaatccattgggctttcacttggaacc

SEQ ID NO: 46588 - DNA, 101 bp, rice(Oryza sativa)
  misc_feature (71): n=t or c
atgtcattcttgacaccccatcgaggccagcaatattatacgcatgcatttccttccagtgccatagtttntcttagctccacttagttctgaagacagat

SEQ ID NO: 46589 - DNA, 101 bp, rice(Oryza sativa)
  misc_feature (71): n=t or c
ttttacaaaaaaactatacaacgggatcccgtcacacgggatcgagtctcaaatcgtgtcctgacacaaanagctctatggcctttaggcccgcctccgtt

SEQ ID NO: 46590 - DNA, 101 bp, rice(Oryza sativa)
  misc_feature (71): n=a or g
aatacatcaagctccttgatggcctcatctttgcgctttccaccttcgagcaacaaaatgacgtactcctncacttaaaacaacaacagaggtacacttat

SEQ ID NO: 46591 - DNA, 101 bp, rice(Oryza sativa)
  misc_feature (71): n=a or g
caccgtcccggagaaagcccccaaacccatgtggtcattgccactggagttgataccgaagcgagccgccncgccaccgtttacctccaatcgatgcagca

SEQ ID NO: 46592 - DNA, 101 bp, rice(Oryza sativa)
  misc_feature (71): n=a or g
tccaaatgtggtcgttaaaggtcactaacgaccactaagtttgtggtcgtcagtggttgttaaaggctccntcgttaatagttttaacgaccaaacgatct

SEQ ID NO: 46593 - DNA, 101 bp, rice(Oryza sativa)
  misc_feature (71): n=a or g
ccgtcgattccggtcctgcctgcgagcaccgtcgcctacagtgacggatctagccacgcctgcgagtgctnacgccggatccggccgtgcccgcgtgcacc

SEQ ID NO: 46594 - DNA, 101 bp, rice(Oryza sativa)
  misc_feature (71): n=t or c
gggggaaaaaaactatacctgccttttgaaacagagaaatattggaaggtcgatctatctatttatttatngtttttagataatataattcattccatatt

SEQ ID NO: 46595 - DNA, 101 bp, rice(Oryza sativa)
  misc_feature (71): n=t or c
atgattcaacgggggtggcgagccatgaaatcagttagcgagcactcccccttctctttagttttaactanctatattagttaatatacttaacattaatg

SEQ ID NO: 46596 - DNA, 101 bp, rice(Oryza sativa)
  misc_feature (71): n=t or c
gcattctgccttctaaattggatataatgcaacttgcttgttatgttctttctgctcctagttttactttnattgattttagtttccactttccactattt

SEQ ID NO: 46597 - DNA, 101 bp, rice(Oryza sativa)
  misc_feature (71): n=a or g
cacatgtgtataaggagttaaggacgcgctcatatatgcgtgtgcagtggtatgagtgtaatgcacgcacntccttaagtagatttagaaagatattttct

SEQ ID NO: 46598 - DNA, 101 bp, rice(Oryza sativa)
  misc_feature (71): n=a or g
aatcatagcgtaattaggcataaagattcgtctcgtaatttctcttttttttctacatttaatacgcacanataaaccatatcgatgtatagcgtatatga

SEQ ID NO: 46599 - DNA, 101 bp, rice(Oryza sativa)
  misc_feature (71): n=t or c
gttacgcagcagagcgctcggggtagccgttctaggtgaacgccaccggcgatgtaagccactatcaccgnggcgcgctccctcgcctccgcgtcgtgcgg

SEQ ID NO: 46600 - DNA, 101 bp, rice(Oryza sativa)
  misc_feature (71): n=a or g
actagtagtactacattgttatgccctagtacaaagtactaagactctgactatgaggagtactaagatantactactcctaagtcctaagagattatatt

SEQ ID NO: 46601 - DNA, 101 bp, rice(Oryza sativa)
  misc_feature (71): n=a or g
tgctttgtaattttccaaggaaataaaaacatggggttggagctcatgtttgggctcctttcaaacgcagnaattaaaaaacatagaaacagtaagggccc

SEQ ID NO: 46602 - DNA, 101 bp, rice(Oryza sativa)
  misc_feature (71): n=t or g
ggcagcttctgcatttgacggggtcaggtcagaattcagatcagggccatttgattatcatcaatcagttngtactccagtatgcatggtcacaactactg

SEQ ID NO: 46603 - DNA, 101 bp, rice(Oryza sativa)
  misc_feature (71): n=t or c
tcgatagaaacacaaccatcaatgatgccatgccaacatgggactttcaatgagacatcttcaagaagctnacgacatttaggatgtcaagtcactattcc

SEQ ID NO: 46604 - DNA, 101 bp, rice(Oryza sativa)
  misc_feature (71): n=t or c
ccatatcatctgaggcctccctccaggcgacgatcgatgtggagaagtgcggtaagcaatgggcagcggcnggtaggacaagagctaggcggtgatggtgt

SEQ ID NO: 46605 - DNA, 101 bp, rice(Oryza sativa)
  misc_feature (71): n=a or g
catttgggccaatatacaacctatggaatgtacaaatcaatttcccctaatgtttgtcacacaaaaacaangtttaaaaatcaatttcccctaatgtttgt

SEQ ID NO: 46606 - DNA, 101 bp, rice(Oryza sativa)
  misc_feature (71): n=a or t
gggcataaaacttgagcacttacactaaaaccatttcccgttagacttcctcaccaaaatcgggttcgccnacaactcgggttggtcgatctcttggatca

SEQ ID NO: 46607 - DNA, 101 bp, rice(Oryza sativa)
  misc_feature (71): n=a or g
ggtgagagaaaatgtagctctagaggatacgccatccaagcatgcaaagatatcacatgcgctatcctagngagatccttgcgccatcccacaactggcat

SEQ ID NO: 46608 - DNA, 101 bp, rice(Oryza sativa)
  misc_feature (71): n=a or g
ttggtagcagtagagttagagttggttcaataacccggcaactctttaaatagataatagataggaagacntcgtaatgtaaccatagcgactaccactag

SEQ ID NO: 46609 - DNA, 101 bp, rice(Oryza sativa)
  misc_feature (71): n=t or c
tcactcgcgttacgcaaaccaggcccacggggcccagcccagcccaagtggtcaaccgtatgtatatgtanatcggattttttgtttttcctttttttttt

SEQ ID NO: 46610 - DNA, 101 bp, rice(Oryza sativa)
  misc_feature (71): n=a or g
aataatatgaacagtcaaacatcatgtccaaaagttgaaaatggtgaaagtaccaactgaaaggataggtntctgataactaaatgttgggaaataatctt

SEQ ID NO: 46611 - DNA, 101 bp, rice(Oryza sativa)
  misc_feature (71): n=t or c
ctaaacaaacaacgtggtgtgcctaacatttagcatggtaccataaaaaaatgatgtactccctccatccnaaaatatttgacgccgttgacttttttaaa

SEQ ID NO: 46612 - DNA, 101 bp, rice(Oryza sativa)
  misc_feature (71): n=t or c
ctatgaagagtaggctcgatttccaataaaagccataccgagattgacacggattatcttctctgctgaanccgacaggtgaggtcgtgtcgtggacgtgg

SEQ ID NO: 46613 - DNA, 101 bp, rice(Oryza sativa)
  misc_feature (71): n=a or c
tgccatttgttaaggtttccatcaagatgtgtggtgttgcgttgttgccaaaagtgttttcttgtcgatgngtgtaaactactagttttagctagcttgac

SEQ ID NO: 46614 - DNA, 101 bp, rice(Oryza sativa)
  misc_feature (71): n=a or g
aggtcactgagatagatattgctggatagctgatacagcccggtgtctgatttgttctacttcttcgattncctgggtatcttgtgcatcagttccaggga

SEQ ID NO: 46615 - DNA, 101 bp, rice(Oryza sativa)
  misc_feature (71): n=t or c
cgcgccttcgccaacgtccgcggcacacgtcgccctgctacacggctaacggctgagatgtcgcagagcgncttcctcctcccggtcgcccagtgccgtgg

SEQ ID NO: 46616 - DNA, 101 bp, rice(Oryza sativa)
  misc_feature (71): n=a or g
cgggcgccgcacaagagtacattgttcaattcatcttaagagtacatttaagagcagaaaacaaacaacancagagcttcagcttcatggccgtgatgagc

SEQ ID NO: 46617 - DNA, 101 bp, rice(Oryza sativa)
  misc_feature (71): n=t or c
gcaagggggaagggggtgggagaaatccgtgtgcgcgaggtgggctcgtgcagcaagtagacgacgacgangaaaggggagaagcaggcggcggcaaatcc

SEQ ID NO: 46618 - DNA, 101 bp, rice(Oryza sativa)
  misc_feature (71): n=t or g
aaaaaggtatttgtcaaagagaggagaaatttatatatggcaagtcaaatactagattccggcgaaaaatnatttaaacatctgaatcaaatcttaacagt

SEQ ID NO: 46619 - DNA, 101 bp, rice(Oryza sativa)
  misc_feature (71): n=t or c
ctgatccaatcatatttttacctctaaggcttagcagtcatgatgagagtcacactcccagtaaaaactanaactaacaacataaccaaccaaaccgaatc

SEQ ID NO: 46620 - DNA, 101 bp, rice(Oryza sativa)
  misc_feature (71): n=t or g
ttctctttctctctccttctcgtcttcttcttcctccagccgatagcagggagaggaggaggcggttagcncggcggcgctccggtggctaacaggcttag

SEQ ID NO: 46621 - DNA, 101 bp, rice(Oryza sativa)
  misc_feature (71): n=a or g
ctctaagttccttcacactgtccacggcccaaacttgttgattcacgtgaagtatccagaccaggaaaagncaaagggctggtgatctccacataggagta

SEQ ID NO: 46622 - DNA, 101 bp, rice(Oryza sativa)
  misc_feature (71): n=a or g
attaacgccgtcaatacctgcataagaccataaacgtggaacatccaacttagcggtagggcttatttctnacaatttccacgagtgttggtgtatattca

SEQ ID NO: 46623 - DNA, 101 bp, rice(Oryza sativa)
  misc_feature (71): n=t or c
agttctttttttcccctcaaaagctttacatatatataaaaaaaaacttacaaatatttccgcacacccanacacatcattacacacgcaacagcacactt

SEQ ID NO: 46624 - DNA, 101 bp, rice(Oryza sativa)
  misc_feature (71): n=a or g
ctgcagggttcgcaaaggaattttcgaccgatgagaaagacgtcttgtggtacaaaaagaggatctatgtncccgaacggggtggactgagaggattaatc

SEQ ID NO: 46625 - DNA, 101 bp, rice(Oryza sativa)
  misc_feature (71): n=a or g
agattcggccgaaatggaaatttatacaactagcttccatgtgagtacatgacctgacatgtttgagaggntaattatgattttactagaaagacatttcc

SEQ ID NO: 46626 - DNA, 101 bp, rice(Oryza sativa)
  misc_feature (71): n=t or c
tccgcgtcggacccaccatcatcatcgccatcggatcttctgcccccaccacccaccgtcgtcaccggcgntggatccactcgcccccactgcccgccgta

SEQ ID NO: 46627 - DNA, 101 bp, rice(Oryza sativa)
  misc_feature (71): n=a or g
tggcccaagtattcgagttcttgcattgcaaaggagcatttactgagcttagcaactaattgatgagcctntaggacttgaaacacaatttccaaatgaga

SEQ ID NO: 46628 - DNA, 101 bp, rice(Oryza sativa)
  misc_feature (71): n=t or c
tctaatcttttcaccaacacatcactttttggtcattccactagggaagagaaaaaaaaaactttgactcncatgtcttggaaagccaaatcttgaagaag

SEQ ID NO: 46629 - DNA, 101 bp, rice(Oryza sativa)
  misc_feature (71): n=a or g
gctaggggctaccagatctccatgccactgaattggtggaggctggatctggccgccccccgagccacctnccttcgccgagatcggggtcacctaggact

SEQ ID NO: 46630 - DNA, 101 bp, rice(Oryza sativa)
  misc_feature (71): n=a or g
ttttaagttccattatttataaaagttagaaaaataaatcgcatgcacctcctctcctactcatatgcacntaccactacctgtcccctccctatttttag

SEQ ID NO: 46631 - DNA, 101 bp, rice(Oryza sativa)
  misc_feature (71): n=t or c
gccacagaacaggcagacccacccaagcacccagaaccccaaggtgataactcgcaatgacaatggtgccngattcataaaaccaacgctcattctttaga

SEQ ID NO: 46632 - DNA, 101 bp, rice(Oryza sativa)
  misc_feature (71): n=t or c
tcttttgttgtaatggttatcatatggttgtaaattattgtcttgtttaataacgttatcagtcttgtctngcaaagaaaatcatggctagtgaattaaat

SEQ ID NO: 46633 - DNA, 101 bp, rice(Oryza sativa)
  misc_feature (71): n=t or c
ggtagctcttttgttgatctagcagcagtcggtaacgcttagcgatggccggtccagtgctaactttttcntgggttctataaagacgttgtcggtgtatg

SEQ ID NO: 46634 - DNA, 101 bp, rice(Oryza sativa)
  misc_feature (71): n=t or c
tgctaaggtggttgaccacttgaccccctggggtccaccgccatgtcctgttgctagaaaagtatagagancgccataaattaaccgggacagtaggacac

SEQ ID NO: 46635 - DNA, 101 bp, rice(Oryza sativa)
  misc_feature (71): n=a or g
acttgactccctatatcatttaactttgcttggctagaaaaccaactattccttccgtcttaaaatataancatttttagctatgaatatagacaaaagtt

SEQ ID NO: 46636 - DNA, 101 bp, rice(Oryza sativa)
  misc_feature (71): n=t or c
cctcacctccctctccttctctcggcccagcccggctgcccccatctattcctccccggaaaaagtacacngaaggtccctcaacttgtcatcgagttaca

SEQ ID NO: 46637 - DNA, 101 bp, rice(Oryza sativa)
  misc_feature (71): n=a or g
acgccattgcccatccatcatcatccaccctattttatatcttttgctttgtttttgaccgcgggaggggngagggagacgccgcgtcgtccctctctctc

SEQ ID NO: 46638 - DNA, 101 bp, rice(Oryza sativa)
  misc_feature (71): n=a or g
ccatacgatatgctttgagatttgtgctgcacagcaaggatcgaacccgagacctgtagcttgcatgctcnttcaactaaccaattgatccatccaatttt

SEQ ID NO: 46639 - DNA, 101 bp, rice(Oryza sativa)
  misc_feature (71): n=t or g
accaagcatacatgcatcaaaaggcatccaattttacccctcctcatcatcaataatccctttctatgganagatagagagatagatagatagatagatag

SEQ ID NO: 46640 - DNA, 101 bp, rice(Oryza sativa)
  misc_feature (71): n=t or c
acatttatccctttggcagccttctcctccttcttcccctcttgtgcaggtagaatcaggcggccgcactncatcggctgcaggcagtcatcatgttgaag

SEQ ID NO: 46641 - DNA, 101 bp, rice(Oryza sativa)
  misc_feature (71): n=a or g
tttatggcgaccttagtgaataatttataattggcattcaacaagcatattggtttatattgttagattcnatttgcttcttcaactttcagaattagagt

SEQ ID NO: 46642 - DNA, 101 bp, rice(Oryza sativa)
  misc_feature (71): n=a or g
ggttacaggtgggtggccaatgatgacaaatctcaatgaacacccgtcatagatgagtcatatgtgactgntgagtaagtcatctatgacggatcgtaaaa

SEQ ID NO: 46643 - DNA, 101 bp, rice(Oryza sativa)
  misc_feature (71): n=a or g
actggatgagtgcgttaaaacatgttaccagacaagggtgttccattttccttgagcccgcaagacgaacnatagatggagaaaaaacggctaacactatc

SEQ ID NO: 46644 - DNA, 101 bp, rice(Oryza sativa)
  misc_feature (71): n=a or g
tcttgtataggtctttaattggttgtgtatagttgcgtatagttgcgattgtggatttctgttcgagcccngatttcaagaagcttcgtgaaggccttgag

SEQ ID NO: 46645 - DNA, 101 bp, rice(Oryza sativa)
  misc_feature (71): n=a or c
gacggttggagacggtaggcagagaggaaaggcaggtgtacgtgcagacacgaacggccgagttgaaaaangttgccgaaatcccgaggcttcgcccactc

SEQ ID NO: 46646 - DNA, 101 bp, rice(Oryza sativa)
  misc_feature (71): n=a or c
agcatgctcagccggaccggcatcttgggttctagatggttgatctacaagccctctctggcaatgtattnttatacctattcaatcatagcatgtggttt

SEQ ID NO: 46647 - DNA, 101 bp, rice(Oryza sativa)
  misc_feature (71): n=a or g
tgctgccgatcccctttatatagcagcagggtgatcggcggcaaggtagatgtggtatccctcacaatctnggtacctgccatccatcaaaatatggcggg

SEQ ID NO: 46648 - DNA, 101 bp, rice(Oryza sativa)
  misc_feature (71): n=a or g
tggtattttctggattttctcatatgataaagttgtgtttttgagcttttgactctcaaattattctctangttgtacaactatagattcacaaactatgg

SEQ ID NO: 46649 - DNA, 101 bp, rice(Oryza sativa)
  misc_feature (71): n=a or g
attcgataaaatctatatcaaaaaccaagaaagaatctactgttcatggacagaaaaagaacgattttganctaatggcctgatcaccagtgctgcagtag

SEQ ID NO: 46650 - DNA, 101 bp, rice(Oryza sativa)
  misc_feature (71): n=a or g
cccccatcgtctcagtcgtcttgccaagcgaaattgaattcatccttagctgtcacatcatagactcctcnaagaccatgttcaccttcatcttctatctt

SEQ ID NO: 46651 - DNA, 101 bp, rice(Oryza sativa)
  misc_feature (71): n=a or g
cgcatttatttccccaattctaagcatctgtgtgcatggatactcgagacaagtaggcttccggaactccntttgcttgagtacctgcatgggtaggcggg

SEQ ID NO: 46652 - DNA, 101 bp, rice(Oryza sativa)
  misc_feature (71): n=a or g
cgtcgtcgtcatctcctcatatacggactcgatctgcgtgcgtttgccgataaaaccacctgctcgtggtntgtatgcgcaggagcggagctagagcgaaa

SEQ ID NO: 46653 - DNA, 101 bp, rice(Oryza sativa)
  misc_feature (71): n=a or c
ttcgctatgtatacctatacattatcatattaataaaataataagatctaagctaattacatcatctaggnccaaattaacggtgtagattaatactcctt

SEQ ID NO: 46654 - DNA, 101 bp, rice(Oryza sativa)
  misc_feature (71): n=a or g
tccattggccaacagcacagcaacaagcctttgataccatcaagctgcaccttgctcaagcccctgttctngccatgccagatttctctcttccctttgtg

SEQ ID NO: 46655 - DNA, 101 bp, rice(Oryza sativa)
  misc_feature (71): n=t or c
ggttgtttaagttgattaacgaggaaggtgtatggtaaaatctattgaagagagtatctctacaatcagtntataacccaagttaataagaaacagggtga

SEQ ID NO: 46656 - DNA, 101 bp, rice(Oryza sativa)
  misc_feature (71): n=a or g
ccagcatcgggcggccgcgccgtccgtctgcttccgagcctttccttccgcggccatcggcgcatgtgctntcctgtcacctcgcgagctttgttcgcatc

SEQ ID NO: 46657 - DNA, 101 bp, rice(Oryza sativa)
  misc_feature (71): n=t or c
aaacgaggaagaggggttgggaaaaggatatccgaacacaccctatttgtacatatgaaagagagagaagnaaaacgtacagatttgtagccagctgcaac

SEQ ID NO: 46658 - DNA, 101 bp, rice(Oryza sativa)
  misc_feature (71): n=t or c
acttgggataaatatctatctcttccttatccctatatattcttatatatggttttaaatacactctcccnggtttttaatatacgacgccattaacttta

SEQ ID NO: 46659 - DNA, 101 bp, rice(Oryza sativa)
  misc_feature (71): n=t or c
ggctgtgctgtttagggcactcacagtgcgtagccaacactgccacctagactaagaactttgtatgcaanaacctccacagtgcacgtggtcttcttttt

SEQ ID NO: 46660 - DNA, 101 bp, rice(Oryza sativa)
  misc_feature (71): n=t or c
ttatgaatactgccactgcattatactttcctgatagcacacaggaactttttttccttttttttcctctntccaatacaacaaacatacgagctgatcat

SEQ ID NO: 46661 - DNA, 101 bp, rice(Oryza sativa)
  misc_feature (71): n=t or c
ttatattcttcctgcctttatgactccaaaatttgttcctcctttgcctcttgtaatcagctttcatgagncaatattttatgcatcagatgagctaaact

SEQ ID NO: 46662 - DNA, 101 bp, rice(Oryza sativa)
  misc_feature (71): n=a or g
taatgctttcttgttcaaccaagggccgatgacccccactctacttgatatcaccatgattactggtttgnatgtgacttcatcggctaaccctatgagct

SEQ ID NO: 46663 - DNA, 101 bp, rice(Oryza sativa)
  misc_feature (71): n=t or c
atggtaattttgtcaatctaagatatgtcagtctactctttcggatatgttcataggggtagtgtgtgtangtgtgtgtatataaggatgagtgtgtcgtg

SEQ ID NO: 46664 - DNA, 101 bp, rice(Oryza sativa)
  misc_feature (71): n=a or g
atgctgaggggggagatgaacaacgtatcacacaaccagagaaaagtttttggtttaagccacatacccanatctttttaagaacagaaaagcatacaaca

SEQ ID NO: 46665 - DNA, 101 bp, rice(Oryza sativa)
  misc_feature (71): n=a or g
cttgggttgaacctggacacacaatgtgttcagattcaaacccgaggtttaatttttttttaccgagtatnaatctggacatatatgtatccacattcaaa

SEQ ID NO: 46666 - DNA, 101 bp, rice(Oryza sativa)
  misc_feature (71): n=a or g
agataagcttagaaaagtatatggatatggttgacaataagcaacctgatccatatttaatcctacaattnaagcgccctatgtatagatggctaaatggg

SEQ ID NO: 46667 - DNA, 101 bp, rice(Oryza sativa)
  misc_feature (71): n=t or c
tgtcctctgagtgtggaacgaactcgtcgatcacctcgttcggggctaacacccagtcacccacgtactgntatacgcgtggtgcccacagtgtgccgggt

SEQ ID NO: 46668 - DNA, 101 bp, rice(Oryza sativa)
  misc_feature (71): n=t or c
aaaaggaaaaataccaaccggatgaaaagaaaagaaaaaaagtcccggtcggtaacaacaactgggaccanatttttagtcctgagtatttgaaccgggac

SEQ ID NO: 46669 - DNA, 101 bp, rice(Oryza sativa)
  misc_feature (71): n=a or c
ttgagttaggacaacaagatgtgtatgccaagggtgattatggcagattaaaattgatggcacaaaaaaancaagatgaagttgataaatctagcgttttg

SEQ ID NO: 46670 - DNA, 101 bp, rice(Oryza sativa)
  misc_feature (71): n=a or g
cctgaccaggcaagcggaaagcaacacttcgtcaattgcctctcacgatcaatctaagagagagacactgncgagataaacttcctaaggacctcccagag

SEQ ID NO: 46671 - DNA, 101 bp, rice(Oryza sativa)
  misc_feature (71): n=a or g
cttgagcctagggttagaactcccttgtagcagcagaagcttaattccactaacagaagtagggtattacncttcttagcggtccgaacctgtataatccc

SEQ ID NO: 46672 - DNA, 101 bp, rice(Oryza sativa)
  misc_feature (71): n=a or g
ctctaagtcctaaactataacgaactacgtaaatatattcgacacaagctcataaccatttgagtgacatntaaacaacgaggggacatcccctcgaggta

SEQ ID NO: 46673 - DNA, 101 bp, rice(Oryza sativa)
  misc_feature (71): n=t or c
tctgtgtgtgttgtactcgatctccagcatcgatcaccatcacgaagtatatatctatagctagctaagcnaaagctaagccaagctagcttgaccattga

SEQ ID NO: 46674 - DNA, 101 bp, rice(Oryza sativa)
  misc_feature (71): n=t or c
gacggcgatctcgacatagtcgctctgaccaccgtgtgcacactggtctaaccgtccgtataccgccggtntgactggtgttatccagctgatcggactgt

SEQ ID NO: 46675 - DNA, 101 bp, rice(Oryza sativa)
  misc_feature (71): n=a or g
ataatcttaaggcccttgagtaactgattacaagatatttgctgttagggctctgctctaagcattcatanctagggataaaatgtcctgttaatttcagt

SEQ ID NO: 46676 - DNA, 101 bp, rice(Oryza sativa)
  misc_feature (71): n=t or c
ctggccattgctggcttttacaacagggcacatgcagtttctgatcttctggagcagctgctttgcattgnagcatggctcaggatttattgaatgaatga

SEQ ID NO: 46677 - DNA, 101 bp, rice(Oryza sativa)
  misc_feature (71): n=a or g
tagggtgaaaaggaaataagaaatgaacttaagacccaaaaacaaggaagatttttattcaactttttcanttatagtgtataacgatccaaaagtttcaa

SEQ ID NO: 46678 - DNA, 101 bp, rice(Oryza sativa)
  misc_feature (71): n=t or c
gaacagacgaacatagccttagtcttgcggcgatcaatctcgtggacccgatgccatgccccattgttggnggttgttaaatgacaatcccataccgccaa

SEQ ID NO: 46679 - DNA, 101 bp, rice(Oryza sativa)
  misc_feature (71): n=a or g
cacccgaagcagtaggagtattttctcgcgtaggagtaaaagtccatatgcatgtaaaaatttagaggtgnggtggtggcagcgacatcctttttgccagg

SEQ ID NO: 46680 - DNA, 101 bp, rice(Oryza sativa)
  misc_feature (71): n=t or c
ttctaaatttaactttttaggagcggagtttggagtagagctgtggagcagtcagaaccccactctatccnagtagcctgtaggttatttatgtcagatca

SEQ ID NO: 46681 - DNA, 101 bp, rice(Oryza sativa)
  misc_feature (71): n=t or g
ccataggaaagttcttgaccctcactttaccattcacgcattcatgaggggtgtgtttaaatatcctactngaatgattggcaaaagaatacagttcttgc

SEQ ID NO: 46682 - DNA, 101 bp, rice(Oryza sativa)
  misc_feature (71): n=a or g
gaaaggctgcgaaagcttcaaggacagtggaaatgccgcatttcaaaggctgtgtttacatctaaattttngatccaaactttcaactttttccatcacat

SEQ ID NO: 46683 - DNA, 101 bp, rice(Oryza sativa)
  misc_feature (71): n=a or c
aaatttgattaaacttaaaaaagttaaacttaaaaaaaaaagttcaaagcgacttataagtataaaggctntgtttagattctaactttttttcttcaaac

SEQ ID NO: 46684 - DNA, 101 bp, rice(Oryza sativa)
  misc_feature (71): n=t or c
cttcgatagtgctttcactgcctcagaccgaaatcgaggcccgaaaaatgatcggacagctcaccataaangagtttagcctggtgcttacccgtcagaca

SEQ ID NO: 46685 - DNA, 101 bp, rice(Oryza sativa)
  misc_feature (71): n=t or c
ctggttgtgctccctggatgaacgccgagtcagtgacgggttagccgtagtgctgtgccaaggcatgccgnagttgtagccgtgaccggccggcggccgcc

SEQ ID NO: 46686 - DNA, 101 bp, rice(Oryza sativa)
  misc_feature (71): n=t or c
acattagtgctgaccacctactgtcagggttagataccatatatctaataagtagttgactaaatcttggnaggacccaccacataccatgtcttatatgg

SEQ ID NO: 46687 - DNA, 101 bp, rice(Oryza sativa)
  misc_feature (71): n=a or g
tgtctttagtacaacatattaacaaaaataaaaatatgtattagactggggcatccaaatacatgcaaacntaatattgagatgttataaagcgcctctaa

SEQ ID NO: 46688 - DNA, 101 bp, rice(Oryza sativa)
  misc_feature (71): n=a or g
ggatctaccactgaaggaaaaagaattaaaaaggggaaagaaagtcaaccctaacctagaagtcaagccangttgtcagacgggtcaactggtcaacctag

SEQ ID NO: 46689 - DNA, 101 bp, rice(Oryza sativa)
  misc_feature (71): n=a or c
ttgactgctgattccagtaccttatgccttgaaaagagaattacctctgaaacaacacgatcgctctgtancaatgtgtgtggtttccagtctggcttgca

SEQ ID NO: 46690 - DNA, 101 bp, rice(Oryza sativa)
  misc_feature (71): n=t or c
tctaatcatgttagaaatgatggccaaaaggcggttgtggtcctcgcacaagaaagcgatactaaactaanaggaccctggggattccttatgtgagcatg

SEQ ID NO: 46691 - DNA, 101 bp, rice(Oryza sativa)
  misc_feature (71): n=t or c
tgttgctagttaaaaaaggagagttgaatgagactccttgtctcactccccttctggattgagattttttnccctggggcactccattcaataaaatggaa

SEQ ID NO: 46692 - DNA, 101 bp, rice(Oryza sativa)
  misc_feature (71): n=t or c
tctacaccttcttttctcaattgtttctcataatatgcaacaagccaaccaggttaattcagagtgaaaanatgtcaagatattggttggtctgaggtatc

SEQ ID NO: 46693 - DNA, 101 bp, rice(Oryza sativa)
  misc_feature (71): n=a or g
cccccttagatgaaaaaagaaatctattgacaccatttagtagaaaagactttcatccttagagtttattntacaaaagaacaattaactttagagtaaat

SEQ ID NO: 46694 - DNA, 101 bp, rice(Oryza sativa)
  misc_feature (71): n=t or c
attctcatgtgctccttgccttttgctgctagctactccctccgtccaatatatctctagtcgtaggttgntatattctgggacggagggagtatctatct

SEQ ID NO: 46695 - DNA, 101 bp, rice(Oryza sativa)
  misc_feature (71): n=t or c
tttctggtgtgattgtagtattgtctgcggatatgtatacaagtgaacatgacgttgtgtttagttcacgntaaaattagaagtttggttgaaattaaaac

SEQ ID NO: 46696 - DNA, 101 bp, rice(Oryza sativa)
  misc_feature (71): n=t or c
gccgaaactattaattcgacgaagcgactaggttaaagcaaattcggccgtaatatgtagatctagtcccnagcggagtcgccaaaaatcgtgttggcaac

SEQ ID NO: 46697 - DNA, 101 bp, rice(Oryza sativa)
  misc_feature (71): n=t or c
accatcggccctgcccgagagagagagatagaggggaggaagggaaagataagagagtaaagagagatgangtggacacctgacatgtgggacccacgtgg

SEQ ID NO: 46698 - DNA, 101 bp, rice(Oryza sativa)
  misc_feature (71): n=a or g
gtttgatgggcctcattcccggccaatagacgtcgataggccgggatttagtaaaaggaaaaagtacaccnaaggtccctcaacttgttaacgagttacaa

SEQ ID NO: 46699 - DNA, 101 bp, rice(Oryza sativa)
  misc_feature (71): n=t or c
tcatgtgatgattggggatggggatagagctagggttttgatgcacatatgggccacaagtccagagcggnatgggctagctacctcagctcgttaaggct

SEQ ID NO: 46700 - DNA, 101 bp, rice(Oryza sativa)
  misc_feature (71): n=a or g
tacgtcgaaacaccgtatataccgtgatgtgtgactggatgaagtgttgtgtactcgtttggtcgtcaccnttgccccggcatagcgtgcacggcgcccag

SEQ ID NO: 46701 - DNA, 101 bp, rice(Oryza sativa)
  misc_feature (71): n=a or g
atcgggtccatgaacctaaaggccaaaaagagttacgttttgacacaccctcaattattcaccggattttnccaaccaaatattcaaaattttagtaattt

SEQ ID NO: 46702 - DNA, 101 bp, rice(Oryza sativa)
  misc_feature (71): n=t or c
ccttcaaagccgagtccctttgtgcagccaattctgccttgtcactttctaaggtctggatccgcttctcnagttgagctatcttggcagcttgcactgtt

SEQ ID NO: 46703 - DNA, 101 bp, rice(Oryza sativa)
  misc_feature (71): n=t or c
ggcacaaccttagaaataggttaattcgcactaattctgataggtccagagaaacagtttgtcattatttnaacaaagtacttcatgttattggtgagcta

SEQ ID NO: 46704 - DNA, 101 bp, rice(Oryza sativa)
  misc_feature (71): n=t or c
cgcaaaaatccaatttccgcatttgggtgcgccacccgcacagagaatccctgatttttgaagacacttcngggcagacgggcgccacctccgcacataaa

SEQ ID NO: 46705 - DNA, 101 bp, rice(Oryza sativa)
  misc_feature (71): n=a or g
acacacagcctaaggctatgttcttaggttggaaccctcacctcccacatggaaaacgggtgatggattantgcacgattaattaagtattagctaaaaaa

SEQ ID NO: 46706 - DNA, 101 bp, rice(Oryza sativa)
  misc_feature (71): n=a or g
tccggtgaactcatgccccaaattgacctccctcctcggttgctctcgccccaaattaaatgcaaaaatcngttcctctcgtcctcctcatcaattccccc

SEQ ID NO: 46707 - DNA, 101 bp, rice(Oryza sativa)
  misc_feature (71): n=t or c
ggaaagaaaaggataagactgtgggttagtattgtagctgcatgaatctttgtatccgtggctatacagtngcctaagagcaggtacaatagcagactata

SEQ ID NO: 46708 - DNA, 101 bp, rice(Oryza sativa)
  misc_feature (71): n=t or c
ctgctcggtcctccacgcgctcatcgagccattatcacctccgccaaggttcacaaaaccaatcggttttngtgtaaaccggccggttttcgtgaaaccgc

SEQ ID NO: 46709 - DNA, 101 bp, rice(Oryza sativa)
  misc_feature (71): n=t or c
aacaaaaaagaaatttgccatctaaaccgggcctaagcggattgttggtgtggattatttatttgattaantatatgcataataagttacatgtcttacta

SEQ ID NO: 46710 - DNA, 101 bp, rice(Oryza sativa)
  misc_feature (71): n=t or c
acaaggttcacaacaaattaaacaaggtttcggtgtgtgagaaaaataaatttgtcctaaaataaaacgcnttgttgataagacagcacacggtttgacaa

SEQ ID NO: 46711 - DNA, 101 bp, rice(Oryza sativa)
  misc_feature (71): n=t or c
ttgggctggctgagccattgaggaactttcagaattttgatagtaattactgtacaaatacggttaccganaaaatggtcggaaaaaactccatcacattt

SEQ ID NO: 46712 - DNA, 101 bp, rice(Oryza sativa)
  misc_feature (71): n=t or c
cgccatccgcctcacgcatgcacgctaggttatgcgtgggccttagcccttatgggcctaaaacgggcgcngtcaacgcgcgcgcgcgaattagctatcgc

SEQ ID NO: 46713 - DNA, 101 bp, rice(Oryza sativa)
  misc_feature (71): n=a or g
ttatggtgtcaactttatcgaatccgttaatcaatcagtgacttgtttattggttgataaggcagtcgtcntcgctaatccatctccgacctttggatatc

SEQ ID NO: 46714 - DNA, 101 bp, rice(Oryza sativa)
  misc_feature (71): n=t or c
gattcggccaccgaggcacccgccgtcagtagttgtgggtcgagcccgcccttaggaagcccaagccaccngtcgcccactgccatccaccacgagccaag

SEQ ID NO: 46715 - DNA, 101 bp, rice(Oryza sativa)
  misc_feature (71): n=a or g
tgtgcacggagcaatgctactgctactactcctcatgcacccatgatgatccatgatcattaaagcattgncaagcgttgacaagaaaggaataaaggtta

SEQ ID NO: 46716 - DNA, 101 bp, rice(Oryza sativa)
  misc_feature (71): n=t or c
gaccttgtcggtataaaacaaggtttagaaaaaaaaatcacaagacctctcattaataaaaaaaatactcnctccgtttcacaatgtacatgagactttcc

SEQ ID NO: 46717 - DNA, 101 bp, rice(Oryza sativa)
  misc_feature (71): n=t or g
tgaggttaactcaaccattcttttggcgtggatatgcattgtcctcatatagtgtatattgaattgattanatataaccgttgatgatcttgaataaataa

SEQ ID NO: 46718 - DNA, 101 bp, rice(Oryza sativa)
  misc_feature (71): n=a or g
gaggtatcaaccgatacgtaccaattagcatgtaatatttttgaggtatcatcccgtccaaacaaatatcntcgtatagtattttccttaaaataatactc

SEQ ID NO: 46719 - DNA, 101 bp, rice(Oryza sativa)
  misc_feature (71): n=t or c
tagcgacacttttccggtagtacaaatcactacacttcgcttctttttctttctatatgataatatgcacngtcggttgctgcgcaccctgcgggtaatag

SEQ ID NO: 46720 - DNA, 101 bp, rice(Oryza sativa)
  misc_feature (71): n=t or g
cctgagagggaattgcatgccaccgctcacaggagatcgcgcaacatgagagaggagaggacgaccctttntatgattcaaattaggaacctttcgatgag

SEQ ID NO: 46721 - DNA, 101 bp, rice(Oryza sativa)
  misc_feature (71): n=a or c
aagatctatcaaattcagaacaatcaattccatgacctaatctatttagttgttcttctcccccccccccnacacactgtttctcttcatctagtcctttt

SEQ ID NO: 46722 - DNA, 101 bp, rice(Oryza sativa)
  misc_feature (71): n=t or g
attcacccaaacaaacaagttcgattgcacccaaagagatcgatccgtggtcgtctcatctgctctttatnaaggtacgtaatttgtcaatttggatattc

SEQ ID NO: 46723 - DNA, 101 bp, rice(Oryza sativa)
  misc_feature (71): n=t or g
aggacaccgacagtttttgttgcttactgaactgtcttatctcccctgaacttttttttccctatccaaantgatcaacttgtcaatcaaacactccattt

SEQ ID NO: 46724 - DNA, 101 bp, rice(Oryza sativa)
  misc_feature (71): n=t or c
ccccagatgtttcgccgggcgccggaaataggaaaagaagctgtcactagggctgtcaatgagccgagctngagcgagcttgcctgcctaggctcgagctc

SEQ ID NO: 46725 - DNA, 101 bp, rice(Oryza sativa)
  misc_feature (71): n=a or g
ttggggcttgggtgattgggacggtctccggccaaattgatgggcgcaggagcatctacggtgtatgggcnttcgatttctccagaaagatgggagggaga

SEQ ID NO: 46726 - DNA, 101 bp, rice(Oryza sativa)
  misc_feature (71): n=a or c
atctatagctactgaacagtgaacatattaagcttctagaaaaccaacatataagagcaatgcgtgttcancacttcaactaacaattcaataacttgcaa

SEQ ID NO: 46727 - DNA, 101 bp, rice(Oryza sativa)
  misc_feature (71): n=a or c
attggaaatctttgtgttgggtgctgtgattgcataaatgttgactagttgaagtgaaattgtacttttgnattagtagtttatggtaatacaaagtatgc

SEQ ID NO: 46728 - DNA, 101 bp, rice(Oryza sativa)
  misc_feature (71): n=a or g
ccgtcggcggcgatgggaggggcggatccggtgacctcttctcctccctcacatatcccatcgcttgttcnccccctcttgcgcggatccaccgtcggcgg

SEQ ID NO: 46729 - DNA, 101 bp, rice(Oryza sativa)
  misc_feature (71): n=a or g
caatttgagcctgaaaatatatatatattgtaaaatatttcattccagctgaactaagggtgtgtttgagnagaaggggattggggagattggaaagatac

SEQ ID NO: 46730 - DNA, 101 bp, rice(Oryza sativa)
  misc_feature (71): n=a or c
attttccactccgcatgcaaaacaagggcctatgaaaatcgtggacgtttgcaggtaccaagaaccacccnaaaaaaatatatttacgcaaatggatatct

SEQ ID NO: 46731 - DNA, 101 bp, rice(Oryza sativa)
  misc_feature (71): n=t or c
atttgaaatatagcaaacctagtacttacaaaaaatgacttttacacactaagactgtgtttgttccagcnggttcccaactctcccctgccgtttttcgt

SEQ ID NO: 46732 - DNA, 101 bp, rice(Oryza sativa)
  misc_feature (71): n=a or g
gatttttttttcacctttcaaggaacaaatcctctctcacacaaaatagtttacctttagttacatcactntgttgatactgataccttttgttatctagg

SEQ ID NO: 46733 - DNA, 101 bp, rice(Oryza sativa)
  misc_feature (71): n=a or g
ccatgaccgcgtgcaaaagagcgacgtgagaagtattgggaacgaaaccgagccactagaagtggagaacnaaatatccaaagttgagaactcgattaatt

SEQ ID NO: 46734 - DNA, 101 bp, rice(Oryza sativa)
  misc_feature (71): n=a or c
acgcgacggccgatcgacccacgtgaccgatcgaccgcgactccgccgtatgatgtcccgtcctggcgagnccggcgcccacccgcacgcgcatttgccaa

SEQ ID NO: 46735 - DNA, 101 bp, rice(Oryza sativa)
  misc_feature (71): n=t or c
gcatagtcctcacccccccccccccagaagtaaaggctcgaggccccatagcccccatgctgcatccaccntgcatgtgattatatgataatcaatttgag

SEQ ID NO: 46736 - DNA, 101 bp, rice(Oryza sativa)
  misc_feature (71): n=a or c
cccttataatgaagcaaatgtttgtacacacttgaatgccacatcaccaaaacatacgacaatcccaaccnaaaaactatcgaatatttttcatactcgtc

SEQ ID NO: 46737 - DNA, 101 bp, rice(Oryza sativa)
  misc_feature (71): n=a or g
aattcctatgcttttccttcgaatcaaagggtgccctaaactaaccaacgtcaagaaaaggtaacatgtcnaatgaagtactagattgctactccctctgt

SEQ ID NO: 46738 - DNA, 101 bp, rice(Oryza sativa)
  misc_feature (71): n=a or g
ttgttgctgaattgggtgggtgatcactcgatcgtgtcaaaaccttgaggagctccgacgagcggaagccnccgagccacatgaagaagcgctcggcgggg

SEQ ID NO: 46739 - DNA, 101 bp, rice(Oryza sativa)
  misc_feature (71): n=a or c
atttagctgcttagcttcgacttgggaatagatcacgtcgcttacgccgtggtcgtacgacagtcggacgncgtagtcgtgtgtgtagcattttcctaata

SEQ ID NO: 46740 - DNA, 101 bp, rice(Oryza sativa)
  misc_feature (71): n=t or c
gttacaacccattagaggtgagacgcctgtgacgggtctaaaggtgacatcccgtgtacccattctatgangtatctaccttgatgcccgtcacagataac

SEQ ID NO: 46741 - DNA, 101 bp, rice(Oryza sativa)
  misc_feature (71): n=a or c
ggcgcctccaagacgacggcctcaactaacaccctactatatactactaatgataatgttaaatcttaacncatgttttatgtactactcctacagtccat

SEQ ID NO: 46742 - DNA, 101 bp, rice(Oryza sativa)
  misc_feature (71): n=t or c
ccgtttatctgaatgcaattagaaaagaacgtggttgattttctgaacatacctgtaagtaaagattttcntgaatgtttagttcccaaaaactttttccc

SEQ ID NO: 46743 - DNA, 101 bp, rice(Oryza sativa)
  misc_feature (71): n=a or g
ctctcgtacacacactaaggctatgttctttcctcatgattgggaacactttcctccagcacggaaaacanagtagtccattatcgcgtggttaattaagt

SEQ ID NO: 46744 - DNA, 101 bp, rice(Oryza sativa)
  misc_feature (71): n=a or g
agatatatgacatccctcaattttcgaaaccggtcactttacatcctcaagcggttttgatcccggttttntcctacgtggcaactgaatcaatatgggac

SEQ ID NO: 46745 - DNA, 101 bp, rice(Oryza sativa)
  misc_feature (71): n=a or g
atccaatagtaacaattgtatcgaaacctacaagttcatatatatccaatagtaacaattgtatagttttnagaaaatccatgaaatgccatcgacaagca

SEQ ID NO: 46746 - DNA, 101 bp, rice(Oryza sativa)
  misc_feature (71): n=t or c
tgcacacgtggcgctaacgtggcaatccagtcagcaaaaagactccttgggcccacttatcatatctctcnctcccctctctatctctccccggtccctct

SEQ ID NO: 46747 - DNA, 101 bp, rice(Oryza sativa)
  misc_feature (71): n=a or g
gtaaacttgagttcagcaactgcatagacatcaccatttggtctcatgaagctcactagtgaagtcatatngtatggattggtatctgtttatccaagaac

SEQ ID NO: 46748 - DNA, 101 bp, rice(Oryza sativa)
  misc_feature (71): n=a or g
agagggaggaggaggagggacagcgccgtcgggagagtagtagtgcgtctgcgtgtgagtaagagatgcgnaggagagagaggaggagagagagagagaaa

SEQ ID NO: 46749 - DNA, 101 bp, rice(Oryza sativa)
  misc_feature (71): n=t or c
taaagtttgacattacctaaacaaacagaaaaaggaaatttgatcgtgtcatgcatagaggaagtatggcntaacatagcaattgatgataatcgagaaaa

SEQ ID NO: 46750 - DNA, 101 bp, rice(Oryza sativa)
  misc_feature (71): n=t or c
atcaagctccattgacttcgtcgtcttcccctactgcaaacaatgaccggttgagatggtggtgggactgncacacgcgcgcgctgggctgggcgtggctt

SEQ ID NO: 46751 - DNA, 101 bp, rice(Oryza sativa)
  misc_feature (71): n=t or c
caaatcagtcccatcggtttagcctatggatgattataaactgtatagcttaatgacaaaaagtcatttgngaataaaactttaataaatgtgctcatagt

SEQ ID NO: 46752 - DNA, 101 bp, rice(Oryza sativa)
  misc_feature (71): n=a or g
tgactataccatcgagggttagggtcttggggcgttcttgacggtcgctgcaatggcgcgctcccacacancggcatcctcttcggcaggggctgcgatgg

SEQ ID NO: 46753 - DNA, 101 bp, rice(Oryza sativa)
  misc_feature (71): n=a or g
ttaaatattcacatcaaacaaaaataccactattttattagttaattaccccactgctatcgattacaatnattttatttaatttgtgtattgtctctctc

SEQ ID NO: 46754 - DNA, 101 bp, rice(Oryza sativa)
  misc_feature (71): n=t or g
aaaattgcatcactttgaccagtttgccgatcccaaatgaagctttatcaattgggtaattttaccatccntaagaaagtaccggaatgtatcatattttt

SEQ ID NO: 46755 - DNA, 101 bp, rice(Oryza sativa)
  misc_feature (71): n=a or c
attttttcaatcacaattttgttgatctttttatatgtttaatgacatattactgcatgctagttgtactntctattttcttaccattaaaacatgataaa

SEQ ID NO: 46756 - DNA, 101 bp, rice(Oryza sativa)
  misc_feature (71): n=t or c
atcgttttcaagaaatttaaagttaaaacagtaaactcgagtaaacattctagaaaaaccgatggaatttnacgaaaactggtcggttttcataaaatcgc

SEQ ID NO: 46757 - DNA, 101 bp, rice(Oryza sativa)
  misc_feature (71): n=a or g
ccgaaaatagaaagaaaacagaagcaacaatacacgacacgaaactatggaggcctaaaagccgagcgacngagatcaagatcttgttttactatatatgc

SEQ ID NO: 46758 - DNA, 101 bp, rice(Oryza sativa)
  misc_feature (71): n=t or g
ctccttgacagaggcatagggtctgctcggctgcctttgctgttgttggcttgttgctgctgtggctgctnctactgccagcatctgtggccctcaacggc

SEQ ID NO: 46759 - DNA, 101 bp, rice(Oryza sativa)
  misc_feature (71): n=a or c
tattttattataaattatattttttggctcaaagcctaatagaaataaataaagatagatgaaaagacganatggcctgacggccatatcaaccaaagaaa

SEQ ID NO: 46760 - DNA, 101 bp, rice(Oryza sativa)
  misc_feature (71): n=t or c
ttcacattcaactcggagtagaaaccaatggaaatccgaaacgaaccttctcgagcaaggaaacccgaaangaacctgacgaaaacagctcggggtcggac

SEQ ID NO: 46761 - DNA, 101 bp, rice(Oryza sativa)
  misc_feature (71): n=t or c
ttggggttatagtcgatggttctctcttagttccatctctactgcaaaagtagacatgagagtttcttctnatccagctcctcgcgaatcaaatgagaaag

SEQ ID NO: 46762 - DNA, 101 bp, rice(Oryza sativa)
  misc_feature (71): n=t or c
acccttcccttatcttctctaccaccacagccgcggacacgactcttctgcgatagccgcatactccatcngtcaaaaaaaaaataatctagacaaagatt

SEQ ID NO: 46763 - DNA, 101 bp, rice(Oryza sativa)
  misc_feature (71): n=t or c
atgatctttttttcccctcggggggcttttctccttttgttgatgtcatttaaaaagtcatcaagcttttntaaaaaataataaaattttatgttatttca

SEQ ID NO: 46764 - DNA, 101 bp, rice(Oryza sativa)
  misc_feature (71): n=a or g
gatgggctctgccatggtcatgggccctcaagcggtcacccgggttgccaccatccttgagccccttcatntatatgagccgtgcatgggaagaggagaag

SEQ ID NO: 46765 - DNA, 101 bp, rice(Oryza sativa)
  misc_feature (71): n=t or g
aggctgaaaacgccgtccttcagcaaatcgcagcaagtgcagccgctaccgctacccacattgcccaaggngcgggcggtggtggacaccatgccgccggg

SEQ ID NO: 46766 - DNA, 101 bp, rice(Oryza sativa)
  misc_feature (71): n=t or c
gtctcctaacctatccattttttcagcttgatttgtgtctcctaacctatccattttttcagcttgattgncacccttttagtattgccaaaatcttgttt

SEQ ID NO: 46767 - DNA, 101 bp, rice(Oryza sativa)
  misc_feature (71): n=a or g
aaattcgccaccaggtgtagccctccatgggctatgcttgaggcacatttgtcgcctttccccaagcgcanccccatgtggactgtgctcagggcgcatcc

SEQ ID NO: 46768 - DNA, 101 bp, rice(Oryza sativa)
  misc_feature (71): n=a or c
gcgattgggaaaaaattcgctcccttaaaagtaggaaacgagatatccggagttgggaacttggattattnggagacaggttagggattctgttggatacg

SEQ ID NO: 46769 - DNA, 101 bp, rice(Oryza sativa)
  misc_feature (71): n=a or g
cataatttgacttattcttttcgtatgggcacggattaggataaattttgtatgaaatttagagctctacnacttaactttttcatttgaaatcttttaaa

SEQ ID NO: 46770 - DNA, 101 bp, rice(Oryza sativa)
  misc_feature (71): n=t or g
aaaacaatcgatctattttctacatctattttctaatcattattgagcaacccattatttccaacaattanatctattttgaggaaaacattaaaccgcca

SEQ ID NO: 46771 - DNA, 101 bp, rice(Oryza sativa)
  misc_feature (71): n=t or c
cactacgaggtcgcgaggtgtggttcgactcgtaccttaggagctgttatacggccatggccggagtctgnagggatctccgagtacctcgcgggaatccc

SEQ ID NO: 46772 - DNA, 101 bp, rice(Oryza sativa)
  misc_feature (71): n=t or c
ttccttcaaggaaattgctatgtatatgacccaactgtccaactcacttgcgactgaatttgatcaacggntgtaaatgggtacaatgatataaacatgat

SEQ ID NO: 46773 - DNA, 101 bp, rice(Oryza sativa)
  misc_feature (71): n=t or g
ctgtcaactgtaagcttttcctctggcttgtgttccagcagcgctgctagacggcagatcttctgcataancatggtattgacaaccactcgacttgcccc

SEQ ID NO: 46774 - DNA, 101 bp, rice(Oryza sativa)
  misc_feature (71): n=a or t
gcgatacttcttgtcgactcgacggccattgttgcacaaaactgaaatgcactggacatcatctttttttnaaaaaaacaaataaatcagcacgagattat

SEQ ID NO: 46775 - DNA, 101 bp, rice(Oryza sativa)
  misc_feature (71): n=t or c
tccatggataaaggtcaaacgatcaattaaagttggctggattaatacggtttcaggcaaggtgtttaccngtgatgatttctagacgaggacgagtgggc

SEQ ID NO: 46776 - DNA, 101 bp, rice(Oryza sativa)
  misc_feature (71): n=t or c
aactaaaaaaccagatcgaaccaaaaaaaatcgtccaccggcgacccggacaaaaactaccagatcggacnggaaaaaactcagtgacctagatcgtagca

SEQ ID NO: 46777 - DNA, 101 bp, rice(Oryza sativa)
  misc_feature (71): n=a or g
caaccaattgttggctccaaaattattcacaccaagaatagctattgtcgacggataatacccgtagaccntattccgagggtattggggtacactggagc

SEQ ID NO: 46778 - DNA, 101 bp, rice(Oryza sativa)
  misc_feature (71): n=t or c
aatcattgccgcatatgtacagtaacgattatttttaagatttataatcttaaaataagtctcatcccatnctaaattataatattttaggatggagggag

SEQ ID NO: 46779 - DNA, 101 bp, rice(Oryza sativa)
  misc_feature (71): n=c or g
ttacatcgattgtacctcctttattccaaaacagaggtgagatgaataagagggatactagtatctggagntaaaaggaatggaaattcaatttaaaatga

SEQ ID NO: 46780 - DNA, 101 bp, rice(Oryza sativa)
  misc_feature (71): n=t or c
aatgtaaattcaaaacttttgttaatttttttaatacaattgtttttatatggatgagtatacgtatttgnatttgtactatatttttttacgcgtatttg

SEQ ID NO: 46781 - DNA, 101 bp, rice(Oryza sativa)
  misc_feature (71): n=a or t
gaagaacaaaactagtactgtcctgtactaagctgttaggagatggagggaaggaaacacacctttttttnaaaaaaaatggaaaagcatactagtgtcat

SEQ ID NO: 46782 - DNA, 101 bp, rice(Oryza sativa)
  misc_feature (71): n=a or t
ccgtcgcatttggcgcgtgcccatttgcttagtactaaagcccagtctgtacgtagaagactaaggcttanggctctgttcttttggttgagttgggaacc

SEQ ID NO: 46783 - DNA, 101 bp, rice(Oryza sativa)
  misc_feature (71): n=c or g
attcgccccacgttcgcgattggcagcaacctgtcctgctccttgatgatctccgccgccgcctgatccgncgcctccccctgcagctgctgctgccggcg

SEQ ID NO: 46784 - DNA, 101 bp, rice(Oryza sativa)
  misc_feature (71): n=a or t
tgtgctcggttgtaaggggttgaacgggagaagggaattgcttattcgagccgatgcattgagccggtatntttttttttttgcgttccagagacctcaaa

SEQ ID NO: 46785 - DNA, 101 bp, rice(Oryza sativa)
  misc_feature (71): n=c or g
gtcctcgcttcgggacaccccgttccgggtcgtctatggcagggatccaccctccatccgctcctacgaancgggggacacgcgggtcgccgccgtcgcca

SEQ ID NO: 46786 - DNA, 101 bp, rice(Oryza sativa)
  misc_feature (71): n=c or g
tttacacgagtaccccctattttttcagagatccaacatacaaaaatgtattaacatacttaaacatgaangtacaagaaaatatatgtattgtacaatgt

SEQ ID NO: 46787 - DNA, 101 bp, rice(Oryza sativa)
  misc_feature (71): n=c or g
agactataacacactaattaatttatcaagccaggagcggttacattcagttcatggtaagacatccatcntcaaatataacaacgcagtaacgaatactc

SEQ ID NO: 46788 - DNA, 101 bp, rice(Oryza sativa)
  misc_feature (71): n=a or t
gcaccttgacagacaaaaccatatcaatttaactccctcgtttgcactgactcggcgcttacttttttttntaaaacctaagtcagcctgagctgatttta

SEQ ID NO: 46789 - DNA, 101 bp, rice(Oryza sativa)
  misc_feature (71): n=c or g
ttttcctttttggcttgatttttccatgggctcagtaattttggcctatttattttcttcaacttttttantttttaagtttgtttttaattttatacgtg

SEQ ID NO: 46790 - DNA, 101 bp, rice(Oryza sativa)
  misc_feature (71): n=c or g
gcagtgtttgtgtgtgtgtgtctctcaagaactaagctaatcaggagggcaaagagggagcaaggccatgntgatgagtgagtgagaaagctcaaatgttc

SEQ ID NO: 46791 - DNA, 101 bp, rice(Oryza sativa)
  misc_feature (71): n=c or g
tagtcaaccgaaaccaacagcagctccaggatttgcatctaggcgaagccaaacccacataacgaacgcancgctccctgcgaaagctgagaggagagctc

SEQ ID NO: 46792 - DNA, 101 bp, rice(Oryza sativa)
  misc_feature (71): n=a or t
tcaggtccacattcaacttgaattgctgtcacagaaaaagggaacataattggaagctgcacgttgagccnagaacacaataaaaaacacaccatttttac

SEQ ID NO: 46793 - DNA, 101 bp, rice(Oryza sativa)
  misc_feature (71): n=a or t
taatttgggcactgaaatttttctagagattgattatgaagatttaagagtatcgctttgcataatcatcngaattttgataaaaatcaaacaactattcc

SEQ ID NO: 46794 - DNA, 101 bp, rice(Oryza sativa)
  misc_feature (71): n=c or g
taggtcaagcatgtcgttcagttattgatcagaggaagaggaaagaacaggtcaatctccctgttgttcanatcctggaggggtctcgcgttgttctcatt

SEQ ID NO: 46795 - DNA, 101 bp, rice(Oryza sativa)
  misc_feature (71): n=a or t
cgctaagcatcgaattttggtaatctaactacgtcttaacatggccatgacataggctgtagcatccacanaactaggtagccagcactagtctgatagac

SEQ ID NO: 46796 - DNA, 101 bp, rice(Oryza sativa)
  misc_feature (71): n=a or t
ctagatgttgcagcataagccacaggatgtgaggcagtgattcttcctcaaaacctccagaatagcccganggttgccacatagaagacatctacaagata

SEQ ID NO: 46797 - DNA, 101 bp, rice(Oryza sativa)
  misc_feature (71): n=c or g
ccgtcgggcagatgaccatcgtggaggtcggaagcgttggcctcattgttgacgtgatcaacgtcgttgcnaaggccgaggcgcagcataacatagtggcc

SEQ ID NO: 46798 - DNA, 101 bp, rice(Oryza sativa)
  misc_feature (71): n=a or t
agtgggactctccctgatgaactcttcaatgccacctccttggagcacctgtctgttcccaacaatggttnaaatggaacactcgatagtgcgcatatcat

SEQ ID NO: 46799 - DNA, 101 bp, rice(Oryza sativa)
  misc_feature (71): n=a or t
gcatcagagaagtgccaacgcaaagaacagagtttgaaagcgagactatacgcaagcaaagcgatcatccntgggcgccgtcctgggcaccgggagggtgg

SEQ ID NO: 46800 - DNA, 101 bp, rice(Oryza sativa)
  misc_feature (71): n=a or t
tgttttcagtccttgctttccggatccatgaggcgccttgatccgatttctgattagcttctttgtgaatnatacacatgcaggatttacatggcttcaaa

SEQ ID NO: 46801 - DNA, 101 bp, rice(Oryza sativa)
  misc_feature (71): n=c or g
tcaggagaaaaaatgaacgcattttcatactctaatacgcaatgtcatactctaataaaattgtaaagtantcttgctgcgctcgtaaagaaagtcgttta

SEQ ID NO: 46802 - DNA, 101 bp, rice(Oryza sativa)
  misc_feature (71): n=c or g
cttcaatgaaatgcagttctcctgcgttttcgagaaaaaaaaacatatagtccctgctcgccagctaaccnttgtctcagcccatgaaaatatgtacatat

SEQ ID NO: 46803 - DNA, 101 bp, rice(Oryza sativa)
  misc_feature (71): n=a or t
tatccgagaacgaccgttggagttcgacaaggaacatggaatgaagcaatggtgtgcctgccgagacgaantttcttgacttcaatccaaactctcaatta

SEQ ID NO: 46804 - DNA, 101 bp, rice(Oryza sativa)
  misc_feature (71): n=c or g
ataccctatatacctcataaaacttatcacacattttgtgtatgggtatcatcaaccaacaaatagatagncaaatcacaatcatccaatgccaagcaagg

SEQ ID NO: 46805 - DNA, 101 bp, rice(Oryza sativa)
  misc_feature (71): n=a or t
tgtgtagggtttgggggggaggggagggaccgatttcttccggcgagatccgccaaagtcgccggagttcngctatcgccggtgtcaatcaagaggagggc

SEQ ID NO: 46806 - DNA, 101 bp, rice(Oryza sativa)
  misc_feature (71): n=c or g
aattgaaggattggtttcaggatagaaacaaagaaccaactccaagttgaaagtgtagagaaagagcaaancaaagaggctggcagagagccatatctcat

SEQ ID NO: 46807 - DNA, 101 bp, rice(Oryza sativa)
  misc_feature (71): n=a or t
tctacgatttgctcgtggggagcggagcgaatgctaaaggaaacgcccccaaggtgatacaccgaaactanttttccacatgccattattaactgttagta

SEQ ID NO: 46808 - DNA, 101 bp, rice(Oryza sativa)
  misc_feature (71): n=c or g
tgctccccagcaggtcgctcacctgaaccacaagtccacaagaaacaaaaggttttgttttagttttttanctttttacctgcaaaattcacttctttaat

SEQ ID NO: 46809 - DNA, 101 bp, rice(Oryza sativa)
  misc_feature (71): n=a or t
aaatgcagaagcaactgagatggttccatcctttgactccacaactacaggaaaagtaacttattttagcntattttacatattgaggacatgatcattgg

SEQ ID NO: 46810 - DNA, 101 bp, rice(Oryza sativa)
  misc_feature (71): n=a or t
ctggaactggatgctttgaaagcttacaagagcaagagctgggataaagggatctgtatgcaactggctanatttgataggatactggagtacatcactag

SEQ ID NO: 46811 - DNA, 101 bp, rice(Oryza sativa)
  misc_feature (71): n=a or t
ttcctatcggaagatcgggacctaacaccctcatcaatattgccccttcgttgtttcactgttggcggccntattgtattgtccttatattattaaccatt

SEQ ID NO: 46812 - DNA, 101 bp, rice(Oryza sativa)
  misc_feature (71): n=a or t
ttattaacacaacataaagggctccacacgtgttgccaaagttgccacgaaatgatgctcagttttttttnaaaaaaaataaccatgtccgttggtgcgat

SEQ ID NO: 46813 - DNA, 101 bp, rice(Oryza sativa)
  misc_feature (71): n=a or t
tcttcgcattccgttcattttggcgcacggagcaaccccatctgcacatggaattaaaccatttttttttnaaaaaaagagagcgtgcagtgagagagaat

SEQ ID NO: 46814 - DNA, 101 bp, rice(Oryza sativa)
  misc_feature (71): n=a or t
acgatataactattacttgtaacattgtgtagcaatatgttattatgccacattagctagctatttttttnaaaaaaatctgcatatatatggattatgga

SEQ ID NO: 46815 - DNA, 101 bp, rice(Oryza sativa)
  misc_feature (71): n=a or t
cattgtacctccaaatgtacagtaataatgaaggagcaatcatggagtaattggttcacttagggcaagtnctataatgctagatgtgttgcccctaaaca

SEQ ID NO: 46816 - DNA, 101 bp, rice(Oryza sativa)
  misc_feature (71): n=c or g
aataatcagccgtgatacggttggcgaacagaagatcgagcaagtgttcaaacgtactagtactacgtacnttccctaagctggcctggccggtggtcatc

SEQ ID NO: 46817 - DNA, 101 bp, rice(Oryza sativa)
  misc_feature (71): n=a or t
tctcaccaatcttgaagcaccggaaaaaagtaaagcaatttggatttttttaattagcgtatacgctccgnattccagtggtgccctacgaatttgtatcg

SEQ ID NO: 46818 - DNA, 101 bp, rice(Oryza sativa)
  misc_feature (71): n=c or g
atgtttggtaggatcgaaagcaatcaaaaaaatgtagaattcagataatgggcgtggagttgcgtgggttnagagatgggcgtggaggtggaccagcgatc

SEQ ID NO: 46819 - DNA, 101 bp, rice(Oryza sativa)
  misc_feature (71): n=a or t
gaataactgatgcaattagaaacatgaagcagcagattaagagctgcatggctgacaatctcttttttttnaaaaaagaagtccatttgtatcgttagaaa

SEQ ID NO: 46820 - DNA, 101 bp, rice(Oryza sativa)
  misc_feature (71): n=c or g
tttggaacaattcatgtgagtaaataattccaagtggagttggttatcatgctaactactttatattaatnttgtactccctccgtctaaaaaataattca

SEQ ID NO: 46821 - DNA, 101 bp, rice(Oryza sativa)
  misc_feature (71): n=c or g
ggtgtgagaggtaacctcactaactcaatgtgaggaggtatctctatccaactatcccaactccatccctncatccctccatccaaacaggtgataggacc

SEQ ID NO: 46822 - DNA, 101 bp, rice(Oryza sativa)
  misc_feature (71): n=a or t
agaggagttaaatgggtgtgagatggttcttgtgttgggtatgggccttgtaagttttagggcataaggantggttcggggtaagcttggctaacctattt

SEQ ID NO: 46823 - DNA, 101 bp, rice(Oryza sativa)
  misc_feature (71): n=c or g
cgacgggaacacggcggaggacaccaggatgttcaccgacaccgtcgtcaagctcaacctccagatgctcnccgccgtcgccgaggactcctcctctgctt

SEQ ID NO: 46824 - DNA, 101 bp, rice(Oryza sativa)
  misc_feature (71): n=c or g
cgagaaaccataaagggatacctagctatttaaggaggtaggagaatgaactaggggtccctaggtttgtnctccacctagttggggcgtacctcacatgg

SEQ ID NO: 46825 - DNA, 101 bp, rice(Oryza sativa)
  misc_feature (71): n=a or t
ttccccccagatttcccaagcaatgagcaagaagactaatttgagctctttgtgatttgctgcttccgggntgcttattccttgtgtctatcaatccaata

SEQ ID NO: 46826 - DNA, 101 bp, rice(Oryza sativa)
  misc_feature (71): n=a or t
tatacctgcaatcaactcactaactgctaactcaattgtcttagctcttcactccaaccatacatatacangtgttaatctttaaaatattttttcaccta

SEQ ID NO: 46827 - DNA, 101 bp, rice(Oryza sativa)
  misc_feature (71): n=a or t
cagcaatccagtgttttggaggcaaggggtgagggtggtgagtcggtgagccgaagaaaaaagaagcaggngttggaaatttggtcataattcggcatatt

SEQ ID NO: 46828 - DNA, 101 bp, rice(Oryza sativa)
  misc_feature (71): n=c or g
ccagaactaggaacatcatgtagttggaaataagattgattgcttcaacatactcggtggtctctgccttntcggaggtgcggaggtagatgtccgtcgcg

SEQ ID NO: 46829 - DNA, 101 bp, rice(Oryza sativa)
  misc_feature (71): n=a or t
cttggaatctctctgcatattgggtatattagaaggaagatggagaaaaacaagaagggctggataatgcngcctctctgaattagccaggttccaggcat

SEQ ID NO: 46830 - DNA, 101 bp, rice(Oryza sativa)
  misc_feature (71): n=c or g
ttacatatcagccatacttaaagttagacaaaaaaaagtactacagtacagaggatatgtgttccatactngaccatgcaatagtcacgagctgcctcttc

SEQ ID NO: 46831 - DNA, 101 bp, rice(Oryza sativa)
  misc_feature (71): n=a or t
gtaaagctctaagagatccaaaggattgcttgggtctacactctcattttccaattgttcctgtcctccanggtatacttgagctacagattcaaaagcac

SEQ ID NO: 46832 - DNA, 101 bp, rice(Oryza sativa)
  misc_feature (71): n=a or t
tcaggacgtggccgtagctcctcctcgttcatcatcacattactattattattcgtggagcttgcaatacnatgttgatctgctggcgcagcgcagctgct

SEQ ID NO: 46833 - DNA, 101 bp, rice(Oryza sativa)
  misc_feature (71): n=a or t
tctggtcatattaacggtacagggcttactagaatgggatttgcattttaggtctaagaagaattatacanggttaaaaattttatctttagttttgatac

SEQ ID NO: 46834 - DNA, 101 bp, rice(Oryza sativa)
  misc_feature (71): n=c or g
gaaggtgaagaagaagaagaataaaaacgaggagaaggagaggcccgggctgaaggtgacgatgctggacnatggcggcgacacgtacgcgacgacgtgca

SEQ ID NO: 46835 - DNA, 101 bp, rice(Oryza sativa)
  misc_feature (71): n=a or t
taataaaaagggtggttgcagccttgcagctggttgttcatagcgatcaaaattaaatgccccaagacctncgtacttggtgttgagattatagacatata

SEQ ID NO: 46836 - DNA, 101 bp, rice(Oryza sativa)
  misc_feature (71): n=c or g
gggagatcctttgtctcccctgctatttaacttagctgttgaagctttgaccttaatggtgaatagggcanatgtcacgaccggaattaacccaacgggcg

SEQ ID NO: 46837 - DNA, 101 bp, rice(Oryza sativa)
  misc_feature (71): n=c or g
gcgcggcgcggcaaatcacattgcagccatgtcgacacgaaggccagaagagctagcggaggcaacaagtnaagcgtctcccagctacaaatcgcgcgcgc

SEQ ID NO: 46838 - DNA, 101 bp, rice(Oryza sativa)
  misc_feature (71): n=c or g
ttttggatcacacctttatctaaacctatccccaagaacctttatttcctctacatcgatccaaaatattntagggtcaagttcctattttgatcgagccg

SEQ ID NO: 46839 - DNA, 101 bp, rice(Oryza sativa)
  misc_feature (71): n=a or t
ctaaccagagttgtacgaagctgtaaagcttgttttcttatacaggttgttgtgggcaaacgttacaccanggtttgcaaagcgtgccgtttttgttgtaa

SEQ ID NO: 46840 - DNA, 101 bp, rice(Oryza sativa)
  misc_feature (71): n=a or t
atatgtgtgctttacttgtgctatcctgatgtgatgacgccatttcgctgacgatttgtgccgtttttttnaaaaaaaatttattcgattccccaatcgaa

SEQ ID NO: 46841 - DNA, 101 bp, rice(Oryza sativa)
  misc_feature (71): n=t or c
agtctataaagggattcttgaagataacaccttggtggcagtgaaagcctcaattgaggtaaatgacgctngaaaagaggattttaccaatgaagttatca

SEQ ID NO: 46842 - DNA, 101 bp, rice(Oryza sativa)
  misc_feature (71): n=t or c
ggttgatgcttatgaacatgcaaggaattatgatgttcctcctcgcagtactaccacagtggcattgtcanagaacaaagacactctcaggataccggcaa

SEQ ID NO: 46843 - DNA, 101 bp, rice(Oryza sativa)
  misc_feature (71): n=t or c
gtgaaaagtgtacgagatagaaaatatatcagcagggtcagcttcatcatcaccggtcccggttgccgccnagtcccacttcgcttcttcgtcgaacacca

SEQ ID NO: 46844 - DNA, 101 bp, rice(Oryza sativa)
  misc_feature (71): n=t or c
tacagaagaggttgtcgagtgctttatcgattacctcaacaatggaaagacaattggaatacatgtacctngacacgagggtgaattgactggtaggggga

SEQ ID NO: 46845 - DNA, 101 bp, rice(Oryza sativa)
  misc_feature (71): n=t or g
cagaccatctactaaagtgggtacaacctttgcttgtgaatgaactgtacctggctccaacaaaacacctnagccatccctttccgaatgcctagttgatg

SEQ ID NO: 46846 - DNA, 101 bp, rice(Oryza sativa)
  misc_feature (71): n=t or c
ctattcattgatgttgtttttgcttccattatacatggctttggaaaattattatctgttagactattgcnaggggcaagaaaatggcgaggctgctgggg

SEQ ID NO: 46847 - DNA, 101 bp, rice(Oryza sativa)
  misc_feature (71): n=a or c
ggcttatatttccctatattattctgttgtacagaaatcctcacatgactcaacttcatacacccagcagntggaatggctaacagaacagaactggctac

SEQ ID NO: 46848 - DNA, 101 bp, rice(Oryza sativa)
  misc_feature (71): n=t or c
gctcgggatccagctcgaggaatcaaaggtctgtgaaaaatttctccatgttgttcctgaacatcttgaanagatcgccttgtccatcgagactttgctcg

SEQ ID NO: 46849 - DNA, 101 bp, rice(Oryza sativa)
  misc_feature (71): n=a or c
ggtctagtaaattttcctagcaccgacaaaccacaaaaggaagtcattgtcatcgagtagacagtaacttntgcttctctgacaaccccctaaaaacagta

SEQ ID NO: 46850 - DNA, 101 bp, rice(Oryza sativa)
  misc_feature (71): n=a or g
ctcctagtttcggcatttgttcaaggactcacctatatggaacagctagagacatggttgcctttcctganaaatatactggaaatgttagtgtttatcca

SEQ ID NO: 46851 - DNA, 101 bp, rice(Oryza sativa)
  misc_feature (71): n=a or c
gtacatatgattccttccatctctaggtcaaaccataaggaagatcggaagcaatattccgatgggactgnaaaacgtggtcagccatgcgagcttgaatg

SEQ ID NO: 46852 - DNA, 101 bp, rice(Oryza sativa)
  misc_feature (71): n=a or c
gtgacaatcgtgatgtacgtaccgaataaatgctgacataccggccagtgtccccttatgtacaatttctntctacttggattctttacgtacccgccatg

SEQ ID NO: 46853 - DNA, 101 bp, rice(Oryza sativa)
  misc_feature (71): n=t or c
tacttctgaagcttcaatcttccttaccaaaactccactatgcttctgaacatcaggctgataagcaatcnttgtgttggccaatgccatctgaacacaac

SEQ ID NO: 46854 - DNA, 101 bp, rice(Oryza sativa)
  misc_feature (71): n=a or g
atgaacatcaaacccgccttcctcatgtcctcccgttgcttcactagctcaccagacagtttggtgttttngttctccaactcctgtaccttgtactccag

SEQ ID NO: 46855 - DNA, 101 bp, rice(Oryza sativa)
  misc_feature (71): n=a or g
gttttaaaatcctgtagacgcaaatggttccactcatgcgttgcctctgggaggataatcgctttatgctnttcatgtccagaaagctcgtgggtcctcct

SEQ ID NO: 46856 - DNA, 101 bp, rice(Oryza sativa)
  misc_feature (71): n=t or c
tgtttattgtattgcaataactgcagcatgatgctgaaattacctgttgattttgatggcttactactctngaaagcagacaaacccatccctccattgtg

SEQ ID NO: 46857 - DNA, 101 bp, rice(Oryza sativa)
  misc_feature (71): n=t or c
gagtgaagtgtggaggcgaatcgaatcgatctgattaggagacctgccatttctgtgcttgattttgtttngatctgctccttgggctgtagatctggaag

SEQ ID NO: 46858 - DNA, 101 bp, rice(Oryza sativa)
  misc_feature (71): n=t or c
tcagctcaaaacaaagcaaattggacgacattgcaacggattacaattgctcaccttgcttccactagatncatcggccccatgacctccatcggtggaat

SEQ ID NO: 46859 - DNA, 101 bp, rice(Oryza sativa)
  misc_feature (71): n=a or g
gtgttcgaagggaaagggaacgggtctgaatttgatacatctgatttttggatggagctttgcatgcaatntatggatgagttaatatttttgttggcacc

SEQ ID NO: 46860 - DNA, 101 bp, rice(Oryza sativa)
  misc_feature (71): n=a or g
taattcttgaaagaggcatccactgagatccaagagacgtgagtatcttagtattgggaatatatccgcantaggcattgttgcctcacaatttctgaaaa

SEQ ID NO: 46861 - DNA, 101 bp, rice(Oryza sativa)
  misc_feature (71): n=t or g
tgaacacggtattcccctgtagtcatctcaacgtcctccagttcttggtcaatttgagcaatgccaccatnatcttcaattgcaagactgggaacttcccc

SEQ ID NO: 46862 - DNA, 101 bp, rice(Oryza sativa)
  misc_feature (71): n=a or g
aatgaacttgactgagtatgttctagtgaattctcccaattctcatgtgtaccaggaatctcaacctttgntttttctacaaaacgttcaggaatcttatc

SEQ ID NO: 46863 - DNA, 101 bp, rice(Oryza sativa)
  misc_feature (71): n=t or c
caatgaaaccatatggaagtgttgggcccctccaaaatgtaaattttttgcatggctggtcatccaaatcngtatatggacggtggatagattgcagaaga

SEQ ID NO: 46864 - DNA, 101 bp, rice(Oryza sativa)
  misc_feature (71): n=a or g
ctctagcccttctggttggagcacaagctttcccaaattgcagtagccctgctggagaaggttgttggtgntgagctccctctggtcgtcgtcagtacggt

SEQ ID NO: 46865 - DNA, 101 bp, rice(Oryza sativa)
  misc_feature (71): n=a or g
agcttccccaaagcctaagaggaagagagtaaagaaagttgtggttaaccctattacaaatcctaccacgnaccaatttggagcagctttgtaagtgtttt

SEQ ID NO: 46866 - DNA, 101 bp, rice(Oryza sativa)
  misc_feature (71): n=t or c
aattttcacgatcctcatttgttagttttttaccctaaatctccatccccctagctccatgtcgtctcccntctcaccggcggtgctgccattgctcccat

SEQ ID NO: 46867 - DNA, 101 bp, rice(Oryza sativa)
  misc_feature (71): n=t or g
ggtctagtgatgtgagcctggatggtggtgtcagatgggagaagaacagggttatcaagttagagagcttnctaccaagtatcgattgcgtagaggcagta

SEQ ID NO: 46868 - DNA, 101 bp, rice(Oryza sativa)
  misc_feature (71): n=t or c
cgggtactggcaagcagtgagtcccttgtagcattcaaagaactcttctcctttgctgacgccattttttnctccgctgtaaaagaaataagatagcttta

SEQ ID NO: 46869 - DNA, 101 bp, rice(Oryza sativa)
  misc_feature (71): n=t or c
gaagcctttggacttctacaatctcgttttgccattgtgcgtggtcccactcgtttctttcaacaagagantcttgtcaaaattatgcaagcttgcattat

SEQ ID NO: 46870 - DNA, 101 bp, rice(Oryza sativa)
  misc_feature (71): n=t or g
aaatgccggcacgttagctgcaactagtgtgtgtcacgctacaccgagcattgctcgtgcactccgtagtncattcgctgcctcttgatgctgcccccgcc

SEQ ID NO: 46871 - DNA, 101 bp, rice(Oryza sativa)
  misc_feature (71): n=a or g
ttgaaaaatgggtactatcagtaacaagattgactgtccacaagttcttattatataatgattacctgccnaattcttgtattttgtatgccttgcggcat

SEQ ID NO: 46872 - DNA, 101 bp, rice(Oryza sativa)
  misc_feature (71): n=a or g
gtcgtcacttgctgctctgccttcgtgatcttcacgggtgccagttattgccgtcatcgcttgttgctccnccgtccccgacgccatcctcaccgcgccat

SEQ ID NO: 46873 - DNA, 101 bp, rice(Oryza sativa)
  misc_feature (71): n=t or g
catcgatcctcgtcccgcgcgccgacggcccttccttcgcgtcttgatttgatatggtggttgttgatttncccagttagggcagttgatgatgcgttctc

SEQ ID NO: 46874 - DNA, 101 bp, rice(Oryza sativa)
  misc_feature (71): n=a or g
cctcgtggtgagccctgcgatgctcaccacattctccagcctaagtccgtggttcagggatggacgaaacnccagcccaacggcgctcttcgagatggctc

SEQ ID NO: 46875 - DNA, 101 bp, rice(Oryza sativa)
  misc_feature (71): n=t or c
agtcggtaggaaggctcgctgcaagcaaggctcgagcagagcagaggagcaactgcccaaccctgatttcngaacagcaaacaaggatatcatgttttctc

SEQ ID NO: 46876 - DNA, 101 bp, rice(Oryza sativa)
  misc_feature (71): n=t or c
aagggctggcactctaggtgtctactgctccaacttgttgcaggtctgcctccatataatggccatgcccngggcgtgaaggattgttggtacacactccc

SEQ ID NO: 46877 - DNA, 101 bp, rice(Oryza sativa)
  misc_feature (71): n=a or g
tacatgctcaaccttaccaccttcttcggggttccatgcttctttctttatgcattccatcctcagagtanttggaggtacctcaactctccatcggaatg

SEQ ID NO: 46878 - DNA, 101 bp, rice(Oryza sativa)
  misc_feature (71): n=a or g
gtgggtccccactaccctcccctctctctcccagatttggtcggaggtaaggcagtcggtgagtagcagcngcagctcgtccacggcggcttcagcggcgc

SEQ ID NO: 46879 - DNA, 101 bp, rice(Oryza sativa)
  misc_feature (71): n=t or c
gtactagctaagtatgttgcacccatgatgtacttgcagacaacactggtgagcaacacggtggtgacatnctccagatcccgaatctcctttgccatagg

SEQ ID NO: 46880 - DNA, 101 bp, rice(Oryza sativa)
  misc_feature (71): n=t or g
tcattaactctactgctgtttgagtgagggcatcaattaaagaacccatcccatcccatacagtatgaatntatgtgtgggagagcaccctgagggcatca

SEQ ID NO: 46881 - DNA, 101 bp, rice(Oryza sativa)
  misc_feature (71): n=t or c
ttgagaccacctccaaaccggaggaaaaatattagagtggaactcatctctttctttctccttctgtcccnttctcttcctctccctcttttcccttctct

SEQ ID NO: 46882 - DNA, 101 bp, rice(Oryza sativa)
  misc_feature (71): n=a or g
aggtcgggcgtagcctcaagctatttcaccgatctgtaaccactctaaaagagatgaccatcagaagcatntcattgtgatttgtgaagaacgactgaaag

SEQ ID NO: 46883 - DNA, 101 bp, rice(Oryza sativa)
  misc_feature (71): n=t or c
gaccatgcaaccgtagtgctcgatcttggggacaatggcgtactcctcctccattgattggaagaattggnggccttcgtcgacaagcccagaatggctgc

SEQ ID NO: 46884 - DNA, 101 bp, rice(Oryza sativa)
  misc_feature (71): n=t or c
gttccaacgagcagccgagccgactagtaaaaaacgtagcgtagtgtgtgttggggtcaatcacggtacangcgcccctgtcccgcagaagatgtcacgta

SEQ ID NO: 46885 - DNA, 101 bp, rice(Oryza sativa)
  misc_feature (71): n=a or g
cctggttgcataaagcatggtgatccacccttcacagggcttgccttattacttgacaaacagctatcagntgagaaacaaccttctcccaaagcagtttt

SEQ ID NO: 46886 - DNA, 101 bp, rice(Oryza sativa)
  misc_feature (71): n=t or c
aagcaagttggcaagcattacctgaaggatggcaacaccgcaattcctgacacatagaggtactcgtcgangccttggaggttcttaagtatgtcagcttc

SEQ ID NO: 46887 - DNA, 101 bp, rice(Oryza sativa)
  misc_feature (71): n=t or c
gggcccacacccacactggcaggagataaggtcaagccttctctcggcttctcccctagctcctcaatttnctctctctctctccacttctccccttctct

SEQ ID NO: 46888 - DNA, 101 bp, rice(Oryza sativa)
  misc_feature (71): n=t or c
tagtagccacctttagccacacgccaagcaaaaatcttaaccttatttggaactgagttccaaatcttctncagatgctccgttctccactcgccgagcag

SEQ ID NO: 46889 - DNA, 101 bp, rice(Oryza sativa)
  misc_feature (71): n=a or g
tattttactttagatcaagtttaaactgattcggttgtataaatttatatttagggatacacacatggtanaatagatgagataaagctttatcgggttcc

SEQ ID NO: 46890 - DNA, 101 bp, rice(Oryza sativa)
  misc_feature (71): n=a or g
gttgcattgctgcttgctcttggtgagacattcatgtgttggaattgggtttggaattgtaggcggcggcngcagcagcagctggttcaggtacaggtcac

SEQ ID NO: 46891 - DNA, 101 bp, rice(Oryza sativa)
  misc_feature (71): n=t or c
atcattttgacgtactgccttgttgtagtaatcgcgcgtaaccagtctctcaggcagacagaatggaaagntctgctgcagctcgggttttcacatgtgta

SEQ ID NO: 46892 - DNA, 101 bp, rice(Oryza sativa)
  misc_feature (71): n=t or c
gccgccgctatttaagtgagtgtctcacactctcactccactactcttctttagttatccaaaacatatanatatatattaaaaaaatactgtctctgtcc

SEQ ID NO: 46893 - DNA, 101 bp, rice(Oryza sativa)
  misc_feature (71): n=t or g
tgaagaggtaatcacgttatgttgtcctgtttgatcatctggcctgtttgtaccttgtgtcagctataacnctgtttctaagaaccataaactaaagccga

SEQ ID NO: 46894 - DNA, 101 bp, rice(Oryza sativa)
  misc_feature (71): n=t or g
tgggaagttctcttcagttgatcgtgcgtttcttcttggtcgttatcttccagttgatggccctgaaatantggacaggatggattcccgagcttatgttt

SEQ ID NO: 46895 - DNA, 101 bp, rice(Oryza sativa)
  misc_feature (71): n=a or c
cagtggcatcattaacatcggccatgattggtgccattttcatgtcaatcttcttcatttggagaacaagnttgccaagcctcttcagcgacgacaaggag

SEQ ID NO: 46896 - DNA, 101 bp, rice(Oryza sativa)
  misc_feature (71): n=t or c
ggaacggggtaaagttaagttaactgctttcggctgggatctacgcgttgcgtgcattacgttatgatganagcatgttaagaaaaccaattctggtttgc

SEQ ID NO: 46897 - DNA, 101 bp, rice(Oryza sativa)
  misc_feature (71): n=t or c
aactatacaggtattgcctatcatttgcagatttaaatgaacagctactgtgatgtgagggccaaaaaaanaaagatgaatataattagcttgtcatttga

SEQ ID NO: 46898 - DNA, 101 bp, rice(Oryza sativa)
  misc_feature (71): n=t or c
ccgctctccatcgtcagcgacagagaccccgtcttcaccagcgcgttctggacggaactgtttcgccttgncggggtcaagctcaccatgagctcggcgtt

SEQ ID NO: 46899 - DNA, 101 bp, rice(Oryza sativa)
  misc_feature (71): n=a or g
attgttacctatccacatcctgttcttgaaatatagcactcctttaagagtaaagtttggaaccgcagctncactgatgcaaagagtctgaactttactta

SEQ ID NO: 46900 - DNA, 101 bp, rice(Oryza sativa)
  misc_feature (71): n=a or g
agttaaattaatgaacacaaccacagaaatatggtgatggtgatgtttcactgaaccaacagttagcaccngtctagtaaaggcttccactgcgagttgac

SEQ ID NO: 46901 - DNA, 101 bp, rice(Oryza sativa)
  misc_feature (71): n=t or c
aaaacagcaggcagcattagtggaggaatcagagggagagctgcagttgcagatgatttccatgctcctgntcattcaaggaaactttcagttaatagttt

SEQ ID NO: 46902 - DNA, 101 bp, rice(Oryza sativa)
  misc_feature (71): n=t or c
agtatcgataacttttactttgattccctcaactgcaccaactacttcttgaacctttctagtgctggtancaaaagcatttgtttccaaccggacatcat

SEQ ID NO: 46903 - DNA, 101 bp, rice(Oryza sativa)
  misc_feature (71): n=t or c
gtcattttatcttctgttcacttttgcacagggtgctttttgactcagcagcccgtattccggctgaaaanttccacagagagggcacacaagatatagta

SEQ ID NO: 46904 - DNA, 101 bp, rice(Oryza sativa)
  misc_feature (71): n=a or g
atagaaccattgcaatacacgggcatatattactagttacacctaattttgtggagtttcatacccaattnagataaggaataattagatttaatgcatat

SEQ ID NO: 46905 - DNA, 101 bp, rice(Oryza sativa)
  misc_feature (71): n=a or g
tgcaccgaagccccgccggctagccttcatgcgccgaaaaatgctccaaacccaatggcagctcctcctcncaccgaggtacgcctcctcaatcgccagcc

SEQ ID NO: 46906 - DNA, 101 bp, rice(Oryza sativa)
  misc_feature (71): n=a or g
attagcggcgggaggcagcgcaatacgttttcactcaacgtagacgcatttgcactctccacccctatgcnctcaacgtatgatggatgtctatgcttatt

SEQ ID NO: 46907 - DNA, 101 bp, rice(Oryza sativa)
  misc_feature (71): n=a or g
gttggcggattggggaatcggcttcgagctgattggttttgactgcgccatccgatttcttcgcttttgtngaggggggcagcacggctgtgcatttcgtt

SEQ ID NO: 46908 - DNA, 101 bp, rice(Oryza sativa)
  misc_feature (71): n=t or c
ttaggcattgtggttgtccttgttgcaacagggacgggataagactgattccttgtgtcatctgtttcttnaatctttctagacagaatattggacacttc

SEQ ID NO: 46909 - DNA, 101 bp, rice(Oryza sativa)
  misc_feature (71): n=a or c
tcttgtaagtgacctttgtcatgatacatctgtccaacttgcacataattacaatcataacaccagtgggnatctaaaccatcgttaaccctcatatgact

SEQ ID NO: 46910 - DNA, 101 bp, rice(Oryza sativa)
  misc_feature (71): n=a or g
tactgacgaaattttaggaaactggtgcaatttactcaagaaaaaaaggctggctagtatctaaaagaccnaaacaaattatttaataaaatcatcactct

SEQ ID NO: 46911 - DNA, 101 bp, rice(Oryza sativa)
  misc_feature (71): n=a or c
ggcattgcgtatcctcaaatgtgctgatgtcatactatcagaagacacaaggcattctggaaagctacttnaacattataacatcaagacacctcttgtga

SEQ ID NO: 46912 - DNA, 101 bp, rice(Oryza sativa)
  misc_feature (71): n=t or c
caagaaagagattttctctccctctctctcttggcttggaactgtggactcattcttcattcttcaatggncaatggaatttgttggataggaagaaccta

SEQ ID NO: 46913 - DNA, 101 bp, rice(Oryza sativa)
  misc_feature (71): n=t or g
tgcagtaccggaaggtgttcgtggacctggtggcgaagacgatacagaaagacaagatgcagctgcagatntaccgcgccccgctccagacgccgctgccc

SEQ ID NO: 46914 - DNA, 101 bp, rice(Oryza sativa)
  misc_feature (71): n=t or c
agcgggtcctctggccgcttgttgcactttcgttgctgcttttctttggtcatttactatcgtgtaggagnatgtcgaatctctagccacctgttgttgag

SEQ ID NO: 46915 - DNA, 101 bp, rice(Oryza sativa)
  misc_feature (71): n=t or g
gctcaagtcagttgaaaccaacttaaagtaggccaaaccattcctaacctccataggagcccacttgtaanctgttgaagaaaatcggtggagagaggtgg

SEQ ID NO: 46916 - DNA, 101 bp, rice(Oryza sativa)
  misc_feature (71): n=a or g
gctcctacaccgctagccatttctgaaaagttgatggtgcatactggtgatcctcttggtgtagaagacancacgaggtacaggagcattgtaggaggact

SEQ ID NO: 46917 - DNA, 101 bp, rice(Oryza sativa)
  misc_feature (71): n=t or c
tcctctctccccatttctcttcaccttggccggactgccggagcagcgatgacatgtcttgtgggtggtgnggccgaggaggtctttgccctctcggcgtc

SEQ ID NO: 46918 - DNA, 101 bp, rice(Oryza sativa)
  misc_feature (71): n=t or c
atggtgtcttgatcgtttagcgttaaccctaaccgcatgaccgagtgtttgtcgcgttgttgtgtcaccgnggtaaaccctagcaccgctgccggccaagg

SEQ ID NO: 46919 - DNA, 101 bp, rice(Oryza sativa)
  misc_feature (71): n=a or g
tggtacagtactttccgataaggattgcttcagtgaacaaactgtcgcatcctcaacaccaggtagagaanaggccaagacgttgggagtgctgtcactag

SEQ ID NO: 46920 - DNA, 101 bp, rice(Oryza sativa)
  misc_feature (71): n=a or g
tcggcctttatttgataggaagctagagccggattattacaagtttgcagcacctcagtttagatcactanaacaaaataaggccaaacaaaaaaatattt

SEQ ID NO: 46921 - DNA, 101 bp, rice(Oryza sativa)
  misc_feature (71): n=a or g
cagaagaacttgtgtttcctccgtcaggattgtctcaccactggtcatacctacttctatgccacaatctntggtcgacttagcctctgcttcctgaagct

SEQ ID NO: 46922 - DNA, 101 bp, rice(Oryza sativa)
  misc_feature (71): n=t or c
ttgtatcttgggccttttgaaccagactgggcttttcctgagtttgacggcccaattaatttacctgtccntccttgtttttaattagggccgttttggtt

SEQ ID NO: 46923 - DNA, 101 bp, rice(Oryza sativa)
  misc_feature (71): n=a or c
aatcagatccaatttaacttttggggacaagagtctagggttcacgaaggacatttttctccacgtcactngtgtgcggttaccatcaacagcacgtacaa

SEQ ID NO: 46924 - DNA, 101 bp, rice(Oryza sativa)
  misc_feature (71): n=t or c
cataaatagctcagtaaaaatgatcttcagagggcagtcgccctgccaaatatccagccaaaagaagatgngagtgccattccccacctgccattctgagc

SEQ ID NO: 46925 - DNA, 101 bp, rice(Oryza sativa)
  misc_feature (71): n=a or g
ggctgtcattccactccatgaccatctagggatgactgtctttagcaagattcttcatggctcaatgcacntaaagtcgtatgactgggttaaaactccca

SEQ ID NO: 46926 - DNA, 101 bp, rice(Oryza sativa)
  misc_feature (71): n=a or g
cagacctctcgtgtgaacgggcaatccttgaacaagtgctgcgccgtttccaggtttctgtagcaaagctnacaaaagtaacaatttggccactgtctgat

SEQ ID NO: 46927 - DNA, 101 bp, rice(Oryza sativa)
  misc_feature (71): n=a or g
gacaacaattggcccgaaaattttgggctttgatagttgccatctcttccgcgatcactacaatcttcctntactctcaaattataacattctaacagccc

SEQ ID NO: 46928 - DNA, 101 bp, rice(Oryza sativa)
  misc_feature (71): n=t or c
cccatcacgcccccgtccgccttcatggcatcgatcaagttccgcaatgacaaatgcccactgatgccggncaagatgccaatcggggtactcagtttgct

SEQ ID NO: 46929 - DNA, 101 bp, rice(Oryza sativa)
  misc_feature (71): n=t or c
agatttctcaacagttattaagaaataatctagactttttcagcagcatggcatgtgccattttgcatctnatctataaatacgcatgccccttcctagtc

SEQ ID NO: 46930 - DNA, 101 bp, rice(Oryza sativa)
  misc_feature (71): n=t or g
aaagcacagccagcggctcaccttccttttctagatcatcgcaacaaaaacacccgcttcttgacctgaangatggtcgaagaaaatctatgactaggaaa

SEQ ID NO: 46931 - DNA, 101 bp, rice(Oryza sativa)
  misc_feature (71): n=t or c
agtgaaatcaggacaatcatcgatggtgaggttgctgaggtggggcaaccatgagcaccccaagttacggnagttctcaaacaacggaaagaccttcagaa

SEQ ID NO: 46932 - DNA, 101 bp, rice(Oryza sativa)
  misc_feature (71): n=a or g
tatatggtgagtttgtgttcatagtggcttctaggctacaacatgcaccaacaagtatcctgaacaatagngacaacaaacaacactatgtgctcatcttt

SEQ ID NO: 46933 - DNA, 101 bp, rice(Oryza sativa)
  misc_feature (71): n=a or c
acacctcctccattttttttacctttttgactttcatgcatggtatattggtatgagagatagactttgancattatttttatatctttaattaatattta

SEQ ID NO: 46934 - DNA, 101 bp, rice(Oryza sativa)
  misc_feature (71): n=a or c
tcatttgcacaatgcagctaaaggcgagatatgggggagcatacatattcacaatgacaacatctccagancaagaacaagaggttgaacggctagttcat

SEQ ID NO: 46935 - DNA, 101 bp, rice(Oryza sativa)
  misc_feature (71): n=t or c
catcgaaggctactaccgatccaaacctctttggttggccaataagggaacatggcattatgcaaagcccnggtggcagtgtactgtggaacgggatcagc

SEQ ID NO: 46936 - DNA, 101 bp, rice(Oryza sativa)
  misc_feature (71): n=a or c
gagctgccaaaggccttgcagcggttcgcaaagagtaggcagtgacaatggagcacagaattttctttttntttttgtttgctgcaacctcatatttatca

SEQ ID NO: 46937 - DNA, 101 bp, rice(Oryza sativa)
  misc_feature (71): n=t or c
acgaaatagaaaactatgatcgattttaaaaaagatctgaattgccaacacgagaccgatctgaccgtcgncatagggctggtctaatcagcagcatgtgg

SEQ ID NO: 46938 - DNA, 101 bp, rice(Oryza sativa)
  misc_feature (71): n=a or c
atattgtccagtcaagatggtggggatgaatctgtgttgaatgtatcactcagtgggcaggttgatgattnttgtgtcttgtactgtgagagattcatgga

SEQ ID NO: 46939 - DNA, 101 bp, rice(Oryza sativa)
  misc_feature (71): n=a or g
ttcactatgtgacatttttctttcattgctgttctcgtggatttgaataatttgtattatattttaggccnacggaagctgttcacagatgaggagaaggt

SEQ ID NO: 46940 - DNA, 101 bp, rice(Oryza sativa)
  misc_feature (71): n=a or g
ccaattggggaatcatggatataaagaacttattgacggaggtagtactacctgctgactattggaagggngagagcagagggactgagggagaggagagc

SEQ ID NO: 46941 - DNA, 101 bp, rice(Oryza sativa)
  misc_feature (71): n=t or c
atcttcacaaatcatcattttctcctcagcctctagatgattcaaattgagatttccacaccacccaaccncgctttgaaccatctaaacataatatagca

SEQ ID NO: 46942 - DNA, 101 bp, rice(Oryza sativa)
  misc_feature (71): n=t or c
actagttattgggttgaaaatccctaatattaggaacagtcttatcctgaaactgataggtgcttagggtnccgtgaagcaaaccactttgatttgtctgc

SEQ ID NO: 46943 - DNA, 101 bp, rice(Oryza sativa)
  misc_feature (71): n=a or c
tcctcatccccctccctcgccaccgcccagatggccacgcgcgcgcacaacatcaccgtgctcgacatcangggccgcgcggcgcacctcaactttcctga

SEQ ID NO: 46944 - DNA, 101 bp, rice(Oryza sativa)
  misc_feature (71): n=a or g
cactgcggcgccctcctcttctcagttctcacttctcacacaactcgcaaccctaataaagcgcaaaaaangaaaaagaaaaatcgccacggaaaaatcct

SEQ ID NO: 46945 - DNA, 101 bp, rice(Oryza sativa)
  misc_feature (71): n=t or c
cttatcggtttttcgaagatacctatcggcttttcgataaaaccggacagttttcagcacgttttaccttntggtttcctattgaaattttgatggtttct

SEQ ID NO: 46946 - DNA, 101 bp, rice(Oryza sativa)
  misc_feature (71): n=a or g
ggctgttgctttgcaatcttgtctgggtggtactccttttggatttcatgtttcccacctcaagaataacngtttctgttttcaagtgtgctctaaacaag

SEQ ID NO: 46947 - DNA, 101 bp, rice(Oryza sativa)
  misc_feature (71): n=a or g
ccgcaaagttggacctcctgatgaaaatgttggacaatcaggacaaaagccagcctcaaggaaccgtgaangcattggattcgcacatctcgtgcaaggtc

SEQ ID NO: 46948 - DNA, 101 bp, rice(Oryza sativa)
  misc_feature (71): n=a or g
gttctgttgacacgatagttggtgtgtactttgcaggggtttaaagatgtttactaaagagtgccgccctnttaagctctttgctaagcacatgaaagtgg

SEQ ID NO: 46949 - DNA, 101 bp, rice(Oryza sativa)
  misc_feature (71): n=t or c
tcaggtaaatgaagagcttcagctaccgcaagtggtgggttgccattgtaatgataacaagtgctctgcanctatcttcaaatgatacattgcctaatttc

SEQ ID NO: 46950 - DNA, 101 bp, rice(Oryza sativa)
  misc_feature (71): n=t or c
tctgtactttcctcgatttcattaatttcctgatcttgtttgcttcattccatctcccagtctcagcatanatgtttatcataagagtatagtagcctgaa

SEQ ID NO: 46951 - DNA, 101 bp, rice(Oryza sativa)
  misc_feature (71): n=a or c
atccaatggcatgtccagttgcagctgatctggaattttatggaaatgaattgagatcagtcattggatgnaattatatgcgaatgcatggatgatggatc

SEQ ID NO: 46952 - DNA, 101 bp, rice(Oryza sativa)
  misc_feature (71): n=t or c
gtgttaccatcgttaaagactagcttcgcgagagtagttttaccggagccgcctaatccaatgactgaaanaatttttatgttttgttgaatactagactc

SEQ ID NO: 46953 - DNA, 101 bp, rice(Oryza sativa)
  misc_feature (71): n=t or c
ttagtagcttcaatcaatgtagatcggcatgttgcgttgcatatggactcttagctatgttactatgtagnagctgttgtttattttgtccgttcttccga

SEQ ID NO: 46954 - DNA, 101 bp, rice(Oryza sativa)
  misc_feature (71): n=a or c
caatacttttcacctcagcgaccattgcgacgatgtcgttaagtttgttgacagcagaaccaactccctgnaatcacaagaaaagccaactataatcaaat

SEQ ID NO: 46955 - DNA, 101 bp, rice(Oryza sativa)
  misc_feature (71): n=a or g
tttcttggaattcctcctcgcctctgcaaacctttgctcatgcaatatcaccttctgtgtgagatgagacnagctttcaaaatcttccgacgagaatttct

SEQ ID NO: 46956 - DNA, 101 bp, rice(Oryza sativa)
  misc_feature (71): n=a or g
cctggggttcctcaggacggtgtgggacatgaacctgtcggcgcgggagaatggagatgaggttgttgtcngagtggtcatcggacatgccgaggcgctcg

SEQ ID NO: 46957 - DNA, 101 bp, rice(Oryza sativa)
  misc_feature (71): n=a or g
gactagtttcttcgcctccatggttgcgcgtcttcatcatcatttattggagttatcatcttctccaccanacgtcttcgtcttcaccgccggcttgcctt

SEQ ID NO: 46958 - DNA, 101 bp, rice(Oryza sativa)
  misc_feature (71): n=a or g
gctgcgaagagctgatcagcaggtggatggagtcccttggttctgaaggctcgtacgaggtggatgtctgnccggagatgcagagcctgaccggagatgtc

SEQ ID NO: 46959 - DNA, 101 bp, rice(Oryza sativa)
  misc_feature (71): n=t or c
ctctcatcgcagtcgcggagtccacgctcttatcccgaaatgagtccgaagaagctggctgtcatctaccngccgccggggatgatcggccacctggtctc

SEQ ID NO: 46960 - DNA, 101 bp, rice(Oryza sativa)
  misc_feature (71): n=t or g
ctgcatatatactctcatacatgtccatgcatgtgcacacatgtgattgatggcatcatcgatcattacangtccccgcactactacacaaccttataaaa

SEQ ID NO: 46961 - DNA, 101 bp, rice(Oryza sativa)
  misc_feature (71): n=a or g
gccatataaatataaaactatgtgtcagtgttaaaatgtgcaggttcctgcattagtaaaatataacttcnataaaaaaaaaatcctaactagttaatgac

SEQ ID NO: 46962 - DNA, 101 bp, rice(Oryza sativa)
  misc_feature (71): n=t or c
ccggtttacagggagtccttccagtgtagggtgagaaatgtcactggttgtgggttggttggtgtcttctntgcagctagattcaccggaacttccgcttg

SEQ ID NO: 46963 - DNA, 101 bp, rice(Oryza sativa)
  misc_feature (71): n=t or c
tatggatgagttaataaatataatatgggattgtacaagtagattagtgttgagaatcagatagggaggantggagttgggactggggaggtggtagtgtg

SEQ ID NO: 46964 - DNA, 101 bp, rice(Oryza sativa)
  misc_feature (71): n=a or g
atggagagatcctcaagagtcatatgtagggtatacatttacaaggaggccggtagcttgaacctagaaantatgtatcacagctggggtagcaatggcag

SEQ ID NO: 46965 - DNA, 101 bp, rice(Oryza sativa)
  misc_feature (71): n=a or g
tatacattaatacatgcatgttgtttaacagaacaatgttttttatgacattctgctccctactcgctccngcccctccaccagcctgctggctgctgctg

SEQ ID NO: 46966 - DNA, 101 bp, rice(Oryza sativa)
  misc_feature (71): n=t or g
cggcaagagcactcgctgcaagttttttggcgtcctcgcttgtttcttgttgtgcctgcttttggccattnttggagccttgatcatttgtggaagcctta

SEQ ID NO: 46967 - DNA, 101 bp, rice(Oryza sativa)
  misc_feature (71): n=t or c
agtggtatcaaggcataaaacattgatgaataggtacatgggcatgtgatcctattattgtaacgtcccgnttctcctaggctgggcccacttacatctgg

SEQ ID NO: 46968 - DNA, 101 bp, rice(Oryza sativa)
  misc_feature (71): n=t or c
aaaaaaacagcacaatatatatgaagtatacaaaacatcaacaagaaccgcttgcatgccaagctacgagntccagtcgctgccgcacgctgccgaccacc

SEQ ID NO: 46969 - DNA, 101 bp, rice(Oryza sativa)
  misc_feature (71): n=t or c
tgggtgctcatattgatggctaatttctttaagtggtaagcggttacccgcattgacggtcctagctagantttgcgcgggtgctcgcattaacaactaat

SEQ ID NO: 46970 - DNA, 101 bp, rice(Oryza sativa)
  misc_feature (71): n=a or g
gaaaggcaaatgctttggatagtggatgacacacatgcgctagtttattgtttctccgagcttgtcgggantgaaatgagaaggaaattaagagtagctag

SEQ ID NO: 46971 - DNA, 101 bp, rice(Oryza sativa)
  misc_feature (71): n=a or c
ggataatttctactataaattcaccttcaatggagacaaactttggtgatatcttttccctactgaacttngggctggtagctggatcctgcatagctatt

SEQ ID NO: 46972 - DNA, 101 bp, rice(Oryza sativa)
  misc_feature (71): n=a or g
acttaccatgaaaattgaggctggagagcatgcctcttgcgaagttggcatgtgacttatcttcatcaacnatcatgacaaaaaccccatcagcagagtgt

SEQ ID NO: 46973 - DNA, 101 bp, rice(Oryza sativa)
  misc_feature (71): n=t or c
gataagaaaaagataagcaaatgcgagattacatgagtaatagttgggtctttgaacggtccatgtttganaagaaaaatataagcaaattgaggttacat

SEQ ID NO: 46974 - DNA, 101 bp, rice(Oryza sativa)
  misc_feature (71): n=t or c
ttttggctagctcaatatttatttttttcggagtacaattgtactatgagctagatagctattcagtcttnagataagcttttgtgtttataaaaaagtta

SEQ ID NO: 46975 - DNA, 101 bp, rice(Oryza sativa)
  misc_feature (71): n=a or g
gcaacttcaccgcttgattacaaacttatatacggacacgacgattgcttcggcaaaatgctaccaaaagntccaaagtaccaccggttcaggcactcgta

SEQ ID NO: 46976 - DNA, 101 bp, rice(Oryza sativa)
  misc_feature (71): n=t or c
cataatttctggtatacgtttactcgaatgcgtgactacaatttggaaatttccttgtttcacactaaggnctggtttagttcccaactttttcttcaaac

SEQ ID NO: 46977 - DNA, 101 bp, rice(Oryza sativa)
  misc_feature (71): n=a or c
gaattaataactgcaatgttcatctgtttcacagatatcccgtctcatagaaatgcagacctcactgtatntggagcgcgtcgagcgtgtgcactcatccc

SEQ ID NO: 46978 - DNA, 101 bp, rice(Oryza sativa)
  misc_feature (71): n=t or g
cccatgcatgtatgatgtatgcattatgtaatacgcgatatcttctttgggttgctaagagtctatgcccnctaaaattattcctgtggtgagatgaaaaa

SEQ ID NO: 46979 - DNA, 101 bp, rice(Oryza sativa)
  misc_feature (71): n=a or g
ctgtgaagtctagataacggtgttaactgagtgacgatttctcttttttgcccttgctcgtttgaccctantgctacattttaacatattcgtaacaaatt

SEQ ID NO: 46980 - DNA, 101 bp, rice(Oryza sativa)
  misc_feature (71): n=a or g
agcaatttcattaggattaaaaatcgttcagaaaccgtgctacttttacagaaatgataattgatcgctcngaaatttatgccaccgtttctatccaaact

SEQ ID NO: 46981 - DNA, 101 bp, rice(Oryza sativa)
  misc_feature (71): n=t or c
agtagcaaattttaagagtggcaaatccttaacgccaaggagagaggaagatactcgagttacatggaatnctataatcctataagagtaggtacaataat

SEQ ID NO: 46982 - DNA, 101 bp, rice(Oryza sativa)
  misc_feature (71): n=t or c
gcaatttacaactctaaacctgaccaacagaaacttctgacctttttttatatcccgacaacaacaaaganatggtggcagcgacgacggtggtacttaat

SEQ ID NO: 46983 - DNA, 101 bp, rice(Oryza sativa)
  misc_feature (71): n=a or g
ttagaacacatcgatatttgtgcaaaaagggaaaaaaatcacgtgttgcaagtttttttagaactacacantaccacgtatacactcacaacgcatgtata

SEQ ID NO: 46984 - DNA, 101 bp, rice(Oryza sativa)
  misc_feature (71): n=a or g
gatcgaaaatctggagtttctgtgcttagtttttattttcttttgggaaatggaagaatgggggtcggccnccgatgacataccagtcgttcgtggccatc

SEQ ID NO: 46985 - DNA, 101 bp, rice(Oryza sativa)
  misc_feature (71): n=a or c
ttacatttcggacatgctatatggtattccattttgctcgttcagttgaagtcgttttttacttcttttgntattgctaagtttttctttcgaggactatt

SEQ ID NO: 46986 - DNA, 101 bp, rice(Oryza sativa)
  misc_feature (71): n=a or c
gacacgtgtcagtcaattagttgagatgatgataaatctcactgtctttttttctgtagtatcgtcggccntccgtctgtcctatttcaaatcgatgaata

SEQ ID NO: 46987 - DNA, 101 bp, rice(Oryza sativa)
  misc_feature (71): n=a or c
gatctgcccaataggatgttgatctagcatccccaccgccacctctatgaccattactctgccatcctcantcacagcatgtgttggctcggccctccacc

SEQ ID NO: 46988 - DNA, 101 bp, rice(Oryza sativa)
  misc_feature (71): n=a or c
caccgagagaccgcacaaagtcctgcacaaacagtcaaacatgctccatggttatagaaacaaaagaagcnatcacaaggctactgcaacaaccacctgtg

SEQ ID NO: 46989 - DNA, 101 bp, rice(Oryza sativa)
  misc_feature (71): n=a or g
tggggtgcataaactagaatccgtagaggtagctgctttcccgaagcttgaatgtttggtcttcagtgatntgcccaactgggaggagtggacctttaatg

SEQ ID NO: 46990 - DNA, 101 bp, rice(Oryza sativa)
  misc_feature (71): n=t or c
gcccaccaagtacattgaaagcataatatgggaagaatcgcttgtagtacagagtgttggagagcagttgngccatggcagggcagctcatccttttattg

SEQ ID NO: 46991 - DNA, 101 bp, rice(Oryza sativa)
  misc_feature (71): n=t or g
tatcactagcgatgatgctgattttattgcttttgttaaggcacgtctcaatgctcaatttcttatatctnatcttggttctcttcgctattttctaggga

SEQ ID NO: 46992 - DNA, 101 bp, rice(Oryza sativa)
  misc_feature (71): n=t or c
accaaggctcaagcccaggttttgcacaaaaaaaatcccccctcgttaatgctggtagaagagtgctcccngcgtgaggttaagcatgcccagtgacgtgc

SEQ ID NO: 46993 - DNA, 101 bp, rice(Oryza sativa)
  misc_feature (71): n=t or c
aaacgttcgcatttggatccaagctattgttcttctttacctccaaaacttatttcctccgtgccgcttgncaccgtcgccgtgcgtgccagctttgcctg

SEQ ID NO: 46994 - DNA, 101 bp, rice(Oryza sativa)
  misc_feature (71): n=t or c
tggcaaaccagtgcccagaggagaggacaagcacatcaaaacgtgggataaattccataaaggtctcatcngggatatccaggaaaaccttatcgataccc

SEQ ID NO: 46995 - DNA, 101 bp, rice(Oryza sativa)
  misc_feature (71): n=t or c
gatttggggggatttcggcgactactattgcaacagggagtaagtacaaatttacgggcacgtcgagatgnggagggggctagatgcaaaatgctgcctat

SEQ ID NO: 46996 - DNA, 101 bp, rice(Oryza sativa)
  misc_feature (71): n=a or c
tgaagttaaaatgccacaaagcgggaaattttgggagaaaactccttttttttttcatgccaagatatgancagtaacatgtctagggttatatgcatttt

SEQ ID NO: 46997 - DNA, 101 bp, rice(Oryza sativa)
  misc_feature (71): n=t or g
accaggggattactcttttgtctcagatgacagaatttctagctgcatcctgtttttgctcgagcgagtcngaaattctgaacagattcttcagagatgcg

SEQ ID NO: 46998 - DNA, 101 bp, rice(Oryza sativa)
  misc_feature (71): n=t or c
tcactggtaatgtggtcagtggcacctgagttgatgtaccagtttgtgtcaaccccgtaggacaaggctgngacattggcactcttgtcttccccagtgaa

SEQ ID NO: 46999 - DNA, 101 bp, rice(Oryza sativa)
  misc_feature (71): n=a or g
tgttgcaaagatcaaactgttttatgtgaaattatgaggactagaccggaccggccgtctgacaaaaaaantggaaccaaagccctcaaacggttatgtcc

SEQ ID NO: 47000 - DNA, 101 bp, rice(Oryza sativa)
  misc_feature (71): n=a or c
gggcactagacgagaggggaaaatatcgggcgcccttctgcatcgcctcatttcgcaccgcctcctctccnccacttccctcgcccacgccgcctcctctc

SEQ ID NO: 47001 - DNA, 101 bp, rice(Oryza sativa)
  misc_feature (71): n=a or g
ctccgtactactgtagcaactagcaagtagtaagcagagatcgacagcgatgtctcgctccgtcggagtgncaatggacgccgccggcgccgatgcagacc

SEQ ID NO: 47002 - DNA, 101 bp, rice(Oryza sativa)
  misc_feature (71): n=a or g
ttcctatgttcttattctgcgggcgtaattcatcagaaaaactaaacatcttttctttctcaacagtttcngtctctccatgagctgtactcgaacttttc

SEQ ID NO: 47003 - DNA, 101 bp, rice(Oryza sativa)
  misc_feature (71): n=t or c
ttctttcactatgggtgaggcccctcccctcctatcatccgtcaccaaacactaaccctaacaccttgcanctgtcgcagcggaatggattctcgattagg

SEQ ID NO: 47004 - DNA, 101 bp, rice(Oryza sativa)
  misc_feature (71): n=a or g
tggctccaacgacatccccaagtacaacaagggcaactggatcgagatcctccacatcgacaacgtcctcntcaacggctccggcaccctcgacggccagg

SEQ ID NO: 47005 - DNA, 101 bp, rice(Oryza sativa)
  misc_feature (71): n=a or g
ccccgcgtggagcggtgtggttagctgccggtcagatgacgtcccttgcacccataaatgtaaatggttcngaaatttgtaaccaaaatttcagaccctgg

SEQ ID NO: 47006 - DNA, 101 bp, rice(Oryza sativa)
  misc_feature (71): n=a or g
ttgctatgttctgtttctgggattgttttttttttggctattgtgaactgttttttgtgaactgaaacgtntcaatggaatgtgaactgatgggtcattgc

SEQ ID NO: 47007 - DNA, 101 bp, rice(Oryza sativa)
  misc_feature (71): n=t or c
tccttaatctagtttactttggaaggattgtgagaggggggttatgaagtgtctgtcgaccatgtttttgnactttggggatttattatttgcagttaata

SEQ ID NO: 47008 - DNA, 101 bp, rice(Oryza sativa)
  misc_feature (71): n=t or c
acaactgcacagtaataatcaaaattgggtagcatgtatgttggcaataaagtgaacacgtccaaaatagntatattgccaaccttaccaaaattttggca

SEQ ID NO: 47009 - DNA, 101 bp, rice(Oryza sativa)
  misc_feature (71): n=t or c
cttgcacatcattttcccactttgcaatggcatctttgtaagctgaaaatgtatgatttatctctatagtngcaactttacagtgggacatacatatctaa

SEQ ID NO: 47010 - DNA, 101 bp, rice(Oryza sativa)
  misc_feature (71): n=a or c
gaggcacgcagacagtggagaagaattccttggacttgacaatgtctttgcctgggcagacaataatgcanccagcaagcaggtgctttagcattggcagc

SEQ ID NO: 47011 - DNA, 101 bp, rice(Oryza sativa)
  misc_feature (71): n=a or c
cgcaaggaaagatgcgctgccccaagaagaaagcttggtaggttgagtgggcttaatagcattggtcaccngtcgaacactagacaagatgttcctcaatg

SEQ ID NO: 47012 - DNA, 101 bp, rice(Oryza sativa)
  misc_feature (71): n=a or g
taaaaatgtttatcattggacttcacgctcaatatgtagcgatggaggaccaatcccttctttctataaanttaagacccaaagctgcattctcagttcgt

SEQ ID NO: 47013 - DNA, 101 bp, rice(Oryza sativa)
  misc_feature (71): n=t or c
tttcggacttttcctccacacgttttccttctctcaagtctcagctctatggcccatacgaatgcgaatanttgactctcgatattgagaaatccagatcc

SEQ ID NO: 47014 - DNA, 101 bp, rice(Oryza sativa)
  misc_feature (71): n=t or c
ttttcttgagtcatctgtgctggttatgggatcgacaatgttcagacttgtccgagagttagtgttcatcntgtgctgtaacaagatcggattatatgtgc

SEQ ID NO: 47015 - DNA, 101 bp, rice(Oryza sativa)
  misc_feature (71): n=t or c
cacatgattttaagaacaagacacatgcttgcaacgcgagagttgaccgagaaagcacacgtgaccaatangaggctatgagtaaatatctaaaagtattt

SEQ ID NO: 47016 - DNA, 101 bp, rice(Oryza sativa)
  misc_feature (71): n=a or g
tgcaccaatagcaaaattaagaattgagagagaaggcatcgatcatcacacgtaatatataggagaattanttgacatataataggagtttccattaacaa

SEQ ID NO: 47017 - DNA, 101 bp, rice(Oryza sativa)
  misc_feature (71): n=a or c
catcaataaattttgcaatctgattcttccaagtacagtgacaaaccttatctgtacgcccttcccccccnccccccccccctttttttttctgaaagaac

SEQ ID NO: 47018 - DNA, 101 bp, rice(Oryza sativa)
  misc_feature (71): n=a or g
ctcccatttccctctgtttgaatctggctctcctcctagtttctctctgaaagcagccttgcatttgatcngcaagaagaaagatcaagggcctcttcttc

SEQ ID NO: 47019 - DNA, 101 bp, rice(Oryza sativa)
  misc_feature (71): n=t or c
agattggccggcggtcggacggctatgcgtacgtgctcgcgacagactctggaaagccggatgaaaaaacnggaatcggactggaacgacgtgcaaaagta

SEQ ID NO: 47020 - DNA, 101 bp, rice(Oryza sativa)
  misc_feature (71): n=t or c
agcagacatacttcgacacgtattcccctccagacttctacgcaaaggtacatcgaattttacgctgatgncaaacgccaacaaatttgcaaatgcaaaac

SEQ ID NO: 47021 - DNA, 101 bp, rice(Oryza sativa)
  misc_feature (71): n=a or g
cacaacacggctattcggaacatctacaactcagtgtgatatccctagttgacaagaggtattctcccttnttgatacggcatggggatacctcatctcgc

SEQ ID NO: 47022 - DNA, 101 bp, rice(Oryza sativa)
  misc_feature (71): n=t or c
gattgagatgcacacttactagcgtagtcgtaggagtgtgttggttttctgggcacgctcgtattttcttnttaaatactccctccatctacttttaatag

SEQ ID NO: 47023 - DNA, 101 bp, rice(Oryza sativa)
  misc_feature (71): n=t or c
atcaacatcaaatgaagcaggttttttcagctctagcagcttcaagcaaccactagctatgaaattcatgngattgatggagtagatttcatggaagcagg

SEQ ID NO: 47024 - DNA, 101 bp, rice(Oryza sativa)
  misc_feature (71): n=a or g
agactgtatttttgaggcactaggtaaatagaagaagctcgctgttcacacaggcatgtttattgcaacgngaagaaaaggcaaaaaaaaatgaggaaaag

SEQ ID NO: 47025 - DNA, 101 bp, rice(Oryza sativa)
  misc_feature (71): n=a or g
tcccaagctaaagtagcctcctccatgtgcaatgcacgtttgcttaccgtgcatcacaagagaacttagcnctgacaagttgttcatcaaagtagacaaac

SEQ ID NO: 47026 - DNA, 101 bp, rice(Oryza sativa)
  misc_feature (71): n=t or c
taaccatcatcatgcttgggtcttggggtagcgtgttacaagcactccacctaaatcaacccaagaatgcncagagctgaattcatcaactgtgagatatc

SEQ ID NO: 47027 - DNA, 101 bp, rice(Oryza sativa)
  misc_feature (71): n=a or g
ggtacaattcatccgtcactagtaaaaagtaatttttccatacgagtcaaaagtgattttcacgtgccggntctacgaaaatcgctatttttccatacggg

SEQ ID NO: 47028 - DNA, 101 bp, rice(Oryza sativa)
  misc_feature (71): n=a or g
tatggccaaaaatcctccccagtaaggtaagatgttggattcaggtattacaaggtcttgtctgtctatgntcttggatgatgagttgcctatcggtataa

SEQ ID NO: 47029 - DNA, 101 bp, rice(Oryza sativa)
  misc_feature (71): n=t or g
cgaaaatttatggtctatgaggtggttagggtaggggtgggggggaccatttctatatggagatcctacanattttccttttgaccgatagagttggcatc

SEQ ID NO: 47030 - DNA, 101 bp, rice(Oryza sativa)
  misc_feature (71): n=a or g
acttttgtgctgaatggtcgatgacactatactacttggttggtcgattgatatttaagttttttggattnaactggtcggtacatgaaatgaccgacctg

SEQ ID NO: 47031 - DNA, 101 bp, rice(Oryza sativa)
  misc_feature (71): n=t or c
tgaattttgataaatcactgatcagttttacattctagggacttatgtttatatggctcctgaaatcattngctgtgaaccatacactgagaaatgcgacg

SEQ ID NO: 47032 - DNA, 101 bp, rice(Oryza sativa)
  misc_feature (71): n=a or g
aatttggggatgttgttgttttgtacattcatgtgtgtagcaacaatggcagcggttttaatgagcagagntatgcaggatttagttcatgggtgttatgc

SEQ ID NO: 47033 - DNA, 101 bp, rice(Oryza sativa)
  misc_feature (71): n=t or c
gcggagttgttcttctttcttgattctgcccctccttccatcatgcccacacacatgtagagtaagtacgnaaccatcagttccaatattttaagtacgca

SEQ ID NO: 47034 - DNA, 101 bp, rice(Oryza sativa)
  misc_feature (71): n=a or g
tatctcttgcaggccatatgacatcggtcgtatcggcacctaccaacaaaaaaaaaaggttggttgattcngtgtagatagggatccacctcttggttttc

SEQ ID NO: 47035 - DNA, 101 bp, rice(Oryza sativa)
  misc_feature (71): n=t or c
tgctaggtgcaggccaatcgttaatgctaacaaacaccttctttcttccccggcagtttcagatgttcatncaatggtcttaggtacacatcaatgtcgtt

SEQ ID NO: 47036 - DNA, 101 bp, rice(Oryza sativa)
  misc_feature (71): n=a or g
gcacctgatgtgaccaagaatgatggcaaggcacattatccacctggaggaaaagcagcatattatgatcnatcattttctcgattggaagcgtatagcac

SEQ ID NO: 47037 - DNA, 101 bp, rice(Oryza sativa)
  misc_feature (71): n=t or c
aattaatactttattttatcaaactttgcagatatatttctatgtttcaaagacaaggaaggaagttttgntgctgatgaagtaagaagtctcttaggctt

SEQ ID NO: 47038 - DNA, 101 bp, rice(Oryza sativa)
  misc_feature (71): n=t or c
ttatctaccttttgcttctgctactactgtccacatattggttcaggtcccctaatggcaggattttgtcntcaccttgcttctctcttctctcccctttc

SEQ ID NO: 47039 - DNA, 101 bp, rice(Oryza sativa)
  misc_feature (71): n=a or g
cacagctaagccgttccctttccctaccttagcttttatactgttcccggcacgtaggagtgtatatgtancaacttgaacgcgacggaggacgtacgtat

SEQ ID NO: 47040 - DNA, 101 bp, rice(Oryza sativa)
  misc_feature (71): n=t or c
tgaagttgcatgctaatgctgcagaagtgctgcattatcaaggcttttcacgtgaagtacacatatttagntcactagacttcacaaactggtcttaacac

SEQ ID NO: 47041 - DNA, 101 bp, rice(Oryza sativa)
  misc_feature (71): n=a or c
tcaccacaggttgacatccggagaacctcaaacgccgtccctaagtcgccgatgagaatccagccatcgcnacggcgctcacttggagcagcagcatcccc

SEQ ID NO: 47042 - DNA, 101 bp, rice(Oryza sativa)
  misc_feature (71): n=t or c
atcattttgcgcaaagcaaaatattgttgatcaacatcagcagtgatacattttcagtgccagaaaccaanagatcttacaaatgccaacatatcaacatc

SEQ ID NO: 47043 - DNA, 101 bp, rice(Oryza sativa)
  misc_feature (71): n=t or c
gagactcaaaagagatcatactgtagtacggagtacataattttattgacagagattttgtagatgttgcnactttttttaaaaaacttggtcaaacttta

SEQ ID NO: 47044 - DNA, 101 bp, rice(Oryza sativa)
  misc_feature (71): n=t or c
ttcattgtgatccaccatcgagttcaggttcatcattgcttcgggatgtccacagagagattccatctagnggtggttcgtaatttctctatattttaatt

SEQ ID NO: 47045 - DNA, 101 bp, rice(Oryza sativa)
  misc_feature (71): n=t or c
accaccaattcatggagttaaggataactaacaacagaatgttttattgggtgaaaataactattcccttnggccataaatacttacgtttaggacaagat

SEQ ID NO: 47046 - DNA, 101 bp, rice(Oryza sativa)
  misc_feature (71): n=a or g
caaattactcttcttgagagttctggtccacctttgtacctgaaaagtattcatgtgtccatgagttgatnatcccaattgaagaagaatgtattcaagta

SEQ ID NO: 47047 - DNA, 101 bp, rice(Oryza sativa)
  misc_feature (71): n=t or c
ttttctactaacaatggcagggatatgcaagaccattatagatcacctagctcgacatcgacatcttcgtngagacatgaagagtgatcaacatgattcta

SEQ ID NO: 47048 - DNA, 101 bp, rice(Oryza sativa)
  misc_feature (71): n=t or c
cgtctgattaacatattttgatgctgaagtcatcataattagctcgttcgttgtcgacataactatatcgnttaccattaaaagtataattaatcgtaaat

SEQ ID NO: 47049 - DNA, 101 bp, rice(Oryza sativa)
  misc_feature (71): n=t or c
ccagaatcaaataaaactttaccaggataagagcacactaagacattacctgtaaccacggtgttggattnttcggctgtgttcttagttaagttgtatac

SEQ ID NO: 47050 - DNA, 101 bp, rice(Oryza sativa)
  misc_feature (71): n=a or g
gtaggtctagtggtaaatgtatgacctgacttgaatagtatcttttcaggtggatgccaatcggttggtcngttaaaaacaactaatttagctgatcctgt

SEQ ID NO: 47051 - DNA, 101 bp, rice(Oryza sativa)
  misc_feature (71): n=t or c
gaccatgcaaacacctgatctgatctcacttgagtgagagactggcagtaacagtagtcagtcctagcagnatacggacatacaattaaaatattaaacat

SEQ ID NO: 47052 - DNA, 101 bp, rice(Oryza sativa)
  misc_feature (71): n=t or c
ccccgtgtcaaatctaggatttgattccgggtgggctggttccatcaaaaaaatctaaccagttgaggtangctcgcttcggcccgttggagctttgtcag

SEQ ID NO: 47053 - DNA, 101 bp, rice(Oryza sativa)
  misc_feature (71): n=a or g
cagctagactcccgcagcttcaagacgatgtctaaaatcgtctccaccatgaaatctggtggcatccttgnagataatccaaaactgagattgaggggttt

SEQ ID NO: 47054 - DNA, 101 bp, rice(Oryza sativa)
  misc_feature (71): n=a or g
ctcgttgccggtgaggaaaatggtacatgcaaagtccaaaaattttgctacctccatcgccatttgaaganccatcaattctccctgcaaagatgatcgag

SEQ ID NO: 47055 - DNA, 101 bp, rice(Oryza sativa)
  misc_feature (71): n=t or g
gcctttcaccgtgatcttattctacccctccgcgaagtcttcgtctggtcttcccccacccgcatcccccngcctcctcaccgcagccgcaaaagccaagc

SEQ ID NO: 47056 - DNA, 101 bp, rice(Oryza sativa)
  misc_feature (71): n=t or c
acatctcaaacttaactaagatgtgttgttaagcaaacaaggattaagataacttccgttgagctgggtangatgatcactagtacatttttagcaaacta

SEQ ID NO: 47057 - DNA, 101 bp, rice(Oryza sativa)
  misc_feature (71): n=t or g
caggcgctacaaatttggagcaaaaaaattgccgtggtccataatcggtagtgtattagtcctaaccgganaccacaccatcatcttggtctaaccaaggc

SEQ ID NO: 47058 - DNA, 101 bp, rice(Oryza sativa)
  misc_feature (71): n=a or g
cacccttcaccggcgatcctcttccggtgatcttcttccaatggcagacctttaccagtcttcctccgacnctgctgcattgaagaagctgcacaccgagg

SEQ ID NO: 47059 - DNA, 101 bp, rice(Oryza sativa)
  misc_feature (71): n=t or c
atcctcagaaacctttgcagtaatagatgccttctgacctctcatcttctttctttcattatctacaccancggagacaaggtttgcctcagacaattcag

SEQ ID NO: 47060 - DNA, 101 bp, rice(Oryza sativa)
  misc_feature (71): n=a or g
ttacaatacacaagcctattattagtaggatgaaaaagaatacgtgaatctcgttgtgtgagctaggggcnctagggcatgttcgatgatagagacgagta

SEQ ID NO: 47061 - DNA, 101 bp, rice(Oryza sativa)
  misc_feature (71): n=t or c
attttttttcttggttttagaccgaaagcacaatctttttttctttgttagtcctagtcctagcccagtcngctacctccctccattcgccctgtctttct

SEQ ID NO: 47062 - DNA, 101 bp, rice(Oryza sativa)
  misc_feature (71): n=t or c
tgatgggttaaacaaaccttgatatatggtaaaaattgatgcagaattgaggtcaagagcagcccttcgcntttcagggaagccaaagcatgtactccctc

SEQ ID NO: 47063 - DNA, 101 bp, rice(Oryza sativa)
  misc_feature (71): n=a or c
tagatattttacagcagtattaaattgtgctactataacttatggatcttgatcacgagggtcggtggtgngatgtagtaaggaggcttggttttggtcga

SEQ ID NO: 47064 - DNA, 101 bp, rice(Oryza sativa)
  misc_feature (71): n=a or g
tcttcttcacagtgatttcatttccttcccatatgatctctgctggtccatcttcaacatattcccattcntcatcctcctcggttccatttccatggtca

SEQ ID NO: 47065 - DNA, 101 bp, rice(Oryza sativa)
  misc_feature (71): n=t or c
tatacacagtgctcgcccctcggcttacatggttagctgtgggaatttgcatcttgtcagtttcaatgccnatttttaccaaggtgcttggtgaatggccc

SEQ ID NO: 47066 - DNA, 101 bp, rice(Oryza sativa)
  misc_feature (71): n=t or c
ggaagaacatgtatacttggcagggtaaaccaatgaaactaatctcaaagaaaaaaagcaacagatgcgcncagaaagccaataaaagagagagaaacaca

SEQ ID NO: 47067 - DNA, 101 bp, rice(Oryza sativa)
  misc_feature (71): n=t or c
ctaaccaacccctccttccaaacacagcttaacaacgccctgcgttcgagagtctaggttgggaactctcntgtctcgattttcacgcgcacgcttttcaa

SEQ ID NO: 47068 - DNA, 101 bp, rice(Oryza sativa)
  misc_feature (71): n=t or c
gaggagccccaacaggttaattttggaggactggctgatatatatggttgggaagggtcaagatttcggangattcgttcagccaaatagccacccaatgt

SEQ ID NO: 47069 - DNA, 101 bp, rice(Oryza sativa)
  misc_feature (71): n=t or g
gaattaattgatatcgtgttacatgaacaaaggaaacaaaccatacttgcaatacagcttgaagcgcacgntcaagttgactcctttcatagaagatgtca

SEQ ID NO: 47070 - DNA, 101 bp, rice(Oryza sativa)
  misc_feature (71): n=a or g
ataaggccacaaatacagctcctgtaaggacgtcagcttctcgatcacaccaggcgacacccttacatcantatcaacacgtagggacagcaattttgtta

SEQ ID NO: 47071 - DNA, 101 bp, rice(Oryza sativa)
  misc_feature (71): n=a or g
tgagtgggcgagcgatgggatcagagtcaattccgttgcaccgggctacatccagactccactcctaactnccgtaagttcctcgttttacaaatactccc

SEQ ID NO: 47072 - DNA, 101 bp, rice(Oryza sativa)
  misc_feature (71): n=a or g
gccgatttttatgacatcatcaatcagtgctaactcattatgacatcatcaccattaattgatcggcaganctcgatccttacctttgtccttagaaagaa

SEQ ID NO: 47073 - DNA, 101 bp, rice(Oryza sativa)
  misc_feature (71): n=t or g
ggggaactaaacggggccaaaattaggcaggagcatgttaaatcatcccatgtcaaccaagttcaccacantgactcgtaccatttccttcccccattatt

SEQ ID NO: 47074 - DNA, 101 bp, rice(Oryza sativa)
  misc_feature (71): n=a or g
taagttattttattgtaaaactactaacagttacatattaatatgtccagattccagctccaaagcgaggngaaattgttaggcaaattggtgatgcattg

SEQ ID NO: 47075 - DNA, 101 bp, rice(Oryza sativa)
  misc_feature (71): n=t or c
cttgtttctgcaagtgattaatgtgctgtatatatcaagctctctcaccgcagaaagagaaacaaaggggnttgcaggacaccaggagggtgcaggacatg

SEQ ID NO: 47076 - DNA, 101 bp, rice(Oryza sativa)
  misc_feature (71): n=t or c
gtccaaccagcccgatttaatctccggtttataaaaaaccgcccaggttaactagtttcatccggtccgantgcacgcccgatctgttaaggggaccggac

SEQ ID NO: 47077 - DNA, 101 bp, rice(Oryza sativa)
  misc_feature (71): n=a or g
caagacgcgattgcagaagcaggttgatgcgatggagaacaaggcggtagacttcgagaagatgctcgctnggatccagaactccatcggagcgatggcgg

SEQ ID NO: 47078 - DNA, 101 bp, rice(Oryza sativa)
  misc_feature (71): n=t or c
aacgtatcttttagaggatacttcatcaattagtacctgtgttcttgaggaacagtatctggaactggaantgaagagagttcctattttgaatgtctagg

SEQ ID NO: 47079 - DNA, 101 bp, rice(Oryza sativa)
  misc_feature (71): n=a or c
tgctctaattgttgctgcaactggaaccccaacagacccaacttcaggattaaacccatatttgtagaaantgtccttgaaaaagctctctggatattgaa

SEQ ID NO: 47080 - DNA, 101 bp, rice(Oryza sativa)
  misc_feature (71): n=t or c
ccataaggtggctgccatttggattgggaagattgttcaacgacagatgaagtcgattcagtgaatggatngcctaaattgttatcgatgagctcttcaga

SEQ ID NO: 47081 - DNA, 101 bp, rice(Oryza sativa)
  misc_feature (71): n=a or g
gtatcaggactttgagtccctctttggtctcaaatttccctgtagctattgaatccatctcctttgcccancaagaattaatcggggtggacagatacaag

SEQ ID NO: 47082 - DNA, 101 bp, rice(Oryza sativa)
  misc_feature (71): n=t or c
cgggtatgtgccggaccagaataagaaggcatgcttgttgatgaccatgaacgctcgtgggaagtggaagngtgatccacctttaccgcaaggattctacg

SEQ ID NO: 47083 - DNA, 101 bp, rice(Oryza sativa)
  misc_feature (71): n=a or g
tgttcgtggtactatggactacagcttacacaaatctcgctcttcgtccaccgatctggtggcctactctnatgctgattgggtcggctatcctgacactc

SEQ ID NO: 47084 - DNA, 101 bp, rice(Oryza sativa)
  misc_feature (71): n=a or g
gtaattaaaatgataagtattgctacgatatatatcattattctttttcttactaggtgccgacgactctnttggtgttggcttcagtcatgttggagccg

SEQ ID NO: 47085 - DNA, 101 bp, rice(Oryza sativa)
  misc_feature (71): n=t or c
tgactaccttgataagttgttggactggaaacaattgaaaaaatcgcttgagaataatatatactccctcngtattgtaatgtatgacgccgttgactttt

SEQ ID NO: 47086 - DNA, 101 bp, rice(Oryza sativa)
  misc_feature (71): n=t or c
tatatttctagaaatgttgagtactctctccgtcttataatgtagagtactagctccctccatcccataanatagtaatatgtctcatcacattctagatt

SEQ ID NO: 47087 - DNA, 101 bp, rice(Oryza sativa)
  misc_feature (71): n=a or g
aaacattgactagtaaaagactcagtatactacctcttcgaaagtatcttgccaagagttacccttccgcntgaagattaaccaacaatcctgacattatt

SEQ ID NO: 47088 - DNA, 101 bp, rice(Oryza sativa)
  misc_feature (71): n=t or g
cctccgatcccctcgcctcgtctcgtgtgctactacacaaaagcaacatacattaattgatacggaatacntatatccttcctacttatcatttaattcat

SEQ ID NO: 47089 - DNA, 101 bp, rice(Oryza sativa)
  misc_feature (71): n=t or g
aatttattgaaattgaaaatgactggaaggaacgtaaaagcaagttgccatattaactagtactccattcntttcaaaatgtttaacactattaacttttt

SEQ ID NO: 47090 - DNA, 101 bp, rice(Oryza sativa)
  misc_feature (71): n=a or g
cgttttaaattacttgccgttttagctttgtcctaaatcaaaggtgaatacctttgaccattaatttatanaaattcatgttaatatagtttaacgtaata

SEQ ID NO: 47091 - DNA, 101 bp, rice(Oryza sativa)
  misc_feature (71): n=a or g
gtgtactttttccttgttggatcaccaattaacggaccacagaaactagcaaggtacaaaccaagatagtnctatattgacatctttcaaaaatttatatg

SEQ ID NO: 47092 - DNA, 101 bp, rice(Oryza sativa)
  misc_feature (71): n=t or g
agcagtaaagaacaccacctaagaattaggactgaaactttgcacctctgcaatgatcaaattttcagatnaaagcaagcactgatcaaacttttcgatga

SEQ ID NO: 47093 - DNA, 101 bp, rice(Oryza sativa)
  misc_feature (71): n=a or g
gaacttcaaaaagaagttccatggagcagtatatgcggagaacatgtagccagctgctaagagttatacantggctggattcaacaagcattatgatgcca

SEQ ID NO: 47094 - DNA, 101 bp, rice(Oryza sativa)
  misc_feature (71): n=t or c
gactggttatcggataccaaacacgatgttatcgcgaggcatatcatggtttcaaaaactgtattatttancaaaccgttttggatgtggttctcgtcacc

SEQ ID NO: 47095 - DNA, 101 bp, rice(Oryza sativa)
  misc_feature (71): n=t or c
gatgaagatgacgagttctctcagctcgctcgcaggttgttctgattgccgacaatattcttgtttcctanccatttatccttgaaatcatccagacctga

SEQ ID NO: 47096 - DNA, 101 bp, rice(Oryza sativa)
  misc_feature (71): n=a or c
taagtgggaaggatgaactcaacctgaacaggtgcaagtgcaactggagagggggaaagtatactactagnaatctggcatctatttaatgagccccagct

SEQ ID NO: 47097 - DNA, 101 bp, rice(Oryza sativa)
  misc_feature (71): n=t or c
ttctcggacacccaataacaatctgattgctcaaagcccatccaagcacatgctactactagcagtataanattttggttaagaaacaaaaggagcaacta

SEQ ID NO: 47098 - DNA, 101 bp, rice(Oryza sativa)
  misc_feature (71): n=a or g
tccaacctatgggtacatagaacatctacagtgctcgatatttctaaagagcatttttcccatccttgagnaggtaccatgaggtatgaggtaccatgagg

SEQ ID NO: 47099 - DNA, 101 bp, rice(Oryza sativa)
  misc_feature (71): n=a or g
tggatgggatgagatcatgacgaagcccgaatttaatatgttaggagcagtttggatggagactaactttnccataactccatttattataactgtggtaa

SEQ ID NO: 47100 - DNA, 101 bp, rice(Oryza sativa)
  misc_feature (71): n=t or g
actgcaccagatatgagtagtgaacgagtatgagacaaatccatttcttgcagcatttctgggagctgtgnatcgggatggtggagagctagacgacgtgc

SEQ ID NO: 47101 - DNA, 101 bp, rice(Oryza sativa)
  misc_feature (71): n=a or c
cgatggtgccgatcatcttgtgcgtgtgagagagagtgtaatggcggcggtggtggtgatcagtggcgcgnggaggggctcctcatgccgccggcggagag

SEQ ID NO: 47102 - DNA, 101 bp, rice(Oryza sativa)
  misc_feature (71): n=t or c
taacactaaggtgaatagagtaatatacctagagaatgctccagagaatgagatattgctattgttgttgntgcctccgttgatgttgtcgttctcgcctc

SEQ ID NO: 47103 - DNA, 101 bp, rice(Oryza sativa)
  misc_feature (71): n=a or g
aagctttttggccggattatgcacttgaagaaggtccatgggagataagaaggctacacaaatggtacatngacaccagcaagaaaggactagtatcatta

SEQ ID NO: 47104 - DNA, 101 bp, rice(Oryza sativa)
  misc_feature (71): n=a or g
tcttctttctaaagcaccatctcaaggtttctttggctctaaaagattggatccagttgagttggaggggnacatgaagctttggtgctgttaagtttttg

SEQ ID NO: 47105 - DNA, 101 bp, rice(Oryza sativa)
  misc_feature (71): n=a or g
cagaactcagaaatattcagaaaatgcaggggaaaccaaagaaaaacgttccattagttgttgcgaactanctagcaaatcgatctcatgtatatatatat

SEQ ID NO: 47106 - DNA, 101 bp, rice(Oryza sativa)
  misc_feature (71): n=a or g
ccacttcatccaataagaatgtcgagcgggatgtcatcctcctagatgccttatgagtgattaagttatangtgggtggcgacggtgagtggcccatggct

SEQ ID NO: 47107 - DNA, 101 bp, rice(Oryza sativa)
  misc_feature (71): n=t or c
tttacacagataggctgccagatagctgcagagatggcaaggctgcagcaatgcagcacttgctagttgcngcggatcggtacggagtggacaggctgagg

SEQ ID NO: 47108 - DNA, 101 bp, rice(Oryza sativa)
  misc_feature (71): n=a or g
tatatttttaactgaccatgacattgtaagcaatacaagtgtagagtgagtcctagaaactcattgtagcnacagaaacttaggaagcatatatataacta

SEQ ID NO: 47109 - DNA, 101 bp, rice(Oryza sativa)
  misc_feature (71): n=t or c
aaatacctctaggtttattttagaacaaaagagtcggccctattcgaagttgatgcaaatgaagattaagntggcatacgtaaagcgagaaagtcgttaac

SEQ ID NO: 47110 - DNA, 101 bp, rice(Oryza sativa)
  misc_feature (71): n=t or g
caagacaatactgatcagttgggtgtctgtttatttgctctacttcctcctgtacagattcatgttattangataatttatgttattaggatatatcgtat

SEQ ID NO: 47111 - DNA, 101 bp, rice(Oryza sativa)
  misc_feature (71): n=a or c
aaggcatattacctaaactggttcatatctgctataatttagaataccgatgctccaaaaagtccaataancattagattaaatttcacaaaattacacct

SEQ ID NO: 47112 - DNA, 101 bp, rice(Oryza sativa)
  misc_feature (71): n=a or g
taacaggcgacttcaaaacaagagcaaaattccatcactgaagagttcgcatgggcttttcctacactcanagtttcaaattcggtccatatacgcgcaac

SEQ ID NO: 47113 - DNA, 101 bp, rice(Oryza sativa)
  misc_feature (71): n=t or c
aacttttaataaaaaaaattaaaaataaaaaaagtttgcgaccattcggtggcctcgaatatctcgtgggntttgtttccttggcccactaaccaaaccac

SEQ ID NO: 47114 - DNA, 101 bp, rice(Oryza sativa)
  misc_feature (71): n=a or g
ctttgacactggcaccaatgctccaccgaaaccaccgagacctcctctaaagaaaccgttgaatgataagncgaaagaacatgagctacctaagggcactg

SEQ ID NO: 47115 - DNA, 101 bp, rice(Oryza sativa)
  misc_feature (71): n=t or g
accaaaaaatattttggtacatcctgaaacgtaactcagattttggtggccacaaattaaaccatgcaaanatcacatatcacatatacgacacatagagc

SEQ ID NO: 47116 - DNA, 101 bp, rice(Oryza sativa)
  misc_feature (71): n=a or c
tttcaatattcaggtaggcaaagaaggaaaaaagaaacgcagcgtacatacatgtgagagaattcagtccnacaacttcgatttcatgaaaatagcatgct

SEQ ID NO: 47117 - DNA, 101 bp, rice(Oryza sativa)
  misc_feature (71): n=a or g
ggagaggaattcagcgaagagagagaaggggatctcaagttcatgacatattgacatggactgcatcgccnggagtgatcccttcctcgacagcacacgag

SEQ ID NO: 47118 - DNA, 101 bp, rice(Oryza sativa)
  misc_feature (71): n=a or g
cggcggcctaccggagctcgactccgagctggcgctactggccatgatcatcgtgctagctgatcgagcgncggaccggaggaagaagaagagcggaaggg

SEQ ID NO: 47119 - DNA, 101 bp, rice(Oryza sativa)
  misc_feature (71): n=a or g
ccaattgttgaatcataacgctcacctcccgagatccgatcttggactcgttgaaattgtgcataggtcangacctagggggagggagactggtctagatc

SEQ ID NO: 47120 - DNA, 101 bp, rice(Oryza sativa)
  misc_feature (71): n=a or g
atgcctaccgcagtatctcatgaccttataagtttatccgttcttcattcagttaaccattgttgcggtgnagaaaatttcgtttgttacgttaaaatttc

SEQ ID NO: 47121 - DNA, 101 bp, rice(Oryza sativa)
  misc_feature (71): n=t or g
caatgctctagaaagatctgttggataacatgcaagcatgccagtagagtacctccaaactagtcaaattntcagggtgatagcagatattagatctcagc

SEQ ID NO: 47122 - DNA, 101 bp, rice(Oryza sativa)
  misc_feature (71): n=a or g
tccttcctgttttcccaggtgacgcatcgtgcttcagtccgcctaggaaaatggtcttcctaggtggaccngtcggccgcctgtgattttcgcaagacttt

SEQ ID NO: 47123 - DNA, 101 bp, rice(Oryza sativa)
  misc_feature (71): n=t or c
acgttttgaagtgagaaggctgatgcagacatgcagtggacgatagcctttgtctaaatggctaactgctngtgttagagtggccgggtgattacgatggt

SEQ ID NO: 47124 - DNA, 101 bp, rice(Oryza sativa)
  misc_feature (71): n=t or c
agcacagcaactactgcatcgacacgattaccaagatttaaaatagaaaagaaaaaaaatctggtgtcacnctgaccagcttggcaagctatggctgtgtt

SEQ ID NO: 47125 - DNA, 101 bp, rice(Oryza sativa)
  misc_feature (71): n=a or g
ggagaatggaagctggcaaagacacataagcatcaaccggcaggtgtcgtcgtcgtctgtgacagcacaangcttgagagccaaggtcgcgtcatactacg

SEQ ID NO: 47126 - DNA, 101 bp, rice(Oryza sativa)
  misc_feature (71): n=t or c
aagggcactgtttcaggcgaatatgggcatgatcaggctgagttcgagtttcagcatggaaatcctgatgngacagtgaggcctgtcaatgttggaaggcc

SEQ ID NO: 47127 - DNA, 101 bp, rice(Oryza sativa)
  misc_feature (71): n=a or g
ttccctatcacgtcctcaacttacactagtctacatgccacctttatcactgtgcttgaaatccatggctnttttagtggcctaatgcaagagtactcttc

SEQ ID NO: 47128 - DNA, 101 bp, rice(Oryza sativa)
  misc_feature (71): n=a or g
caccgtccttggctagcccaggttctgttaaagtgaagatccagcagttagaccaatacgaggttaatganggcaacatcgtgaacattactccagacaag

SEQ ID NO: 47129 - DNA, 101 bp, rice(Oryza sativa)
  misc_feature (71): n=a or c
ataggcgcatttccagggtaatgacttttgagagtgcagtgactaggggtggacgtaggataaaaaataantggggggcatgtatctatataactcataga

SEQ ID NO: 47130 - DNA, 101 bp, rice(Oryza sativa)
  misc_feature (71): n=t or g
caggacacaaggcttcttcagcttcccgtaagaggttcattcggaagcatgacatagcaaacaagtaccgngactctggcagcttctttcctttatgttat

SEQ ID NO: 47131 - DNA, 101 bp, rice(Oryza sativa)
  misc_feature (71): n=a or g
cattttgcgtgcgccaacctccacacacagcctaaagagctttgctgtaacgtgtaacatcatgcatgganaattggtcgacaagagagaaccttgcaaag

SEQ ID NO: 47132 - DNA, 101 bp, rice(Oryza sativa)
  misc_feature (71): n=t or g
gggagggctgcttgcttgagcctctatttccgggatgtcttcattttgttctttacctgactggtttccantctggggctcctgatcaccactgatttcag

SEQ ID NO: 47133 - DNA, 101 bp, rice(Oryza sativa)
  misc_feature (71): n=t or c
cgttccctcgtagatctgaatcgtagccttgtcatcggtgcaagtcagctcgtaggatgtaaaaccgcatncagatgggtcacctcgccggcggaaaggag

SEQ ID NO: 47134 - DNA, 101 bp, rice(Oryza sativa)
  misc_feature (71): n=t or g
tgcgatcgtcatcatcgagcttttggaactgctactaagtgctaagccaacgatcgagagaatatctccgnagtcctcccgatctgctccatgatgatttg

SEQ ID NO: 47135 - DNA, 101 bp, rice(Oryza sativa)
  misc_feature (71): n=t or c
aataaaagattcgttgcatgtctgcatgcagtggcaggggacaaaacctgcgtccgatttttctccacccngctggtcgccggggtgtgagcattttcggt

SEQ ID NO: 47136 - DNA, 101 bp, rice(Oryza sativa)
  misc_feature (71): n=a or g
gccatgattaatggagtagtttggggagagagagatagcacgagagacagtacaactgcgtttagtttttnaaattggaaaaaagtttggggaaagttagt

SEQ ID NO: 47137 - DNA, 101 bp, rice(Oryza sativa)
  misc_feature (71): n=a or g
gactcgccggtgaccgggttgatcacgacgatgctgccgtagtagaggggatctcggtcgaaccacaggcngatcaggccgttgcacgagccgaccatgtc

SEQ ID NO: 47138 - DNA, 101 bp, rice(Oryza sativa)
  misc_feature (71): n=t or g
atgacattgtgtgcatacaaataatcgacaaataagaaggggatgagaacaaagccatgaaaaactacctnacatcgtatgtaaactttatagatctcctg

SEQ ID NO: 47139 - DNA, 101 bp, rice(Oryza sativa)
  misc_feature (71): n=t or c
ctacaaatgctacttatatactttccttattccaaaatataagaggtacgagtaccattaacacaaagatnaagaaaaaatactattatcttcacctttgg

SEQ ID NO: 47140 - DNA, 101 bp, rice(Oryza sativa)
  misc_feature (71): n=t or g
tgaaacatttctgcttgcatcacgctgcctatctggagcttcaatatttgtaatgaagtcaaaaggctgtncttggtgtatgtagtcatcatcctcatcat

SEQ ID NO: 47141 - DNA, 101 bp, rice(Oryza sativa)
  misc_feature (71): n=t or g
gaatttgctctagaaaaatatatacgaaggatgaagctaatttttttcaagctacacaactctagcttggnagtactccctccgtcctataatataaaaaa

SEQ ID NO: 47142 - DNA, 101 bp, rice(Oryza sativa)
  misc_feature (71): n=t or c
catggctgcaatctcacgtaataaataagttatcggcgacataagggcacccataatagttatgtcacacnccaatccggcaccgccgtacaacggcacct

SEQ ID NO: 47143 - DNA, 101 bp, rice(Oryza sativa)
  misc_feature (71): n=t or c
tactagtcgatatctagcgagaggcatccgcagtgactccatcaatttcaagatataccgacctagtcttncggagagcgtatgtggttgtactatgtttc

SEQ ID NO: 47144 - DNA, 101 bp, rice(Oryza sativa)
  misc_feature (71): n=a or g
actaaaaagagtggcacgcgggcgttcgttagcctttttgcacaacaacaatagtggacatgaaataagantgcctacaaagaacatgacaacaatgcgat

SEQ ID NO: 47145 - DNA, 101 bp, rice(Oryza sativa)
  misc_feature (71): n=a or g
ccaagccaaattcaaatccaaggaccctgatctgctgcccgatccaattaatattccacctgactgcatcntcgtgctcaacgacgacgacgagcctgcag

SEQ ID NO: 47146 - DNA, 101 bp, rice(Oryza sativa)
  misc_feature (71): n=a or g
ttctatttagctagctatggccttattcccttttctttgtgctcattccgaattgtttcttaccaaccgtncacatgtacgcataacccgaaacgaaagac

SEQ ID NO: 47147 - DNA, 101 bp, rice(Oryza sativa)
  misc_feature (71): n=a or c
ggttcctgatcgttgtttgggtgatgattctgacagatcatttcttcgacgtcgacggagaccaacaaaangatcatgccgaatccgacagcccgcattcc

SEQ ID NO: 47148 - DNA, 101 bp, rice(Oryza sativa)
  misc_feature (71): n=t or c
tagatccatcttctgggtgcttaatctcttcgctacatccatagcagtgcttgccatctataggcggattntggagatccagacacaccacatactcgtca

SEQ ID NO: 47149 - DNA, 101 bp, rice(Oryza sativa)
  misc_feature (71): n=a or g
ggcaaaacttgctatagcattcttccgtagaatgaccacctggaccatgtgctttacaaaacttgctatgntcaagctgatattcttttcctccgcttctg

SEQ ID NO: 47150 - DNA, 101 bp, rice(Oryza sativa)
  misc_feature (71): n=a or g
ctgataaaaaacccggtaaaaaccaatgactttgggttgacgcccgtgcgaaaaccgtctaataccaatcngttttcataaaccaagacctagcggtttca

SEQ ID NO: 47151 - DNA, 101 bp, rice(Oryza sativa)
  misc_feature (71): n=t or c
tttatgacttccagaatctatgatgcctaatgcttcccaaaaatgactaatctctatattattaaaatggnagtcctcagggtaaagggcacaataagaaa

SEQ ID NO: 47152 - DNA, 101 bp, rice(Oryza sativa)
  misc_feature (71): n=t or c
tcattttgtctgggatatccaaagtagttgtggtattgcaaagtccacggaccatcattttgtgtacaganttcctgacaccttagaaggaaactaagatc

SEQ ID NO: 47153 - DNA, 101 bp, rice(Oryza sativa)
  misc_feature (71): n=a or g
ttaaatggtccataaaacttagatctcagcttcagtgatcccctgataccaaatgcagtttgtctgtaggnctgcagtttaatgtacaccatgtccccaac

SEQ ID NO: 47154 - DNA, 101 bp, rice(Oryza sativa)
  misc_feature (71): n=t or g
gggtaaaggtgcgaatggtcggttaggacatggagatacggacgataggagttctcctactttggttgaanctctgaaagataagcaagtcagaactgttg

SEQ ID NO: 47155 - DNA, 101 bp, rice(Oryza sativa)
  misc_feature (71): n=a or g
gttggtggtgtaacaagccaatcattgcctggttcaacctatctcaagcttcctgaggctttaaaagtccncgagtcctccattccccgctcacagccttc

SEQ ID NO: 47156 - DNA, 101 bp, rice(Oryza sativa)
  misc_feature (71): n=a or c
acctcctccccacagcctgattctgccggctgaattttccaagctttaccatcttcaggagctctctgtcnatcctaacactcgcttgcattgtccatccc

SEQ ID NO: 47157 - DNA, 101 bp, rice(Oryza sativa)
  misc_feature (71): n=a or g
tacagataaattcctcagttggagccagaaatgtcgttcagaactaactgcatctcaagaactacagcgcnccgcctccctctcactctgatgagcctcgg

SEQ ID NO: 47158 - DNA, 101 bp, rice(Oryza sativa)
  misc_feature (71): n=a or g
tccacttccatctcaccacgtcacttttggtccgtagcatagtaagaaaacctggaccggtccttgacccngtggagggctcggttcaccggtttaccgac

SEQ ID NO: 47159 - DNA, 101 bp, rice(Oryza sativa)
  misc_feature (71): n=t or g
cttctgaaggtttaagatgctactaaatggggcaggattgtcttccgaaggtttaagacgctgctaaatgnggcggttgtgctagctgggtctaaggttcc

SEQ ID NO: 47160 - DNA, 101 bp, rice(Oryza sativa)
  misc_feature (71): n=a or g
tagagacttctgcacaagtggtgatgatgatcgaggctcagctaagtttgttcctcagtctccaaatactnggtgtgtttagttcctgaaaaaagttagaa

SEQ ID NO: 47161 - DNA, 101 bp, rice(Oryza sativa)
  misc_feature (71): n=t or c
tactttacatctatactactttaaatgaagctagtggtggtcgagtccgccttcaacacaagctgacatgngaggtcaggtcataaagtccccacacgtga

SEQ ID NO: 47162 - DNA, 101 bp, rice(Oryza sativa)
  misc_feature (71): n=t or c
gtttgagaaacatatgcctgcttatgtggacgggcttttcttctcttcctagtttatcaaactagggcgangtcaaatattattcagatgcctggcttctt

SEQ ID NO: 47163 - DNA, 101 bp, rice(Oryza sativa)
  misc_feature (71): n=a or g
gaaagccatggacgacgctgtctatgatggtgttgatgtcttatcactttctataggtggtacaaaagaanatgtgggaaccctacatgtcgtcgctaatg

SEQ ID NO: 47164 - DNA, 101 bp, rice(Oryza sativa)
  misc_feature (71): n=t or c
agtggtccctagttttctttcactagaatgacctgcaattgagttctctcctttgttcatatccccactgnctgagtgagtatttgcaccataagccactg

SEQ ID NO: 47165 - DNA, 101 bp, rice(Oryza sativa)
  misc_feature (71): n=t or c
aagcataatatatgtagtatattatatgtatttatactcgaatgtgcctaatactttttttctcaacaaantcactccttatgcacttctagctcacaaca

SEQ ID NO: 47166 - DNA, 101 bp, rice(Oryza sativa)
  misc_feature (71): n=t or c
tgtctccccagtgcgtgtagctttgggtggggtccataacagatttttttttctcacgctgggcccaccangggaatacctttccccacccatctctctcc

SEQ ID NO: 47167 - DNA, 101 bp, rice(Oryza sativa)
  misc_feature (71): n=t or g
aggaagagaaggaaggaaggggaatgcgagaggtggaggtgggcgattttatgttgggttgggtttgcccnttttttttttcggtttcggttcgggtcggc

SEQ ID NO: 47168 - DNA, 101 bp, rice(Oryza sativa)
  misc_feature (71): n=a or g
aagggttgaaaacaacctgggagtaatacatttacctggtgcagctgacctgcaaagaatgcaaacatcanaaaagaccagcaacgcataacatggctact

SEQ ID NO: 47169 - DNA, 101 bp, rice(Oryza sativa)
  misc_feature (71): n=t or c
gcagtggtgtccacaatgatggtgccatcaggactacgtgtatgggtactcatccttccatgtatagcagncgctactccaacaaaacatatccccatgac

SEQ ID NO: 47170 - DNA, 101 bp, rice(Oryza sativa)
  misc_feature (71): n=t or g
ttagttttggttgtgctcatgccagaggcagctagccctcttatttccagccgcaaattgagaggctcatntttttttttttaatcttttgaagacttaag

SEQ ID NO: 47171 - DNA, 101 bp, rice(Oryza sativa)
  misc_feature (71): n=a or g
cctttttgggtaatgccaaacaatggaggtttacagatgacaggaaccatagttgctgcactggaatagtnagcttcaggcatgtttgttgaatgaacctt

SEQ ID NO: 47172 - DNA, 101 bp, rice(Oryza sativa)
  misc_feature (71): n=a or g
gagagaacaagtactacagtagtagaaatggatctggataggccggaacttaccagcattatgccttcctnttgcatcgcaagacatgaaaacaacagaca

SEQ ID NO: 47173 - DNA, 101 bp, rice(Oryza sativa)
  misc_feature (71): n=a or g
gccagcctaggaggctggccaatattagccagtgggtgggcttgaatggagaggcaatggagagtttgttngaggagtgtttttggttcatttgtcaaatt

SEQ ID NO: 47174 - DNA, 101 bp, rice(Oryza sativa)
  misc_feature (71): n=a or g
cgcaatcaccgtcgcaacgatgtcgactatcccgctgtggctgacaatcgcagtcgcgatgtcggtagatngatccgcggcggaatcaagtactgtccccg

SEQ ID NO: 47175 - DNA, 101 bp, rice(Oryza sativa)
  misc_feature (71): n=t or c
gatcgatcactcacccatctaacttccattctcccctgacggtcttggtgaggaggtcagaactagcacangccgggacgccattgatgagggtgtaggca

SEQ ID NO: 47176 - DNA, 101 bp, rice(Oryza sativa)
  misc_feature (71): n=a or c
tgttttcttctcgcgctgttcgccttaaaacctgccaaaacggggtcctccgctccatattttctttctgnaaaaggacctttcctgatcagagagtagga

SEQ ID NO: 47177 - DNA, 101 bp, rice(Oryza sativa)
  misc_feature (71): n=a or g
tctcaacaatctcgagacctcacaggatccaaaattggaatgttcgttacttcattatattttttaacacngtaatatcataagcacacgcaatcaaaagt

SEQ ID NO: 47178 - DNA, 101 bp, rice(Oryza sativa)
  misc_feature (71): n=a or g
ttattgttaaaattgaccatctttttgggccatcccattccagctgacatcgttttccctgcggttgttangctacctcaaaacacctgtcttgggtgttc

SEQ ID NO: 47179 - DNA, 101 bp, rice(Oryza sativa)
  misc_feature (71): n=t or c
tctgtggagttggtagctgttgatgatgccatcgaatcaacctacattgacaatcccaaccaaccaagggngatgctcgccaagtgttcgatgaattgctc

SEQ ID NO: 47180 - DNA, 101 bp, rice(Oryza sativa)
  misc_feature (71): n=t or c
cgcaacatcctcaagctttttggtgattgtcgtagctgtgttagtggatgtaaattttgattcctctttgntgttttcatcttcaaacatagcagaaagat

SEQ ID NO: 47181 - DNA, 101 bp, rice(Oryza sativa)
  misc_feature (71): n=t or c
tttgctcttgatggttaatgtattgagctgtctgtaatcaacacatagcctccatgtgctatcctttttcntgacaagtaaagcaggtgaagaccatgcac

SEQ ID NO: 47182 - DNA, 101 bp, rice(Oryza sativa)
  misc_feature (71): n=a or g
gcaaatggtggtctgaatcaacaacgcatttctgtaagttgctggattgtttttaccctcagcataaatcntccaagtagatacatttactcatttagtct

SEQ ID NO: 47183 - DNA, 101 bp, rice(Oryza sativa)
  misc_feature (71): n=a or g
catcttatgcaggcaaacagtcaaaaaagaatctgaaatcgaggccatcatagaggaagcagaggatgccntccttccaggaactagtgaggagacattct

SEQ ID NO: 47184 - DNA, 101 bp, rice(Oryza sativa)
  misc_feature (71): n=a or g
tgggtatatcagggataaaaatgaaaactcaagggtgcgtaggggataagacaaaatttaggggcacagangaaattgggcgaaaattcatgggtacataa

SEQ ID NO: 47185 - DNA, 101 bp, rice(Oryza sativa)
  misc_feature (71): n=a or g
aaccggccggaacttcctggcgggaatttttgaaagacagaaactcccgcctggaagtttctcccggtttntccggacgttccgggtccctgactgctcac

SEQ ID NO: 47186 - DNA, 101 bp, rice(Oryza sativa)
  misc_feature (71): n=t or c
taattctctggaaggcttgcaatggctcggcaacctcaggttgctgcaggcacacagatgcctcagtggtnatggagaaaatggaaggtgtatccttccac

SEQ ID NO: 47187 - DNA, 101 bp, rice(Oryza sativa)
  misc_feature (71): n=t or g
gctttttttctttttcggaaaatcgcgaaattggctgatacgtacggatccgatacgtatccgtatcctantacgtatccgatatggatacgtggtttttt

SEQ ID NO: 47188 - DNA, 101 bp, rice(Oryza sativa)
  misc_feature (71): n=t or c
accttccgatcctacttgatccacaatgaatcttgttcttgtcacctgtttcctgaatacatctcattccnaccctcgtgtacctctctttttttttcaag

SEQ ID NO: 47189 - DNA, 101 bp, rice(Oryza sativa)
  misc_feature (71): n=a or g
aactgcaaccatccaagcaaacagagcttctatcaatgaggaaacagctaaactggatgaattggaagccngtccaagtgcaacccaaacaaacattgatc

SEQ ID NO: 47190 - DNA, 101 bp, rice(Oryza sativa)
  misc_feature (71): n=a or c
accatgtttgtttcagggccctggcaaatggatcacaacgatttcacatcacttcgtaaaccgtttactcngtcctaaaaaatccaacctaatactctatc

SEQ ID NO: 47191 - DNA, 101 bp, rice(Oryza sativa)
  misc_feature (71): n=a or g
ggagatgcgcaggaggggaggaggtggggctttgctctgctgttcctctcctcgttgtggggaagtggcanctgcgggaagggggagaagaagaggaggag

SEQ ID NO: 47192 - DNA, 101 bp, rice(Oryza sativa)
  misc_feature (71): n=a or g
gctggagataagagtaccctgggaggcattaagtctgctttgagcaaagtaatgacttctctttgtacctngagcaaaaggaaattcaagaatgtgtcatg

SEQ ID NO: 47193 - DNA, 101 bp, rice(Oryza sativa)
  misc_feature (71): n=a or g
catgcatcgtttaagacactatgccaattacaccctagcatgctaaaaaaattgtatttcgattaaatccntgtctccatgcggttatatttgagaaatca

SEQ ID NO: 47194 - DNA, 101 bp, rice(Oryza sativa)
  misc_feature (71): n=a or g
gatatatcatttattctggactaattattgggtagccaagccagtttttctcagcgagcattcatgattancaacagttaatatttggagcaggtatttag

SEQ ID NO: 47195 - DNA, 101 bp, rice(Oryza sativa)
  misc_feature (71): n=a or g
acaacttctgttacggagtgttcatttagaacactggggaacaccaggatattggagtattacactagcgnatgtgagtcccccgtccctcagtacagcac

SEQ ID NO: 47196 - DNA, 101 bp, rice(Oryza sativa)
  misc_feature (71): n=t or c
agatatttcccagactaactgaatcctaagttgatgtacacattttgcttctgttctatttgcccagagangcactgcgtgaccgcacacccctaacagtt

SEQ ID NO: 47197 - DNA, 101 bp, rice(Oryza sativa)
  misc_feature (71): n=a or g
ggaagcaaccatctgccataccatgaaagaaatgttgccgggcgtttcaacgtccgacaatggcatgggcngcgccattatgaggcgcgccgaggcactgg

SEQ ID NO: 47198 - DNA, 101 bp, rice(Oryza sativa)
  misc_feature (71): n=a or g
atactccaataaaaaaagagagatagagatagagatactcactcgtcatagaataagatcattttaatttnatcccttccgtttgtcccaaaataaattta

SEQ ID NO: 47199 - DNA, 101 bp, rice(Oryza sativa)
  misc_feature (71): n=t or c
tccaatatatacaaatataatgacattttctccatcttttgtaccacatttattttcccatctttctttcngttaacacctacaatgaatgtatcctcttt

SEQ ID NO: 47200 - DNA, 101 bp, rice(Oryza sativa)
  misc_feature (71): n=a or g
tcatggtcaatttgctgcctttaccactggtgttcgttggaaggatttggcccgtgaaaagaacattgccngtgttgatgatgagagaattctcctgcttg

SEQ ID NO: 47201 - DNA, 101 bp, rice(Oryza sativa)
  misc_feature (71): n=t or c
gctcgagctcggctcgttgacagccctatttctaggcatgataccatttttttcatttccgttgtttaacntgtttgtcaaaaatgtaatccattttacta

SEQ ID NO: 47202 - DNA, 101 bp, rice(Oryza sativa)
  misc_feature (71): n=t or g
catatagggttcacaagtgcaactcatcgatgaataattgaattgagcgtacaagtaataatttttggacnacatggatcgatctctctttgtcggtcaca

SEQ ID NO: 47203 - DNA, 101 bp, rice(Oryza sativa)
  misc_feature (71): n=a or c
actctgtctctatccactgcaatttcctcatactcgttataaaacttaaaagaaaaaaaatcgaaaaaggnagcaattattattatctcgttgatttggac

SEQ ID NO: 47204 - DNA, 101 bp, rice(Oryza sativa)
  misc_feature (71): n=t or c
cataaactgatcatttgttggagtgtggctgaacacagactcaccagacagatattacggcaaaaacaagnaagtttctagtccttgacacgcaactctgg

SEQ ID NO: 47205 - DNA, 101 bp, rice(Oryza sativa)
  misc_feature (71): n=t or c
tacaaaaagatttcgggaggatcatgaacgtgttcttgtacctataccactactttaatttcatgctcttnagtcctatatatagttttaagaagtttaat

SEQ ID NO: 47206 - DNA, 101 bp, rice(Oryza sativa)
  misc_feature (71): n=a or g
ccgaaatctcatgtgtgccgtgtattatctctctatcttgtggaagttatttggatggggctacggatcgngcgtctgatccgtaggtgtaaaaattggac

SEQ ID NO: 47207 - DNA, 101 bp, rice(Oryza sativa)
  misc_feature (71): n=a or g
atgataccgaacttttttgaaagtatttcttgggcgaaactttcaaatttcgcatttgcacgtcgtttgcngagcagtcgttcactgtgacgctgagcaga

SEQ ID NO: 47208 - DNA, 101 bp, rice(Oryza sativa)
  misc_feature (71): n=t or c
ctagctagatccttttcatgttttgatatgatgctacatacatgatacctcatacatccatctagctatgntagctcctgtctcacttattttacatacct

SEQ ID NO: 47209 - DNA, 101 bp, rice(Oryza sativa)
  misc_feature (71): n=t or c
tttatgaataaaactataatctcgcagatgctatcagtcactttggccctcctgatcctgcacacaagaanaaaaagtcagagaaagaggagtttttttac

SEQ ID NO: 47210 - DNA, 101 bp, rice(Oryza sativa)
  misc_feature (71): n=t or c
taaatactcacataggtaatctcaaagaaatcacaatcaaagtctttgggccgaacaaggctcaaggttcngtggaagaatatggtatgcaaaatgcctgc

SEQ ID NO: 47211 - DNA, 101 bp, rice(Oryza sativa)
  misc_feature (71): n=a or c
gacataggagaacaataaagcatgtcttgtgctacagtacgaaacagtaatctgcagtggtttaccgtagnaacagtgataagcaggaaaatatgatgtac

SEQ ID NO: 47212 - DNA, 101 bp, rice(Oryza sativa)
  misc_feature (71): n=a or g
tccagagcttcacggcggcgaatttgcggccttttggcccatcaaataagtagaatactgagtaggaatancccaaaagaatttggatccataaaggccca

SEQ ID NO: 47213 - DNA, 101 bp, rice(Oryza sativa)
  misc_feature (71): n=t or c
aggtttaacttctttcttgattaattccacatgattgtgatgcctctacttatatagagccgacccctaanaaacatcctaacaaacttatctaataaagc

SEQ ID NO: 47214 - DNA, 101 bp, rice(Oryza sativa)
  misc_feature (71): n=a or g
gcaatgaaaccctattacatgaatcccctatctaaagaagaatgctttatggtcttccaggaacatgctgnttgtggttttgatattaataatgaccatga

SEQ ID NO: 47215 - DNA, 101 bp, rice(Oryza sativa)
  misc_feature (71): n=t or c
caaatgatccatggcgcgtaccgatggctacggcgatgttaccaccagatatgacatctgacgacgacgangacatgtcgatccaactggtcgagttgatg

SEQ ID NO: 47216 - DNA, 101 bp, rice(Oryza sativa)
  misc_feature (71): n=a or c
gtttggttaaactatgccaaacaataattgttgttgcatcccggccatgcatgatgggcttgaattaaaancattatcctctctaccattagtcatatctt

SEQ ID NO: 47217 - DNA, 101 bp, rice(Oryza sativa)
  misc_feature (71): n=t or c
tggaccgctgacatgcggggcctggcctacatagatcctactcgtaacgtcagacaaaaaccggtcactangggcgtgtttggatggtgccctgacctgag

SEQ ID NO: 47218 - DNA, 101 bp, rice(Oryza sativa)
  misc_feature (71): n=a or g
gtcatgtatcaaccttcgttgtgcggggtttgttcagatgagcaaaaaggcaatccctggaataataatcnggccagtttccactgtcaatggaaaacaat

SEQ ID NO: 47219 - DNA, 101 bp, rice(Oryza sativa)
  misc_feature (71): n=t or c
tccggtaagcagtgcctgacctgcggtggtgatcccgaccatttcccgatgtcgctgcggtgatacttccntttgtcgtcattcttgaacacggtcgtccg

SEQ ID NO: 47220 - DNA, 101 bp, rice(Oryza sativa)
  misc_feature (71): n=a or c
tggggatggtgggggttggaagcatccagatttgcctcgagactcacgcactccagaatgccatggcatcnatctaacctatggatggttgagccacttct

SEQ ID NO: 47221 - DNA, 101 bp, rice(Oryza sativa)
  misc_feature (71): n=t or c
gtgcagaactccaccgttttttcggtgccaaataaaaaaaaaaacccaccgtcttcccgtcttccgcttcntgggcggcgcaccgcggttctttggcgcgt

SEQ ID NO: 47222 - DNA, 101 bp, rice(Oryza sativa)
  misc_feature (71): n=a or g
cggtgtggatatatcttttctggatcctatattagttctagcaaataatttactgtcataaacagtagaangatgcttagaactatactttaattaagttg

SEQ ID NO: 47223 - DNA, 101 bp, rice(Oryza sativa)
  misc_feature (71): n=a or c
aaatttgccaaaaaagatagtgggaaaacaaaagcagctcttgcgaccagcaccaagaacaaaatagtggngctcaaagcaatagatttcattgggctgca

SEQ ID NO: 47224 - DNA, 101 bp, rice(Oryza sativa)
  misc_feature (71): n=t or c
ttccacgggcacacagaaaagcatgcagcatgcagctcaaagacatacctattcttttggccgctataacnggcttaagactggaactggaattttataaa

SEQ ID NO: 47225 - DNA, 101 bp, rice(Oryza sativa)
  misc_feature (71): n=a or g
tgtgaagattcggcgccggaaactcagtcgacactagcggtcgtgggagctttcacaagaccagtgttctngtcgccgcagccagtgtttgtgccagcggc

SEQ ID NO: 47226 - DNA, 101 bp, rice(Oryza sativa)
  misc_feature (71): n=t or c
aaatttttcagatttggaaatatgcatatcaaaaatagattaagggagtagctgctatgtcattctctttntattaactgctatgtcattctttttgtgaa

SEQ ID NO: 47227 - DNA, 101 bp, rice(Oryza sativa)
  misc_feature (71): n=a or g
gtctctctagggaattaatggtaagagattattgtgggaggaatacggctttgctagtcgctatacatggngagggtgaggtggaaggagtaattatcttt

SEQ ID NO: 47228 - DNA, 101 bp, rice(Oryza sativa)
  misc_feature (71): n=a or g
cctaatgcaaatgataaacttattagaatatggcaatgatgcttcagatcatacctccaccgatggacacnatttcacataactaattaccccatcaacac

SEQ ID NO: 47229 - DNA, 101 bp, rice(Oryza sativa)
  misc_feature (71): n=a or c
ttacggcagcgctttcgccaacctgaaccagttgtatattgcagctcatatatatggccatcacgcccagntaggaaaatttgacccttatctgtacaagt

SEQ ID NO: 47230 - DNA, 101 bp, rice(Oryza sativa)
  misc_feature (71): n=t or c
aaggccgcttgggatgccatcaaactcatgcgagtgggtgttgatcgtgttcgtgaggcgaaggaacaggngttccgtcagcaatacgaagcaatgcgctt

SEQ ID NO: 47231 - DNA, 101 bp, rice(Oryza sativa)
  misc_feature (71): n=t or g
atggcaactgggtgccgcgcttgacggacttcgggttggcgctcacctgggaaggcccaggccatgagganacggttgttggcacgtacggatacgcggca

SEQ ID NO: 47232 - DNA, 101 bp, rice(Oryza sativa)
  misc_feature (71): n=t or g
atatgcgttgtccatgcatgcatatggatatggatatcgtcgtcgtctacctctcgtcgatcgacgccatngctgctaactacccgcaggttagctagcta

SEQ ID NO: 47233 - DNA, 101 bp, rice(Oryza sativa)
  misc_feature (71): n=t or g
tcaaggaactcacggataagaacattgtcctcatagaccttcagtgtcacaatagggccagcaaaaacctnccgccttccatagatttggaagatgggctg

SEQ ID NO: 47234 - DNA, 101 bp, rice(Oryza sativa)
  misc_feature (71): n=a or g
tttttaaaaaatagggtgaaactcttataactatcaataatttcaaaatggacaatgctatatttatggcnacacaaaattagcttgatcacagtcggtta

SEQ ID NO: 47235 - DNA, 101 bp, rice(Oryza sativa)
  misc_feature (71): n=t or c
tatatcctttaattattaacgcggagagaaagcgagaaagaggaaaacatgaggagggatggaggaatacngctggttcgctgaaagaaaaaacaagaaaa

SEQ ID NO: 47236 - DNA, 101 bp, rice(Oryza sativa)
  misc_feature (71): n=t or c
atatggatggtgtttgctccgtgttattcagtgatgagattatttggcaattggcacttggacaggccagntctgctacgtttagtctactcccttcgtcc

SEQ ID NO: 47237 - DNA, 101 bp, rice(Oryza sativa)
  misc_feature (71): n=t or c
ctactgcatgggcctgatcagttcatcagcacattcgtgccttcttctatcctccatcagtccatctatcnaattgaagggagaagaacctacaagaaaat

SEQ ID NO: 47238 - DNA, 101 bp, rice(Oryza sativa)
  misc_feature (71): n=a or g
attgcaatgcaaaattagaggaggaaacatgaaaaacataccgtcattgttcttgtcgaacagcgagaagncgtctcggaaatcggagatctgctgctcgt

SEQ ID NO: 47239 - DNA, 101 bp, rice(Oryza sativa)
  misc_feature (71): n=t or c
gaaagacaggcaatttctggcgcatcgagtccatgcacatcttcttataaggcggctcatggacaagttcnatggagaagaggagcaatgcgagggaagtg

SEQ ID NO: 47240 - DNA, 101 bp, rice(Oryza sativa)
  misc_feature (71): n=a or g
tttcattatgttttgtctttgaattgctgcagattttgacaaaccaccaagagccacgctcccaacagaantctgcacagacaaatccggccaggaggccg

SEQ ID NO: 47241 - DNA, 101 bp, rice(Oryza sativa)
  misc_feature (71): n=t or g
ctgaaagtgaaattggggccctaacctcagtgtcgtccctagaacggcggatgtggtttatggtgatgtangtgtctctgttgcgctggcatcccctcgtg

SEQ ID NO: 47242 - DNA, 101 bp, rice(Oryza sativa)
  misc_feature (71): n=a or c
aatcgtcaccgctgacgccggattcctccgccgcttccttgttgatgatttcagtggtcttgccacttttnttctccggcgcgacggagatcatgacggag

SEQ ID NO: 47243 - DNA, 101 bp, rice(Oryza sativa)
  misc_feature (71): n=t or c
cgtgtccatgtcgtagatcagtggcagtatgtatataccttgagggcggtgtacctgtggtagagcttggngttgagctgctccatcggtgcggagaagcg

SEQ ID NO: 47244 - DNA, 101 bp, rice(Oryza sativa)
  misc_feature (71): n=a or g
aaggatagattgtagctaacttgtagcctttcgttgtatgagttagctctaagtgaactcctaataacatnaaacttttttggagctagtagttagctctt

SEQ ID NO: 47245 - DNA, 101 bp, rice(Oryza sativa)
  misc_feature (71): n=a or g
ttctactacgaaatcatagagaaaaaagaggaagacctaagccttagcaattcaggtccatttagttcgcnaaaagaaaatttttagatgtcacatcagat

SEQ ID NO: 47246 - DNA, 101 bp, rice(Oryza sativa)
  misc_feature (71): n=a or c
gaataagaatactccttgcataattaattatcagaaggtaggtgtgcaagaatctcaaactaactcgaccntatactataaaaaactgtaagtcaaacatg

SEQ ID NO: 47247 - DNA, 101 bp, rice(Oryza sativa)
  misc_feature (71): n=a or g
tgcgagaaaatagtgttcacgcaaatattctccgctttcaattttcataactctcaattgctggcggcccncgaattctcccccttccccctctcggccag

SEQ ID NO: 47248 - DNA, 101 bp, rice(Oryza sativa)
  misc_feature (71): n=a or g
acacccgcatgcaaaactcaattttttgcggccggtcagtaatgctacccacccaaaaaagaaaaatcacnaaaaaaataaaaatccccaaaaccaaaacc

SEQ ID NO: 47249 - DNA, 101 bp, rice(Oryza sativa)
  misc_feature (71): n=t or c
tgcggggatcaaggatctacagagcatggtggatgggatcgtagcgcgggtgatgaacctcgaaaacaagnagtcgacgtcgtctaccatggcaacgccac

SEQ ID NO: 47250 - DNA, 101 bp, rice(Oryza sativa)
  misc_feature (71): n=a or g
cgcgtgcccggccttctctcactccgccacctgggcccccccctgcctcatcagtttcatcatctcactgnatgtctggatcggtggatccctgtgtgtgc

SEQ ID NO: 47251 - DNA, 101 bp, rice(Oryza sativa)
  misc_feature (71): n=t or g
ggcagtatataggaatctattgtgctgaaagtaataaagggctttcaatctgcaggtgcttgtgaagaatnctgacaataatgtcggaaggattgccaaag

SEQ ID NO: 47252 - DNA, 101 bp, rice(Oryza sativa)
  misc_feature (71): n=t or g
agcctggttgatttgcatgagcatgcttggcttgtacaatatcatccactggaaccctcaagtttatcgcnctcttaatccctattacatgctcaaattct

SEQ ID NO: 47253 - DNA, 101 bp, rice(Oryza sativa)
  misc_feature (71): n=a or g
actgctgcatttgaaatgaggtggagagagatggggaagaaaataagaggggatgatggaggaagaagatngaactgacatgtgggtcccatatctaaggg

SEQ ID NO: 47254 - DNA, 101 bp, rice(Oryza sativa)
  misc_feature (71): n=t or c
ccgagctttggtagctgcagagatctcaaagctatagcggctatttcatttcctcttagagtatagttgcngtccatactccaaatacgtactgcctgatg

SEQ ID NO: 47255 - DNA, 101 bp, rice(Oryza sativa)
  misc_feature (71): n=t or c
atgctggctgaaactgcagagttgtcatcgcctaaaagtaattttgcaatgccaaagtctgccaaatgcgncgtcatctcctcatcgaacaacacattgct

SEQ ID NO: 47256 - DNA, 101 bp, rice(Oryza sativa)
  misc_feature (71): n=t or c
aacaggtggatcagccacgcgttgcagaatcaagctagtttcctcaagatcatcgtggatgcgcacgaatngcacctcgatcacacggtgttcacatcatg

SEQ ID NO: 47257 - DNA, 101 bp, rice(Oryza sativa)
  misc_feature (71): n=t or c
ataagctgcagactgcacaatgtgatgatgttaaaccatactctctctgtcttataatacaggagattttngatggatgtgacgcatcttagtacaataaa

SEQ ID NO: 47258 - DNA, 101 bp, rice(Oryza sativa)
  misc_feature (71): n=t or c
caagtacttaataatgacttcccaaaatgtattacatgtgaatggtcagcatgttcacttctactccctcngtttcacaatgtaagtcattatggtatttc

SEQ ID NO: 47259 - DNA, 101 bp, rice(Oryza sativa)
  misc_feature (71): n=a or g
cacactgcctctttcgcgcagatccatacaaaaccaccggaaaagttttcaaatcccgaagcggattcgcncacggaaacccacagtcgattctccggtga

SEQ ID NO: 47260 - DNA, 101 bp, rice(Oryza sativa)
  misc_feature (71): n=a or c
atagtttattgttttcattcatttaatcatcatccatctaaccaaacaagactctgctcctgagttttacnctttcaataactaaaacacccttgttgtgg

SEQ ID NO: 47261 - DNA, 101 bp, rice(Oryza sativa)
  misc_feature (71): n=a or g
agcacaaaccaaagcctgaactatttctagcttcaaagaactccggtagtcatcaagaattcttcccccantgctaaaagtggactctgatgacacactgc

SEQ ID NO: 47262 - DNA, 101 bp, rice(Oryza sativa)
  misc_feature (71): n=t or c
ggcagcgttcgctcacaaagatgccacgtggatccagcaccggatcttccactccaggacaccctcaagcngaggtgcttgggatgcggtagcagggacag

SEQ ID NO: 47263 - DNA, 101 bp, rice(Oryza sativa)
  misc_feature (71): n=t or c
tactcatggggcacaggtatttcttcttctacttcacaatcatcagcaataggttccttggagattacttnagcgacaggtgattttgtggcagatttgct

SEQ ID NO: 47264 - DNA, 101 bp, rice(Oryza sativa)
  misc_feature (71): n=a or g
ttgaaatcctgtgaaaacctgtaaatgatttttcctatctttttatttaataacctgttctgtcctgtttngtagagctccaactccaaaatttagcttca

SEQ ID NO: 47265 - DNA, 101 bp, rice(Oryza sativa)
  misc_feature (71): n=t or c
ttcaagtcttccttttccttcagtcttttactcattctcatctcttcatcttgactacccgtagtgtcctncactaagttgatcccagtcttttggcaaag

SEQ ID NO: 47266 - DNA, 101 bp, rice(Oryza sativa)
  misc_feature (71): n=t or c
gctgctactgtgttgatgcctaaagcctcacttagtagctcagtaccgaatccgttgaatatgttttggcnagagtgttgctcaattgagctgccatatac

SEQ ID NO: 47267 - DNA, 101 bp, rice(Oryza sativa)
  misc_feature (71): n=t or c
cgtctgggagcttggtggagaagcgcatggaagagaagtccacagaggagaagctcgaggcagagaatggngggacggagatcctgcaactaacaaaataa

SEQ ID NO: 47268 - DNA, 101 bp, rice(Oryza sativa)
  misc_feature (71): n=a or g
aaatgggagctcgtgggctccaggaaagaccgaacactgcactgcacaacacaagcgtcgtcttcaggccntacgtgacaaacctcagcaggcgagtgtca

SEQ ID NO: 47269 - DNA, 101 bp, rice(Oryza sativa)
  misc_feature (71): n=a or c
ttggcttcaacatcactttctccttcaaggaccttcatcaccaatgacatggaaggccttctgttgcaatnactctgcaagcaccacattgcaagcttcat

SEQ ID NO: 47270 - DNA, 101 bp, rice(Oryza sativa)
  misc_feature (71): n=a or c
atactaaatcaaaggaatcatggaccaggagacagttgccagcatcttacagaagccaagatcaagtgttntacaagaactttcaaatctttgagcagcga

SEQ ID NO: 47271 - DNA, 101 bp, rice(Oryza sativa)
  misc_feature (71): n=t or c
ttgagcataacatggtatgctgactggggtggacaggtatgctgattggggtggagcattacctcacaggncagctgaagacagtgcttttgctgttgctc

SEQ ID NO: 47272 - DNA, 101 bp, rice(Oryza sativa)
  misc_feature (71): n=a or g
tatgatcgtacacttatatcatccatgttgtcatatctcatgtcgatcatcaagcacctactccactgttnccttgctcaatttacaaattggtactctgt

SEQ ID NO: 47273 - DNA, 101 bp, rice(Oryza sativa)
  misc_feature (71): n=t or c
ggccagaatttccaatttggttcaagagagcaaataaaccagtaccaacatttctacgacgacgacattcnagatgaaagtgtctctcatctcaacagttc

SEQ ID NO: 47274 - DNA, 101 bp, rice(Oryza sativa)
  misc_feature (71): n=t or c
atgtgaacaacatgcttaaaattagcagaattaacattaggaatagcaaattcattaacttgttgtggcantgatataagtaaagcattatcacacaactc

SEQ ID NO: 47275 - DNA, 101 bp, rice(Oryza sativa)
  misc_feature (71): n=t or c
ttctctaatgaatcctatcttactacatagttgattcccactaaaacgcatttactcatataaagaaaganatgcaagaatccatatcatcaacaatttta

SEQ ID NO: 47276 - DNA, 101 bp, rice(Oryza sativa)
  misc_feature (71): n=t or c
aaggcatttctgctaccgagtgcagcaaagtcacgacttgctgggatcatgtaggtgcgggtgcaagaatnacgactttgaactaccatgacatttccgat

SEQ ID NO: 47277 - DNA, 101 bp, rice(Oryza sativa)
  misc_feature (71): n=a or c
gagtcatgcgatccagtgacggaggactttggcagctggagatttttttttcgggggatttgggaagtgangaaaatggaagaaacttcaaatcagacgtc

SEQ ID NO: 47278 - DNA, 101 bp, rice(Oryza sativa)
  misc_feature (71): n=t or c
cttgctgcagatcgcaacttgactcccaccacttcctccccctcctcgtagttgtgcggagcggagaggancgcatcgttgttctcggcggtgttcccact

SEQ ID NO: 47279 - DNA, 101 bp, rice(Oryza sativa)
  misc_feature (71): n=a or c
gtacgttaatagctcatctcatgctctacacattgaacctaatggacaggacagggaatatgcagaaagancattcctaacctaacgactaaaatgatatc

SEQ ID NO: 47280 - DNA, 101 bp, rice(Oryza sativa)
  misc_feature (71): n=a or g
attgaacggaaggatgttgtgtcatggaatgtgatgataggtgctttcgcaaagaatgggcatggagaganggcacttgaacttgtggatgcaatgttgcg

SEQ ID NO: 47281 - DNA, 101 bp, rice(Oryza sativa)
  misc_feature (71): n=t or c
atggatttgacatcatctattacaaaacaaatctgaactgttctgttcaaatctgttttactccctccgtnctatttgacttttttacttgcattatttaa

SEQ ID NO: 47282 - DNA, 101 bp, rice(Oryza sativa)
  misc_feature (71): n=t or c
cccccaacacacaccagttgccaggcctgacccaacagaagcgagcgcatgcggcattagagtaaagccgngaaggtgaagagctcacatcacatgcgtgg

SEQ ID NO: 47283 - DNA, 101 bp, rice(Oryza sativa)
  misc_feature (71): n=a or g
aggttagtttaaatagataacgaacttcatcattctcttacaaatagaaagataagataccggtgaacacncaaaattggagacttcaagattaatggaat

SEQ ID NO: 47284 - DNA, 101 bp, rice(Oryza sativa)
  misc_feature (71): n=t or c
caccggcagatcaaaatcgaagcaaaaaatcagggagaattcttggtacttccagtacctctcgtcgacancacgtgtcgggttttctgcaccgcggatcc

SEQ ID NO: 47285 - DNA, 101 bp, rice(Oryza sativa)
  misc_feature (71): n=a or c
cttgaagttcatgttagcagaccaaggccgtcaattcagcaagggggctaccaaaaaaatgtcattggtcngcaatccaggtaaagtgacttcaagaattt

SEQ ID NO: 47286 - DNA, 101 bp, rice(Oryza sativa)
  misc_feature (71): n=a or g
ttgctatccgagattaactctataatgtggttgcatttaagttatgtgaattgggattggaaattgctacnttaggcgctgcccttttgtagtaaactagc

SEQ ID NO: 47287 - DNA, 101 bp, rice(Oryza sativa)
  misc_feature (71): n=a or g
cacaataagtttatcacaactatagcacacaagcgttttaattttaggaacaattccaatttacccccttnaaactattgcgacagtataaattaccccct

SEQ ID NO: 47288 - DNA, 101 bp, rice(Oryza sativa)
  misc_feature (71): n=t or g
atactagatttggttttaaacccagctataaagataagagtaggcgtgatggtatattcgctaagctgaantttgttttaaaaaatatcaaatacatgagt

SEQ ID NO: 47289 - DNA, 101 bp, rice(Oryza sativa)
  misc_feature (71): n=t or g
ccaagagggttactatgcccaaaggcgtagcagctgccggcccaatgaagaactaggctaggctttcgccngagaccctcttcgccccgtcgctgtggtcc

SEQ ID NO: 47290 - DNA, 101 bp, rice(Oryza sativa)
  misc_feature (71): n=a or g
ggcgtgacttcgcggagaagcatatcaaccaacctcttatcatcggttccaccacataaaatggaggcctngatggcggcgccatacgcgacggcttcatc

SEQ ID NO: 47291 - DNA, 101 bp, rice(Oryza sativa)
  misc_feature (71): n=t or c
gaaatcaagcaacaccctttctttgaaggcttaaattgggccttgatacgatctgccgctcctccagagangcgaccctgtgacgttgtgaccctcacgac

SEQ ID NO: 47292 - DNA, 101 bp, rice(Oryza sativa)
  misc_feature (71): n=a or c
tgcaggctcggtggaagcaaatttataccagaacaataacgaatttcaagagatgtaagagatgagtatgnttgaggccccttcggcaaggataccaggcc

SEQ ID NO: 47293 - DNA, 101 bp, rice(Oryza sativa)
  misc_feature (71): n=t or c
ccacgtcataccgatttgggagcaacagctggagtggtgctatcggtctcgcttattggcagcgcgagaangggatcgctaccaggtttagacgcgcgaga

SEQ ID NO: 47294 - DNA, 101 bp, rice(Oryza sativa)
  misc_feature (71): n=t or c
tcctgcactgtaataaatgctttagtactggaaaggccttcaaagcactggatgagatgaggctgacaagnggtcagatcagctggcgttgctggacatga

SEQ ID NO: 47295 - DNA, 101 bp, rice(Oryza sativa)
  misc_feature (71): n=t or c
tgtagataacgagattgacgagagcatgaagaaggctttgctagaatcactgtgcggcttgcgtaaactcnagaacctggtgatagattttgacttgatat

SEQ ID NO: 47296 - DNA, 101 bp, rice(Oryza sativa)
  misc_feature (71): n=t or c
caagatcatgaatgctcagtgctcgcatcacccgaattcaaaccatgcggtcaaagattgcatcatctacnagcagttcacagagcaatacgccaagaaag

SEQ ID NO: 47297 - DNA, 101 bp, rice(Oryza sativa)
  misc_feature (71): n=t or c
ttattttcaccatccatctaatccaacggtcaagcttcatttatcctcttttgttttgtagtaaatccaanggctaatatttcatttatcttcatttatcc

SEQ ID NO: 47298 - DNA, 101 bp, rice(Oryza sativa)
  misc_feature (71): n=a or g
cgagccggctctttttttttttttgctcgtgcaaacctataggtgccggctctattttggtataggtgccngttgtttttattggtgccaaccaataggtg

SEQ ID NO: 47299 - DNA, 101 bp, rice(Oryza sativa)
  misc_feature (71): n=a or c
cgtgcaagccgtcagggatgatgcggattggcaggcagtggacggagctccagggtgctcgtgattggganggcctgcttaacccgctcgacggcgcgctc

SEQ ID NO: 47300 - DNA, 101 bp, rice(Oryza sativa)
  misc_feature (71): n=a or g
cctacattttgtcccaccataacctctctctaattaccctccaaaattgtactacttcctcctaatgtatnaaaccgttaactttttattaatgcttaaac

SEQ ID NO: 47301 - DNA, 101 bp, rice(Oryza sativa)
  misc_feature (71): n=a or c
ggattttacatggagcatgacaaagatgtaactacgatccctactagcactcgccacctatttcatatgtntagaatggtagttggtgattccgtatctac

SEQ ID NO: 47302 - DNA, 101 bp, rice(Oryza sativa)
  misc_feature (71): n=a or g
tgttattttttgcgacggcatcaaatcgttttaattagagcgtgatgccgtgatcgacatgagactaatcnatgcgcgtgccagttgggatttaattagag

SEQ ID NO: 47303 - DNA, 101 bp, rice(Oryza sativa)
  misc_feature (71): n=a or g
ccataataggtatgtgattctctttgaacataggcaaaattcttggtatcaccatgatcatagtaagtgtnaaatttacttggaactcttttgtagttatt

SEQ ID NO: 47304 - DNA, 101 bp, rice(Oryza sativa)
  misc_feature (71): n=a or g
cgcgcgtgcgcttcgctcgagtcgcgtcgcgtccccactctccaagatcctcctagaagaagtatccatcntcaccaccacttcgctttcccagggaggag

SEQ ID NO: 47305 - DNA, 101 bp, rice(Oryza sativa)
  misc_feature (71): n=a or g
agaaagcaagaggagcattcactttacgagttggatacactcagtgctgtccatctacttcctctcaaagngaagaagccaatcacgtataccttgagtgc

SEQ ID NO: 47306 - DNA, 101 bp, rice(Oryza sativa)
  misc_feature (71): n=t or c
atgaagcttgggcaaatccctacagtgcagtggagcatagcacggggctttcttctgtcaatggagcacanaataataatattaaccacggtggactttca

SEQ ID NO: 47307 - DNA, 101 bp, rice(Oryza sativa)
  misc_feature (71): n=t or c
gtgatgacggcgaacgatggacatgtctccaagtccgactatatgaactgagaatatgtcgctgtgttccnggcgtggcgtcatcagaaatagagagatgg

SEQ ID NO: 47308 - DNA, 101 bp, rice(Oryza sativa)
  misc_feature (71): n=a or g
gttgtttgcagggagtgcgacagaagaaagctccagtacctgtatgtttcatatgctggctgaatcagtanttgggatgaaattttcagtgaagaaccaaa

SEQ ID NO: 47309 - DNA, 101 bp, rice(Oryza sativa)
  misc_feature (71): n=t or c
taatggcgaggaatctgggactaaagatgggtatctttatttagtcccgggtgaaatgataatggtggcangggcacgatgatgtcggatgcggtttctaa

SEQ ID NO: 47310 - DNA, 101 bp, rice(Oryza sativa)
  misc_feature (71): n=t or c
tgcttcttcccctgtaccagcgccagcaccacaacatcctgtaaccaggttacagcaaggtattcgcaagncaaagtgctacacggatggtacagtaagat

SEQ ID NO: 47311 - DNA, 101 bp, rice(Oryza sativa)
  misc_feature (71): n=a or g
tggcctttggcccctagcgaccgacaaagtcaagattgcatgatggttacacgacgtgatcgatagatttnattatattcgacgtacgcttaatcgatctg

SEQ ID NO: 47312 - DNA, 101 bp, rice(Oryza sativa)
  misc_feature (71): n=a or g
gttataattttcttcttctctctccatctctcacgtatttgtttttaaacttgtgataagattagctcttncatgagagtcaacactcttaattttttact

SEQ ID NO: 47313 - DNA, 101 bp, rice(Oryza sativa)
  misc_feature (71): n=a or g
acttaagggtctcttccatcataatgcagtcctacacacagttgaactttgtgccagtgaagctgttgcantcagtcttgttctgccaagagaagtggagg

SEQ ID NO: 47314 - DNA, 101 bp, rice(Oryza sativa)
  misc_feature (71): n=t or c
taatcgtgcatgcaacacaactcaacatggtattacaaccagaggtcttgagttcgaattctgactagtangcaattaaataatgattatagtccattttg

SEQ ID NO: 47315 - DNA, 101 bp, rice(Oryza sativa)
  misc_feature (71): n=t or g
ctgatgttgaagcagcataacacacaaatgaatctagtccaatgatgaagcaggacctcctgtcatttcantaaaatttcactctacccattccacattac

SEQ ID NO: 47316 - DNA, 101 bp, rice(Oryza sativa)
  misc_feature (71): n=t or c
cttgatttcgcgaaggcgtttgattccgtcatttggtcaagccttttcaagattcttgctgtcagatgttncccagaaaactggattagctggattaaggg

SEQ ID NO: 47317 - DNA, 101 bp, rice(Oryza sativa)
  misc_feature (71): n=t or c
agtttgattaatgaaaaacctgaaagctaatctgcaaagttggcaaccgatgccattttcttctacgaacntaaaatccaaagattcttccgcttcccaaa

SEQ ID NO: 47318 - DNA, 101 bp, rice(Oryza sativa)
  misc_feature (71): n=t or c
atatttttgggccaacgataacgtcacacgagagtatctcggaatcaagaaggtaaatttgtggttccttnatttttctagagatgaatacacgcttgttt

SEQ ID NO: 47319 - DNA, 101 bp, rice(Oryza sativa)
  misc_feature (71): n=t or c
ttttctttctttactgttatcctaaccacttgcttgaacaagctgaggatgctctagtttgcaattcatgntctgtgttgttaactaatttagtaaaatat

SEQ ID NO: 47320 - DNA, 101 bp, rice(Oryza sativa)
  misc_feature (71): n=a or g
aagaaaccagagagagttcttccgccaatgtcacctgagaaatcattgtgccaatcaacccagcaaaaccnatctttccttagtgaaggactggataaatt

SEQ ID NO: 47321 - DNA, 101 bp, rice(Oryza sativa)
  misc_feature (71): n=t or g
ccgtttcgatttttctttttgacattcaggtaatcgtttaatgaagttacagcacacgtgtatgttgtttntaccgtgtatttacagtgcaaaagtgttct

SEQ ID NO: 47322 - DNA, 101 bp, rice(Oryza sativa)
  misc_feature (71): n=t or c
tgaaacacgcttcaaagctccagaaactgatctgttgtgattcatgtcacatggaagtacaggatggcacngccgtagcctgttccaagtatcttgtacat

SEQ ID NO: 47323 - DNA, 101 bp, rice(Oryza sativa)
  misc_feature (71): n=t or c
acttctcctctctctctctctctctctccttctctctctttgtgcagcggcggccccatcgagccaaagangaagacaacgccactgcccaacgccatcga

SEQ ID NO: 47324 - DNA, 101 bp, rice(Oryza sativa)
  misc_feature (71): n=t or c
gagtataggagggttcccaactagaaggaaagcccctttttccaccagtgtacgtccaccctcctgacaanggggagccagtgtggcgcctcgttcgacag

SEQ ID NO: 47325 - DNA, 101 bp, rice(Oryza sativa)
  misc_feature (71): n=a or g
tactgcaagcttgagctcaattctcacagtggaacaacttcagccaacagtcaccaatttagacgaagtcntcaggaaaggggccaacgttggctacctca

SEQ ID NO: 47326 - DNA, 101 bp, rice(Oryza sativa)
  misc_feature (71): n=t or c
accacctgaatccaatttgtattctttgcccatttccacatctggaaatgagcccgagtatacaacaatgngcttcttcaggcagtgggttagagcaccaa

SEQ ID NO: 47327 - DNA, 101 bp, rice(Oryza sativa)
  misc_feature (71): n=a or c
cgattcaaactgagtgcatatataactgcaccacctagccatatttctagctactatagtgttttggcttntagatagatgcatgggaagcagctgagatc

SEQ ID NO: 47328 - DNA, 101 bp, rice(Oryza sativa)
  misc_feature (71): n=a or c
ttttacataccagatattttgaagaacaccattcagtcattacgtgatagcaacagacacgactttgatgnttgggtgtcattaattaaagctgctgaaga

SEQ ID NO: 47329 - DNA, 101 bp, rice(Oryza sativa)
  misc_feature (71): n=t or c
tttatctccacctcattgttgttaccatcatcgtcctcatcatcaccggagccggcacggctgcgagcatnggaaattgggggttgcgtgctccccatgct

SEQ ID NO: 47330 - DNA, 101 bp, rice(Oryza sativa)
  misc_feature (71): n=a or g
actgacactagtagaatcactactgactgcacaagtagaatcagggataataagggcctgtatagttgggnaaaaaatttttttgggtgtcacatcggacg

SEQ ID NO: 47331 - DNA, 101 bp, rice(Oryza sativa)
  misc_feature (71): n=a or g
ggggtgaatttcttcgcgacgatgcgtgaatttctcaaggaagctgagcaggagatcgagcaagtgaggcncgacgagaaggcggcactcggaagagtgaa

SEQ ID NO: 47332 - DNA, 101 bp, rice(Oryza sativa)
  misc_feature (71): n=a or g
gaatgacttacattgtgaaacggatgaagtatgaactatgaagtgcccgcgtggatcgctcgcaatcctcntaactcgccggcaccggcgtcggcgtcggc

SEQ ID NO: 47333 - DNA, 101 bp, rice(Oryza sativa)
  misc_feature (71): n=t or c
aagtgacaaaacatatacgtggacaacgggactcttgaatacattgaccagggagcttattattatgaacnggggctacaaagtttctattttcaggttgg

SEQ ID NO: 47334 - DNA, 101 bp, rice(Oryza sativa)
  misc_feature (71): n=a or g
aaattggtgtgtgtcaaaaaggagatcaagaacctcaccgtaacatttgacgatatctgtgctcaaataanaggcgcagaccagattgttgcacactctga

SEQ ID NO: 47335 - DNA, 101 bp, rice(Oryza sativa)
  misc_feature (71): n=t or g
gctgtgagacgcgcgtgcggagatcgatgaggaaggaggagctggactacgtgctgatcccgctggggatngcgctcatggtggggtaccacgcatggctg

SEQ ID NO: 47336 - DNA, 101 bp, rice(Oryza sativa)
  misc_feature (71): n=t or g
attgggacttcctcaatccaagagtaacatgtgctgtcccaccactcgtcgatccctagcatcatggctancttcctaaggcagcgatctgttgcattgat

SEQ ID NO: 47337 - DNA, 101 bp, rice(Oryza sativa)
  misc_feature (71): n=a or g
ctatgacgcgctcggttcgcactctatgcaatagaagcgccgggcccaacttgcaaccgataacatggganataattaacacacagcaacacacagtaaca

SEQ ID NO: 47338 - DNA, 101 bp, rice(Oryza sativa)
  misc_feature (71): n=a or g
ccgtgcttgactcattactagctccgctccacacggcttggctcgttgcgttaaatattttgtggaagttngctttatgtgcgatcatatattttgccgtg

SEQ ID NO: 47339 - DNA, 101 bp, rice(Oryza sativa)
  misc_feature (71): n=t or c
tcaaatatgatatgtaaaaaaaatacgtaaggattcaggatgtatttgtgtccgtccctcctcacgtcggnccaggtggcgcgactcatccccctctccgc

SEQ ID NO: 47340 - DNA, 101 bp, rice(Oryza sativa)
  misc_feature (71): n=a or g
gtaaattggtgatcaattagcccaatggcctccttcgattcagcctaggtgttcttcaatcaacagaaacncggcttattttcttcctggtgcctctcatt

SEQ ID NO: 47341 - DNA, 101 bp, rice(Oryza sativa)
  misc_feature (71): n=a or g
aagtcgtctatgttgggacagacaaagtatcgcctgccatatgtatcttgtgagaaggatgttgcaacctngcagcgatctctacaaccgcatttgggacg

SEQ ID NO: 47342 - DNA, 101 bp, rice(Oryza sativa)
  misc_feature (71): n=t or c
attgtgtctacggcccaggagactactccgtcgaagtcgtaatgggccaatacttggtggccttctaatcntctctctctctcttgggcctgatctacggg

SEQ ID NO: 47343 - DNA, 101 bp, rice(Oryza sativa)
  misc_feature (71): n=t or c
taaatcatcatcatcattcaagtatgaatattcagataaatgatggtgcctacttggataactcgctgtantctctcttccactgcttgcaaatgagatat

SEQ ID NO: 47344 - DNA, 101 bp, rice(Oryza sativa)
  misc_feature (71): n=t or c
caggatatcatggatgttttccagtgtttgtataacctgtcaggatgaaactttggagcactcaacagagnagcaattaccttgcttccaaagaggaatgc

SEQ ID NO: 47345 - DNA, 101 bp, rice(Oryza sativa)
  misc_feature (71): n=a or g
cagtgcaattatcacatttggtctgaatgcgctctatgggaggtacaatgtccgtcgttctttctgggctngcaaatggaactctacaaatgcatataatt

SEQ ID NO: 47346 - DNA, 101 bp, rice(Oryza sativa)
  misc_feature (71): n=t or c
caggataaaataggatgcattcctaatactaggaatttagacggagcctatgcaaattcgatttgtagtangtatatgttctatcgtattctatattgcta

SEQ ID NO: 47347 - DNA, 101 bp, rice(Oryza sativa)
  misc_feature (71): n=a or g
agccgtttgagatatagttacggccttacgggatatgagttcctctgttacggtggccgatcttcacatantctaaatgattatatataaacaatagatag

SEQ ID NO: 47348 - DNA, 101 bp, rice(Oryza sativa)
  misc_feature (71): n=t or g
atgggccacatctagaatgggctccaattgaacccatcacaaatgcgttcacctgtgatgagacactttgncccgttactgataggtcatcatagatggat

SEQ ID NO: 47349 - DNA, 101 bp, rice(Oryza sativa)
  misc_feature (71): n=t or c
ccttaacctttaggaaccgacatatctttttctcctcccctatcgtgatgcgcactattgttatggttgcnattgaggtcggagatgtctcaatggtcgga

SEQ ID NO: 47350 - DNA, 101 bp, rice(Oryza sativa)
  misc_feature (71): n=a or g
ccatacaacaggcgaagatcatactccccctatgagaggcgtagatcctactctccacatgaaaggagacngtcctactctccgtatggcagatccccttc

SEQ ID NO: 47351 - DNA, 101 bp, rice(Oryza sativa)
  misc_feature (71): n=t or c
attttttaattcaagaaagaaagactcaagctaatctgtaggataggtgtaactcattccacttggtcccnaaacaaaacacacactactacaaaaatgat

SEQ ID NO: 47352 - DNA, 101 bp, rice(Oryza sativa)
  misc_feature (71): n=a or g
ttgacaaaacaattcatgacagaccatacattgtccggatgaaagaagtaaaccatagctgaaaccgatcnatgctccgccaacggatcacctctcaagtc

SEQ ID NO: 47353 - DNA, 101 bp, rice(Oryza sativa)
  misc_feature (71): n=a or g
ccgcgtggtggtctcagaagtaaatctcacccctgtttcgacgaatttctcacggttttgtcctgcagctncgtcgatcgaagatgtatctccagtactac

SEQ ID NO: 47354 - DNA, 101 bp, rice(Oryza sativa)
  misc_feature (71): n=t or c
gttagtggagaagggtcgcaaaaatttagttggagattaggcttttagttttttgttctcctcctgtaccntgtccccttcgttttgtctttttggcccgc

SEQ ID NO: 47355 - DNA, 101 bp, rice(Oryza sativa)
  misc_feature (71): n=a or g
taaaaagtatcacagcttcatgtgtgtatgccgctcaagccttcaccaatcaccaacatcgtcccatgatntgttcttttttcccgaatagaatggaatta

SEQ ID NO: 47356 - DNA, 101 bp, rice(Oryza sativa)
  misc_feature (71): n=a or g
tatgttgtgttagtcttccagaaatacttataggataggtcgtcgacaataagacacccatcgtgacttcntcaatctcaaaatatgtcggttcaatcttc

SEQ ID NO: 47357 - DNA, 101 bp, rice(Oryza sativa)
  misc_feature (71): n=t or c
ataagaaatattttgcatcgtgctcttatgtccacgtatataagatccaccaaagaacactcttctgagangcaagattgatgcaacaaggaaagaaatct

SEQ ID NO: 47358 - DNA, 101 bp, rice(Oryza sativa)
  misc_feature (71): n=t or c
attggcagcactatggcttgatgggagtctatcgtctgggaacataacagagtttgtggaaaagttaccgngatgttctagtccattgaatatattgagtt

SEQ ID NO: 47359 - DNA, 101 bp, rice(Oryza sativa)
  misc_feature (71): n=t or c
cgcataccatacatatttccgctgtttcgagggaggcatgtcttgtgaaacactcatgtctttgatcttcnggtgatcaaatgagagtacaagagctagaa

SEQ ID NO: 47360 - DNA, 101 bp, rice(Oryza sativa)
  misc_feature (71): n=t or c
tgtccaagagcgaagactcatgattactatcgcccaatgatatgctaggcgtgtgtctgaggagggatgcnacagatatgtcatatagcctggttgacatg

SEQ ID NO: 47361 - DNA, 101 bp, rice(Oryza sativa)
  misc_feature (71): n=t or c
tggtttggcccatgaagaagaaaggtctctcatgtcagctactcatccttgaagaaattaacaaggtcgangacagtagatggatgagataggttatgcac

SEQ ID NO: 47362 - DNA, 101 bp, rice(Oryza sativa)
  misc_feature (71): n=a or g
caagtaaaaaaaatgcatttaactttgtgttcgttcaataattaaggagacgactacacgtcggacatccngagatttgtaaaactccggacggtgtttca

SEQ ID NO: 47363 - DNA, 101 bp, rice(Oryza sativa)
  misc_feature (71): n=a or c
ctgcaaagttatgttggaggcttcgttattcattagagatgcatttgccacatcatcaatcgcatcgttcnaccaggtactaatgttattaataatttatt

SEQ ID NO: 47364 - DNA, 101 bp, rice(Oryza sativa)
  misc_feature (71): n=t or c
gttagatagagctgtgatctcagagaaggattcaattggtgtaagcatatcctcggcatgtaccgcgtacngtccagaaggcttctcccgagaaaagctat

SEQ ID NO: 47365 - DNA, 101 bp, rice(Oryza sativa)
  misc_feature (71): n=t or g
attttttttgaccgaacactgttgtgcatgcatgtggaaacatatttgaactgtccatggctcacgactanctacctactacgtatgttactatcccgctc

SEQ ID NO: 47366 - DNA, 101 bp, rice(Oryza sativa)
  misc_feature (71): n=a or g
tattgatttatcgcacaggccagtaaaatcaaagtggccgtaaagattattgatccgcttagatgcttcantgctgtcacatatgctcccagcagaacaag

SEQ ID NO: 47367 - DNA, 101 bp, rice(Oryza sativa)
  misc_feature (71): n=t or c
ttcttcaaaggcagacatgtcgcaagttccaaatcatgtgtacctggcttgagaagtactccctccgtccnacgatataagggattttcagtttttacttg

SEQ ID NO: 47368 - DNA, 101 bp, rice(Oryza sativa)
  misc_feature (71): n=t or c
aataaagacgtatttgaggcccatcacttggatactgctagctatttacccgctacgtatcctaatactangaatctacatacgatctttctcgaaccgaa

SEQ ID NO: 47369 - DNA, 101 bp, rice(Oryza sativa)
  misc_feature (71): n=t or c
agccatcgagacggccgggttacctcttttggagagaactcaccgaaaacaggaaaagcaaaaagggtggngatacgccgaagttgtattggattgtctcc

SEQ ID NO: 47370 - DNA, 101 bp, rice(Oryza sativa)
  misc_feature (71): n=a or c
gtgccacatccccctggacatgaactccaaacaaaggctgttccttatcggattcctctggatcttaaacntatccaggggctgggtacctaccatccctc

SEQ ID NO: 47371 - DNA, 101 bp, rice(Oryza sativa)
  misc_feature (71): n=t or c
cctcccgtccatcgccatccccaacctcaggacattccaggccacaacgcgcaccgtcaccaatgttggcnaggccaatgccaggtacaaggcgttcctct

SEQ ID NO: 47372 - DNA, 101 bp, rice(Oryza sativa)
  misc_feature (71): n=a or c
cactagcttcctaaatccatcctctatagaagaaccgtgggaacattaggatcattcccactgccttcagnagatttcttcttgcctcgcttcttgagctt

SEQ ID NO: 47373 - DNA, 101 bp, rice(Oryza sativa)
  misc_feature (71): n=a or c
acaaaaataacacaccaagtaaatgaagcaactaaatggcaaccttaacagcagaaatgatgggaattggngggctgtcctgataaaacgataacttcgtc

SEQ ID NO: 47374 - DNA, 101 bp, rice(Oryza sativa)
  misc_feature (71): n=a or g
atgattgtttgcctatgatggttcatacccaaaaacaaagctaagggttttctgcagtcatttgatctgtntgttgtgtcaaagcagatcacatcacagaa

SEQ ID NO: 47375 - DNA, 101 bp, rice(Oryza sativa)
  misc_feature (71): n=a or g
aacgtccttggtgctgtcatgttggaccacggcaccaactacattggcgccgcgaaaagcaccatttctanaataagttattttaaggatttatttgtaga

SEQ ID NO: 47376 - DNA, 101 bp, rice(Oryza sativa)
  misc_feature (71): n=a or g
aggatgaggtgacgagatggtgtggactggttaggttgggctggtataatatttattctagactcacctcnaatcagaaatgtcgaccaataatcaaatca

SEQ ID NO: 47377 - DNA, 101 bp, rice(Oryza sativa)
  misc_feature (71): n=t or g
cattttgtttcttctttctattttagggtgatagcaaaatggcgatcgaaaacctccaaagattagcaganctcaaggaaccagaaaaacccattaacaaa

SEQ ID NO: 47378 - DNA, 101 bp, rice(Oryza sativa)
  misc_feature (71): n=t or c
cttggcatcttgcagttcttgatttcattgacaatgatgctattgatgatgcatggagtgtggcgtcatanttgagtgaggcagattgccttcttgctggt

SEQ ID NO: 47379 - DNA, 101 bp, rice(Oryza sativa)
  misc_feature (71): n=t or g
cgaagtccaaactagtatgatgttcatatcttgtaagacagcgacatcacgacaactcaaagtcctgtcgncttataacaatacaacatgacaaagaagat

SEQ ID NO: 47380 - DNA, 101 bp, rice(Oryza sativa)
  misc_feature (71): n=a or c
gcaaaggctgttataggatactgaacatagcatactgaacaaaagaaacgaaaatgtagcctctcccaacntacagatgggtctctgaacagacgaacatc

SEQ ID NO: 47381 - DNA, 101 bp, rice(Oryza sativa)
  misc_feature (71): n=a or g
aatagattattttcgcaggccgttgattgcaggcggatcagaaaacatccatgcgaacggcttatgcatcntctagacatgcaaatgttttccctgcagta

SEQ ID NO: 47382 - DNA, 101 bp, rice(Oryza sativa)
  misc_feature (71): n=a or g
cgatttggtatttgggcctgcctatgaattcgggcttcttttgtgttcgaggatgttacttcctttaatgngccgtcatgaagtcgggccccggaagaaac

SEQ ID NO: 47383 - DNA, 101 bp, rice(Oryza sativa)
  misc_feature (71): n=t or c
actcgcccaccagtatataacctcctcgcaagcgcaaactcgaaaccctaccttcccaaaccccagccacngccgccgccgccgccaccaccgttgccgtt

SEQ ID NO: 47384 - DNA, 101 bp, rice(Oryza sativa)
  misc_feature (71): n=t or c
gagctccgatttgtcggccgcggacgaacaccttgtcgtcgcaactcgcaagtacatataaacctcactgncacacccacacttgccgctgctgtctgcag

SEQ ID NO: 47385 - DNA, 101 bp, rice(Oryza sativa)
  misc_feature (71): n=t or g
aagtacagctacatgttcagatttatatataggtaaagatttattttagaacattgggagttattacttanagataccttgtcatcgatgtaggcagccca

SEQ ID NO: 47386 - DNA, 101 bp, rice(Oryza sativa)
  misc_feature (71): n=t or g
gaacaatctagggtttaattgaccctatcctatcaattaaacctaaggttttggtttaccagcccagatgntctgccatgtgagctgcctgtcatttcgtt

SEQ ID NO: 47387 - DNA, 101 bp, rice(Oryza sativa)
  misc_feature (71): n=a or g
aaatatggtgtcgcaatcgcaaccatggaattggtttgtatgatgttttttatattgtagatgttttttgnattttaggataaattaattgaagatatttg

SEQ ID NO: 47388 - DNA, 101 bp, rice(Oryza sativa)
  misc_feature (71): n=a or g
aagagatagaaaagaaaatgagagaaccgaaaagagaaaaacatataaataaagagagaaaagagaaaggngaaaaatatagataaagagagagaaaagaa

SEQ ID NO: 47389 - DNA, 101 bp, rice(Oryza sativa)
  misc_feature (71): n=t or c
tcttctacagcactttcaacctattttcttattttgttagactctttgacttttacttttgcaaaatttgntacacagcactcaaaatttgtgtaatttac

SEQ ID NO: 47390 - DNA, 101 bp, rice(Oryza sativa)
  misc_feature (71): n=a or g
ctttgcaatgtccacatcaaacaactcctttgcacccttccgtttttgaggagcttgaataaatcttctantgacatttttctccatgtttgttggctttg

SEQ ID NO: 47391 - DNA, 101 bp, rice(Oryza sativa)
  misc_feature (71): n=a or g
ttggggacatgctcagatatcctctgattttccttgggcatctcaggttggctagacattccatcaaacanttggtgggcgctgcctggatgagaactttt

SEQ ID NO: 47392 - DNA, 101 bp, rice(Oryza sativa)
  misc_feature (71): n=a or g
cgttcgtatatacttacatgtaagttgtgcatgcatgcggctgacaaaaagtaacatagagaagttgcganaaactctacaaaaggtgaatcaactttaga

SEQ ID NO: 47393 - DNA, 101 bp, rice(Oryza sativa)
  misc_feature (71): n=t or c
aaacggcaatattcccgtttgggtggggtcggtgagaattttatcccatgggtttaggttgtgttcatttnaggaggatgggaactaatccctcacgcaca

SEQ ID NO: 47394 - DNA, 101 bp, rice(Oryza sativa)
  misc_feature (71): n=t or c
gagccgatgctttttctacaagcttagcctcttccatcggatggtaaaggcttagcaccataaggtttgtncacatagacccctggttgtcaattctacca

SEQ ID NO: 47395 - DNA, 101 bp, rice(Oryza sativa)
  misc_feature (71): n=t or g
tggaggggatggaggcacaggggattatcatcttccacgaggcacagaggatcattatcaactagcacagnatacgtgacagcatagcaaagacaacagat

SEQ ID NO: 47396 - DNA, 101 bp, rice(Oryza sativa)
  misc_feature (71): n=t or c
cctctgttgtgctgcatcttcatcggaaattcttctgatactcctcgaaagaaaacctacagacctgcttncggcttccgaagatacctgtctcttgaaaa

SEQ ID NO: 47397 - DNA, 101 bp, rice(Oryza sativa)
  misc_feature (71): n=a or c
cttcaattttaaataaccgatgctaacttatacttatatttttagcctcctcgacttccaactcatgtccnagaatcaagtgaaaatactccatcagctgc

SEQ ID NO: 47398 - DNA, 101 bp, rice(Oryza sativa)
  misc_feature (71): n=t or g
cataggggttgttggggtcgccattgggagctagagggaacggcgcgtaccatgcagagaagggcacgatnccgtgtagcctccttgcagatgttctcatc

SEQ ID NO: 47399 - DNA, 101 bp, rice(Oryza sativa)
  misc_feature (71): n=a or c
tttagggaaggagggagtatatggcttgacaatgcacactatttcggatcaagtacaagtattttaaatgnaggtggtgaagccgtcgccatgcatgccga

SEQ ID NO: 47400 - DNA, 101 bp, rice(Oryza sativa)
  misc_feature (71): n=a or g
agactgatcatatcgatcgatatgatgatccgtatcatcactgctactctacatatcggtcggttgatcgntcggttggtccacacccacttgtctcctgt

SEQ ID NO: 47401 - DNA, 101 bp, rice(Oryza sativa)
  misc_feature (71): n=a or g
cactttttctagaaattgcttatccatgacagttttagcatatttactttcccttcgagtccctaagtccngtgcccctaaagaacatggaagtccaagtg

SEQ ID NO: 47402 - DNA, 101 bp, rice(Oryza sativa)
  misc_feature (71): n=t or c
tgtcaatcctgtaaaataattgtcagccgatttgtacctttactagtctcatcttctgtcttgcagacaanagaatcttcccatcctcgcaaaagcaacag

SEQ ID NO: 47403 - DNA, 101 bp, rice(Oryza sativa)
  misc_feature (71): n=t or c
acgtgcttatcttcatccatatcttttttatggtgctgctgcgtcatttgaaaaaaaaaatatgcgtttgntttctttttatttaatttatatcgatttga

SEQ ID NO: 47404 - DNA, 101 bp, rice(Oryza sativa)
  misc_feature (71): n=t or g
ccagtataagctccttccagcttttgtgttccccatattgtgttcacctactttcaggtgaccatattgtnttccccatataattcaagttgtcattaatt

SEQ ID NO: 47405 - DNA, 101 bp, rice(Oryza sativa)
  misc_feature (71): n=a or g
tccgtgacgggcctgtgttttatatccatctaacatgtatgttcgagcatatctcaatcgggcttttttcngctcgatagagatgactttcttgagacgac

SEQ ID NO: 47406 - DNA, 101 bp, rice(Oryza sativa)
  misc_feature (71): n=t or c
cctaagaaaaccgagtacgatatgagggcgacattttccgacaatgtaatcgataacccagaagacgtacngagcgggtaggcgccttccggcggttgctg

SEQ ID NO: 47407 - DNA, 101 bp, rice(Oryza sativa)
  misc_feature (71): n=t or g
ccccatcttgccattcgcacgggagtgccactattgcgaaattcttattggtgttggttgggaacaactanaggtgttggtttaacagtaagaatcaactt

SEQ ID NO: 47408 - DNA, 101 bp, rice(Oryza sativa)
  misc_feature (71): n=t or c
tctactgctaataaccttgcaccatggatggtcacggttggtgcgtcaagcataaaccgtcggttcccagnaaacattatcctcggaaatggcgaaactta

SEQ ID NO: 47409 - DNA, 101 bp, rice(Oryza sativa)
  misc_feature (71): n=t or c
ctatagatataactagacaagcagctatctcttcactaaacaatgtcacttgacgatcacaccgtgggatnaaggacatgccccgcaaagacgatcacccc

SEQ ID NO: 47410 - DNA, 101 bp, rice(Oryza sativa)
  misc_feature (71): n=t or c
agaaacggcccgtaaaaccgtcaggaccaggtgccttatcagagggcaaggacttgatcaccgcccagacntcatcctctgtgaagggacagtccagcccc

SEQ ID NO: 47411 - DNA, 101 bp, rice(Oryza sativa)
  misc_feature (71): n=a or c
tagttcttgcagtggtgtgtgtattttatagggcaatgcgtgtgtatacgagaaactattaatctaaactnttgagaatagatcactcgttatttacatct

SEQ ID NO: 47412 - DNA, 101 bp, rice(Oryza sativa)
  misc_feature (71): n=a or g
agcaggattgtgttttcagtatatggatatttggaaacaattagcatcaaccctattaatgcttggtgttngacataagattttgagtaaatctcacaaag

SEQ ID NO: 47413 - DNA, 101 bp, rice(Oryza sativa)
  misc_feature (71): n=t or c
actatacgctgcatctatactaaacagtagtgaaaaatctacctctccaccactcaattattacgccggtntataataattcgttgtataaattacggggc

SEQ ID NO: 47414 - DNA, 101 bp, rice(Oryza sativa)
  misc_feature (71): n=a or g
caacgggcacaacaaaggttgatagatcggcaggaaaggcaatccttggaagcgaccgtcacctccagccnacagcagattttggattacaaaagcaagct

SEQ ID NO: 47415 - DNA, 101 bp, rice(Oryza sativa)
  misc_feature (71): n=a or g
aaaaatacagtttcaagatcatttcccgtcagctaaggcacctaaaattctctctcaagctagacgcaatnacgcattgttcgccggagggcatctcggtc

SEQ ID NO: 47416 - DNA, 101 bp, rice(Oryza sativa)
  misc_feature (71): n=t or c
ttcgctacatatcacttgactatgatttccgtagaaagagcacaactaccacagataacgatgccagtcgngcacttaccaaaacaaaaagtattgaacca

SEQ ID NO: 47417 - DNA, 101 bp, rice(Oryza sativa)
  misc_feature (71): n=t or g
tgcctcgcacaaacgcatcgatacgccaagctccactagagaatagagattttgacgaggagtattatggntggagacgcgacgagctgatcgatcgattc

SEQ ID NO: 47418 - DNA, 101 bp, rice(Oryza sativa)
  misc_feature (71): n=t or c
cgatctctggatcgaagcacggacgttgtcaaacagctcagtctccagattttccatcacccagctttcgntttcaagagtcgaagttgttgactcccctg

SEQ ID NO: 47419 - DNA, 101 bp, rice(Oryza sativa)
  misc_feature (71): n=a or g
ctatcaggtagggctttcttcaggaagaagcttgaacgttaaatctgcacggattttccgctgggaaaggnaggaatccagaattttcatgactaggaatt

SEQ ID NO: 47420 - DNA, 101 bp, rice(Oryza sativa)
  misc_feature (71): n=a or c
gatagttaaattaataaatatatttttttttaccatttttgattgttaggatatcgttagcacatactccntctgttacataaaaaatcaacttaataccg

SEQ ID NO: 47421 - DNA, 101 bp, rice(Oryza sativa)
  misc_feature (71): n=t or g
ccatcgaggtggttgtttgctgttagcctgttactggttagtgcttactacttagtggttggtgctcattnctggtctccagtaagaatttacaagattta

SEQ ID NO: 47422 - DNA, 101 bp, rice(Oryza sativa)
  misc_feature (71): n=t or c
ctaactaagtaaacataatggatcttatcacagtcgtccgttaagttcttcatgcagttaggagtataatncatagcattaagttggctaataattgaaga

SEQ ID NO: 47423 - DNA, 101 bp, rice(Oryza sativa)
  misc_feature (71): n=a or g
cacctcttccgaccggcactgctatcatcacctcctacgcccgagccaccagctacaccatggtcccctcnactatggttggagtctacatcgtctcccaa

SEQ ID NO: 47424 - DNA, 101 bp, rice(Oryza sativa)
  misc_feature (71): n=t or c
taaaaccagatatcggacgtctctcaactaacaagatcgttcacttgaggtccttcattagttttgactcnggttttgcctaacgtagcggctgagtcaga

SEQ ID NO: 47425 - DNA, 101 bp, rice(Oryza sativa)
  misc_feature (71): n=a or g
gctttaatatttgtgtgcacctacctaatgaaacataacctaccattcctcatctcctctcccccttagcngccccacgacacgagcttgagtacttgatg

SEQ ID NO: 47426 - DNA, 101 bp, rice(Oryza sativa)
  misc_feature (71): n=a or g
tttgtcatcagaacagcaacatacattggtcaaagaaatattggatgaacggcctacagcacccacaacancagaagaggaaagcatagaaattctcatca

SEQ ID NO: 47427 - DNA, 101 bp, rice(Oryza sativa)
  misc_feature (71): n=a or c
gtccaatctgtcaaacagacagaaggatgagcaagagaatgggcaaggtgtttattggatacaaatatganaaagaggagggaagggatggtgagtggttc

SEQ ID NO: 47428 - DNA, 101 bp, rice(Oryza sativa)
  misc_feature (71): n=t or c
ttgttgcttctgatataactaaacacgcaaagcttttgtgtggtggcaaagaacccatgttgccacttgtnagtgacaagtgtaaaacctcacatctgtat

SEQ ID NO: 47429 - DNA, 101 bp, rice(Oryza sativa)
  misc_feature (71): n=a or g
aagtaatacggtgccaaaaaaaaatcaggtagagagaggggggcgaattgattgttgcccccatctccagncgagcgatcgcccattaaaggccccggttg

SEQ ID NO: 47430 - DNA, 101 bp, rice(Oryza sativa)
  misc_feature (71): n=a or g
cacttacttagacaaagaatcttgcaagaagtccccgtccaagctaacacgatccacaagctcgttaaaantaggagccaactcgcacgcctgcctccaat

SEQ ID NO: 47431 - DNA, 101 bp, rice(Oryza sativa)
  misc_feature (71): n=a or c
gaatgattaatttgtctcatgaaaccttgaaatcaaagtatggccaagtgctacagatattgcacataccnattccagcagcatctgaacctctcatgatc

SEQ ID NO: 47432 - DNA, 101 bp, rice(Oryza sativa)
  misc_feature (71): n=t or c
aacaatgtttggaaatgagcagccaacatggcaacaatggtgagcaaatccttcatatgcaaatgttttgnggtatattttcgctgaacattcccaatggt

SEQ ID NO: 47433 - DNA, 101 bp, rice(Oryza sativa)
  misc_feature (71): n=a or g
taatgcatttgtttatgcgcctcttatctcagggtactgtagagaaggtaatgtttcattggcatgtgaantttttgataagatgacaaaggtgaatgtac

SEQ ID NO: 47434 - DNA, 101 bp, rice(Oryza sativa)
  misc_feature (71): n=a or g
tgaatgggaagataaactctttttctgaacttgcagtggttatgagaatgttgtagcagtgttacatatancttgataacagtttcactatacacaagggc

SEQ ID NO: 47435 - DNA, 101 bp, rice(Oryza sativa)
  misc_feature (71): n=a or g
ccgccgtcaccaccgaccccaccgcgttccccgtgttcccggccttcatcagcccatcgaagaagaagtcnttcgccgtcacgttctctatcctcttgcac

SEQ ID NO: 47436 - DNA, 101 bp, rice(Oryza sativa)
  misc_feature (71): n=a or g
ccaaacattgcttcaaaaggggacatggcaagagccgagtgataagaggaattataccagaattaagcaanccccaaccaccgttgccactgagcaggaca

SEQ ID NO: 47437 - DNA, 101 bp, rice(Oryza sativa)
  misc_feature (71): n=t or g
ttcaattccgagtaggttctcatgtagaactgatgaagaaacctgaaggtgcttatgctcagctgatccanctccaaggggcacagcaggatgctgaaatc

SEQ ID NO: 47438 - DNA, 101 bp, rice(Oryza sativa)
  misc_feature (71): n=a or g
aacggagctcgtgtcctcgaaaagttgattgcaagtgcagctgcattggtagagaaaatcgagctaaaacntggcttaatagagatgaatacgcatgaaag

SEQ ID NO: 47439 - DNA, 101 bp, rice(Oryza sativa)
  misc_feature (71): n=t or g
cctcgccggccacgaggaggaggttcgctctgcttgcatcccttctcccttttggatttgttctctctttnggggtttgtttatctcgctgaattgattgt

SEQ ID NO: 47440 - DNA, 101 bp, rice(Oryza sativa)
  misc_feature (71): n=a or g
accatcctcttgcgacagtcgcacaaccatgagaggaacgagtgttcattgatcggtaagcactccgaatncccgatagctctgagcgcaacccaccacag

SEQ ID NO: 47441 - DNA, 101 bp, rice(Oryza sativa)
  misc_feature (71): n=a or g
aatatgaggatagacattgataaggccaaggatgatgtgaagtctttgtggaatgctgctgctacattacnagctaatgtagagatggagaaaacaaacat

SEQ ID NO: 47442 - DNA, 101 bp, rice(Oryza sativa)
  misc_feature (71): n=t or c
ttatttaaggattgtccattcacacgagaaatttgggacaaagtaatggctagaatgaaccacaaccaacntttcccggtgcacaaccggacgagagtcta

SEQ ID NO: 47443 - DNA, 101 bp, rice(Oryza sativa)
  misc_feature (71): n=a or g
aaccaaggggtcggccgaccccttgctggctcttctggccctcaattttctccagtagactactatgtggncctctaaatcagtgatatacattttgggcc

SEQ ID NO: 47444 - DNA, 101 bp, rice(Oryza sativa)
  misc_feature (71): n=a or c
ccaaccttggcttcatccactagttcttttgtaggttccgtaccatctgaattttgagcatcttctgaacncttcttatattggtcaacctgcaatgtaac

SEQ ID NO: 47445 - DNA, 101 bp, rice(Oryza sativa)
  misc_feature (71): n=a or g
tgcattgcagcgatatcttaaatgagtacgttgtggcggtgagagcgatgatgtgggaggtgctaaagttnatggcggaagggctaggcctgaaggagaaa

SEQ ID NO: 47446 - DNA, 101 bp, rice(Oryza sativa)
  misc_feature (71): n=a or g
catttgcaatggtagtaggaatttccagggtagtaacactagtaacagtatcgtcgtgccaacatcatcgnacaaacttttttttagactagaggttagag

SEQ ID NO: 47447 - DNA, 101 bp, rice(Oryza sativa)
  misc_feature (71): n=a or g
gttttttttttcctgttttgttttgcagaatagttcatatggcaggagcttgcaggcggctgacaatggcngcggcggcggcatggaggctccccttcgac

SEQ ID NO: 47448 - DNA, 101 bp, rice(Oryza sativa)
  misc_feature (71): n=t or g
atggcccttgcgttgtgggcgtcgcggaagccgaaggcgtggacggagcagttgaggttcatggcatcgtngaggacggaggcgtcgtcgccgtcggagat

SEQ ID NO: 47449 - DNA, 101 bp, rice(Oryza sativa)
  misc_feature (71): n=a or g
aagaagaagtggaatatttcccacctctcgttcgtacgccgacatgtagcaaatagtctcaactctcttgnaagtccttggcagtggtaggctaagtgcac

SEQ ID NO: 47450 - DNA, 101 bp, rice(Oryza sativa)
  misc_feature (71): n=a or g
ggagggatgtgttttgaactctcaagttaatcactcctagtcctcctttctctttaggggtgcacaccctntcccaagaggctagagatttccttgtagaa

SEQ ID NO: 47451 - DNA, 101 bp, rice(Oryza sativa)
  misc_feature (71): n=a or c
atttgtgttatctgtttatttatgtgttcattcagtatgtgatgcagaaaattcacatcgtggaatatcanctttacatttgatctggacctttagttagt

SEQ ID NO: 47452 - DNA, 101 bp, rice(Oryza sativa)
  misc_feature (71): n=a or g
tcagttgctttatctctcgacatgtcagttgctgcttctccctcaacgtgcctccatccttgctccctccntatgtgtcgtcgctttcgctgctccctctg

SEQ ID NO: 47453 - DNA, 101 bp, rice(Oryza sativa)
  misc_feature (71): n=a or g
cttttgagattccccaagatcacttgcgtaaacttgttcagaatgagtgacatcaggaagaaagaagttcntgtgaagttttccctctggaatcctgtact

SEQ ID NO: 47454 - DNA, 101 bp, rice(Oryza sativa)
  misc_feature (71): n=a or g
ccggcggcagcacgtgcacctatccgcagcaatccccggcaaaaatccgacacaggcaccgacctccatcnccggatttcgtcctgcatcccgcacacagg

SEQ ID NO: 47455 - DNA, 101 bp, rice(Oryza sativa)
  misc_feature (71): n=t or c
cgaataatattcctttcaaatatttacataataatagccaatacaatgcacaggccaggttggcaactagntgacttaatttgcaattcccaatttcctgt

SEQ ID NO: 47456 - DNA, 101 bp, rice(Oryza sativa)
  misc_feature (71): n=t or c
ctcgtgctccggctgccggatggcaccgtcttgtgggagacgttcgagcacccctgcaacacattcctgcncggcatgaagatcggcgtcatctaccgaac

SEQ ID NO: 47457 - DNA, 101 bp, rice(Oryza sativa)
  misc_feature (71): n=a or g
gagtagctgatgtgtgtgaattaacgtgtttttgtgtgtgtgcagctgctgatgagaggggagcacgaggngaggcacagggggacgctggagaggtacag

SEQ ID NO: 47458 - DNA, 101 bp, rice(Oryza sativa)
  misc_feature (71): n=a or g
cacaataaactgtaaactgcctctatttttcatacagctccaacactggatgttgactggagaaacaatanttcttttgcaacatgctcaactgataatat

SEQ ID NO: 47459 - DNA, 101 bp, rice(Oryza sativa)
  misc_feature (71): n=a or c
aagaatgcttatattttaggacggaggagtaccttttttttgtgcatttaaaggtcttgtttggggagctnaaaattttaagaagctgcggtttgctagtc

SEQ ID NO: 47460 - DNA, 101 bp, rice(Oryza sativa)
  misc_feature (71): n=t or c
tagtgtgataatacaaatctgacgattcacctcagtatgatggcatttacaaacgttacagcaggtaatangttggtgagtgctgatgagaagctcgccga

SEQ ID NO: 47461 - DNA, 101 bp, rice(Oryza sativa)
  misc_feature (71): n=a or g
ctctctctctcccaatccagagctccccctctttctttctttttttcttctctgcctcccagatccagccnaggcacttggcagcagcggtgcggggaggg

SEQ ID NO: 47462 - DNA, 101 bp, rice(Oryza sativa)
  misc_feature (71): n=a or c
cattttctagttgagcaactcgagatctatgagtgcagtgctagtgggatagaaatgacacaactgctatnttatttccccaagctcatgaacttgagaat

SEQ ID NO: 47463 - DNA, 101 bp, rice(Oryza sativa)
  misc_feature (71): n=a or g
gtctacgcgcaggcggcaggttagttccaagagaaaatgtcgatcaataacgcggattctagagtaacgcngattccagactattcctccgtggtctactt

SEQ ID NO: 47464 - DNA, 101 bp, rice(Oryza sativa)
  misc_feature (71): n=a or c
acatttttggatgggatgtagggaatggagggagtacggatcttttgtatatattgcttaatgtttgactngttattgccaggacgttataacttcagaaa

SEQ ID NO: 47465 - DNA, 101 bp, rice(Oryza sativa)
  misc_feature (71): n=a or g
agaaaagacagtgccgcaggagtactgcgacacgcgggttgctgccattccatgaacgaagtaggaaaccntcagtggatgagcaattcgctcattttgtt

SEQ ID NO: 47466 - DNA, 101 bp, rice(Oryza sativa)
  misc_feature (71): n=a or c
cagtactcggacgaggtcttcacgtaatcacgccttcccgaccctatccgtactgcacttccggccaaccncacgtcgcgtagcctcactgacaggtgggg

SEQ ID NO: 47467 - DNA, 101 bp, rice(Oryza sativa)
  misc_feature (71): n=t or c
aaggttcagcgtcatggacagacaaagaggagtcgcactatatttgtacgagtttttttaaaagcgggggnacacaatcaagtgtgaggaggccggcaagg

SEQ ID NO: 47468 - DNA, 101 bp, rice(Oryza sativa)
  misc_feature (71): n=a or c
gctccttcttcctctctctcccatctcacctccagatcgacgcccactgcagcctaacacggcacaagccngccgccaacaccgcgttcatgggggcacag

SEQ ID NO: 47469 - DNA, 101 bp, rice(Oryza sativa)
  misc_feature (71): n=a or c
tacctggaagagccacacgaatattttcagtattttgtcactggacggactacggaccagcactgcccggnagagacgttcttggattcccggcctggttc

SEQ ID NO: 47470 - DNA, 101 bp, rice(Oryza sativa)
  misc_feature (71): n=t or c
gggggtttcagcgctgtgaggaaatatgttggtattgaggttagtaccgaagagacaagggtcttccttcncgcctgttgcaacagctttcctttccatcc

SEQ ID NO: 47471 - DNA, 101 bp, rice(Oryza sativa)
  misc_feature (71): n=a or g
tatgacagaatcgataccgaatagtgtgtttgcctgtcctgaataggcaataaagcaatgggaatattacnttagaatattgctttttctaaaactttaaa

SEQ ID NO: 47472 - DNA, 101 bp, rice(Oryza sativa)
  misc_feature (71): n=t or g
tagggttggattttatatgggacaaagggagtacatatttgtaaccagtaagctgtcacacggactataanatgttgtgtgtatatacacatatatatata

SEQ ID NO: 47473 - DNA, 101 bp, rice(Oryza sativa)
  misc_feature (71): n=t or c
tcatccgggatcagagcgtgaatttctcgaagtcttgcccgaatggaaccacaatcaaccacaaaattgtntaaagatgcctctagccgatgagatatatc

SEQ ID NO: 47474 - DNA, 101 bp, rice(Oryza sativa)
  misc_feature (71): n=a or c
attggcgacatcactgcgaacatttctacggatgcctggtgtcattgcatcaaattcttccttgacagacncatcactagttgtggcacggtgatccttaa

SEQ ID NO: 47475 - DNA, 101 bp, rice(Oryza sativa)
  misc_feature (71): n=a or g
cgccttgtcagaaggcaaagacttaaccaccgcccacacctcctgaaggggccgtccagctccccaagctncgccggacagaggccgagggagtggagatc

SEQ ID NO: 47476 - DNA, 101 bp, rice(Oryza sativa)
  misc_feature (71): n=a or g
ctctaccactgctagccaagctcctataggtcaaacaagtagtggaaccaatggagcggtgcatgtagctngtccgaccgggcctgatggtcggtcagacc

SEQ ID NO: 47477 - DNA, 101 bp, rice(Oryza sativa)
  misc_feature (71): n=a or g
tacttattatgacatacctgtatataaagaattgagttgttggcctggcgcgttcggttgcactaaccctntatgcaagacgtgctaattaattaatatga

SEQ ID NO: 47478 - DNA, 101 bp, rice(Oryza sativa)
  misc_feature (71): n=a or g
tcagcttgatgaagaaaagaaagaacaagcagtgaagatgaaaggcgaggaagaagatggggttttctctncccccttaagtcctgaggtgggagcacgcc

SEQ ID NO: 47479 - DNA, 101 bp, rice(Oryza sativa)
  misc_feature (71): n=t or g
aatagtgtgacctatcatgtgaaacgcgagcgcaattgtactgtactatcatgtgaaacggagtatttccnatttcaaaccgtattacctgccaaccgttt

SEQ ID NO: 47480 - DNA, 101 bp, rice(Oryza sativa)
  misc_feature (71): n=t or c
ggagatgggtaggttgggatatatatacctcgtcgtcatcgtttcagcatctaccatgccaatccgacttngctcaagccccataccgtgccaccagccac

SEQ ID NO: 47481 - DNA, 101 bp, rice(Oryza sativa)
  misc_feature (71): n=t or c
gtgctgccaaacatggaggctggggatttgatgaaggagctcgataggggcccagggctgaagccaacgcnaaggcagctaaaggcgacagaggtggtggc

SEQ ID NO: 47482 - DNA, 101 bp, rice(Oryza sativa)
  misc_feature (71): n=a or g
aagatcgatctttaccaaccgggactaaagaaggcagaggcagttccggttagtttctttttttttcattntttctattgatacttactacttaatcccta

SEQ ID NO: 47483 - DNA, 101 bp, rice(Oryza sativa)
  misc_feature (71): n=a or g
gtacgtgtaccgcccggggatacatcgagctaggccgtgtttacttcctccaaatttccaaatttccatcncatcgaaaacttttctacacatataaacta

SEQ ID NO: 47484 - DNA, 101 bp, rice(Oryza sativa)
  misc_feature (71): n=a or g
ttcggcaccaccaaattaagtaaggattttgctatcagcaaccctcacaaatccatgccagatagatgctngaatgaattcgatccacttcattgagaaga

SEQ ID NO: 47485 - DNA, 101 bp, rice(Oryza sativa)
  misc_feature (71): n=t or c
ctcaaaattttaaactttctactcaaatttgaaacttcaaactcaaacattaaactttcaacccaaaattngaaactttaaatccaaaattctaaaacctt

SEQ ID NO: 47486 - DNA, 101 bp, rice(Oryza sativa)
  misc_feature (71): n=t or c
caggttataagatgttttaactttggtcaaagtcgactaagtttagataaatatagtactccacccgtccnaaaatataacaacttttagccatcaagatt

SEQ ID NO: 47487 - DNA, 101 bp, rice(Oryza sativa)
  misc_feature (71): n=a or g
tcgtaaatattgcaacgaagggatttgaatccaacccagtcaatgcaattgaaatgatttcaatacgggcncgattactcctgtaactgacgaatcaatcc

SEQ ID NO: 47488 - DNA, 101 bp, rice(Oryza sativa)
  misc_feature (71): n=a or g
gtccttagttttgttgatatgtatattcatgtggctagcagatgatggtgttagttcagctcttattggcntggattattacaagcgttcatcagcaaagt

SEQ ID NO: 47489 - DNA, 101 bp, rice(Oryza sativa)
  misc_feature (71): n=t or c
gtatgcgcaagggtgaggttggattacattagagaaaaacatttactcgaaagggtgggtggtagagatangcgatcagagtagatcatttactccgataa

SEQ ID NO: 47490 - DNA, 101 bp, rice(Oryza sativa)
  misc_feature (71): n=t or c
atttatatccgatggtttacaacgcatattgtattctcccactggatagtggtattgcacgggatacttcnccgtgattggtgataggtctccaattgaaa

SEQ ID NO: 47491 - DNA, 101 bp, rice(Oryza sativa)
  misc_feature (71): n=t or c
actaggcactgattagaaattggagtgggggctagctaacaactgaaatggaaacagtaaaggataacaantgaaacagaaacagaaaaagaactgaaaca

SEQ ID NO: 47492 - DNA, 101 bp, rice(Oryza sativa)
  misc_feature (71): n=a or g
aaaaaatatacttttactcagttctggtaaggaggattcaggtggtgaagggaactggttgctgccctacntttcacgtggaaagagtccaatttgacccc

SEQ ID NO: 47493 - DNA, 101 bp, rice(Oryza sativa)
  misc_feature (71): n=a or g
cagttatatagaaaatgtcgcagcaaggcgaacccatgcagcgactactagtgggataacatcgagctggnctcgtaggacccagaataagatccctaagg

SEQ ID NO: 47494 - DNA, 101 bp, rice(Oryza sativa)
  misc_feature (71): n=a or c
aatgacttacattgtaaaacggaggaagtaacagattgaatgtgaatatttgcctaacacgaatttggtcntgagttgaatttgatcgaacattctcccaa

SEQ ID NO: 47495 - DNA, 101 bp, rice(Oryza sativa)
  misc_feature (71): n=a or g
gctctccactaaatctccggttaaacatgcaaacgtcacttttttaggcgtgtccagttgaaatgactgcnacttgaagcgttctttggctgtgtttactt

SEQ ID NO: 47496 - DNA, 101 bp, rice(Oryza sativa)
  misc_feature (71): n=t or g
tttagccattccatttagggatttctgattctgttgcaggtgtccgtggcactggtggtaccttgataganactagagtgaatgcctttttctttgttctg

SEQ ID NO: 47497 - DNA, 101 bp, rice(Oryza sativa)
  misc_feature (71): n=t or c
ttttgaaatcatttaatgaatatcatttcaccgtgttcacgcaagtgcatgcactgataatcgcgtcctgnacaagctttgtgatggctagggcagtttgg

SEQ ID NO: 47498 - DNA, 101 bp, rice(Oryza sativa)
  misc_feature (71): n=t or c
aaaccctaccccatgagcatctttgaagactgagacggcaaatccataatggagattaacgaagtcactanaagcgtgactaaaagcacaaagccgttaaa

SEQ ID NO: 47499 - DNA, 101 bp, rice(Oryza sativa)
  misc_feature (71): n=t or c
aaataacttgaagctccaaacaaggcaaagtctcgaattgttgggttcaataacagggaaccagttttgtnagacgatgattttccaaagtttcaaatatg

SEQ ID NO: 47500 - DNA, 101 bp, rice(Oryza sativa)
  misc_feature (71): n=a or g
gcccttgtacaaagctcactagagataggtgatatggctggcacaaccttgaccttactagatctggcgcngtggtggaaactagcccgtagactatgaag

SEQ ID NO: 47501 - DNA, 101 bp, rice(Oryza sativa)
  misc_feature (71): n=a or g
gctgcaggattgacaatctgttttgccttggagggtgaaggaccaacattggccaacatctctgcaggacnaaggccaatcctttcctttgatgccctcat

SEQ ID NO: 47502 - DNA, 101 bp, rice(Oryza sativa)
  misc_feature (71): n=a or g
ggggggacaaaagatcccaggctcgctcaccttgcagaaggagatggcgaaaggtatggcggggtcgccgncgtgctcgacggcgatgaccccgctcccgc

SEQ ID NO: 47503 - DNA, 101 bp, rice(Oryza sativa)
  misc_feature (71): n=a or g
gatttagaattcatggagtctgttatgatcagtataactgtataagaacctggtgtaatataatcttctcnatatattgtttcctcccttgtattcttgtg

SEQ ID NO: 47504 - DNA, 101 bp, rice(Oryza sativa)
  misc_feature (71): n=a or g
aaacaaagtttgccgaatagcaaaaattctggcaaataagcttttcactcataattcggtaaaccgtcgtnctcgttagcaatatcatacaccgcgtatgt

SEQ ID NO: 47505 - DNA, 101 bp, rice(Oryza sativa)
  misc_feature (71): n=a or g
tagagagatcagaaaacaaggagaggagagaaaatctttacctatggacgtgactacgatgaccatagctngattgtcataactagttacctcacccttag

SEQ ID NO: 47506 - DNA, 101 bp, rice(Oryza sativa)
  misc_feature (71): n=a or c
gacagcattattagtgattccaatgacagggtactactagacgtgaagaaggatgaattggaagaaagcangaagaaacttaaaaagatgcatgtttcttc

SEQ ID NO: 47507 - DNA, 101 bp, rice(Oryza sativa)
  misc_feature (71): n=t or c
tctaactttgagtgcagggttaattcaatgaacgctgctatacgtacgatcccagcgtccgactgatgtcngactctgttacgacatcagcagcacatatc

SEQ ID NO: 47508 - DNA, 101 bp, rice(Oryza sativa)
  misc_feature (71): n=a or c
cttcaatttaagagaggccttaggttatgcatttacctctctgtcaaaaaaaataatcttaaatatgaatntgtagatacactgtgtctaaatttatcctt

SEQ ID NO: 47509 - DNA, 101 bp, rice(Oryza sativa)
  misc_feature (71): n=a or g
cgtcggttgttgtcgggacctagcatcctcatcatctcatgcacgtaatattcacatagtacaagatgccnagggggttgcttgaaacactgcgaacataa

SEQ ID NO: 47510 - DNA, 101 bp, rice(Oryza sativa)
  misc_feature (71): n=t or c
ctgtccgcgattttttctgttcaaacacagtacgcgaggggcctatacctgattacgaagaatcggagggntttttcgcaaaaatccaacctcgcactgta

SEQ ID NO: 47511 - DNA, 101 bp, rice(Oryza sativa)
  misc_feature (71): n=t or g
ctacttcccccattgttacaccgttcaacaaatttctgggcaaatcatcctcaagtatatctagcttagcntcatccgtcgcatccactttcctcattgaa

SEQ ID NO: 47512 - DNA, 101 bp, rice(Oryza sativa)
  misc_feature (71): n=t or c
tcaccacacttcttcttcaggttgaagttgtagttgccctggcctccagcaccacagcaagcctgcatagncgagctgaaacctgcaatgccatatcattg

SEQ ID NO: 47513 - DNA, 101 bp, rice(Oryza sativa)
  misc_feature (71): n=t or g
tactaactttcgataatcttcacatgtgtttcattggtgagagaataacgggaacacttggatagccctgnatcggaggtggatccgccgctacgttgaac

SEQ ID NO: 47514 - DNA, 101 bp, rice(Oryza sativa)
  misc_feature (71): n=a or g
aagttgaaggatccccggtgaacttattcctttgtaaaaagagaaaagaaaggagaaaagcgaggaggccnaaggggcagcccaaaaagcccaagctatga

SEQ ID NO: 47515 - DNA, 101 bp, rice(Oryza sativa)
  misc_feature (71): n=t or c
gagaacagggttataaagaggaaaaccaaaccgaataggcatcagtttcttaatctattacatggtagtanttagccgagactataggccgtgctgtatca

SEQ ID NO: 47516 - DNA, 101 bp, rice(Oryza sativa)
  misc_feature (71): n=a or g
cccgctggacagttacaatcaaaaccgccaggtttattacggcattctccatagcaatgatgagtcttggnatcttgacattcatcaatatctacaaaata

SEQ ID NO: 47517 - DNA, 101 bp, rice(Oryza sativa)
  misc_feature (71): n=a or g
ctttcatccgaaaaatttctaactaaaaactttcatcgaagaagctaatcttctaagtttttgaaaccatngtaaatctcgcggttactgcgataaccgcc

SEQ ID NO: 47518 - DNA, 101 bp, rice(Oryza sativa)
  misc_feature (71): n=a or g
ccacagcctccagaagagagcatccaggacctaatccatcaggttgttcacatcatcaatcatcagtaccnctttcaagtggtaagaactatcaggttccc

SEQ ID NO: 47519 - DNA, 101 bp, rice(Oryza sativa)
  misc_feature (71): n=a or g
gtccttgcattatctgatagaaaccttcatgaggcattaccaaggtacatcagtagcatgaaactactacnccatcttgaagggccatggaatgcacccag

SEQ ID NO: 47520 - DNA, 101 bp, rice(Oryza sativa)
  misc_feature (71): n=t or c
cacatactttttttttttggacaaacaggtacctatcaaactgcatttgttcgacagggtactaaacttgngatttcacccaaccgacatatatttttgtg

SEQ ID NO: 47521 - DNA, 101 bp, rice(Oryza sativa)
  misc_feature (71): n=t or c
tttatttaaatagagttgcacccatttttaaggacgaaaaatgatttttcacatgtggtttgttacgaaancgtcaacaaaattagacatattttcactag

SEQ ID NO: 47522 - DNA, 101 bp, rice(Oryza sativa)
  misc_feature (71): n=t or c
acaaaaatcactccactctccggctgaaaaaaaaccgcaaccacctctctgcacgctgcaacttaccgcangggcgccagatttggtggagagaaaaccac

SEQ ID NO: 47523 - DNA, 101 bp, rice(Oryza sativa)
  misc_feature (71): n=t or c
ttgtacctagaaaaaaagaacatattcatgccctttagataatattcactataggtagcaaactgagtacntgaggaaatttaacaataagaactgttcac

SEQ ID NO: 47524 - DNA, 101 bp, rice(Oryza sativa)
  misc_feature (71): n=a or c
tgccatattcattcattttacggcagcacattagatactcaacagttgtactcagaacattttcctttganaaaaatcgaatgcccgaaatttcgatcttg

SEQ ID NO: 47525 - DNA, 101 bp, rice(Oryza sativa)
  misc_feature (71): n=t or c
aagggaattttcttgatatttcttcctacgcactggagaatttttgtatcctaaagatccagtggcaccantcagagcaaagttagctgcttcttgaatgt

SEQ ID NO: 47526 - DNA, 101 bp, rice(Oryza sativa)
  misc_feature (71): n=t or c
cctgttatgatttccggtcgaggacgagcaggaccttgcaccctagcaggggaattagttccagagttggngccagcgctcgtcttgggagggctatcagc

SEQ ID NO: 47527 - DNA, 101 bp, rice(Oryza sativa)
  misc_feature (71): n=a or c
atttctggatatctgcatggattgagatgaaccaagctaattgttaccttgtttttgctaatatcccttantccattcacataatcataaatcttaaagtt

SEQ ID NO: 47528 - DNA, 101 bp, rice(Oryza sativa)
  misc_feature (71): n=a or g
ctttttttcatttgatctagcatcacgacatgtggctacattgtcatacaacttttccaagtgtcgtaccnagacccaatctatcatgtgctattgaactc

SEQ ID NO: 47529 - DNA, 101 bp, rice(Oryza sativa)
  misc_feature (71): n=t or g
aggcaaacaggcttgctttctgcaccatatgatatgtcacgcaatataacatggtctcgagaggaaggatnctccctccatttttcagtcttcttccacac

SEQ ID NO: 47530 - DNA, 101 bp, rice(Oryza sativa)
  misc_feature (71): n=a or g
cagatgcagatgaggagaaacaagctctcctcccacttccaaggagatatcgatgatgatggtggtgttgntgttgtggacatccgggggtcgccgatggg

SEQ ID NO: 47531 - DNA, 101 bp, rice(Oryza sativa)
  misc_feature (71): n=a or g
ttttctctagtttattgaatttgatatgttgatgtttattacaatttaccgtattttaggcttatgcaatntggtttttagttatatatttggtaaaggta

SEQ ID NO: 47532 - DNA, 101 bp, rice(Oryza sativa)
  misc_feature (71): n=a or g
ggcgatgaggatcacactactgattcaatacttacaaggtgtatgtacagagtatttggtggcctagaccncctgtactttcagattgccatgagggttgt

SEQ ID NO: 47533 - DNA, 101 bp, rice(Oryza sativa)
  misc_feature (71): n=t or c
gttcatcagtttttagtttttaccttggcattctctgaataagaccttctccgaaatggttgaatgctatngtgacctgcattgccttgtccttgacatag

SEQ ID NO: 47534 - DNA, 101 bp, rice(Oryza sativa)
  misc_feature (71): n=t or c
cttaaattaactctggacccactcttatctaccaaaagatatagaaaaaaataacttcgctcatcccctcncacgtacgcaatctctctacgtatagcgtc

SEQ ID NO: 47535 - DNA, 101 bp, rice(Oryza sativa)
  misc_feature (71): n=t or c
attgtaattttactggtaaaatactccgtagcatattttcaaaacgattattgtcacggtttatctactanagatgcattaatttttttagaaataaactt

SEQ ID NO: 47536 - DNA, 101 bp, rice(Oryza sativa)
  misc_feature (71): n=t or c
tctgaccatgcttgtatgtttagatttttggacagataaccccccagaactgcaagtgcaagaggcaatcngttgcattttctagcaagctttctccctag

SEQ ID NO: 47537 - DNA, 101 bp, rice(Oryza sativa)
  misc_feature (71): n=a or g
gagtgcctagcggcggggaggagaagaatcaattgaggatgaagaagggcacgactagataaagccggccngctcggtcgcccatttttttattctttaat

SEQ ID NO: 47538 - DNA, 101 bp, rice(Oryza sativa)
  misc_feature (71): n=a or g
catttgcattcaagagtcacactgaagatatatacttcagcaattcaccatccgatccgaccgaatcatcncatcacatctgtccacgatcgatcgtatat

SEQ ID NO: 47539 - DNA, 101 bp, rice(Oryza sativa)
  misc_feature (71): n=a or g
ctcatgaggagaaccaactgtaatttcagtaactttttcatccgaaatatggtatattaggaaatgttagnaaggatcatggtaaaaggaacgaggaaaat

SEQ ID NO: 47540 - DNA, 101 bp, rice(Oryza sativa)
  misc_feature (71): n=a or g
gatcgacttcttgcttgtattagttgtgtatgcgtaattaatgtgcgagcgtgttgcgcgtcatctatgcntgcttgtgcatattggtcccagcattttgt

SEQ ID NO: 47541 - DNA, 101 bp, rice(Oryza sativa)
  misc_feature (71): n=a or g
agcctgaaatgctattatacgcattccggttctccaagtcttattgggggattagacgttttggtagaccnggtgccaaatgtattgtttcaaaactgagc

SEQ ID NO: 47542 - DNA, 101 bp, rice(Oryza sativa)
  misc_feature (71): n=a or g
cggatctatttataatatcaccctactagttatccgtagaaacaaggagtggcgttattatataaaaaaangtacataggggtataatcgttatttggcag

SEQ ID NO: 47543 - DNA, 101 bp, rice(Oryza sativa)
  misc_feature (71): n=t or c
gatcttctcatcaatatcccggcattgcgaaaactcgacgccatgctccttgtaagcataatagcatatanaaatgtccaaattgatcttttccccattag

SEQ ID NO: 47544 - DNA, 101 bp, rice(Oryza sativa)
  misc_feature (71): n=a or c
tttgtctttgtattggtgatcttaacaaaagcattaagcattaagcttacttctgtgtcccactggagcantttcatgcttcccctgaacagaacatatgc

SEQ ID NO: 47545 - DNA, 101 bp, rice(Oryza sativa)
  misc_feature (71): n=t or c
ggcacctttatcatacttgaactccattggcctaagtgacttggatttgttttggcatgcccatagggttncaccccatgacagtaaaactaatgacaggg

SEQ ID NO: 47546 - DNA, 101 bp, rice(Oryza sativa)
  misc_feature (71): n=a or g
tcttccacccggactcccaagcctccgtcacccctagggccgccgttgtcaacgagattcacccctgtctnaactgcctcctcctcgccgagaatcttgca

SEQ ID NO: 47547 - DNA, 101 bp, rice(Oryza sativa)
  misc_feature (71): n=a or g
tagatccctcacatatctaaataataattccggtgtcctcaagatcactacagaggaattatgtgggactnttgtcaaattgtcactgcccccatgctatt

SEQ ID NO: 47548 - DNA, 101 bp, rice(Oryza sativa)
  misc_feature (71): n=t or c
ttaagttattttctcgcgaataaccgagattggaaaagtccatatgtacaatttaggacattagaatcttnattaagataaacttcgtttgttagtaccgt

SEQ ID NO: 47549 - DNA, 101 bp, rice(Oryza sativa)
  misc_feature (71): n=t or c
gattggagaatacatataccatggcaaaaggttcgagattcagatagacaaagaggcaattgcaaatttancactattttgaatcgttattgcaaaactgt

SEQ ID NO: 47550 - DNA, 101 bp, rice(Oryza sativa)
  misc_feature (71): n=a or g
gcactctttaaagatccagggatataatatggtgtgcatctagcaaaatataccccataattcataggatntggttgcgaattagccgatgaaaaagaaga

SEQ ID NO: 47551 - DNA, 101 bp, rice(Oryza sativa)
  misc_feature (71): n=a or g
ttggataccagaaagtcccatgtcttgcttgctaagctgctcaactgaatgaagaagtggaagcctttganccagagctcctaatacaagataactctctg

SEQ ID NO: 47552 - DNA, 101 bp, rice(Oryza sativa)
  misc_feature (71): n=a or g
gcgtcgtcgttcttcacaggaaacctcgtcgtcgttcttccatacagtctcatatgtgcaccaatgtgtgnccgcgggtgtgagtcccgtatgtgctcgtg

SEQ ID NO: 47553 - DNA, 101 bp, rice(Oryza sativa)
  misc_feature (71): n=a or g
gaatggtggcgagaagaatatgctgatgagcttgcgaaaaagcagaaacgacgtgcacttgctaaatcaangagcgagcaggcagggttgcaatggtggga

SEQ ID NO: 47554 - DNA, 101 bp, rice(Oryza sativa)
  misc_feature (71): n=a or c
gcaacgtccgtgcaagtagtgctccattattctagcaaagaaggcaagcagaattcatccgcttaaggatnagaaccagatcgatcagttcgatatatcga

SEQ ID NO: 47555 - DNA, 101 bp, rice(Oryza sativa)
  misc_feature (71): n=a or g
ccagtggcaggatactgacactatgagagaagagctggatgatcttcaggttgctcgtttgtcatgtctcnttttttttacaaaattttgttatgttggtt

SEQ ID NO: 47556 - DNA, 101 bp, rice(Oryza sativa)
  misc_feature (71): n=a or g
actagtgcaagtacttcattcatctcgaaatattactacctagtctctgattgaacattgtgatttcttgnattggaaagtatccaatcggaaactaggta

SEQ ID NO: 47557 - DNA, 101 bp, rice(Oryza sativa)
  misc_feature (71): n=a or g
tcacaccaacaatgaggcatgagagatctacttagttccaatacaggtcctagatcttgatgagtgtcacncccggaaattcactagtaatttctgaactt

SEQ ID NO: 47558 - DNA, 101 bp, rice(Oryza sativa)
  misc_feature (71): n=a or g
tcactatccacagaggtgcatgtgtatttcggagtttaaaagattttcacttttatagccccatgatgccntcgtttcaaccaggagctatgccccacctt

SEQ ID NO: 47559 - DNA, 101 bp, rice(Oryza sativa)
  misc_feature (71): n=t or c
aagaagaaatgaaaatttgataaactcctccaaactttgttaagagatggttcatgcatactaacagagancactagaacaccgatttaattaataatcac

SEQ ID NO: 47560 - DNA, 101 bp, rice(Oryza sativa)
  misc_feature (71): n=t or c
ttgccatgagcagtcactactaaacttttcaaaagctccttgctaggtttagcatttggtgtgattagcantcttctaccctggaaattcaataaattttt

SEQ ID NO: 47561 - DNA, 101 bp, rice(Oryza sativa)
  misc_feature (71): n=a or g
ctccaaaatttgtttatttgtcctatgaaacggggtggacgaaactttcttaaatcatgcaacctccatcntgtagctattggtttccgtgaccaacgttt

SEQ ID NO: 47562 - DNA, 101 bp, rice(Oryza sativa)
  misc_feature (71): n=a or g
ctggatataggtagggctaggttacgcgtggattatagagactttatacgagtacaaacattacatgatcnttacatatgtatgatatagattatagatat

SEQ ID NO: 47563 - DNA, 101 bp, rice(Oryza sativa)
  misc_feature (71): n=a or g
aattttacggtcctctcagatatatcatccctaggcaaaatacagagagcctccttccaacggccagtccnattacgcggccaaacatatatagccgtata

SEQ ID NO: 47564 - DNA, 101 bp, rice(Oryza sativa)
  misc_feature (71): n=t or c
tgtcaccatccgaggactaattaagatggccattctgccataattagtgaccaaaccagaccattgctccncttaatcagtaccttgattgatctgttact

SEQ ID NO: 47565 - DNA, 101 bp, rice(Oryza sativa)
  misc_feature (71): n=t or c
gaagattgatctttaaaccaaaacaaaaaaaaaaaaggttcaaacagggggttcatcagagagcagccgcngccttcgtgctcatgctcgaggagaggagg

SEQ ID NO: 47566 - DNA, 101 bp, rice(Oryza sativa)
  misc_feature (71): n=a or g
tgaacgaaaggaggagaatataaaagtaagctaggacgtgctgcgatgtttctatagagaatgcatctgcncgcgcgtactacgtgggtaaagcagggccg

SEQ ID NO: 47567 - DNA, 101 bp, rice(Oryza sativa)
  misc_feature (71): n=a or g
ctttggtcggcacatagaaatgaaaattttaagggttggcatcaccgtaaccagatccaccacccccaccncttccgctcccaccgctttggccaccaccg

SEQ ID NO: 47568 - DNA, 101 bp, rice(Oryza sativa)
  misc_feature (71): n=t or c
tgtttgtttcattttatctttaggaaagtgtgttaagtgacccacaagggttttatgtttttctttttatntttaggaaagtttatttcttatccaataag

SEQ ID NO: 47569 - DNA, 101 bp, rice(Oryza sativa)
  misc_feature (71): n=a or g
cgtccgagcaatcgtattcctcctgtctagactctgcattcttctgtcacgattgatgtcgaactagaacntgcaagtaatagttttcaaaaaaaaaaaaa

SEQ ID NO: 47570 - DNA, 101 bp, rice(Oryza sativa)
  misc_feature (71): n=a or c
gagagggatctgtgaattccttgagccgatttcgtcagtcaatcgatgatgcctgcgcgaaccagatcccncaacagtttggacagcgctggggagtttga

SEQ ID NO: 47571 - DNA, 101 bp, rice(Oryza sativa)
  misc_feature (71): n=t or g
ccttggtgatggaaaaactgaggatagttcttttgcaaatcatcttccttctcccatgtggcctcatcttnagtgtgatgactccattgtacctttaaaaa

SEQ ID NO: 47572 - DNA, 101 bp, rice(Oryza sativa)
  misc_feature (71): n=t or c
gtaaagtgccaaagaagaagctctatctaaaattcgtcttgacctgatgtggtgaccaccttggaagactnggaaagttggaagactttagcaagtcaagc

SEQ ID NO: 47573 - DNA, 101 bp, rice(Oryza sativa)
  misc_feature (71): n=a or g
ctcccgagcgctataaaaagcttccctgtgccatcctctctctttttccccattcgcccgagctcccatcncgccctctcgagctccccgtgtcgctcctc

SEQ ID NO: 47574 - DNA, 101 bp, rice(Oryza sativa)
  misc_feature (71): n=t or c
tgcgcggtctcccggtgaggagccccacgctccgtcaactataaatttggataattagtatatctacattnaaagtattagaatatgtcccatctaatcaa

SEQ ID NO: 47575 - DNA, 101 bp, rice(Oryza sativa)
  misc_feature (71): n=a or c
cccaaatcaatctaactgtaataattcaggaatgggctacggatcatgaacgagtggacgaacttccctcncattaaattgccatcgaaaactgttgggaa

SEQ ID NO: 47576 - DNA, 101 bp, rice(Oryza sativa)
  misc_feature (71): n=a or g
cttaccaatgatggcatttcggtaggtctgtgctgtataacttggaacagaaggggatggttcattcctcnatcgtccagccagggtcattgagcgggaaa

SEQ ID NO: 47577 - DNA, 101 bp, rice(Oryza sativa)
  misc_feature (71): n=t or g
gaggagtaaaaagttaggctcaacccacaaaagaccatctccctacattcctagtctcctctatctgttantcatggtgtttgtctctaattttgcaccat

SEQ ID NO: 47578 - DNA, 101 bp, rice(Oryza sativa)
  misc_feature (71): n=a or g
acaaactaaaaccggtctacgtgtccatgatctccatcgcgatctatggattccaggaagatgcgcaggcncaagaagatgacaacttcgccggcggcggc

SEQ ID NO: 47579 - DNA, 101 bp, rice(Oryza sativa)
  misc_feature (71): n=a or g
tagctccataaaatggtgtgctagataacctggtttggagcctcacccttctaattactcctttcgtttcncaatgtaagtcattctagtatttcccacgt

SEQ ID NO: 47580 - DNA, 101 bp, rice(Oryza sativa)
  misc_feature (71): n=a or c
tggtgcatgggcgttggttagtttggttgggttggttgccgtatggatgagggaagcatgcatttcagganaatgatacatatagatagactgattgattg

SEQ ID NO: 47581 - DNA, 101 bp, rice(Oryza sativa)
  misc_feature (71): n=t or c
tgggtgcactcaccaaatcaagttgtcgggtctgtctcttctcattgattagaatcaacctcttagcgccntgcaagacaaaaagagaacaatctagttaa

SEQ ID NO: 47582 - DNA, 101 bp, rice(Oryza sativa)
  misc_feature (71): n=a or g
gataaggtcgacaaggaggagatactcaaggatatagatgctcatgaagtggttcggcgtgacatgaatanctgaaattgcagtttgcaacaccctatgtg

SEQ ID NO: 47583 - DNA, 101 bp, rice(Oryza sativa)
  misc_feature (71): n=a or c
gcaacttacctattcctttgggtaccttcacaccgaatgatttataccagcaacttttggtggccatgtgnaattcagcaatttgtattgcacgatcatcg

SEQ ID NO: 47584 - DNA, 101 bp, rice(Oryza sativa)
  misc_feature (71): n=a or c
tgcaacttttcatatggtaccacgaaaaaatgacgagtattgtggctcctttaaacaacatttagaacacntttaaataatgtgatttgctacactaaatt

SEQ ID NO: 47585 - DNA, 101 bp, rice(Oryza sativa)
  misc_feature (71): n=a or g
tatatccaattatatgttacatagacaaccccttacatctccacaccagtaatagttgactgattccaagnaagagaataatgggtcatcaacgatgaaaa

SEQ ID NO: 47586 - DNA, 101 bp, rice(Oryza sativa)
  misc_feature (71): n=t or c
tataatgcaactccgtgtcattcatccaaggatcaggtattagtaacaccagggactaatgcctcagtagngactctgaaagatagcagccaggtccatag

SEQ ID NO: 47587 - DNA, 101 bp, rice(Oryza sativa)
  misc_feature (71): n=a or g
tcctctctctatatgaactggccttttagttcagtcgatcatgtttcttgtggcagaatctatccacttgnattgtgtctttgacttaagactacacgtat

SEQ ID NO: 47588 - DNA, 101 bp, rice(Oryza sativa)
  misc_feature (71): n=a or g
acttccggtgaaaatttggttccatcacgagtccatcaggagaattaattgtcgattttgctatatatttntcgataaattttttctcaaaaatttgacac

SEQ ID NO: 47589 - DNA, 101 bp, rice(Oryza sativa)
  misc_feature (71): n=a or g
agtggttactatactgttgtgttgccttgtgtggatggtcgtttgataggttataatccacttactaaggncatgtacaaagatagagtcagatataagct

SEQ ID NO: 47590 - DNA, 101 bp, rice(Oryza sativa)
  misc_feature (71): n=a or g
tctcaccaagctaggcacatgctaccttgagtctctttctcttgatatccatggacatgacgaggaagacnatttctcactacatttgtggacccttgctc

SEQ ID NO: 47591 - DNA, 101 bp, rice(Oryza sativa)
  misc_feature (71): n=t or g
cgagttgttgacggcgccaccgttgcaaggttctgtaatgagtggaaaagccttgtggagaagccagaacngctattgctgcatatgcgatgatccaattg

SEQ ID NO: 47592 - DNA, 101 bp, rice(Oryza sativa)
  misc_feature (71): n=t or c
aaagtagccactgacaaaaatatagcaatggcggcggcgacctacgtccagacgtagggtctccttgtgcnaggcgaaggcgctgcatagagcgtcgcaga

SEQ ID NO: 47593 - DNA, 101 bp, rice(Oryza sativa)
  misc_feature (71): n=t or c
agttgccaaattagaacggtcctcgtactcagacattacaaacaatttgtaactctcactgatatcatgtnaggactccattttaggtcagaacaattctg

SEQ ID NO: 47594 - DNA, 101 bp, rice(Oryza sativa)
  misc_feature (71): n=a or g
agagatttagggtgttcaccatacaaggacaagttgctctccatcatccctctgtataggttcagcacacngatccaaaatggaacactgaaattattcct

SEQ ID NO: 47595 - DNA, 101 bp, rice(Oryza sativa)
  misc_feature (71): n=a or g
cttggtgatgtggagtctcttcatgcttggcgtaattggccatcgcctatttggataacaccatctcttanttagaaagatgtgggagattttcatgtatt

SEQ ID NO: 47596 - DNA, 101 bp, rice(Oryza sativa)
  misc_feature (71): n=a or c
ctgccattgctgatatgatatccccctgattcaataggtgctgaaaatggagggcctggtgcttaatgatntggggtttcatctatctgttccaacaacaa

SEQ ID NO: 47597 - DNA, 101 bp, rice(Oryza sativa)
  misc_feature (71): n=t or c
gtgccgttatacatgatgtcttttatgagttgccaaaaggagtaaagaaaagaatagattttttcagatcnaattttttacggtaagaggatcaaggggtc

SEQ ID NO: 47598 - DNA, 101 bp, rice(Oryza sativa)
  misc_feature (71): n=a or c
aaccagaatttcctctaccctcctcttaagatttcctgattccttcaagatttctaccttctcagcttcanatgcctttgcagctgcatccttcgcctcca

SEQ ID NO: 47599 - DNA, 101 bp, rice(Oryza sativa)
  misc_feature (71): n=t or c
tccttggattgtccaatctccacagtgcgcacgggcatgatcaagtcaacgatgcacagaccaccaccacnatctcatctctcctgttccctcgtaaaacg

SEQ ID NO: 47600 - DNA, 101 bp, rice(Oryza sativa)
  misc_feature (71): n=a or c
ggattgtaaccttgattatgatcatgtggatatgcattactagtgttggattccgttggtcctttcttggnggcaagcgtagggggaggccgtgaaggagg

SEQ ID NO: 47601 - DNA, 101 bp, rice(Oryza sativa)
  misc_feature (71): n=a or g
gttgtggagagtaaaaatcgatcattgggttggaggagatcgatgcaacagtgagacaaggatgatgccancaaatgtgcacatctctgctgcactaatgg

SEQ ID NO: 47602 - DNA, 101 bp, rice(Oryza sativa)
  misc_feature (71): n=t or c
tccgtcacataaaaaataatctaggatgtaaaaaataatctaggatgtgtgtgacacatcatagtacgtanaataaattataataaatctggatatagata

SEQ ID NO: 47603 - DNA, 101 bp, rice(Oryza sativa)
  misc_feature (71): n=t or c
cgtcgtcgtcgtcgacggcgacatcgtcgtgcagagggttcagatcattgacacagctgatcactgaaaanatatatgatggatgagtggatgagacggcg

SEQ ID NO: 47604 - DNA, 101 bp, rice(Oryza sativa)
  misc_feature (71): n=t or g
atgaccttctatctttacctttaacgggaccctgaatgttcttttcttgagcaccttctctgtaacaatancttgtgcattactctcatctattggagcac

SEQ ID NO: 47605 - DNA, 101 bp, rice(Oryza sativa)
  misc_feature (71): n=a or g
aatcataaaatccgcaccggggtagcgtaaaagcagggaatgccgaatacgaagtgtatcgtggaattatnggtaatgttgcaatcggccaagctttggtt

SEQ ID NO: 47606 - DNA, 101 bp, rice(Oryza sativa)
  misc_feature (71): n=a or g
gccgacactgaaaaccacaagctttgataactgtccaagatcagcagggatgttacctgacagatggttcntgctcaagttcatggcatgaagctttgggc

SEQ ID NO: 47607 - DNA, 101 bp, rice(Oryza sativa)
  misc_feature (71): n=a or g
cagtcttgccatcatcatgagagtagcttcttcacaggcatgatcaaacgtgcccccactagctgtgaccntcatgttgggcaggtaggaagggatgccat

SEQ ID NO: 47608 - DNA, 101 bp, rice(Oryza sativa)
  misc_feature (71): n=a or g
cccttatatttcatattaattgtcttaaatttcaatctttctgtagggatgtcttggaaactgcgtgtccnaggatggaagaatctggtctagcttttgtt

SEQ ID NO: 47609 - DNA, 101 bp, rice(Oryza sativa)
  misc_feature (71): n=t or c
tggatttgctcgtcgcaaagcacaactgccaagccccatctggatctgcccgcgtgctaccgccagaatcngccgtcgagccccgcctggatccacccgca

SEQ ID NO: 47610 - DNA, 101 bp, rice(Oryza sativa)
  misc_feature (71): n=a or c
acaagctgtatttcccggtgcaaaattaaacttttctggctctacacaggtgcagaacagaaaaatcccangctctatggcatcgtcggcttgctcatttg

SEQ ID NO: 47611 - DNA, 101 bp, rice(Oryza sativa)
  misc_feature (71): n=t or c
ctttttctcataccaccatccagcgttaataaatcttccatatctcctgtcccatccaaattctgcacccncctgtccttctccaaaggattgaacatatc

SEQ ID NO: 47612 - DNA, 101 bp, rice(Oryza sativa)
  misc_feature (71): n=a or g
tatcgctggagctagcaataggaactcgtatgtgacttacgttcaagttgctcttgttgttggtagatccntcccggctggatccacggccgatagatgcg

SEQ ID NO: 47613 - DNA, 101 bp, rice(Oryza sativa)
  misc_feature (71): n=t or c
cttgcatttgctgcatcagtgccccatggtcgaaaactcaactggactctcacgactcaagtctgcacatngtgggttgggattacatgcacaccagatgg

SEQ ID NO: 47614 - DNA, 101 bp, rice(Oryza sativa)
  misc_feature (71): n=t or c
tactgttgtcagcgtgtcacaattactaattggaaaagtaacaacagaacaagcacatttggaaagcacangctaagatcgggcgtaggggtgcaattttc

SEQ ID NO: 47615 - DNA, 101 bp, rice(Oryza sativa)
  misc_feature (71): n=a or g
acatccaaccttttttctcacctcaaccaatcaatattacatctcacttaattattccaccaatttcaacntttaattttaaccctctcctcgatccatgt

SEQ ID NO: 47616 - DNA, 101 bp, rice(Oryza sativa)
  misc_feature (71): n=t or c
accatatttttcattcttgttttgatgaattgttatttgttgtccaaccggtttgatttttctcctcaagnttttaaaagtacatggttcgagtatcctat

SEQ ID NO: 47617 - DNA, 101 bp, rice(Oryza sativa)
  misc_feature (71): n=a or c
ggaggcagattttggcaaagtcatgaattggggggggtacttatctcccaacagacaaaacctaaagttgnaattgtagatttgtaggggataggaggagc

SEQ ID NO: 47618 - DNA, 101 bp, rice(Oryza sativa)
  misc_feature (71): n=a or g
gcagagcacgtgtaggccctacctaacgaggaacatgtgaagttgtgacccaaattgactatgtgatcttnaagagttgtgtgattagacgacgtggatat

SEQ ID NO: 47619 - DNA, 101 bp, rice(Oryza sativa)
  misc_feature (71): n=t or c
cagtcagtgacacctataaagcatgatgaggtggtccttgggcaatatgatggctacaaggatgactctanggtaccagatgactccaacacacctacttt

SEQ ID NO: 47620 - DNA, 101 bp, rice(Oryza sativa)
  misc_feature (71): n=a or c
tcctcgcggggcactcctcccccaacaagaagcccaacaaattcggcccggcccaaaaattaccttggcgnaggcgctgcgggcctgggcccaatcgattg

SEQ ID NO: 47621 - DNA, 101 bp, rice(Oryza sativa)
  misc_feature (71): n=t or c
gaatagactaagtacattttcaggtgaagataatcaatgaaaacctgagtcgtagctactctttgttctcntttaccatatgccatgtttgtagtcaacta

SEQ ID NO: 47622 - DNA, 101 bp, rice(Oryza sativa)
  misc_feature (71): n=a or g
ctgagcttgtatgaactagaggaaatcaagacatgatatatttctttttctgtttgacggttgcactatcnatttgctgttgtgatgctaaaattcctaaa

SEQ ID NO: 47623 - DNA, 101 bp, rice(Oryza sativa)
  misc_feature (71): n=t or g
gggagtaaagaggggaaatctttagtcccggttggtgtgaggggcagcaacagttcctcgagatcttttcntttattattttattgttgatttgctaatgg

SEQ ID NO: 47624 - DNA, 101 bp, rice(Oryza sativa)
  misc_feature (71): n=t or c
gagtatattgtgtgctcaattctcctcacgtgcacaaagattcaaggttccattttgagatcagaacgcancagcgattgattgatatcatgtacccgact

SEQ ID NO: 47625 - DNA, 101 bp, rice(Oryza sativa)
  misc_feature (71): n=t or g
cgtggcacacgctgtgccagacgagatttcggtttacctctcgccaagtctcgatgcgtgcgtagttcgcntaagtagaggtgtgtttggttactagtcac

SEQ ID NO: 47626 - DNA, 101 bp, rice(Oryza sativa)
  misc_feature (71): n=t or c
gcgtcgtctccgacgatgttggtggtgatgtgtagtagcttggccatggcggtgatcctgtcgtcgagctngccggcgatggcgcagctggacgtggggtt

SEQ ID NO: 47627 - DNA, 101 bp, rice(Oryza sativa)
  misc_feature (71): n=t or c
catagtatacgctccatctcatcctcactgaacaaccgaagagtcttaagagcaaaaacctgcaggatgcngaaataaatcaggagtgatttttttggctt

SEQ ID NO: 47628 - DNA, 101 bp, rice(Oryza sativa)
  misc_feature (71): n=a or g
accagtgacaagaataatgatcatgtatgccagcaccacaaacactaagtatttgaggcatctcttcttgntatcaatggagttcatggatggagtttggg

SEQ ID NO: 47629 - DNA, 101 bp, rice(Oryza sativa)
  misc_feature (71): n=a or g
acaagttcctgcaaacttgggttgtcttcaggaaacctcaagagaaatgctcaaggttcatgctcatactnaatgtgtaaaaagggaaaagatgtaagtaa

SEQ ID NO: 47630 - DNA, 101 bp, rice(Oryza sativa)
  misc_feature (71): n=t or c
actgtttgtacgttagatggtaaggaagctttagatggagagaaagttcttatattcaaatctttcttaangaagcacttacaaatcgggtagggtggaaa

SEQ ID NO: 47631 - DNA, 101 bp, rice(Oryza sativa)
  misc_feature (71): n=t or c
cattctctgctctctcgctctctactattcgtccgacctctcactcttcgtttaggcggctgacgggcaanggccaacctcacaaacacctacgttgatat

SEQ ID NO: 47632 - DNA, 101 bp, rice(Oryza sativa)
  misc_feature (71): n=t or c
tatacatgctaattaattggcataaatggatcaattttctgcaggtacggcccaattttcaggacaaacanaattgctcaagacatgatcgtgtcccttga

SEQ ID NO: 47633 - DNA, 101 bp, rice(Oryza sativa)
  misc_feature (71): n=a or g
tttagagagattaaggacatagggaaaataatatagtacacctcatctaactagaggtgggagagtggtcnaaagtaacatcgggtgaagattaaatgagg

SEQ ID NO: 47634 - DNA, 101 bp, rice(Oryza sativa)
  misc_feature (71): n=a or g
acaatgctacccttcctcacccatctaagcctacgtattgttacatgcaatatcgcggtgaaggaaagcangatcatgatagaaggctccataggattcgc

SEQ ID NO: 47635 - DNA, 101 bp, rice(Oryza sativa)
  misc_feature (71): n=t or c
agttgtcaccaataagaaatctttgttatttagatgcaaaggtatgtttgtattcagggagtaaactttantccatgtcacattggatatttggatgctaa

SEQ ID NO: 47636 - DNA, 101 bp, rice(Oryza sativa)
  misc_feature (71): n=a or g
tgatgaacattacactaacagacaaaattaggcatttctgcaacgggagaccatagactagggggcaaaanggtcgttacggaaaattaaatttctgctga

SEQ ID NO: 47637 - DNA, 101 bp, rice(Oryza sativa)
  misc_feature (71): n=a or g
gaatgcttgcatagagacttcaaaggataggtgcgattatggccctcctgagtatcgctgccgtatgtgcnctgctcagttctggtaccaggaacagtgca

SEQ ID NO: 47638 - DNA, 101 bp, rice(Oryza sativa)
  misc_feature (71): n=a or g
tgctttctcataatccacccatggatcttgagaaatccaccatgaataaagcattactcaaggcactccangtggaggaattaatccttggccaggaaaca

SEQ ID NO: 47639 - DNA, 101 bp, rice(Oryza sativa)
  misc_feature (71): n=a or g
gaatgcatttgtctcacaatcatcggtcacatggatatatatgcagggttgtgatggctccctcctcctgnacagtacggattccacggagagcgagaagg

SEQ ID NO: 47640 - DNA, 101 bp, rice(Oryza sativa)
  misc_feature (71): n=a or c
tatgaaaggccattcttccatcatctcatatgctataaagaagaagattcttgagcatcttttgaatgcgnaagacaaggaggggaacacaacacttcatt

SEQ ID NO: 47641 - DNA, 101 bp, rice(Oryza sativa)
  misc_feature (71): n=a or g
acttggtgctggaattataatggggaaaagaagaggagctatttgtttcatcaagaattaaagcttgaatngtgagcatctcatatatatgaatatgtgct

SEQ ID NO: 47642 - DNA, 101 bp, rice(Oryza sativa)
  misc_feature (71): n=a or g
aactttactcctcctgatcccctgcatgtctgaatccactacccctccaaaagtcaagagtctatacattnatcgagaggtaaactgcttcttcttagtat

SEQ ID NO: 47643 - DNA, 101 bp, rice(Oryza sativa)
  misc_feature (71): n=t or c
ttgtaaccaacattttctaggttgtatccttgataatgttctaaatgggcagccggttctagcagtgggangggaacctttgggaatctcatgtagggtga

SEQ ID NO: 47644 - DNA, 101 bp, rice(Oryza sativa)
  misc_feature (71): n=a or g
aggtcaggatttttcaacatactgagcttatcttttatgtcctcagagagcaggtccaaaacctcagttgnattgtccacagaagattttatcaactctgt

SEQ ID NO: 47645 - DNA, 101 bp, rice(Oryza sativa)
  misc_feature (71): n=a or g
cacgaagacccggcttcgcgaacaacttgaaaaattgacgaaggataaggaagccgctgccaccaaccccngggtggaccctaggccgtcggagccaagcg

SEQ ID NO: 47646 - DNA, 101 bp, rice(Oryza sativa)
  misc_feature (71): n=a or c
aggcctcggcgatatcgcaggtctgcgttatctttttctcaatgcaaacaacctttccggcgaacttccgntatctctgtacaatttgtcgtcgctgatga

SEQ ID NO: 47647 - DNA, 101 bp, rice(Oryza sativa)
  misc_feature (71): n=a or g
tgtgatgtactgatactgatgggttttgtgccagaatagcatgcagagctctaattgttggtgcagacaantggtttgacagatctggctgattactgtaa

SEQ ID NO: 47648 - DNA, 101 bp, rice(Oryza sativa)
  misc_feature (71): n=t or c
gcacaacagtcccatcacgttcatcggctagtgagcaatctaatgaatcaacttggacaagctacagtggntcaaccttccacagctccacaggtcttgcc

SEQ ID NO: 47649 - DNA, 101 bp, rice(Oryza sativa)
  misc_feature (71): n=t or c
ccccgccatccgtgcgaccgccttccccaatcgcgctggtgcaacccacctcgttctctgccgccttcccngaccgtgccggctctaccaccacgagctcg

SEQ ID NO: 47650 - DNA, 101 bp, rice(Oryza sativa)
  misc_feature (71): n=a or g
gtcggagaaagaggagcagaatgacgacagcagcctcaccatgaaccggggtgtgataagagcatttatgnccgtaagtatatgtatcctatatatctcag

SEQ ID NO: 47651 - DNA, 101 bp, rice(Oryza sativa)
  misc_feature (71): n=a or g
caagggatggcgtttgttgttctttcatttggtatgggacaaatcatggtcgctacaccgaattaaatagnaccactagtatcatatatccatggagtatt

SEQ ID NO: 47652 - DNA, 101 bp, rice(Oryza sativa)
  misc_feature (71): n=t or g
taccagaagtaaccacttaacggtaccggtccgtatttatagagctagaggtgtcaaattttggcgtatcntttagacaataataaaaaaactaatcacag

SEQ ID NO: 47653 - DNA, 101 bp, rice(Oryza sativa)
  misc_feature (71): n=a or c
tctgttgatcatctccgattagaacacagtaatacaaaggcataggtactcgaacgagtccccgtgcagtntgtagcattgcactgtgctcggctcggaca

SEQ ID NO: 47654 - DNA, 101 bp, rice(Oryza sativa)
  misc_feature (71): n=t or c
ttacaacgattgtgtggacttaagcattttatcatccatgtactccactgagcatgtccacctcagcgtgnctgaggacacgacaaacaaaggagacctga

SEQ ID NO: 47655 - DNA, 101 bp, rice(Oryza sativa)
  misc_feature (71): n=a or g
aaaaaaaaaacgaaaaaaatgggccaattggctaaaaaccatcacgggaaggtgtaattggaccgtaccgnaagattaaattccgcagtctaatctaatta

SEQ ID NO: 47656 - DNA, 101 bp, rice(Oryza sativa)
  misc_feature (71): n=a or g
gaaagtagttaggaaggcattttctgagagagctggattggcgacgaatccgatggggaggaagctgttcnagttgatggaggccaagcaaagcaacttgt

SEQ ID NO: 47657 - DNA, 101 bp, rice(Oryza sativa)
  misc_feature (71): n=t or c
ggagggagtatagtttttcttggaatacttacattgcgtatagcttggatagactgctcacaccgagcatnccctggggcactgtatttccctctgcaggt

SEQ ID NO: 47658 - DNA, 101 bp, rice(Oryza sativa)
  misc_feature (71): n=a or g
gatccaattgtatcatatatctgtaggtagatcataaaagtttgtctaggatagcttgaagataagagacngtactttcagagttcttccgcttcgtgggt

SEQ ID NO: 47659 - DNA, 101 bp, rice(Oryza sativa)
  misc_feature (71): n=a or c
aactgctgcattgttaaagttgttgtgcatgattaattgaaggtgaaatttatttccctgctacaggaatntaaatctatggtggaattggaaacagaaga

SEQ ID NO: 47660 - DNA, 101 bp, rice(Oryza sativa)
  misc_feature (71): n=a or g
agcctccagatcaggcctgacccacttgaacacatctctagcgatgccctccaccaagtcgccttctactncttgcgcctccaccacctgcacctctcggg

SEQ ID NO: 47661 - DNA, 101 bp, rice(Oryza sativa)
  misc_feature (71): n=a or g
tgctcaatactggagaagggaaggatggaacctaacatcccatccctggtgtctactttatcaggttcagnttacttcataccaaagttgaaattgggtac

SEQ ID NO: 47662 - DNA, 101 bp, rice(Oryza sativa)
  misc_feature (71): n=a or g
accctgtgcatatgtagagtaaaatcccccttaagcctttcttccaagaaagaaaggatgcacgaacattnttgatagagatcatttattcttgtccaaat

SEQ ID NO: 47663 - DNA, 101 bp, rice(Oryza sativa)
  misc_feature (71): n=t or g
actcttcgtctccggcgctttcgactgggacggcgcctcagagcagctacatatgtatgtgtcctctagtngtgttttgttactctcgttctgattttttt

SEQ ID NO: 47664 - DNA, 101 bp, rice(Oryza sativa)
  misc_feature (71): n=a or g
tactttccctgacctcaagatcgacattgaccttgttgaaccccaccacccgcttgtcgccgtgccacctngggccaccgtcaccacaatgaccgaggcta

SEQ ID NO: 47665 - DNA, 101 bp, rice(Oryza sativa)
  misc_feature (71): n=t or c
tttcgctgccattaattaggaaatagttctgttgagtagtgcattagcacctgcagcttaatagtccatgnagaaaatattggatttgttaggaaatcaaa

SEQ ID NO: 47666 - DNA, 101 bp, rice(Oryza sativa)
  misc_feature (71): n=a or g
agcaaatatatctagtcagcttcaggttcttgaactatcaaactgcaacctgaatgccaattctggtgttntaccaagtttcttatcacaccagcacggat

SEQ ID NO: 47667 - DNA, 101 bp, rice(Oryza sativa)
  misc_feature (71): n=a or g
gatctgagccttctggtatatgtacgatctcggatacgtcagctcttatttgaaaaacactctcatagctntatgtaagatcatttttttttgacatatga

SEQ ID NO: 47668 - DNA, 101 bp, rice(Oryza sativa)
  misc_feature (71): n=t or c
tttcggccgaccaggcaactaatatatgcagcgccagttaggatatcatccatgtgtattacatgctccgngcatgcatttatgtgtttgggcacgcatgt

SEQ ID NO: 47669 - DNA, 101 bp, rice(Oryza sativa)
  misc_feature (71): n=t or g
aagcaaactgccgatgtggtggtggagtttgaaattggttgaaccctggagcttgctaaaatgaaaatgtncttggctcctggatgcagtattgtggcctg

SEQ ID NO: 47670 - DNA, 101 bp, rice(Oryza sativa)
  misc_feature (71): n=t or c
agtataatactagtaccaccggttaaaaagttgggcatgatactaagagaaaggggaagcaagaaagggangtgatactgcagtagtatatgctgctgact

SEQ ID NO: 47671 - DNA, 101 bp, rice(Oryza sativa)
  misc_feature (71): n=t or c
tgatgatgggaagaagaagcaaactcacaaacttcccctaccaccactgagcatctctcacagttcatttnatccaaataactccactccaactagtccta

SEQ ID NO: 47672 - DNA, 101 bp, rice(Oryza sativa)
  misc_feature (71): n=t or c
acccgccggcggcgggccgccattcccgtcgctcagcattggatcaggtgggaacacgagctccctccctnccggatttctcggggggtgggtctctcctc

SEQ ID NO: 47673 - DNA, 101 bp, rice(Oryza sativa)
  misc_feature (71): n=a or c
tagtatctatatatgcatccatcgtggacctagtctgatgactgatttctagcagtaagtatgaagggttnctcgaaaatttgggtgatttcaatgggacc

SEQ ID NO: 47674 - DNA, 101 bp, rice(Oryza sativa)
  misc_feature (71): n=t or c
tataaatcaaatataattttaccaggtcatataactcctatggcaaaattctagctactacagaattaganctacatttccactaaaacaatacaattaaa

SEQ ID NO: 47675 - DNA, 101 bp, rice(Oryza sativa)
  misc_feature (71): n=t or c
atccaaggcgaaccacactctgcgatcgagagctcgctgagccgtaaaaccctagctaatccttctctctncccccctctcgctgtcgtctccgtctccgt

SEQ ID NO: 47676 - DNA, 101 bp, rice(Oryza sativa)
  misc_feature (71): n=t or c
gacatatcccaccgagaacgccaaatctggccgcgaatttaccaagtatcgcagtgatcccatgatccgcntataatccgttgcatcaacagccggtgcgg

SEQ ID NO: 47677 - DNA, 101 bp, rice(Oryza sativa)
  misc_feature (71): n=t or c
aatactttatattgaaatggagatagtacactatttctctataaacttgtctaaatttatagaagtttganagaaataaagtcaaagcgttttataatata

SEQ ID NO: 47678 - DNA, 101 bp, rice(Oryza sativa)
  misc_feature (71): n=t or c
cagaggttgaaggcctctaggttaggctagggtagcacggtggtggtgatgatgagaagatcttcctcaancgccgagctgaaaaaatcggagtacttggg

SEQ ID NO: 47679 - DNA, 101 bp, rice(Oryza sativa)
  misc_feature (71): n=t or c
gaggagagcgtgtagattacccaaatcctaattaagagaatatcttgagagagacttccgacgagattggnttaggtgatcggctccttcgtaactcaaag

SEQ ID NO: 47680 - DNA, 101 bp, rice(Oryza sativa)
  misc_feature (71): n=a or g
ttcagaatgcttgaaaacttgttaaagaggatgggtcctcaaaagcatgaaagtggactgcattagtgccngaggcaacatttttgttatttatattatag

SEQ ID NO: 47681 - DNA, 101 bp, rice(Oryza sativa)
  misc_feature (71): n=a or g
aatctcacatatcctctctttctctcctcctattcttccttgggcggcgatgggggcggaggggattgcgncgacgagcggcaatggttgagggagcgaag

SEQ ID NO: 47682 - DNA, 101 bp, rice(Oryza sativa)
  misc_feature (71): n=t or c
acaattatactatatttacatctgccaaaaccactaaccacctcctccatttatattactccctctgtccnaaaatataagcatttttagaacagtgctaa

SEQ ID NO: 47683 - DNA, 101 bp, rice(Oryza sativa)
  misc_feature (71): n=a or g
tcttcctttggagaaatggtggacctaattggcaatgggaatttgatgcttggacccgtgatcaagaaaangaatggatttcggtggctcctaagaaacgt

SEQ ID NO: 47684 - DNA, 101 bp, rice(Oryza sativa)
  misc_feature (71): n=a or g
ggacatgtcttcgattataaaattttctcccgcatcaaagcaaaagacatcagcctcgtcattatgaacgncgatttgcccgtgacaagtccatatcttat

SEQ ID NO: 47685 - DNA, 101 bp, rice(Oryza sativa)
  misc_feature (71): n=a or c
gaaatttcagaatgacaaggggaagcaagtgatgacggtcaaggaggtccaagcctcgcgcatgaactttnatgcaaggaaatgaagcgaacaggctcccg

SEQ ID NO: 47686 - DNA, 101 bp, rice(Oryza sativa)
  misc_feature (71): n=a or g
acactcgatttacgccatacttcattattagtgatgcctgaaagtattgttcagctcaaacggttgatgcntcttgttggacatcatctcatattaccgga

SEQ ID NO: 47687 - DNA, 101 bp, rice(Oryza sativa)
  misc_feature (71): n=a or g
cttattgccacctaaatctaggtaagtcaagtcagacaaggatcctagagaagggataacaccggtgaaanagtttctgcgaaaatatattacttggagat

SEQ ID NO: 47688 - DNA, 101 bp, rice(Oryza sativa)
  misc_feature (71): n=t or c
tcgccccaaccttctcccgcagatctggcgatggcgacgacttctccgttggatctaacggcggcggcggngacccgcggacggatccggtagatttcttg

SEQ ID NO: 47689 - DNA, 101 bp, rice(Oryza sativa)
  misc_feature (71): n=a or g
gtgtgtgcataagagcttaacaagtgatgagaatgtctgtccctccccttcttgtgggaagaaattaagcnctcaaacagttttttcacctggagtgttaa

SEQ ID NO: 47690 - DNA, 101 bp, rice(Oryza sativa)
  misc_feature (71): n=a or g
aaaaaaaagagaggtgagttggaaaaggagggagaagaacgcaaccatagtaatggcatttatctaaaatnacatatttgtaatggtatgaatccaattaa

SEQ ID NO: 47691 - DNA, 101 bp, rice(Oryza sativa)
  misc_feature (71): n=a or g
aaaccattcaagcccattctaattccactgcaagccaagcgaagaggagtagttcatgttgaggcggaaantggtgacgcccgcgccgaacaccccgtcgg

SEQ ID NO: 47692 - DNA, 101 bp, rice(Oryza sativa)
  misc_feature (71): n=t or c
agaggtggcgagatttaacttatttttcttttttaaccctacctacaccttgtctctaccaccttaaggcnccctttgattcaaaggaaattcataggaat

SEQ ID NO: 47693 - DNA, 101 bp, rice(Oryza sativa)
  misc_feature (71): n=t or c
tccacttctaactcccaatcaatatagtccctaggattaaacctaccaacaaatgaaggcaatgatatctnattttcacaaacctcatcatgtacctcttc

SEQ ID NO: 47694 - DNA, 101 bp, rice(Oryza sativa)
  misc_feature (71): n=t or c
agaaaaatccagtcgcaggggttcggagaccgtaccaattcccgaaaaattatgccaagcccatcatcagnacagcccaattcttgggcctaaacccccgt

SEQ ID NO: 47695 - DNA, 101 bp, rice(Oryza sativa)
  misc_feature (71): n=t or c
gctgtaatccctaatagctatccacctgataagcagaagttaataaagtatttgggcgccgaagtaagaanaactggtaagtgttaaatacgtacatatac

SEQ ID NO: 47696 - DNA, 101 bp, rice(Oryza sativa)
  misc_feature (71): n=a or c
tctcccatctacttccacagtgtcaatctttataacactaccaggttttctaagtacctttgccctccatntatacagcatgtgaaaactttcctcccatg

SEQ ID NO: 47697 - DNA, 101 bp, rice(Oryza sativa)
  misc_feature (71): n=t or c
caggatacaaacacatgatcagtaaatcacatgggaaaatgtaaagagtagtaccagcaccaatgcctgangaatattcaatccacttgccagtcaagaca

SEQ ID NO: 47698 - DNA, 101 bp, rice(Oryza sativa)
  misc_feature (71): n=t or g
aacacaagtgcaagtgatgtggtgctttaaaaggtttctgcatggattgcaatttggaacatgtgacttgngcaagttatgtggggtaagagctcctaatc

SEQ ID NO: 47699 - DNA, 101 bp, rice(Oryza sativa)
  misc_feature (71): n=t or c
gcaagaacacatggggttcgttcgactgcagctgccatggcaacaacctgatgtacatcaaagctgaaganacctgcattggtaattcttcgtcaatggag

SEQ ID NO: 47700 - DNA, 101 bp, rice(Oryza sativa)
  misc_feature (71): n=a or g
atcagtttcagatcaatgtacttgctattcagccagtctttactgaatattgttgacttatgcaggttgcncagctggtttcatattttaagataccactc

SEQ ID NO: 47701 - DNA, 101 bp, rice(Oryza sativa)
  misc_feature (71): n=t or c
agccaaccgcgcactacttgtacttcctcatcttcctcttgctattaatcgaatcaaattactactagtcncccttccacgccacgcacacgcacccaatc

SEQ ID NO: 47702 - DNA, 101 bp, rice(Oryza sativa)
  misc_feature (71): n=a or g
aagccctgcgctatatatatggagcataagcctgcagggcttctcattcagcaacgatgagtgtgccaatnaaagaaaaaaaaacaatctaacctctatca

SEQ ID NO: 47703 - DNA, 101 bp, rice(Oryza sativa)
  misc_feature (71): n=t or c
tagctctaactttcatctgtgcaccgtgcattggatgcagagttaccatagtatgcggcgcatgagtatangatggcgcaagctcaaactccaagcgttga

SEQ ID NO: 47704 - DNA, 101 bp, rice(Oryza sativa)
  misc_feature (71): n=t or c
catgttcagtctccagtactatccattaaaagtttattcttttgttgatcagatgctaatcatgctaaccntcataaatgatgatcaggtacctgccgccc

SEQ ID NO: 47705 - DNA, 101 bp, rice(Oryza sativa)
  misc_feature (71): n=t or c
acttttgagcacacagattctatcaaaggagaggtgcaattgccggataaagataagaatttagtgacatnagaggcagagggaagtgtgcttgaagttat

SEQ ID NO: 47706 - DNA, 101 bp, rice(Oryza sativa)
  misc_feature (71): n=t or c
ctcctaatctcctataatcagctcaaactgaaaactggtgcgtaactgacactaccattaatcctccagcntctcatggtcgcaccacaagctccaaaagg

SEQ ID NO: 47707 - DNA, 101 bp, rice(Oryza sativa)
  misc_feature (71): n=a or g
gcgctgaaggtgctcgacggaatgcttgtttgcatatgggttggaaaaaaggcaggcgctacaggtcggcngtgtgcgcgacaatgttgcactggccacca

SEQ ID NO: 47708 - DNA, 101 bp, rice(Oryza sativa)
  misc_feature (71): n=t or c
aactaatccatgtatatattaatttatcggctaaccagctagctgtttcgaaccggtaggtgacaacaggnatcctgccctttcatcgtttttttgcatcg

SEQ ID NO: 47709 - DNA, 101 bp, rice(Oryza sativa)
  misc_feature (71): n=a or g
ggaagaaagcaggagggtcaaagcgttatgtgccacagaagaattctgctgcttacgcgatactgatcacnctccataggtatgctttgcttggggatata

SEQ ID NO: 47710 - DNA, 101 bp, rice(Oryza sativa)
  misc_feature (71): n=t or c
acactttgtccattatgtattgaaaccctaacctcagactcacaacatatgtgacccaaattgtccaatgnagaggatagaagcaaggatgacaacaatgg

SEQ ID NO: 47711 - DNA, 101 bp, rice(Oryza sativa)
  misc_feature (71): n=t or c
tcccaagccgataaatgggttgagtggtataacagagtagctacaagcaagcagagtcactgggaagaaanaggaatatctcaatgcctttctctatctct

SEQ ID NO: 47712 - DNA, 101 bp, rice(Oryza sativa)
  misc_feature (71): n=t or c
ggtggcagggcttacaacattgtgttcatggttctcatgaagttgatccggggcaacaataacaatagcanaacatcttatgggcttgagcagaccaacga

SEQ ID NO: 47713 - DNA, 101 bp, rice(Oryza sativa)
  misc_feature (71): n=a or g
ggagtgtactggcttaggcatcgacaatctagagcttatgggtgttgcgcttaggtcctgatggatctcgncccaacgcacatctcaatttaagccctagc

SEQ ID NO: 47714 - DNA, 101 bp, rice(Oryza sativa)
  misc_feature (71): n=a or g
ctgtcaggaaccacgcgttgctgtttgttgccattgctagcacaatccatagctgttatgtgatgtcatcnatagcatcggaattaatacaacctttgttg

SEQ ID NO: 47715 - DNA, 101 bp, rice(Oryza sativa)
  misc_feature (71): n=t or c
agtgcagatgcattcatggttccactcgtccgaacgatagttgggccggtcattgaatgcaacgatgacanggtacggcgccaaatggcagtcaccaccac

SEQ ID NO: 47716 - DNA, 101 bp, rice(Oryza sativa)
  misc_feature (71): n=t or c
gataaattgggatctgtcactagactttatgaatatgatcatgacggcaagaaggcttttccctcaacctntctttatggaagtattaagaattggatgct

SEQ ID NO: 47717 - DNA, 101 bp, rice(Oryza sativa)
  misc_feature (71): n=a or g
cgctgacagctttcacacctcttggcttgctcgacacaaacttttagcacagttggccaatacaccccctngcgaaacactttggaagcaaccgtccttgt

SEQ ID NO: 47718 - DNA, 101 bp, rice(Oryza sativa)
  misc_feature (71): n=a or g
aatcaaggatgaaatctgcaaatgaaagagatcgaccaggctatttagacacacctgaatattcggaagtnaacctatataggcgagtatagctcatatgc

SEQ ID NO: 47719 - DNA, 101 bp, rice(Oryza sativa)
  misc_feature (71): n=a or g
gcatacgtccatagcaccaccaccaggcacaactgttgggttcttgacagctctactcacaataatgatgncaccatgtagacttctttcagcttcctcga

SEQ ID NO: 47720 - DNA, 101 bp, rice(Oryza sativa)
  misc_feature (71): n=a or c
gttgagggaccttcggtgtactttttccttctaccaggccttactgtccatcacagagcgatgtagcccanagccaaatataaggctttggagttcggaag

SEQ ID NO: 47721 - DNA, 101 bp, rice(Oryza sativa)
  misc_feature (71): n=t or g
taggttgcgttgcagctgttgtgggatatgcagatgttagagccgaccactgcataggatgtgatcttggngtaggtgaagcagcaggtacgatcagagac

SEQ ID NO: 47722 - DNA, 101 bp, rice(Oryza sativa)
  misc_feature (71): n=a or g
tagtatatttctagagctcgccttgtccaattcagccaatgacaatacaattcttgttggtgtttattacngtcacaaataaaatccgcaagcgcacggat

SEQ ID NO: 47723 - DNA, 101 bp, rice(Oryza sativa)
  misc_feature (71): n=a or g
gtgataattttcatatcatatcttgtcctccttgcggcaggaatacaagaaggtagatatgtaaagcatgnagcaagttatgatcaacctatttccgacaa

SEQ ID NO: 47724 - DNA, 101 bp, rice(Oryza sativa)
  misc_feature (71): n=t or c
gagttggtaatttcactctgttgttccctactgagaaagctctgaacctccactgcattgcctttagctcnagcccatgggtgatgttggtatctcctcag

SEQ ID NO: 47725 - DNA, 101 bp, rice(Oryza sativa)
  misc_feature (71): n=t or c
tacaaatatatagtctgataaaataatgatcatcctttcgagaacggaggcggtagtagttaaaaattganttgtctctataataacaatacaaacaccaa

SEQ ID NO: 47726 - DNA, 101 bp, rice(Oryza sativa)
  misc_feature (71): n=a or g
caccttgccggcgatgttggtgtccgagaggtcaaggtgtgtgagctcggtgagctgctcgaatccagtgnccgggagctgggacatggtgaagatgttac

SEQ ID NO: 47727 - DNA, 101 bp, rice(Oryza sativa)
  misc_feature (71): n=t or c
ttgggagccacacacaaacacacaaagtttcacatggaggcagccatttcggcaattgcaagtgacctaangagccggttcatgtcctttctaatcaagaa

SEQ ID NO: 47728 - DNA, 101 bp, rice(Oryza sativa)
  misc_feature (71): n=t or c
ctgtcattgttaactctactctcctcaagggatctttcaccttccggtgtagtgaacagcataccactgcntacaacaataggtgtatccgtcagccaacg

SEQ ID NO: 47729 - DNA, 101 bp, rice(Oryza sativa)
  misc_feature (71): n=t or g
gatagtgttatgggaggcaacagccaacaggagacctgatgtttgttttcgcacctcttaataatgtcgcngaacagtttctggtatggtgatggtgaatg

SEQ ID NO: 47730 - DNA, 101 bp, rice(Oryza sativa)
  misc_feature (71): n=a or c
gctaaattatgaccatgttgggtataggatcttatggttgttgttgaatccttcggaagcatcttaatatngaaggaagtgttcaatctttttgagggaaa

SEQ ID NO: 47731 - DNA, 101 bp, rice(Oryza sativa)
  misc_feature (71): n=a or g
caaacacacccctaatgtatatgctcgaagcatataggacaggtgtgatgcacgcgaccaatttagtgtantttgatcacacacaaaactggtaagttgaa

SEQ ID NO: 47732 - DNA, 101 bp, rice(Oryza sativa)
  misc_feature (71): n=t or c
ccagaaacccttcaatttttctttgttccaaagtcaaggaaagcccttctttttttacccgccaaaggccncaaataaaccaatatcaaattttgcgcttt

SEQ ID NO: 47733 - DNA, 101 bp, rice(Oryza sativa)
  misc_feature (71): n=a or g
ggaagtacaaacaatgagtatactatgtatctgacaacgccatctttcatcgatgcaggaccgcgaagacnacggcgttccttacatcgatggggactggg

SEQ ID NO: 47734 - DNA, 101 bp, rice(Oryza sativa)
  misc_feature (71): n=a or g
ttttaattctgtattagatgatgggttcagcaatgggttcaagctgactcgatcttctttaggctggatgnagaatgcaatgtcagatgtcacaaaaagta

SEQ ID NO: 47735 - DNA, 101 bp, rice(Oryza sativa)
  misc_feature (71): n=a or g
tgcttgattaggatagtccttaagtgcctcttcaataacagccttgctgtcatcatcaaaggaataaatgnttgcatgccgaagggagtagagattctcca

SEQ ID NO: 47736 - DNA, 101 bp, rice(Oryza sativa)
  misc_feature (71): n=a or g
aagctagccacatgatgatggccttgacaactctagcaataaggagaccaaatgagtatagctatatcgcngtggctcatgaaggaatcaaaggtcagtag

SEQ ID NO: 47737 - DNA, 101 bp, rice(Oryza sativa)
  misc_feature (71): n=a or c
cattgctactaattgatttggcaacaaaacaatgggaaggaaacgaaagaagggccactcacgtcatgtgnagacctgtaagtaccgaacatcgcccaaat

SEQ ID NO: 47738 - DNA, 101 bp, rice(Oryza sativa)
  misc_feature (71): n=t or g
gacgagtgcttctgctcgaatgatcctccaaggcttgatgatgtcagtggcgattgcagctgaaacctgancaccagagtcatgctctccggtagcccttg

SEQ ID NO: 47739 - DNA, 101 bp, rice(Oryza sativa)
  misc_feature (71): n=a or c
caaaatcgggcggaaaaagacggacgaaaaaaaagggtgaaaaaaatcctattctgtgtaaagaaaagggngaaaaaaaaataaaagaaccaatctgtccg

SEQ ID NO: 47740 - DNA, 101 bp, rice(Oryza sativa)
  misc_feature (71): n=a or g
ttacttgtgcagactacaaagtagcagatggtgcaagctaagttggatacgtcaagttgttgattaatttncgaaatttgtaaactgaaagctgacacaga

SEQ ID NO: 47741 - DNA, 101 bp, rice(Oryza sativa)
  misc_feature (71): n=t or g
ctacttaactactaagaaaaattgatgaattggtaccacgattcttattctacctaggcagacgtcatacntagattcgtttctttgatatagcttttgct

SEQ ID NO: 47742 - DNA, 101 bp, rice(Oryza sativa)
  misc_feature (71): n=t or c
ctaattatctcccggaaaaacaagttgctactttctttgacttgatcactctttgacatagtactctcgcncttgactgagaatatatacttatcgttttg

SEQ ID NO: 47743 - DNA, 101 bp, rice(Oryza sativa)
  misc_feature (71): n=t or c
atgttacaacaattacaagcactaacaacaaagaacaacatggtgaacttcattttgaccagacagatgtncagtgatttgaattgaagaaagacaaacct

SEQ ID NO: 47744 - DNA, 101 bp, rice(Oryza sativa)
  misc_feature (71): n=t or g
atattcgtgagcactggaatttgaaagccatatactcacacgactctactgccgtattaccgtatcactgntgtttccatagtgctttaccttttctgttc

SEQ ID NO: 47745 - DNA, 101 bp, rice(Oryza sativa)
  misc_feature (71): n=a or g
ttagcatataattatatctctttctaccctacatataccggcctaagagactcagtatgtacaataatccngttataagacatatctattttttgtatcca

SEQ ID NO: 47746 - DNA, 101 bp, rice(Oryza sativa)
  misc_feature (71): n=a or g
ggtttgtataccatgtaaatccatccttctctcgtaccaaaaatatggatggttttaagtgtagtgggatnccgtgtttttgtctgtctctcagcattagg

SEQ ID NO: 47747 - DNA, 101 bp, rice(Oryza sativa)
  misc_feature (71): n=t or c
atgaaggtggtgcaccgtgtgcagaagaagacaggccgcaaggttgagcttctatcaccgatgccacctcnggtggaggagaagaaggaagaggagaaaaa

SEQ ID NO: 47748 - DNA, 101 bp, rice(Oryza sativa)
  misc_feature (71): n=a or c
tgtcttttttgacgcggagttagtaagtctcgagagaaggaagaaacgtccaaaggttttccgattagctntacaaggtggtgagctagatgacctaaatt

SEQ ID NO: 47749 - DNA, 101 bp, rice(Oryza sativa)
  misc_feature (71): n=t or c
aagacctccctatatttactctcagattggtatgatttatttggaggatgccttttgatggcatgtaacgntatgtacttagtcctagacaagattgactc

SEQ ID NO: 47750 - DNA, 101 bp, rice(Oryza sativa)
  misc_feature (71): n=t or c
gttgcatcatccaatttgggccgatgcaaaattgctcatgttaaaagtggagatgctgatggttacccaangactgaagatttgtcaattgacgaggaaac

SEQ ID NO: 47751 - DNA, 101 bp, rice(Oryza sativa)
  misc_feature (71): n=a or g
tatatatgtactccaactataaatgggagtagatgagattggtacctgcagtgcaggtatgtgtgtgtgtntatagacgcgagcaaatgagcaatatatat

SEQ ID NO: 47752 - DNA, 101 bp, rice(Oryza sativa)
  misc_feature (71): n=a or g
ttggagcatgctcttcaagagctccttcatcaatgaaaggttgtaacttttcactttgtccatcagtatcnagagaggctgcagttgaatccaaagaccca

SEQ ID NO: 47753 - DNA, 101 bp, rice(Oryza sativa)
  misc_feature (71): n=t or c
ttgattgaagatatgtgttgaagatgatgacgcccattagcagcagcaacgacgtggctagccgtgaagangataacaccagttagagtcatacgaggcag

SEQ ID NO: 47754 - DNA, 101 bp, rice(Oryza sativa)
  misc_feature (71): n=t or c
gccaaagcgatacgagctaaggcgaaatgacctgggtaccctcaaaaccgtgccctttgactcggtctcgngagtggggacgaacgcatcgcctcttctcc

SEQ ID NO: 47755 - DNA, 101 bp, rice(Oryza sativa)
  misc_feature (71): n=a or g
ttcaattcttgatcatgattgcacaagatgataaagattataaggaaaatcagatgattcagtatttaccngaggaggagggttgaaagcgttatatggca

SEQ ID NO: 47756 - DNA, 101 bp, rice(Oryza sativa)
  misc_feature (71): n=t or g
ttcataattattaaatttaaaaatagaaaaattcgactcaactcaggctatgttcgtttgatggagttagnaacctttatcttcatcatgggaaatagagc

SEQ ID NO: 47757 - DNA, 101 bp, rice(Oryza sativa)
  misc_feature (71): n=t or c
tattctccaactaaccttatatttgtatttttaaggactatattatggatgactatgatgttattcatcgngataatctttcaaaataagtaaattttaat

SEQ ID NO: 47758 - DNA, 101 bp, rice(Oryza sativa)
  misc_feature (71): n=t or c
gggggtccgtcggagctcgcaaactcctccacatcatcctccaattcttcagcatcattgttgaagggagngccggagccagatgcttgtccacagacggc

SEQ ID NO: 47759 - DNA, 101 bp, rice(Oryza sativa)
  misc_feature (71): n=t or c
taggatgcagtcagtgcaggaagagaatcttctatcagctatggtccctgctgatcaaaatgatgatcgcngcagacctgatgacactggtagtgatcagg

SEQ ID NO: 47760 - DNA, 101 bp, rice(Oryza sativa)
  misc_feature (71): n=a or c
acgcgtgggcttctagcaagacgagatgaggttaccccatgtcacctctaaagggcacctatctccttacnaaccatgaatcgcactgcgctgtatatgtt

SEQ ID NO: 47761 - DNA, 101 bp, rice(Oryza sativa)
  misc_feature (71): n=t or g
tttgtcctatcatgagttagctaactcataatactgtacacactcactgtagcagcagaggatccatcacngcataacacatcacatcacattaccttaat

SEQ ID NO: 47762 - DNA, 101 bp, rice(Oryza sativa)
  misc_feature (71): n=a or g
gtgtgggaagctagaggggtggtggacatttttaaaaaatcatttgtgggcaacgctcaagcaggcagccnaattctcatcacaacaagatctaaacaagt

SEQ ID NO: 47763 - DNA, 101 bp, rice(Oryza sativa)
  misc_feature (71): n=a or g
tgttctcttggatacgtaatcagtaatgcgcttggtttggctgattacctctcttctcttgtctgaactgnagagaattgcgtgctgaaaccggctctgaa

SEQ ID NO: 47764 - DNA, 101 bp, rice(Oryza sativa)
  misc_feature (71): n=a or g
acacacacgaggaaattattcattacgcgtatatatacgcgcgtaccacacgaaggcgtagtaaccaacancacacgtgtgttccagaggcttcaaccgca

SEQ ID NO: 47765 - DNA, 101 bp, rice(Oryza sativa)
  misc_feature (71): n=t or g
ctcacaacccctctagaactggaaagctagtggatgaagcagccgcagagtgatgccgttttttttttttnacaaattgacccttttcaaaaacttatttc

SEQ ID NO: 47766 - DNA, 101 bp, rice(Oryza sativa)
  misc_feature (71): n=t or c
tgcacgggaagggccagcaggcacgcggcaagggaccgacaggcacgcgcacaaacgggagagaggaaaangaggcgacggtagccggtggaggagcggtg

SEQ ID NO: 47767 - DNA, 101 bp, rice(Oryza sativa)
  misc_feature (71): n=t or c
ggctcggtgtattgcggctcggtcacgaggcgaaagtggtgcgacgctgggtgagacatttcgtcgaacancttgcgtgcgtgagctggctggcctgagga

SEQ ID NO: 47768 - DNA, 101 bp, rice(Oryza sativa)
  misc_feature (71): n=t or g
ggacccaagccaatgggagccttgcctatctgtacaaggctggtgggagatgcttgctaacaaaagagagnttcctaagaaagggctgcgtagcttgattc

SEQ ID NO: 47769 - DNA, 101 bp, rice(Oryza sativa)
  misc_feature (71): n=a or c
agattggcgacacctatataccaagtcatgataccaagtcttcctatggaatcaaggctcgtacgtatggnaaaagtcctgagttaataagaaaggaatct

SEQ ID NO: 47770 - DNA, 101 bp, rice(Oryza sativa)
  misc_feature (71): n=t or c
ctaaagttttcacagatgtgagagggaccattggctacatggatccagagtacattacacattccaagctnacttgtgccagtgacatctacagttttggt

SEQ ID NO: 47771 - DNA, 101 bp, rice(Oryza sativa)
  misc_feature (71): n=a or c
ttttcctagaattaactagaccaactacgctagcaacaagtcacacgcctccttttcgcatcacatacatnagtgattttgcttcacactacgcctccttt

SEQ ID NO: 47772 - DNA, 101 bp, rice(Oryza sativa)
  misc_feature (71): n=a or c
cctgtcaaaccatgtatgccacagcccacctccgtatgtctgtacatttaccatttgatgcccagatttanaggaggcagaccttggtttcagcttgagac

SEQ ID NO: 47773 - DNA, 101 bp, rice(Oryza sativa)
  misc_feature (71): n=a or c
catccctatatgcacctcttggatattccaggtaaatgatgaaatgcttcaacagcatatccattcccagnataaacttagttaggtcatcggtgctcacg

SEQ ID NO: 47774 - DNA, 101 bp, rice(Oryza sativa)
  misc_feature (71): n=a or g
atcatgaaaggggaaccatcttttgattgatgggttgggtgtggatgaggtgaggttgatttggtgatganttctctcagccattggtctctcacatccaa

SEQ ID NO: 47775 - DNA, 101 bp, rice(Oryza sativa)
  misc_feature (71): n=a or g
tgtgctgttctctagcttgttattctggagagagagcctacgaaccttgcttgctggagatgtctgttgcnaaatgccatccattacagtaacaaagttct

SEQ ID NO: 47776 - DNA, 101 bp, rice(Oryza sativa)
  misc_feature (71): n=a or g
tgcactgaggtccctaccagcagatccatgtcaccaatgctcccaaggccgccacctccaccgccactccnagtgagcccgccatcggatccgccattgcc

SEQ ID NO: 47777 - DNA, 101 bp, rice(Oryza sativa)
  misc_feature (71): n=a or g
cgcagagtgccgtgtgtccggggctctctccatccatgattaatgatactctccccagttctggcatgatnctgggacttcgtcacaggcagcaggcacgt

SEQ ID NO: 47778 - DNA, 101 bp, rice(Oryza sativa)
  misc_feature (71): n=a or g
cgttctatgtcgtggcacttcttttctacctataggaaccactaagtttgctctcaaaaacattcttgtcnccccttctttggttcgaaatttactttcag

SEQ ID NO: 47779 - DNA, 101 bp, rice(Oryza sativa)
  misc_feature (71): n=a or g
gatcagcactggtccagtttagattagttggatgagttggataccatcatctcatcacccatacaacaatngccacccctgcaaaaggctgtgcagatggt

SEQ ID NO: 47780 - DNA, 101 bp, rice(Oryza sativa)
  misc_feature (71): n=a or g
cttgttgcagctgctgccatagccattgggattatatctgccacactgttgcggctgggtgtgtattgtanccatatttagacctacggaatatgccctac

SEQ ID NO: 47781 - DNA, 101 bp, rice(Oryza sativa)
  misc_feature (71): n=a or g
gtgactgctccagtcctcatgattaaggacagaaaactcttccgagatcaccacatatttgttcgatttcncgtgtgtttagttcacgccaaaattaaaag

SEQ ID NO: 47782 - DNA, 101 bp, rice(Oryza sativa)
  misc_feature (71): n=a or g
catcgcgtggcatctcacgtagtatggtgctactccatccgtgctagtataatataagagattttggttgnataagatatgatcttagtacaataaaatcg

SEQ ID NO: 47783 - DNA, 101 bp, rice(Oryza sativa)
  misc_feature (71): n=a or c
atcatccagtccctttgcatcctctccaagtttcctcatggcaacaactatgctctcaatggtagacaagnacccagcccttggctcatgcctcacctcac

SEQ ID NO: 47784 - DNA, 101 bp, rice(Oryza sativa)
  misc_feature (71): n=a or g
tttagtgaaaaagaaagatggtacatggagggtttgtattgactatagacaacctaatgccataactgtcnaaggtaaatttcccatgccagtcattgatg

SEQ ID NO: 47785 - DNA, 101 bp, rice(Oryza sativa)
  misc_feature (71): n=a or c
tctccaatagaagaactgatatttttttttgacgcacttgaaaaacaccagctgctttgctagctgagcanccagaggccagagcagcagcagcagcagca

SEQ ID NO: 47786 - DNA, 101 bp, rice(Oryza sativa)
  misc_feature (71): n=t or c
cggtacttctttttttttcagaagatctgttggatcgtgtagcgtcttatccgatcacacgttgtcatgtnacgagacagagggagtaggattttaggatc

SEQ ID NO: 47787 - DNA, 101 bp, rice(Oryza sativa)
  misc_feature (71): n=a or c
caaacgacttctaatatgaaacggagggagtagcacgaattattttccagggcataagcctgatttgaatntcctacattcttcgttttcaactgtgattt

SEQ ID NO: 47788 - DNA, 101 bp, rice(Oryza sativa)
  misc_feature (71): n=t or c
actacaccacaaacattgaggatgcccttaacccaccatcacttaattccctccacccgccaaaccctagntgtgccgcctaatcaaagccgccgtcgttg

SEQ ID NO: 47789 - DNA, 101 bp, rice(Oryza sativa)
  misc_feature (71): n=a or g
aaaacgaaattgttctcatgaccacagccatgaaacaaaagtggtcagcaccctcaagtatgaggcagacnaagcagacaagaagggcctgcaccttcttg

SEQ ID NO: 47790 - DNA, 101 bp, rice(Oryza sativa)
  misc_feature (71): n=a or g
tcgtcggcgagaatgctcgagtgctggagaagatggtgattgtgatgaaacttggaaggtactctgcaccngaagaggtggcagccaaagtgatggatctg

SEQ ID NO: 47791 - DNA, 101 bp, rice(Oryza sativa)
  misc_feature (71): n=t or g
ccggagacaagaaaatacgagatgttaaatggggagtatatctgctacgatcattacaacctttgaactcntgacgaagtacgctcttgacctctacgtcg

SEQ ID NO: 47792 - DNA, 101 bp, rice(Oryza sativa)
  misc_feature (71): n=t or c
gtttcttggtgtgtccactagcaaggaacaatatatgtatcattaacacagaagcccctgcatttccatcngaattcattgttttctatccacgttagata

SEQ ID NO: 47793 - DNA, 101 bp, rice(Oryza sativa)
  misc_feature (71): n=t or c
atggaagagcggcaccgcctcagtcccacgtccccgttgtgtggatgaggtatatttgtgcaaatattttncacgcatgtatataaacacaaaatattgaa

SEQ ID NO: 47794 - DNA, 101 bp, rice(Oryza sativa)
  misc_feature (71): n=t or c
aagtgaatattcctctgcggcggataatgaagggcaagctagatctccatatccaagcaacttagcataantaaatcccttttgagcttgagcagattttt

SEQ ID NO: 47795 - DNA, 101 bp, rice(Oryza sativa)
  misc_feature (71): n=t or g
tggacaatttccgccttgcaagctgaattctccatgaaggacctcaggcctctccaccacttccttggaancagtgttacccgcacatccactggtttgtt

SEQ ID NO: 47796 - DNA, 101 bp, rice(Oryza sativa)
  misc_feature (71): n=t or c
tccaggaactaacccgaccaagtgaacttggcaaccggaacacttcgtattatactaatccgcttgttaangtacttatcctaacttaacaaagtccataa

SEQ ID NO: 47797 - DNA, 101 bp, rice(Oryza sativa)
  misc_feature (71): n=t or c
tttctaacttgtagaggcctcttttgaaactcaggaatttagagggaaaaaatgtactctctcagtcacangagtctagagaaaaaaatactcataaaata

SEQ ID NO: 47798 - DNA, 101 bp, rice(Oryza sativa)
  misc_feature (71): n=a or g
tcatagttcaaattcctaccaacataagttacagtactgcttgctgatgtgtttctgtattacttcagctnatggcatcgtactgagcggtggagacaaca

SEQ ID NO: 47799 - DNA, 101 bp, rice(Oryza sativa)
  misc_feature (71): n=t or c
aggcacagcttgtagaccatggacgtaactaatacattacatataggtaggggtgtaagtggctaacccgngaaacccacttataggctaaaataagccgt

SEQ ID NO: 47800 - DNA, 101 bp, rice(Oryza sativa)
  misc_feature (71): n=t or c
aaactgtagctggattagttaaccacagcttggaattgtcaatgtgacacagatagttgatggcaaggagntcctgaatgaaagaacaaacactgagaacc

SEQ ID NO: 47801 - DNA, 101 bp, rice(Oryza sativa)
  misc_feature (71): n=t or c
tgaaaacttttaaatgtaactatagtataattggggtgttattatattataatcactaatccctccttccnaaattgatcgtcgcataagaaaatatagta

SEQ ID NO: 47802 - DNA, 101 bp, rice(Oryza sativa)
  misc_feature (71): n=t or c
cctcgctctcgtttcttttgcaatgtgtcattgaactcggggtatgcccacagttccaacatgtctaagantattcatattaatataatccatattcgcta

SEQ ID NO: 47803 - DNA, 101 bp, rice(Oryza sativa)
  misc_feature (71): n=a or g
ggagacatggatggcgctgagaaagtctgggagatgattacggagaggaatatggtgccggatgcaaaganctataatgcaaagttgaggggccttgttgc

SEQ ID NO: 47804 - DNA, 101 bp, rice(Oryza sativa)
  misc_feature (71): n=a or g
aagcgagtcatcgaggggagaaaagaaggaagcgccactggggtttcgattcgattccgtcactatgggcntcggcgatgcatgtggccgctcctcctctt

SEQ ID NO: 47805 - DNA, 101 bp, rice(Oryza sativa)
  misc_feature (71): n=a or g
gtcttcctgtatgatggacttcagaactgtcgaaaccgatgagagagagtagtcgaaaaccttgggttccnctccttccacaactattaggataccaggag

SEQ ID NO: 47806 - DNA, 101 bp, rice(Oryza sativa)
  misc_feature (71): n=a or g
catgacgtcttcccctttgtcaatggttgccaaatcaatccagagactttccctcgtcgatccgccatctnaaacgccgactcgacagcctttcgaggcca

SEQ ID NO: 47807 - DNA, 101 bp, rice(Oryza sativa)
  misc_feature (71): n=t or g
ccacctactattccatctcacaaaagtacaaaaacctttacaagcatcaaagctatggcaaagatttgggntagttgtatggtggatcaagactgcaaaat

SEQ ID NO: 47808 - DNA, 101 bp, rice(Oryza sativa)
  misc_feature (71): n=t or c
atcggctgctagagctcatcacaaggcagtgattcgtcgtacgccatcttcatcacatcatgtgaaccttngttcttgcttggtaattgcctttttttctt

SEQ ID NO: 47809 - DNA, 101 bp, rice(Oryza sativa)
  misc_feature (71): n=a or g
atgccattaagtccggcaaggagctcgaaggtcttggttcttatcttcttaagattaccaagacggggaantacaggtagatttttcgtttgtgaatttcc

SEQ ID NO: 47810 - DNA, 101 bp, rice(Oryza sativa)
  misc_feature (71): n=t or c
ctatgttaaactaacttctactctgaattttgtagagaatgcatggaagaagggcgtgcagcgctactgcngtgattggaagctgtcacgcccggaatttc

SEQ ID NO: 47811 - DNA, 101 bp, rice(Oryza sativa)
  misc_feature (71): n=t or g
caatctgcccatgcgtcttccaggacttcagctactgcatttcatacagtcacataccttttccacatcanaaatcccattaacatctgatgtaccaactt

SEQ ID NO: 47812 - DNA, 101 bp, rice(Oryza sativa)
  misc_feature (71): n=t or c
aattggtggaagaactaacagtgcggtgagatgctacgtgatgggtttggatggtcctggatctaggtgcncgcctgaggcggcgaagcatgtcagtgcag

SEQ ID NO: 47813 - DNA, 101 bp, rice(Oryza sativa)
  misc_feature (71): n=t or c
tgcaagattagggatacattatatcttcaagttcggaacagttaaaactcgacaacaagataagggaggtnaggtgaactttttccgagatgaaaaatttc

SEQ ID NO: 47814 - DNA, 101 bp, rice(Oryza sativa)
  misc_feature (71): n=a or g
aattagtttttgttgttgtggcagaatatttgtgatgccttcaaggttgtgccttaattcagtgcacaatncaagggggattattaatcaaagcgatgcga

SEQ ID NO: 47815 - DNA, 101 bp, rice(Oryza sativa)
  misc_feature (71): n=a or c
aattaacggtatcatatgccgaaaatcagagagtaccatggagtgccggagcaacctaattcccagaggtnaactctaatacagtaccactccctccattt

SEQ ID NO: 47816 - DNA, 101 bp, rice(Oryza sativa)
  misc_feature (71): n=t or c
gctcccgagcatcccttataacgcaagccggttcgatcagaaaacgcttatcaacttatgcacggactttngccggttcattcgtcgcgacatctgtaacc

SEQ ID NO: 47817 - DNA, 101 bp, rice(Oryza sativa)
  misc_feature (71): n=t or c
aggatcactaggtttgccgtgttttgtggctcaaggtggatgagcttgtccattgctaattctgctagttntacattgccatggaagctgcaagcaccaag

SEQ ID NO: 47818 - DNA, 101 bp, rice(Oryza sativa)
  misc_feature (71): n=t or g
ccaaggccaggttcctcctccatgtccacctcggtgacaccctttgggagtgaccaattgaagtggtatanaagctgcacaagtgctatctccaagacagg

SEQ ID NO: 47819 - DNA, 101 bp, rice(Oryza sativa)
  misc_feature (71): n=a or g
catgctcagccccgtggggctcctgctgcttcccgtcagcctcgtcttcgtcatccgcatcctctccgacnaccgcagcgccgccgtgctcgccaacgtcc

SEQ ID NO: 47820 - DNA, 101 bp, rice(Oryza sativa)
  misc_feature (71): n=t or c
agcatagatctagaatagcccagtttggttggcaattaggagttggcaagcgcaagccctcttcttttccnaattagcctgcttgaagtagctgctcatca

SEQ ID NO: 47821 - DNA, 101 bp, rice(Oryza sativa)
  misc_feature (71): n=t or g
atactacgaacgagaccacaacatgtggccgcggtgataaaatcataaaacccgaaaggggaaacacaganttgtttgtaactggtactcactcagtttta

SEQ ID NO: 47822 - DNA, 101 bp, rice(Oryza sativa)
  misc_feature (71): n=a or g
atctgggctttgagcaaaaatcaaacaagaagccatgattcctgttcctgacatcttgtatgaggcagacnatgaggactcgatggctagcgactccatgg

SEQ ID NO: 47823 - DNA, 101 bp, rice(Oryza sativa)
  misc_feature (71): n=a or g
caaaattaactctaattttgagtttttaaattggaaagtttgctgatgtcggtaattgagcaagcagacgncaaaagccgcaatctcgaagatttaatcta

SEQ ID NO: 47824 - DNA, 101 bp, rice(Oryza sativa)
  misc_feature (71): n=a or g
gaacatgtattacgagcttaaatgctcatactatgtaaccttgtggttgcatatatcctgcgggatgtagnggccttttttttttctcaaatccattatct

SEQ ID NO: 47825 - DNA, 101 bp, rice(Oryza sativa)
  misc_feature (71): n=t or g
ttctacagcgggagggcatcctggacaacctgctgtcgaacgaggaagaggtggcctccttcttcaacagnctcggcagatgcgccttggtggatgtcagc

SEQ ID NO: 47826 - DNA, 101 bp, rice(Oryza sativa)
  misc_feature (71): n=a or g
tatgccttacggaatacgtactttaatgaaaactgaatactccgtatgtaaaaaaaaaaatccaacctacntaggaatatgacaatgtgacactacctagg

SEQ ID NO: 47827 - DNA, 101 bp, rice(Oryza sativa)
  misc_feature (71): n=a or g
tgctacctactccgactctgcgtgtttgtgtgggagcggagtaatataatacgacacgttttattaaaagncgtgtgtgctggtgtggctggcgcggttgt

SEQ ID NO: 47828 - DNA, 101 bp, rice(Oryza sativa)
  misc_feature (71): n=a or c
tattatctatggtaacttgttaccccacatgaggacatatcacacataggagagcctatgtagagcacatnagtactttacagcaaacattacctacagta

SEQ ID NO: 47829 - DNA, 101 bp, rice(Oryza sativa)
  misc_feature (71): n=a or c
catgcgttccatagcatttacctatttgcctttgtgtttttgcgcctctagaagcttcatcgttttttcanagtcaaagttcaagaaataaggtttctgat

SEQ ID NO: 47830 - DNA, 101 bp, rice(Oryza sativa)
  misc_feature (71): n=t or c
atgtatcatttgtatattgtctttgatatgttgtcttcctccaattacgaatctttcgttggtgcttactnaaaatcattgtccaagaacatagagagaaa

SEQ ID NO: 47831 - DNA, 101 bp, rice(Oryza sativa)
  misc_feature (71): n=a or g
gcaggcagtgcacctaatggttgtacatctacagtaaaggggtcagaagagaggcacagtttggaacgtcntcatgatgatggctcatgtatctcagagat

SEQ ID NO: 47832 - DNA, 101 bp, rice(Oryza sativa)
  misc_feature (71): n=a or g
ggtatagttggctggcgagatgttagtggttgggggaggtggaggtagagggggtcgacaggttggatatnaaagatacactacaacagaaacagaaacag

SEQ ID NO: 47833 - DNA, 101 bp, rice(Oryza sativa)
  misc_feature (71): n=a or g
tgaaattaaaaattatgtcgcggttcacagaccatataactcaatgcttggctatgttgcaagaagaaacnccaaactttcgttaaaagggaaagagaaga

SEQ ID NO: 47834 - DNA, 101 bp, rice(Oryza sativa)
  misc_feature (71): n=a or g
tcaacaagggatacatcttacaaacctaaaagaagggaataaaggtagctatgaattcactacggagtggnaaaaaagcatcgatttgattgggaaccaaa

SEQ ID NO: 47835 - DNA, 101 bp, rice(Oryza sativa)
  misc_feature (71): n=a or g
ccataacttatttttgtttcttatgtttgcaaaagattttgaattggataagcgggcaaacatatgtctanaagtcaactacgtcatacattaaaaaacag

SEQ ID NO: 47836 - DNA, 101 bp, rice(Oryza sativa)
  misc_feature (71): n=t or c
gaggtcatcttccctctttttgacataccatggatgataatttgtgtcccgttgttccaagttaacaatgnactcaggccatcccatgctaacggtggtgt

SEQ ID NO: 47837 - DNA, 101 bp, rice(Oryza sativa)
  misc_feature (71): n=t or c
tccaaggaatctctcgaattgctggacaagcagagaagaaatttcttatgggcaggggatgaaaacttcanagggggaagtgtaaagtcaactggacacgg

SEQ ID NO: 47838 - DNA, 101 bp, rice(Oryza sativa)
  misc_feature (71): n=a or g
gcattcgaaatcaatccaaatatgacagacaacagtggggctgttgttacgagggtatctgattccgttantgttgatccggattttaatgaagccgcata

SEQ ID NO: 47839 - DNA, 101 bp, rice(Oryza sativa)
  misc_feature (71): n=a or g
tccaaggaatctcatgtgggcgagacgcctttgttgcattccatagtcattcagctccagccctacccttntctcctctaaaacctgaattgaaatagaga

SEQ ID NO: 47840 - DNA, 101 bp, rice(Oryza sativa)
  misc_feature (71): n=t or c
gctgggctgtagcttggcccacggcaacgaaattaaaatggcccatttgcacacaaataggtgtcgccacnataggtgtcggtagtactaaaaccggcacc

SEQ ID NO: 47841 - DNA, 101 bp, rice(Oryza sativa)
  misc_feature (71): n=a or g
ttaatattctctcctcttcaagtacatagagacttgtacatagagacggcgagacggcggtgccggatctngcctccacggcgcaggagaccaccctccta

SEQ ID NO: 47842 - DNA, 101 bp, rice(Oryza sativa)
  misc_feature (71): n=a or c
agagcggggaaggaggttgtggcacctgtgataatgaggaagagagagcggggatgatgatgaagtgaggntgcgtggaggagaccactagctgcgtcggc

SEQ ID NO: 47843 - DNA, 101 bp, rice(Oryza sativa)
  misc_feature (71): n=t or c
aacaggcaattcctcatcactccatttcgcctcttgtgcattcatagctttgtgctccagccaagtgaacngaactttgaggttggatatatcaatgtgat

SEQ ID NO: 47844 - DNA, 101 bp, rice(Oryza sativa)
  misc_feature (71): n=a or c
cgattctttttccctcaaccacctcacatcaccattattgttacactattccttttccaccacttatcctnccgtttgcaattaaaaagaataaaaaggga

SEQ ID NO: 47845 - DNA, 101 bp, rice(Oryza sativa)
  misc_feature (71): n=t or c
gagtcaagattgcagggttcagatccaattgtgattaggcttgatgcttctactgttaacgctgttcttgntgatcttttctcctctgttgacacattaac

SEQ ID NO: 47846 - DNA, 101 bp, rice(Oryza sativa)
  misc_feature (71): n=a or g
cgatctcgtcgccctctgccacacggaagtacgaaattcgatgccggagatttcttcaccaccacgagctngacgggccactcctcgtcgacaatggtgac

SEQ ID NO: 47847 - DNA, 101 bp, rice(Oryza sativa)
  misc_feature (71): n=t or c
gacaaatataaggatgacgaggcccaaaaggacaaaaatgaagatgaaccaccaacagggcaatcgggtancccattggactcgacgggcttgctcaaggc

SEQ ID NO: 47848 - DNA, 101 bp, rice(Oryza sativa)
  misc_feature (71): n=a or g
gagatgacaggagaagtatgagaagtgggagaggagggagaaaaatgagtggagagagaggaggttgtggnaaaaaagagtggaaagagagaggagagaaa

SEQ ID NO: 47849 - DNA, 101 bp, rice(Oryza sativa)
  misc_feature (71): n=t or c
cataaatccttctgaatgaaagcagaattccgcaccttaaaagcatcctcgtcggtacaatcatccccgangtaaatagggagaacatttttacagctagc

SEQ ID NO: 47850 - DNA, 101 bp, rice(Oryza sativa)
  misc_feature (71): n=a or c
aggtaacaaatagtattcgtagagggcgctatagcggtaatggccctctaccactatcgctatgacgtagnggaatgtaaatagtacgttggaattattca

SEQ ID NO: 47851 - DNA, 101 bp, rice(Oryza sativa)
  misc_feature (71): n=t or g
cacggaaatcctagatcgaatcttggaaaatacttcctttgttgagaaatattctgaacccctccaaaagncatctgtgtcaagtcgtgaggacccatctt

SEQ ID NO: 47852 - DNA, 101 bp, rice(Oryza sativa)
  misc_feature (71): n=t or g
cgagtcaagaatcagcagcaataatctcgcagcatggatctaccggtcagtgtggccacgccgctgtcatngtccttgtcgagtcatcgtcaagccatcct

SEQ ID NO: 47853 - DNA, 101 bp, rice(Oryza sativa)
  misc_feature (71): n=t or c
atcaaaatttttttttaagttataactcatcgatatggtgattttcactatgtgtgtaaccttctcaatanaaacttagacacacgcattaaattgaactt

SEQ ID NO: 47854 - DNA, 101 bp, rice(Oryza sativa)
  misc_feature (71): n=t or c
tgtggtgcctcagccggctgcgattgtgcgagctcaagtgtgtcgtggcattcgtgaaattttggtacaangggttgatttgtcagcagaagaggcatctt

SEQ ID NO: 47855 - DNA, 101 bp, rice(Oryza sativa)
  misc_feature (71): n=t or c
ttctgttatttttttttcttcaggaaaaatgaagaacagagtaggtcatactccatacctgctccaggctntagagatagaaccggagcctcggctgctgg

SEQ ID NO: 47856 - DNA, 101 bp, rice(Oryza sativa)
  misc_feature (71): n=t or c
gagtagcaacatgttaatggagcacgttggcttttcgattccaagatctgaaatattttactactccctcngtttcaggttacaatactttctagcatgat

SEQ ID NO: 47857 - DNA, 101 bp, rice(Oryza sativa)
  misc_feature (71): n=a or c
cgtcaggaggaagagcagggcgctggcgtctagggttaaggtgttcgtctccaagatcatagaggagcacnagacgaggagagatgccaagtacggcggct

SEQ ID NO: 47858 - DNA, 101 bp, rice(Oryza sativa)
  misc_feature (71): n=a or g
ggaaggtatgtgcttgctactatttttcttcattcatttgaacccaattagcgccacctcacatgcccatntttgttctcaggttatgcaagacctttagt

SEQ ID NO: 47859 - DNA, 101 bp, rice(Oryza sativa)
  misc_feature (71): n=t or c
tacaccacgtgtctatatctgatcctactactgaaaacaaaacaagtacatgacaccccggggaatggttnttctaaaggacgcctcgacactccggggaa

SEQ ID NO: 47860 - DNA, 101 bp, rice(Oryza sativa)
  misc_feature (71): n=t or c
ggcggccggaatagtagctggcccgccgccgtcagcttaattcgtcaataaaatataatggacgtttgtcnggcctgcaatcggccactgcatgcgtgatg

SEQ ID NO: 47861 - DNA, 101 bp, rice(Oryza sativa)
  misc_feature (71): n=a or g
tcagttcggttttcacgttttccgtgccagctgaagttacaaatatgggcctgctaatgcgcagatgggcntgcgtttagtcgtctgcacagcacacacta

SEQ ID NO: 47862 - DNA, 101 bp, rice(Oryza sativa)
  misc_feature (71): n=a or g
cacacggtgtgggaatgtaagggtacttccggtttcttgcccatgaagaacgtacagctactgacatcttnttggtgcggtgaatgtaataaattctcatc

SEQ ID NO: 47863 - DNA, 101 bp, rice(Oryza sativa)
  misc_feature (71): n=t or g
gtgcccccaagcaagatccttgtggctttccatgtatgatgcaggaacaattttgtccgtaccggctgtgnggaggatgaacccaaattggttattcgatc

SEQ ID NO: 47864 - DNA, 101 bp, rice(Oryza sativa)
  misc_feature (71): n=t or c
aaggatagccatgaagaccttgtttgtttcagcatcctgccgttttggtttgatgaagaacatcgactgcngggttctgaaaagggtgtatacattcgtgg

SEQ ID NO: 47865 - DNA, 101 bp, rice(Oryza sativa)
  misc_feature (71): n=a or g
actatggtgtgtggcatcttacttttcccttgaactcaccgtgtcgtggtgctctcaatgtcccaggggtncacacagtgaggaagtgggggtattgaggg

SEQ ID NO: 47866 - DNA, 101 bp, rice(Oryza sativa)
  misc_feature (71): n=t or g
atgccattggtcacgcgtggcatgtcaaagggtgcctcatggcagacgttgtcgttgacaagatcaatctngcgctgacgtggcacttctgccacgcctag

SEQ ID NO: 47867 - DNA, 101 bp, rice(Oryza sativa)
  misc_feature (71): n=t or c
attaccatcgtgggagataccccctaccaacctatgcacgcatgggtacctccaagggaaacatcccacangaatgacgaatgggcatagataaccacaac

SEQ ID NO: 47868 - DNA, 101 bp, rice(Oryza sativa)
  misc_feature (71): n=t or c
ctggaacttacttcagataggagcggagtacgaatgaagcctggcgcaacacagttaactctgatcccatngttcgcccactcagcagccaggttccttgt

SEQ ID NO: 47869 - DNA, 101 bp, rice(Oryza sativa)
  misc_feature (71): n=t or c
gggatagcggctattgggccgtgaaaccatattcgcgtttgtgggctgcgggcctttacaagggtgaaacnatatttggagcaataagtccatttcagata

SEQ ID NO: 47870 - DNA, 101 bp, rice(Oryza sativa)
  misc_feature (71): n=a or c
agcactagcagcatgccaacttggttctttattgcaactcctatttttcagctgcgcacagcagcagcagnagcagcagaagccagcagggagaggaattg

SEQ ID NO: 47871 - DNA, 101 bp, rice(Oryza sativa)
  misc_feature (71): n=a or g
cttcatgccccttatttggtaaacagaggtgcaatttatagaatacattgttgttccaaagtgccttacantgaaaaagaaatatctacattacttgctat

SEQ ID NO: 47872 - DNA, 101 bp, rice(Oryza sativa)
  misc_feature (71): n=t or g
taaaacacagaagaaattccctcgttccaaacgcggcgaaaagggaaaccaacaatttcttcgaaaatcantgtaacattcaagttcatctgaggcaaact

SEQ ID NO: 47873 - DNA, 101 bp, rice(Oryza sativa)
  misc_feature (71): n=a or g
aataaatatcactgcttaaagcctcaaacctcacacctaatgtcagaaaaaaaaaagaatacaaatgtagncggcggcgaatctagaacgaaaaatacaaa

SEQ ID NO: 47874 - DNA, 101 bp, rice(Oryza sativa)
  misc_feature (71): n=t or c
atctttggacaaagctgtaactaggatcttacttccccgcttcccaaaattcagtgtattacgtacttggncccgttcttgctgagcaacatccgactgga

SEQ ID NO: 47875 - DNA, 101 bp, rice(Oryza sativa)
  misc_feature (71): n=t or c
tgtattgtactttacattttgttagtagagtgggggagtgattccaaacataatgggctataatacatganacgtgatcggcggctgcacgaccgtacaac

SEQ ID NO: 47876 - DNA, 101 bp, rice(Oryza sativa)
  misc_feature (71): n=a or g
ttgcaaggtaagagaaaatctagcaagtacaagtccaatgatgatttgttgaatgaagaaaataagttacnaaagatgaacaaaaaatcaagctctaagaa

SEQ ID NO: 47877 - DNA, 101 bp, rice(Oryza sativa)
  misc_feature (71): n=t or c
aactgatggtgtagcatatgatggctatagtgatgttactgttgaggaaccattggatggagcagacatanctgtgaggcctcctatggatattgttattc

SEQ ID NO: 47878 - DNA, 101 bp, rice(Oryza sativa)
  misc_feature (71): n=t or c
atgtacatagtactgctagtatattaataagactacacataacaaggcgtcaaggtcaagttgtgggttgnggcctagtttggagatcctagtttctggtt

SEQ ID NO: 47879 - DNA, 101 bp, rice(Oryza sativa)
  misc_feature (71): n=t or g
gatactggaagcgctgcacgcaaaggatgccaagcgccagaacgatggcaatggcgcattaacagtggctnctcagcaggcaggggatgcactgaacacca

SEQ ID NO: 47880 - DNA, 101 bp, rice(Oryza sativa)
  misc_feature (71): n=a or g
atgggtaggtggtatattatccgacattatccgtatccggttccgaattcaaagcaagatactaggttaangccttgtttggttcacagggactaaacctg

SEQ ID NO: 47881 - DNA, 101 bp, rice(Oryza sativa)
  misc_feature (71): n=a or g
tcgtcgattcttcagtcaacgagttggtatcagagcgagttctcacccccttcctgatgagctctcttctnctcattactagtgacattgccagaacgatt

SEQ ID NO: 47882 - DNA, 101 bp, rice(Oryza sativa)
  misc_feature (71): n=a or c
aacttcgaccgttcgacgtcgcggatcagttggtcaaataaggacgaaacacaccatatttcgtgctatcnatcatgataatttgaacagcaaaatagaac

SEQ ID NO: 47883 - DNA, 101 bp, rice(Oryza sativa)
  misc_feature (71): n=t or c
accgaagatcaaaatctacggccaccattaaaatttgagtggcatgggacttcctaccacggaatgaagantcaacattcttacgaacagaggctctaata

SEQ ID NO: 47884 - DNA, 101 bp, rice(Oryza sativa)
  misc_feature (71): n=a or g
cacgtggctcctgacctcatgttctttttctgtagtttcaccagtaactaagggtaagggcatgtacaatngtgtctaataacaggctctcttcgttatca

SEQ ID NO: 47885 - DNA, 101 bp, rice(Oryza sativa)
  misc_feature (71): n=a or g
atggaggtgaaaaggttttgatgcttattggatgagatgggagaaagtggtcaagtttgggtggtgcattnaattttagctggtttcatgagaaaacaaga

SEQ ID NO: 47886 - DNA, 101 bp, rice(Oryza sativa)
  misc_feature (71): n=a or g
tgtgcgggacgatgtcgatgagtatcgccgaaattacatcttcaatcgatccagagataacccggtcctcntcacaccggtaagtactgctctctccatcc

SEQ ID NO: 47887 - DNA, 101 bp, rice(Oryza sativa)
  misc_feature (71): n=t or c
ccgaatccaaatttgagaaaaaaatataaaactcatggaagcggtacttgaattgtataactagttaaacnctatatctatatccaagccctgaacgagtg

SEQ ID NO: 47888 - DNA, 101 bp, rice(Oryza sativa)
  misc_feature (71): n=a or g
ctggaagacactgtaagaacgtgtttttactgaaagacgcggtaaaaaaaaggtaaataggatacccacgncattatttaactaaatcaagagagaatgga

SEQ ID NO: 47889 - DNA, 101 bp, rice(Oryza sativa)
  misc_feature (71): n=a or g
ccgcacttggatctagctaaggtagagcaactggcatggttggagaaggtaggagatggctacaggcgtcngtagtggaaggctggcacggaggcgtggct

SEQ ID NO: 47890 - DNA, 101 bp, rice(Oryza sativa)
  misc_feature (71): n=t or c
taactttgataattgttctcgttttttctaaactctagtaataatgaatcccccccctccccccctaaaangtctaatactacagatattcgaacagattt

SEQ ID NO: 47891 - DNA, 101 bp, rice(Oryza sativa)
  misc_feature (71): n=a or c
cggcaccggtagtataaagtggtagaagaaggaattgcccatctaaaatggacatattcttgaattgaagnatactgttgtatgaaagaggcatggtttag

SEQ ID NO: 47892 - DNA, 101 bp, rice(Oryza sativa)
  misc_feature (71): n=t or c
gtgatctccaccttcagatccggtatgcacctcatctctacagctactatctgccagtatacggttaaggnggtggcacgagttcgattgggaggtgggta

SEQ ID NO: 47893 - DNA, 101 bp, rice(Oryza sativa)
  misc_feature (71): n=a or g
gtagacacgattggtgtattagtgataaatttctctgtaaatataaatatatggtcccttgttttaaaatntagctaggaaatagttatattttaggatta

SEQ ID NO: 47894 - DNA, 101 bp, rice(Oryza sativa)
  misc_feature (71): n=t or g
gttttagatgcccataaaaatgatttcttttgtttttaaataaaatagcgacctttctgtgcagagtatcnttgtgctattagctcttaaattttgtactt

SEQ ID NO: 47895 - DNA, 101 bp, rice(Oryza sativa)
  misc_feature (71): n=a or g
acctttttgttagtttgtgtggtaaccacattcagtacttattaagtgcaaatcatgcgacattgacccgntttaattaattttgttctgtgaatattgat

SEQ ID NO: 47896 - DNA, 101 bp, rice(Oryza sativa)
  misc_feature (71): n=t or c
tttagacccttaggcatttagaatgcttgttatggacgcagtaaatacgtcatgaaaaatgtacccggttnacaagccacagcagtaactctttactcact

SEQ ID NO: 47897 - DNA, 101 bp, rice(Oryza sativa)
  misc_feature (71): n=t or c
attaaaccaataacatagtcattgatctcatcaactgttatattattaggacaaacaatcgcacggctggntaagtattcaatatccttgtaagaatgaag

SEQ ID NO: 47898 - DNA, 101 bp, rice(Oryza sativa)
  misc_feature (71): n=a or g
ggcggcgaccacatcgcaccgggccacctgaacgaagcacaagcagaaaacgaggacggccgcgatcacanctcggtggttcgccatggcgcgctcgctcg

SEQ ID NO: 47899 - DNA, 101 bp, rice(Oryza sativa)
  misc_feature (71): n=a or g
accttattgttgtcatctttggtactgaagtacaacttagcgttgtatacttggcgctgggaacattgctntatggtcacgcagttcatatcactaggggc

SEQ ID NO: 47900 - DNA, 101 bp, rice(Oryza sativa)
  misc_feature (71): n=a or c
gactcataatatgaaacaaaggactactgatttgctagttgtttccctgtcgaataaaacagattgcattnaatttaaaaattggtgctaaaatcgcggaa

SEQ ID NO: 47901 - DNA, 101 bp, rice(Oryza sativa)
  misc_feature (71): n=a or g
ctgctcgttaaccaactcttggtcacgtaaaccatcatcctcggtgtcacttgctgagtccaattcacccntctcattcacaatcatggtcctcctactag

SEQ ID NO: 47902 - DNA, 101 bp, rice(Oryza sativa)
  misc_feature (71): n=t or c
ggaactatactctccaaatatccaaataatcagggatcgtgctgcaggctccttaattttgtccaggctgnggaccaagcgtacaatcaccttcaggaaaa

SEQ ID NO: 47903 - DNA, 101 bp, rice(Oryza sativa)
  misc_feature (71): n=a or g
ccgcggctccgaccgcgacggacgtcgatttgggaggaaatgggttaatggaatggatgcacttgcagttncagttaagttaaccagagctttgctttatt

SEQ ID NO: 47904 - DNA, 101 bp, rice(Oryza sativa)
  misc_feature (71): n=a or c
gcaaaagaaaatgcacacatgtgtccctgttgtctatacgtggggcataaggttaattgacagcttgtacntaatatatatgcatgtggatcgctgaccaa

SEQ ID NO: 47905 - DNA, 101 bp, rice(Oryza sativa)
  misc_feature (71): n=t or g
gtttctttctttcagagctgagaatgctcaacccccatctcagacaagcgcgaaagcagcctcctctccancttcacgccggccaactccgcctccctgat

SEQ ID NO: 47906 - DNA, 101 bp, rice(Oryza sativa)
  misc_feature (71): n=t or c
tctaacatatacatgttagagtcagtataaatacataatctaacctaatcctactaaaaacgtacccacangtatgtaacaccagtcaacacacaaacata

SEQ ID NO: 47907 - DNA, 101 bp, rice(Oryza sativa)
  misc_feature (71): n=t or c
ctcgagaaatctcacaccgtcctcctccgttttcgccactaaaaccaactttgccctctctctctctctcnggcgatctccctgacgcacaaggcgatccc

SEQ ID NO: 47908 - DNA, 101 bp, rice(Oryza sativa)
  misc_feature (71): n=t or c
agggagccactgtcatcaaactacagaccttagtattgccgatagcgaataaattgatatgttcatgttgntcacgatttctcataataaggcctaagagg

SEQ ID NO: 47909 - DNA, 101 bp, rice(Oryza sativa)
  misc_feature (71): n=a or g
gacaacaaaataggacaaataccttgctcagatttattatgttaggataggtcacatcttatcctatattnattctttttggaacggaagtacttgactag

SEQ ID NO: 47910 - DNA, 101 bp, rice(Oryza sativa)
  misc_feature (71): n=t or c
aacaaacagagcccttccagtctgatggctcatggctgtgtgaccctgtgaatccagcattgtgtgtgcgngcgcgcgtcatgaattgtcaaaaattatgg

SEQ ID NO: 47911 - DNA, 101 bp, rice(Oryza sativa)
  misc_feature (71): n=a or c
ttagtactgtttggtaggctaatttgtagacaactctgaatttgctgccagctaatcaagctagaccaacnacgtctgtaaacatatatatgcagagtacc

SEQ ID NO: 47912 - DNA, 101 bp, rice(Oryza sativa)
  misc_feature (71): n=a or g
actccgtacattctcgctcgtccgagaatgatcaagcgagaacgacattgttattccaaggttttcggtcnagaacatcaactcgttcatttgcgttgatt

SEQ ID NO: 47913 - DNA, 101 bp, rice(Oryza sativa)
  misc_feature (71): n=t or c
gcggtgccattatttcgggcatcaaagcaaagtatagcatgcttggcaaggaacgaattgaacctaagccntgtttagtttcaaagttttttttcaaactt

SEQ ID NO: 47914 - DNA, 101 bp, rice(Oryza sativa)
  misc_feature (71): n=t or c
gtctgcggggtggacggtaggcgttgtgtttcctgggaagacctgcctcaagccgaactgcctcatcacangctgggggcagtgaggctcgatgtagatgt

SEQ ID NO: 47915 - DNA, 101 bp, rice(Oryza sativa)
  misc_feature (71): n=t or c
tgagctctactgctccattcgctgttcctacgtcgcaggcagcgccatatccatatgggggtctcgggttnccgccgccaccgacagcttggcttgcttct

SEQ ID NO: 47916 - DNA, 101 bp, rice(Oryza sativa)
  misc_feature (71): n=a or g
cggatccgtccttcacaagactggcaccatcaacgccgccactactggggtcacaacgatcaatgttgccnctcgcatgcatatcggcagtggatccatca

SEQ ID NO: 47917 - DNA, 101 bp, rice(Oryza sativa)
  misc_feature (71): n=a or g
gaggcatcttggacgaaggatgtatggcaaaagcggatggattcgccataacaagttcaacttcaaggagncccaagaggccatctcagccaatcaagccc

SEQ ID NO: 47918 - DNA, 101 bp, rice(Oryza sativa)
  misc_feature (71): n=a or g
tgtcaaacttgccaacgggagggccttgaacaagagggatcttggtgatcttgacgtcgcagagatatagnatcttctagaatgcgactttgtttatatac

SEQ ID NO: 47919 - DNA, 101 bp, rice(Oryza sativa)
  misc_feature (71): n=a or g
ttgaagaatttccatataaacttgttcagctttcacatgaatcgtgtaagaatttcggctgtctaaacggnggcctaatcgatgccgtggcgcgccatgca

SEQ ID NO: 47920 - DNA, 101 bp, rice(Oryza sativa)
  misc_feature (71): n=t or c
tttatacgtgaatattatttgcaacccaattttactaaatacattagagatgtgtctatgacgtgtgggcncagaaaaattcaaatatcacacgatgtccg

SEQ ID NO: 47921 - DNA, 101 bp, rice(Oryza sativa)
  misc_feature (71): n=t or c
ttcaccacaggcaagtaggccaactgcatattgatttttaggtatttgttttgggtcacgaccagactganggtattccttcagaacatcttgacatatcc

SEQ ID NO: 47922 - DNA, 101 bp, rice(Oryza sativa)
  misc_feature (71): n=t or c
agccgattcacattttgcccactatgctgtgactgctcccttaccaacaaccgagggttaattagttgacntggtgccgatgacggtgcagcaggtgcagg

SEQ ID NO: 47923 - DNA, 101 bp, rice(Oryza sativa)
  misc_feature (71): n=t or c
cacacgactactcgatcggttcattaattctacttacacactgtaattagcactaccattacacaattacnggctagtacacctccatctcaaaataaatt

SEQ ID NO: 47924 - DNA, 101 bp, rice(Oryza sativa)
  misc_feature (71): n=a or c
gaccaccgtcagcaaggttggtgatcaagccgacgacgtacggacagtgagagagcaaagaaaatgtggangtgacagtgtgagtgagtgagagtgagagc

SEQ ID NO: 47925 - DNA, 101 bp, rice(Oryza sativa)
  misc_feature (71): n=t or g
tctttatcatgatgataatcttggtttactggacccaacctccaatgaacaggtaccctcttttgactcanccgattacctctattataggatcggcttga

SEQ ID NO: 47926 - DNA, 101 bp, rice(Oryza sativa)
  misc_feature (71): n=a or g
ttcatactgcattgggcaagtcaccgtatgaagtgttgtttgctcgaaagccgacgcactttggggtggtngatcttggacagagtactgttccggatgtg

SEQ ID NO: 47927 - DNA, 101 bp, rice(Oryza sativa)
  misc_feature (71): n=t or c
aaacctagcattgtcgccacatcatctccccgtgtgttttatccccctattgaattttgtggatttgttcnaattttgagaaaaacggaaagagaagatcg

SEQ ID NO: 47928 - DNA, 101 bp, rice(Oryza sativa)
  misc_feature (71): n=a or c
aacagattgatagggctagtttagtacagtaatttagtttggtagagcagcctgcagttactccaatcagncgtcacgtacggttttgagaggcgaacccg

SEQ ID NO: 47929 - DNA, 101 bp, rice(Oryza sativa)
  misc_feature (71): n=t or c
aatgtgttaggtcgtgttcttaagtgaagattcccaaccttcacttcctcgtttaccacatgtacacctcncgaattactaaacaatgtgatttttgtaat

SEQ ID NO: 47930 - DNA, 101 bp, rice(Oryza sativa)
  misc_feature (71): n=a or c
cgcggcctcacatccggcatggcctcctccaaccacaatcacatcgtatcgctcctcaagacttgtcgagnctaatgccagaatagcagaaacccatccat

SEQ ID NO: 47931 - DNA, 101 bp, rice(Oryza sativa)
  misc_feature (71): n=a or g
tgaaacagtcctacagtgaagcactcgtccttcatcatgattttccctggtgatggcgagtactccttccntccaaaaaagaaccaattcctggctatgaa

SEQ ID NO: 47932 - DNA, 101 bp, rice(Oryza sativa)
  misc_feature (71): n=a or g
aagcggtcaatcacatgtttcttgcaatcccttttccactggttcgacctgacatgcagcccctctctacnacagtgatagggtccgatggaaatgtagct

SEQ ID NO: 47933 - DNA, 101 bp, rice(Oryza sativa)
  misc_feature (71): n=t or c
tcatgttttattcgttaaaatgtcgtttggcttattccaaatgatggggctgctagatgacagtattactncgtcccactatataaggaattttgagtttt

SEQ ID NO: 47934 - DNA, 101 bp, rice(Oryza sativa)
  misc_feature (71): n=t or c
aacgctcgttgtcaaaggacttgtacccattgctctcctcgaactgaaccagacgatgctttgccatgcantgcaggaacaggcgaagaaccagcagcacc

SEQ ID NO: 47935 - DNA, 101 bp, rice(Oryza sativa)
  misc_feature (71): n=t or c
agagaaaacaagtatagaattgctagttggcgattacgcgccattagcttaagtcgcgtgcattttttttncccaaggctccgtatgcggtccacgtactc

SEQ ID NO: 47936 - DNA, 101 bp, rice(Oryza sativa)
  misc_feature (71): n=t or c
ttgatttttagaaacctgtttacccatgtagttcaacaacttgtgtattatataggaagaggattttgatncctcgaggggatatcccctcgttgtttgca

SEQ ID NO: 47937 - DNA, 101 bp, rice(Oryza sativa)
  misc_feature (71): n=a or g
cactgccccggttaactgtaggtttcactaactgtcagctgaatcagtgatcaacatggcagggacggtgngcgtgccgaccatgtccatggagatggagc

SEQ ID NO: 47938 - DNA, 101 bp, rice(Oryza sativa)
  misc_feature (71): n=t or c
gcgacggcgaaagagactccaccgaaatccgcacactggtcaccaccaaaccaccactgctacaactaacngtgtggcccgcgccccgggtgacaaaggcc

SEQ ID NO: 47939 - DNA, 101 bp, rice(Oryza sativa)
  misc_feature (71): n=t or c
ccgattcccttcaccacaaccatcggcagaggagcctcaaagtgcttgatgtactgatcagcaaccacatnattgcccaccagctctccttgttgcaaaat

SEQ ID NO: 47940 - DNA, 101 bp, rice(Oryza sativa)
  misc_feature (71): n=a or g
aaacggttactatggacttcattgaagggcttccaaagtccaggagatttaattgcataatggtggtggtngacaagttgtccaggtatgctcattttctg

SEQ ID NO: 47941 - DNA, 101 bp, rice(Oryza sativa)
  misc_feature (71): n=t or c
tcgcatagagtgtgttgttaactacgaagaaatagggactgcatcattagtattaacgatccatcattttnattcgtcctaacattgtagcagctaggcac

SEQ ID NO: 47942 - DNA, 101 bp, rice(Oryza sativa)
  misc_feature (71): n=t or c
tgtgacttataaggactaaggtaaggtgtgcccggatcttaggactgggcggtgtgcccagatcttagganggggcagtgtgacttataaggactaaggta

SEQ ID NO: 47943 - DNA, 101 bp, rice(Oryza sativa)
  misc_feature (71): n=t or g
gtccggataggatgcagggacacggtacgtgtatgcatggataccgaaaaaattagcaggttgagaggagnagtccgtggtagagttgtattcgtaattga

SEQ ID NO: 47944 - DNA, 101 bp, rice(Oryza sativa)
  misc_feature (71): n=t or g
catgtatgaacagatgggctgcattatataaagatagtaggcctcttgggtcatcggctaatgataattcnttattgaaagtgccatgatcacctttgaat

SEQ ID NO: 47945 - DNA, 101 bp, rice(Oryza sativa)
  misc_feature (71): n=t or c
atccgattgacccgcaggccgcaggcagtggttgctcaatgcacattttgtttcagtactttatggaagcntcctcatagctacatgcctgcatttttttg

SEQ ID NO: 47946 - DNA, 101 bp, rice(Oryza sativa)
  misc_feature (71): n=a or g
cctatctacacgtgggcttgctcctgtcactgcacaacagcgacaccactacattacatccatactcgctngaatggactgtgagcaggccatatgtgttg

SEQ ID NO: 47947 - DNA, 101 bp, rice(Oryza sativa)
  misc_feature (71): n=t or c
cataaaaacaagcacgtgttaaataaaggatttgaatccgggtggatttattccatcacaagaatctaacnagttaagctatgcttacttcgcttttgcca

SEQ ID NO: 47948 - DNA, 101 bp, rice(Oryza sativa)
  misc_feature (71): n=t or c
caacaacactgcagccgtccttctgaacagtggaaacctcgtactgcaagacacctcgaacatgtcccaanctcgtacgctgtggcagagcgtcgaccacc

SEQ ID NO: 47949 - DNA, 101 bp, rice(Oryza sativa)
  misc_feature (71): n=a or c
ctcaggaggacaattccccggagcttcacctcatgggataataccaaagcagttcagcagagcgcctcgtnttcgtgtcagtataagaggtatgaggtacc

SEQ ID NO: 47950 - DNA, 101 bp, rice(Oryza sativa)
  misc_feature (71): n=a or g
aagcatcgagtacgggatgccaagtatgcacagcgtaatggagacgcccagcaacccaacattggccatgntggaaccgagcggcaccaaggcaggatcgg

SEQ ID NO: 47951 - DNA, 101 bp, rice(Oryza sativa)
  misc_feature (71): n=t or c
ctgtggaatccctaccatccaatccgtcctgcacgattgtcctctgaccctaccggagtgttctgcagttnccaaagcttcggttagctcatcatgctgct

SEQ ID NO: 47952 - DNA, 101 bp, rice(Oryza sativa)
  misc_feature (71): n=a or g
cgaagcgaggatgaaattgtaagtggagaggtatctgtaagtgggccagcccgtcggatagactggctacncggttctggagggagggctgttacaaatgg

SEQ ID NO: 47953 - DNA, 101 bp, rice(Oryza sativa)
  misc_feature (71): n=t or c
ctgagagctaagctcagcttttctcgaaagggggaaatggaagagaagatattacaaacctgcagtcgcgngtgaaatcattatagtaaagccgagcaaaa

SEQ ID NO: 47954 - DNA, 101 bp, rice(Oryza sativa)
  misc_feature (71): n=t or c
aaaaccatttgctatccatagttggatcaacatgtccttctccatctcatagtccttgcagaaaattgcanagaaggtgaagcattgtttcatttcagatg

SEQ ID NO: 47955 - DNA, 101 bp, rice(Oryza sativa)
  misc_feature (71): n=a or g
atgaatttgtgcgtatatcattgagcttgagttatatgggatgttgggcttgtgccatattgtatattggntttatgctattggatgttatctgggcttgt

SEQ ID NO: 47956 - DNA, 101 bp, rice(Oryza sativa)
  misc_feature (71): n=a or g
ccatccaacatgtttcccatcaatagcaggtatgataatgcagaaaggttgccaatagaagcaggaatggntcctgttagttgattcattgaaagatgcaa

SEQ ID NO: 47957 - DNA, 101 bp, rice(Oryza sativa)
  misc_feature (71): n=a or g
aggagatcggctgcagtaaagtgactgaatggattgcattcatttttactgagccttcacaccaaaattgnaagtttggttgaaattggaatgatgtgatg

SEQ ID NO: 47958 - DNA, 101 bp, rice(Oryza sativa)
  misc_feature (71): n=t or c
tcggtatagatcttactgccagagtatgctccattggactgaccaccatgatgattttgcaccactgcttngctttgcatttctcttagaaaactgccgct

SEQ ID NO: 47959 - DNA, 101 bp, rice(Oryza sativa)
  misc_feature (71): n=t or c
catttatagagataagtttcatctatctatagtctactgaactctcgtgccatacaagttgtcgtcactangtcggtcatcatcccagtgaaaacatttac

SEQ ID NO: 47960 - DNA, 101 bp, rice(Oryza sativa)
  misc_feature (71): n=a or g
ctctgcattttgcccacgcatctggtcatctagttggaggcctgggccgcgctagctccaaagctcacaanggctccgcctccgcgtcagcgactgagcgg

SEQ ID NO: 47961 - DNA, 101 bp, rice(Oryza sativa)
  misc_feature (71): n=a or g
cgggcaggcacccgcggtcgtcgcgtcgacggcgaagcaaaggagagtagagatatagcggtggggaattnaggggcgcgtacgatcccgatcttgaggtg

SEQ ID NO: 47962 - DNA, 101 bp, rice(Oryza sativa)
  misc_feature (71): n=a or g
catcattttgtggttcaactgaatcagttggaccttcaaccattacattacttgaggtggtctttgttgcnattttgtcttcatcaaggttcaactttgag

SEQ ID NO: 47963 - DNA, 101 bp, rice(Oryza sativa)
  misc_feature (71): n=t or c
gttcgaggagaggggatcgaatttggtctgattcgagatagtcacaatcaccttcagaagccgatcgaccngagggggaaaatggtacttccaacactctt

SEQ ID NO: 47964 - DNA, 101 bp, rice(Oryza sativa)
  misc_feature (71): n=t or c
gaaattatattgcgtctgaagagttccaatttgagacccagttttgttctctctacatagagaagttttanagtgtttacgaggtacgtagaggtattgag

SEQ ID NO: 47965 - DNA, 101 bp, rice(Oryza sativa)
  misc_feature (71): n=t or c
tcttcgaaatgatcatcctctgcgacatcagaagattctgtaaactcatgttgttggggttcaagtgtacntgtctcaggctcatcttcggtgtattcagc

SEQ ID NO: 47966 - DNA, 101 bp, rice(Oryza sativa)
  misc_feature (71): n=a or g
cgcgttttcactgggatactttcctcgatgaatacagtgatcgatctatcacgcaataagggaagctttgnattgtagcgaagcctaatatatcacgtagg

SEQ ID NO: 47967 - DNA, 101 bp, rice(Oryza sativa)
  misc_feature (71): n=a or g
ttcaaatgagactgatgtcatttatgtgggtagtttgaaggttcaggtagatcccagtgagcaggatcaanttgcacagaagcttcttagagattaccgat

SEQ ID NO: 47968 - DNA, 101 bp, rice(Oryza sativa)
  misc_feature (71): n=a or g
cacaccaccagtgcagagagaggagcactggggcgaacagcagagcaactgaaaggaagaaaatatggggngaggggggatgacggtcaccggtcacccct

SEQ ID NO: 47969 - DNA, 101 bp, rice(Oryza sativa)
  misc_feature (71): n=t or c
caggacacccagcagcactgccacaacaagtcagcaatcaaagtctccatgcgcatgtgcatgctggtaanctctaccactatgtgcatacataataaatt

SEQ ID NO: 47970 - DNA, 101 bp, rice(Oryza sativa)
  misc_feature (71): n=a or g
acaccatcaccgcgcaagggcgcaaccactccgagcccgtcgtcgcacgctcgggtttcgtatttcaggantgcaacgtgtcgaccaaggaggacctgagg

SEQ ID NO: 47971 - DNA, 101 bp, rice(Oryza sativa)
  misc_feature (71): n=t or c
gaacaatgataatataacttaattaccaattgttgtcgtgctgaactaaacatgtatatgtctgtcaggtngccacagcaattggtgatctaggggaatct

SEQ ID NO: 47972 - DNA, 101 bp, rice(Oryza sativa)
  misc_feature (71): n=t or c
tcctctctatttatacatgaaaattctcctactcgaaataggagtaccactcgtcaaactatgactctatncaaattagtctcctaaagcctgcagcctca

SEQ ID NO: 47973 - DNA, 101 bp, rice(Oryza sativa)
  misc_feature (71): n=t or c
cgcaccttcgtgcgagatccattgtcgagctcgtcggcactccagcccagcgttggaagctcttgcccgcngccggtggctgacccgctggccgttccagt

SEQ ID NO: 47974 - DNA, 101 bp, rice(Oryza sativa)
  misc_feature (71): n=t or c
cttaatgctttcgtcgtcccagattaaacagtcccaccagaatgtttctcctatcgtcgtgacaaatggantgttttcatcaacgccaacagggatttttc

SEQ ID NO: 47975 - DNA, 101 bp, rice(Oryza sativa)
  misc_feature (71): n=t or c
gtttaataatttttgttgaataattcggtccaagttgttgggcagttttggaattgtaaacggggacatgnattttgttttagttataccaatcgatcgca

SEQ ID NO: 47976 - DNA, 101 bp, rice(Oryza sativa)
  misc_feature (71): n=a or g
atcctctaatgttgtagagacgagagacgacgggcaattgggaatttgaggataatagaaattaggatagntaccaagaaggagggagatgtagaatatag

SEQ ID NO: 47977 - DNA, 101 bp, rice(Oryza sativa)
  misc_feature (71): n=t or c
tgtatacagaagttcaacgccgattatagttgaacactgccaatctatggagatcaatggtcggatgagtngtttcacaagattttgtcacacgtacgttt

SEQ ID NO: 47978 - DNA, 101 bp, rice(Oryza sativa)
  misc_feature (71): n=t or c
cacgcgttccatttggccgttggtctgaggatgataagaagagatcatacgcaattgtgttccggccaatnggaacaaagaagtccacaaggtactagtaa

SEQ ID NO: 47979 - DNA, 101 bp, rice(Oryza sativa)
  misc_feature (71): n=t or c
tgctgagtgtgacttcccgtgcgtcaatagcatacagcacacggtaacgctaaaaagcttaccgagtgccngatggtgctgaactctcggtaacgctaaaa

SEQ ID NO: 47980 - DNA, 101 bp, rice(Oryza sativa)
  misc_feature (71): n=t or g
atgcagatgtcagacatgggagtcaaacctaatcaatatacatttgtcggcttagccatcgttgcatcaanaactggtgatgtgaacctatgtcgcagcat

SEQ ID NO: 47981 - DNA, 101 bp, rice(Oryza sativa)
  misc_feature (71): n=a or c
cgccggcgccctgatggcttcaaccattggccccttccccttgccgggttgcttgatagcatagcaagtgntctccaacggtcgcagctgtgaggtacaaa

SEQ ID NO: 47982 - DNA, 101 bp, rice(Oryza sativa)
  misc_feature (71): n=a or g
tggcttttgtcctgcacaaatgagcgagcatctcaaattatgcatactagaaaggaaagggagagggaaangaatctaactccaagcataaccagaggcgt

SEQ ID NO: 47983 - DNA, 101 bp, rice(Oryza sativa)
  misc_feature (71): n=t or g
gggcgagggcagcgaggagctgaggtggagtcgtggatgaggggctagctgttggcggcgcattttttcangaagaatttatacaatttcatatataccac

SEQ ID NO: 47984 - DNA, 101 bp, rice(Oryza sativa)
  misc_feature (71): n=a or g
ggcgctgcatttcccagttggtttgaagactttagatagtcgaacaaacaggcgacaaatcgaattttcgnaaaaaaaaattgtccgtgcaaattaacaaa

SEQ ID NO: 47985 - DNA, 101 bp, rice(Oryza sativa)
  misc_feature (71): n=a or g
caagattgatatgatgaaggcatatgatagagttgagtgggcttatctttcgggttgcttatcgaaacttngtttttcccaggattggatcaacactgtga

SEQ ID NO: 47986 - DNA, 101 bp, rice(Oryza sativa)
  misc_feature (71): n=a or c
ttggacgatccgtcatcgatcgacgagcgcccagcaaagctggatcgcgtccatttttgttacatgatatnattcatatagtgtttttttttttgggtcta

SEQ ID NO: 47987 - DNA, 101 bp, rice(Oryza sativa)
  misc_feature (71): n=a or c
tctaatactcaggcaccgagtctaatatgtataggtatcgggtctgataattagataccgagtttgatatntagaagtatcgggtctgagactcaggtatt

SEQ ID NO: 47988 - DNA, 101 bp, rice(Oryza sativa)
  misc_feature (71): n=t or c
cttgagttagcctaatttatttgttacatgatcaaaccaagaagatccaggctaacaatgcttgcttaaantcttaaactcataagggtatgacaactccc

SEQ ID NO: 47989 - DNA, 101 bp, rice(Oryza sativa)
  misc_feature (71): n=t or c
agagatcgacgacaacgtggtaacgatgatagggacaccgaggacatttcgacttagtggcgattgtggcnctgttgacatgtctatggcaatttttgata

SEQ ID NO: 47990 - DNA, 101 bp, rice(Oryza sativa)
  misc_feature (71): n=a or c
catcatcgtaagcgcattaattcattcctcacatagtcacatacataatacctccgtttgttaatagaggntaccattaacttttaaacataaaatatata

SEQ ID NO: 47991 - DNA, 101 bp, rice(Oryza sativa)
  misc_feature (71): n=t or c
ttattacgatggcattttttgaactcaggccaataactatgccgaatatgtctttatcgccaggtgggtangtgacggtaacacaaacaacacttctgcta

SEQ ID NO: 47992 - DNA, 101 bp, rice(Oryza sativa)
  misc_feature (71): n=t or g
ctaacattcgcagccataattaaaaaaagttaaacactttctggaaagaaaaaaaaaagggtgagttacanaggcatagaacagagggaacatatcctatg

SEQ ID NO: 47993 - DNA, 101 bp, rice(Oryza sativa)
  misc_feature (71): n=a or g
gctagccaatggcagctatacgtacaattataataatatagtataatagaagtgtgttatgattctggacnaaccagaaaatcaactactccctccttccc

SEQ ID NO: 47994 - DNA, 101 bp, rice(Oryza sativa)
  misc_feature (71): n=t or c
ctacaactcctttatatatatacaagtccaatgcaaaagatccatgtagttaagctgcgtaagtagagtgntcattccgtctcataatacaagagattgca

SEQ ID NO: 47995 - DNA, 101 bp, rice(Oryza sativa)
  misc_feature (71): n=t or c
caattggcaaaaacaagtgcaccgtaccgcgcctttcatgaagattgcactctcctttcttctccatatcntgctgttccatggctttaatcttgtgctgg

SEQ ID NO: 47996 - DNA, 101 bp, rice(Oryza sativa)
  misc_feature (71): n=a or g
cctgtttttcccttgctctttcaatgaccgcaaaacctaggagccttcttttcagggccgcgcggagcctntgttctgcctgtgttaattaggtgtcggcc

SEQ ID NO: 47997 - DNA, 101 bp, rice(Oryza sativa)
  misc_feature (71): n=t or g
tccgcaagaccatcctattggacagggtgaaacttgttgaacttttggatagtttccaaggaggtgcaatntcctggaatgaattctctgctgctgtgaag

SEQ ID NO: 47998 - DNA, 101 bp, rice(Oryza sativa)
  misc_feature (71): n=a or c
tggcattatggttctgcaccctctgatgagtggattgaaaagaacaatatgtttctagaccatgctttctntatacctgatttagttcaagatggaagtat

SEQ ID NO: 47999 - DNA, 101 bp, rice(Oryza sativa)
  misc_feature (71): n=t or c
gcccacatcaatatacaggaatgggagtttatgatgccatgaaattttgcaaggctgatatatcaactgtntgctttggactggcggcttccatgggtgca

SEQ ID NO: 48000 - DNA, 101 bp, rice(Oryza sativa)
  misc_feature (71): n=a or g
ttatatagcctccataagaaggatgtgcatactgtacatctgttcactaaaaagaggatgcataaacagcntgtttttccttaggatagacaaaagaattc

SEQ ID NO: 48001 - DNA, 101 bp, rice(Oryza sativa)
  misc_feature (71): n=a or g
tgattcacttgatctccagatttcgatgcacgattcgacggcctcgatggagaagaccgcgccggagaccnccccgacgcctgcgcctcgtagcatgccgc

SEQ ID NO: 48002 - DNA, 101 bp, rice(Oryza sativa)
  misc_feature (71): n=a or g
ttggattttgagtggatttggaaggaattgaggagggggcgtcagttgaaactcgcggacgagagagaganaaaagagagggctggaagaggagaagagat

SEQ ID NO: 48003 - DNA, 101 bp, rice(Oryza sativa)
  misc_feature (71): n=a or c
taattgtgaccaataatttcaattattgtaaattaacatgctaaccccaaagaactgaaaaaatgagcatnagtttgaaaactctaaccatgtatagtaat

SEQ ID NO: 48004 - DNA, 101 bp, rice(Oryza sativa)
  misc_feature (71): n=t or c
gagagcaattgaatacatagttgctgtcgaagggccacgtttggaattgactgattagccacatgtaaaantagaaacgttattagatatgattaattgag

SEQ ID NO: 48005 - DNA, 101 bp, rice(Oryza sativa)
  misc_feature (71): n=t or g
ctaaacttaaattggaaatctgcatcttgaaggaaactattgattgcatattgacccgccttagaccactngaaccagctggttttaagtaaacaggtgat

SEQ ID NO: 48006 - DNA, 101 bp, rice(Oryza sativa)
  misc_feature (71): n=t or c
ttatctatcgacctcttctacggtcttctccaattaatttttagcgtaagcatgcacgtgtgggtgttctnatttatcacatatatagttttattttgtct

SEQ ID NO: 48007 - DNA, 101 bp, rice(Oryza sativa)
  misc_feature (71): n=a or g
tgcaccactaccattcccgccattttcaccattgccattgcctccaccattaccactagcacccgctcccncacttgacccataccaattattattagcat

SEQ ID NO: 48008 - DNA, 101 bp, rice(Oryza sativa)
  misc_feature (71): n=t or c
acagattgaaatgttgtaagctagtgagtttacttcatcgtctgagcacttgagtttataggaaattttgnaatgtgtgtattactatattggacattaag

SEQ ID NO: 48009 - DNA, 101 bp, rice(Oryza sativa)
  misc_feature (71): n=t or c
atgtcgatgacctggtggtaaagacgcgccaccaggagacgttattacaggacttggctgagactttcganagccttaggtcaacgcgcatgaaactgaac

SEQ ID NO: 48010 - DNA, 101 bp, rice(Oryza sativa)
  misc_feature (71): n=t or c
tgggtgacatgtggcttcctcttgatggaaggtttccccagggatgtgagcctaagttacacttgcgaatntttttgaacaactcgcgtgggactgaaatt

SEQ ID NO: 48011 - DNA, 101 bp, rice(Oryza sativa)
  misc_feature (71): n=t or g
ctcagctcagtgtcaagctagctctacacattgtacaaccacactacaaatcgatcagtaaatcaatgganagcaggagcgcgagagagcatggccatggc

SEQ ID NO: 48012 - DNA, 101 bp, rice(Oryza sativa)
  misc_feature (71): n=t or c
acaaaccgtaggagtaggaagaatggaaaataaccctaccgcacagtacagatttgtcataaaaggatgcntgcaaccaagcagcccacgtagtagtacgt

SEQ ID NO: 48013 - DNA, 101 bp, rice(Oryza sativa)
  misc_feature (71): n=a or g
gactgaccgatcgaggcgagttatacatgtgtactgtacactccttgtcctaaaataaatttatctgtggntttttatattcaacatttaacagtccgttt

SEQ ID NO: 48014 - DNA, 101 bp, rice(Oryza sativa)
  misc_feature (71): n=t or c
gttgagggcaaaaaataggttttaccctaaaatttgtagctgcccacttccctctagtactcactccttcnaaaagtctaagtcctattttattctttaat

SEQ ID NO: 48015 - DNA, 101 bp, rice(Oryza sativa)
  misc_feature (71): n=a or g
gctcccatgggtggtgctggatgccctcatgacctttaggtctgttcccgtgggagagttcatctctcaanaaagcaccagttttgatgcctacacagatt

SEQ ID NO: 48016 - DNA, 101 bp, rice(Oryza sativa)
  misc_feature (71): n=t or g
gtcgtcggagttggaggagaaggcctggagcacaaattataaagttcatccaatggcccaaaatctacaanatttgaaggtagatttttttgtcaatagat

SEQ ID NO: 48017 - DNA, 101 bp, rice(Oryza sativa)
  misc_feature (71): n=t or c
atcgtcacgtcatgtattctacgaaatcgttacaaaacagtcactgacatgtgagcctcgttagctgatangactcgtccgaacccatatgtcagtgactg

SEQ ID NO: 48018 - DNA, 101 bp, rice(Oryza sativa)
  misc_feature (71): n=t or c
gatttggcttcctcaattgaagaagcaatagcattaaacgcagcttgcccatcaagaaaccattgtacgangctaccatcttcagtcaaacccctaggtgg

SEQ ID NO: 48019 - DNA, 101 bp, rice(Oryza sativa)
  misc_feature (71): n=t or c
ctagtatatccctttcccatgacactgacaatatgaatcctatccacaacacaatctcataccatatcaanaaccattttttttttaccttttgtgtgttc

SEQ ID NO: 48020 - DNA, 101 bp, rice(Oryza sativa)
  misc_feature (71): n=a or g
gtcaagtattaacatccgacataatttttggcaggcaattatatccagcctacaaccaaattcatcgagcncgtccgcctccttacacaaatcaatcatat

SEQ ID NO: 48021 - DNA, 101 bp, rice(Oryza sativa)
  misc_feature (71): n=t or c
cataccaacttttggcgttgacaccctcctagcatgtaaaaacggagcaaccaagggggctgctatataanggaatcctgttgggacgggatgatatctaa

SEQ ID NO: 48022 - DNA, 101 bp, rice(Oryza sativa)
  misc_feature (71): n=a or c
gcactgttactgttcaaactgggaatgatccggtgtttctgttcaatgttccggtcagggtttacactttngatctcggtggaaactttggtgatttcggt

SEQ ID NO: 48023 - DNA, 101 bp, rice(Oryza sativa)
  misc_feature (71): n=t or g
cttattcatagatagctaatcaagtcattacacataatacagcacaggtacaaacacagacagacggacgnacagacgacggtatatatgtcctaagatta

SEQ ID NO: 48024 - DNA, 101 bp, rice(Oryza sativa)
  misc_feature (71): n=t or c
agcactgacgcatgcacacacttcacacattgtggagttaggtatatcattctcaactaaactactactcntttagtatatcttttaataacaagtcaaga

SEQ ID NO: 48025 - DNA, 101 bp, rice(Oryza sativa)
  misc_feature (71): n=a or g
gctttcttggtatgtgctgcattggctggaagcctagaaccgctgcataggtgataggaataagttcaccngaggtccctcaaattaacaccgagattttt

SEQ ID NO: 48026 - DNA, 101 bp, rice(Oryza sativa)
  misc_feature (71): n=a or g
atctcttattatctgattccttggttgagtttaatattctgttgtaatattgcagcacaacaaggaactcnaagctaacacaaggaagaagctgcagggag

SEQ ID NO: 48027 - DNA, 101 bp, rice(Oryza sativa)
  misc_feature (71): n=t or c
taaaatttgaagctggaaattttgcttggaaacagtcagaaagagagtagaacacctccctttgtgatgancgcatcttcggctttcccatttgtttgtct

SEQ ID NO: 48028 - DNA, 101 bp, rice(Oryza sativa)
  misc_feature (71): n=a or c
ttaacgatcttcttcaatggcatcagtggtttcgttcactctcagtggtttcgattcgacaactgcttcangtggttctctcaacagtggttggaaaaaga

SEQ ID NO: 48029 - DNA, 101 bp, rice(Oryza sativa)
  misc_feature (71): n=a or c
ctgaaaaagacaagtgttaaataatgttggctttgattgtacttaaagatacaaagaaccttaccggtggngctggctttgatgctattgttgccgatttc

SEQ ID NO: 48030 - DNA, 101 bp, rice(Oryza sativa)
  misc_feature (71): n=t or c
aggagttgtttttttgaggaaacgtgagttcaagacacaaacaaaaggatgataccatgacagagtacctncatgagttcaaccgtctagctcgctatgct

SEQ ID NO: 48031 - DNA, 101 bp, rice(Oryza sativa)
  misc_feature (71): n=a or g
cccccaactatccagtcagagtacgtaacaaatgaattaatgtgccggccttaattttgcagaagcttatnttgcacctgctggagactatacatctcttc

SEQ ID NO: 48032 - DNA, 101 bp, rice(Oryza sativa)
  misc_feature (71): n=t or c
gacacgtggtggaggcacatgcctagcatgttggcccgatggtttggcttcgtataccgtccaataaaaanccaacctagaatttggattaaaaaaatatg

SEQ ID NO: 48033 - DNA, 101 bp, rice(Oryza sativa)
  misc_feature (71): n=a or g
gttccaggcggctaagctcagctggtatacgcccgtgaaagctattgttcgacagatcaagcctctcaatngagctcaagttggctatgcacggaggtata

SEQ ID NO: 48034 - DNA, 101 bp, rice(Oryza sativa)
  misc_feature (71): n=t or c
aaatcgataattcatgcataaaaatagtgtactctatttcatgttataaattgttgacttttttcttagtnaaacatttttaggtttaaccaatcttatag

SEQ ID NO: 48035 - DNA, 101 bp, rice(Oryza sativa)
  misc_feature (71): n=a or c
tcttctaaattcttttcactcccctgaacttacaaatgcatggcccacctaacttgtaataaaatgcaatntaaagttacagtacacttcatgggagcttt

SEQ ID NO: 48036 - DNA, 101 bp, rice(Oryza sativa)
  misc_feature (71): n=t or c
tgtgaagcctaatcctaaaatttggatttcttatgtgaaaaacgtgctctaacgattcccttcaaatatgncttaaaaatttacattttgtcctcctttct

SEQ ID NO: 48037 - DNA, 101 bp, rice(Oryza sativa)
  misc_feature (71): n=a or g
aggacgacttgtggcggtggctgtgctgtgttcacggcgaggaggcgttttagggtctcgatgtctccatntcgagcagccatgagcagcttaggattcat

SEQ ID NO: 48038 - DNA, 101 bp, rice(Oryza sativa)
  misc_feature (71): n=t or c
tgcatggacatggtgatggtgtatatataccttaattactcgttagctagtagtagcaactggagtagctnagttagcttgttgcaggccacgagatagat

SEQ ID NO: 48039 - DNA, 101 bp, rice(Oryza sativa)
  misc_feature (71): n=a or g
cttgttttaaaaaaaatcagtgtcgtcaccacaagtacaggatagtgagcacattacatttatcaatgaanaggaccatctggtgaaagcatgcagagtgc

SEQ ID NO: 48040 - DNA, 101 bp, rice(Oryza sativa)
  misc_feature (71): n=a or c
ggtgtatgagcaaggagattgtgtaatcgtcaagagcttcaacaagagcaggttaagagagaatctaggcntctttgattgggagctcaccaatgatgatc

SEQ ID NO: 48041 - DNA, 101 bp, rice(Oryza sativa)
  misc_feature (71): n=t or c
catcaaaactgaattgcatcttggttttgattcagttacctggctatgatccgtgcatcgactactacatncctcgttacctcaacaatcccgatgtgcaa

SEQ ID NO: 48042 - DNA, 101 bp, rice(Oryza sativa)
  misc_feature (71): n=t or g
tcttgagaagtatcagaatcatgtgaaaatacatatttctccagcgaatcattaggcatgtattcgtaaangagagcccgccttgttccttctgagcaaaa

SEQ ID NO: 48043 - DNA, 101 bp, rice(Oryza sativa)
  misc_feature (71): n=a or g
cactgctaggttgaacatctcagtcagagcatgattatctagtgcacccatgcttttcatatgctgtccanaattgcaaattttctcccggtatcctgaag

SEQ ID NO: 48044 - DNA, 101 bp, rice(Oryza sativa)
  misc_feature (71): n=t or c
atcggacaagaggggtggagccagagattggccaaaccttacactagctaggcacttaatttttttacagnattcacttaatttttttacagtattttgat

SEQ ID NO: 48045 - DNA, 101 bp, rice(Oryza sativa)
  misc_feature (71): n=a or g
ttctagttgcatacaaggaaggtggaaaaaaatgcgagacagaaagcaaagaagagaaggaatacgaatangatgatgaactgatgattacctggatggat

SEQ ID NO: 48046 - DNA, 101 bp, rice(Oryza sativa)
  misc_feature (71): n=t or c
gattggacaggacactttggatattggatgggctaagcggattggaggtggcataccgactgttagtctgncagatatgacaagctaccaattcatgtgca

SEQ ID NO: 48047 - DNA, 101 bp, rice(Oryza sativa)
  misc_feature (71): n=a or g
agggatattagataaacagtttgaagttgaggagtgtgttgtagacttgttccatgtgatgatcacttagntatatgaaacttgtaaaatacggatctagc

SEQ ID NO: 48048 - DNA, 101 bp, rice(Oryza sativa)
  misc_feature (71): n=a or c
tttttttgcttctccctgaacgaatttttactgctagaagaggcaaggtagccgtcatgcctttgtctctntatatatatggtggtacggccgtcgatgtg

SEQ ID NO: 48049 - DNA, 101 bp, rice(Oryza sativa)
  misc_feature (71): n=a or g
taattaatcaattaacctagctctgtacccaactggtttcacagatgttgaggcgaagacagtgtgccagnagacggaatacgggtgcacgcaggagaaat

SEQ ID NO: 48050 - DNA, 101 bp, rice(Oryza sativa)
  misc_feature (71): n=a or g
ttgtattggtttataaaaaccggcaaaaatagtctccctaagtcatatgtgccggttattatgacaaaccngtaaatatatacatgacataggtgccggtt

SEQ ID NO: 48051 - DNA, 101 bp, rice(Oryza sativa)
  misc_feature (71): n=t or c
agctcaggcaagtgaatttcctgttgtggaggttggaaattcagtggaataattcattaggctaagaatgnggtttttggaatgttcaatttttttttcag

SEQ ID NO: 48052 - DNA, 101 bp, rice(Oryza sativa)
  misc_feature (71): n=a or g
gctacttgcttgtagacaagaatcgcataaaatgtaacaatggtttcagaaaggaaatgctcatactaacnaaagtttcatgacacaatatttcagatctt

SEQ ID NO: 48053 - DNA, 101 bp, rice(Oryza sativa)
  misc_feature (71): n=t or c
ttttggtattgtcgcaatacccctgataacttcttgacagtctgaagcaatacagacctttaggatgttgnagtccatggcgatagcaagtccttcattac

SEQ ID NO: 48054 - DNA, 101 bp, rice(Oryza sativa)
  misc_feature (71): n=a or g
tacatttctcttatgcttattgttggtcttgtggataagacatacccaatgatcttggattgggattggcngggtccaccatatatcaaatcttatacgga

SEQ ID NO: 48055 - DNA, 101 bp, rice(Oryza sativa)
  misc_feature (71): n=t or g
taaaatttaaactcaagatacgtcggcttagtttttagaggtgtttatagacgtagtacatgtgttcttanaggtaagtgcacgtgtactgtaagtgtctg

SEQ ID NO: 48056 - DNA, 101 bp, rice(Oryza sativa)
  misc_feature (71): n=a or c
acatggccagatatctcgagctcgcagctcatcaagatgctactgtatacaaggtgattatcccattatgnaagctagtggtatttacgcatggctaagca

SEQ ID NO: 48057 - DNA, 101 bp, rice(Oryza sativa)
  misc_feature (71): n=t or g
ccaggacaggtatgtgtgtgtggacatcatttggtcaagaacctagtgaagaacagaatgttcctacatantacttgatgagatgtttaaacacaaatttt

SEQ ID NO: 48058 - DNA, 101 bp, rice(Oryza sativa)
  misc_feature (71): n=a or g
tcctccgttggcactaacatggccactttaaagatatcaatcattgtcgtaaagttttaagcggatgctanaatagggacggcaccagcaatcttgttggc

SEQ ID NO: 48059 - DNA, 101 bp, rice(Oryza sativa)
  misc_feature (71): n=a or g
aaacacagcaacacagtacaaacactcatatgtcggtgcaccatagtacgacctccccgggtacgatgctncaagatcatcaatcaataaacttctaacat

SEQ ID NO: 48060 - DNA, 101 bp, rice(Oryza sativa)
  misc_feature (71): n=t or c
agaatacaagagcacttaaactcatatcttaccaaagagaagaacataccaccaataaacgaaaaaactangacctcgagacatccctgctttccgacatc

SEQ ID NO: 48061 - DNA, 101 bp, rice(Oryza sativa)
  misc_feature (71): n=a or g
ctggcggtgagctaagtggcccgtcaataaaaatagggttattttttgcaagcgggcttcttaagcaaccngtagcgaaaatcagcgaaaatggattttcg

SEQ ID NO: 48062 - DNA, 101 bp, rice(Oryza sativa)
  misc_feature (71): n=a or c
caaaatgcagtatatctctggctcaccttaccggccgttagatcaaacatcaactgcaagactgacatggnagaacaataccctttaaaggttgagttctt

SEQ ID NO: 48063 - DNA, 101 bp, rice(Oryza sativa)
  misc_feature (71): n=a or g
aattttgaaggtttgttctgtccccatttactgagagcgttcgtgcatgttcaagttgagaagatccctcntacatatgtactgcgtcgttactcaaggga

SEQ ID NO: 48064 - DNA, 101 bp, rice(Oryza sativa)
  misc_feature (71): n=t or c
taggggattttttttttcatttaggggatgtggatgaatgcaatataatctcttgatttctgtttgcactntgcagggattggcaagcacagcaaagggca

SEQ ID NO: 48065 - DNA, 101 bp, rice(Oryza sativa)
  misc_feature (71): n=t or c
aagcaaacaaaataggtaaaataattcttagccattgaataaaggagggtattcgagagctttccggtgtntccttcatatgtgggagagatagatataca

SEQ ID NO: 48066 - DNA, 101 bp, rice(Oryza sativa)
  misc_feature (71): n=a or c
tctcgttctgatcatcaggtgaagatcgagaatggctgaaactgtatatgtgcttgtttgatgctgaatcnacagatctgacagtgccatagaattattgg

SEQ ID NO: 48067 - DNA, 101 bp, rice(Oryza sativa)
  misc_feature (71): n=a or g
cactattaaaagtttatttacgatataggcaattttacaacagatttcagcccatttctctcacctcacanaagaactctacaaattgaagacagtaaagc

SEQ ID NO: 48068 - DNA, 101 bp, rice(Oryza sativa)
  misc_feature (71): n=a or c
cccccgagctagcagacaccacaaatccagaatccagcgaggtcagcgaggagcgacccccaaaatggctngagcgagagaaggaggatgctcactgtggc

SEQ ID NO: 48069 - DNA, 101 bp, rice(Oryza sativa)
  misc_feature (71): n=t or c
tgatgtcctccaatgctgctgttgatgttaacccggactggccgccaaatagactcaaatatgagagttgntggtcagacctagcgctctgcgaaaagaat

SEQ ID NO: 48070 - DNA, 101 bp, rice(Oryza sativa)
  misc_feature (71): n=t or c
gtcgaagttgtcaaaactataaatcagctgctttcttgttctttggtacgatggaataagttccagtcttncagcacatacatagtcatccacagttagaa

SEQ ID NO: 48071 - DNA, 101 bp, rice(Oryza sativa)
  misc_feature (71): n=a or c
cggaagtgtggtactccggagatgaagaagatcccgatcacgaggtcaagctcaagcccaagtcaaaaganaaggttgaaggagaaggtggtgttgctacc

SEQ ID NO: 48072 - DNA, 101 bp, rice(Oryza sativa)
  misc_feature (71): n=a or g
cgatggtgccacggcaatgagggcatgcgcgcctgaatctggcctagggagcggcaactttgggtcgatgntgcctggtgtgtgttaccgtcttcccgtgg

SEQ ID NO: 48073 - DNA, 101 bp, rice(Oryza sativa)
  misc_feature (71): n=a or g
atggtcggtcgatcaggttgttaattaactgtgtctttcgcccccctgatatgtactacctcgtctcggantacaaagagtttttaaagttgtacacaatt

SEQ ID NO: 48074 - DNA, 101 bp, rice(Oryza sativa)
  misc_feature (71): n=t or c
tagtgcaaaataaatgttgtgttggtcaagtgctagctcttgcagattattgttacttctatctctacttnttttttttttgcataataatgcgatggact

SEQ ID NO: 48075 - DNA, 101 bp, rice(Oryza sativa)
  misc_feature (71): n=t or c
aatcattaccttctttcctttcttccccgtctctccctctctagataatttggtttggtgtcttctctctntatctcctaagagcaagttcaatagtagag

SEQ ID NO: 48076 - DNA, 101 bp, rice(Oryza sativa)
  misc_feature (71): n=a or g
ctctaatatctttagtactagttggtgttaccctctaatatctttagaccctctaagatcggcatgcacgnagagatcgaggcgtgcgcgtgaatcggatc

SEQ ID NO: 48077 - DNA, 101 bp, rice(Oryza sativa)
  misc_feature (71): n=a or g
agctagctggacacattcctgatgtcgaggttgaacgatgtagtgtgcatgcgggggtgacaatttccccnttggaggtagggcctcagtggatcactacc

SEQ ID NO: 48078 - DNA, 101 bp, rice(Oryza sativa)
  misc_feature (71): n=t or c
cttgtgtagaggccttttccctcgctgtccccgtgcttgttccatgccacggtgttgcatcccaggacgangaacttgttgcgctcgtcggagatgcggta

SEQ ID NO: 48079 - DNA, 101 bp, rice(Oryza sativa)
  misc_feature (71): n=t or c
gcggataatgttcagaattagagttaacaactacatatgcatggcatgcttcccattagagcaagtataanagtgagctataaacttactataatcttagg

SEQ ID NO: 48080 - DNA, 101 bp, rice(Oryza sativa)
  misc_feature (71): n=t or g
ccggtcgggttctgacttctcaaatatgggcagcacccgagtaatggcacattgatcactgcaaacttccntgctcctaaattgtataatgtctacaagaa

SEQ ID NO: 48081 - DNA, 101 bp, rice(Oryza sativa)
  misc_feature (71): n=t or c
atatatggatgacttctttgatctgtgtcaagcaatcctaacgggcccaaattgtaaacagcaggtgaganggcctcagcacggttatggatatcactagg

SEQ ID NO: 48082 - DNA, 101 bp, rice(Oryza sativa)
  misc_feature (71): n=t or c
acagaccatccacaaatgccaagatttcagattccggtgcctcactgcatctctcgattggcttacaggangcaaagatggttttcccagcgctatctcga

SEQ ID NO: 48083 - DNA, 101 bp, rice(Oryza sativa)
  misc_feature (71): n=a or g
ctgtgatggatgttttttgtttggtgggtttgtttcgattgattcgtctgcttgctgctggggtttggatnatgggatcgttgattcgtctcgatcgcgag

SEQ ID NO: 48084 - DNA, 101 bp, rice(Oryza sativa)
  misc_feature (71): n=t or g
gacaggtagagcacagccagagggcacagtatgatggcgaacaccaccgcctggatgaacgtcacaagacntcctgctcgtgaacgccacaactggatgcc

SEQ ID NO: 48085 - DNA, 101 bp, rice(Oryza sativa)
  misc_feature (71): n=a or c
gtaatacggagagagcgtggggactaatacagactgttgaaatgtgaggggcagatttttatttatattcntagcaagcaaagctgataataaagcgatta

SEQ ID NO: 48086 - DNA, 101 bp, rice(Oryza sativa)
  misc_feature (71): n=a or g
gcaggattaggctgatgatgacacagatgatggaggtgataacaatattccaggcagtgacaaatagtgcnccagcaatctgcttcccgaactgtgatcca

SEQ ID NO: 48087 - DNA, 101 bp, rice(Oryza sativa)
  misc_feature (71): n=a or c
cgcgcccccacgcctctgcctcctatccgcggcgatggagctcagcctccgattcctatccggttttgctntagcattgggctctgccatgctcctcctcg

SEQ ID NO: 48088 - DNA, 101 bp, rice(Oryza sativa)
  misc_feature (71): n=a or g
aaacataactacgtggctagtaataaatggaagttattgtcgctatctatcgagctaaatcctttaagacnaaataacactggtggagaaatcgtttttag

SEQ ID NO: 48089 - DNA, 101 bp, rice(Oryza sativa)
  misc_feature (71): n=a or g
gtctagtccagcgtcgccttaattggccttctaagtggtagatgccgtcgtcattgttgtagtagatggtncggtcgatgccatcgtatctgtcctagatg

SEQ ID NO: 48090 - DNA, 101 bp, rice(Oryza sativa)
  misc_feature (71): n=a or g
agtccggtggtcattgttttgctatttatagactcgccggcgtcgccgccggacgtataaaatgctggatntcagcgctggcatggaaagtgacttttcta

SEQ ID NO: 48091 - DNA, 101 bp, rice(Oryza sativa)
  misc_feature (71): n=t or c
gtgaatcgagaaaggaagtccaagagaggttcaacaaaaatgtgcccatccacaaaaatgtgttgtattanggtgatgtttggtttccagccacaatttgc

SEQ ID NO: 48092 - DNA, 101 bp, rice(Oryza sativa)
  misc_feature (71): n=a or g
gtgccggtgacggtggtgtacggtgtatactcatatgagatacgtatactgtatacggcgtaccgcgtacngggagaatatagcactcaattcgcacctct

SEQ ID NO: 48093 - DNA, 101 bp, rice(Oryza sativa)
  misc_feature (71): n=a or g
cgacctagaacttcttcagaaaataggtacggatgttgattttcgtattgtttggaaggctataggatggnagaaatttgctgtggtagatgagccaggtt

SEQ ID NO: 48094 - DNA, 101 bp, rice(Oryza sativa)
  misc_feature (71): n=t or c
tgtagctatactaattagaccctttgagagagttatataactacgctgcataattccttgagagagtattnttcgattttttttgtctcatactttttagc

SEQ ID NO: 48095 - DNA, 101 bp, rice(Oryza sativa)
  misc_feature (71): n=t or g
tggacctgcctgcatataaaaaaaaattgcgatgcaactagtacggatttgaccatcttagatagatacangcaatctagcaaacatttggctagtatttt

SEQ ID NO: 48096 - DNA, 101 bp, rice(Oryza sativa)
  misc_feature (71): n=t or g
aagtttgctaagaagaaattgattagctattaatttttcttttgtaaatgaacgactttactatgttatgngctagctaataaattatttaagttgagtta

SEQ ID NO: 48097 - DNA, 101 bp, rice(Oryza sativa)
  misc_feature (71): n=a or g
cgcgcatgagtgatggtggcgactgaaccggtacgtgccacgatgaggtgtggtgtggtagtatggagcancgatgaggcatgtggtgatgtggaggtgcg

SEQ ID NO: 48098 - DNA, 101 bp, rice(Oryza sativa)
  misc_feature (71): n=t or c
ggccactacatccaaccgaatatatgcagcctttttaaattgagatcttagcctaacctaatctgaaattntctcatatatagatttgatctcaggaccat

SEQ ID NO: 48099 - DNA, 101 bp, rice(Oryza sativa)
  misc_feature (71): n=a or g
gccatccagatagcagcctttgagctctagaacttccaatgaagggcactgagaagagagctgcattagtntcctttgtcgaaacaagtagccagacagct

SEQ ID NO: 48100 - DNA, 101 bp, rice(Oryza sativa)
  misc_feature (71): n=t or c
atcgacaatcgcatacatatattgcagtacatggttagctggggaagcttgtgaaatagaactggttaaanggacttacattacatgtcactggaagaaac

SEQ ID NO: 48101 - DNA, 101 bp, rice(Oryza sativa)
  misc_feature (71): n=t or c
catgcaattgaaaaagaaaattgatctagccattataaccactgaccgtgttgagaatcagcaatggtgangacgatggttaggagttctttaaaggaaaa

SEQ ID NO: 48102 - DNA, 101 bp, rice(Oryza sativa)
  misc_feature (71): n=t or c
ttgtggcggatccggtggcaaccatggtgtcggcagcttccatccggtgacgacggcggcggtggatgttnttgatgtgttcgatattgtagtgttgttgg

SEQ ID NO: 48103 - DNA, 101 bp, rice(Oryza sativa)
  misc_feature (71): n=t or c
aattttttgtggtggaatatgctcagccagttttaagtcctaaccttaacccatgtgctcgtatttacatntaattgttatcttttagtagtaggagacgt

SEQ ID NO: 48104 - DNA, 101 bp, rice(Oryza sativa)
  misc_feature (71): n=a or g
taaagaagatcgtcaccatgaatctcctgaccatcaagaaggtccactcctatggccagacacggcaacangaggtgcggctggtaatggccaagatcgtc

SEQ ID NO: 48105 - DNA, 101 bp, rice(Oryza sativa)
  misc_feature (71): n=t or g
tctggaaaacaatgattcctggagctgtaaaagttgccagaagtgttcgcttggagatatccctagaaaantgtttacatcaaatcagaatggaccaacga

SEQ ID NO: 48106 - DNA, 101 bp, rice(Oryza sativa)
  misc_feature (71): n=t or c
aagaaaagagtatttagtaccttagaaaaaccagagctggcacatctaatgatgatgagaaggccagttcntggagctctttctgtgcttggtagacctct

SEQ ID NO: 48107 - DNA, 101 bp, rice(Oryza sativa)
  misc_feature (71): n=a or g
ccagcccccatgacacaccgattctctgtacctcgcatctcttgatcttggcatccttaattctgaactantgtataaccttaacgtgaagagtgtggaac

SEQ ID NO: 48108 - DNA, 101 bp, rice(Oryza sativa)
  misc_feature (71): n=a or c
ctatgtctaagaagtatgaagtgaagtgagaaactcttttgggcagatttcagttgtttaggtaggaaaantccaagcttttgctaatagtcttcaacacg

SEQ ID NO: 48109 - DNA, 101 bp, rice(Oryza sativa)
  misc_feature (71): n=t or c
tcacagaatggacctagtttattccccctttcctctgaagaagtatatatgctgatcatgatggatcgtgngctttgtagcctccagctatctggcgagtt

SEQ ID NO: 48110 - DNA, 101 bp, rice(Oryza sativa)
  misc_feature (71): n=t or c
ttgggtgaagtttcataggtacacgaccctacctcccattcaccgtacctcccctcctgtttttcccatcnaagatcgagaggggagagagaggcggcggc

SEQ ID NO: 48111 - DNA, 101 bp, rice(Oryza sativa)
  misc_feature (71): n=a or g
attttcttccaggggcctctggggataagaatggccaagaaggccattgatcaagggatgcaggcagcagncatgccgtccgcgttggccgtcgaagggga

SEQ ID NO: 48112 - DNA, 101 bp, rice(Oryza sativa)
  misc_feature (71): n=a or g
ttatcttgccacgttaccctagctgacatgacatgataaaattattaggcttgctgcaagtggcacgtcantgttattttgtcacgtcaagcgggctggcg

SEQ ID NO: 48113 - DNA, 101 bp, rice(Oryza sativa)
  misc_feature (71): n=t or c
atccacggtccatgtctatttggatttttttggatcactagctatgcatagatttataggagctgagattntctagatttaattgtgaacattagcttgaa

SEQ ID NO: 48114 - DNA, 101 bp, rice(Oryza sativa)
  misc_feature (71): n=a or g
tcataacaaggcccggggtttcagtttattgacggttttgccatttcgttaattgtgcttctggtttgcgnaggaagaaattgttttcgcgcttactagag

SEQ ID NO: 48115 - DNA, 101 bp, rice(Oryza sativa)
  misc_feature (71): n=t or c
actcatgcagtctcatgtgcatgtgcccttcccttcatgacgattttgcaaaacctcttgattggtagtcngagtcttgtgacatagcttatgtatgagat

SEQ ID NO: 48116 - DNA, 101 bp, rice(Oryza sativa)
  misc_feature (71): n=t or c
tccgaagcttcccctcactctcttcctatattagaactctactatagagtagactaaatgtgtaagtcagntgtacttcacttgttgtgccatttgagatt

SEQ ID NO: 48117 - DNA, 101 bp, rice(Oryza sativa)
  misc_feature (71): n=t or c
cgcgtggatccagctgcggcacggcagatctaccacggtggcgagcaacggccggttcgacgaccttgggntccacctcctccaccgctgggtggctccac

SEQ ID NO: 48118 - DNA, 101 bp, rice(Oryza sativa)
  misc_feature (71): n=t or g
acgcttcccgcccttatcactgcactgtcccttccgccggccaaacttccattcctccgtcgcctcatgcngctccttgtcagctccggcgttttcaccac

SEQ ID NO: 48119 - DNA, 101 bp, rice(Oryza sativa)
  misc_feature (71): n=t or c
cagaattaccacgggggtaacttgaattatcattatcagcctccctcgccccgtatccaacaagggggatnacctcagcctcagtatgctcctcagttcaa

SEQ ID NO: 48120 - DNA, 101 bp, rice(Oryza sativa)
  misc_feature (71): n=a or g
acaacaccatatgtcgtagcttgcaggcttgcacagtcgattttttttcaccacagctgttctattgacantgatacttgaacagaattatcatgtgacta

SEQ ID NO: 48121 - DNA, 101 bp, rice(Oryza sativa)
  misc_feature (71): n=t or g
attgtagtgtaattttttacttattcatgtaaggagggtattgactaccaaaggagtctgcattgtgcaanagctatggacagcatgtttgattatctgca

SEQ ID NO: 48122 - DNA, 101 bp, rice(Oryza sativa)
  misc_feature (71): n=t or c
cctgcgaccgattctcctccgcgttgtacaatgggtttgagctgagctaacatcatctccaacagagttgntatctgcctcttcaagtaaaattttagcaa

SEQ ID NO: 48123 - DNA, 101 bp, rice(Oryza sativa)
  misc_feature (71): n=a or g
aataattccaaacaactattagacttcgatgtttagtagatcaaacatggacatgtgtttcagaaactatntactccctccgtttcaaaatgtttgacacc

SEQ ID NO: 48124 - DNA, 101 bp, rice(Oryza sativa)
  misc_feature (71): n=a or g
taccttacctcgccggcgtcatcgccgaagtagcagctacctcaccgccaaatattctccttgttatcgcncgctcgggtgatacctcgccggcgtcgtcg

SEQ ID NO: 48125 - DNA, 101 bp, rice(Oryza sativa)
  misc_feature (71): n=t or g
attgtttcccgtctgttactattaatcttgggattgagttgagtctctgaatgtggcaattagtctagagntggtttttttaggttcctcaaaattgtgta

SEQ ID NO: 48126 - DNA, 101 bp, rice(Oryza sativa)
  misc_feature (71): n=t or c
caggtaaagcaggatgaacaatagctagcacaaaatcctcatgccgcattggagtaggaatgaagtttacngtgtcaacccttcgacggtgatttggacca

SEQ ID NO: 48127 - DNA, 101 bp, rice(Oryza sativa)
  misc_feature (71): n=t or c
agggcgaagcccccccatggcaaagactatggaacaaggacggcggtggcagggaattgcgcgggtacctngccaagccagaggcctcttgggcgaaggat

SEQ ID NO: 48128 - DNA, 101 bp, rice(Oryza sativa)
  misc_feature (71): n=a or g
ttgaagaagctgttggagatgctctaacattccaaccgaacgcaactagtttgacaaccaataaacccttncataagcaactagtgtggctgacttggcat

SEQ ID NO: 48129 - DNA, 101 bp, rice(Oryza sativa)
  misc_feature (71): n=t or c
acctccggctaaaagacgaccaccgtcgggttcgcaagaagcctgcacatctttctctatttggccgcatngtccaaggagctgccattcactgtcagcgt

SEQ ID NO: 48130 - DNA, 101 bp, rice(Oryza sativa)
  misc_feature (71): n=t or g
tggtgctacaacaaaaacaagaacagaatatctacacttaagaacaaaacagcccttggactcaaaagctntattgacaagttggaggtgaacaagtctag

SEQ ID NO: 48131 - DNA, 101 bp, rice(Oryza sativa)
  misc_feature (71): n=t or c
gagtggttgtcaaaaagctatgatatccgtgaatcatggataccggcctacttcatggacatatctctagngggcattctgagatccacttcaagatcaaa

SEQ ID NO: 48132 - DNA, 101 bp, rice(Oryza sativa)
  misc_feature (71): n=a or g
tttaatctatctggtcttttatgtagggcttggactattcaaatgtgagtcagctctttttgtttatatantgtatacctaatttagttatgaatgtttgc

SEQ ID NO: 48133 - DNA, 101 bp, rice(Oryza sativa)
  misc_feature (71): n=a or g
cagcacaaacacccaatgacacgacgacgacgtactagtagcagctccatctaaaccgtgtttacttccanaataattcttcaaacttccaacttttccat

SEQ ID NO: 48134 - DNA, 101 bp, rice(Oryza sativa)
  misc_feature (71): n=t or g
ttggtggaaagaaattgaagctgacaatatgggatactggtgagttcataacttgggttgtatagaaatgncctgcttttcgatgatatttagcttcagat

SEQ ID NO: 48135 - DNA, 101 bp, rice(Oryza sativa)
  misc_feature (71): n=t or g
tctgaaatggaaactatgcgatgctcctttaccttgtgtacgagggaactggagctgcaggaggttgtgcngcaaagtatccatgtccccctctcccctcc

SEQ ID NO: 48136 - DNA, 101 bp, rice(Oryza sativa)
  misc_feature (71): n=a or g
ttttttttcctagtataagcgattcaagcctcacactggagctgctcttataatatacctcctctgtttcntattataagactttctagcattacccacat

SEQ ID NO: 48137 - DNA, 101 bp, rice(Oryza sativa)
  misc_feature (71): n=t or c
gttagcaagatagataatgttatgactcctcactcactttatattttagtgtgacatggattgctgtcctnttcaaactaagtttgttatgtattgtaagc

SEQ ID NO: 48138 - DNA, 101 bp, rice(Oryza sativa)
  misc_feature (71): n=t or c
ttccaccggggagtggaatggaagatacttcaactctgtgccagaaatgtcaagcaatgtttttcttgacnccaaattcgtggacaacgacgaaaaggact

SEQ ID NO: 48139 - DNA, 101 bp, rice(Oryza sativa)
  misc_feature (71): n=t or g
attaattttcatgtattcgtgggtgagtgtgctcacattctcacacgaacacatttcaaaattttgaattntgtttagccatattataactatcacacgtt

SEQ ID NO: 48140 - DNA, 101 bp, rice(Oryza sativa)
  misc_feature (71): n=a or g
gagaggaaagagatagagagaaggaagaggggtgaggaagaagatttgatgagaagtcgatgataagttgnttcctcccgctaactcagcaagtcaacatc

SEQ ID NO: 48141 - DNA, 101 bp, rice(Oryza sativa)
  misc_feature (71): n=a or g
ttgaattaaaaccatcaatcatatggcattcatctgctgaaacaatatgtgccaggtcatgaatcaggtcntgcatagaatagtatgtgcttctttgaaaa

SEQ ID NO: 48142 - DNA, 101 bp, rice(Oryza sativa)
  misc_feature (71): n=t or c
cgacatgcctaagttcaagagtacgtctccgttggattcatattctcctaccataatgacactaccattanaatcactgacgtgtgggggaatagaaggtt

SEQ ID NO: 48143 - DNA, 101 bp, rice(Oryza sativa)
  misc_feature (71): n=t or c
gcattcttccatgctagggcgatctccgattggggaggtactaacctcttttttcctgccatttttgtctnctgtcaggattttgggcaaaggtgggggtg

SEQ ID NO: 48144 - DNA, 101 bp, rice(Oryza sativa)
  misc_feature (71): n=a or g
gtgcacacgcatgccaatatattcaagctgaacaaattcatggaacaccacaggagagtagcaattacgtngattgaaattgcattttgcatctttgtttc

SEQ ID NO: 48145 - DNA, 101 bp, rice(Oryza sativa)
  misc_feature (71): n=a or g
ttcatcagtatagtgccgaaaaacttgaggataggttcatgatacagagtaggagtactagctaatagttntagcgttctcacaaatttgaagacaaaatt

SEQ ID NO: 48146 - DNA, 101 bp, rice(Oryza sativa)
  misc_feature (71): n=a or g
agaaatgatggaaaagacaaaagaaacgatgaattaagcgaaagatccacatatggatgtgaccagaggancatccaagtcttgactcttgactgctacct

SEQ ID NO: 48147 - DNA, 101 bp, rice(Oryza sativa)
  misc_feature (71): n=t or c
cgcgcgcccattgcatatgcattgactagaccctgaaaaactactgctgctgcgtcaaatgcagctactgntggagtagctactgtacctgcgcccattgc

SEQ ID NO: 48148 - DNA, 101 bp, rice(Oryza sativa)
  misc_feature (71): n=t or c
ccctacatagtactccatatttttactcttcttgggtggtgggcggtcaaccacctgctccttccctgccntttaagccacacggccagcactagacaagc

SEQ ID NO: 48149 - DNA, 101 bp, rice(Oryza sativa)
  misc_feature (71): n=a or g
gtaatttgttctccttcttgagcaatggtgtcttctttatttgtgagagggaggttccttttgggtatccnggaagagatccagtggataagcctttttct

SEQ ID NO: 48150 - DNA, 101 bp, rice(Oryza sativa)
  misc_feature (71): n=a or g
atttctcacatggtattccattatctgaggccttggttgtagattttgtgacctaggaattggtggttgcngcgcaatatgattatattggccataaacat

SEQ ID NO: 48151 - DNA, 101 bp, rice(Oryza sativa)
  misc_feature (71): n=a or c
agcgatacttcaatagatagcagatgggagcgccagagaacaaatctcaacgaaacaaaaataaaacctantccctgagttaggccattcctaacccaaga

SEQ ID NO: 48152 - DNA, 101 bp, rice(Oryza sativa)
  misc_feature (71): n=a or g
tgaagttgattttgaagttttttttatcaagcttattttccaagcttaacttttagatcggtaagaacacntttataaaaattttgttcacaaattatttt

SEQ ID NO: 48153 - DNA, 101 bp, rice(Oryza sativa)
  misc_feature (71): n=a or g
ggaaggtgaagtggttctgtgattgggggcggatgccgcagagaaattggaggaagagcgaaagtggggancgggtgctgcgccgtgggggagagggtggc

SEQ ID NO: 48154 - DNA, 101 bp, rice(Oryza sativa)
  misc_feature (71): n=a or c
taaagattccgtcaagtttaaccgcggtgagcggaacagagggagtaaatgaaaacgaacaaggtaatacntatttcctttttaaattttataaaaagggt

SEQ ID NO: 48155 - DNA, 101 bp, rice(Oryza sativa)
  misc_feature (71): n=a or g
gtatgttgtaaattgtaagtttgtaacggtcttgttgcattgcttgtacaaaatggaaggaaattgttatncttactatccaactgttcgacttacgtacg

SEQ ID NO: 48156 - DNA, 101 bp, rice(Oryza sativa)
  misc_feature (71): n=t or c
agggtcagcgtggagactgcatgcacctcaactattatgtggttgtcccgttcgttggatctcctctacgngcctccgcctctatcgtcggcgtcatcttc

SEQ ID NO: 48157 - DNA, 101 bp, rice(Oryza sativa)
  misc_feature (71): n=t or g
cccggccagatgcgtgcggacggtgcgaagtagcaacacgagggtgatctctggcgagcttgctcgtgccntccccgagatcgaccgcaccggacggacgg

SEQ ID NO: 48158 - DNA, 101 bp, rice(Oryza sativa)
  misc_feature (71): n=t or c
acacctcgaactaaaacacggggtgatcaaattttggatatattttatgaattatcgtggttgctcgtttnaagttttagttttgtctatttagtctacag

SEQ ID NO: 48159 - DNA, 101 bp, rice(Oryza sativa)
  misc_feature (71): n=a or g
tttctatactccttataaaaagtagttgtggtggtggtacccctactaccaactcccaatattttttaagnaaaaagcacgaattaccctcccaaactacc

SEQ ID NO: 48160 - DNA, 101 bp, rice(Oryza sativa)
  misc_feature (71): n=a or g
attatcatcacagtgctttcgctcaaaaaattaacacggtccaaaataagcatccgcagtgcacggtacanaagtacaaactgggtttagatcctatttaa

SEQ ID NO: 48161 - DNA, 101 bp, rice(Oryza sativa)
  misc_feature (71): n=a or g
tcgatccctaaaaaagagcacaaatcaaccactctgagatagatagaaggtgcatgagcgatgttctggtnctctctactggtagtattattctaccagta

SEQ ID NO: 48162 - DNA, 101 bp, rice(Oryza sativa)
  misc_feature (71): n=a or c
tttctgcatcttagaactcaagtgaagcccataataaggtcatcataaatatgatctggtacgagtcgttnaaaaaaaaaagtcataaggtcatcataacc

SEQ ID NO: 48163 - DNA, 101 bp, rice(Oryza sativa)
  misc_feature (71): n=a or c
atccatgagcttccgagtaatcttgtcaaaattctcagcgtccttgctgctaaggattctcccgagctgcnaaaatgaattgatttggaacattaatgata

SEQ ID NO: 48164 - DNA, 101 bp, rice(Oryza sativa)
  misc_feature (71): n=a or g
ccactaataatgtaggtaattcacctagcaaaagagatactccctccattttcaattggccatcatataanttttcgaggctatttccaaataatcatcag

SEQ ID NO: 48165 - DNA, 101 bp, rice(Oryza sativa)
  misc_feature (71): n=a or g
cttaagtgtacacaatttttttaatcaaagtgaccaaccttaagttttatatcgaaaacaacgtaggtccnctcattagagcagtgcttcttgtggaaaat

SEQ ID NO: 48166 - DNA, 101 bp, rice(Oryza sativa)
  misc_feature (71): n=t or c
ctggtagaagaaagctgcaaagaggccaaagcttataggggaatttgatgggattaattgtggtttggtgngtggcgtttgcgggagaggctttttctggt

SEQ ID NO: 48167 - DNA, 101 bp, rice(Oryza sativa)
  misc_feature (71): n=a or g
atatttttctggtactttagaacatcatacacatcatacacatcgattttaattaagtttatttgcttttngaaatatagatctataattgagtcgggttt

SEQ ID NO: 48168 - DNA, 101 bp, rice(Oryza sativa)
  misc_feature (71): n=a or g
acacttagctttctttacaacatgtaggagtgaaatagagcaagaaaagaataataaggaagatagagggnaaaaaaaagaaaggggggggggggcaaggc

SEQ ID NO: 48169 - DNA, 101 bp, rice(Oryza sativa)
  misc_feature (71): n=a or g
gtcctcccctgcacgatattgctggatgcagagggtatacatgtccctaaaaagtgaagataaaacagcanttgggtttgaaagtgggggcgtagatgcaa

SEQ ID NO: 48170 - DNA, 101 bp, rice(Oryza sativa)
  misc_feature (71): n=t or c
ttattaatatgtgccttttctcatatcacattagattttattttactttttccctctttgacgtcctggcnttgaatttttttattttagatttttttaat

SEQ ID NO: 48171 - DNA, 101 bp, rice(Oryza sativa)
  misc_feature (71): n=a or g
tgatggccatgaagcgttgaaacttatgttgggggtccgtgaattactcacacatgatattcatggaatcntccccactgttgcatggaatttaagcaggg

SEQ ID NO: 48172 - DNA, 101 bp, rice(Oryza sativa)
  misc_feature (71): n=a or g
tggaggtgatggatatggaggttttactgctgctatctttttttgtagagatgagcgagagatactgtggnttcttttcttgctgatgtattcttggtgta

SEQ ID NO: 48173 - DNA, 101 bp, rice(Oryza sativa)
  misc_feature (71): n=t or g
aatggaactgtggaggcattggtttgccttcaagattagatgcgagcagatggtatggagcctaccttgtncattgctacttatattatgggccataaact

SEQ ID NO: 48174 - DNA, 101 bp, rice(Oryza sativa)
  misc_feature (71): n=a or g
gcggttgatctgttgccgaggctagaactcaatccatgttgctacggaggtcgatatcgttatccgatctntcgaggttgagcttgtcatcgccgctgaac

SEQ ID NO: 48175 - DNA, 101 bp, rice(Oryza sativa)
  misc_feature (71): n=a or g
ttttagaaaatatgcaatgcatgaagagtttgcaaacacctcgtaaccgcttgatagtatgaaacacaccnaattttgctatcattgggtccataagaaga

SEQ ID NO: 48176 - DNA, 101 bp, rice(Oryza sativa)
  misc_feature (71): n=t or g
ctgcagcatccctgggcttttgccttcggcctccttggtatatcatcatcacctaccacaactaagacatncccttcattgccaacattttacttcttttt

SEQ ID NO: 48177 - DNA, 101 bp, rice(Oryza sativa)
  misc_feature (71): n=t or c
tagagggtactatggtcattttccgtaaaccttaattttttgctaatctagaacgacaactatagtagaanagatgttcgtcttatttgaaatattttata

SEQ ID NO: 48178 - DNA, 101 bp, rice(Oryza sativa)
  misc_feature (71): n=a or g
atttgctgactcagcgagtcaagtcaactgtggtcaacctatcacatcagcaaaaattgcttcccaaaccnctaaaggaggtgatttgcactggtttttaa

SEQ ID NO: 48179 - DNA, 101 bp, rice(Oryza sativa)
  misc_feature (71): n=t or c
acgggtagtttccgagtctcaatgactttgtgtccaggactctgcacatatttaaacagaaaaagtactgnatcatgggatgccgttgacaagcatgatac

SEQ ID NO: 48180 - DNA, 101 bp, rice(Oryza sativa)
  misc_feature (71): n=a or g
aattttttctagttcatcacttgtcggaggacgcaagtacttgctaccaaaacattcaattattccttcgncaaattttcccaaacattccaaagaagtgc

SEQ ID NO: 48181 - DNA, 101 bp, rice(Oryza sativa)
  misc_feature (71): n=a or g
acgcggtcgtaagccttcgacaaatccagtttgtaagcacaggcagcctttccctgattcttgttcttctnaataaagtggaagcattcaaaagctaataa

SEQ ID NO: 48182 - DNA, 101 bp, rice(Oryza sativa)
  misc_feature (71): n=a or g
acactccaaggtggaggatgaggaggccgtcaggaggtgcaaggataggaggaagctgatgaagcagctantgcggcgccgagttgagcttgcggctgcac

SEQ ID NO: 48183 - DNA, 101 bp, rice(Oryza sativa)
  misc_feature (71): n=a or g
cggtaaaaagatttacagagagagtttgacagcatcttgtacattcaccactggtaatgtggtgattcgangagcaataatccaagcataaaagttaaatg

SEQ ID NO: 48184 - DNA, 101 bp, rice(Oryza sativa)
  misc_feature (71): n=a or g
cacaacaaatatgggtagttactgaaatcacctgtggttttttggcctcttcagcagaattagcaactgcntcaaatccaacatatgcgaaaaagaccact

SEQ ID NO: 48185 - DNA, 101 bp, rice(Oryza sativa)
  misc_feature (71): n=t or c
caccaggcaaaagcagagggtatccttctagttctagactagatacagcacacgctgtggagccataccangaatgtaccaatgcgcgcacaacctggatc

SEQ ID NO: 48186 - DNA, 101 bp, rice(Oryza sativa)
  misc_feature (71): n=t or c
ttaccattaatattaatatttgttaaggaattccatattaagttatcaaaacgtgacctcgccactgccanatgggcatattgaagacgacggtagcgcca

SEQ ID NO: 48187 - DNA, 101 bp, rice(Oryza sativa)
  misc_feature (71): n=a or g
aagcctgtcttgccgcgcgatgtgcctcccaccagatgggatgcacacctttggcagtgctcaaaaacttntgccaaaattattggaagtgaatgttgtca

SEQ ID NO: 48188 - DNA, 101 bp, rice(Oryza sativa)
  misc_feature (71): n=t or g
ctataacactcttgttttgataataggtctagtgatattggttaatattttttttcacttacgtgaataantagtactaaatataaatacaccctagtaca

SEQ ID NO: 48189 - DNA, 101 bp, rice(Oryza sativa)
  misc_feature (71): n=t or c
cgaacccatcaaaaccgttattcatccattctttcgaggaagcatccactgttaacatcaatcacatgtantccatccatacgtaaaaaaagaaagacaac

SEQ ID NO: 48190 - DNA, 101 bp, rice(Oryza sativa)
  misc_feature (71): n=a or c
gtcatgggccaaccatttttggactgacattttggatttatggccgagcagatgggcgttgctattactgntcaggtaggtatcttttgttactgcttcaa

SEQ ID NO: 48191 - DNA, 101 bp, rice(Oryza sativa)
  misc_feature (71): n=a or g
taacgaaattaaaccatatgcatcttgcatccccaagttaaaattctacaagttgcgcatccctatcacangaaattctgccggtcgtctcctgatggatg

SEQ ID NO: 48192 - DNA, 101 bp, rice(Oryza sativa)
  misc_feature (71): n=a or g
cctggccgtgtacatacggacattactcttgtaacattgtaacattggcttgttttgaagggcgacgatcnaaacggatgccatggctgagaaagagcatt

SEQ ID NO: 48193 - DNA, 101 bp, rice(Oryza sativa)
  misc_feature (71): n=a or g
gatggttaatgtaaaccggtgctatcgatcaggtgatcaatgttggtttgttggcatgtttggttgtctcngattaccacaactcaacttgtcttgtcata

SEQ ID NO: 48194 - DNA, 101 bp, rice(Oryza sativa)
  misc_feature (71): n=a or g
catgaacatgaggcgagatgcaccttggactgacagacgcgatgtggtggcggcacgagcttgacgcagcncgtgcgcccgagcaacagtagacaacgcgc

SEQ ID NO: 48195 - DNA, 101 bp, rice(Oryza sativa)
  misc_feature (71): n=t or g
tattggtgaaactgaaaatgcagaatatttttatataccgcgtccgtgaactagcaagggccaaggtatgncggttagtaccaactactccatatagctag

SEQ ID NO: 48196 - DNA, 101 bp, rice(Oryza sativa)
  misc_feature (71): n=t or c
gtgcttatatttgtggatggagggagtatttttcaaatatcaaaccagaagtcaatgaccttatgttgtangttgtgatgttatagtattattcctcattc

SEQ ID NO: 48197 - DNA, 101 bp, rice(Oryza sativa)
  misc_feature (71): n=a or g
tcatgtgcgaattcatgtgcgactgaccaagagggaacaatatagcataaactgccaagatctccgagctngaaaggcgagttaaagctctagaaaaagac

SEQ ID NO: 48198 - DNA, 101 bp, rice(Oryza sativa)
  misc_feature (71): n=a or g
tctttttattttttaaagaaacacaatacaaacgcgacatgcacaccatactctgtgaacatctccgaaangctggaccaatatattttaagattgacaga

SEQ ID NO: 48199 - DNA, 101 bp, rice(Oryza sativa)
  misc_feature (71): n=t or c
cttactgaatgaatatgtcttaaaatgatagcgagacttgacctttgaatttaatagtgcacaacactccnctccttgaatattgtcatcaatatttaaaa

SEQ ID NO: 48200 - DNA, 101 bp, rice(Oryza sativa)
  misc_feature (71): n=t or g
gacaaagatgggaggggcacgagcggcggcacacatagcagcacaaggaagaagaggaacagagagagagnatacgtgagaatgacaagtgggcccatgag

SEQ ID NO: 48201 - DNA, 101 bp, rice(Oryza sativa)
  misc_feature (71): n=a or c
atctgaaaaaccatttgttgcagtgtacaattcctcgtaggagtatgatcttggaccagctgcaacaaatngatgcatcatatatatcgtgtgaccattct

SEQ ID NO: 48202 - DNA, 101 bp, rice(Oryza sativa)
  misc_feature (71): n=t or c
atccttagatatatatgaaaacctcccggtcaatcaagctatatatctgtaatacacgtaacgtatattgntctcgcaaagaaaaaaaggagacaagaaaa

SEQ ID NO: 48203 - DNA, 101 bp, rice(Oryza sativa)
  misc_feature (71): n=a or g
caaatataacccttttaacccaattattagtacacatatgtaatacaccataatatgtagtgttctttttncaaaaattttgggggtacagctgtaccccc

SEQ ID NO: 48204 - DNA, 101 bp, rice(Oryza sativa)
  misc_feature (71): n=t or c
cagagatcatgacctagcatttgcatctcatagaaagaataagaccgaatcaatgatccgacgtgaccggnacctgtcttaaaaccggcacttatgtgtgg

SEQ ID NO: 48205 - DNA, 101 bp, rice(Oryza sativa)
  misc_feature (71): n=t or c
aacaagattaaaagtcgtgcaaaacgcgactatgcgtggctagttaggatttgaatcaagattgctagagncagtacatactcacaactacggactcaaac

SEQ ID NO: 48206 - DNA, 101 bp, rice(Oryza sativa)
  misc_feature (71): n=t or c
ttttttttccgggcctaattacgtgttgacccgagcaacttacctcgctccgattggacgtacggtcagancgagaagagcatcaagctactccctccgtc

SEQ ID NO: 48207 - DNA, 101 bp, rice(Oryza sativa)
  misc_feature (71): n=a or g
tcaagcactcttagctccaccagcttacctagctctacaacggcgctcggggacttgtcagcagagtgaangcgcagttgctgtagggatgttaagctccc

SEQ ID NO: 48208 - DNA, 101 bp, rice(Oryza sativa)
  misc_feature (71): n=t or c
ccatgcgctcgcgtttcccccatgtagtacgtgcacggcgcacccattcctctgctcgatttcacgttatntcaacaatatcgaagtgcgtggtagtcgtg

SEQ ID NO: 48209 - DNA, 101 bp, rice(Oryza sativa)
  misc_feature (71): n=a or g
agtttacaatcgattattatagatgttacaggttccatccaactggggcttgaagaatcccttttccatgntaattattcagttgaatccttgtttggagc

SEQ ID NO: 48210 - DNA, 101 bp, rice(Oryza sativa)
  misc_feature (71): n=t or c
actacaaaaaaaaaaaagtcagccttctccatcctttacacactgaaaaaacggaagtacttgctccctcngtaaaaaaaaaagacaaatcctttctgtgt

SEQ ID NO: 48211 - DNA, 101 bp, rice(Oryza sativa)
  misc_feature (71): n=a or g
ataaaatatagccacacattaccacaagtacacgacgacacaatcaacatatccacctcacctatgattancttaattagctccaacgacaactaacgaag

SEQ ID NO: 48212 - DNA, 101 bp, rice(Oryza sativa)
  misc_feature (71): n=a or g
ctccccttctcccacatttccttgagccagcggatgagcggaggtcttcaccttctcccccgacatggtgntggttcccaaccacgcagatttggggccca

SEQ ID NO: 48213 - DNA, 101 bp, rice(Oryza sativa)
  misc_feature (71): n=a or g
aatactgtatagtacatacggccgggatacagctagcgtggccatatatatttgctgcccgtattactgtnagatataaatgaaaataaaagaaataatga

SEQ ID NO: 48214 - DNA, 101 bp, rice(Oryza sativa)
  misc_feature (71): n=a or g
agcgtggtgggctcacggagaaggttgtaagggataaggtattgacgttccgcttcactgatgttggcacnctaccacctccagtgctgcagtttgtggag

SEQ ID NO: 48215 - DNA, 101 bp, rice(Oryza sativa)
  misc_feature (71): n=t or c
tattaccatttgccagtcgcctcgcctggcatggatggaaccatcgatgcatgttctcttgatgagcctanaagtcggcccatcaggctgcaggcccagct

SEQ ID NO: 48216 - DNA, 101 bp, rice(Oryza sativa)
  misc_feature (71): n=a or g
atgttagatccaagggtcgatcgaactcctagttcagctgaactgacatcggctcccctcgccatctgctnccacgtgggggactacgatgctctcccaat

SEQ ID NO: 48217 - DNA, 101 bp, rice(Oryza sativa)
  misc_feature (71): n=a or g
atacacagtcttctgggcaccaaagttgaatattgtgaaggaatatgggaggcctaaccaactgacaagtncaatgccaaccgtcatcacaacggtggaaa

SEQ ID NO: 48218 - DNA, 101 bp, rice(Oryza sativa)
  misc_feature (71): n=a or c
ggcatttttagggattttggagccagcacttatcatggttttgtggtagtgtttccaagacaacagcacanatattaatctcatccaaactatgtgttata

SEQ ID NO: 48219 - DNA, 101 bp, rice(Oryza sativa)
  misc_feature (71): n=t or c
tgatggcttacactataagctaacttatgatgtaagctggcttctcccgcaaggtgacttccggtttctantgtaagctttcttccgtgataagatatctt

SEQ ID NO: 48220 - DNA, 101 bp, rice(Oryza sativa)
  misc_feature (71): n=t or c
gatcttagtatgattcttgatggttttccatagtggataatttgttggtctggttcttggaccgaccaggntagaatgtcttggctctgattcgttcgaga

SEQ ID NO: 48221 - DNA, 101 bp, rice(Oryza sativa)
  misc_feature (71): n=a or g
tcttcgtctgtcgtctctcacttcagcgccttgtccatgagaaaatattggctgcaatgcatactaaactnctgggattagggatgaaagcggatcgaata

SEQ ID NO: 48222 - DNA, 101 bp, rice(Oryza sativa)
  misc_feature (71): n=a or g
tgttaattgattagcaaacaaaatacatcaaatcgagcaagcattcaggtatacttactactctaaatctnttataagttacatccacctaaaatccctta

SEQ ID NO: 48223 - DNA, 101 bp, rice(Oryza sativa)
  misc_feature (71): n=t or c
gggttactcgtggtgtagaaaatatggtatacccctagcacatagggaaacaccagacatccatatagaanacatgtacgtctatgggaaggctactccca

SEQ ID NO: 48224 - DNA, 101 bp, rice(Oryza sativa)
  misc_feature (71): n=t or c
caatgaacagcctgacacaaaatcctgcatttatatatgagccgagcaatccgagcaaaacctctgttctncccgataagcttgtaacctgcagtgcttta

SEQ ID NO: 48225 - DNA, 101 bp, rice(Oryza sativa)
  misc_feature (71): n=a or g
ttccgtacggcgaactccaccgatactagctactacatattcgactatatgtaatgggtcatctctgacangccaaaaaatatctcatttaagatatgact

SEQ ID NO: 48226 - DNA, 101 bp, rice(Oryza sativa)
  misc_feature (71): n=t or c
gtgcaacatggatgttcattcaacatgcacgcctgatccacatctaaaccttagtacagttaccattttangtttttaaagtctcagatctgcttgttttc

SEQ ID NO: 48227 - DNA, 101 bp, rice(Oryza sativa)
  misc_feature (71): n=t or c
aaaaccactgagggagtcaaattgcactgatttcagtagttcgggagtcatcctatcctatccggttttgnggttgagggttacatattagatttgggtca

SEQ ID NO: 48228 - DNA, 101 bp, rice(Oryza sativa)
  misc_feature (71): n=a or g
atccatctctaccagactctactccacttcactatcatcacgtacgtatctcttcgtaaataaactgaggnaaacctgagattatatttgatatacaaagg

SEQ ID NO: 48229 - DNA, 101 bp, rice(Oryza sativa)
  misc_feature (71): n=a or c
atctaggatggatgtcgtcatcgctattccagtcacccgaaactatattttcacaacttaagccccacatntacgatgatctgagctcaaccttcgatgtt

SEQ ID NO: 48230 - DNA, 101 bp, rice(Oryza sativa)
  misc_feature (71): n=a or g
tatcctaaacgacttactttacgagtatgaagggaatatgtgttaagcgagtgtactcgtaagcatatgtnctcgtctgaattgaaaaattaaaaatctgt

SEQ ID NO: 48231 - DNA, 101 bp, rice(Oryza sativa)
  misc_feature (71): n=t or c
ttcctttgggcggcggcaccggccttcgacgacgagccagtgatggttagcaacgcattagcactagcgangttttgaggacgcgtgggcgaagcgctaga

SEQ ID NO: 48232 - DNA, 101 bp, rice(Oryza sativa)
  misc_feature (71): n=t or c
gaatgatggacccaacagtgtcgtcaaagtgacaaccatggaaaaaaaaaaggatgcgtctaagtcgattnttgttctagtcttataggaaatatgaaagg

SEQ ID NO: 48233 - DNA, 101 bp, rice(Oryza sativa)
  misc_feature (71): n=a or g
gctagtagagtagctcaggtaggtgctgcaagagttgaggtgagattgaacatatgtgggtttcatgagcngaggttttagcgtttgcagttgggggaaaa

SEQ ID NO: 48234 - DNA, 101 bp, rice(Oryza sativa)
  misc_feature (71): n=t or c
acatgagagaaaatggctgccagatgtggcatgtacttctataaaacaaaacaacacagaaaattgtcatncaaaaagtgtttcaaaacaaaattcataat

SEQ ID NO: 48235 - DNA, 101 bp, rice(Oryza sativa)
  misc_feature (71): n=t or c
tgtatgagaactaatgtcacagtgcattttttaggttcaaactgagtgtgatagcaggcgatcatacagcngacactacatttattgtttttggccgtttg

SEQ ID NO: 48236 - DNA, 101 bp, rice(Oryza sativa)
  misc_feature (71): n=t or c
tcatatcctcattcccatgtgctcatgaggtatgtgcgtcgatttgcatccaaataatatcaatgatggangtttggtaactaaatgttaattcttaatta

SEQ ID NO: 48237 - DNA, 101 bp, rice(Oryza sativa)
  misc_feature (71): n=a or g
tcaaatcaaatgcatggaaaaatatcttgctttacagtttacacagctgcacaatgcaagggggcagcganaaagatactccctccatttaaaaaaaatgt

SEQ ID NO: 48238 - DNA, 101 bp, rice(Oryza sativa)
  misc_feature (71): n=a or g
tacgcatttcagaacacatttagcattaccaattctgcttgttcatactttagactcacaagtcgacacgngaactttactaattactactacccaccaat

SEQ ID NO: 48239 - DNA, 101 bp, rice(Oryza sativa)
  misc_feature (71): n=a or g
agatttggtatttaaaggttccatcgtacataagtagaaactgtggcagattgaacaaacaaaaataaacngacaagaaatgagtaagatatagcggttgg

SEQ ID NO: 48240 - DNA, 101 bp, rice(Oryza sativa)
  misc_feature (71): n=a or g
ggcgcaccggtccatggtggaccgagtccacgggaccgaaaggggaagagccatgtggcgctgacgtggcnccgaggtggaggccacgctggcggccacgt

SEQ ID NO: 48241 - DNA, 101 bp, rice(Oryza sativa)
  misc_feature (71): n=t or c
gcattcctgtttcacaactccccatcctcagtactacccaaaaggaaaatgtgcaccgaaaatcgagctanaaaatcatccccaaccacaaaaccagatat

SEQ ID NO: 48242 - DNA, 101 bp, rice(Oryza sativa)
  misc_feature (71): n=t or c
gtaattgctaatagcatatgcttcaatattagtaccatctgacaagattatgagttcaagtctcgctatantattctaagtaaattttataaaactgtaaa

SEQ ID NO: 48243 - DNA, 101 bp, rice(Oryza sativa)
  misc_feature (71): n=t or c
aaacgcaaaggatccgaatccatgccgtcagtcctctttcaaacacgtattatattgggccaattgcttanttgaccctgttttaaaagctaactaccaat

SEQ ID NO: 48244 - DNA, 101 bp, rice(Oryza sativa)
  misc_feature (71): n=t or c
cgcgtcgtccatagcgctacccctccaatctctctggtcgccttcagccacacctggacctgtctaatcgngagtgaggtcatcgtctccgcgacgtcctc

SEQ ID NO: 48245 - DNA, 101 bp, rice(Oryza sativa)
  misc_feature (71): n=a or g
gtacgtttgtttttttggcaagaatacctacccatatacttaacgaggatatggcgggagggcaggcggcntgcagcggcaccatcccctctctccccctc

SEQ ID NO: 48246 - DNA, 101 bp, rice(Oryza sativa)
  misc_feature (71): n=t or c
cacgtccaagtacacagtgtcgtccgtcctcgatcgcttcaagaacacgatcgatcgagaagagcatgcangaattcatgcagaattaagatgcattcaat

SEQ ID NO: 48247 - DNA, 101 bp, rice(Oryza sativa)
  misc_feature (71): n=t or g
tcaaactaaaagggctagaagataatgaagatgtggcagctatgcctctaaagcttttcatcatccattcnattaaactagtagattaatctcgtatattt

SEQ ID NO: 48248 - DNA, 101 bp, rice(Oryza sativa)
  misc_feature (71): n=t or c
cctcgacttcactgacgcccaagcttgcctcgagaaggtcaatcaaactctcaactgaaaatttctactcnctccgtttctagatatttgatgctgttgac

SEQ ID NO: 48249 - DNA, 101 bp, rice(Oryza sativa)
  misc_feature (71): n=t or c
catctttcttaaaatttgtgtggaggttaccacttaatttagggtgatatttaactatttgcttatagtanttgccctcagttcttgaatattagctacct

SEQ ID NO: 48250 - DNA, 101 bp, rice(Oryza sativa)
  misc_feature (71): n=a or c
attttgatcgtttgtaacgaaaatgatcgatttgaagcaaaaattgtacatattttttggggaacggaaanaagccatacataatatttttgttaaactgt

SEQ ID NO: 48251 - DNA, 101 bp, rice(Oryza sativa)
  misc_feature (71): n=a or g
tcatctctatgattgcctctaggacatatcactaacatattgtccactagatgacaccccacacggtgcancgagatattgtcgtgtgcaatacaattaca

SEQ ID NO: 48252 - DNA, 101 bp, rice(Oryza sativa)
  misc_feature (71): n=t or c
atgtcaacgaagaggaaacgaaacggacacaactacccttgccttcattgccagaacacgttaaacctacnaagggtagaacggtctttgtccacaaatat

SEQ ID NO: 48253 - DNA, 101 bp, rice(Oryza sativa)
  misc_feature (71): n=t or c
gcgtgtatatgaaggctgatagataaaaagtgatacgtacatggtgcatggtggggagggatgcatgatgngtaccgaggagcggccgtccgattttttct

SEQ ID NO: 48254 - DNA, 101 bp, rice(Oryza sativa)
  misc_feature (71): n=t or c
attatccagttagaatgtatctctgtgaatgccatgacttataattttaagtctagatcaagcataccatnacggtcatatttcaagtgtatatcatctag

SEQ ID NO: 48255 - DNA, 101 bp, rice(Oryza sativa)
  misc_feature (71): n=t or c
gaagaaataactgtccattgggtatctatcccacaaacacctaaatcggtgtaagctacttcctccgtttnagattatagatgtcttaactttggttaaat

SEQ ID NO: 48256 - DNA, 101 bp, rice(Oryza sativa)
  misc_feature (71): n=t or c
atttttggtccaccattgcaatcaatcaagcgagaggtgtactttactgattcttttttctttttcttttnttgtttgggatatgatgcttgagacgacca

SEQ ID NO: 48257 - DNA, 101 bp, rice(Oryza sativa)
  misc_feature (71): n=t or c
caccaatggaaatagacagaattcttccaccaacaatatctaacctgtagcgactagatttgtaaattttngaaaaaagattattttttaaatattttaat

SEQ ID NO: 48258 - DNA, 101 bp, rice(Oryza sativa)
  misc_feature (71): n=t or c
tagaactaagtactctccctccgttctcgaataactgacacggttaactatagaggtctcactttgattanaaattacttttaaataattatattatgaat

SEQ ID NO: 48259 - DNA, 101 bp, rice(Oryza sativa)
  misc_feature (71): n=t or c
ccacaaattccatcccagcttcaagtggccctgacagaaatatcgatgaaggggacaaaattcgtgtctgnaacttttgctttaagcaatgggagcaagag

SEQ ID NO: 48260 - DNA, 101 bp, rice(Oryza sativa)
  misc_feature (71): n=a or g
ctgatggagaggaagccacttagacagagatgaggtcaccgttgtcttgctcctcttttgttagccaccgntagcatctggggagcgagaaggggaaggag

SEQ ID NO: 48261 - DNA, 101 bp, rice(Oryza sativa)
  misc_feature (71): n=t or c
tgctctgttcctctattttatgtatgccttttatttttctccagtgtcatttcacacattttttatagctnttttctttcatggaactgttgaattgttta

SEQ ID NO: 48262 - DNA, 101 bp, rice(Oryza sativa)
  misc_feature (71): n=t or g
taagttagatcacacctggcccataccaatcccaaatctcaagggcatgggactgttgttgtaatgtatangcatattattagtttttattaaaaaataga

SEQ ID NO: 48263 - DNA, 101 bp, rice(Oryza sativa)
  misc_feature (71): n=t or c
ttgttctcttcttcataaattaaatccaaatggatttacttacactttgccaccttacaacaatgaatacnaaaaaagaatagtaaatctcttttacagta

SEQ ID NO: 48264 - DNA, 101 bp, rice(Oryza sativa)
  misc_feature (71): n=a or g
tgcagatcattgcattaagatgaaagtagtttacaaggaacctaaaccagtccaaatgttaaacatctagnctaatcaaccagaaccgaaacacaacagat

SEQ ID NO: 48265 - DNA, 101 bp, rice(Oryza sativa)
  misc_feature (71): n=t or c
attgtgaaacatgcataactgctaaattttcagccaaccaatttagcgctcttggccatggtactttcctngagttcttggggaaacatgagcaacattta

SEQ ID NO: 48266 - DNA, 101 bp, rice(Oryza sativa)
  misc_feature (71): n=t or c
tctgaaaaagaaaataatatgacccccaagttactacatactccatctttctaaaaaaaaaaaatccattnctagatatgtgttctcgactctatgttcag

SEQ ID NO: 48267 - DNA, 101 bp, rice(Oryza sativa)
  misc_feature (71): n=t or g
tcctgggtgtctaggataattgggttggagtcctatgacagtcttaagttcctatatccatcatttttccntagtgaaaaccagagcacacgcatagagac

SEQ ID NO: 48268 - DNA, 101 bp, rice(Oryza sativa)
  misc_feature (71): n=a or g
gcttctgaccagattttgaaagaaaaggatgtcagctattaagtttgtaatatggaaaaaagacccaaganaaaggaatagtggtgacgacccctgttttt

SEQ ID NO: 48269 - DNA, 101 bp, rice(Oryza sativa)
  misc_feature (71): n=a or g
agttaacgtaacgttacttgagttcagatctgtgttcagacaacacatcacatgtatagtactcctgtatncattatcttctcttctgtgtttatataata

SEQ ID NO: 48270 - DNA, 101 bp, rice(Oryza sativa)
  misc_feature (71): n=a or g
aatcggtatttttgcatgcaggagacacacttgtatgcaaaaatcttttttgcgtgtggtcacttatgctncccgcttgcaaaaagaaaaatcgtgaaaaa

SEQ ID NO: 48271 - DNA, 101 bp, rice(Oryza sativa)
  misc_feature (71): n=t or g
tcctagaaaaatgaaggcatctacaagttgttttctaggtggaaatggattcgcatgtttgctagtcttanttttcttttttgttctttttagttatcttg

SEQ ID NO: 48272 - DNA, 101 bp, rice(Oryza sativa)
  misc_feature (71): n=t or c
gtacagaaaattttgtaagaatgaaagatatacaaaggttttcagagtgcttgactttgcccaaaatcctngtgcagtccggtgagggacgtcgccgactc

SEQ ID NO: 48273 - DNA, 101 bp, rice(Oryza sativa)
  misc_feature (71): n=a or g
gacaaaggtggggaggggggggagatggcggcaacaacagcacaaagagcaacgacaactgacgattgccnaccctggtggaaggactgctcctcagcggc

SEQ ID NO: 48274 - DNA, 101 bp, rice(Oryza sativa)
  misc_feature (71): n=t or g
gtgaactcacttggtctggtttttcttatcctctgtgatgttgcacgcgatacacttaattatatggttgngaaaatgcctttaataatccctggcggtat

SEQ ID NO: 48275 - DNA, 101 bp, rice(Oryza sativa)
  misc_feature (71): n=t or c
caattgtatgttaggtaatggttactctgattaagacgtggctactacttcttacccaaagaactggtccncaagaccaagaacatggcaacctgatcata

SEQ ID NO: 48276 - DNA, 101 bp, rice(Oryza sativa)
  misc_feature (71): n=a or g
atatgagttctgaaagcagttttgggaacatcttgattagacatcctaatctgatggtaacctgatctganatctaacttagtaaagattttagctccatt

SEQ ID NO: 48277 - DNA, 101 bp, rice(Oryza sativa)
  misc_feature (71): n=a or c
tccatgaagctcctcgcctgctatggctagccccttccgatcgaagggagctcttttggcaagacgatganggtggtgattggggaagagggtgctctatc

SEQ ID NO: 48278 - DNA, 101 bp, rice(Oryza sativa)
  misc_feature (71): n=t or c
tttctaatagtagctcagagttgcggctctctcttgcttcagaagaagccttcaggtctgtataatctttngttaactcacttagcttttcctcagcttca

SEQ ID NO: 48279 - DNA, 101 bp, rice(Oryza sativa)
  misc_feature (71): n=a or c
gatgaaaagagatattaggtagggaaattaaatgggagatgattagtctaacgagttaagataagatgtangtaggtgtaaaaatagctatatttttaaac

SEQ ID NO: 48280 - DNA, 101 bp, rice(Oryza sativa)
  misc_feature (71): n=t or c
gaatatagtatcaaagttactttgttatatatttaaaaaaaatgtaacagtatctttcatcttttaagggnttgtttagttcgcgaaatgaaaatttttgg

SEQ ID NO: 48281 - DNA, 101 bp, rice(Oryza sativa)
  misc_feature (71): n=t or c
tcgtccccatcctcccggagacaggacgtcgtcgccgcccttgctaacaacgatggcacggagctacctcnccctatccgccacaagccaaggtagctaca

SEQ ID NO: 48282 - DNA, 101 bp, rice(Oryza sativa)
  misc_feature (71): n=a or g
gtatcatcccctacatgagaaaaacaaaagggtgcaagttgacaatgccactttgcgccagataaaattanttccaggcagtatttgggttagtaaccaat

SEQ ID NO: 48283 - DNA, 101 bp, rice(Oryza sativa)
  misc_feature (71): n=a or g
gtcagatttgtatccccgggatctcctattagattcgtgccggagtacttccgtgtctctgccataatgtntgttcacacgctagttcataagaatatgat

SEQ ID NO: 48284 - DNA, 101 bp, rice(Oryza sativa)
  misc_feature (71): n=a or c
tcagctctctccattcatttacatcacgagtccacagatcatccaataccaggaaataatttccattctgnagaattcccctgagcttattttgtaaatgt

SEQ ID NO: 48285 - DNA, 101 bp, rice(Oryza sativa)
  misc_feature (71): n=t or c
tgttggtcccttccccactgagcgaacaaatccattcctttcaggcccacatacacgtgacataaggtccncttcagttatgcttttttctgtccactccg

SEQ ID NO: 48286 - DNA, 101 bp, rice(Oryza sativa)
  misc_feature (71): n=t or g
caagtcgcgcgtgatttgtcagctgttagttgtcacacctactcatcagccaaccaattcgccatcaatancaaaccaagcggattgatcatctcatctca

SEQ ID NO: 48287 - DNA, 101 bp, rice(Oryza sativa)
  misc_feature (71): n=a or g
acaacagggtaagagcagtgtgaagctaccatcatcgtcattcacctatggctggttggcagatcacatcnaatccatatagtctaatccttatatacaca

SEQ ID NO: 48288 - DNA, 101 bp, rice(Oryza sativa)
  misc_feature (71): n=t or c
gtcacacctttcatacgcacacaatattttagagtctgtgttgtgttacagctaactacaagtccgctttntttctctctcttctcttttcttctctacat

SEQ ID NO: 48289 - DNA, 101 bp, rice(Oryza sativa)
  misc_feature (71): n=a or c
taatatgtaaatcttacatagaaaacatggttatatccaagctgatgatgtccttatcaatactatttacnttttttaaaaatctaggctttttaatttgt

SEQ ID NO: 48290 - DNA, 101 bp, rice(Oryza sativa)
  misc_feature (71): n=t or c
cgattaatttaacttacagatgatttaatcttgttactggggacaaagcaacggggcttttaactatttgncacttttagatttagcaaataactatttgc

SEQ ID NO: 48291 - DNA, 101 bp, rice(Oryza sativa)
  misc_feature (71): n=t or c
aggtggcggcatcgggaccgggcaccggcacatgcgagaacagcaacaccaacgtagacaacaacaccaanaatgcctcatctagtaccggagcattctcc

SEQ ID NO: 48292 - DNA, 101 bp, rice(Oryza sativa)
  misc_feature (71): n=a or g
tccggctccttcatcctagtttcatcggccatgacttcctagtcggtttcttcttcgacgatggctccatntcaattgttttccaggttcatcatctatgc

SEQ ID NO: 48293 - DNA, 101 bp, rice(Oryza sativa)
  misc_feature (71): n=a or c
gtcctatcctcatccatcccacccctccaactaaacacaacatcagtcattccatcactgttttgtaccgntgtcaacactgctctggcagttcaatgcag

SEQ ID NO: 48294 - DNA, 101 bp, rice(Oryza sativa)
  misc_feature (71): n=a or c
tcgttgatatattgcttgtacgcaatatcacggtgagcatgtgcgatggctgtactttcaaacaggaagancactatcttatccgtatcgagctcagtgta

SEQ ID NO: 48295 - DNA, 101 bp, rice(Oryza sativa)
  misc_feature (71): n=t or c
gcattttgcgagcatttcaccgccctgctcatcaagcagatcaaagtcgaagaactttgcttcacctctgncattgctcaagtgctggagaccagattttg

SEQ ID NO: 48296 - DNA, 101 bp, rice(Oryza sativa)
  misc_feature (71): n=a or g
ttagcatccaaatcccggggtccagctacctcccgaccaagaagaacctaaagacatggtcagtggacaanaaggtgagaagcatgctcacggacatcatc

SEQ ID NO: 48297 - DNA, 101 bp, rice(Oryza sativa)
  misc_feature (71): n=t or c
ctgaacctgataatttaggacctgcactggacctgcactcgtcgtaactggtagagaggaggcccaacaangagtttttgacagggatgcagaggcggaga

SEQ ID NO: 48298 - DNA, 101 bp, rice(Oryza sativa)
  misc_feature (71): n=a or c
agtaggactgttccggctcagaacaactctaatgcaccagtacagaaggcccgtgttaatcatgttatggntgcggaagctcagaatgcacccgatgtggt

SEQ ID NO: 48299 - DNA, 101 bp, rice(Oryza sativa)
  misc_feature (71): n=a or g
tgctctcctaaaaatcccactttacttcaacttcctttttcaaagtggctagaaggtttccaggcacctcnaaagaaattaaccaatacatgagttctaat

SEQ ID NO: 48300 - DNA, 101 bp, rice(Oryza sativa)
  misc_feature (71): n=a or g
catccgcccgtggggagaaagcgggagagagacagagaggaggtgggggtagggatagggagccgcatccncgccagagagaacctgaggctagatccggc

SEQ ID NO: 48301 - DNA, 101 bp, rice(Oryza sativa)
  misc_feature (71): n=a or g
tcttgacaaaatgcagtaattggttgcaggacaattattgtttctaaagtcgtatatttggttcttgaagnaagaacaatgttgaagaatttatatgtctt

SEQ ID NO: 48302 - DNA, 101 bp, rice(Oryza sativa)
  misc_feature (71): n=t or g
gaaaaagtacgaattactccccctcgaactatcgtggtcaactaaattacccccgtaaactttcaatactngacaaattacccccctcgacccaatccaga

SEQ ID NO: 48303 - DNA, 101 bp, rice(Oryza sativa)
  misc_feature (71): n=t or c
caacaggtcatgcaaccagctcagcaagcaccatcaactcagcagcatctccaaccgattcagcaagcacngccaatgcagcggcttcagccgatccaaca

SEQ ID NO: 48304 - DNA, 101 bp, rice(Oryza sativa)
  misc_feature (71): n=t or c
cccaatccagatatattaccagatcggcgacttctatcaaaaccatcgacggtaattcgtgcatgacattnctcattttgttttttttaaaaaaatacttc

SEQ ID NO: 48305 - DNA, 101 bp, rice(Oryza sativa)
  misc_feature (71): n=a or c
aggaagactgtatctgcaaagttcagaatcaaggcaatttccatggctagctgcaaggctagcagttcagnttgcaaaggggattctgccaaatgactata

SEQ ID NO: 48306 - DNA, 101 bp, rice(Oryza sativa)
  misc_feature (71): n=a or g
agggatccccatgctttctttcatgatgagaggctttcgctgatgagaaaggaaaggggaaaagggagttnaagggaaggaggattttggcagatgagcgc

SEQ ID NO: 48307 - DNA, 101 bp, rice(Oryza sativa)
  misc_feature (71): n=t or c
gaccaaagatgatttctccaccagtgcactttacccgaccgactcacccctattgatttgtggagctcctnactgatttatttttgttttgtttatatgtg

SEQ ID NO: 48308 - DNA, 101 bp, rice(Oryza sativa)
  misc_feature (71): n=a or g
tcagcttagttggttctcatcaagatgcaggatacttgggtacattgatccacgcagcaactgtaggattnaatcataagaactaagctaaccagaaaagg

SEQ ID NO: 48309 - DNA, 101 bp, rice(Oryza sativa)
  misc_feature (71): n=t or c
ctttattttcttcacacatttgattttccaaatccaaaccacaggtcttggaacagaaatcccagcgaaantagatttgtaaaactttctcgaggaataat

SEQ ID NO: 48310 - DNA, 101 bp, rice(Oryza sativa)
  misc_feature (71): n=a or g
tcaatcaaaccctaacccctgtaggcctcaccattttttaaaacctttgaagcttcttccaacacatccancccatccagccaatcaatggcattccggca

SEQ ID NO: 48311 - DNA, 101 bp, rice(Oryza sativa)
  misc_feature (71): n=t or c
ggctcggttcagatcttgcgagtcactaggtagatgaacacgtggggagcatatttgtggagggatgagantgatttttggctaattcagagtatgatccc

SEQ ID NO: 48312 - DNA, 101 bp, rice(Oryza sativa)
  misc_feature (71): n=t or g
actagtcctaaaataccacgcaagcttaactgatgtagtggaggaaaaaaatgagatgagaggagagagtnttagcactaccccttgtattagagagtgtc

SEQ ID NO: 48313 - DNA, 101 bp, rice(Oryza sativa)
  misc_feature (71): n=a or g
ttgggaacatgccatctcttagtgatcttaccttatgggtgaatgagcccacgcaagacagacatgaaagnttggtcatcgacaattgttatccattccac

SEQ ID NO: 48314 - DNA, 101 bp, rice(Oryza sativa)
  misc_feature (71): n=t or g
gggcagaagtaatcactattcttttatgcatcttggtgttaaacatgtgctgaaaccaatgcatgatagtnctatcaagtcactggtatttcctgttgtaa

SEQ ID NO: 48315 - DNA, 101 bp, rice(Oryza sativa)
  misc_feature (71): n=a or c
gagtcaattactagtttactacccatcccccatcattttggacattcatggggttgattggatggaatccntaatgagatggtgcttattttttattcctc

SEQ ID NO: 48316 - DNA, 101 bp, rice(Oryza sativa)
  misc_feature (71): n=t or c
atcccttttgtgtaaatggtggcttctctggggtgagaaaaaaaacaaattcaactattatctgacaatcnccacaacaacagagcttcattgtgggcaag

SEQ ID NO: 48317 - DNA, 101 bp, rice(Oryza sativa)
  misc_feature (71): n=t or c
cttaatccctatcaagacctaccgtcaacatccatgccattaaaaagacatacggtatgaagctaagtganagtttaaatgcttgaaaagcatgaagatat

SEQ ID NO: 48318 - DNA, 101 bp, rice(Oryza sativa)
  misc_feature (71): n=a or g
agacgacacatcgtggggatgtgcaaagcaaatagggataaagcctgcagagtgcagacctaagaacctgngtggccttggtgtgcttaacctagaccagt

SEQ ID NO: 48319 - DNA, 101 bp, rice(Oryza sativa)
  misc_feature (71): n=a or c
gttgagttacggtgaaattgtgaaattggttaagtggccgtgttaaattgatgtttttagctgttttgatngatttaattaagatatcagaggcttaatta

SEQ ID NO: 48320 - DNA, 101 bp, rice(Oryza sativa)
  misc_feature (71): n=a or g
atacaagttcaccaaactaaggatcgacattgaacacataacagtcaaagacacagacatgatcgactatnctaacttccattcgagatctataatttctt

SEQ ID NO: 48321 - DNA, 101 bp, rice(Oryza sativa)
  misc_feature (71): n=t or g
gatattcagacatgctaacacctgaccaacgagatgaggtttgtaaaccttgtactttgtggttttagagnctgccattattaattttggctgtggtagca

SEQ ID NO: 48322 - DNA, 101 bp, rice(Oryza sativa)
  misc_feature (71): n=t or c
cagatgaccctgtaaaactattagggccatgcattagtagtagagtgataatggccatccaatttgtttantataaaacatgattatccagtaatcagcgt

SEQ ID NO: 48323 - DNA, 101 bp, rice(Oryza sativa)
  misc_feature (71): n=a or g
cggcctcaaccatcctatttgccacttagctcaaatgccaataaaattgttttgcagagaatccatctcangaatgaagcaaaaactgcgactcttgagag

SEQ ID NO: 48324 - DNA, 101 bp, rice(Oryza sativa)
  misc_feature (71): n=t or g
aaccgagtgtttgcgtcacctgctttgatccacaattgtctggatctttaacgaagtcgcaccctgtctanggctgccagacctaagagcttctgcttaag

SEQ ID NO: 48325 - DNA, 101 bp, rice(Oryza sativa)
  misc_feature (71): n=a or g
tggaagccgtaaacggcgcgggcaggccaccgtcaaaccagcctcctcctctcttcctccctatgccagcngtggctccatttccccgcatcaccatcttc

SEQ ID NO: 48326 - DNA, 101 bp, rice(Oryza sativa)
  misc_feature (71): n=t or c
tcggcattaaaaaatgtcctcgaaccgcaaaatcagatatacaggttcctgaactgtacgaaaccggtcgnccgaggtctttttggtggtttttaccccgg

SEQ ID NO: 48327 - DNA, 101 bp, rice(Oryza sativa)
  misc_feature (71): n=t or c
ttcccctcgtttggtgcaagccattttatcaattttattaaaaaacattaacaacatactctctccatccnataaaaaatgaatctagaatcggatgtgac

SEQ ID NO: 48328 - DNA, 101 bp, rice(Oryza sativa)
  misc_feature (71): n=t or c
gcgatgcctctctctctctctctcctctcctccgttggttcgaaatttcgaattctcctcaaatttagaanaaaatttggaattcatatgcactcaaatgc

SEQ ID NO: 48329 - DNA, 101 bp, rice(Oryza sativa)
  misc_feature (71): n=a or g
cgcgctgtttacaggtcatacttcttgggagttgggaaattaacatgagcatttggacacatctgtcttgnctatttctgcagctgtgatgatccataagc

SEQ ID NO: 48330 - DNA, 101 bp, rice(Oryza sativa)
  misc_feature (71): n=t or c
tttataacatgagatggttctgattttgaggggtagcttggcattgctgtgctgtgccatgctggtaaatntggttagatcagaaaagcaggtcattgact

SEQ ID NO: 48331 - DNA, 101 bp, rice(Oryza sativa)
  misc_feature (71): n=a or g
aatcgagataaaatatgtatgttaatcagaaaagagcggggcaaataagctgggaagatccaactccaatncaaatcacttcattaagattcatctcttac

SEQ ID NO: 48332 - DNA, 101 bp, rice(Oryza sativa)
  misc_feature (71): n=t or g
aagtgaaataaagatgaaggacatgttcagataacatccacactttacaacacactaccacaaaactcctnatgggttgtactaagtcataatttgatgga

SEQ ID NO: 48333 - DNA, 101 bp, rice(Oryza sativa)
  misc_feature (71): n=a or c
tccaaagataactgaaaccgtaaaaccattatgttccatagaaatctaaggtatatctatgggagataatngtacaagacctctaaaagaaatgattgatt

SEQ ID NO: 48334 - DNA, 101 bp, rice(Oryza sativa)
  misc_feature (71): n=t or c
aggaaacatggtcaatttctcggctgctatcacattccttgttttcttagtcttgggagacttatagccanactaaaggcaatacagtcgaggaatgacaa

SEQ ID NO: 48335 - DNA, 101 bp, rice(Oryza sativa)
  misc_feature (71): n=a or c
cgataccagggcattctgatggtgtgtttgatctcccatgagttgtaaactaccgtgacattaccatacanatgcaccttttgaaaccaaagcaagagaga

SEQ ID NO: 48336 - DNA, 101 bp, rice(Oryza sativa)
  misc_feature (71): n=a or g
tcatccagtattgtaattcaactatattagaaaaactaccatgtaaagcactaagaaaaggagctgcagtncatgaattgtatgacaaaaaaaaagctatc

SEQ ID NO: 48337 - DNA, 101 bp, rice(Oryza sativa)
  misc_feature (71): n=t or c
cgcggtatgcacgcacgaatccctcccgtacgttctttgctacttgcttcaagccctagcgcgcatggatngatcgcctgcttgtttagatatttgatttc

SEQ ID NO: 48338 - DNA, 101 bp, rice(Oryza sativa)
  misc_feature (71): n=t or c
tatggatttttcaaatttgatatgaaagcgatggaaagaatgtgtttggtttgttgtgtttccaaagggtntgttcgcgacaacttttttgcagctgcgca

SEQ ID NO: 48339 - DNA, 101 bp, rice(Oryza sativa)
  misc_feature (71): n=t or c
aatgcaccacaggctttacctagaggatgaagctgacaagcacaacaagtaactaatctcttgacagatancatactatcagatagattcctgttaccact

SEQ ID NO: 48340 - DNA, 101 bp, rice(Oryza sativa)
  misc_feature (71): n=t or c
ttcaacaagaaagttgccagcacttgtttctttcccatgtaaagctattacaactcctgtggacaattggngggtgagtattccaagcaacatgatatatt

SEQ ID NO: 48341 - DNA, 101 bp, rice(Oryza sativa)
  misc_feature (71): n=a or g
gtcgctggactacaggcccgagtacgatgacatcgaggaggccaagtcccccaacaccagcgtcgccgccntcgcagtcaagaacgccgacgcctccgtct

SEQ ID NO: 48342 - DNA, 101 bp, rice(Oryza sativa)
  misc_feature (71): n=t or c
ttgagcaggccagaaaagagaggatgaacagagatctaaagcaggctctgttgggtgctcattacatgttngatttttgcaagagcctattcgttgatgct

SEQ ID NO: 48343 - DNA, 101 bp, rice(Oryza sativa)
  misc_feature (71): n=t or c
ttgataaacatgatgtatgcatcatacaagatctgcacatctctatgcttttggtcggacggccctgtccnaaccactatatccatgattatcaccttttc

SEQ ID NO: 48344 - DNA, 101 bp, rice(Oryza sativa)
  misc_feature (71): n=a or g
catcttacaatagcaatatataattctgatgataatatttctgtagccagtcgtgtagtaaaagatttgtnatagtgcagtaagatggtttgaagtgtata

SEQ ID NO: 48345 - DNA, 101 bp, rice(Oryza sativa)
  misc_feature (71): n=a or g
agttattttcaatcacttccacgcagctttggatcaagaggtgcacaaaactcttgtcctggttccttagnaacaaatatatattgtaatccaggtgcata

SEQ ID NO: 48346 - DNA, 101 bp, rice(Oryza sativa)
  misc_feature (71): n=t or c
gattgatcttcccgtgtggttacaggccagctttcgtacaggaagatgcctttcggcccgcctagaaaaanctattctatagtagtgacacctcctatctc

SEQ ID NO: 48347 - DNA, 101 bp, rice(Oryza sativa)
  misc_feature (71): n=a or c
cctcttccaactttacggagcttcacatcttggagaagacacatcatccccttaacttccgtgatcaaagnatgccacctagatttatcagaagacttaac

SEQ ID NO: 48348 - DNA, 101 bp, rice(Oryza sativa)
  misc_feature (71): n=t or c
actgcagaggcatccgaggaacaaatgcatcttcattttccctgtgttctgtttgtcgttcttggcgaggnggtgtttatgatcagagatgccagcatttg

SEQ ID NO: 48349 - DNA, 101 bp, rice(Oryza sativa)
  misc_feature (71): n=a or g
accaaaaattgaagttaccatagttgtgatacatttggcaaatgaagcttggtgataaacgaagaaatcanatatgaaaataaataagattattagtatat

SEQ ID NO: 48350 - DNA, 101 bp, rice(Oryza sativa)
  misc_feature (71): n=a or g
ataatggctaattatctaggttggttagccggtgctaagattgggtagcatgtcggctaaatatcggctcntctagtcgatgctacagtcaagcatcacaa

SEQ ID NO: 48351 - DNA, 101 bp, rice(Oryza sativa)
  misc_feature (71): n=t or g
caaaatgaactacttctgaaggagaggggagatggtctgaactgaatcactcctaatcacgttaatcattncaatttggattactgcaattggaggcctgt

SEQ ID NO: 48352 - DNA, 101 bp, rice(Oryza sativa)
  misc_feature (71): n=t or c
tttgctcagagctgtctttgatgacattgatgcagtgccaagagtaatcgtgctcaaagaactccccttgngaggtggcttaggtcagtcctggacttttg

SEQ ID NO: 48353 - DNA, 101 bp, rice(Oryza sativa)
  misc_feature (71): n=t or c
gtatgtatgtgcaaaataaggaaagaagatgacaaacatatggtgatgatactgtcatgtacgcaggggcntatgcaggtctaaagtagtcttatctctaa

SEQ ID NO: 48354 - DNA, 101 bp, rice(Oryza sativa)
  misc_feature (71): n=a or g
atggttgactaaccggctagtctgagtttgaggtctcaatcctttctatttgatattagttcattctctantattcgtggtttctatatatctctttaaaa

SEQ ID NO: 48355 - DNA, 101 bp, rice(Oryza sativa)
  misc_feature (71): n=a or c
gctttccttcttcatttatctccatttattttaaatttcatcagtgcaatgcggcaaatttctcatttttntgtgagtttttttttttttttgcaaaatct

SEQ ID NO: 48356 - DNA, 101 bp, rice(Oryza sativa)
  misc_feature (71): n=a or g
agggttgtagcttaagccatagatcttggtttacttttgctcgcgtggtgggtggtgttgtgttggccatnttgttagtagcttactaccgatcttagttt

SEQ ID NO: 48357 - DNA, 101 bp, rice(Oryza sativa)
  misc_feature (71): n=a or g
agaagaggtccccgttcaaatcctatataccacacgtgtgcaaaattacgcaactcgtgaaacttgcgacntgcggccgtgtatatatagttgcttactaa

SEQ ID NO: 48358 - DNA, 101 bp, rice(Oryza sativa)
  misc_feature (71): n=t or c
tcttcaactattattaatattagacaaattacccgctgactcaacccaagttggttttggtcctacgtganagtccagttaacattttcttcgaaaacaaa

SEQ ID NO: 48359 - DNA, 101 bp, rice(Oryza sativa)
  misc_feature (71): n=t or c
gaatcgaactacaaaattcgaatcctgaggaattacggcaagagggtggattcacagggatggattaaatngagatcttggcatgaaaatacaaatgcaca

SEQ ID NO: 48360 - DNA, 101 bp, rice(Oryza sativa)
  misc_feature (71): n=t or c
tgaagtaggactacccaatgaaaatttcctagctacgccactgcttgcaagggacgcgaggccgacacggngggctgctcggccggttggcggtggcgagt

SEQ ID NO: 48361 - DNA, 101 bp, rice(Oryza sativa)
  misc_feature (71): n=a or g
cactaaattattattgttcaactcgatggtgcaatctgatgtgcatagctggcgtagattgtctaaaaacnatttgtatgagtggagattgacagaggaaa

SEQ ID NO: 48362 - DNA, 101 bp, rice(Oryza sativa)
  misc_feature (71): n=a or g
aattttgatcgtgaaaacgtgattatttttttctaattgcgacgcagacctaaccgcatgacgtgttactnttcctgactggttcagtgcattccgctttc

SEQ ID NO: 48363 - DNA, 101 bp, rice(Oryza sativa)
  misc_feature (71): n=t or c
tcctccttgatcttgggaatgatggtggttggcgtagtaacaacatgccaaaagatcctggcgtttcgttnacaccaaagcttccatgtcactagaataat

SEQ ID NO: 48364 - DNA, 101 bp, rice(Oryza sativa)
  misc_feature (71): n=t or c
attatgttgatataagtatacgaaagtacctgacatacagtgttcacctagatgctaaacactagatgganagtgacccatggtctagaggctagccagtt

SEQ ID NO: 48365 - DNA, 101 bp, rice(Oryza sativa)
  misc_feature (71): n=a or g
gtggtgggggcggaggtgggtacggtgaggaggctgggtgtggcgaggggggtgacgtttttttttattcncccaaaatattttcgcaggtgggtggatac

SEQ ID NO: 48366 - DNA, 101 bp, rice(Oryza sativa)
  misc_feature (71): n=t or c
gctagctaaaatggcgctgaggtttatgaaagggtcaattaggcctggggaataggctaattcaaaaactnaagtaaatacggaagtagggattttcggaa

SEQ ID NO: 48367 - DNA, 101 bp, rice(Oryza sativa)
  misc_feature (71): n=a or g
tgatagataggcactagtagttccatctgatctgagcaggcagtattacatgtcttgttggaactgttagnggaatttcacctccgtaaacttaagtgggc

SEQ ID NO: 48368 - DNA, 101 bp, rice(Oryza sativa)
  misc_feature (71): n=a or g
ttttttttttcttttcttttatttaaccttgatgagcaaggagaagagagccgttgcagtggtgaagatcnagattgctaattagcgcgtacgcgcgagat

SEQ ID NO: 48369 - DNA, 101 bp, rice(Oryza sativa)
  misc_feature (71): n=a or g
atcaccatgcgagtgattgtgacaagactctttgcataactccccctaaacaagcgcacccccccatctcntgtctaggtgaatccggaagccgcatatgc

SEQ ID NO: 48370 - DNA, 101 bp, rice(Oryza sativa)
  misc_feature (71): n=t or c
tcctccatctcctttcgactatgttcttgagttcttttagatatgcttcttgtttcgaatctttttttggntgtgtgatgccggagctttttctttcttga

SEQ ID NO: 48371 - DNA, 101 bp, rice(Oryza sativa)
  misc_feature (71): n=a or g
cttatgaccttgtgctcattcatgtagcactcaacagtgctcaccatatcgcctttgttcttcccacactntatgaatgtcaaagataaattgcaatatct

SEQ ID NO: 48372 - DNA, 101 bp, rice(Oryza sativa)
  misc_feature (71): n=a or g
gtcatatgcccatgctgcaaaattagcactaatatgaccaatgttggcaggatcataatctgattctctgnaattaagtaggacatatgtgttatgcatat

SEQ ID NO: 48373 - DNA, 101 bp, rice(Oryza sativa)
  misc_feature (71): n=t or c
ttttccattgccaagtcgataaggcagtgacaacacagacagtgattgaggaacaatgttgagctggtagngcggtttgttaatcttgctatcactaatac

SEQ ID NO: 48374 - DNA, 101 bp, rice(Oryza sativa)
  misc_feature (71): n=t or c
ttcacttaattccatccaaaacatcaaatagaagtagttgtcaacaggtttattgcatggtctgttgtcanagctcgtgcttgtttggaattaatctcaat

SEQ ID NO: 48375 - DNA, 101 bp, rice(Oryza sativa)
  misc_feature (71): n=a or g
ttgtttctcgagctgaggcttaccgtatgcattgccgatcttgtctgtagtttggaaaatagctgtaacanctacacataaaaccatcaatacataattga

SEQ ID NO: 48376 - DNA, 101 bp, rice(Oryza sativa)
  misc_feature (71): n=t or c
ttcgtccaaatcatgaggggtttctaatagccgcacgtgagtcatatgacccataagcataaagaatgaangcatgatgaccgcatataatatcatgactg

SEQ ID NO: 48377 - DNA, 101 bp, rice(Oryza sativa)
  misc_feature (71): n=a or c
gtggaagaatgatatatggagtatttctctagaagaactatgtctacaacctgccatggaaatgacaacanaatttctagactgacaaattaaattaaatg

SEQ ID NO: 48378 - DNA, 101 bp, rice(Oryza sativa)
  misc_feature (71): n=a or g
ccttgttgctcatgctcagccagagtggcccgcactttacaataaacaaatgtactagcgcgaaaggaagnaaggggaaaaaaaaaacacacaacggtttc

SEQ ID NO: 48379 - DNA, 101 bp, rice(Oryza sativa)
  misc_feature (71): n=t or g
gtttattctcagatttgttgtaggaaggttatctaattgacgcggcatcatgattgattgttctactaganttgcattcagtagtatattgtgttgtggaa

SEQ ID NO: 48380 - DNA, 101 bp, rice(Oryza sativa)
  misc_feature (71): n=a or c
tcatgtgctgtcttaaacagagtttattggagcacaacaacgagagaggcataagagcaagtttaatactnaaactttctaacattatccatatttatata

SEQ ID NO: 48381 - DNA, 101 bp, rice(Oryza sativa)
  misc_feature (71): n=t or c
tggtcctggcggtccggtccatctcgatacccagaaaatcaagccataggtccaatatatgtagtgcacgnatacaaaactgtcaattcagccgatgaact

SEQ ID NO: 48382 - DNA, 101 bp, rice(Oryza sativa)
  misc_feature (71): n=a or g
atctacggccaatgaaggcatgcttttctcgcaaagaatttcaaatggaatacaccagcgtacagaaatgnttgcaacttagccgtctcgcataaattaaa

SEQ ID NO: 48383 - DNA, 101 bp, rice(Oryza sativa)
  misc_feature (71): n=a or g
tgaattggaatgtcagagggttgaacaacccggcaaggagagaggctatctgtgaggttgcgaataatgcngatgcgagcatactttgcatccaggaaact

SEQ ID NO: 48384 - DNA, 101 bp, rice(Oryza sativa)
  misc_feature (71): n=a or g
gtctctggtggattctccaggcgaaaacttgtttcggatgtccgaaatagctacggcgatattatattctngattttgcaactttcttaaattgtcacatt

SEQ ID NO: 48385 - DNA, 101 bp, rice(Oryza sativa)
  misc_feature (71): n=a or g
taataatgtgggacatgcacgtgaatacaagtcttttctcacttttttttacggattcagatttaaattcngatagtatatatcggatatctctttcttct

SEQ ID NO: 48386 - DNA, 101 bp, rice(Oryza sativa)
  misc_feature (71): n=t or c
gtccgagcccgggagaccggatctagtcgaggacgcgttgggtctggctaggagacgttggctcatgatgnacattgcctcgtcatacccccccccccctc

SEQ ID NO: 48387 - DNA, 101 bp, rice(Oryza sativa)
  misc_feature (71): n=a or g
cattttagcaccataaatttcagaattcttttaagaacaagaatgctacaaactactgaaagtgagaacancaaagtcatctatcaatttgttatagttac

SEQ ID NO: 48388 - DNA, 101 bp, rice(Oryza sativa)
  misc_feature (71): n=t or g
tgcttattttccctctctcagacaatggttacgagtcatatcgcgtggatatcaagggtgttaattctgtngatgttgaagatccatacgattatgtttat

SEQ ID NO: 48389 - DNA, 101 bp, rice(Oryza sativa)
  misc_feature (71): n=a or g
tgaaattggacatattgctaacacgtgtgttgctcactgcccttattgtggataagagcatccactaggcnaatgtcctacaaggaagatcacttgtttct

SEQ ID NO: 48390 - DNA, 101 bp, rice(Oryza sativa)
  misc_feature (71): n=t or g
gcaacgcttacttcacgatttctccgtaaactttaaacgttagaactgttcattgtttagactgctttgtntttaaatttatttttaaggtttgtaatata

SEQ ID NO: 48391 - DNA, 101 bp, rice(Oryza sativa)
  misc_feature (71): n=t or c
ccaccagtcacccgaaaaaaaaaaagcaaagaagggtttacgatacctctctcatgaaacctaatgctganataattttttaactctctgatttttcatat

SEQ ID NO: 48392 - DNA, 101 bp, rice(Oryza sativa)
  misc_feature (71): n=t or g
cggcatcaacggcaacatcagcaagctcatgccggcgccgatcgatctcacgcgcattatgtctcttccgnccacctgcggcgttgccccgcctgttgagg

SEQ ID NO: 48393 - DNA, 101 bp, rice(Oryza sativa)
  misc_feature (71): n=a or g
ggtgacaacgagcaacgacagactaagagctagctaggctttcgggtttcaatttttgggattttttttcntgatttttcttttcgcaagcgggtgacata

SEQ ID NO: 48394 - DNA, 101 bp, rice(Oryza sativa)
  misc_feature (71): n=a or c
cctagctagctagtagcagtataagttactcccctcatttctataaggcataactattttttttcatgttncataatataaggcatgcatgcatgcatata

SEQ ID NO: 48395 - DNA, 101 bp, rice(Oryza sativa)
  misc_feature (71): n=t or c
agtaggtggccgcttgccaacttaaccgcactcgccacttctcggttgtcacgcctctctttcgtaccgtnacttatggtaacgctagctactttttattt

SEQ ID NO: 48396 - DNA, 101 bp, rice(Oryza sativa)
  misc_feature (71): n=a or g
gcatatataaagtagtgatgtaaatgggttggcccatgggtttgtaactttttaccgaccaaaaactaggnttaatcgaacttaaccctgaaaacaacgag

SEQ ID NO: 48397 - DNA, 101 bp, rice(Oryza sativa)
  misc_feature (71): n=t or c
atgcgatgtggccgtattgcgtaaggtacgtcctcttaagcaaccacacgtgataatcgatattcgtgtanagtctatgacctggtcccaagggaccactt

SEQ ID NO: 48398 - DNA, 101 bp, rice(Oryza sativa)
  misc_feature (71): n=t or c
gtgtgtgtgtgtgtgtgtgtgtgtgtgtttatatgttggattgcttgtttcttcataagtaaagtttggtnattgcatgtgacatatgtatttttctttaa

SEQ ID NO: 48399 - DNA, 101 bp, rice(Oryza sativa)
  misc_feature (71): n=t or c
aaacggtaattaccgggataatacggtaacactacactggatcaggtcagcactgacgggctcaaaccctnaactttgacgggtttagctcccggtcagag

SEQ ID NO: 48400 - DNA, 101 bp, rice(Oryza sativa)
  misc_feature (71): n=a or g
aatggagggatgtgtattttcagaagtctagatataatcctggtattatctatgttctccctctgttttcncttttaataaataacgttattgacttttag

SEQ ID NO: 48401 - DNA, 101 bp, rice(Oryza sativa)
  misc_feature (71): n=a or c
agagggaagaggaaaatgaagaaggaagaaaggggcgaaaaatagctcaccgtctttgagttcacggtggngaaaaatatggcgccgaagagctcggcgtt

SEQ ID NO: 48402 - DNA, 101 bp, rice(Oryza sativa)
  misc_feature (71): n=t or g
tcgatcttcttgcttctatacatctgaaaatcgaacatatggaagaaaaggcaacatggattaattttagnaaattaagaggaaatactactactgaccta

SEQ ID NO: 48403 - DNA, 101 bp, rice(Oryza sativa)
  misc_feature (71): n=t or c
ttggatgggtcaagagctgctagttctctaaaaattggtgatgttgttattgagaagccggacttagcagnggctgctattgaagaactgaagacacgtgg

SEQ ID NO: 48404 - DNA, 101 bp, rice(Oryza sativa)
  misc_feature (71): n=a or c
atctactatctgcacgcaacgcatccattgcccagtttggtagtaatcctggattcttttgttcctctcgnagccaagtgggcccaaagctaagcctgagc

SEQ ID NO: 48405 - DNA, 101 bp, rice(Oryza sativa)
  misc_feature (71): n=a or g
catccattcaagtgatggcatccaaataatacaatagcgagaacctatcatccaacaaataagcgaaacgncatatttaccaacgacaaataatttataaa

SEQ ID NO: 48406 - DNA, 101 bp, rice(Oryza sativa)
  misc_feature (71): n=t or c
cactaatggcaccagctcagttagatccgccagcgatgccagctcaatcagaacagccgaagaaggagtcnggaggaaagccaggaccctgcttcaactgt

SEQ ID NO: 48407 - DNA, 101 bp, rice(Oryza sativa)
  misc_feature (71): n=a or g
tacattgaatatttattcatgttaaaagagatcagtagtgttaccgtcatggtgacacactctcaatactngcacgaatattttgattctcatagtacagt

SEQ ID NO: 48408 - DNA, 101 bp, rice(Oryza sativa)
  misc_feature (71): n=a or g
tctccctcttacactgtcacacacactggcttcttcgctggcaaacgaacgtgacttgggttcccgtagcngaagaaggcgcgccaacccaaccgtcggcc

SEQ ID NO: 48409 - DNA, 101 bp, rice(Oryza sativa)
  misc_feature (71): n=t or c
ttggaattgaattgatcaatcacccgtcaattgatgtttgatcatgttttcaattgggttctaatccctcntcattgtacgaagatgcttaaacagagagc

SEQ ID NO: 48410 - DNA, 101 bp, rice(Oryza sativa)
  misc_feature (71): n=t or c
gttgtagtactagtagtagacgctgtagtttttgcattgcattggggcgacaatcgtcgttgtgttgttantggagctaaagctcagccgaacagtttcaa

SEQ ID NO: 48411 - DNA, 101 bp, rice(Oryza sativa)
  misc_feature (71): n=t or c
taatgactcattgtgaacagacaacgaattgcggcaaggcatggcgcatgccctcgatgtcgcactctccnggcagccgtccataagcccgatttctgctc

SEQ ID NO: 48412 - DNA, 101 bp, rice(Oryza sativa)
  misc_feature (71): n=a or g
cttgctgacacacgaggagattaaatcttctaggacattccgtttatatagcctaggaaatcaggtcgcantgttgcatcaatttaatagtagttatgtgg

SEQ ID NO: 48413 - DNA, 101 bp, rice(Oryza sativa)
  misc_feature (71): n=a or c
gagcgattcccttgtctattaatcaatcgttaccatgttacggaacatagatgtagctactccctccgtcnaaaaaaaaaaaatacaaatcctgggttttc

SEQ ID NO: 48414 - DNA, 101 bp, rice(Oryza sativa)
  misc_feature (71): n=a or g
cacgcaacagaaaaaaaaaaacactttgtgatgagacaggtccaaagattccatgtcccattttcaacccnccatctctacctcccttgacacatgccata

SEQ ID NO: 48415 - DNA, 101 bp, rice(Oryza sativa)
  misc_feature (71): n=a or g
gtttaattcatttgattgtttctcatcgtacatgaaattatattacgaactaatcagtaattttgaggggnaaaaaattctcaatgagaaattttacaata

SEQ ID NO: 48416 - DNA, 101 bp, rice(Oryza sativa)
  misc_feature (71): n=t or c
aacaacaaattcctatctggtatatgatactttctttatccccgtggtcctagaaaagctgcatacacagnggcaaccacatacatatgttgatatgacga

SEQ ID NO: 48417 - DNA, 101 bp, rice(Oryza sativa)
  misc_feature (71): n=t or c
tgtgatgtagcaatcatctgcattctaatcgtactgggaagtaaggttatttatgaaatgtgagatgatgntatttgggtagttagggttaaagctagggt

SEQ ID NO: 48418 - DNA, 101 bp, rice(Oryza sativa)
  misc_feature (71): n=t or c
tctacatgtttgacaggtatattgtgcaagcatgctctccgagtctttaatatcaatgaggttttcatctntccgaatctttaatatcaatgaggttttca

SEQ ID NO: 48419 - DNA, 101 bp, rice(Oryza sativa)
  misc_feature (71): n=a or g
acaaggcagaactagtatactcaggcaactaaatgaatcataaacattcaaaaatgcccgatggagtggcntgaagaaggataaaatcgccagaagactat

SEQ ID NO: 48420 - DNA, 101 bp, rice(Oryza sativa)
  misc_feature (71): n=a or g
agcagcgggccgaggatcggaagaaccagcagatgatgcggcagtcacaggccacggttctgcagaagacncagcaggtgcgcgccgcccagcagccgcag

SEQ ID NO: 48421 - DNA, 101 bp, rice(Oryza sativa)
  misc_feature (71): n=t or c
ctataaatattattattttgctattatccgtacttggctaaacgataggggcctcagtttgctctcctacntcttcatgcaagtgtcattttgtcttattt

SEQ ID NO: 48422 - DNA, 101 bp, rice(Oryza sativa)
  misc_feature (71): n=t or c
aggtctgcggcagcatgggtcattgtggaaatgactatccggaaacacgtgaagaagcgatgtacatgganaacaacacaacgggttccgtccacagggag

SEQ ID NO: 48423 - DNA, 101 bp, rice(Oryza sativa)
  misc_feature (71): n=a or g
gcatcttgtccacatctttttgactccagacgggttggggatcctacacaaatttatttcatttatggcanggcatgctgcctcacagctagctgtggagc

SEQ ID NO: 48424 - DNA, 101 bp, rice(Oryza sativa)
  misc_feature (71): n=a or c
caacccaaaattattgaaaaacaacaaacaaaattaatccattctctgtacaaaccaaaaccaaaccaacnaaaagctgtcaaaaacgcttataattaaaa

SEQ ID NO: 48425 - DNA, 101 bp, rice(Oryza sativa)
  misc_feature (71): n=t or g
gaagacgacggcgccatgctcgtcctcgacgagaccaccacggagttctcgctggtgacgttcccggacancatccgggagaactaccacatgacgacgtt

SEQ ID NO: 48426 - DNA, 101 bp, rice(Oryza sativa)
  misc_feature (71): n=a or c
gatgagaaaaacgttaaccctgttagcttaaatggcatgggaacagaaaggcatttccatggaggataatnccatatttccgttaattgcagtctacttca

SEQ ID NO: 48427 - DNA, 101 bp, rice(Oryza sativa)
  misc_feature (71): n=a or g
gctccaatatcaagaaatgaaacaagcatatagtgattggaacataggcaacatacccaagtaaaccagcntttccaggctttaactggataccagtagct

SEQ ID NO: 48428 - DNA, 101 bp, rice(Oryza sativa)
  misc_feature (71): n=a or g
ttgcacggtctgaccagtggctctctcgccggtcagaccacacctctgatgaccggttagatcgggccttnggccggtcagaccggtggaattgttcctgt

SEQ ID NO: 48429 - DNA, 101 bp, rice(Oryza sativa)
  misc_feature (71): n=a or g
cacattagctacttcaaacttcaaagtttaaacacattaccaactcaactcaactgaagtttagttcactnaagttttgaagtttggttgaaattaagtta

SEQ ID NO: 48430 - DNA, 101 bp, rice(Oryza sativa)
  misc_feature (71): n=a or g
aattggcccaaaggcaactatccatcaacaaaccaaatggaaagtatagggaaatagagctccataactcnataggcacattttttactcggattatttcg

SEQ ID NO: 48431 - DNA, 101 bp, rice(Oryza sativa)
  misc_feature (71): n=t or c
gcacagaaactgcgcgtcaaagcttccaacaggcgttcaattactgcatccctgcgtgcccctgatccagncgctactccaaagctgcctaccccaactgt

SEQ ID NO: 48432 - DNA, 101 bp, rice(Oryza sativa)
  misc_feature (71): n=t or c
gcaaaatcataacaggatggtaaactaaggatttccaggagacggtaattctataactccttggtgtcatngtgtgccctatgaggcaatgagcagaagca

SEQ ID NO: 48433 - DNA, 101 bp, rice(Oryza sativa)
  misc_feature (71): n=a or g
cctaccgtttggctcaaaaacatccacatcagcaatacaattaactagtaaagataatatgtacagtaatnaggtattagctcttctatccataaatttgc

SEQ ID NO: 48434 - DNA, 101 bp, rice(Oryza sativa)
  misc_feature (71): n=a or g
ccgtgaagagataatatatctatttctagtgagtctagaagtgttactggccctgaagagataaccgagtngttcttaataattctcacaatttagaaccc

SEQ ID NO: 48435 - DNA, 101 bp, rice(Oryza sativa)
  misc_feature (71): n=t or c
gtagcctatcagtttgtcagattaattatggaattgtgcctgtggttacgtcgaatgccaggtaaatgaanttaatagtctaatcttaagttgaaattgta

SEQ ID NO: 48436 - DNA, 101 bp, rice(Oryza sativa)
  misc_feature (71): n=a or g
tcgccagtctcgcaggtaccggtttcctcttgttttgttggcggaacccaatgtcccatggactcattctnattttagcgacttaaatgccaattctaaaa

SEQ ID NO: 48437 - DNA, 101 bp, rice(Oryza sativa)
  misc_feature (71): n=a or g
aagttaagctttccatagacactgttcttcaccggtgaaacctctctatcttttgcctatctatagcttcntgtccttggatgaatctgaaccggcgttga

SEQ ID NO: 48438 - DNA, 101 bp, rice(Oryza sativa)
  misc_feature (71): n=a or c
gttaaactcacgagacacctccgattaaggtacgatggtcgtcatcgttggtcttcgctttatgttctccnatgtatgatgtagatgtgatgatgttgatg

SEQ ID NO: 48439 - DNA, 101 bp, rice(Oryza sativa)
  misc_feature (71): n=a or c
taggttggctttcgacgaagccgcattagtacgtgttttcgactcagttaccgttgtaggatcgagatgtngactagaggggggtgaataggcgatttaaa

SEQ ID NO: 48440 - DNA, 101 bp, rice(Oryza sativa)
  misc_feature (71): n=a or g
ccccctcaattataaaaactagattaatttaccttctcgagtggtttggaaagtggtttcgttatacatgntgtctagtggcacgttgatccagtatttat

SEQ ID NO: 48441 - DNA, 101 bp, rice(Oryza sativa)
  misc_feature (71): n=t or c
gtattttaggacttcatgcctacgcgaaatgctgtgccactgtgctggagctgaccgtgcagaatatgttnttagcgtgcagaatagattcctctgggaac

SEQ ID NO: 48442 - DNA, 101 bp, rice(Oryza sativa)
  misc_feature (71): n=t or c
agctgctcgagcggatgagcagattcctagtccagcaacaagaggaacaggagtcccagtcgcaagcctcngcgcaggtccctcctcaggccacccctgag

SEQ ID NO: 48443 - DNA, 101 bp, rice(Oryza sativa)
  misc_feature (71): n=t or c
tcgtagcccaggtcttcatatatagaggatgggcacaactgcccttccctgacattgatctggcacacgangtcgttactagcccgccgcctccgccagtc

SEQ ID NO: 48444 - DNA, 101 bp, rice(Oryza sativa)
  misc_feature (71): n=t or c
taccgtgctaatggcccatttaccatcaagagttttataacaatgcttgatttaattttgctgcaatgagntaagcttggtttatttaccttttactttga

SEQ ID NO: 48445 - DNA, 101 bp, rice(Oryza sativa)
  misc_feature (71): n=t or c
agttcagtgagcagactgaagctgatgtgtagttgtgcactagtttagtttatatggaccgcttttttctnactacctccgttccattataagtgcagtta

SEQ ID NO: 48446 - DNA, 101 bp, rice(Oryza sativa)
  misc_feature (71): n=a or c
atcgagatgagatgatgcgagatgcacgtcaagtgtagtggctttaatcccgacatctcgttttcaatccncaacacgctcatatctcttcttaaaatagt

SEQ ID NO: 48447 - DNA, 101 bp, rice(Oryza sativa)
  misc_feature (71): n=a or c
cctatgcaaaaattagtggtgatctgtccggtaccttgacaagccatcaccggtgtagctcgatcgtgagntgctcagtgatgaccagagtggacgtagag

SEQ ID NO: 48448 - DNA, 101 bp, rice(Oryza sativa)
  misc_feature (71): n=t or c
gtgcttacggtttcgcaaagtgcagtgtctgaagagaagaccgaatactgtactaaatacagtggccaganacgtgtagacgagtaccatgtcatgctaaa

SEQ ID NO: 48449 - DNA, 101 bp, rice(Oryza sativa)
  misc_feature (71): n=t or c
ccggtggaggacttaacaagcttccttaataaaaaaattacggttgcccaaatttcttaataagctacaanggcttattagagaatatattaatttatgga

SEQ ID NO: 48450 - DNA, 101 bp, rice(Oryza sativa)
  misc_feature (71): n=a or g
aaacagctagcttagctagggaatattgcatgcaatcaagcacagtttcgaacgatcaagccagtgaggancagtgctactaatcgaacaaaaatggcact

SEQ ID NO: 48451 - DNA, 101 bp, rice(Oryza sativa)
  misc_feature (71): n=a or g
atccaatgcccattcttgccagagcccaattagtgatcgatctggatcataccccagataagaagttaagnactgaagctgtatacgccgcaggtaggaca

SEQ ID NO: 48452 - DNA, 101 bp, rice(Oryza sativa)
  misc_feature (71): n=a or g
aaatcccttatatcatgagacggagggagtacttacataacactaaactagcttggtccgcacattttacncggctagctgccaatgttccttattttcta

SEQ ID NO: 48453 - DNA, 101 bp, rice(Oryza sativa)
  misc_feature (71): n=a or g
ctaccagtaccagcaagactgggcaaaagtttgatgctaaaatgacatgatcacctcaaggtcattccatncatcttgcatatcatgtcccactcccacaa

SEQ ID NO: 48454 - DNA, 101 bp, rice(Oryza sativa)
  misc_feature (71): n=a or g
ttgtactcatgtactgtaaaaagttctctacgctaatgctcttgtgccatgttcgtcatggtgacgccgcntgatgcagagaagatcgagctaggctcgct

SEQ ID NO: 48455 - DNA, 101 bp, rice(Oryza sativa)
  misc_feature (71): n=a or g
ggtgtgtgttggagggagtgaggggagctccttaaataggcaacttatgacggttggaaaggtcggaaacnccctccaactgtcatagggagtgaatctcc

SEQ ID NO: 48456 - DNA, 101 bp, rice(Oryza sativa)
  misc_feature (71): n=t or g
gcccacattctagttacaccagtacaccactacgattgcttataatcgagcaaacatgccccaaataacgnaaaggaaaatacaagtaaaacacagatgct

SEQ ID NO: 48457 - DNA, 101 bp, rice(Oryza sativa)
  misc_feature (71): n=t or c
actctcttttgtgtgtagatgttttgtgtgtgcatagtgcaaacccctccctacatctactccatccatcncaagatataagggattttgggtggatgtga

SEQ ID NO: 48458 - DNA, 101 bp, rice(Oryza sativa)
  misc_feature (71): n=t or c
gcccatagtcacaaagttcctgggtcaatgggatcgaggaacgggatcgaggaacgtgatacgctacttgngagaggtttttacaaggtggggacgaaaat

SEQ ID NO: 48459 - DNA, 101 bp, rice(Oryza sativa)
  misc_feature (71): n=a or c
gctgcaacagagtttgaatgcattatagcatgtagatgaggaacagattagattagagaaaggattgttangtatgtaagactgttcttccccttctttcc

SEQ ID NO: 48460 - DNA, 101 bp, rice(Oryza sativa)
  misc_feature (71): n=t or c
tgggttcctactgcccatataagaaagccagaatacccaggatgacgcataagcctgtaaatttaagcatngatatcagcaacataaattattgattggcc

SEQ ID NO: 48461 - DNA, 101 bp, rice(Oryza sativa)
  misc_feature (71): n=a or g
taggccctcctgaaggttgaaaattccaagcggcacctcttgtttacgcggcggcgggggcttcctctccngcgacctcggccgcggcggcggaggcggag

SEQ ID NO: 48462 - DNA, 101 bp, rice(Oryza sativa)
  misc_feature (71): n=a or g
taagagttgagtacgaagccaacttagcctgagttcggtagaacaggttgggaactaatctcctccgcacngaaaacggagcggtctattaacgcgtgact

SEQ ID NO: 48463 - DNA, 101 bp, rice(Oryza sativa)
  misc_feature (71): n=t or g
aacaatatctatcaggctcttggggattggagagctatgtttaatgaggaactaaatattcatttgctcanactaagattagagataaacatcccctttaa

SEQ ID NO: 48464 - DNA, 101 bp, rice(Oryza sativa)
  misc_feature (71): n=t or c
catacgtctgacgcaacaaacaaaaatcggacaggcaaacgtagagcctgtttggatctattcttagaagntagctaccaacttactgcttcttagaattt

SEQ ID NO: 48465 - DNA, 101 bp, rice(Oryza sativa)
  misc_feature (71): n=t or c
caagcaaatggtgcaagagggagcattgacagctttagcatcagtagctgattcatcgcaggtaatttgtncatgtataagttagcttaatttcttatagg

SEQ ID NO: 48466 - DNA, 101 bp, rice(Oryza sativa)
  misc_feature (71): n=t or c
caactgcaaaggtgtgatgagtatatcaaacttatgcataacctagaggcaaagattatacagattctcgncaactacagatgtaaattcacaaagaagtt

SEQ ID NO: 48467 - DNA, 101 bp, rice(Oryza sativa)
  misc_feature (71): n=t or c
agatatcccgggcgcctaacctggcctgtctattcctcacccgacagccaatttggcatctcgtttactcntttatctatcacctgttcgttttaatcagc

SEQ ID NO: 48468 - DNA, 101 bp, rice(Oryza sativa)
  misc_feature (71): n=t or c
cccctgagacctttcacagtgcactgagctggaccagaacctcattgcgccacattggatttgatcgacangtcgtgtgcgcccgcgaccaaactagacgc

SEQ ID NO: 48469 - DNA, 101 bp, rice(Oryza sativa)
  misc_feature (71): n=a or g
acttgaaaatggaaaagaagagcccaaataagattctgcactctaggagtcgaaaatacaagattttatcncacagtggcatcagtcaacatgcaaaaaaa

SEQ ID NO: 48470 - DNA, 101 bp, rice(Oryza sativa)
  misc_feature (71): n=a or g
aggtggattcagtggatggattcaagttaatcttcctgcagcagggtggccaaatatagatggccaaaagncccgaggcccgatggcccggcccacagcac

SEQ ID NO: 48471 - DNA, 101 bp, rice(Oryza sativa)
  misc_feature (71): n=t or c
aggtacctgtggtacctcacaagcaacgtaaaagatctcataatcattatgaatatacttcgtgagggtgngggggtagggaggggggaatacaacaaaac

SEQ ID NO: 48472 - DNA, 101 bp, rice(Oryza sativa)
  misc_feature (71): n=t or g
aaggagggtcgggtgccaacaatatctggttaatgtggttcagtaagtgtcgagcataaaggtgtatagcntacccggttcatgtcatatgacacacctaa

SEQ ID NO: 48473 - DNA, 101 bp, rice(Oryza sativa)
  misc_feature (71): n=a or g
tttggataaaatccttttgatcttcttccctacaatgccgttatagagtagtactccactccatattagtnatagacaaaaaaaaaaaaaaagaccttaag

SEQ ID NO: 48474 - DNA, 101 bp, rice(Oryza sativa)
  misc_feature (71): n=a or g
cttgccacaggtaggtcacctcgccaacgtcttcctctctcttctttttcgtctccaaagacgagaccaangcaagcagcagcagtagcagcagcagcagc

SEQ ID NO: 48475 - DNA, 101 bp, rice(Oryza sativa)
  misc_feature (71): n=a or g
ggcagtgacctagctaaggcctggtggaaagatccagggtcttagcgatatgggaggagagggctcgtcantgcacctgttctcctcgctcgcaactttgc

SEQ ID NO: 48476 - DNA, 101 bp, rice(Oryza sativa)
  misc_feature (71): n=t or g
gaatcttatgctaaagtcctagtggttttcctaatagagcaactcacacttatggtgttttctagaagtangttaagttggatctaggtggtcactcaatt

SEQ ID NO: 48477 - DNA, 101 bp, rice(Oryza sativa)
  misc_feature (71): n=t or c
gatccggatgagggtgggagttctgtttagacgtcaacagttgtggggtagcgtgaggagagatgaatgcnaaatttgatgtttctctctctaggatggag

SEQ ID NO: 48478 - DNA, 101 bp, rice(Oryza sativa)
  misc_feature (71): n=a or g
aacaaacgtttcattgaatcattgggttcctgtacatttgctactccacacccccgtccccgtgacagaanattttacgctaccccacctgtcagcgcccc

SEQ ID NO: 48479 - DNA, 101 bp, rice(Oryza sativa)
  misc_feature (71): n=t or c
cagatggcaaacaaaatgaaaagcagcatgaatgaatggttggtcgatgattgatgattgagagctgaatnttgatcgcacatgcacatgcacgcacgagc

SEQ ID NO: 48480 - DNA, 101 bp, rice(Oryza sativa)
  misc_feature (71): n=t or c
cacgaccccccttccatcagctcatacaagccgagtgagacacaggtggcagccatcgccaagagcatcgnggacagggacgagttcctcgccgacattcg

SEQ ID NO: 48481 - DNA, 101 bp, rice(Oryza sativa)
  misc_feature (71): n=t or c
gcagggagcctctcgtaccgacaagaatcaatccttacaatttcactgctccgaccggatgagacgcactntctcgtccgtgtcgttgagaagcactcact

SEQ ID NO: 48482 - DNA, 101 bp, rice(Oryza sativa)
  misc_feature (71): n=a or g
gttctatagtttctacacgtgcggaatcatgtacatggatccaccaatgtgtgtccttggtgcatgtcatnaaatccaaatcatggcgtagttaggtggtg

SEQ ID NO: 48483 - DNA, 101 bp, rice(Oryza sativa)
  misc_feature (71): n=a or g
aaaagtcactgaactatatggtttcttaaaatattcattcaaggagctcaaagagaagtgtgctttggctngctagtctcgcgaacgcgtcgtcgttggct

SEQ ID NO: 48484 - DNA, 101 bp, rice(Oryza sativa)
  misc_feature (71): n=t or c
cctcacctatccgtggccctctatttgtacgaaagaaaaagaaggaagaaagcaaactttccctgcacttngacgacactttctgtgtagcccagtagccc

SEQ ID NO: 48485 - DNA, 101 bp, rice(Oryza sativa)
  misc_feature (71): n=t or c
ccattactatcagaacctttgctgcttggcttcttgcttaccgagtactccgtccatccttaaatatactncaactatcccaaattataaggtctatattt

SEQ ID NO: 48486 - DNA, 101 bp, rice(Oryza sativa)
  misc_feature (71): n=t or g
cataaaaaataacataagcattcttttctgggaccttttcctgactgtacttcgaatttctaaaaccattnaattttcatgtacctttaggtcaatcttcc

SEQ ID NO: 48487 - DNA, 101 bp, rice(Oryza sativa)
  misc_feature (71): n=t or c
atgacaccagtatatttcacattttcactcatgctccagccccttaaaatgatatgatgtacacatgacanctacagatctagtataaactagcatcccaa

SEQ ID NO: 48488 - DNA, 101 bp, rice(Oryza sativa)
  misc_feature (71): n=t or c
cacaagtaacaacagctaaaaaattctctccagattttcaggcatgacgtgaaaaagatggattaatcgtnctggcttacaaaattaatccacacaaaaac

SEQ ID NO: 48489 - DNA, 101 bp, rice(Oryza sativa)
  misc_feature (71): n=t or c
ttgttttatttctctatagaaaaaggacaaatgtgcccgtatcacacagtcgcacagtaagtcagtaatanggagtagtagtagtccatccgtccgtaaat

SEQ ID NO: 48490 - DNA, 101 bp, rice(Oryza sativa)
  misc_feature (71): n=a or c
tctttcatatctcgggtatatgcatacgtatttgaggtcgatggatagataggccatttgtgtcaccaacncgcagatgtcctcatgtccaagtcctaaca

SEQ ID NO: 48491 - DNA, 101 bp, rice(Oryza sativa)
  misc_feature (71): n=a or g
gtgtgctatgagggagtgagacaaagagcaacaaatgagtaaagtggcggggatggtgtctgagaattatnaaaaggaactccaacaataataaggtacga

SEQ ID NO: 48492 - DNA, 101 bp, rice(Oryza sativa)
  misc_feature (71): n=a or c
gatgtgcagactcctgatgtatttatccatctatctatattatcttaatgtagtaggaaaaaaggccaccntgttagctctcacttcctagaaactcccat

SEQ ID NO: 48493 - DNA, 101 bp, rice(Oryza sativa)
  misc_feature (71): n=t or c
gcttgaaaggaaaaaaaaacaatgagacaatcagatgagcataacaagaacagctgtcaaatggtggtgtnctttatagacagagtatgaataaggaaatg

SEQ ID NO: 48494 - DNA, 101 bp, rice(Oryza sativa)
  misc_feature (71): n=t or c
aacaattctggacaaccaaatcaaacacggggaattgcaccagcgcaccactaactaaatgttactccctncgtcccggattttgatattttgcttgtact

SEQ ID NO: 48495 - DNA, 101 bp, rice(Oryza sativa)
  misc_feature (71): n=a or g
actgggagtgtaacaatcaaactagaaaaaaaaaagtagttgcaagcgggccaaaaccgttttcccaggcngacgagccttccgcctacgagcaaatgcct

SEQ ID NO: 48496 - DNA, 101 bp, rice(Oryza sativa)
  misc_feature (71): n=t or c
ccactgtaggggtcggtgacatttgggtcctaggcgagggcatctctatcgcccgggttgatggcaacggngggtgggtggaggaggaggtgagatgaggg

SEQ ID NO: 48497 - DNA, 101 bp, rice(Oryza sativa)
  misc_feature (71): n=t or c
atatctcggttttcctcttgcctgtttgttatccttgaaactgtcttattcggaagataaacatgatcctnaacaagatgcacctaatcgttgtgtcaggg

SEQ ID NO: 48498 - DNA, 101 bp, rice(Oryza sativa)
  misc_feature (71): n=t or c
gggccaattgaaggtgggtgtttcttcaatctgaaggacaatgtgagtatgtttcagtttttgggtcatgntactttttttttctggtctctaaattcaaa

SEQ ID NO: 48499 - DNA, 101 bp, rice(Oryza sativa)
  misc_feature (71): n=t or c
tatatatgcatgagataaagataaggtatatctatatatatgtaggtttgatcggtatagctggctgcggntgcagctgtgctgtaattctgtacctacag

SEQ ID NO: 48500 - DNA, 101 bp, rice(Oryza sativa)
  misc_feature (71): n=t or c
tcgaatgaacattacgtccttcgctcaggcgtaagtaagtcaaatctacatactgacacacacacacacanacacacacacacacacacacacacacacac

SEQ ID NO: 48501 - DNA, 101 bp, rice(Oryza sativa)
  misc_feature (71): n=a or g
atactctgcatgaccgaaccagctcacagcgaagccaattaactcatgttgcataacagtttgcagaactntgacaagtagtactgcttacctggagagtg

SEQ ID NO: 48502 - DNA, 101 bp, rice(Oryza sativa)
  misc_feature (71): n=a or g
agagtaatactcttcctaaactctctttaaatagagagacacttgttataaccgcatgacgactgtagcanatgagggaatgattgaccaatagtgttgta

SEQ ID NO: 48503 - DNA, 101 bp, rice(Oryza sativa)
  misc_feature (71): n=a or g
aacaagggataattggacatggtttatgaatcagctgaatagagcaataagtgatccccctattatagcantgtgtacagatgcatccaaaggtttagaac

SEQ ID NO: 48504 - DNA, 101 bp, rice(Oryza sativa)
  misc_feature (71): n=a or g
gtaccggttttgacagttgagggaccgttgtatctgccatctggtattgtgaaggacgaaaatcaaactcnctgtcaagttaagggacctagaatgaactt

SEQ ID NO: 48505 - DNA, 101 bp, rice(Oryza sativa)
  misc_feature (71): n=t or c
agcaacatgctgaatttgtaatacggactgaccactgtagtttggccttcttagataatcaacgattgtcnaccacttggcaacagaaagctcttaccaag

SEQ ID NO: 48506 - DNA, 101 bp, rice(Oryza sativa)
  misc_feature (71): n=t or c
ggccttcttggcctgcctagctgtcacgacaatcggcgtcggcgtcctcatggtgaagtactaccgctccnaccatggagcccttgccgtcttcctcctcg

SEQ ID NO: 48507 - DNA, 101 bp, rice(Oryza sativa)
  misc_feature (71): n=a or g
ttgtgttttatgttgcttcctacttcctaatgtgttggcccatcagctactaacattaacacagcctaacnttggcaggcaatgattgtaagaagggaaac

SEQ ID NO: 48508 - DNA, 101 bp, rice(Oryza sativa)
  misc_feature (71): n=a or g
ctcctcgggtcgaacaaagcgatggtggtggtggtccgtcgttaggagcggagctagaataaaatgaagtnagttccactcgcttgctttactctggtttg

SEQ ID NO: 48509 - DNA, 101 bp, rice(Oryza sativa)
  misc_feature (71): n=a or g
aatttgctctctctttgttttgccgccgcccacgcaatgtatatatctactgcagattccttccatgcatncatcttaattaacttctccgaattcatgga

SEQ ID NO: 48510 - DNA, 101 bp, rice(Oryza sativa)
  misc_feature (71): n=a or g
tacctcccaggttccaacaagcttgtttacttgaggcaccggcagttcctatccaagggtcataagtttcncaagatgaaagcagagttcgatggtactga

SEQ ID NO: 48511 - DNA, 101 bp, rice(Oryza sativa)
  misc_feature (71): n=t or c
attgtcaaggttttagtaaatacacttctagtgaaaatgtgaactgaacaagcttcgctacacttccaatntttcatggtgtattcttctatagttaattt

SEQ ID NO: 48512 - DNA, 101 bp, rice(Oryza sativa)
  misc_feature (71): n=t or c
tagaaccattcataaaattataaaaatattgagatatgaaatgttaatgcaaactaaatacctgcctaaanagtatctatctattatattattaagacagc

SEQ ID NO: 48513 - DNA, 101 bp, rice(Oryza sativa)
  misc_feature (71): n=t or c
ttccttctcctttccaggtgagcaacggcatgcctggtgtgtgcttgcacggcgtgatgcactacagccangcatggcgaggtagtccagtgcgagggagc

SEQ ID NO: 48514 - DNA, 101 bp, rice(Oryza sativa)
  misc_feature (71): n=t or c
ataagcccagatgatgggcctgacccaatcaatcgaaccgaacggcaaaagaaataagttcatcatatatnccttaacttgtcaacgaatccgattttcgt

SEQ ID NO: 48515 - DNA, 101 bp, rice(Oryza sativa)
  misc_feature (71): n=a or g
acccctaatccaagcttgctggagtatggggttgatcttaaactagaaattaaaatttcttttctggcttnatacatagagagatgcttctatcctcacta

SEQ ID NO: 48516 - DNA, 101 bp, rice(Oryza sativa)
  misc_feature (71): n=t or c
ctccactattcacttttctcaccaacctccactactcatccaataatagccctctactacttacttctacntacctttttaataaccatgtccaactctaa

SEQ ID NO: 48517 - DNA, 101 bp, rice(Oryza sativa)
  misc_feature (71): n=a or g
caagaatgatgcactgctcatatgagctatgcaactacctgaaatcagctatactaatgatttctgtatanctatggcgtacggttatatgatgtcttatg

SEQ ID NO: 48518 - DNA, 101 bp, rice(Oryza sativa)
  misc_feature (71): n=a or g
gtaggtgtatcttaggggggaatgcactcatcctcctaatcatcagctaataacagccaaaaccgtacccnttttgttttttttaaaaaaaatcctctaaa

SEQ ID NO: 48519 - DNA, 101 bp, rice(Oryza sativa)
  misc_feature (71): n=t or c
tttatttttcaaattaaagaggactacatagctagaagcaagtatgcaacagctaactaaatatcgtgcanattacgtggatcttgctttagctagggatc

SEQ ID NO: 48520 - DNA, 101 bp, rice(Oryza sativa)
  misc_feature (71): n=a or g
gtcttatttatccctttcaattactacttcttgtatgctcttggctcttgctcattgccactaaaaatatnccattttagataaataacactactattcaa

SEQ ID NO: 48521 - DNA, 101 bp, rice(Oryza sativa)
  misc_feature (71): n=a or g
gcatactgtttgccagtacacacatgtagctttatagtacttgtgtagctatacttaatttggagagatgngatctgccttgatctagcatatgcttagag

SEQ ID NO: 48522 - DNA, 101 bp, rice(Oryza sativa)
  misc_feature (71): n=t or c
atcattaagatctcaaaagtttgaccggactgtatactcccttcgtccaaaacatagcaacacatagcaanctagtgcttaaatttataatattagattat

SEQ ID NO: 48523 - DNA, 101 bp, rice(Oryza sativa)
  misc_feature (71): n=a or c
acaatctagatcccactgagttcatcaatgccaaaaccaatcgaattccttttagattggccaaccctaanttaggtctctggaaaaacactttcaaatct

SEQ ID NO: 48524 - DNA, 101 bp, rice(Oryza sativa)
  misc_feature (71): n=t or c
tgaatggacttctagcacgacttcgggcttgaaatgaaactatatggcgcgcccgttattatataacccgnttatatatttgtttagtggacttttaactt

SEQ ID NO: 48525 - DNA, 101 bp, rice(Oryza sativa)
  misc_feature (71): n=t or c
tttcacgttcaagctccttctaagtggtggggcccgcccatctacgttatcggtccaactcagccttcctngtggatttattatcggcccatcttttcgtt

SEQ ID NO: 48526 - DNA, 101 bp, rice(Oryza sativa)
  misc_feature (71): n=a or g
ggtgaactaaatccttattatgcctttttttgttttcttctgacacaattgtaagtttgtttagaatactntaagctgcggcaccggaggatggccaacct

SEQ ID NO: 48527 - DNA, 101 bp, rice(Oryza sativa)
  misc_feature (71): n=t or c
aaatagtatactaagatacaacgtaatgatataaattatacgatacagatatccttaaaatatattactangaatgcataaaggagaaactttcaccacat

SEQ ID NO: 48528 - DNA, 101 bp, rice(Oryza sativa)
  misc_feature (71): n=a or g
acagccttgaggtagggcagcttgtccacgtggtccttggtgacatgactagtgttgcccacgactgcccngatctcgttctgcgctttgcgcatggcgcg

SEQ ID NO: 48529 - DNA, 101 bp, rice(Oryza sativa)
  misc_feature (71): n=t or g
ctaattaattatgctttctttttcagttccaggatctcgttacctgcaggattttgaaaaaggcaaaaagncagagacaattgaatcagagattggcgaaa

SEQ ID NO: 48530 - DNA, 101 bp, rice(Oryza sativa)
  misc_feature (71): n=a or g
gttttgtttgttggcaatttactttgctggccctccgaatattcacctttttgctcgtaggcagtgaaacntgctgctatgtacgatatggtaatgtgctt

SEQ ID NO: 48531 - DNA, 101 bp, rice(Oryza sativa)
  misc_feature (71): n=t or c
acaccggggaacgggaaaagcaagcggggaagtcaggccggggaggaaggagaaatcgtcggtgagaaggnggcggcgacggcgaaaatcgcctcaccctc

SEQ ID NO: 48532 - DNA, 101 bp, rice(Oryza sativa)
  misc_feature (71): n=a or g
aagccagttgagttttaatattgttcatttttaacattaacggtaggattttaaaaaactggaggctcccngtcccagcctactccctctatcccataaaa

SEQ ID NO: 48533 - DNA, 101 bp, rice(Oryza sativa)
  misc_feature (71): n=t or c
ttacacgcatcttataaatttcgtttagtcatcgctgatgacatatttgagtactacttatcccatgcggntatgcatgtacgagatccgtgtatacgaat

SEQ ID NO: 48534 - DNA, 101 bp, rice(Oryza sativa)
  misc_feature (71): n=a or g
gccagaggtaatgatccaacggattgtggatgcacaaaaatatcttgtttaagggcatataaactttattntcacattcaaccttatcaagttttagcatt

SEQ ID NO: 48535 - DNA, 101 bp, rice(Oryza sativa)
  misc_feature (71): n=a or g
gtcccggtgtgtctgctcgtcgcctggtacgatctgtacaggcgccagcgtaaccttcatacgacacgggnacaattcatgtccatgggatcaacagcgac

SEQ ID NO: 48536 - DNA, 101 bp, rice(Oryza sativa)
  misc_feature (71): n=a or g
acggccgtggccttgcactgcccgcaggccagcaggctagctgggcaggctcagcttgaagcttcccttcngcgactggcgactcgatgccggcttggaga

SEQ ID NO: 48537 - DNA, 101 bp, rice(Oryza sativa)
  misc_feature (71): n=a or g
taccatgcaagaatctttctcttcagattctgaacttgtatcttgatgtttcgacttacaacttatgctcnggatgattattgctgtcaactatagacttt

SEQ ID NO: 48538 - DNA, 101 bp, rice(Oryza sativa)
  misc_feature (71): n=t or c
acactcaagttagggatttgattgaagagttaatcagtccctaaactgtgggtcaaagtagagacataccnaataaatatcaacatatttagaattacgat

SEQ ID NO: 48539 - DNA, 101 bp, rice(Oryza sativa)
  misc_feature (71): n=a or g
ccacgaccacacggatatacatccacacacaacacactagcataaatcaacacaacgttcctcctcacgcncgtacacgtacgtacgcacgtacgtacacc

SEQ ID NO: 48540 - DNA, 101 bp, rice(Oryza sativa)
  misc_feature (71): n=t or c
ttttggggtggttaccgaccccccgcggtaaccgcgcaataaccgtgaaaaacattgtaaatttcggtttnaaaaatttgaattcaaaaaaaactgcggta

SEQ ID NO: 48541 - DNA, 101 bp, rice(Oryza sativa)
  misc_feature (71): n=a or g
attcaagtaaactcaaaccaatttagacataagatttgctttggtccagtaaaaaatacttcgagataccngtatcttacggtaccaaatcgtttctgatt

SEQ ID NO: 48542 - DNA, 101 bp, rice(Oryza sativa)
  misc_feature (71): n=a or g
gccagcggtgatgcacggaaacaacttgtttcaacggctcccatcggttggcctaatcagaaaaaaaaaanggctaaattttgaattttcaagcttaattt

SEQ ID NO: 48543 - DNA, 101 bp, rice(Oryza sativa)
  misc_feature (71): n=t or g
atcgatcgacagaaacaaagaacttactaatgttagctctatagccactggatgcgttcatatattttacnggtctgtttggtaaagcttcaacttttaaa

SEQ ID NO: 48544 - DNA, 101 bp, rice(Oryza sativa)
  misc_feature (71): n=t or c
gtccagcaactaactaccagttttttttttggtgtcctacagctgatacgcattcttactgtgtccctagntaattatatttttaatgtcatgtaacaaat

SEQ ID NO: 48545 - DNA, 101 bp, rice(Oryza sativa)
  misc_feature (71): n=a or c
gtctgacggtattttgcgacgcggtgtagaccagttctgaacttctgatggttcatttgaaaagcatgatntttttccaatttcacctaacaatccacaaa

SEQ ID NO: 48546 - DNA, 101 bp, rice(Oryza sativa)
  misc_feature (71): n=t or c
cgtgcgtcccgtcgcccccattcgcgcccaatggataaaacggagcctcctgccacagctagagctagaangcacagactttaggctttaggtacgatgat

SEQ ID NO: 48547 - DNA, 101 bp, rice(Oryza sativa)
  misc_feature (71): n=t or g
ctttaaaatttggttaatcttatctaaagtatagaattttacatagcaaaggagaaattgtggtacgtagnggtggtagtacgcaccccgcaccggttacg

SEQ ID NO: 48548 - DNA, 101 bp, rice(Oryza sativa)
  misc_feature (71): n=a or g
gatcgagaacatctgattgtatcatatcacgccgggcctcctcaccttgaacgtcggcaacggcgacggcncctcgatccgtggcctcttcgctgccgccg

SEQ ID NO: 48549 - DNA, 101 bp, rice(Oryza sativa)
  misc_feature (71): n=a or c
atatgaacaatccgttagtgcatgtagctctgctcttatttaaattaacctgattatgatattaaacgagnaaattagaatttatttgagggtatgtgaat

SEQ ID NO: 48550 - DNA, 101 bp, rice(Oryza sativa)
  misc_feature (71): n=a or g
acaaccttctcctatttaattctacatactttcttaatactatgcacgaccctagaaatgcttatagtctnggataagtagtaaggataagtagtaagaat

SEQ ID NO: 48551 - DNA, 101 bp, rice(Oryza sativa)
  misc_feature (71): n=t or c
agtttagtcagttatcaatcgatcgcagacaccaacacgaacactgaattttccccctattttccaatctngcaatgccttctctcttgggcccaaagccc

SEQ ID NO: 48552 - DNA, 101 bp, rice(Oryza sativa)
  misc_feature (71): n=t or c
gttcgtcgatctgctaagggactaagaagagtggagggtaatttaatcccggataatattatagtgtacanatagtcatgggttgagtatgattttataga

SEQ ID NO: 48553 - DNA, 101 bp, rice(Oryza sativa)
  misc_feature (71): n=t or c
ccttcttgttactcttgtattcgtgtcaatactctgaagtcttccactgatgctgtcatgcataaactgangaatttggtagatcagaacggactctgtgg

SEQ ID NO: 48554 - DNA, 101 bp, rice(Oryza sativa)
  misc_feature (71): n=a or g
acgcacgccataaacacaaccgttagacgttagtgtaccccctaacacacgctttaagagcacccgcaatngtaaagtaaggtgttctctataaaacatgt

SEQ ID NO: 48555 - DNA, 101 bp, rice(Oryza sativa)
  misc_feature (71): n=t or c
taaacttgcttcaggaaatctgaaaacagaaaatgaaagcaaacatttcaaacattcaatggaatcactcnctgcttcttatcctccaccaattgcttttt

SEQ ID NO: 48556 - DNA, 101 bp, rice(Oryza sativa)
  misc_feature (71): n=t or c
tgagagatactaaacacaatgttgacatatttaggaatgattgggattttaccttttggtagttctataangtcagttaacacattatagtgttgtagaaa

SEQ ID NO: 48557 - DNA, 101 bp, rice(Oryza sativa)
  misc_feature (71): n=a or g
ttatataatcttatatgattggtgcagttcgagatgcggcacaggaatccaagaattgagaattttttacngtggattaattttttttggattgtaatatt

SEQ ID NO: 48558 - DNA, 101 bp, rice(Oryza sativa)
  misc_feature (71): n=t or c
catcgaatgttttgacacatgcatggagtattaaatataaacatccgggcctgtttagatctcctagcaanattttacaccctctcgcatcgaatgtttgg

SEQ ID NO: 48559 - DNA, 101 bp, rice(Oryza sativa)
  misc_feature (71): n=t or c
tggtaaggccggcgagctgcaggcgggccgagcgaccgcgggataatagatccaaccgcggataatagatncaaccgcctagaaaaatgggcactgtagta

SEQ ID NO: 48560 - DNA, 101 bp, rice(Oryza sativa)
  misc_feature (71): n=t or c
atttgtggggcttcgaagtgccagctcattaagctgcccattgacatgaccttttcgtgcgacaagtcaangtggaaaaatccggcctgttaatctgcggg

SEQ ID NO: 48561 - DNA, 101 bp, rice(Oryza sativa)
  misc_feature (71): n=t or g
gttgccaccgcctccatctcttctttcatcaagctcaacgttggtcttgccggtcctcaccgtcgtccaanccacacacaaatagagagagagagagggga

SEQ ID NO: 48562 - DNA, 101 bp, rice(Oryza sativa)
  misc_feature (71): n=t or c
gctatccatcggatcgtttgtatctccctgtacctcccatgcccgttgagtttggctatcttagggcctgnttagttcgcgaaatgaaaatttttgggtgt

SEQ ID NO: 48563 - DNA, 101 bp, rice(Oryza sativa)
  misc_feature (71): n=a or g
taaataagatgaccgatgacggattcggtggtaggagctgccaaggaagagggaagcatgtggtccaaaanttttcattctgttacatcgaatgtttggac

SEQ ID NO: 48564 - DNA, 101 bp, rice(Oryza sativa)
  misc_feature (71): n=a or g
acgtaccgcgcggggtgcatgctatacagtctattttgactgctgtattcaatggtctaatttcactgttntatttatttcaattaaatatttatagagag

SEQ ID NO: 48565 - DNA, 101 bp, rice(Oryza sativa)
  misc_feature (71): n=a or c
atgaagttgttttaccatgtgaaactaacatcggctcaaggaggattctttttcaagatcaattgacagcnggtgattatcatagtttgatggttgatgaa

SEQ ID NO: 48566 - DNA, 101 bp, rice(Oryza sativa)
  misc_feature (71): n=a or g
tcaacagttctgttcgggttttttcgctgatttttttcccgattagtctttcttttttttatccagcttcngtttttttatccgtttgttttttctgttgt

SEQ ID NO: 48567 - DNA, 101 bp, rice(Oryza sativa)
  misc_feature (71): n=t or g
gatttgaaaaagaatttatttaaaactggaaaaagaacatgtgtcctcaccttagagagggtttttttttngctttaatgaagatagtcttgggcacgacg

SEQ ID NO: 48568 - DNA, 101 bp, rice(Oryza sativa)
  misc_feature (71): n=a or c
gtttgaatgcagctagccggacatgcatgtgcattgatctactacttattctgaatactggaaaagtaaanaaaacaaactaataacaaacacaaaagagc

SEQ ID NO: 48569 - DNA, 101 bp, rice(Oryza sativa)
  misc_feature (71): n=t or c
gcggcagtggtaaacaacgaaccatactatgtaaaagcaggggcggagcccaataggaccagggggtgccnaggaacccggtccaaaattcgaaatagctt

SEQ ID NO: 48570 - DNA, 101 bp, rice(Oryza sativa)
  misc_feature (71): n=t or c
attgaaaaccctgggtggtataaatctgacagccgttgggtcggtataactctgtagctgtgatccgagcngctaggtgagggggtgagtggtgactctag

SEQ ID NO: 48571 - DNA, 101 bp, rice(Oryza sativa)
  misc_feature (71): n=t or c
tatcaagtgcatctcaattacatatactacaggatgagagtcagagagtcggacatggcagacatgcatangttactttgtaggaggaataggcatgtagg

SEQ ID NO: 48572 - DNA, 101 bp, rice(Oryza sativa)
  misc_feature (71): n=a or c
ttgtaagcttttgctaatcagatctacatgggactcagtggtttacaggaggtttagatgttcttgtatgnttgtgattatcagatctccgtcaaattcta

SEQ ID NO: 48573 - DNA, 101 bp, rice(Oryza sativa)
  misc_feature (71): n=a or g
ttaggatatcattaccccaatggtctttctagaataaagctatgtttccttgatggatttgaagagtgganattaccctgaatagaggaattagctggaag

SEQ ID NO: 48574 - DNA, 101 bp, rice(Oryza sativa)
  misc_feature (71): n=a or g
tccaagttctacttggtgaccaagatgatcctcggtacaaatacataccccctgaggggtacagggcatcngatcctgagtgcaaaacacccgccaccaca

SEQ ID NO: 48575 - DNA, 101 bp, rice(Oryza sativa)
  misc_feature (71): n=t or c
acgtaggacgaagatcatatcagcattgtcacgtagtcatcacgctagtgaaaccgtcctccaaaactatngagggagtcaaattacaccggttttaatag

SEQ ID NO: 48576 - DNA, 101 bp, rice(Oryza sativa)
  misc_feature (71): n=t or c
tcttatatataatttgtgtgcgcactcaatcccttctaatttttagtgaactccactgctcccaacaaaanaactgacacagaaaacctacttcggcatcg

SEQ ID NO: 48577 - DNA, 101 bp, rice(Oryza sativa)
  misc_feature (71): n=t or c
agattatcatttatccaagatcacaagtaaagtaatcacataggatgtaaaaaaattgtaaatttggaccntatacaggtctccgcgggggacggataccc

SEQ ID NO: 48578 - DNA, 101 bp, rice(Oryza sativa)
  misc_feature (71): n=a or g
ggcgaaggaggtgcggcgcaaggcggatcagatggtgcagctcgggaaagaggtaaaaactgctacctgtnaaacattctcctgttgccatagaactataa

SEQ ID NO: 48579 - DNA, 101 bp, rice(Oryza sativa)
  misc_feature (71): n=a or c
cacacaagcatgtacacaatctctcctgcctttaggcgcacgagatgtgtgcctcctcgccgacgtggatngccttcgtcgacgatggcacggcgcactgt

SEQ ID NO: 48580 - DNA, 101 bp, rice(Oryza sativa)
  misc_feature (71): n=t or c
tgtgccacatcgtccatcgtacgagttgagtaaatgttactacggagcgtagtactggctaatatcgcatnctatattaggtagctacattttagaacgga

SEQ ID NO: 48581 - DNA, 101 bp, rice(Oryza sativa)
  misc_feature (71): n=a or g
taaaatgtcatctgttgttaaagactcggtatacatataatttatttagagttcagcggaatatatatacntgatatgatcgatattaatttacttctgat

SEQ ID NO: 48582 - DNA, 101 bp, rice(Oryza sativa)
  misc_feature (71): n=a or g
ggagggagcgtaagacggcgtgtcggacagctacagtacttaccggcttgcgatttagataggactagttngcaccccgcgccttgccgcgggatttgcta

SEQ ID NO: 48583 - DNA, 101 bp, rice(Oryza sativa)
  misc_feature (71): n=a or g
agaacacctgccgacttatctcgtagtgctttatttatttctttgcacggcgcgtgagaaaaaatagtttnttggacgcgcgcaccaacacacgctcgcat

SEQ ID NO: 48584 - DNA, 101 bp, rice(Oryza sativa)
  misc_feature (71): n=a or g
taatacaaaaacctactcgaattaatgtcattcaatgtcgtcttgtttgccaaatgagaaactgaataacnctgtcaaagtggaagagggtagcaaaagca

SEQ ID NO: 48585 - DNA, 101 bp, rice(Oryza sativa)
  misc_feature (71): n=t or c
gtgcattgggatcattttgtaaggtgacatgcatgcatagtttcgacagacgttttctaattcagaaccancacaggactgaagaagcaaaacaccactgg

SEQ ID NO: 48586 - DNA, 101 bp, rice(Oryza sativa)
  misc_feature (71): n=a or g
aaccccctactctacttggaactcaggtaattctcctccttggctcttaccctactggtaatgcttgactncttcctgacatctttcttgatctgctactg

SEQ ID NO: 48587 - DNA, 101 bp, rice(Oryza sativa)
  misc_feature (71): n=a or g
agctccgccgctgtccccccccccaagccgttgacgccttctgccttcctgcgctgcctccgctgattacngactccattgcgtcgccttcctgcctcccc

SEQ ID NO: 48588 - DNA, 101 bp, rice(Oryza sativa)
  misc_feature (71): n=a or g
ggaggcggtgccgttttaggaaagaaaaagaaaacggcgatggaatcagaatatgacagggactcgacccntgaacacagtgtgaggccgaaaatgacaag

SEQ ID NO: 48589 - DNA, 101 bp, rice(Oryza sativa)
  misc_feature (71): n=t or c
aaagagagagagaggggagagaaagaagctactactaaaacaatgaaaatgttctaggcagataatctcgngatatttgttgttccacatatcttccatag

SEQ ID NO: 48590 - DNA, 101 bp, rice(Oryza sativa)
  misc_feature (71): n=t or c
cggccatagcacggatccgaaatttccgagaggaggaggcatggtgagtttgcaggcgacgcgtggtggcngggggcacgagctcccgttcatcgtcttca

SEQ ID NO: 48591 - DNA, 101 bp, rice(Oryza sativa)
  misc_feature (71): n=t or c
cgagacatcatccttgccggacaaccaccatctgccctagctccatcccaaccaatgacagttgccgctcntgcaccgacctccccgctaggatcaccttc

SEQ ID NO: 48592 - DNA, 101 bp, rice(Oryza sativa)
  misc_feature (71): n=t or c
atacgcacccattatttaatccttttcttccatgccggccgtaagaaccttccatttagatatatgttcantttcattcttataaaccagaaagttctaaa

SEQ ID NO: 48593 - DNA, 101 bp, rice(Oryza sativa)
  misc_feature (71): n=a or g
taagctacagaaatatttttacactacaatgggtggcttcgttgaaaccaaggtttgaccatcggtcaccntagtttaccaccaaggctaaataacgaaaa

SEQ ID NO: 48594 - DNA, 101 bp, rice(Oryza sativa)
  misc_feature (71): n=a or g
ctttagtagtagtaaaaatgaagatggatccagtctatctgggtgtgtttttggggaaaagaaaacttttnggtgtcacatcggacgtttgaccggatgtc

SEQ ID NO: 48595 - DNA, 101 bp, rice(Oryza sativa)
  misc_feature (71): n=t or c
tgggcttgtgtgcagcacatctggctagttttacagtttttcaaatcctttaaaatccctaagaaataagnttaagagtactaagaaataagcttagtagt

SEQ ID NO: 48596 - DNA, 101 bp, rice(Oryza sativa)
  misc_feature (71): n=a or g
cggaggtcatcgccatgcccatttccacgggtgagtttcgtcccatatcgtcctgcgacataggcgtttgnagggtaatcgccggggcgaccaccggtaac

SEQ ID NO: 48597 - DNA, 101 bp, rice(Oryza sativa)
  misc_feature (71): n=t or c
cccaccaccatgtggagctaggaggaacaccctagacatttctcttccctttgtatgcatatacctgtgtngtgtcgtgtcgttgtcaattagcctgcaca

SEQ ID NO: 48598 - DNA, 101 bp, rice(Oryza sativa)
  misc_feature (71): n=a or g
tcttgctctagtcgaatcgcatccctcaagcataaaactaggtataatgtctccctcaatttcaaaaaccngtacaaatcgacttctttctgtggtttggg

SEQ ID NO: 48599 - DNA, 101 bp, rice(Oryza sativa)
  misc_feature (71): n=a or c
caataatctctcatatcctcttgccttacatatacctccgaccttccctctctgactctcccatcctctcntctctaattaaattatcccatcttctattt

SEQ ID NO: 48600 - DNA, 101 bp, rice(Oryza sativa)
  misc_feature (71): n=a or g
aaaatagcttggttcctttaatattttatcataattaacctgtttgtttgtgtcggtgatatgggcccggngtatcaggtttagagggaggaggctgcccc

SEQ ID NO: 48601 - DNA, 101 bp, rice(Oryza sativa)
  misc_feature (71): n=a or g
ggaattttatttaaatacatgagatcttcacctaaatggtggagaatcgacggaaaataagtgcacaatcnattgaagtcggtcgagtggtagaattatgg

SEQ ID NO: 48602 - DNA, 101 bp, rice(Oryza sativa)
  misc_feature (71): n=t or c
gctaataacaggaaatgaaacactggtgtatgggggaagcactagcggtgtgttagtcaagttgtgggtgnatgacttcaatcaccagtgttaaaatcttg

SEQ ID NO: 48603 - DNA, 101 bp, rice(Oryza sativa)
  misc_feature (71): n=a or g
gatcattgttggttttctccatgggagagtactgagaaaatcgcgtagtctttagcttatgtcagaaaagnttatctggtttaggaactgagatcaacagg

SEQ ID NO: 48604 - DNA, 101 bp, rice(Oryza sativa)
  misc_feature (71): n=t or c
cgttgccaagctcatcacagaaacgaccaaacagcttcgacttcccatggcgaacatcaaccaaatccacngtatcaccgcttcctgcttgttgttggcac

SEQ ID NO: 48605 - DNA, 101 bp, rice(Oryza sativa)
  misc_feature (71): n=a or g
acggacgctagcttgcgctgcagggtgcgagcagcactaacaaggaggaggaggaggaggattcaggctcnttcagggctttgtggaagtaactgggaaat

SEQ ID NO: 48606 - DNA, 101 bp, rice(Oryza sativa)
  misc_feature (71): n=a or g
gctccaagtaacgaaccgtcggttaacagcacttgggcaccgggccatgctcgccggcgtattcggacacngacaacagcaccaccgacgacgatgtggcc

SEQ ID NO: 48607 - DNA, 101 bp, rice(Oryza sativa)
  misc_feature (71): n=t or c
tggaggttttggttggctgggctaggccagttccgagtagaagctacaaggaataagttcaccggacgttnctcaacttaacagagagattttctgagatt

SEQ ID NO: 48608 - DNA, 101 bp, rice(Oryza sativa)
  misc_feature (71): n=t or g
cccagtgcaattccattgggcattccacttgtttaatccactattgcgcctgttacaatcatgccaaaagntgaagggccccttttcgttacaccggctcc

SEQ ID NO: 48609 - DNA, 101 bp, rice(Oryza sativa)
  misc_feature (71): n=a or g
tggcggccacaatgtcctccagctcgtcctccacgtcgctgacacctcggatcctggtgagaagcaccctnactctgcgcttgtctctgccttgctgcagt

SEQ ID NO: 48610 - DNA, 101 bp, rice(Oryza sativa)
  misc_feature (71): n=a or g
cctctcgaaaatgctagaaataccaaaaaaaaaagtaattagatctaggactgcatagactgagaaaattnattttattgatacaaaactatctaacacca

SEQ ID NO: 48611 - DNA, 101 bp, rice(Oryza sativa)
  misc_feature (71): n=a or g
gagatagtatagaatggtaaaatggcacttgaactttaaactgagatttttgggaatgagagttctatacnttatcaaatatggcacaattcatccttgaa

SEQ ID NO: 48612 - DNA, 101 bp, rice(Oryza sativa)
  misc_feature (71): n=a or g
gccaggggactcggcgtcaataacatcggcgaggccctggttggtaaggtcgagtatggtggtgatgttgntgttctctcaccacgagcgcgacgtgcaca

SEQ ID NO: 48613 - DNA, 101 bp, rice(Oryza sativa)
  misc_feature (71): n=t or c
aaaaatggctgacctgggattcgaaccctagtcctaagatatagcaagaaataaacttaccgttgcaccangagcaacaccgttaattcattgccgcacat

SEQ ID NO: 48614 - DNA, 101 bp, rice(Oryza sativa)
  misc_feature (71): n=t or c
gcatcccgccactcgctcaccgtttgtcgtcttcgtctgggctccagcctgcgccagaggaggaagtgggngcgacggcgatgaggaaggggcaggagggc

SEQ ID NO: 48615 - DNA, 101 bp, rice(Oryza sativa)
  misc_feature (71): n=t or c
attaattatgtgaacaaaaaacattgttagctctgaaggacttggtaataccaaaccgggaataaagattnacctctttaatcccggttgatgttactaac

SEQ ID NO: 48616 - DNA, 101 bp, rice(Oryza sativa)
  misc_feature (71): n=a or g
ctactagtccacgtgtgcagtagttccctttcgctttcagctggtgataaaaacgattggaaactatgggntgtttagtggggctaaaaacttttttggcc

SEQ ID NO: 48617 - DNA, 101 bp, rice(Oryza sativa)
  misc_feature (71): n=t or c
gtgaatgttaatttcctacgttttcctctcgaatcataggaacaagaatatttcatgcgtttttccttttnttattccttcttccttttcttattcatata

SEQ ID NO: 48618 - DNA, 101 bp, rice(Oryza sativa)
  misc_feature (71): n=t or c
gaaatttgttcagaatttaccagtttttcaccgaatttggtgaaatttcgaattccgccaatgcctggganggaagggccagtcggaatcgtaatccctga

SEQ ID NO: 48619 - DNA, 101 bp, rice(Oryza sativa)
  misc_feature (71): n=a or g
tcactctaatttttgaacgatatcaaaacaactcacactgtttagcaacgagccatgttatttatacgctncttttcaatcatggtttgctcattatttgt

SEQ ID NO: 48620 - DNA, 101 bp, rice(Oryza sativa)
  misc_feature (71): n=a or c
ctttataaaatttgttcggaatctaccggctttccactagatttcgcgaaaaccgtcatttcgctagagcncaaaatggaagaccatctcagaatcataaa

SEQ ID NO: 48621 - DNA, 101 bp, rice(Oryza sativa)
  misc_feature (71): n=t or g
gtggcaatggaagagggggaggagtaataataatcttggggtggtaatggcagtggcaatggcaatggtgntgtactacgccgcttcactggacgcgggtg

SEQ ID NO: 48622 - DNA, 101 bp, rice(Oryza sativa)
  misc_feature (71): n=a or g
acaaatcatagcacacacatatgtgaaaaaatttgttcccaaggtctccattttatcgaaataacaagttncggaaagatttttgaaaattacatacaact

SEQ ID NO: 48623 - DNA, 101 bp, rice(Oryza sativa)
  misc_feature (71): n=a or g
gaccgaattaccccctctcccctgaactcaaatgacaaacgttttacgccctcaattattcataccagacnaattaacccccatgtggcatcaacgtgaca

SEQ ID NO: 48624 - DNA, 101 bp, rice(Oryza sativa)
  misc_feature (71): n=a or g
cgacgatggcgtgctcactgttcactggcgaggacgagcttcccacggacttcgagcgaaaaggagggaangccagggaggaggtggttgcgaggccaagg

SEQ ID NO: 48625 - DNA, 101 bp, rice(Oryza sativa)
  misc_feature (71): n=a or g
aatcggacgggcatgtcttgccacacttgttaaggatgaggctgaggtcgactggtaggttgaccctaatnccaagtacgttggccttcacggcggtgcag

SEQ ID NO: 48626 - DNA, 101 bp, rice(Oryza sativa)
  misc_feature (71): n=t or g
caatttgaacaggacaaaccattagagacaggaaagttatgaagagagtttggctagaattgacgtataancagcatttatatataagtgaaactacgtgc

SEQ ID NO: 48627 - DNA, 101 bp, rice(Oryza sativa)
  misc_feature (71): n=a or g
acaaatttggattcagcattggatcatgttccttttccagcttgcattgtggtaggatagtgtgtctgcanttggcggggatttgatcttacgatcgatca

SEQ ID NO: 48628 - DNA, 101 bp, rice(Oryza sativa)
  misc_feature (71): n=t or g
tgtcattcattttatttttccaaagttgaaaacatgattcttacactagtgtcatttttcgatacacaagnaaacaaccatgaactatgattgtacaaaaa

SEQ ID NO: 48629 - DNA, 101 bp, rice(Oryza sativa)
  misc_feature (71): n=t or c
tgtatctaactggaattgttcatcgatctcaatcatgttttgcatacaacccttcatgcaaatatgagagnatattcatattttctccaacaatgattaat

SEQ ID NO: 48630 - DNA, 101 bp, rice(Oryza sativa)
  misc_feature (71): n=a or g
actatttttgttgtgattttagatacatgtttaaaattttgggtttatttttaaaccacctatctcctttncttgcagttatttatcattcaattagtgaa

SEQ ID NO: 48631 - DNA, 101 bp, rice(Oryza sativa)
  misc_feature (71): n=a or g
agcggccgcgctagccactaaccactctttacatgttcatttcagcctcctccatggattcttctatagtnaatcttgtcaccaccacaccaattaatgcc

SEQ ID NO: 48632 - DNA, 101 bp, rice(Oryza sativa)
  misc_feature (71): n=a or g
acagaatgcagaggagcactgctccgctgcaaaaacactgcaaaaacattgctttgcttgccgaggcagcnaacgacggcaatgggccaatagccaggcca

SEQ ID NO: 48633 - DNA, 101 bp, rice(Oryza sativa)
  misc_feature (71): n=t or c
ctaacacacaagcttgtaattattaatttaaacttaaccgtatatcagaggagacttagaatcagacgccnaatccaaactggcaaaaattgctgacgtta

SEQ ID NO: 48634 - DNA, 101 bp, rice(Oryza sativa)
  misc_feature (71): n=a or g
gctgaggggcaaacctggaaggctgtgtattcccagaaatactgaagaaacgtgcgaaagttcaacttttnaaccgttaatcgataaggcgatcaggaact

SEQ ID NO: 48635 - DNA, 101 bp, rice(Oryza sativa)
  misc_feature (71): n=t or c
cttccagttccaataatttagtgaaatttgacgacgaaaggattttacctttttcttttcgtaaaacatanagggcgtgtttagttggtgaaatgaaaatt

SEQ ID NO: 48636 - DNA, 101 bp, rice(Oryza sativa)
  misc_feature (71): n=a or c
gcaagaatcatgtgtcacacgcggatatattatttcggtggagaatcgatcatgtgctactctttccgagnagctgcgaatctgaaatttttatgagcgtt

SEQ ID NO: 48637 - DNA, 101 bp, rice(Oryza sativa)
  misc_feature (71): n=a or c
caacagttgtgtcgattcctcccgcaaatgcatcctgaagtcagatgtgacattctgattaatttataggnataaagaatgcatttttttagaacaaggtg

SEQ ID NO: 48638 - DNA, 101 bp, rice(Oryza sativa)
  misc_feature (71): n=t or c
tgagtcgtgatgcagtgacacaaaaactgtattacattatatcttcttacgtcatttactctttccgttcnataaaaaataattataatattatataggac

SEQ ID NO: 48639 - DNA, 101 bp, rice(Oryza sativa)
  misc_feature (71): n=a or g
ttattcataacttatgaatcggacaaaacttatatataatatgtgtgtgtacattacgatttaaaaactantggtaaaaaattaactttgatgacaaaaaa

SEQ ID NO: 48640 - DNA, 101 bp, rice(Oryza sativa)
  misc_feature (71): n=t or c
tcacctttggcaagtttagctaagagaagtatggtgaacctaggcaacgttagtatgtgaaccaaacagcnccataaacttccaacttttccatcacatcg

SEQ ID NO: 48641 - DNA, 101 bp, rice(Oryza sativa)
  misc_feature (71): n=t or c
tatgcaggctacacaattatacatccataggctaagttcctaaaagaaaggccgcatatatccggctgaangtagaggctggataaaaaatacccttctct

SEQ ID NO: 48642 - DNA, 101 bp, rice(Oryza sativa)
  misc_feature (71): n=a or g
tgtctcgtgattttgcattcttcgtatctaaaaacaaaatagggcaaccaaataattagaagaatttatgngcctgtttggggagtttaaaattctgagaa

SEQ ID NO: 48643 - DNA, 101 bp, rice(Oryza sativa)
  misc_feature (71): n=a or g
ctacacatcgatatgaaagccttttcatatctaacgttttaacaacctcataatgctccctccaatcttcncacaatcttgttcctgccacaaggatattc

SEQ ID NO: 48644 - DNA, 101 bp, rice(Oryza sativa)
  misc_feature (71): n=t or g
ggattaatggaactctatatccttggaagttcctcagagtttagtaagtggtaacaacaccccagtggtgngaacaggaatcaggaacgattgttctttaa

SEQ ID NO: 48645 - DNA, 101 bp, rice(Oryza sativa)
  misc_feature (71): n=a or g
tgtgacgattacctgatgacagaacacatatctgtcataaacagaggctgtttataatgactgttcacagnatgacaactgtttatgaccaaaccttgtat

SEQ ID NO: 48646 - DNA, 101 bp, rice(Oryza sativa)
  misc_feature (71): n=a or g
gtatgataaggttgggttcgtaacgcgagacttgtacaatttttttgcccggtacaagaagaagagaattnaaggtagggacgctgatctcgtggtgaacc

SEQ ID NO: 48647 - DNA, 101 bp, rice(Oryza sativa)
  misc_feature (71): n=t or g
gttgaacgtgacgtgacgcggtatccgccgttcgccgcgtactcgtcgaacaaggacgagaggttgcccangttagcgcgcacgacaagcaggtgcgaggc

SEQ ID NO: 48648 - DNA, 101 bp, rice(Oryza sativa)
  misc_feature (71): n=a or g
gtgatatttttaaaaaatttaacttgagtgtggaaggtgatgcatatttagaatttggtgttgtcaattcnaatagtttatttgaattttggactattgat

SEQ ID NO: 48649 - DNA, 101 bp, rice(Oryza sativa)
  misc_feature (71): n=a or g
tggctatgcctgatacgacatactgtaagggcatttacaatgcgtcaccacattttgccgttcttcccgtnccacatagactaggaatattataagccaca

SEQ ID NO: 48650 - DNA, 101 bp, rice(Oryza sativa)
  misc_feature (71): n=t or c
tttataatataaccaactactacctaaaaaaattaacatatcatctacacttgctaaggccattcccaacncaagatactatggcccgtttggcacagctc

SEQ ID NO: 48651 - DNA, 101 bp, rice(Oryza sativa)
  misc_feature (71): n=t or g
gctagatagtctcaagttgaaaataacaagttgattacatggaatagatggctactatctccgtttcaggntacaagatgtttttgacattggtcgaagtc

SEQ ID NO: 48652 - DNA, 101 bp, rice(Oryza sativa)
  misc_feature (71): n=t or c
tcttctatctggagacctctacccatttatctacgaaaactttttttcctatgtaacagttgtaattcttntgactattcttgtcagtccgtgtcttacaa

SEQ ID NO: 48653 - DNA, 101 bp, rice(Oryza sativa)
  misc_feature (71): n=a or c
acaggttcggaatccggaaaaattccgaaccgttttcacccctatttgcgatgaagtgaaaaagaactaanatcacttcatagcatcacttattagtgtcg

SEQ ID NO: 48654 - DNA, 101 bp, rice(Oryza sativa)
  misc_feature (71): n=t or c
tattttacaaggtttaagagtccatcatttagaaaggtcgtctgtagtcttctattagcaccgctactttngagggcttgttgagagtgtagtggggcttc

SEQ ID NO: 48655 - DNA, 101 bp, rice(Oryza sativa)
  misc_feature (71): n=t or g
gatatggaagcttcagaagctcgagatgttgtacctctttgcaagcaatttcagtggcgagattggtcctnacatctcaacactcaatatgcaggagcttg

SEQ ID NO: 48656 - DNA, 101 bp, rice(Oryza sativa)
  misc_feature (71): n=t or c
aatttaaggaaatactttttgacagttaatatgtttcttattgtatctaaggctgcgttctttcccacccncaacagtgctcacggaaaacggagcgatcc

SEQ ID NO: 48657 - DNA, 101 bp, rice(Oryza sativa)
  misc_feature (71): n=a or g
acccgaccgagtatttgactggcttgtgtatgtacctgtgtcagggtgagagcaacagcatctgcaagagncagagagggaagcagcaacagcagcagcag

SEQ ID NO: 48658 - DNA, 101 bp, rice(Oryza sativa)
  misc_feature (71): n=a or g
cccagttccaataacaaccgggactaaaggtcccgaattcttggtcccggactatagagggttacaatccnggacaaataagggtttctccaccagtgatt

SEQ ID NO: 48659 - DNA, 101 bp, rice(Oryza sativa)
  misc_feature (71): n=t or c
ctcagaaggaaaaaggtaatatatagttttctgttctcaactggtggatcccaatcattgggttcttaatntgtatgtgaaatcccactagaagaaaaatt

SEQ ID NO: 48660 - DNA, 101 bp, rice(Oryza sativa)
  misc_feature (71): n=t or c
ttgtcaacaatcgaggattggtcagttgccttgacgccgatgatggtgcagcaagtacaagcgccgatacnggtgctgtcggctgagctggtggcatattg

SEQ ID NO: 48661 - DNA, 101 bp, rice(Oryza sativa)
  misc_feature (71): n=t or c
acagagtcttgtccattataatttacagataagggtgtactcatagtacatgtttcatgtctactctctcngtttcacactataagtcgatttgaccattt

SEQ ID NO: 48662 - DNA, 101 bp, rice(Oryza sativa)
  misc_feature (71): n=t or g
gagaagagaggggagagggggagagagaggatgattttgctaaagtagtcgatttgaaccattgtgtctanaaatagggcttaggttatttggagttacta

SEQ ID NO: 48663 - DNA, 101 bp, rice(Oryza sativa)
  misc_feature (71): n=t or c
ttgtatcaacttccaattaaacaaaattcacttatgaatttaacaacatatttcatcattcacaatatccngtgcatgtcacgcccggaatttctatccaa

SEQ ID NO: 48664 - DNA, 101 bp, rice(Oryza sativa)
  misc_feature (71): n=a or g
tatgaccgttcgatgcagcattccgataagcgaacatcgtcggattagatcagcaacattttcaaaaatancccttcgagaaacttctctcaacttccagt

SEQ ID NO: 48665 - DNA, 101 bp, rice(Oryza sativa)
  misc_feature (71): n=t or c
ctaacaatgacgcaacgcaaattgaatcaggtgagccgtgaacgaaacgattaacatttacggtacgaatnaggaattaggcatcgttcgtttaggggtga

SEQ ID NO: 48666 - DNA, 101 bp, rice(Oryza sativa)
  misc_feature (71): n=a or c
ccttaaaatttgttttaaagtttaaagagccacatgccaaaaaaaaatctatttttacatgaaaaaaatcnaacatttttttcaacccaaccttatcttct

SEQ ID NO: 48667 - DNA, 101 bp, rice(Oryza sativa)
  misc_feature (71): n=t or c
tccagtcactaatagtagcaaccttccccttcccctttgaaacaaagtagcatgtgatttccctacacctnagctacatgaaagtatagataaaaaaaaag

SEQ ID NO: 48668 - DNA, 101 bp, rice(Oryza sativa)
  misc_feature (71): n=t or c
gatatgttatttgtatatcttatcagttgatggatcaaaccggcatgcccgtatctcaccaagatttgganctgcactggaactaaacagatctcctaggc

SEQ ID NO: 48669 - DNA, 101 bp, rice(Oryza sativa)
  misc_feature (71): n=t or c
tggaacatttgctaggctatatataggtaccaccgagcaagacaaataatagaaaatgttctatccgatcntaagtttttatattttagaacaattacaca

SEQ ID NO: 48670 - DNA, 101 bp, rice(Oryza sativa)
  misc_feature (71): n=t or g
gcattttcatatatgagcataccaaagacccatatttctttactaacttcacctaccacatcactttgttngtcgccatagtaaagtgcggggcgaccaaa

SEQ ID NO: 48671 - DNA, 101 bp, rice(Oryza sativa)
  misc_feature (71): n=t or g
tggtttgtcttttttgacggagggagtagtccatccgtcctctaatataacaaattttaacatttcacttnaattgtttaatcattcatcttattaaaaaa

SEQ ID NO: 48672 - DNA, 101 bp, rice(Oryza sativa)
  misc_feature (71): n=a or g
ttccgacctcacatctttcgtttttcacgcgcacgtacgcttcataaactggtaaaatgtgtgtttttatncaaaagttgtaaaaaatatattaatctatt

SEQ ID NO: 48673 - DNA, 101 bp, rice(Oryza sativa)
  misc_feature (71): n=a or g
tgctccaccttgcgcacatgtccttccctggacataaaccgcgagcggcgtggtgtgaagcacctccatcncgcctctaccatggatctcccgcaggctct

SEQ ID NO: 48674 - DNA, 101 bp, rice(Oryza sativa)
  misc_feature (71): n=a or g
aagtccaaacaaaaagttttagctccaacaataaaaaaaaatagagtggactaaagtgctctcacaaaatnaactcaagaggtgaagcttgatttagaaag

SEQ ID NO: 48675 - DNA, 101 bp, rice(Oryza sativa)
  misc_feature (71): n=a or g
atgggtgcaagctcgctctagactatgtccttctgtgccagcaccctagtttatgcaagttggctacgtcngagggtctagggggagagcggttccattct

SEQ ID NO: 48676 - DNA, 101 bp, rice(Oryza sativa)
  misc_feature (71): n=t or c
cctgtggcgtcgtggtgaactggtgattgatctcttgtcctggcgcgtgcctcggttgccaatggagacgntgtttagatcacaccttaaaatttttcaca

SEQ ID NO: 48677 - DNA, 101 bp, rice(Oryza sativa)
  misc_feature (71): n=a or g
ccggctcatcccagcgacgcttgaacatgttcccacccacttgctggttgctaccgcggggaacaggagcnccgaagtagcgcccagttctactggtgagg

SEQ ID NO: 48678 - DNA, 101 bp, rice(Oryza sativa)
  misc_feature (71): n=t or c
gtcaatagggagtggatggaaaacacaaaggagtggcatgaattcaatttcccagaattgcagtggcactnaagagtgctcacgaatagtagtggcatttt

SEQ ID NO: 48679 - DNA, 101 bp, rice(Oryza sativa)
  misc_feature (71): n=t or c
gcgacgcggcggcgcctgccatgccgagagaggtgcttcggccgtcacccctgcagcatgcgctcgacgangagcgaggcaggacgagtggcgcgccgggt

SEQ ID NO: 48680 - DNA, 101 bp, rice(Oryza sativa)
  misc_feature (71): n=a or g
agaagaccaacagtgcaacacttattccattactgcagaggttaagcatgcaaattgtgatgaacatgcgntgcatgctttgtccgacctcttgttcttaa

SEQ ID NO: 48681 - DNA, 101 bp, rice(Oryza sativa)
  misc_feature (71): n=a or g
tatttttgtgttatggcagcaaaactgaactgtaaataacgatgataccaaatcatgtctcttcaggatgngtattattatggtattgacattgactgttg

SEQ ID NO: 48682 - DNA, 101 bp, rice(Oryza sativa)
  misc_feature (71): n=a or c
agtgattttggttccagtttatattgaaaaacaaacgaacgagaggtgtgtatttggtttaatcattgacnaaattaaactgactaggaatgaaatcattg

SEQ ID NO: 48683 - DNA, 101 bp, rice(Oryza sativa)
  misc_feature (71): n=t or c
gcggtcgacagcggcggagattgtgcactcaacgacggcaacggcgtgccgcgaggtaggtggccggtaanagcggaggaggcggtggcacgaggcggacg

SEQ ID NO: 48684 - DNA, 101 bp, rice(Oryza sativa)
  misc_feature (71): n=t or c
tctgcctgacacacttgtcatcattctgcttgttcaaagctaagcagttgaggaaggacaccatctcaatnatgcagggtttagcgccaccaccaaacttc

SEQ ID NO: 48685 - DNA, 101 bp, rice(Oryza sativa)
  misc_feature (71): n=t or c
cgacgcctccacgtctctgctccgagcgatagcgttcatggtgtttgcgtcgtcgactcatcatccaccgngccgttgcggtgctctcctgctgctgccta

SEQ ID NO: 48686 - DNA, 101 bp, rice(Oryza sativa)
  misc_feature (71): n=a or g
tatgttttaaatacaaataattgcataatataaactttttatatcgcatgaactttttatgtaaaagatcntacctttagcacttctcatatcaaatatac

SEQ ID NO: 48687 - DNA, 101 bp, rice(Oryza sativa)
  misc_feature (71): n=a or g
cgtcctaaggccttaggtgggttagaaattcctaaccttaggttggcagggttcaccttgcgcgttcgctngctttggcttcagcgttccggtcatcccta

SEQ ID NO: 48688 - DNA, 101 bp, rice(Oryza sativa)
  misc_feature (71): n=a or g
gaatctggttgtggaaccagatcctctaacgtagtggattctatgttagagggacgtagaaagctgcagtntcgtttattccacatctgacggaaatgctc

SEQ ID NO: 48689 - DNA, 101 bp, rice(Oryza sativa)
  misc_feature (71): n=t or g
caacgcctccgctctctcacttacgtagtagatctgatctgccatgtcggtgtgggcgtcgtcgtcgtcgncgtcgccggcggcgaggttggtcgccggcg

SEQ ID NO: 48690 - DNA, 101 bp, rice(Oryza sativa)
  misc_feature (71): n=a or g
catgttcaattgcaacccatgtttacgaggaggaggtttatacggagatcaactttattttatacatccanagtatttcgtgtgtttctactaggattcta

SEQ ID NO: 48691 - DNA, 101 bp, rice(Oryza sativa)
  misc_feature (71): n=a or g
tttcttggttttttagcaaagattaaggttgagggtaaattcaaagggtcacttcggcctagagggtgtgngggaggggggtaggcaagtttgttatatta

SEQ ID NO: 48692 - DNA, 101 bp, rice(Oryza sativa)
  misc_feature (71): n=t or g
tatgtagctatccgtttatggttgccacaaatcataatatatcctaatatatatggtattttaaacttttngcacaacttataggttctctgaaatttact

SEQ ID NO: 48693 - DNA, 101 bp, rice(Oryza sativa)
  misc_feature (71): n=a or g
agacagtaataattgagagggtaattcggatttcttttcctacacttggtgcgccaacgccaagtagccancggatggagaatcgcgttccggcgtcgctt

SEQ ID NO: 48694 - DNA, 101 bp, rice(Oryza sativa)
  misc_feature (71): n=a or c
atccttatcacctaatactgggagatatttaaagcttgagaattcttgatggaataagttcatctgaggtnccttaacttgtcaacgaatccgattccatc

SEQ ID NO: 48695 - DNA, 101 bp, rice(Oryza sativa)
  misc_feature (71): n=a or g
tcggactttttttttctttttttccggtttttcccttctttcgcccttttatcggactttggtttttttcntccgcggatttttttttgttttgtcctttt

SEQ ID NO: 48696 - DNA, 101 bp, rice(Oryza sativa)
  misc_feature (71): n=t or c
tctttaaaaaaatttggcggtgtttcgcctctcataaactaatgttgtagcatttagtgaaaaaatgtttnagttcttaaaaagaagtagaacacaattgg

SEQ ID NO: 48697 - DNA, 101 bp, rice(Oryza sativa)
  misc_feature (71): n=t or c
ctcctaaattaactggttgatggattttcatcattcgaggatatatatatatatctgtttgttttgtgcangtcacttaaaaaattatcaaaaaattgaaa

SEQ ID NO: 48698 - DNA, 101 bp, rice(Oryza sativa)
  misc_feature (71): n=t or g
ataaggggcaagggtgagtacttaacgtactcagtaagccggggaaaagaatgacatgacggtttaacaangaggctacggttttatttgcgaaggctgcc

SEQ ID NO: 48699 - DNA, 101 bp, rice(Oryza sativa)
  misc_feature (71): n=t or c
ctacaccttcgggggccacgctgtcaccgtgtaagccgaccatcctctctcttgattagctatggctcgantaaccatttgattggtcattagtgcctact

SEQ ID NO: 48700 - DNA, 101 bp, rice(Oryza sativa)
  misc_feature (71): n=a or c
ctgtgctaatattccactccagaagcgcccaggttcttatcgatgccacaacgaaaatgcagcagaatttntggcttactacctctctgcactagagcatt

SEQ ID NO: 48701 - DNA, 101 bp, rice(Oryza sativa)
  misc_feature (71): n=a or g
gggacatatgccaagatgggtttgccaactttggcattatctcaagcaccgacttcactcagaggttttgnaggcgaagcggtgcaggttctgggacaagc

SEQ ID NO: 48702 - DNA, 101 bp, rice(Oryza sativa)
  misc_feature (71): n=a or c
tctcaaattttacaacagaaggtgatgttctgccgcaatttacaagagaaggaatatactccctccgtccnaaaaaaaaaaaaggcaaactctggatttcc

SEQ ID NO: 48703 - DNA, 101 bp, rice(Oryza sativa)
  misc_feature (71): n=t or g
attctaaaaaatggaacaaactaatgtacgtaggacaaccaacggtcggataaagctttttatttgtgcanatatatttaatttgatttccagaaggatgt

SEQ ID NO: 48704 - DNA, 101 bp, rice(Oryza sativa)
  misc_feature (71): n=a or g
tttgcttaggcggccaggacaatcaacagttaggcgttgcatttttcttaggccgtcgagacaatcaacanttaggcattgcattttgctcaggcagtcag

SEQ ID NO: 48705 - DNA, 101 bp, rice(Oryza sativa)
  misc_feature (71): n=a or g
gcagtcgatgactggtgagataggggagagacggattggcaggagcgcggaggcgaggttctgttgacgcnaaaacacacacactggcctgggtgatctgc

SEQ ID NO: 48706 - DNA, 101 bp, rice(Oryza sativa)
  misc_feature (71): n=a or g
aatgaacaaacaggagtatttgatgatagcaccaaacccctcatatatatatataaggggtgtttagatgnggctaaaactttttagcccatgtcacatcg

SEQ ID NO: 48707 - DNA, 101 bp, rice(Oryza sativa)
  misc_feature (71): n=a or g
tcccatgcttgtagttagcaatggataatcagtatcatctccatttcttgctttgtagttcgttacctttngaaacttgttttctttcctgtttctgtctt

SEQ ID NO: 48708 - DNA, 101 bp, rice(Oryza sativa)
  misc_feature (71): n=t or g
gcatttagtttttgtgtttcaaaaatgcaatatagctatgaaatatttgtggtggttatgttttatccatnttttcaactttagcagagattttactccta

SEQ ID NO: 48709 - DNA, 101 bp, rice(Oryza sativa)
  misc_feature (71): n=a or g
aattttttgcggtgagatctaaatggggcctaactattttttctctcttccttcggatggagacggcactntggtccactagtcactagatcatcctctct

SEQ ID NO: 48710 - DNA, 101 bp, rice(Oryza sativa)
  misc_feature (71): n=t or c
atagctattgcatatttgcagtttcatcagaggaattgacgataggtaatttagaaccgatagttagccanactattaaacttgctctaattcaatcacta

SEQ ID NO: 48711 - DNA, 101 bp, rice(Oryza sativa)
  misc_feature (71): n=t or c
gagaggatgccggccggctgctgttgaaccagtatgagccgctcttgtgcatgctccacgccactgtgccnaacggttggaccactgccaacgtcgccact

SEQ ID NO: 48712 - DNA, 101 bp, rice(Oryza sativa)
  misc_feature (71): n=t or c
aaccaacgcgaagtaaggcaaaatccctctggctgcgcgatctggcgataggataacttaccgagggggtnggcgctttgcgacgatgtccgcttacagag

SEQ ID NO: 48713 - DNA, 101 bp, rice(Oryza sativa)
  misc_feature (71): n=a or g
ctctctccttctccgcggaggcgatttgatcggctgggttttctgacggatcgattgtatgctcattgttntggttattcaggtccatgcgtggtgatgag

SEQ ID NO: 48714 - DNA, 101 bp, rice(Oryza sativa)
  misc_feature (71): n=a or g
ccttccgcgtttctcctgtccttcccgcgtaagggatctccttctgcgcacgggaaaggaaaaaaaaatanaatttctgttggtagtttaatagaagggcc

SEQ ID NO: 48715 - DNA, 101 bp, rice(Oryza sativa)
  misc_feature (71): n=a or c
tattagtagttagcacctccgttataaataacgacacatcatgcatcacttgcaatctccagccacaaaanaaaaaaaaaatcgacctcttctcgcaagca

SEQ ID NO: 48716 - DNA, 101 bp, rice(Oryza sativa)
  misc_feature (71): n=t or g
gcacggccgcttgatgaccatggcgagtgcggggaggcattgctgaatccaaagagcaataaaggaatatnagcaacaaatttagaaaacactcggttagg

SEQ ID NO: 48717 - DNA, 101 bp, rice(Oryza sativa)
  misc_feature (71): n=a or c
ttcaatcaatatcgaacttgataaaattagtctcttgtgtcgttttggctttggttcgtatgcaccagatnagataagtttgtgtagtaaaatgagtattt

SEQ ID NO: 48718 - DNA, 101 bp, rice(Oryza sativa)
  misc_feature (71): n=a or g
ggaaattccaaaaccattggtaaggacgtaactcgatcaacagatttcttgtggtgaaacggatccaactnagtttaaattctagacttaacacggatgct

SEQ ID NO: 48719 - DNA, 101 bp, rice(Oryza sativa)
  misc_feature (71): n=a or c
gctaatagatctacacaaacatgatggacatatcgatcaatctaaagctacaatatgattaaagaaatagnaacttaggcagaatatcggacctaaccgag

SEQ ID NO: 48720 - DNA, 101 bp, rice(Oryza sativa)
  misc_feature (71): n=a or g
cgttcaagatgctcttaaaggtgctgtagtgcaagatatgctaccggcgcggcagttttcatatcccttcncgccacctgtctagaaattaattagtacaa

SEQ ID NO: 48721 - DNA, 101 bp, rice(Oryza sativa)
  misc_feature (71): n=t or c
tcaagtgcaggaaaaagcaccaccacttgcactttgttcacacggagttggagtattaggcttaggccttntttgggaaattttttaggtttggttatcag

SEQ ID NO: 48722 - DNA, 101 bp, rice(Oryza sativa)
  misc_feature (71): n=a or g
caatatacgatgaaggctacaaacgttcacctacatacaaatagctacaagtgatcattgtactattacanaataggatagattttactcccttctaacaa

SEQ ID NO: 48723 - DNA, 101 bp, rice(Oryza sativa)
  misc_feature (71): n=a or c
actagaaacctcatctttcttctctctttatccccactcatttttatcatgtgtctagaggaggtaacagnaacctccggaaatttccatatgtttagccc

SEQ ID NO: 48724 - DNA, 101 bp, rice(Oryza sativa)
  misc_feature (71): n=t or c
atctggccagcttcaaacttatcatgcgagcggtcttgttcgaagttgtagaattctgaatcagggcatanataactgattaattcgatatttgttttgtt

SEQ ID NO: 48725 - DNA, 101 bp, rice(Oryza sativa)
  misc_feature (71): n=a or g
tgacatatttccgttcacatattaataacagcgcaagaaaatgtcttatgtaatttcataatccgtgttcncagcgaacactacatactattcctcgtcta

SEQ ID NO: 48726 - DNA, 101 bp, rice(Oryza sativa)
  misc_feature (71): n=t or g
taatctccggaatagcctagtggttgccacacagtagacatctacaagcgttggaagtatagaccaattanaatttcaattgaaactcattaggaactcgg

SEQ ID NO: 48727 - DNA, 101 bp, rice(Oryza sativa)
  misc_feature (71): n=t or c
ctggactctgaaaataggcagaaggtggaaaatagaaaggaattaaagtgactccattttttatcttaatngacttgtttttattccagttacatgaaaga

SEQ ID NO: 48728 - DNA, 101 bp, rice(Oryza sativa)
  misc_feature (71): n=a or g
ttctatccaaaaaataataaaaaccgtggggccaaatatcagttacaccaaaaaataataatttaaaaatngtggggcccacgggagcctcacatgtcagc

SEQ ID NO: 48729 - DNA, 101 bp, rice(Oryza sativa)
  misc_feature (71): n=a or g
gacgaggtggcgaccgctgagttggatcactgtcctcgggcaggtctccatctcgttgttccctattagcnccatcgatccgcggttgttctagtggtgcc

SEQ ID NO: 48730 - DNA, 101 bp, rice(Oryza sativa)
  misc_feature (71): n=t or c
tagtatactccctccgctccatgacacatcctagatgtatccaaattcgttatgctagaatatattatatnatttatttattttttttttgaacggaggga

SEQ ID NO: 48731 - DNA, 101 bp, rice(Oryza sativa)
  misc_feature (71): n=a or c
atatccaagtgaattactgtagtcttcagaaaaaaataatgtataccgtgcttaaagtctagtaaatgcanttttttattatgtggtcaaaatataactaa

SEQ ID NO: 48732 - DNA, 101 bp, rice(Oryza sativa)
  misc_feature (71): n=t or c
gaatctaaaggatatatttgtaatgggaggggattttaatattactagatgggcaccctacgtgttattgngggagaattgtgtgataatatagtatatat

SEQ ID NO: 48733 - DNA, 101 bp, rice(Oryza sativa)
  misc_feature (71): n=t or c
accccaggtcatgacatctccaaggtggttgaagactctgagaaagcacaagaactcaaagcacatacccnagatcaggcaatctcgaagttagtacaagc

SEQ ID NO: 48734 - DNA, 101 bp, rice(Oryza sativa)
  misc_feature (71): n=t or c
tatgctttcagtacaaaccctagatatgaatgtggacatgatgtatgtccagattcatacccaaggtttancttttttttttgggacggagggagtatatc

SEQ ID NO: 48735 - DNA, 101 bp, rice(Oryza sativa)
  misc_feature (71): n=a or g
tttggaaaaagctcgttcgggaaagcaaagtaaaagctgactacaaacagcatcggctgccgctcaaatcngtaattcatttatcggagatgaagatagaa

SEQ ID NO: 48736 - DNA, 101 bp, rice(Oryza sativa)
  misc_feature (71): n=a or g
gaactatatctgtttttatttaaaatgcactctcctcttgctgtgtttcaatgcattagtggcattgtcanattgtaaactaaattgccatgataactgta

SEQ ID NO: 48737 - DNA, 101 bp, rice(Oryza sativa)
  misc_feature (71): n=a or c
tttgttaatctcaagatataccggatataccggcccaatcttttaaagatgctcataaggatataatatgngtgtgtgcatttataaagatgagtgtgcgt

SEQ ID NO: 48738 - DNA, 101 bp, rice(Oryza sativa)
  misc_feature (71): n=t or c
agaggtatttataactctttgatttttcacgctttattggagatgagcaggtgtcacgtttaggtgctgancgcctgattcctgtgctgcatccaactttt

SEQ ID NO: 48739 - DNA, 101 bp, rice(Oryza sativa)
  misc_feature (71): n=t or c
gccacatgcgttttgactttgttctaatcgaaatgaaaagattgaccttcttaacacactccgttcacgtngagtagtgtcacgtcctgataaattcatcc

SEQ ID NO: 48740 - DNA, 101 bp, rice(Oryza sativa)
  misc_feature (71): n=t or c
tagagtaaccagctacaacaactttctcgtcatccgtaagcatgtttctgaaactgttaaatggtattgtnttgtgcaaaatttttctatagagaagtttt

SEQ ID NO: 48741 - DNA, 101 bp, rice(Oryza sativa)
  misc_feature (71): n=t or g
ctcagctagacaatttggaatgggccaactcccgatcggcttgtattttgttgacaaaatccagtgccgangagaaatctcaccaactctgatgatggatc

SEQ ID NO: 48742 - DNA, 101 bp, rice(Oryza sativa)
  misc_feature (71): n=a or g
tgaggaaattttggtcattgccggatgaaaaggagtttgttatgtctgggctagactggttgctggtgctnttagaatctttaaacagcaatgacaaagct

SEQ ID NO: 48743 - DNA, 101 bp, rice(Oryza sativa)
  misc_feature (71): n=a or g
aggaatagcgtctgcaagggttcataacaattcaaatcttctagtactacacattactgctcgttgacatntgggcctgaggatatgtgagggccacatgt

SEQ ID NO: 48744 - DNA, 101 bp, rice(Oryza sativa)
  misc_feature (71): n=a or g
aaataccgctccccgaatcattccttgccatctggaagggaacaacatcggtattctctacagtccaactntcggggccaatctcgtttcggaatcttttg

SEQ ID NO: 48745 - DNA, 101 bp, rice(Oryza sativa)
  misc_feature (71): n=t or g
atttgcttcattaatcgcacggtctcttttcgtgattggatgaggaggacgaggccaggtggctgcatcgnccctggtaggagtccatgacctccggtgag

SEQ ID NO: 48746 - DNA, 101 bp, rice(Oryza sativa)
  misc_feature (71): n=a or g
tcggttcagtcttacaacgagacaccactgaagccattactctactgaaaatatactactagttcatcaancaaataggaaccacctatacttccaataac

SEQ ID NO: 48747 - DNA, 101 bp, rice(Oryza sativa)
  misc_feature (71): n=t or c
catcttgtaaaaaagcaaatcacataatattactcgtgctttatgtagctaagctacattggatcaggatnctctgcagtcaaagtcacgtgactttgtca

SEQ ID NO: 48748 - DNA, 101 bp, rice(Oryza sativa)
  misc_feature (71): n=a or g
aggccggcatcgacgacgcgacgttggaggcgttcacggccgtggtctacagtgaggctagaaaggctgcnacagcattgcggcggcgacgcagacatgct

SEQ ID NO: 48749 - DNA, 101 bp, rice(Oryza sativa)
  misc_feature (71): n=a or c
ggttcatcgtcggcgaatccccaagtcaggcccttctatgggctgtgctcggggcacatcttaagcaagtncccaagtcccccctccccccctcttgtgaa

SEQ ID NO: 48750 - DNA, 101 bp, rice(Oryza sativa)
  misc_feature (71): n=t or c
aggacaaccaccagtgcacaaccatcggttgtggtctggagttgggatgggaaggctacgaaggcttttgnagtgacagttgtaggattaagcatgaatac

SEQ ID NO: 48751 - DNA, 101 bp, rice(Oryza sativa)
  misc_feature (71): n=t or c
tattgtgcttagctggacacatacaagtcacatattattatgttgttggctatcaatgctattttatactncctccgtactcgtaaaggaagtcgtttagg

SEQ ID NO: 48752 - DNA, 101 bp, rice(Oryza sativa)
  misc_feature (71): n=t or g
tactttgattggctactcaccgtgacgtcgtctacaccgacgtaatacggcgcgggggagtgcagtgccgnggacagcaccatgcacacgaatcttggccg

SEQ ID NO: 48753 - DNA, 101 bp, rice(Oryza sativa)
  misc_feature (71): n=t or g
caaaggggcaacaaagttaaaatatatagagagagagacactgagacaagcaaaaactagctaaaatctanaaaatgaattaagagtcagggaaaagctaa

SEQ ID NO: 48754 - DNA, 101 bp, rice(Oryza sativa)
  misc_feature (71): n=t or c
ctcatgctaggtgcttattagctatcaatcgagtatactctctatggacacatgttccatctatttatagncatcctttgagcaagtttaatagtatagcc

SEQ ID NO: 48755 - DNA, 101 bp, rice(Oryza sativa)
  misc_feature (71): n=t or c
ccgacatcactgctggatcatgtttgtacgcctgcgagagacgatgacgcgcattgcgatggcatgattcntggtcaattatgatcatcattaaaaatttg

SEQ ID NO: 48756 - DNA, 101 bp, rice(Oryza sativa)
  misc_feature (71): n=a or g
taggcggtggccggcgcttggcagcactgggctcaacacggcagtggcaagtcagaggcagcgctcgttanaaaacgatgggcaaacaaacgacaaagaat

SEQ ID NO: 48757 - DNA, 101 bp, rice(Oryza sativa)
  misc_feature (71): n=a or g
ccgtcgtatcaatggatcttggagcctcatccatcgacacctccgggatgaagctgcgaatgaaagagtcnctgcctggccaccaggatctagagcgatcg

SEQ ID NO: 48758 - DNA, 101 bp, rice(Oryza sativa)
  misc_feature (71): n=a or g
tcacggaggaaggaaggaaggggaggggagggagcagaggatatgatgggaagggaagagagagagaggangggatggtggtggagaggagaggataagga

SEQ ID NO: 48759 - DNA, 101 bp, rice(Oryza sativa)
  misc_feature (71): n=a or g
atatgttcctaacacacgctaaaaaagacggggaccaacaacacatttttgacatcactgaaatcctattnaaaacccatcttattcgtgcataatatttg

SEQ ID NO: 48760 - DNA, 101 bp, rice(Oryza sativa)
  misc_feature (71): n=t or c
tttttttgccatccacttttttcttgctgtttcttcgctattcggcgcgccctttttggtcatttttctcntttttttcatccgcttttttgccgatattt

SEQ ID NO: 48761 - DNA, 101 bp, rice(Oryza sativa)
  misc_feature (71): n=a or c
gcaatggcttggcctctaaatggaagacgagcgagcaagccgacccgatcgaaaaagcccactccacccanccaacacccgcgggttcttgcccccccaaa

SEQ ID NO: 48762 - DNA, 101 bp, rice(Oryza sativa)
  misc_feature (71): n=a or g
gagactcgcgtttattgttagattttactagcattcgtcagaaccgacccacactcgtcgtgccccacggnccgtcagggaaggaagaggaaggaaaggga

SEQ ID NO: 48763 - DNA, 101 bp, rice(Oryza sativa)
  misc_feature (71): n=a or g
taaacaccggaatggactcactcaaaaagtagaaaagaactagaaggattaatcaatgtgcgtgtacattngttttttcaattcccacatgatacttctct

SEQ ID NO: 48764 - DNA, 101 bp, rice(Oryza sativa)
  misc_feature (71): n=t or c
aatcttgccccccatccaccccggccggaaggggaaagaatagtttttaaacagagcagcgtgtcgtcgcnagctgctgcgtgcgtgcgtgcgtgcgtgcg

SEQ ID NO: 48765 - DNA, 101 bp, rice(Oryza sativa)
  misc_feature (71): n=a or g
ggatggcagtcggacacgacgggtatgggtagtgactacatgtatacggatatgttcgttactacatgacnggcaggtaacattgtccatgccggttgccc

SEQ ID NO: 48766 - DNA, 101 bp, rice(Oryza sativa)
  misc_feature (71): n=t or c
accttttaatcattggataaataatttggttgattatctacccgtataaacgtagcgtaaaatacatgccngtgtattcgcacgggctacctttctactcc

SEQ ID NO: 48767 - DNA, 101 bp, rice(Oryza sativa)
  misc_feature (71): n=t or c
tgaaacataccgtttagcagtttaaaagggtgctaacgaaaactgaggtcaaatatgtatcttagcgaaangaaaaattaatgaaacaatcgaaaataatc

SEQ ID NO: 48768 - DNA, 101 bp, rice(Oryza sativa)
  misc_feature (71): n=t or c
aagttgatgtgctctttgcaagtagaatgcatgttttcccccatttaaaatggcttattattgcgcccttnttttcatctgggtagcagaactagcaccaa

SEQ ID NO: 48769 - DNA, 101 bp, rice(Oryza sativa)
  misc_feature (71): n=t or c
cagggcctaagacgtcaataaagtgtctttaccctggaaattttgtggcgacttgtaaaccgtctcagagnaggtacaatagtaagctataagccagctgc

SEQ ID NO: 48770 - DNA, 101 bp, rice(Oryza sativa)
  misc_feature (71): n=a or g
ctcaactattaaaatcgatgcaatttaactctctcggtggttttgagagtgattttcgctcatgtgtcacnttgacctggtccaataggttgggtcagcat

SEQ ID NO: 48771 - DNA, 101 bp, rice(Oryza sativa)
  misc_feature (71): n=t or g
atgcatggctaggtcgccgcattggtagccgtacgtcgtccgatcctggatggagacctaaaactccggcncgcatggcggatgtggcatcggctagcaca

SEQ ID NO: 48772 - DNA, 101 bp, rice(Oryza sativa)
  misc_feature (71): n=t or c
aataattcaataaaaaactgtgacttcagctgagtttagttccaaaaaactttcatacacatacaaacttncaacttttccgtcacatcgttttaatttca

SEQ ID NO: 48773 - DNA, 101 bp, rice(Oryza sativa)
  misc_feature (71): n=t or g
tttctcttaggtacagtagcatattacaaatgttttcatcttgtcctacatcactatatcatgcaagatcnatggatatccatatatctaatctaatagca

SEQ ID NO: 48774 - DNA, 101 bp, rice(Oryza sativa)
  misc_feature (71): n=t or g
gccagtagtagatgccggacggggcagagttcaatttaaaaacaggaggtcgagccagccagccggtctgntctgtccatccatccatccatccatccacc

SEQ ID NO: 48775 - DNA, 101 bp, rice(Oryza sativa)
  misc_feature (71): n=a or g
gatcattgatatgatgcgttatcagccgatgctagaaaatatctatatagtgcacacctgtttcgatggtngaactagatctaaaccttgaaaacaaggtg

SEQ ID NO: 48776 - DNA, 101 bp, rice(Oryza sativa)
  misc_feature (71): n=t or c
gagtggagtaggacctaaatgtcagtggctttcatatctcctagagaatttttgttcggcaccccttttcncagcccctctcactcgttttccgcacgtac

SEQ ID NO: 48777 - DNA, 101 bp, rice(Oryza sativa)
  misc_feature (71): n=a or g
gagctgcagctcacggcctgtgtcagctagcccatgcgtgcaccatgatagagaaacacggtggcaaggtngcctctgaccggcgagccggccgccggcag

SEQ ID NO: 48778 - DNA, 101 bp, rice(Oryza sativa)
  misc_feature (71): n=t or c
atcttgcatttgatcctaaacttattgaactttgccactgaacgagagcctgctagagctatacagatcgngggaccatttgatatatttgatgagcaacc

SEQ ID NO: 48779 - DNA, 101 bp, rice(Oryza sativa)
  misc_feature (71): n=t or c
cctcttgttcccatggcattcatcccaacaaaaccacatgaatgtcaatcaccagaatcaccacatgaatnggaatcatcgatcatagtagcaagaatgtg

SEQ ID NO: 48780 - DNA, 101 bp, rice(Oryza sativa)
  misc_feature (71): n=a or g
tacattagtgctgaccacctactgtcagggttagataccatatatctaataagtagttgactaaatcttgncaggacccaccacataccatgtcttatatg

SEQ ID NO: 48781 - DNA, 101 bp, rice(Oryza sativa)
  misc_feature (71): n=a or g
gccatggagaagagcacaagcttccactttctctgttctcatgagggtgaggacaaaggaaaaaaaaagcngatgagggtgcagagaaatcaaacgtggaa

SEQ ID NO: 48782 - DNA, 101 bp, rice(Oryza sativa)
  misc_feature (71): n=t or c
gctgctgtttgcttcaaaaagaaacggagaggttaagccgtttagatgaaaaaaaaaggagcgtaaggccntgggcccgctggaaaagcgatcgccaatag

SEQ ID NO: 48783 - DNA, 101 bp, rice(Oryza sativa)
  misc_feature (71): n=a or g
aaggggaccgccgagagtctctcccgctagctgacacccttctccctgctggtcgtcgtctgtcactgtcnagcttctacccgccacgcgcctctcccgcc

SEQ ID NO: 48784 - DNA, 101 bp, rice(Oryza sativa)
  misc_feature (71): n=a or g
gttcctagtaggagtacaagtttgtatttgaagccccttgccctttaccaccagcatactagtatcagagnactaatgatcctctgactccagagaccagt

SEQ ID NO: 48785 - DNA, 101 bp, rice(Oryza sativa)
  misc_feature (71): n=a or c
cgtcatcatgtaaaactgctaatacatcaaaaatcaagctgcaacaacaaggtagtagaagagagtagtgnagatgggagaaagagtagggggacaaagaa

SEQ ID NO: 48786 - DNA, 101 bp, rice(Oryza sativa)
  misc_feature (71): n=t or g
cacaaaccgttcaataccacgagaagagtgggagagagaagagggaagagtggggaaggattttttttttnacatgtgggtgccaaatagacctcacatta

SEQ ID NO: 48787 - DNA, 101 bp, rice(Oryza sativa)
  misc_feature (71): n=t or c
gagagcggcgatggactgcagctgagctagcagaggcgagcagtgttgaggtcgtggagcttgtcgttacnctctctgcctgcactgcaagcttgaagcca

SEQ ID NO: 48788 - DNA, 101 bp, rice(Oryza sativa)
  misc_feature (71): n=a or c
cgcagaggtatgtgccccatcggctagatctttcttctttatgcagtagatcggtttctccttgtctcatnttgttttcttcttctctattcttttctgca

SEQ ID NO: 48789 - DNA, 101 bp, rice(Oryza sativa)
  misc_feature (71): n=a or g
agagagagagagcgagagcggctggggtgatgggccaggaaacggttgcggcccaagagggaaagggagcnagagagatgtgcccgggaagaaaaacagcc

SEQ ID NO: 48790 - DNA, 101 bp, rice(Oryza sativa)
  misc_feature (71): n=a or g
cttccaaatattccaagcagaataaagcaccttcccaacaaaatgggaagagttatatgaatttctggccnttaccaacatttcaccaaagctcaaagaaa

SEQ ID NO: 48791 - DNA, 101 bp, rice(Oryza sativa)
  misc_feature (71): n=a or g
cgaattaattaggcttaataaatttatttcgcagtgtacaggtggatgatttgttttatttttagtctatntttaatacttaaaatatatgtatgtatacc

SEQ ID NO: 48792 - DNA, 101 bp, rice(Oryza sativa)
  misc_feature (71): n=a or g
caatggctctgattcggtacctccatccctcaaggatggtaaaatctctctaaattttacgctagaaaatntggtaccttcctataccttttcaagaatga

SEQ ID NO: 48793 - DNA, 101 bp, rice(Oryza sativa)
  misc_feature (71): n=t or c
caaataataaagtacagtatatactaattttcttttcagcctccctgaaataacgagtatttatacataanaaagtttataaatagaaagtttgcatgcat

SEQ ID NO: 48794 - DNA, 101 bp, rice(Oryza sativa)
  misc_feature (71): n=t or c
gtgattggctccgattgggattgggtgacatagtcacaaggtgacatagggtgaatcgtgatgacgtgtangaatttcagccgctagatttgtttcgtgat

SEQ ID NO: 48795 - DNA, 101 bp, rice(Oryza sativa)
  misc_feature (71): n=a or g
tagaaaatacaataatgatttggatctagacttccaacagcaaacaacatcaacgcaacaacagcaaacancaaaacaacaacattatttcaagatagcca

SEQ ID NO: 48796 - DNA, 101 bp, rice(Oryza sativa)
  misc_feature (71): n=t or c
gagagggactccatcaataactcccgcctgattgtactgaataggaggtgcacgaggtgggagtacagccnggtgcctgcgatggcgactgggttgggttg

SEQ ID NO: 48797 - DNA, 101 bp, rice(Oryza sativa)
  misc_feature (71): n=t or g
gaggtagatttttagatactttcttttttttctgctggttaactcttttttaaacatggtataaatgcaantggtcataatgtgtgctcatcatataatca

SEQ ID NO: 48798 - DNA, 101 bp, rice(Oryza sativa)
  misc_feature (71): n=t or g
aatcaaacatcgttagctaaaattatgagtgatttctaactgtccatttgttacatagtctttctttaatnagtgatttcatgttatttatggataattac

SEQ ID NO: 48799 - DNA, 101 bp, rice(Oryza sativa)
  misc_feature (71): n=t or c
gccggctccgccatatacttcttggtatcaccgtctaacttcaccctttttttaattttcttaattaggcnctgtttagattctctaaaatggcaaaaatg

SEQ ID NO: 48800 - DNA, 101 bp, rice(Oryza sativa)
  misc_feature (71): n=a or g
atttcacatgcggttttctttggaaataacctggaacaaaatacaacattttcataagcgattctcttaanaagccacccataaagttcaattttcatcgg

SEQ ID NO: 48801 - DNA, 101 bp, rice(Oryza sativa)
  misc_feature (71): n=t or c
acctcaaaagtttatataccatcgctgtaatttactaaaaaaataaactagcaattaaaaacaggttaccnaatttcggaggcgcctagatcgcacatact

SEQ ID NO: 48802 - DNA, 101 bp, rice(Oryza sativa)
  misc_feature (71): n=t or c
tgtcacaaaattcaagatcactattataattactctcccccatttatacttataagtcactttgacttttntaaaagttcgatcaagtttataaaaaaata

SEQ ID NO: 48803 - DNA, 101 bp, rice(Oryza sativa)
  misc_feature (71): n=a or g
acatggaaatcagcaagttattacagatggatcggcagtctttattatacaaatgctgtgtttagttcacnctaaaattggaagtttggttgaaattggaa

SEQ ID NO: 48804 - DNA, 101 bp, rice(Oryza sativa)
  misc_feature (71): n=t or c
acttctcttactaaaaggccttcgcccttgtacattgcgcatgcttcctttagaggagcatggagacgtanaagatctacatcttaagatcttgagccaag

SEQ ID NO: 48805 - DNA, 101 bp, rice(Oryza sativa)
  misc_feature (71): n=t or c
tatttgtcaaaacgaccaacaatagggcaccgtgcccaggagagaagaaaggtccaggcccgcttgcttanaaaaactatggtacacctcagtccagtctt

SEQ ID NO: 48806 - DNA, 101 bp, rice(Oryza sativa)
  misc_feature (71): n=a or g
atccttccctctctccggtgaactcatgccccaaattgacctccctcctcggttgctctcgccccaaattnaatgcaaaaatcggttcctctcgtcctcct

SEQ ID NO: 48807 - DNA, 101 bp, rice(Oryza sativa)
  misc_feature (71): n=a or g
tttactctaaaaataaaatagacgaatattatatagagggtgtttagattcaggtgtaaagttttggtatntcacatcgggattatatagggtgtcgcatg

SEQ ID NO: 48808 - DNA, 101 bp, rice(Oryza sativa)
  misc_feature (71): n=t or c
aatttacgggattggatcaatgacggatacatgaaagaaatagcagggggtctaaacaaactatataaagntatagccccctcccatctatatatggtaaa

SEQ ID NO: 48809 - DNA, 101 bp, rice(Oryza sativa)
  misc_feature (71): n=a or g
aactggctaacccgcaaacccgcttacaggtcaataaatgggtttacggtttattttaatctataagtggnatcgtaggttaaccatttacaccttttatc

SEQ ID NO: 48810 - DNA, 101 bp, rice(Oryza sativa)
  misc_feature (71): n=t or g
cagaagtgagaactgatgaaaagtccagcgtggacggtgtcgacgagccgaaagtggagtataatccaggnctagtttagattgtagccaaaataaagctt

SEQ ID NO: 48811 - DNA, 101 bp, rice(Oryza sativa)
  misc_feature (71): n=a or c
aattccctgtgttggacagatatgccttccttttccttgtttatgtcattaattatataataatgtcctgntgtgtgtttgcatttaaccatttaacatga

SEQ ID NO: 48812 - DNA, 101 bp, rice(Oryza sativa)
  misc_feature (71): n=a or g
gtgtagcactcgatgcatatgcatgcctgtatgttagccctacatttgcaatactaatatgttattttagnattaataatggcatttagttcataccatac

SEQ ID NO: 48813 - DNA, 101 bp, rice(Oryza sativa)
  misc_feature (71): n=a or g
ccacagattgggaatctaaataccccctggtttcggtccatgcactagatagaggggtgtcagattacacncctctattgcttgacacaggggaagcggcc

SEQ ID NO: 48814 - DNA, 101 bp, rice(Oryza sativa)
  misc_feature (71): n=t or c
aatgctctacctacgacgacgtactagctgcacgcctgcacactgagcccaccggtgcagcagcattaagnagtaatatcaatccgtgcatgcatcaatca

SEQ ID NO: 48815 - DNA, 101 bp, rice(Oryza sativa)
  misc_feature (71): n=a or g
cgcgccgaagcacaccgctggccgtgcccgagctcaccgctcatgcctgtggatggagggagagatagttngagggagagagggagtggaaggaggagata

SEQ ID NO: 48816 - DNA, 101 bp, rice(Oryza sativa)
  misc_feature (71): n=t or c
aaggagaggtggggagaaaaagaatatgtgaaggagagtgaatatttttgcgtgcgggccacttaataggnctgcttgtgaaaatatgctcatttttgtgt

SEQ ID NO: 48817 - DNA, 101 bp, rice(Oryza sativa)
  misc_feature (71): n=a or g
tgatattttgtcattggcttttgcagttcacccctgcaattgatatttggagcataggatgtatatttgcngagctgcttacaggaaagccactctttcca

SEQ ID NO: 48818 - DNA, 101 bp, rice(Oryza sativa)
  misc_feature (71): n=t or c
caaaggccggcggtggcggatcgacggcaattagggttggtcaggcagtgcgctcctgaggggggcacaanacgtcaattgcgtgtgcagggcaaggagat

SEQ ID NO: 48819 - DNA, 101 bp, rice(Oryza sativa)
  misc_feature (71): n=a or g
tactttttttaaaataataataataataatgattatctactcattattctttcgtttgttatccgactctntctatatgggttcgcaatgcacacgtggta

SEQ ID NO: 48820 - DNA, 101 bp, rice(Oryza sativa)
  misc_feature (71): n=a or g
tagctccaaacaaaatcgtttttttttttgtctaggcactccccttaactggtcaccaaaaatatcttttncattgtggggagggggatgttgaaggcaaa

SEQ ID NO: 48821 - DNA, 101 bp, rice(Oryza sativa)
  misc_feature (71): n=a or g
cgctccgagccctccacctcgtctcctgccaatgccgtaactccaaggtcgtgatcgacgcaccattgccngacctccgggagcttgtcgtcgtcgacggc

SEQ ID NO: 48822 - DNA, 101 bp, rice(Oryza sativa)
  misc_feature (71): n=a or g
catgttattgtactcgagtcctttttttttctttatcctgtaaaatgggatattagttcaaaacattacantaatcaataaaatgcacacgaaaatgatca

SEQ ID NO: 48823 - DNA, 101 bp, rice(Oryza sativa)
  misc_feature (71): n=a or c
agtgtatactcatctaactgtggatttgtgattcagaatttcatatataaactaaaaacagtacacaccancaaaaattagaaagaacccctccattaaaa

SEQ ID NO: 48824 - DNA, 101 bp, rice(Oryza sativa)
  misc_feature (71): n=a or g
tatatgtgtggaaaaatctaattgttgtgttttggtgttttcttatgtcttacatcgaccctctcatgggntatatataggagtacataggggatagagac

SEQ ID NO: 48825 - DNA, 101 bp, rice(Oryza sativa)
  misc_feature (71): n=a or t
tcgtgacaccaatgttcttcagtattctgaaagcattttcctccatcatgaccagcctcttctggttcaanttcggggcatcatccaattggtccctgagg

SEQ ID NO: 48826 - DNA, 101 bp, rice(Oryza sativa)
  misc_feature (71): n=t or c
gatccaaaagttgaatccaaacttatgtttaaattcaaaagttaaatctaaacttagtacttttctatcgnatcaatctgtcatacacaaataatttttca

SEQ ID NO: 48827 - DNA, 101 bp, rice(Oryza sativa)
  misc_feature (71): n=t or c
atcgtcatataacttttttgaaattattttcaaatgatcatcatataagtatatgtttcctcagtctatcngttatttgtgcataggtgtaaatggatatt

SEQ ID NO: 48828 - DNA, 101 bp, rice(Oryza sativa)
  misc_feature (71): n=c or g
aaacaatccgtttcgagcacaaacggcaggagggtccattgtaacgcaaggacaactccttctttgcaagnaaggagttccgcctcaagtgcattccggca

SEQ ID NO: 48829 - DNA, 101 bp, rice(Oryza sativa)
  misc_feature (71): n=a or g
ctgctagacaagtgtcaatcgtgcctggccccctggcaagggaaaatgatgtcagcggccgcaaggatctntttaaccaaaacagttctcacagcgcagcc

SEQ ID NO: 48830 - DNA, 101 bp, rice(Oryza sativa)
  misc_feature (71): n=a or t
cccattaattggattaatctctagccacacgtagtacaggggcggtaggcagcgcaatactatacgagagntcgatcgatcgatcccaacaacacccacat

SEQ ID NO: 48831 - DNA, 101 bp, rice(Oryza sativa)
  misc_feature (71): n=c or g
ctactttcgttgtcctggaatggcagttgaacaaaataggcaatggcaattacacctggtaagttagaaanagtctataaacagtgttaagaaatataggc

SEQ ID NO: 48832 - DNA, 101 bp, rice(Oryza sativa)
  misc_feature (71): n=a or g
tatattatagaagttaagcaaaatgcggtgccatattagaacttgacaacccaatgacatattgtagaccngggacaaaatcagtgacacacaatggattg

SEQ ID NO: 48833 - DNA, 101 bp, rice(Oryza sativa)
  misc_feature (71): n=a or t
tgttgggtgaaatgcgcagagacagtttttggtcgatatgcggtcgctttcctgtaggaattttcggtccnaccgcaacccgccaccgaaacgatcatatg

SEQ ID NO: 48834 - DNA, 101 bp, rice(Oryza sativa)
  misc_feature (71): n=a or t
ccccaacatctgctgcctcctgtctctttgcgaggacgtcctttactaatacttacatattactttttttnaaaaaaatgaaaaataaatcaggaacatac

SEQ ID NO: 48835 - DNA, 101 bp, rice(Oryza sativa)
  misc_feature (71): n=c or g
cggacattagatcagaagttagaagagcttatttgttgaagggacctacccaacctaaaattacatttccncgtaaataatatgggtctgataggagatat

SEQ ID NO: 48836 - DNA, 101 bp, rice(Oryza sativa)
  misc_feature (71): n=a or t
ctcttctattatgggacagaaggagtatcttcttgtttttcatgtcatttcaaccatcattgttttttttnaaaaaaatgatatgataaatcagtatgaaa

SEQ ID NO: 48837 - DNA, 101 bp, rice(Oryza sativa)
  misc_feature (71): n=c or g
gtgcaggtacggtatcagcaaccatgccatggagcaaatacttcacttattctgtcttttgctccctaagngacattgtgtcccaaatactttagataaag

SEQ ID NO: 48838 - DNA, 101 bp, rice(Oryza sativa)
  misc_feature (71): n=a or t
gggggagtacggcctgtctcacggttggattagacgtatttggttctggtgtagttcgcgaaaagaaagtntttggtattagattggatgtcggaagggat

SEQ ID NO: 48839 - DNA, 101 bp, rice(Oryza sativa)
  misc_feature (71): n=a or t
ggtcagtataaagaatatgaccgatatgaagcggtaattaataaatatatagagttattatatttttcccnttttaataaaacaatgcataaacttaatca

SEQ ID NO: 48840 - DNA, 101 bp, rice(Oryza sativa)
  misc_feature (71): n=a or t
aaagctggaaattttattaggagggacatgtgcgtgaagggtaattaaggtagttccctcgtatttttttnaaaaaataaatctaagggtaattaaggtag

SEQ ID NO: 48841 - DNA, 101 bp, rice(Oryza sativa)
  misc_feature (71): n=c or g
cttgccccaatgacggatgccgagccaaagtttcagttcgctgcatgacagaccatgattctgcttgcctnttcaagatccttacatgtgagcagagctgc

SEQ ID NO: 48842 - DNA, 101 bp, rice(Oryza sativa)
  misc_feature (71): n=c or g
cctagggttcgctcttgatagccaccttgttgagatgtgatggttagaacgggattgctgcgacattgttnttctttttttttttgtgtgtgtgtgtgtgg

SEQ ID NO: 48843 - DNA, 101 bp, rice(Oryza sativa)
  misc_feature (71): n=a or t
aaaaaacacgcgtcatatatcctcatatgtaggtaggcatcggagatccaggcagcttcagtttttttttnaaaaaaaaatggtgcaacttgacaaaaaga

SEQ ID NO: 48844 - DNA, 101 bp, rice(Oryza sativa)
  misc_feature (71): n=c or g
ccaaaccctccttgcccgagcttgttctcatctgcgaaattgcccgttgcggctaccagatcttgtagttngaatcgactaggccccattattcccaaaag

SEQ ID NO: 48845 - DNA, 101 bp, rice(Oryza sativa)
  misc_feature (71): n=c or g
tagaactagcagagtcttttgttacaagctacttgacacaaattcacagaatcacagtgatatttacatgntactattatgaaagataattaagaaacgac

SEQ ID NO: 48846 - DNA, 101 bp, rice(Oryza sativa)
  misc_feature (71): n=c or g
cgcctcaccttggcgtagtccatcccgtctcccacaaccacgctttggaggttctgcacagcaacagcaancacatgatcccgattggggatcgcctcgtg

SEQ ID NO: 48847 - DNA, 101 bp, rice(Oryza sativa)
  misc_feature (71): n=c or g
acacaattaattatgtatacattgcacgagtaacttttcatctatgttatacacatagttattttcagcanaataaagaaattaatatttaaagactccat

SEQ ID NO: 48848 - DNA, 101 bp, rice(Oryza sativa)
  misc_feature (71): n=a or t
tgctgctgtggcattgatgcaagagagtgttctacttgaattgagtactaagcaatctaagcgattgatgnataaaccattgcctaccaaaggggagttgc

SEQ ID NO: 48849 - DNA, 101 bp, rice(Oryza sativa)
  misc_feature (71): n=a or t
ggagctattgatgagtaattgatattgatgccatcgtcaatgacttcgcatcggtaaatgttagaagaaanttttaaggtaagatatataacttgttttat

SEQ ID NO: 48850 - DNA, 101 bp, rice(Oryza sativa)
  misc_feature (71): n=a or t
catactctagcgggtgtttgatacgtttgacggtattcatgtatgcgaacgacacacatacttaaaaaaanttccctcttagaaaaagaaaagaattgtct

SEQ ID NO: 48851 - DNA, 101 bp, rice(Oryza sativa)
  misc_feature (71): n=a or t
attgggtattcgagtagaatggtaatgcaagagagggggtgagctgctatgctagctacgaccgaattganttgggtgccggccgtgcatccatgatgaag

SEQ ID NO: 48852 - DNA, 101 bp, rice(Oryza sativa)
  misc_feature (71): n=c or g
ttggtatcttgatgcgaaatgctttcagctacgtacattaattccataaaacttatccacgactatactantgtctcatttatattcatttctttgtttgc

SEQ ID NO: 48853 - DNA, 101 bp, rice(Oryza sativa)
  misc_feature (71): n=c or g
ggcgcagggcgcgaggagcggagacgagacggccaaaacgcaagaggggacggcggaggggcttgagagangagaaaattgatattgtgccatcctcaaaa

SEQ ID NO: 48854 - DNA, 101 bp, rice(Oryza sativa)
  misc_feature (71): n=a or t
tgatcttctaataacgtgcatggtatctcacgtacagtgtactaataccgtatacatcatacgtttcacantgtaagactttatagcattgttcatattca

SEQ ID NO: 48855 - DNA, 101 bp, rice(Oryza sativa)
  misc_feature (71): n=c or g
ttggagggccattgacctagatgtggatcaagcaaaaaggtgttatgtggtaaaatagctctagctgtgcnttgctagaatgaaatttactgttttttctt

SEQ ID NO: 48856 - DNA, 101 bp, rice(Oryza sativa)
  misc_feature (71): n=a or t
agttgtctgctgattttcttttacaccaatgcagatatgttaattggaaagggaggaacaagccaagtttncaaggcacaactatttgatggcacattatc

SEQ ID NO: 48857 - DNA, 101 bp, rice(Oryza sativa)
  misc_feature (71): n=c or g
gtgatgtcgtgatttcgcgtatgatctctcttcagatgcagactcagagctgcctgcagctggcggatgangcggagaaggagcacaggaagatggccgac

SEQ ID NO: 48858 - DNA, 101 bp, rice(Oryza sativa)
  misc_feature (71): n=a or t
attccgcgaaatgtgctaagtggatcactgcctataaggctataaagctttgttttctttttatttttttnaaaaaacttttattgtaatgctaatggtta

SEQ ID NO: 48859 - DNA, 101 bp, rice(Oryza sativa)
  misc_feature (71): n=c or g
tgtacatgtagcttgagtccattttatgcttatagttcataaagtacgaaaaagttttcttttaacgactngcattagtgtttaggatagaaaaatacgaa

SEQ ID NO: 48860 - DNA, 101 bp, rice(Oryza sativa)
  misc_feature (71): n=a or t
ttcattcatattatctgaatacggactttatttcatacttacgccaatataattgtgtagctagcttaccngatgaggacatcaacaccatcgatacatcc

SEQ ID NO: 48861 - DNA, 101 bp, rice(Oryza sativa)
  misc_feature (71): n=c or g
gtagaagtcatgcttgcatcaacttgggcttacaactagcaataacatcttgaccttgtacatgttggcanattgcgttctgatcgtattatataattgct

SEQ ID NO: 48862 - DNA, 101 bp, rice(Oryza sativa)
  misc_feature (71): n=c or g
ctcctccattgcctgcatataaataacacaaaagcagaccggtcttggcaaaggacactcactttgctttntcatactcgttggctcgttgctcctttgca

SEQ ID NO: 48863 - DNA, 101 bp, rice(Oryza sativa)
  misc_feature (71): n=a or t
aaagaagccgacgatgctgctgttgttcttgatgggaacgctgaagcgatcccagccggatgtgtccactnttccaaagggtccatggcgtccgcggttgg

SEQ ID NO: 48864 - DNA, 101 bp, rice(Oryza sativa)
  misc_feature (71): n=a or t
atacccatcacatctaatcatcatttgtcaaatagcataagcagcaaggtaatttcaatgagttttttttnaaaaaaattgacatatatataaactcacaa

SEQ ID NO: 48865 - DNA, 101 bp, rice(Oryza sativa)
  misc_feature (71): n=c or g
ttaataattcaaaatcaattatcagaattaaattaattgttaatatctttttccgctcccttgggctgtcnacatcctccccgagcgcgtccttctccttc

SEQ ID NO: 48866 - DNA, 101 bp, rice(Oryza sativa)
  misc_feature (71): n=a or t
atttgtggtgaccccatcaatcttaagaatatgttaaatttttcaaatttgctcataggagtaggttgtcnatgttatttttatcaatctcaagatgtgcc

SEQ ID NO: 48867 - DNA, 101 bp, rice(Oryza sativa)
  misc_feature (71): n=a or t
caggcgataggatactggcggttctctcccccgcctgtgaaaagtgtttttggccgcctgtaaaaactatntttttagtagtgaaaacaatctaaattata

SEQ ID NO: 48868 - DNA, 101 bp, rice(Oryza sativa)
  misc_feature (71): n=c or g
gtgcccaatactgctcctacaaagacactgccacattccttctccttcctcctgcatactgtctctctctntctctctatctgatcagctgttccgcttcc

SEQ ID NO: 48869 - DNA, 101 bp, rice(Oryza sativa)
  misc_feature (71): n=a or t
aatagtaccgtagtagctatagtagctaattaaccgtctagcaagttaatagataacgacgattgcaaaantttgaccttgaagataaaaaaagagctttt

SEQ ID NO: 48870 - DNA, 101 bp, rice(Oryza sativa)
  misc_feature (71): n=c or g
acgggattgcaagaacatgcccatccagcttttaagattaaagatcccagtcaaattggtcttacaagttngttttacaagttcgttttgcttctaggtca

SEQ ID NO: 48871 - DNA, 101 bp, rice(Oryza sativa)
  misc_feature (71): n=a or t
caaaatttttcagccgtttgtcacatagagtccctttttttaagtgtccagagcaattgttcatttttttnaaaaaaatatagggataaatccacattgca

SEQ ID NO: 48872 - DNA, 101 bp, rice(Oryza sativa)
  misc_feature (71): n=c or g
tgactctgaagctcggagcggcgcttgcgatcagtgaacaggtttgacacctaagatggacaagggatagnaaccaaggcatgctcaaatccaaattaaac

SEQ ID NO: 48873 - DNA, 101 bp, rice(Oryza sativa)
  misc_feature (71): n=c or g
aggaaagctcccaacgaaggccgtacagatgggcccagaacaacccaggatgcaaattccttcggaaaaantacaccgaaagtccctcaacttgtcatcgg

SEQ ID NO: 48874 - DNA, 101 bp, rice(Oryza sativa)
  misc_feature (71): n=a or t
ccaattcatgtgaattcatatttctgaaatctcactgaaaagcactctcttcagcaaaaacattttttttnaaaaaaaagtctgcttcatcagtttttggt

SEQ ID NO: 48875 - DNA, 101 bp, rice(Oryza sativa)
  misc_feature (71): n=a or t
tattatgataaggagagtatattggtcatatatagccagtactttaatcagctaactataatttttttttnaaaaaaatgctactacaagctaattaaact

SEQ ID NO: 48876 - DNA, 101 bp, rice(Oryza sativa)
  misc_feature (71): n=c or g
cgatgatgcttggtccattgcagaagagctcctgaatttagaagatgaggagaagatgtggagggtgattnaaggagtgtgggtagagatgctctgcttct

SEQ ID NO: 48877 - DNA, 101 bp, rice(Oryza sativa)
  misc_feature (71): n=c or g
acacatatattttttcttccgacgaacggaacataggctttattgtttttttgggaatcatcgtactgtanttatgattttttgttttgccgacggtacgt

SEQ ID NO: 48878 - DNA, 101 bp, rice(Oryza sativa)
  misc_feature (71): n=a or t
cggaggtagtagtaatgatctgactgtaggggacaactcctctctcttgccctttttctcctagagtttgngatcgattgaaccactatcttgagttcttg

SEQ ID NO: 48879 - DNA, 101 bp, rice(Oryza sativa)
  misc_feature (71): n=a or t
ggaaataaaaaaggttatagttggagacttgtgagagttgtacgacttgtactgatggttacgcgacaatntgtgcatggatagtttgtgtgcttgtaccg

SEQ ID NO: 48880 - DNA, 101 bp, rice(Oryza sativa)
  misc_feature (71): n=a or t
gtccaaattgtcaaccgctcgtccgttggagggattaacctcaatagtagagctgtagaggactggttatnagccattcacatgcggaaatgctcttcggc

SEQ ID NO: 48881 - DNA, 101 bp, rice(Oryza sativa)
  misc_feature (71): n=c or g
tttgaaaatatgagcatgagctttcatcatgtgtttcaaggggacaagaatgggttaatttgatcagtacnactgcaactttacagatttagaaaaatatc

SEQ ID NO: 48882 - DNA, 101 bp, rice(Oryza sativa)
  misc_feature (71): n=a or t
tgattgattggattgtagaaaaacatagaaatcagatgggataaatatactcgaagacaattttccaaaanttagtacaagacatccaaaaatgtgtaatt

SEQ ID NO: 48883 - DNA, 101 bp, rice(Oryza sativa)
  misc_feature (71): n=a or t
caggaagtcctcggctgtctttgggtgccggcaatctacaacaaaatcaatgagcaaatgcaaaaaaaaanaaaataaaaaaatactgttgcaaattaaga

SEQ ID NO: 48884 - DNA, 101 bp, rice(Oryza sativa)
  misc_feature (71): n=a or t
accacttttggttaccttataaagatgtaatcttttatctgaacaggaataatttgacaaaactacctccnaaagtaagtctaaaacgattaagtaatcct

SEQ ID NO: 48885 - DNA, 101 bp, rice(Oryza sativa)
  misc_feature (71): n=a or t
ttccatcttccttgtaaaaagatagtggtttagtgctccactggttgctgccagttagggatttttttttnaaaaaaaacattcttttgctgcgaaaattg

SEQ ID NO: 48886 - DNA, 101 bp, rice(Oryza sativa)
  misc_feature (71): n=a or t
ctaacgcgaatacctagctagcgtgtggaaggtatcattctatccgtggatgtagttttttttttttatgntgagttaaaatagttgtttagagtagagta

SEQ ID NO: 48887 - DNA, 101 bp, rice(Oryza sativa)
  misc_feature (71): n=a or t
gtcgccatgcacgaccacgtttccatgcagagcaaccgctttagccgatagcaatcatttcccattccgtntctctccaccgagccttgagtggttcatcc

SEQ ID NO: 48888 - DNA, 101 bp, rice(Oryza sativa)
  misc_feature (71): n=c or g
cgtgtgcatggccatgcactgtccctagtgcatgcatgccttggctgcaccaccgatccatgtatgtgatnatgacacacatgcatgctgcacgtctttgt

SEQ ID NO: 48889 - DNA, 101 bp, rice(Oryza sativa)
  misc_feature (71): n=a or t
tgtggaaatgcctctgtgggagtagcacgcagtacttacgcacgcacgcacatgtgtgcccattttgctcnatgcatatccttatgcctgcatgttgtgag

SEQ ID NO: 48890 - DNA, 101 bp, rice(Oryza sativa)
  misc_feature (71): n=c or g
gtgcagacatcgccgatgcgtacataccacactgtgatgacatcgtgggtcgtagggtcgtagctagcggncgtgtgcaccgggagtccgggaccgcgttc

SEQ ID NO: 48891 - DNA, 101 bp, rice(Oryza sativa)
  misc_feature (71): n=a or t
atcggaggggagagtgatctctattggtagtttagtgtggacccacttttattttctagaatcagattttnaagatatttatgaatctattcatatctcaa

SEQ ID NO: 48892 - DNA, 101 bp, rice(Oryza sativa)
  misc_feature (71): n=a or t
agggccggaagaatgggtccaagctgatgtggatgcggttttgaaaagtccatggtttgttgtcgaacatntcatttgttcagttcccacttgtgggaaaa

SEQ ID NO: 48893 - DNA, 101 bp, rice(Oryza sativa)
  misc_feature (71): n=c or g
tattgtttatgcccttatacacactgttgatgcccgaactgagcagggatcgtccttctgcctagcactcnctccatctcataaatctcataatataacaa

SEQ ID NO: 48894 - DNA, 101 bp, rice(Oryza sativa)
  misc_feature (71): n=a or t
agggatcatatcaaataaacagtactgcaaattaaggaggcaacatgaaattaagatggaatttttttttnaaaaaaaagagagatgaagaacacagagat

SEQ ID NO: 48895 - DNA, 101 bp, rice(Oryza sativa)
  misc_feature (71): n=a or g
ggaggaaggaaatctgtggtggattcggatcgagctcttcgttttcttgctctttgtataaattgcgatcnggggcggcggaaacaagggttcttctctgt

SEQ ID NO: 48896 - DNA, 101 bp, rice(Oryza sativa)
  misc_feature (71): n=a or c
gaaaaaaagcagaggaagaaaagattagtgcagtggcaaagccgcgttcagatctcaagagtctgggatgnagaatttgcagagaggaaggtgcaagggca

SEQ ID NO: 48897 - DNA, 101 bp, rice(Oryza sativa)
  misc_feature (71): n=t or c
agtgattttggtttatttgaagaatttatagtcactccccacctgtatgtacccttggtacggagcgttangcagccactggtgagcacatccgccgcagc

SEQ ID NO: 48898 - DNA, 101 bp, rice(Oryza sativa)
  misc_feature (71): n=t or c
caatatcacatatcaaggtcgttcaagtatccatgaattcaacaaggattacttgagctatttcaagctgngagatcagctgaaagaatttgggctcaagg

SEQ ID NO: 48899 - DNA, 101 bp, rice(Oryza sativa)
  misc_feature (71): n=a or g
taattgctcactttctccctaactaacagtgtggttgctcttgccaacatcatgtggcccagtcttcaacnaaaagattgtgtgctctgaaatatctccta

SEQ ID NO: 48900 - DNA, 101 bp, rice(Oryza sativa)
  misc_feature (71): n=a or g
ttctagtcggatccaagttgttagttttgggacccgacacccctttctctcttctcccgtaggcggcgtcngcttgctcggcggcggagggagtcggcgag

SEQ ID NO: 48901 - DNA, 101 bp, rice(Oryza sativa)
  misc_feature (71): n=a or g
tcaaattaggaaaagtagcacctaattcgcggatggttgattaggcttcgatccgtgagccaacgaggcanagcgcaaaaaaaccaggaatcgaacgcggg

SEQ ID NO: 48902 - DNA, 101 bp, rice(Oryza sativa)
  misc_feature (71): n=a or c
gcaacaaaattaatggagcatccaactaagttgatttcgcctaaactaaagctgcatctactattactagntgctaattaacaacgcactaactataataa

SEQ ID NO: 48903 - DNA, 101 bp, rice(Oryza sativa)
  misc_feature (71): n=a or g
tttttctttaccctttctataatgagaagcagttccagcgccttcgctaacgatgatcccgaaaaagaagnaatggccaatagatataccttcagctatgt

SEQ ID NO: 48904 - DNA, 101 bp, rice(Oryza sativa)
  misc_feature (71): n=t or c
cgggggtgccgggtgtgcctctgagacgagtgcctcgaacatgtccgtatcctcaacctccggctctctcnactagtcttgcatcggctcagggatctcaa

SEQ ID NO: 48905 - DNA, 101 bp, rice(Oryza sativa)
  misc_feature (71): n=t or c
tgcactattagtccttcaaatgtaaaatagaagaaagctctgttgtttatcaaagatatgctctgctgttnatcttttttatgctttgtaatctaatctat

SEQ ID NO: 48906 - DNA, 101 bp, rice(Oryza sativa)
  misc_feature (71): n=a or c
ttggccaacgctcaaatgttctatcgttagcttctttactgaagtttgctccgcacattgaacacctttgnatttcggtaatattagattcacaccttcaa

SEQ ID NO: 48907 - DNA, 101 bp, rice(Oryza sativa)
  misc_feature (71): n=a or c
agtgctacgaccagctcgggctcgttcgtatggtgcaatggcattgttactagcagcttcccctcgttttnctcacgcacatttttcaaatgactaaaaga

SEQ ID NO: 48908 - DNA, 101 bp, rice(Oryza sativa)
  misc_feature (71): n=a or g
tgcagcacgacataccaacagttctactatgcagcgggtttgcaacacgatgtggctgttatttatggccntgtctcaactcaaatcattcggttctctaa

SEQ ID NO: 48909 - DNA, 101 bp, rice(Oryza sativa)
  misc_feature (71): n=t or c
gcactcccgaagttattcaagatcgaaatcaggctgtccacatcttgtcgtgatggtttgatgaagattgncgtgtcatcagcatatagggagcatctgaa

SEQ ID NO: 48910 - DNA, 101 bp, rice(Oryza sativa)
  misc_feature (71): n=a or c
accggtggggagagtgaagagggagaggcgacatcaaggaagaagatggcaaccctccctccgccacgctngctctccaatcccccttctcagtcgagccc

SEQ ID NO: 48911 - DNA, 101 bp, rice(Oryza sativa)
  misc_feature (71): n=a or g
actggggagcaccacgtgttcccggacatggcgattccatttttggtactgttggaagaagaggatgtgtngtttctaccgatgactgacgaagacgccca

SEQ ID NO: 48912 - DNA, 101 bp, rice(Oryza sativa)
  misc_feature (71): n=a or g
gtaggacttttttgtgctaatcgattgcagatagctgtgtgattgacatcccttcattggcgaaagaactnagggtcgaactctccagcttcaagtcgtcg

SEQ ID NO: 48913 - DNA, 101 bp, rice(Oryza sativa)
  misc_feature (71): n=t or g
agaaatacctcgggaaaagtctactttacctccctcttgctcgggcagcccaataaagaagtttatgactnccccctccccttctcccaccttaacacccc

SEQ ID NO: 48914 - DNA, 101 bp, rice(Oryza sativa)
  misc_feature (71): n=t or c
accaatccgatgccaagaagtggatctagatgtcgttttgcgcagtttttctgggtcaagaaccagcttcncactgacttatctaggacttccactcacgc

SEQ ID NO: 48915 - DNA, 101 bp, rice(Oryza sativa)
  misc_feature (71): n=t or c
ccagaaagatctcctacatttcgatcaataacttggttcaattcaaggtcgacacaaagctcagctttcangcctctctcgtctttctggtcaagtacttg

SEQ ID NO: 48916 - DNA, 101 bp, rice(Oryza sativa)
  misc_feature (71): n=t or c
tcagaccttaattctgcagcctagccgtagaccaaactcgcccgcgttcacgccgtcagcggacgcagaanagatcggggcactgccaagtggtgaggcct

SEQ ID NO: 48917 - DNA, 101 bp, rice(Oryza sativa)
  misc_feature (71): n=a or g
gtggcacttcgacagggtgctagagttggagagccaaaaaaggcagttggagaaccaaaactggcagttgnagcaacaaaactctagactgtccagtgaga

SEQ ID NO: 48918 - DNA, 101 bp, rice(Oryza sativa)
  misc_feature (71): n=a or g
gccaccctggcatcctccttagcgacggggtggggatatacttcgacgaggacaccgacaaggagacactngccttccgcgtccgtacctgactcctctgg

SEQ ID NO: 48919 - DNA, 101 bp, rice(Oryza sativa)
  misc_feature (71): n=a or g
gtccctagtcattctatcacatagttgaagcctttcctgactgaccaaactagctctcttagctctttctnatactcctctttgaataatcctcattaatt

SEQ ID NO: 48920 - DNA, 101 bp, rice(Oryza sativa)
  misc_feature (71): n=t or c
aaaattcatgatcttatgcatgatcttgcagttcatataagcggtgatgagtgtttagctttggaaaatcnggctaaaattaagaaaatacccaaaaatgt

SEQ ID NO: 48921 - DNA, 101 bp, rice(Oryza sativa)
  misc_feature (71): n=a or g
atacaatttagttataatttataaatttaaaatgactagttcttgggcatcggccggagtcgcactcgcgncggcggcgggctcacttgacgcggcggcag

SEQ ID NO: 48922 - DNA, 101 bp, rice(Oryza sativa)
  misc_feature (71): n=a or g
ccttcctggcgccaacgaccttgtcagcctcagcaccatccttgatgaataggaaggtcggcattgcctcnacattgtacttttcagcaacttcctgttgg

SEQ ID NO: 48923 - DNA, 101 bp, rice(Oryza sativa)
  misc_feature (71): n=a or g
cacgaacagcaagatgatccgcttgtttgctccatgcccaaaattcattccactcttggctgttttcatcntctcatgctctctgccattagcaatcagcg

SEQ ID NO: 48924 - DNA, 101 bp, rice(Oryza sativa)
  misc_feature (71): n=t or c
atcttggtggatccatcttcacactcggttatggtatcccctgtagtgttgtcactgctagcagggtactntacgacatttatggatttcacagctccaaa

SEQ ID NO: 48925 - DNA, 101 bp, rice(Oryza sativa)
  misc_feature (71): n=a or g
gccattttctccttagtgtacgtggatactataacgggtatgagcttgcgggcttcacaggtttttggctnctcctttgatgtatctggctgtggaggtgg

SEQ ID NO: 48926 - DNA, 101 bp, rice(Oryza sativa)
  misc_feature (71): n=a or g
ctcaccgcgttgcctctctcctcgttgacttcaccaattctgacaaccccaatgagctcgccaacctccanatctggtgtaggaagggagaaagtgggtgg

SEQ ID NO: 48927 - DNA, 101 bp, rice(Oryza sativa)
  misc_feature (71): n=t or c
ggctgagagcaatgcagcaggagaacaacactgtatcaccatcagtgtaaagtctgaagaaaatacctggntgcgaacagtcataacgaggcttttccgta

SEQ ID NO: 48928 - DNA, 101 bp, rice(Oryza sativa)
  misc_feature (71): n=t or c
gttcattttatgttctaatctgttttttttggcatatcagctgcggtgggagtctcgtacatgcaatttgnaaacaaaaattcgatgaggaacatatacat

SEQ ID NO: 48929 - DNA, 101 bp, rice(Oryza sativa)
  misc_feature (71): n=a or g
ttccattgtagaagctttgcgcaacaataccatctggacattgtggccgctacatatttcaactgccaaanggaagccggctctggtggaagaaggttcag

SEQ ID NO: 48930 - DNA, 101 bp, rice(Oryza sativa)
  misc_feature (71): n=a or g
gtgaaatcgagaaggtaaacagcgaatgctagcgctagttaatttcataacctttgtaatgaacttggacntcctccccagcttcctctcagtctctttca

SEQ ID NO: 48931 - DNA, 101 bp, rice(Oryza sativa)
  misc_feature (71): n=a or c
tgatcggcgacttcagaccaatcctgttggttctgatcgggcagagcagctccagcatcagcgatcaggtngggaagatcacggaacaccatgtcggtcac

SEQ ID NO: 48932 - DNA, 101 bp, rice(Oryza sativa)
  misc_feature (71): n=a or g
cataggaaaggactaacctgcaccgcccaatccaggttttggctgaataataccctgtccatataaggatnatgggtccatgggcaaagatctttgggcaa

SEQ ID NO: 48933 - DNA, 101 bp, rice(Oryza sativa)
  misc_feature (71): n=a or g
ctgggctgcacgtgacggagaggcaccaggagatgtagccgcctagattgccacctggtagggaataagcngctgctcgacctcatccgagggagcggcca

SEQ ID NO: 48934 - DNA, 101 bp, rice(Oryza sativa)
  misc_feature (71): n=a or g
gcagcagcattgggtaacctcttgatcctaaggtactcttctcccctcagcagcaggacaagctcggggtntgccctgtaaatgtcgtgggagggcgcggt

SEQ ID NO: 48935 - DNA, 101 bp, rice(Oryza sativa)
  misc_feature (71): n=t or c
acagaaggatcttgcacagagtcacagaaaaaccagcatcaagattttgtaaccacttcaggtgatattgntggtagtacaaataatatgtgccaacttcc

SEQ ID NO: 48936 - DNA, 101 bp, rice(Oryza sativa)
  misc_feature (71): n=a or g
gaaacaaactcgacgtcgcttacgcatcctccagactgatctttggatgaaccaggtggagtcgattgagnccccgttgctgacactcgccctcgtttcat

SEQ ID NO: 48937 - DNA, 101 bp, rice(Oryza sativa)
  misc_feature (71): n=t or g
gatagagagtctcgagaagttcatgcggcgggaagcccaagagcgctccctagagagtgaccaatacgacngtacagactcagaagaggaggttgcatcag

SEQ ID NO: 48938 - DNA, 101 bp, rice(Oryza sativa)
  misc_feature (71): n=a or g
gcggttggcttcgaggaataggcggttgagacactcctcgacatggcaaagcttttgacacaagtggcatngggcggcggtgagcattggacagaggatgg

SEQ ID NO: 48939 - DNA, 101 bp, rice(Oryza sativa)
  misc_feature (71): n=a or c
gagttgacttccagggagacagaggaaagcaaggaggagttgacttccaggaagacagatgcaaatgatgnggagagtgcttcaagtgtggcagaggcaat

SEQ ID NO: 48940 - DNA, 101 bp, rice(Oryza sativa)
  misc_feature (71): n=a or c
taaatttaaagttcatccatccaatttggatccagagtcaagatggcattcccagtttagtcatgtacacngtagccgtaggatggccaatggacgttcca

SEQ ID NO: 48941 - DNA, 101 bp, rice(Oryza sativa)
  misc_feature (71): n=t or c
agtgattatattgaaaatttgggggagagtgaaggggttttatacccaagggtaaaaaaaaaacatcctcnttgagggtggcaagggggtcgctagcaaaa

SEQ ID NO: 48942 - DNA, 101 bp, rice(Oryza sativa)
  misc_feature (71): n=t or c
agttgcagctgacatgatcctctatagtactagaaaccagcttctttttcactgtacttccatgtaccaanatctcttcggtaccaacttctggtgtactt

SEQ ID NO: 48943 - DNA, 101 bp, rice(Oryza sativa)
  misc_feature (71): n=a or c
gaatccataccgtcggacggacattgtacggcgaaggtaattttccatttaggctctcggtttcactgtantccaaattaaaagaagcacacctactactc

SEQ ID NO: 48944 - DNA, 101 bp, rice(Oryza sativa)
  misc_feature (71): n=a or c
tcttgttttgactcggatgaaatcttagggacactggctgttcttttatcagatatcaacactgtgcctgntggctgttatgctgaagtggtacggagaaa

SEQ ID NO: 48945 - DNA, 101 bp, rice(Oryza sativa)
  misc_feature (71): n=t or c
acctcgaccattgtcgtcccgatctcgccattctcgacggtcattgtcatgatgacttcgacaatcctgtnggtctcggttctcgttagggtggcctcctc

SEQ ID NO: 48946 - DNA, 101 bp, rice(Oryza sativa)
  misc_feature (71): n=a or g
tggtatttgtggttctgttctatatgcagcttggttaaggttaccgtcaggagtgagcatctggtgacagngcaaaagtggaggagccatatctggttggt

SEQ ID NO: 48947 - DNA, 101 bp, rice(Oryza sativa)
  misc_feature (71): n=t or c
gccgtcgactccatcaagagactctatgtttgtattggacaagacaatcttctcgagctcaggagctccancttcaaatttgatgtcagtctgcatgtggt

SEQ ID NO: 48948 - DNA, 101 bp, rice(Oryza sativa)
  misc_feature (71): n=a or g
gtcccttggtggcggtaagaggaaataatatggcaagagaaagaggaatctccacaacggaaagagaaagnaagaaacgctgtttgcgactctgtaaatga

SEQ ID NO: 48949 - DNA, 101 bp, rice(Oryza sativa)
  misc_feature (71): n=a or g
agaaagttaaatgaagtggaaaatgtctcttgtgagcttaagaacaccatactgctgctgaattctgaganagatactactgttcttcagcacaagcaggc

SEQ ID NO: 48950 - DNA, 101 bp, rice(Oryza sativa)
  misc_feature (71): n=t or c
agcacatgcttcaccgccgcttgatgatcctcatgtggttcctccatgaaccgactcaggtagccgacggngtgagcaatgtcggggcgcgtgttcaccag

SEQ ID NO: 48951 - DNA, 101 bp, rice(Oryza sativa)
  misc_feature (71): n=a or g
ctgccattaggtatactactatcctcacttgttctccttcatgccattgccgtgccatccatcgatgagcnagctgcagcgcttattgcctggaagaccac

SEQ ID NO: 48952 - DNA, 101 bp, rice(Oryza sativa)
  misc_feature (71): n=t or c
gctcttagtaccgcttttttcttcgaggctccaataaatgtttcggctgttcaagccgtcatggtactacntctactatgctgatatcgagcctgttcact

SEQ ID NO: 48953 - DNA, 101 bp, rice(Oryza sativa)
  misc_feature (71): n=a or g
acaggatctcttgcttgggaaaagcttccatgttttcagcggccgacaagacgacgggaatgtcatgtcantagctatcgacgtggacgcaaggcagtgtt

SEQ ID NO: 48954 - DNA, 101 bp, rice(Oryza sativa)
  misc_feature (71): n=t or g
actgtccatctctaagcagcaagtgtacagtgttgcatttggtctctgcctctagcttattgctgatagcngttcagttttacaagcaattctgtgcatgg

SEQ ID NO: 48955 - DNA, 101 bp, rice(Oryza sativa)
  misc_feature (71): n=a or c
ctgggcctaactgtaccagaataaaaacggcccatttaactagaagaagcccgtttagatggtgatttccntttttccattttattcttatatttcgaact

SEQ ID NO: 48956 - DNA, 101 bp, rice(Oryza sativa)
  misc_feature (71): n=t or g
cagctcatggacgagatgcggtggtgcaaatggagcaaaagggttcatgaacaagtcagaagaccaagcanagctgcatgcatgtggagtggtgcaagacg

SEQ ID NO: 48957 - DNA, 101 bp, rice(Oryza sativa)
  misc_feature (71): n=t or c
aagatttaaacccaaataaagaagagcacactttgtcagaaatgtaccacaccaatgagtgcatgcatggnttctctctccccctcttcttttttcctctc

SEQ ID NO: 48958 - DNA, 101 bp, rice(Oryza sativa)
  misc_feature (71): n=t or c
aatcacaaaaaatgaaatgtagttcgtttatttggactagagtgggtcaattagtacctatgggttggccngtggccagtcttggccgcattcatgcatca

SEQ ID NO: 48959 - DNA, 101 bp, rice(Oryza sativa)
  misc_feature (71): n=t or c
cgacgacggccaaacaactaccatttggagtcttccctgaggaatacaaagaagcctactccctctgtccnggaaagccagcctttttaagattggttgga

SEQ ID NO: 48960 - DNA, 101 bp, rice(Oryza sativa)
  misc_feature (71): n=t or c
gaagttgagcttgatccaacccttgggtggaggggaccaagtattccgatggattgctgggattcggtgcnggaactcctgtccccagaattgaggttcat

SEQ ID NO: 48961 - DNA, 101 bp, rice(Oryza sativa)
  misc_feature (71): n=t or c
tcacacgattgactgattatttggaagattgttactcatgctctaccagaaccgtgcagcccagtctatcngacaggcaaacacactgactgttgagaata

SEQ ID NO: 48962 - DNA, 101 bp, rice(Oryza sativa)
  misc_feature (71): n=t or c
gcaatgtactgttcctgatgtgcaaatgtggttgcaagaacgagctggactaaatgagttgctccatcagnagcttacacgagcgcaacagcgtatgaaac

SEQ ID NO: 48963 - DNA, 101 bp, rice(Oryza sativa)
  misc_feature (71): n=a or c
ggaaacgtaggttttctgttggtataaagccatccaggaaaatgttgattccttctctaacagaagagggnaaagtaacaacaccatatgctccaggagtc

SEQ ID NO: 48964 - DNA, 101 bp, rice(Oryza sativa)
  misc_feature (71): n=t or g
tctggtgagtgttaagtattgtagtcctcctacaatactcctgtaccgagtactgtcctcagtaccaagangatttcctttgtgtgccatcaacttctctg

SEQ ID NO: 48965 - DNA, 101 bp, rice(Oryza sativa)
  misc_feature (71): n=t or c
cactcattccattccatcatccccttaagatgcaactcatgtaactttggaaatgcaacatgtcttgaacncttcttgttgtccatatttctttgtccttg

SEQ ID NO: 48966 - DNA, 101 bp, rice(Oryza sativa)
  misc_feature (71): n=t or c
aaaatgagaataaagcttcgaaaaggatggtctacaaaagcaagagagtcatactcgaccacaatgaaggnacgcgtgtagtttaaatactgttcatttct

SEQ ID NO: 48967 - DNA, 101 bp, rice(Oryza sativa)
  misc_feature (71): n=a or g
catagtgaaaacgtcaatcatgtcgtttcttttcatttggagctcacaccataagagaagagggagggtgntgcgcctgcagaagatagaagagatgcgca

SEQ ID NO: 48968 - DNA, 101 bp, rice(Oryza sativa)
  misc_feature (71): n=t or c
taccaacattttggcatggtagcaaaccaaacgctctactcatgtcccaaaggccctatatccttttcagntcatttattgaattattgaaacatattatt

SEQ ID NO: 48969 - DNA, 101 bp, rice(Oryza sativa)
  misc_feature (71): n=a or g
tcttctcgacggtcatacgggtgtccatcggctgttacatcgttggaaaatcgtgtcagtttagttaacgngcttgggttactgggattattcgattcctt

SEQ ID NO: 48970 - DNA, 101 bp, rice(Oryza sativa)
  misc_feature (71): n=a or g
catgtgcaagggcatgatccaggtgaaagagaggacataacaacttatgagttgtctggtacttctaacgnccccatcatttcaacataattacaaataaa

SEQ ID NO: 48971 - DNA, 101 bp, rice(Oryza sativa)
  misc_feature (71): n=a or g
ccgaggagaagttccggcagcaggtcgactacttctcgcttgagaggctcttgcctaccgctggatggatngtgaaagcgtactggtgcacggaagaggag

SEQ ID NO: 48972 - DNA, 101 bp, rice(Oryza sativa)
  misc_feature (71): n=a or g
gtgctggggaaatataaaatttcttgccgcgttcagttctgtggcaaaataattggctgataccataccangtgaaattgaatcttcattttttgtgcttt

SEQ ID NO: 48973 - DNA, 101 bp, rice(Oryza sativa)
  misc_feature (71): n=t or c
tagaggccgtcatgtgtgcggaacgcggtcttggtgacgtcggcagcattcatcctgacttggtggtatcnggagcagaggtcgagcttcgtgaagaagcg

SEQ ID NO: 48974 - DNA, 101 bp, rice(Oryza sativa)
  misc_feature (71): n=a or c
gccggcttctgcttcaggctagatggaaaacctgcatcactgcaatactccaagctacccaagataaacanatctgatctacctgatcatgtcacctatgg

SEQ ID NO: 48975 - DNA, 101 bp, rice(Oryza sativa)
  misc_feature (71): n=t or g
gagctagatatactcaagttgtagtagtgcaatgtgatatgatgttaattggtggggtttgcagtgagtgngttgtgttggtggagagggtgatatgtact

SEQ ID NO: 48976 - DNA, 101 bp, rice(Oryza sativa)
  misc_feature (71): n=t or g
taactaagtcagagaagctcaagttcccataaatcttgctccctccaacactactgacatcatgcgatggngcaggattactaacactgactggcacattt

SEQ ID NO: 48977 - DNA, 101 bp, rice(Oryza sativa)
  misc_feature (71): n=a or g
ctttcatgcctccaccgctccacacgcacacgcccacaagaacaagaaattcaaactcaaaaatctttcanagcctcttcttgcttcccctctctctatct

SEQ ID NO: 48978 - DNA, 101 bp, rice(Oryza sativa)
  misc_feature (71): n=t or c
ccagctctgctatccaacactcgagggatgcttaccaaactgcacaccaccaaaggtgcacagaggttcanaattaacaagtgattgatcagtaataatca

SEQ ID NO: 48979 - DNA, 101 bp, rice(Oryza sativa)
  misc_feature (71): n=t or c
agtaagaattgtccttactctatcttctattctgtcatacatgaacctacaacctggttcaggctgtgagngttgaacttgcaaggtacaccttttactag

SEQ ID NO: 48980 - DNA, 101 bp, rice(Oryza sativa)
  misc_feature (71): n=a or g
ggaggtttcaacttattggcttgggaacaacctgaatttaaagcaaaggggattgctaggaccggtggctngcaacaggtcaatacaagttgagttgttgt

SEQ ID NO: 48981 - DNA, 101 bp, rice(Oryza sativa)
  misc_feature (71): n=t or c
tttaggtctcacaacgccatcttgcaagccaaacaactgcctcggcacaaccaagattctatcattgtggntaggtggtgacttcattgttgcttttaggc

SEQ ID NO: 48982 - DNA, 101 bp, rice(Oryza sativa)
  misc_feature (71): n=t or c
caaacgaagagcacatccggcgtttcttttctgatattggtggtgtgacagcaataaggttgctgaggganaagttcaccaaaaaatcaagggtatgtatt

SEQ ID NO: 48983 - DNA, 101 bp, rice(Oryza sativa)
  misc_feature (71): n=a or g
gttggtcactcttctccacaagttgtgtccaactaaatggaagtgggagccagtgccacacgggaaggacncttttgttgttcttttcccttcaaagggcg

SEQ ID NO: 48984 - DNA, 101 bp, rice(Oryza sativa)
  misc_feature (71): n=a or c
ttactttggagaaagctccgaaccgatgcccagaaactttcttattaaagctttgcaacatggtttagagnaagtttaatagtatatagccaactactagc

SEQ ID NO: 48985 - DNA, 101 bp, rice(Oryza sativa)
  misc_feature (71): n=a or g
ggaaaaacttttttggcctacccgttgtatcgcctgtactatgtgtgtacgatttgaggtcgcattcatanccgaaggaaaaggtcctgcgcataacctgt

SEQ ID NO: 48986 - DNA, 101 bp, rice(Oryza sativa)
  misc_feature (71): n=t or g
gcccaatgtgatcttgaggccagtgtcagcgtgatgccgaaggacgccttcgacaagctgaactatacggngttgattccaacaccgatgaggctccaact

SEQ ID NO: 48987 - DNA, 101 bp, rice(Oryza sativa)
  misc_feature (71): n=a or c
taattttccatttcttaattatgatagagtcggaattttctaagtggccacacaaatcctatctacagacntgtttggcacaactccagctctagctccac

SEQ ID NO: 48988 - DNA, 101 bp, rice(Oryza sativa)
  misc_feature (71): n=t or c
caagaactggatcattttgttgaaaactcaaacaacatcgtatgactatacttctcaccaggctgaacgancaccgagggaaaattaggttggttcactgc

SEQ ID NO: 48989 - DNA, 101 bp, rice(Oryza sativa)
  misc_feature (71): n=a or g
aaatcagatgaagagaattctcacttttctaattggcatctccctggacacaattgctctgtagcatcacnttttgatgtgctatctacaatgaacatctc

SEQ ID NO: 48990 - DNA, 101 bp, rice(Oryza sativa)
  misc_feature (71): n=a or g
agagagagaaagagcgctaagaggtggagagaaagagaggagaaaatgaggaaacagtcactaaaactatnggtcccacgtattatttttattattgtagt

SEQ ID NO: 48991 - DNA, 101 bp, rice(Oryza sativa)
  misc_feature (71): n=a or g
catgaagaacttcctagtgaaggaagcgtcaatgagtaggccctgtccaaataagacaccagttaaaactngtgtgcaggtcaagcagcctgtaaagccgg

SEQ ID NO: 48992 - DNA, 101 bp, rice(Oryza sativa)
  misc_feature (71): n=t or c
aaccgccatagggacccacctgtcaaccacatagggaagtttggaggcctgctgcgaaccctggtgacgcnggctctggctggccttacacctggacgctc

SEQ ID NO: 48993 - DNA, 101 bp, rice(Oryza sativa)
  misc_feature (71): n=a or g
atggacctatctttacgtggtaatcacctcagtcctcgaccgaggcctatatgttctagttggatgtctcngtgacctatctagtataatcatggcatgat

SEQ ID NO: 48994 - DNA, 101 bp, rice(Oryza sativa)
  misc_feature (71): n=t or c
gttgctggattccattcataaacatccatgccattgacaattccagtttcaaggggctttgtgcgaaggangccatccaattcaacacctttatctgggcc

SEQ ID NO: 48995 - DNA, 101 bp, rice(Oryza sativa)
  misc_feature (71): n=a or g
aagagagtgaccctgcactagagacagctcagaaatcatcattaggccattttgcataatagaaaaatcanataaattacttctattatgcattactgtag

SEQ ID NO: 48996 - DNA, 101 bp, rice(Oryza sativa)
  misc_feature (71): n=a or g
tgaaaagcaaactttaaggcctcaacatacagcggaaaggaaatgacctcatcctgcatatagtatagagnaaatctgttacaagactgtgtttcatataa

SEQ ID NO: 48997 - DNA, 101 bp, rice(Oryza sativa)
  misc_feature (71): n=a or c
cgattctgaaaatttcagtataatcaagggaagggaagacgaaacagaaggagataaaaaacatatatgcntacgaaatgcattggaaatttgaaaatgat

SEQ ID NO: 48998 - DNA, 101 bp, rice(Oryza sativa)
  misc_feature (71): n=a or g
tgatgcaggtttggcagaatcaagtccaaaaggatctatgggtacatggttagcactatattcttcttccnaaaacaactgtgcattctgaataagatgaa

SEQ ID NO: 48999 - DNA, 101 bp, rice(Oryza sativa)
  misc_feature (71): n=t or c
tggtcgtgcagtcgagcggtcatgacgtcgtggatgtcttcacgttcacggatggacgtgcggtcgatgangggcggcggcggcgtcgctgcggcgcctgc

SEQ ID NO: 49000 - DNA, 101 bp, rice(Oryza sativa)
  misc_feature (71): n=a or g
aagaagatgaacttatgtaagccctcataagcctataaattatcatgtccaaaggaagcttcacttcttcngtaccacgaatccatggatgaccttaaatg

SEQ ID NO: 49001 - DNA, 101 bp, rice(Oryza sativa)
  misc_feature (71): n=a or g
gggtgtcctaaagagggacgtgattgaaggtgtccgagagttttttgaaactggagaatggaaggaaggantgaatgatactgttattgtcatgattccaa

SEQ ID NO: 49002 - DNA, 101 bp, rice(Oryza sativa)
  misc_feature (71): n=a or c
caaatggacatataaagtatcacacagctaacagtacagtactacctaaaagtcaacagcaccatctattnaataacggaggtagtatgaaatagacatga

SEQ ID NO: 49003 - DNA, 101 bp, rice(Oryza sativa)
  misc_feature (71): n=a or c
aaatctttagagtaatacttaattaatcatgctaatgagcagcaccgttttccgttgaaggtgggttcctnaccccacattcctaaagcaaccctagtttt

SEQ ID NO: 49004 - DNA, 101 bp, rice(Oryza sativa)
  misc_feature (71): n=a or g
agagagttgagaacactgttcagtttctgacaaaataccctgtaatgtattggattcctttctccaggaanctgtcaagagcttgttaacccaatcaacct

SEQ ID NO: 49005 - DNA, 101 bp, rice(Oryza sativa)
  misc_feature (71): n=a or g
cggcgaggaggagttggctagggatacctactccctgatgcacgagtcccagcttgtgttgacctccgctnccttccgcggccagtgctcccccgccacgg

SEQ ID NO: 49006 - DNA, 101 bp, rice(Oryza sativa)
  misc_feature (71): n=a or g
acagactgaatggcacaagtaccaaaaacataatccaaattccctaagcgaagtgggtgtagatcaactgnttagattccttgtgatgaaaccaactcatc

SEQ ID NO: 49007 - DNA, 101 bp, rice(Oryza sativa)
  misc_feature (71): n=a or g
agggaaaaaatttgattataccactattgagtgtccacttattatatttcctctggtactcttagggcatntacaatggtccagatgcttagataggtgct

SEQ ID NO: 49008 - DNA, 101 bp, rice(Oryza sativa)
  misc_feature (71): n=t or c
ggcctcgacggcagtagtggagggtgttagagctatgagtagggcatggctcacatgagtagggcagcaancggtaaagggagtacgggagatgaccggaa

SEQ ID NO: 49009 - DNA, 101 bp, rice(Oryza sativa)
  misc_feature (71): n=t or c
ctggagtactatgaaattgttgctaaaaaatacatttatgtactgcacggtagatgtggagaaattgttgngaataaatgtggttggctatagcatactcc

SEQ ID NO: 49010 - DNA, 101 bp, rice(Oryza sativa)
  misc_feature (71): n=t or c
gtactgcgtgtgaacggtcaaagtcaaacttggaaggtcaaacctaaggaaaggaagaggagctcagtgancgtgcgtgacgtcagcaatggagatggaga

SEQ ID NO: 49011 - DNA, 101 bp, rice(Oryza sativa)
  misc_feature (71): n=t or c
tgttggttttggagataccggataaagaaattaccatatgcatgggaggatgcatgctacttgactcggangtctcttaagatacctgctaatacatggga

SEQ ID NO: 49012 - DNA, 101 bp, rice(Oryza sativa)
  misc_feature (71): n=t or g
cgccgccgtcaagccgctgcatcctccgccggaggagaggcctctcccgtacatcctcctcccgggagatngggagcgctccttctcgtgcgctctccgcg

SEQ ID NO: 49013 - DNA, 101 bp, rice(Oryza sativa)
  misc_feature (71): n=t or g
ttatccatcaagtataggttggaccgtgatttatatgtaggatgctcactgagcgacatgtatgcgcgatncaagaatctggactctgcaagggtagcatt

SEQ ID NO: 49014 - DNA, 101 bp, rice(Oryza sativa)
  misc_feature (71): n=a or c
tgtactattatttagctcagcttcccctgaataatcagattgggtgcatgaaagacaaatataactaaaanttaatataagatatcctttatttcaagtaa

SEQ ID NO: 49015 - DNA, 101 bp, rice(Oryza sativa)
  misc_feature (71): n=t or g
atttccaacaaacaaattcagctagaagccaaaagagttacctatgtaactgtacaaaaggtcaagagtgntacaatgaaaagctcaggtgaaagagataa

SEQ ID NO: 49016 - DNA, 101 bp, rice(Oryza sativa)
  misc_feature (71): n=a or g
tcactccatttgttcctaaaaataaatgtagttttagagtgttccactgtaccctttttagggcccctttnaatcgtaggaatgaaaaaacagaggaatag

SEQ ID NO: 49017 - DNA, 101 bp, rice(Oryza sativa)
  misc_feature (71): n=a or g
gcagtatgtcgggaatggcttcactcctagaggatcttgacgatttaattgtagacccctatgagaatgangaggaagaagaccaggatttaaggtaataa

SEQ ID NO: 49018 - DNA, 101 bp, rice(Oryza sativa)
  misc_feature (71): n=t or c
aagattgatttgcttgagcttgaatcggtttgacaggtaggatcggggcaaccgttggatgaaccggtgcnatcgttgcatgagcggtgggatgcacttgg

SEQ ID NO: 49019 - DNA, 101 bp, rice(Oryza sativa)
  misc_feature (71): n=a or g
agatgcagaagccctggcagcgacgaaagaagcaagagtgaatcttgcgcaattccgctcgcgatcaaatnaacctgcttgaggcttgtaaggaagcaggt

SEQ ID NO: 49020 - DNA, 101 bp, rice(Oryza sativa)
  misc_feature (71): n=t or c
tctgttgcatctttggacagaatatataggtgaacagctagcaggcgaatctgaaaattgcattttatttnctgaaggacttccgttagtagggacccaag

SEQ ID NO: 49021 - DNA, 101 bp, rice(Oryza sativa)
  misc_feature (71): n=a or g
tcgtagtagaaaagttgcggaagcggtagattccacatatacatttgacatgccattcttgtctgaggatnacagccagaaagtgttcgagcaaaatttag

SEQ ID NO: 49022 - DNA, 101 bp, rice(Oryza sativa)
  misc_feature (71): n=a or g
cttcatggcggcggtggcgcttggcgtactcttaggcgtgcacacccatcaaagacgctccttgatcgtcngcatcctctgcgtcatctttgacaccatca

SEQ ID NO: 49023 - DNA, 101 bp, rice(Oryza sativa)
  misc_feature (71): n=a or g
cgatcaactagctagttaccaatccggtagaggttaccatatatacctttgttgactggactcattttagntacattatactggtaatatatactgctagt

SEQ ID NO: 49024 - DNA, 101 bp, rice(Oryza sativa)
  misc_feature (71): n=t or c
ggtcttgccagtgattcagcaaggtacaagagctgatgtggtggctgcttccttggttgcattgtggaacnatgttgaagtcttacacctcaccattaaca

SEQ ID NO: 49025 - DNA, 101 bp, rice(Oryza sativa)
  misc_feature (71): n=a or g
aatagaatccgacgattaagaaaagagacgatgggtaaaccattaagtagcactgtcatgacagttggccngacatttagaaagcaaaagaaaaaaaaaac

SEQ ID NO: 49026 - DNA, 101 bp, rice(Oryza sativa)
  misc_feature (71): n=a or g
agttcctttccataggtattggaggaggttaattcagcatccattaaggtgcgtagaaaatactagggatnaaaatggtatggaaatttttaagatttctg

SEQ ID NO: 49027 - DNA, 101 bp, rice(Oryza sativa)
  misc_feature (71): n=t or c
aaatatataatagtcaagcataaaagaagtaactaattgcaaaagcgagggtagctcaactacctgaattnaaatcctagatttaacatgggtgctcgtgt

SEQ ID NO: 49028 - DNA, 101 bp, rice(Oryza sativa)
  misc_feature (71): n=t or c
agaaaagttttgcagatgatggatggattacaacaaattaaggttctgaaccgaaaaatcaagctcgtccntgtgctgctgatttccacagtgaggaaaat

SEQ ID NO: 49029 - DNA, 101 bp, rice(Oryza sativa)
  misc_feature (71): n=t or c
gactgtggtgccacagatcacatcaccggggaactcgacaaactctccattcgagagaagtacaatggtcnggatcaggtgcatgcaacaaatggctcagg

SEQ ID NO: 49030 - DNA, 101 bp, rice(Oryza sativa)
  misc_feature (71): n=a or g
attccccttggtggctatatggatttatgcctcgaaagagcaaagttgcgtgctccgtggctgaaatggangaaggcagttttggcccggggaagtcagaa

SEQ ID NO: 49031 - DNA, 101 bp, rice(Oryza sativa)
  misc_feature (71): n=t or c
tccggcacctatgagcttcgaaaatgtgtcccccaagtagctgacccataaactaccataaagttcaatangatgatataagagagaacaacaattgaagt

SEQ ID NO: 49032 - DNA, 101 bp, rice(Oryza sativa)
  misc_feature (71): n=a or c
tgaaaacattattttgaaaatcggattttcgcatgtaaattgcaaagatccgattttcagattttgggtgnatgcggatcgtttgtccagatgcaaaaatt

SEQ ID NO: 49033 - DNA, 101 bp, rice(Oryza sativa)
  misc_feature (71): n=t or c
ctatgatctcgatgggagccaagaggatgacggtgtagaatcgtttgacgtatgagtcagctaggagggcngccgggatggagaacacctgcaacgcggcg

SEQ ID NO: 49034 - DNA, 101 bp, rice(Oryza sativa)
  misc_feature (71): n=a or c
tgcatgctgccatggtggcttggttgatgaaggccggaagcagttccatgcaatgagggaggtttatcagntagaaccaagagttgaacactatagctgcc

SEQ ID NO: 49035 - DNA, 101 bp, rice(Oryza sativa)
  misc_feature (71): n=t or c
ctcacgattttcaggcggctcaggccttcgtattcaggtttgtttttcccgaatagtccaaggatctcttnccttgcacggtcttgccactctgggtgcat

SEQ ID NO: 49036 - DNA, 101 bp, rice(Oryza sativa)
  misc_feature (71): n=t or c
gcccggtcccggagctgtggaactacaaggagaagcgcaaggcgacattggaggaagccatccagttcgtngttaagcagtggaggacacacgaggaagcg

SEQ ID NO: 49037 - DNA, 101 bp, rice(Oryza sativa)
  misc_feature (71): n=t or c
ggggacaccataggcaagctctctcatttctcactctaattttcagttcttcccaagcagtttttatcttnttttttttcgcgaacatgcaaaaggcttgc

SEQ ID NO: 49038 - DNA, 101 bp, rice(Oryza sativa)
  misc_feature (71): n=t or g
tatctgaagtaatcgtggagattttgaaagaaactgcaaccagaagctgtgacaaagacaagagcttcacnctcaaatgcagcctaaacttgaggtccatg

SEQ ID NO: 49039 - DNA, 101 bp, rice(Oryza sativa)
  misc_feature (71): n=a or c
agagcgcatgcactcgtgaggttgaccatgcagaaggcagtgatgcaagcactggttggtggagcagccgncggattcggggcctcaaacttggatcgagc

SEQ ID NO: 49040 - DNA, 101 bp, rice(Oryza sativa)
  misc_feature (71): n=t or c
atcagaacggactctgtggtggaattaatggtttggagattggtcagcagaatggtggagagcaagcacangaagggaattctgtggtgcataagtgccca

SEQ ID NO: 49041 - DNA, 101 bp, rice(Oryza sativa)
  misc_feature (71): n=t or c
aaatgatctgattttaatattttacgcaattttcttctcctccggaaacaagatgtgtgtgggctattttngtcattggatcgaaatagtgcatgtattaa

SEQ ID NO: 49042 - DNA, 101 bp, rice(Oryza sativa)
  misc_feature (71): n=t or c
ggagatgtgattttcgccttttctttcgggaagctcttctttctttcttgcgttccaatccaaacgagagnaatagaatccgggctgggcctccaccgtag

SEQ ID NO: 49043 - DNA, 101 bp, rice(Oryza sativa)
  misc_feature (71): n=t or c
ggcgagtaggtctctgctgaatttgatgtggaggagaccgtcgagcaaccagctggctcgacgacatctgnggtaggcttcgtaccgcggtaccaagcacc

SEQ ID NO: 49044 - DNA, 101 bp, rice(Oryza sativa)
  misc_feature (71): n=a or g
agtgcaaaaaatagcgtagctagttttccacaacacaaatccagagcagcaccagtttgaaaccatcacangttaaattcaactcatgtgtacttttaatg

SEQ ID NO: 49045 - DNA, 101 bp, rice(Oryza sativa)
  misc_feature (71): n=t or g
ccactagtattggtgaatattggtatgcaggtgatatttggataagagcacacccaccaagtgacaaaatncacctccaacaaatcataagcgagcacaag

SEQ ID NO: 49046 - DNA, 101 bp, rice(Oryza sativa)
  misc_feature (71): n=t or c
gatgagcccctcctctgcctcctaaacaagtcttcaagctcatggtctgaatcatcttcatcatcctcatngtcatcgtcgtcgtcatcatcctccatgat

SEQ ID NO: 49047 - DNA, 101 bp, rice(Oryza sativa)
  misc_feature (71): n=a or g
caattttgtcgtgtatactccgttggctgtcagtttccatatgatggtgtcttcatgctcattgaaggccngtggctgaagtagtctaacccaaaggtcta

SEQ ID NO: 49048 - DNA, 101 bp, rice(Oryza sativa)
  misc_feature (71): n=t or g
ttaatgacgcatgcaacgttttttactccaccgctatctcatttgtctatgttcgagccattattggagantaattttatctgcgtgctacgaactctatt

SEQ ID NO: 49049 - DNA, 101 bp, rice(Oryza sativa)
  misc_feature (71): n=t or c
atcctcccttgaagggcagtatttgagtatatggtcagagatgacagagcaggcatatgtcctagcaattngaaatcctcctgccaaattttgttgacata

SEQ ID NO: 49050 - DNA, 101 bp, rice(Oryza sativa)
  misc_feature (71): n=a or g
cagatacatttctgagaaattaactgatgctgggcagggggggttttagtatcacaatagtacagcaatanccttatctttgttcacacttttatgtagcc

SEQ ID NO: 49051 - DNA, 101 bp, rice(Oryza sativa)
  misc_feature (71): n=a or g
gccaccatgcctccaaaccagatgttagttgctgagttagatagtgtactgtagtacgacatgggaatgcnaccaatgagatcaggatccctgttaaaccc

SEQ ID NO: 49052 - DNA, 101 bp, rice(Oryza sativa)
  misc_feature (71): n=a or g
agttttaggttccaaattgtcgacttgttcggtggtattggtttgctcttttgtcgaaggatatatgaatntggtgagcaatattcattttacatgttttt

SEQ ID NO: 49053 - DNA, 101 bp, rice(Oryza sativa)
  misc_feature (71): n=a or g
tgagagcctcaacaactgaacatgctccgccacataatcaaactacaagattgcaggtaaaaatttacacntcttctatatatttgacatacaattcacgc

SEQ ID NO: 49054 - DNA, 101 bp, rice(Oryza sativa)
  misc_feature (71): n=a or c
cctccaaggagttcttgaagttgctaccttttacttggtgccttgctctctctttcttggagattgctgcngtctataaggaatttcagataggaggtgga

SEQ ID NO: 49055 - DNA, 101 bp, rice(Oryza sativa)
  misc_feature (71): n=t or c
tgactagggtttatatttatcttctccattatattttctctctccctatccgctcaaccataaccatatcngcgaagatatctttttctcatgtacttgag

SEQ ID NO: 49056 - DNA, 101 bp, rice(Oryza sativa)
  misc_feature (71): n=t or c
atacgatggttgtgccttaaaatgtgcagagaggtgtatatgataactttctccacgctcttgtcaaaatngtccgtgaagaaggccctactgagctgtac

SEQ ID NO: 49057 - DNA, 101 bp, rice(Oryza sativa)
  misc_feature (71): n=a or c
atttagagtgtaaattaaaggaaataagtaatctagacttgattttcttgcattattgtttccgaaatggntttaaaacggctaaaacaagaaatggtttt

SEQ ID NO: 49058 - DNA, 101 bp, rice(Oryza sativa)
  misc_feature (71): n=a or c
aaatgagtcagaatggattgccccaaatgcaaaattctgtgcatatgcactgccaattaattcacagcaantgtactcctgttcatatcaatcaaaacaca

SEQ ID NO: 49059 - DNA, 101 bp, rice(Oryza sativa)
  misc_feature (71): n=t or g
ttataaacattgcacaaaaggcatatctgctatctcactactctaagagaaggcagtggtggtgattgttntcaatctgacgcctcactctacattgcatt

SEQ ID NO: 49060 - DNA, 101 bp, rice(Oryza sativa)
  misc_feature (71): n=t or c
cggcagcgccacccccgccatgatcccaggtcatccgggagccttttatcccttcccgccgccgtcacttncaggagtcggtccacctcgaggcggcggcg

SEQ ID NO: 49061 - DNA, 101 bp, rice(Oryza sativa)
  misc_feature (71): n=a or g
tagccgtgccgtcgtgctgatcaaccctgtcatgttcgaggttgacctcaaggtgatcacccacaacaatngtggcttgccgttgtctgaatctgaagagg

SEQ ID NO: 49062 - DNA, 101 bp, rice(Oryza sativa)
  misc_feature (71): n=a or g
cagtgagacctcctatttccgtgtctcctcttgtttcaagtccacagctggaaggtgccgctgttccatcntttcctcgtcaatcaaatatctccacaagc

SEQ ID NO: 49063 - DNA, 101 bp, rice(Oryza sativa)
  misc_feature (71): n=a or g
tcttttctttcacatggttcacctccttgcctcttattcccaatttccgcatataccacctctgtacaggnttgcagctcactccatcaaacacctatgct

SEQ ID NO: 49064 - DNA, 101 bp, rice(Oryza sativa)
  misc_feature (71): n=a or g
attctcttgggttagcctagcttagctatagctaggtaggtagcagcgcgtgtcatgccacgtacgtaccnacttggcctcgtcctggacgcgcacggccg

SEQ ID NO: 49065 - DNA, 101 bp, rice(Oryza sativa)
  misc_feature (71): n=a or c
aattataatttaatcaaaaggaaatgccctccaggggcaaaacgttatgcaaattaagcatcatgagaagntaaatcagttctctacaatacacaccaaac

SEQ ID NO: 49066 - DNA, 101 bp, rice(Oryza sativa)
  misc_feature (71): n=t or c
attaattagaacaactaagcgaaatcatgactaccacaacaactccaccaacaacactctcacaccagccnactaacaactataagaacgatggaggtttt

SEQ ID NO: 49067 - DNA, 101 bp, rice(Oryza sativa)
  misc_feature (71): n=a or g
ctctacgtgggtcctgagcagccttgatatttgcttgctgtcgtctaatcgagtctaatcgtttataggtnaatcagttagtgaatgctagtaatatacta

SEQ ID NO: 49068 - DNA, 101 bp, rice(Oryza sativa)
  misc_feature (71): n=a or g
cagcaatcgattactgttgcacatgcccttggtacctctcaagtgcaaaataattcacctcacatctgttnggttgcaaatggttaaatttcccaattgtt

SEQ ID NO: 49069 - DNA, 101 bp, rice(Oryza sativa)
  misc_feature (71): n=t or c
ccccatgggtatccagtgggtatgcccggtgaccttgttccctatgctcggcgcgacggtgagaagggagngaagcggcgacaaaagtgcgatggaggagc

SEQ ID NO: 49070 - DNA, 101 bp, rice(Oryza sativa)
  misc_feature (71): n=t or c
atggattttgagggagccgaagagtggagaaagatacagatattagagttggaagaatggagggataaagnatatcacaactccaagatttacaaggaaag

SEQ ID NO: 49071 - DNA, 101 bp, rice(Oryza sativa)
  misc_feature (71): n=a or g
attccttgatacacgacgcctccagccacatgagagaagaggagggcaatggaagaaaaaggagagaaaanagggctatagaattcatttgtgagaaattt

SEQ ID NO: 49072 - DNA, 101 bp, rice(Oryza sativa)
  misc_feature (71): n=a or g
aggttttcttcggggttgtcatgggcttgaagattaagggtcattttggtttggcgctccttcttgccttnctaattctttgataacttaaaggtcaaaaa

SEQ ID NO: 49073 - DNA, 101 bp, rice(Oryza sativa)
  misc_feature (71): n=a or g
ggatcagggggagtcccaggtatttgatcgggaagcatgctctcactgctgggactccctctaggacatcntccaaatcaatgttattgcatttgatgacc

SEQ ID NO: 49074 - DNA, 101 bp, rice(Oryza sativa)
  misc_feature (71): n=t or g
gcattggcgacgaagagcgcattcgtcgtcagtacatctttgtttatgcgctctatcaagtcgtttgagcngaagccacatgtggtagacgacattatagc

SEQ ID NO: 49075 - DNA, 101 bp, rice(Oryza sativa)
  misc_feature (71): n=t or c
ttgcgaattagccccgagaactagaatgttaattacctggtatttgaattgaggggtaatttgcatgtctntatagttctatagttcaagagtgtaattcg

SEQ ID NO: 49076 - DNA, 101 bp, rice(Oryza sativa)
  misc_feature (71): n=a or g
gatgccgtagatctttctccatttgaatatgatttccaagggcttctagatgtggaatcatcggatgttgnctgtaatgatgatttgtgtgctcttgatga

SEQ ID NO: 49077 - DNA, 101 bp, rice(Oryza sativa)
  misc_feature (71): n=a or c
agaagacgaggagatagctgcagtctcgtttttggcttttcgaatttattataaccccggttcgtgtttgntagctctctatatatttctatctccatcgc

SEQ ID NO: 49078 - DNA, 101 bp, rice(Oryza sativa)
  misc_feature (71): n=t or g
atggtttgccaccttaaatttgcttgattagttacttttgccgctggtactgatgcgctgagggcgacatncttggggactatactccccagtctttattt

SEQ ID NO: 49079 - DNA, 101 bp, rice(Oryza sativa)
  misc_feature (71): n=a or g
ctgagcaaccgaatgagtcgcccaccatacctaagagccccatgatgcgtctacctatcaaagcacaaaanattagtattaccttgcaaagattcggcgaa

SEQ ID NO: 49080 - DNA, 101 bp, rice(Oryza sativa)
  misc_feature (71): n=a or g
tcgactataccgtgccattcctgatcccttgtaacctacctctgctggactttgctggtagtatttttgtnccaagaaggttggtcccaaattgattgcaa

SEQ ID NO: 49081 - DNA, 101 bp, rice(Oryza sativa)
  misc_feature (71): n=a or g
acaaattgcatgatggagaaactcttggttagcttcactagcatggccactgggccctacatcttggcaanatatatgaagcatattttctccactagttt

SEQ ID NO: 49082 - DNA, 101 bp, rice(Oryza sativa)
  misc_feature (71): n=t or c
tgaacttgaagcatgcgaggtattcaacgcgcttcaccaaccaggaccacctggtgtccgatccacaagtnaagaggacatgagctctcgggctgcaaagt

SEQ ID NO: 49083 - DNA, 101 bp, rice(Oryza sativa)
  misc_feature (71): n=a or g
aagtgcacgtagataatttggggtgcatgttatttttatcaatacttgcaatgtcacctttttggccgggngaaatagtaggcttcacgtacgattctcac

SEQ ID NO: 49084 - DNA, 101 bp, rice(Oryza sativa)
  misc_feature (71): n=a or g
gacgaatggtcaattgttgcaagaagaagtcaaagcgacatctaattcaagacggagggagtaccgtttancagtttgaaaaacgtgctcacgtaacacag

SEQ ID NO: 49085 - DNA, 101 bp, rice(Oryza sativa)
  misc_feature (71): n=t or g
ttgttgttaataagctttaccgcctataattagctatggacgtgactacataggaactgtactctatattntcttaaccagagactcatctcagaccttgt

SEQ ID NO: 49086 - DNA, 101 bp, rice(Oryza sativa)
  misc_feature (71): n=a or c
ggtccatacttgatcttgaccatcgagcattgctccatcctcggactgaagtcgaatttctcctccttccnattgatccgtctgcatcaatgctggcctcg

SEQ ID NO: 49087 - DNA, 101 bp, rice(Oryza sativa)
  misc_feature (71): n=a or c
tattgataattatggacggtggtcattagtggttgtttatgatttctatttacatgagcaactatttaacnctctaaatagtcaacattaagtaggcattg

SEQ ID NO: 49088 - DNA, 101 bp, rice(Oryza sativa)
  misc_feature (71): n=a or c
tcttcgtggaacaccaagatgtctctgatggtgacagcattgtcgattcgctcgaactgggggcagaacgnttgcagcaccatggcctcgaaggacgcact

SEQ ID NO: 49089 - DNA, 101 bp, rice(Oryza sativa)
  misc_feature (71): n=t or g
cttaccaagacaattcctctaaaaatattttgttgaataaatacaaggcacctctgcaagctctctgcttncaaaataaatgccctgtttggactgaaacg

SEQ ID NO: 49090 - DNA, 101 bp, rice(Oryza sativa)
  misc_feature (71): n=t or c
ggacagggatgctggcgataacaacgctgcggataatcttggtttgatgttgcatgaagcaaaggaggatngtgaaagtgaaaaggaggcccataaattgg

SEQ ID NO: 49091 - DNA, 101 bp, rice(Oryza sativa)
  misc_feature (71): n=a or c
atgttgcttgtgcaggagaaggaaggttgccgttctttttctcgtgctccatgcagatcgaggaaggaaangtcatgcccaggcgatctcgccggcgcagc

SEQ ID NO: 49092 - DNA, 101 bp, rice(Oryza sativa)
  misc_feature (71): n=a or g
tgaaagattattttcatgcaaatgttggtactaagttgtgctctttttattgtgccagtttgatgaactcnacagttttctatgccgtagaaggtaatact

SEQ ID NO: 49093 - DNA, 101 bp, rice(Oryza sativa)
  misc_feature (71): n=t or c
gagtaaaattttgttctttgtgcggcggctgtatcgtgatatgtgttcttggaaaaaaaagagtgaagtgnaccggtggttcctaaacttgtgtgggtgta

SEQ ID NO: 49094 - DNA, 101 bp, rice(Oryza sativa)
  misc_feature (71): n=a or g
catatgctaatcgcgtactgttaagcgaagcgaagcgagtagagtaataagcgtatgattaattatgtatnaactattataaatttgaaaataattttatt

SEQ ID NO: 49095 - DNA, 101 bp, rice(Oryza sativa)
  misc_feature (71): n=a or g
tctgtttttgataaaccagtgagagacgattttcatgtcaaaaacagaaaggtgaaacctgcatccaaacnctttagagcaggtacaatagcaggctataa

SEQ ID NO: 49096 - DNA, 101 bp, rice(Oryza sativa)
  misc_feature (71): n=a or g
ctccgctctgcgcactcactccctcgctcgatcgatcaatcgccactcaatctctgcaggtcggtcagtcngtcagtcagtcagtcaatgaccacctcatg

SEQ ID NO: 49097 - DNA, 101 bp, rice(Oryza sativa)
  misc_feature (71): n=a or c
taccatggcggctgcggcatcaatgaaaggtgtcaatgagggggacagagtggaaggcaatgagtgctcancgggcagcagccggctagcgcatgtgaggg

SEQ ID NO: 49098 - DNA, 101 bp, rice(Oryza sativa)
  misc_feature (71): n=a or g
aataaactttaggaaataaaggttcaatttttaaatgttctaaggatgttgaatagattccgtgaaggtcnggcaatcaaataaaaaggtggcaaggaagt

SEQ ID NO: 49099 - DNA, 101 bp, rice(Oryza sativa)
  misc_feature (71): n=t or c
aaacctgttagcaagacgcagaaacttaacccggatcatctggagtttctcacggatttcatcattttcgnctccatcctcaggagattcaacatcctgcc

SEQ ID NO: 49100 - DNA, 101 bp, rice(Oryza sativa)
  misc_feature (71): n=t or c
ctttggtatatactaaataattataactatgtatgtttataacccagttgccgccagcctcaaagggaaantcacaataactctgagaacacgggtgccac

SEQ ID NO: 49101 - DNA, 101 bp, rice(Oryza sativa)
  misc_feature (71): n=a or g
ctaatgagttttcttattttgtgtgcgataaaagtttctctctaaagatggatatcgaacgcagccttagncttgaccatcatctcttctctcttcttctc

SEQ ID NO: 49102 - DNA, 101 bp, rice(Oryza sativa)
  misc_feature (71): n=t or c
cagaagaaaaatatgcacatgtcggtgacataaatggttccaaacaacaagcaccaaacattttgttcaanttacgctgagcataagaaggttcaaaagca

SEQ ID NO: 49103 - DNA, 101 bp, rice(Oryza sativa)
  misc_feature (71): n=t or g
gccacttcaaagtcatttgcagattcatcaaaccaagcattgatttcccacataccgaaagtcctacccangccttcgaaaaggggtgcaataaaaaacta

SEQ ID NO: 49104 - DNA, 101 bp, rice(Oryza sativa)
  misc_feature (71): n=a or g
atggatcttctttgaatctctttcatggcttctcctggtgagctcgtcactccctcccctcccgatggctngaattttgatttcggaaagtctttctccgc

SEQ ID NO: 49105 - DNA, 101 bp, rice(Oryza sativa)
  misc_feature (71): n=a or c
ctcccagtcgccggagccggaggggccaaggacgaacacctggtggacgatgtcgttaatgtcgtactccngatactgcagcacgccggtgtcctcgtcgc

SEQ ID NO: 49106 - DNA, 101 bp, rice(Oryza sativa)
  misc_feature (71): n=a or g
gtgagagcgggcgggcgggggtgagtgtagcaatattggtaggactaggagcaaggctgtggggtgtgtcngtgtgtgtgtgtgtgtgtgtcagaaggggt

SEQ ID NO: 49107 - DNA, 101 bp, rice(Oryza sativa)
  misc_feature (71): n=t or c
gtgagacatgggtagggagcaatgcccgactcccgtgatgccactaacgaggaacaggcaaagggcgaggngaaggctagagaaggagatagaggtggagg

SEQ ID NO: 49108 - DNA, 101 bp, rice(Oryza sativa)
  misc_feature (71): n=t or c
aaatacaattcacagaataatttggtccatggacgatattgtgtggtaaaggttagtgagggtcaagagtntattgcagcgagtacaatagcagattataa

SEQ ID NO: 49109 - DNA, 101 bp, rice(Oryza sativa)
  misc_feature (71): n=a or g
gatgttagaaaaatactttacttactttacgtgaagtaccaatagatagattcaggaaaaggggttcctcntcgttaacctctttgactgaaggaacttgt

SEQ ID NO: 49110 - DNA, 101 bp, rice(Oryza sativa)
  misc_feature (71): n=a or g
cttttgttgctaattattacgtgcagtgataacacagcgtacaaaagtaacgcattgggtcctaaatatgntagggccaaagtatttcagaaagaatcctg

SEQ ID NO: 49111 - DNA, 101 bp, rice(Oryza sativa)
  misc_feature (71): n=t or g
agagaaaatggacatcatacaactctgaaaagagaccggagcattgcacagcctgaatgacatcctataanaggcataggttccatacgggcatgtgaacg

SEQ ID NO: 49112 - DNA, 101 bp, rice(Oryza sativa)
  misc_feature (71): n=a or g
ggttgaaacctaaaaaatataagtactaatcgcattctccaaatgaagccccatgggactagaacactctnatgcagagagtccttcactcaccgatagca

SEQ ID NO: 49113 - DNA, 101 bp, rice(Oryza sativa)
  misc_feature (71): n=a or g
ggtggttcgtggcgtcgccgttgctgatgtcgttgaagaggccgatgtactggctggcgacgaagaagacnatgccgtggccgcaggcgtcggcgtcgggg

SEQ ID NO: 49114 - DNA, 101 bp, rice(Oryza sativa)
  misc_feature (71): n=t or c
cctaccaagaattgtttttacacaaactaatccttgaccaccacaatgcctatactgaggctagacatgancgacaatatacttccagctcctagtcacta

SEQ ID NO: 49115 - DNA, 101 bp, rice(Oryza sativa)
  misc_feature (71): n=t or c
ttagtagtacatagatctccacaatttccctagcatgtttagtactagttctcatcactgttgtcatcatngttatcctcgatcacatcatcattgtcttc

SEQ ID NO: 49116 - DNA, 101 bp, rice(Oryza sativa)
  misc_feature (71): n=a or g
gctaattgcatctctacatcaagagcaaataaaactcaaggctaacccacttaccagacacgattgcatcngccaacggagtctaacatatgctctagatg

SEQ ID NO: 49117 - DNA, 101 bp, rice(Oryza sativa)
  misc_feature (71): n=a or g
aattggtcgatcacggtttacaggagggggattagtttttgtttgggtgttcgtgtctagggttttccctnccgagccaagggtggcgctcacatcctgct

SEQ ID NO: 49118 - DNA, 101 bp, rice(Oryza sativa)
  misc_feature (71): n=a or c
atatatacacgtaatgctgtcactgtaaattaaactacattccaaatcccgcggttgtttctttggttttngaattcatgcaatttttgttggagtggaag

SEQ ID NO: 49119 - DNA, 101 bp, rice(Oryza sativa)
  misc_feature (71): n=a or g
acaagtaggattatgcataacacccctagagataagtgacaaagtaaagagcatatataagactctgcaanctgctatcaggtacttgttcttcatcagag

SEQ ID NO: 49120 - DNA, 101 bp, rice(Oryza sativa)
  misc_feature (71): n=t or c
tcccagaggtgcaggacacttgaggcaaaagcctgcattttgtctactacttccttctccgatattcttcncgtgccgattgcccaattattacagatgat

SEQ ID NO: 49121 - DNA, 101 bp, rice(Oryza sativa)
  misc_feature (71): n=a or g
aaaaaggcaattagcgtttcatcattagtgtaattaagtaatatatctgcagattgtatatccggatcgcnttaattagcataattaatcaagatttgacc

SEQ ID NO: 49122 - DNA, 101 bp, rice(Oryza sativa)
  misc_feature (71): n=t or c
cattgtccctcttttttcttccccatctcttcctccatccccacgatgggagcgtcggtggtggtgaacgnggaggagctcacgggggcaccggtcggtgc

SEQ ID NO: 49123 - DNA, 101 bp, rice(Oryza sativa)
  misc_feature (71): n=a or g
gaaatgagagggaaagcatgtcccctactttagcattctagaatcattatgtccaaagcaaaacagtgttnatcaagcactcagttcatatgccgtgtgga

SEQ ID NO: 49124 - DNA, 101 bp, rice(Oryza sativa)
  misc_feature (71): n=a or g
aggaactcaccagcttaatgtattgacctcctgggtgtgcatgtgatcatcagctctgattcaattaatcntggaccgtcagatggcggtgcgggtcgatc

SEQ ID NO: 49125 - DNA, 101 bp, rice(Oryza sativa)
  misc_feature (71): n=a or c
cccaattgggccttttcagctggagtagattgtatgggctgggccttagttgatgattggcactattttancttggaataagttcattttaggtctcttaa

SEQ ID NO: 49126 - DNA, 101 bp, rice(Oryza sativa)
  misc_feature (71): n=t or c
ggcaattgactagtatttgacttggtactggtaactttgagatgtgcttgctagcacggtggtaggagtangtgatttcaaccgaaaggactcgtgtgttt

SEQ ID NO: 49127 - DNA, 101 bp, rice(Oryza sativa)
  misc_feature (71): n=t or c
cacaagatggattttcacagcgattaaccagaccaagatcaaatgggacatatttaagtacaaagcctganctaaaccctgtgatttggccaggagaatct

SEQ ID NO: 49128 - DNA, 101 bp, rice(Oryza sativa)
  misc_feature (71): n=t or g
ccgtgatgcagcatcgatccctgtcaattccaaagattcctctaattcttctttggatggtggccaacacncaggcatttggagctgttcagcccgtgtgc

SEQ ID NO: 49129 - DNA, 101 bp, rice(Oryza sativa)
  misc_feature (71): n=t or c
aatgacagccccacctgggaggcttgttaccaacggtctcaaatccgacgagaaaagatctctataaaacntgttcagtctaatgatggtttcagaaaagt

SEQ ID NO: 49130 - DNA, 101 bp, rice(Oryza sativa)
  misc_feature (71): n=a or g
gacatccaggacgacgccgggaacgtcacgcggttcgtcccgcgaacggacccggccattcaagacgagcntcgtgttcgcgcacgacagggagggcacgt

SEQ ID NO: 49131 - DNA, 101 bp, rice(Oryza sativa)
  misc_feature (71): n=t or c
gagatcaaatcaatgtgtgtcatacagaacttcaccacatttatctctcgagttataaaaagaaataatangtggtataatttcaatttagattagcttac

SEQ ID NO: 49132 - DNA, 101 bp, rice(Oryza sativa)
  misc_feature (71): n=a or c
atggcttcctcagactcattgggagccccaaaagtgaactgagccggcggccattattgtcataacaaagnaagctatacgctctcagcaaatcatcacga

SEQ ID NO: 49133 - DNA, 101 bp, rice(Oryza sativa)
  misc_feature (71): n=a or g
aggaataaaaaatgtgacggggtgggcatggttccaatcttgcaaaatttcaattctatctatttcctccntttcacaatgtaagtcattctagaatttcc

SEQ ID NO: 49134 - DNA, 101 bp, rice(Oryza sativa)
  misc_feature (71): n=t or c
ctcaaaagctgatttgttacaaaggccaatcacccaaacccttttttgataaatacttatcattatggagncaatcagccaacgtgtacccatagtactac

SEQ ID NO: 49135 - DNA, 101 bp, rice(Oryza sativa)
  misc_feature (71): n=a or g
ttggtgagaaagaagaaaatgagatgatgttgtcaggtagttttgtagagtttacttcgttttagtttttnttattatctataactatgttgatgtcagtg

SEQ ID NO: 49136 - DNA, 101 bp, rice(Oryza sativa)
  misc_feature (71): n=t or c
tctatgttctaattaaacatgctcttagctcatatggttatgtgtgtttaattaaatactatctccgcccnaaaataagtgcagtcgtgagtatccatgtt

SEQ ID NO: 49137 - DNA, 101 bp, rice(Oryza sativa)
  misc_feature (71): n=a or c
tatatgagcggctattaacctagaagctagaatccatccagctagaaactagctaaggtgcttgacaggtnagctaatttagaatagcacattatctatgc

SEQ ID NO: 49138 - DNA, 101 bp, rice(Oryza sativa)
  misc_feature (71): n=a or g
cttgtcacactcgcatggtgacgtgtcaggtatagcacggtgaaaaatggtggattgtgtcttgtctcttntgggtacagttgtgcacctttggtaagagt

SEQ ID NO: 49139 - DNA, 101 bp, rice(Oryza sativa)
  misc_feature (71): n=a or g
aaacagtaatttcagtgaatgaaatgaaagacaccctagcttccctgtgacaactttgctcttggagcacntctacaaggtacatgttctttgatttttgc

SEQ ID NO: 49140 - DNA, 101 bp, rice(Oryza sativa)
  misc_feature (71): n=t or c
tgattgataatttggaccaatcacatagattcatcaaatgcctacccattttcttgtttacctgtgtagcnatacaactatccagcatatttgaaatcttc

SEQ ID NO: 49141 - DNA, 101 bp, rice(Oryza sativa)
  misc_feature (71): n=t or g
gttcaaatctgtagctgacgccagcactcatcagcaaacaggtgacatccacatgctagatcggctttcanatgagaaatcaaaacgactgttcaatgaaa

SEQ ID NO: 49142 - DNA, 101 bp, rice(Oryza sativa)
  misc_feature (71): n=t or c
aatatttagaaacgaagggagtattagggagcggttgagcgcgccaaatagtgtagtgctattaaaacaanagtcttttgcacatgtaagagcagaggatc

SEQ ID NO: 49143 - DNA, 101 bp, rice(Oryza sativa)
  misc_feature (71): n=a or c
gaagtaatttgatttcttggagtgctagaaaacaacccactgtttctagatctagtacagaagccgaatanaaagcacttgctaatgcaactgcagaaata

SEQ ID NO: 49144 - DNA, 101 bp, rice(Oryza sativa)
  misc_feature (71): n=t or g
catcttctcccccggtacgagggagaagtagttgtcggagtagtggacagggaggattcttgtgtccttgnaaacatcctgactggatgatggctcagatg

SEQ ID NO: 49145 - DNA, 101 bp, rice(Oryza sativa)
  misc_feature (71): n=a or g
cttatgttattgattgttacgtaagccgcggaaaagaaaaatcaataacataacggtgaaatcgagttccnatcaggattttgagaggatattgcggcgca

SEQ ID NO: 49146 - DNA, 101 bp, rice(Oryza sativa)
  misc_feature (71): n=a or g
ctaacttatagaaaaacttcttcaacccttaccgttaggcacacaaacaatatgtcatgactctctgaaangcctagttaagcaacaaaatacatcatgcg

SEQ ID NO: 49147 - DNA, 101 bp, rice(Oryza sativa)
  misc_feature (71): n=t or g
tttttgaacggaactgataactgatctctgaacatctgcagttgtgcatgtttgtgctcgtttttggggtngatggagttttacttagcttttcttgaaat

SEQ ID NO: 49148 - DNA, 101 bp, rice(Oryza sativa)
  misc_feature (71): n=a or g
caccaatcccattttctcccctagcttttgtttctgagtgtcaatgttggcctagtagagtgatttcgccnttggtgtcctttccgatctcaatgctcaaa

SEQ ID NO: 49149 - DNA, 101 bp, rice(Oryza sativa)
  misc_feature (71): n=t or c
ggccgccacagcatcatctcctcctcctcgttcccctgtttccctcctctcgtgctctcgtgttctacttntgctagtcctcccaccctacttcgatggcg

SEQ ID NO: 49150 - DNA, 101 bp, rice(Oryza sativa)
  misc_feature (71): n=a or c
tacaattgataggaacgactgaaacagattcaattagctgtcctacctaggaaacttgtacactttcgccnagacaaaaatcggcctacacatggttccat

SEQ ID NO: 49151 - DNA, 101 bp, rice(Oryza sativa)
  misc_feature (71): n=t or c
accgcacgcgctaatcaacctcgtgtcatacgtacgttgaatactgtattgttcaactgatcgattacacnggtggtgaaacccttattagttttggttgg

SEQ ID NO: 49152 - DNA, 101 bp, rice(Oryza sativa)
  misc_feature (71): n=a or g
ttttttcttttcaggtatttcccatatctgatctcaaaaacttaattagtgccaggtcatacagattccanataattccataggtttaattcgtggtacgt

SEQ ID NO: 49153 - DNA, 101 bp, rice(Oryza sativa)
  misc_feature (71): n=a or g
cgtacttgatagtagatgtattatatatctttttccgtattattacatcgacacacaattgggcaacaggncatcttcctgtcagagtatcaagacaatat

SEQ ID NO: 49154 - DNA, 101 bp, rice(Oryza sativa)
  misc_feature (71): n=a or c
tcttgtccgtcctgcagccccccgagtatgggatccaaaccagcaaagaatctgggtgttccaaagacatntaattcgctgagctgaccctgggtgaggag

SEQ ID NO: 49155 - DNA, 101 bp, rice(Oryza sativa)
  misc_feature (71): n=t or c
tacatcgaggtaccggtacctcatggtaataagtcgtttatgatcgttagatttagctaggtaggatgagnattgttagatcaaaaaatcaaaaacgattt

SEQ ID NO: 49156 - DNA, 101 bp, rice(Oryza sativa)
  misc_feature (71): n=t or c
aggcaatttcctctcgatgttggagagttgagggtgctagccatctaggtaaagggtgtagatgccacacnggctaacacgtttggcatgggcagctggac

SEQ ID NO: 49157 - DNA, 101 bp, rice(Oryza sativa)
  misc_feature (71): n=a or g
ccttggctgcctggcacaattatgcggatcgttggcccaatacgcggtttctccaacctctagccatccgnagaccttcagcaccctaccttatcatccat

SEQ ID NO: 49158 - DNA, 101 bp, rice(Oryza sativa)
  misc_feature (71): n=t or c
cacttgatctgtcgcaagtttctaaataattagacaaattacatattagtacattccattccacttacatncgagttacaatatatatatacactatgatt

SEQ ID NO: 49159 - DNA, 101 bp, rice(Oryza sativa)
  misc_feature (71): n=a or c
caatcaagtggagtaataaccaaatagtaaccgttactgtctctcggggaaacctatgtggcctgtacggngacatcgtcaagagggcgaccctggtacga

SEQ ID NO: 49160 - DNA, 101 bp, rice(Oryza sativa)
  misc_feature (71): n=t or g
cgttccctcaaaaaaaaattctgggttcaactttcaaccttgtgggtatatcaaaaaaaaaagcaccccanactttattagtattttcttcctggagaaag

SEQ ID NO: 49161 - DNA, 101 bp, rice(Oryza sativa)
  misc_feature (71): n=t or c
gatagagcatatttattccgtccaatcaaaatttggcaattatgctaacttgccaaaaagttaacattacnaaatttcgatgaggttggttttggcagtaa

SEQ ID NO: 49162 - DNA, 101 bp, rice(Oryza sativa)
  misc_feature (71): n=a or g
aggattgactcgtattaatcttatttgagttggtggtgtttggtggttagaacctccctagaatcgatgcntgtgcctcggaagctgggttttagacttct

SEQ ID NO: 49163 - DNA, 101 bp, rice(Oryza sativa)
  misc_feature (71): n=t or c
ttttttaattggatcattagaagctacttttgaacttgtaatcgaaacatggagggaataaaaggttgggncatgagctactgtttattttttatttttat

SEQ ID NO: 49164 - DNA, 101 bp, rice(Oryza sativa)
  misc_feature (71): n=a or g
ccacccaacagcctgccaggtaacctaaaagagttgcaaatagaggagtgctcatttgaactagaggcacnatgccagaatccaacaggagatgcgcggcc

SEQ ID NO: 49165 - DNA, 101 bp, rice(Oryza sativa)
  misc_feature (71): n=a or g
ctcactttcattttaattttcaggaagattattgatgataacaaagatgagccagcagttcgaacttctanatcaacagccagtgtattagatgatgaccc

SEQ ID NO: 49166 - DNA, 101 bp, rice(Oryza sativa)
  misc_feature (71): n=t or c
cagaattgagagttcacatatcctcagtggtcagagttcagagttgagacgacagccgagccttgcatatngagcagacaagctcccatggcttcgtacac

SEQ ID NO: 49167 - DNA, 101 bp, rice(Oryza sativa)
  misc_feature (71): n=t or g
ttaatgccttgtagcttaattacacaccaaaagtcccacatttatgtgctacatgacggtacatacatttnggttcgcgtcactgaagtcctctggcacat

SEQ ID NO: 49168 - DNA, 101 bp, rice(Oryza sativa)
  misc_feature (71): n=t or c
atgctggagcgatgaaagagcgtgtcatcaatgctggagctcgagaatatgtggtcacagcaccgatggcngacgacaaagcccaaggtgtcggacctcct

SEQ ID NO: 49169 - DNA, 101 bp, rice(Oryza sativa)
  misc_feature (71): n=t or c
tcagcgcctcaatagtttctttaacaatgttggcattgaacatcatgtcgcctgcccctatgcttaccagnagaacggatcagttgagcgcaaccatcacc

SEQ ID NO: 49170 - DNA, 101 bp, rice(Oryza sativa)
  misc_feature (71): n=t or g
gttcaattcatgataggcaagtatgctacttacactctgaatcagttttgacccattttgcaccatcatcntctagatcacgcagtgcatcctccaggcac

SEQ ID NO: 49171 - DNA, 101 bp, rice(Oryza sativa)
  misc_feature (71): n=t or g
aattcagtgtaatagtttataggtgaggtgacaccaaatagtccgaacagagaaattggtggtaccaaaantggggagaaatcacaaaatggaggttgata

SEQ ID NO: 49172 - DNA, 101 bp, rice(Oryza sativa)
  misc_feature (71): n=a or c
ggtacatgaaaccagctgactcagtcccttcaaggtattccctcaacatatttggatgatactccagaatntctctatagatgagttcccttatatcttcc

SEQ ID NO: 49173 - DNA, 101 bp, rice(Oryza sativa)
  misc_feature (71): n=t or c
acagaatgcagaaaaccattaaggaaaacccttgtccgatcgaccggaaggctaaccataacttcatcatnccatccatttacatggagactccataaccc

SEQ ID NO: 49174 - DNA, 101 bp, rice(Oryza sativa)
  misc_feature (71): n=a or g
tcacgtgtagcctatccactgtccacactgttttgaatgattaaccatgagaaaaacttgcatttgttccntaggatcttgtcatgttatttttactactt

SEQ ID NO: 49175 - DNA, 101 bp, rice(Oryza sativa)
  misc_feature (71): n=a or g
tggtgcccttaatcaatcgtcgacactgacaagctccttgaaaaccgtgtcattttaccatgctcctccgncatggccactaatctcctcggccgccctaa

SEQ ID NO: 49176 - DNA, 101 bp, rice(Oryza sativa)
  misc_feature (71): n=t or c
catgggttgtgggtttttttttttgctagctttcccaacttaatcgtctcatttttcgcgcacatattttncaaactgcaaaacggtatagtttttataaa

SEQ ID NO: 49177 - DNA, 101 bp, rice(Oryza sativa)
  misc_feature (71): n=t or c
tgctccacttgtcggaagagggttggtcttaccggattcaactgccgatgtggcaacttgtactgcgcaangcaccgctattccgataagcatgactgcca

SEQ ID NO: 49178 - DNA, 101 bp, rice(Oryza sativa)
  misc_feature (71): n=t or c
aatggaagggggctatctttagtatgggaagttgataccgcggtctggaaggatctttggaagactacgangccagggaagacgaaaataaatgttcggag

SEQ ID NO: 49179 - DNA, 101 bp, rice(Oryza sativa)
  misc_feature (71): n=a or g
acgaatcaagcacaaagaattcaaggctggggacaaggtgctgctattcaactcatgggtgaagcttttcngacatggaaaactttgaagtaaatggatag

SEQ ID NO: 49180 - DNA, 101 bp, rice(Oryza sativa)
  misc_feature (71): n=t or c
taattatggataaaccactgctgagaaacccatctttagtcccagttgagcagcttatgaactatttgaancgggacaaaagtgatttttagtaaagatca

SEQ ID NO: 49181 - DNA, 101 bp, rice(Oryza sativa)
  misc_feature (71): n=a or c
caccaaaatgtacatagcaacaagaaaatgggttcagaacatcgtcatcataccttaacaattcctggagnaaatgctgcagtcctgcactcgttcttctg

SEQ ID NO: 49182 - DNA, 101 bp, rice(Oryza sativa)
  misc_feature (71): n=a or g
tgtcgtcaatgtgagggttcgtgtcaaaaactcgaattttccgttgaaaccctttctgttgggacgaacgnttattaaatcttcacggaaatttcgcagga

SEQ ID NO: 49183 - DNA, 101 bp, rice(Oryza sativa)
  misc_feature (71): n=a or g
gaaacatgaaagctgagaaggcctaaatggcatcccacataaagtgggaatgtaactaccttccacaaccngaggtgtatactccaagtagcggtatagcg

SEQ ID NO: 49184 - DNA, 101 bp, rice(Oryza sativa)
  misc_feature (71): n=t or c
aagaggactctctcccaacaacataaagtcttgctaactgcggtccataatcaatgaatgccccttggccnaggctaaactcaaaaggcaagcctcctcac

SEQ ID NO: 49185 - DNA, 101 bp, rice(Oryza sativa)
  misc_feature (71): n=t or c
aagaagcataccatatagagtaaataagccaaagaaagaggtgtagtacgcaacagtattctgaacggaangaagaataacgcatcagaaggcacggatgg

SEQ ID NO: 49186 - DNA, 101 bp, rice(Oryza sativa)
  misc_feature (71): n=t or c
tgtgagtaccactaatggctggaaataaaattgtatttctttcgggagaaagaaactcaccaaactgacancatgtttagatcccaattttttcttcaaac

SEQ ID NO: 49187 - DNA, 101 bp, rice(Oryza sativa)
  misc_feature (71): n=t or c
agtcttctggaggtgctaatagatgtatggatacgtgatgagtgtgtgtgcgttatgagggccgcatttanattgtgtttataaaaaaatgtaaataggct

SEQ ID NO: 49188 - DNA, 101 bp, rice(Oryza sativa)
  misc_feature (71): n=a or g
atgatttcaactgaaaagtcatcaacaagagatgtataactcaccacatgactctttccagtgttcgattncttttctttcaagagatgaggttcaaaagt

SEQ ID NO: 49189 - DNA, 101 bp, rice(Oryza sativa)
  misc_feature (71): n=a or g
gttgttattgtgattgctggttcgggtgtgttcatttcttgctgctgatttcttggatgcagggatcgganaggggtgaagatgtcgggtgctgctctcgt

SEQ ID NO: 49190 - DNA, 101 bp, rice(Oryza sativa)
  misc_feature (71): n=t or g
ttttttttaccaggttcctaagcatcccctctcctatctagttccgcccctaccaaagttaaatcctgtcnatggctaactacaaaattactttatattgt

SEQ ID NO: 49191 - DNA, 101 bp, rice(Oryza sativa)
  misc_feature (71): n=a or g
tcctagtactacaaatctggacagggagctagtggcttcaagtcttcaacaaaattatgattactgttgtnctagtggtctcattcagtaaaaggaagtgc

SEQ ID NO: 49192 - DNA, 101 bp, rice(Oryza sativa)
  misc_feature (71): n=a or g
attatgaagggcttgttatcattaagaaagccagttggcatggatgttaccagcattaagttgaaaggggncataaataacaagagattagtaactataaa

SEQ ID NO: 49193 - DNA, 101 bp, rice(Oryza sativa)
  misc_feature (71): n=a or g
tcatccaaaaggccatcacccatcttatttctcaacatcttgttctctagtgtgctcctcaatcacaaccngggaagaaggcaatttaaaagcattcttct

SEQ ID NO: 49194 - DNA, 101 bp, rice(Oryza sativa)
  misc_feature (71): n=a or g
aaaatataaggttacagaacacaggaaaaacttatagggatggtatttaattaggcaggttggagctcatnctaactatccttcaaaatctcaatacgatt

SEQ ID NO: 49195 - DNA, 101 bp, rice(Oryza sativa)
  misc_feature (71): n=a or c
aagaaggttgtgcactgcatctgcatcatcttcttcggcaggccagataaccgcgaggccctcaaactcantgggaggatggcggagcaccccggtgcagg

SEQ ID NO: 49196 - DNA, 101 bp, rice(Oryza sativa)
  misc_feature (71): n=t or g
gatcgataggacggcctcctaattaagccttgtattccttcagaaaacaaaagctgttttttctttctgtntttgataaattagtttttactaggaaaaat

SEQ ID NO: 49197 - DNA, 101 bp, rice(Oryza sativa)
  misc_feature (71): n=t or c
agattggtcaatgaaagatacgattttactgaaaatctgagggaacatattatgaagaaatgtcacatggnttctaagcttaaatcaatggaaatggaaat

SEQ ID NO: 49198 - DNA, 101 bp, rice(Oryza sativa)
  misc_feature (71): n=a or g
acgcactgtcaccaatgttggccaagttaatgccgtgtataaggcattcttccaagctccagctggtgtcnagatggccgtcgagccaccagtgctggtgt

SEQ ID NO: 49199 - DNA, 101 bp, rice(Oryza sativa)
  misc_feature (71): n=a or c
gtacgtgctgacaagcgttgagttggtctaattaatcatcttaatgactagctaattatctatctattatntattatctatctatctatctatctatcttc

SEQ ID NO: 49200 - DNA, 101 bp, rice(Oryza sativa)
  misc_feature (71): n=t or c
gaaacatcagacatcaaagcttcacacacatacacatgtagcgatgaaggaaacaagagttcaatgaaggntaaggaataaggaacagcgaaaatggagta

SEQ ID NO: 49201 - DNA, 101 bp, rice(Oryza sativa)
  misc_feature (71): n=t or c
tatctctcttcgttcgtgatgcctccaaagccagcagctcaatgttatttacaaatgtattttttttactnggcctttacatccaatcgactatataaagc

SEQ ID NO: 49202 - DNA, 101 bp, rice(Oryza sativa)
  misc_feature (71): n=t or c
actcagcgtgggacccacatgggccccatgtgttagcatcttttttccccatcccctctccacctctcttnctctctcctgtcttcttcacgggcaccggt

SEQ ID NO: 49203 - DNA, 101 bp, rice(Oryza sativa)
  misc_feature (71): n=a or g
aatcaacgggtgttcaaacacactgagcctcactctgctactatcatacaacaaatcaaggaaaatctacncctgtgggtccatcgccttaagccaagcct

SEQ ID NO: 49204 - DNA, 101 bp, rice(Oryza sativa)
  misc_feature (71): n=t or c
cgtgttatatatttggttcagagagagaaacggtgtggaaagtaccaatttgcctctatgtccattgtcangcctagaaatttagccaaaaattccagact

SEQ ID NO: 49205 - DNA, 101 bp, rice(Oryza sativa)
  misc_feature (71): n=t or c
tataaaggggttaaaactaaatactacaaagctagccttgataatattgccctcttcatatagatatggcngtataggtctaattgtaagatagtttagga

SEQ ID NO: 49206 - DNA, 101 bp, rice(Oryza sativa)
  misc_feature (71): n=t or c
aacctgcagtttacatgacaaaagtacaaagacagctttgacctcacggtactgaatgtctgaatctcttnttcatctgcaccacatctttcatagtactg

SEQ ID NO: 49207 - DNA, 101 bp, rice(Oryza sativa)
  misc_feature (71): n=a or g
accaaaccatttagtagtcactttgcaatcatttgcttgggcggttgtcttcaccccgttagttttacacntacttggtggaagatgagccttcaagatgt

SEQ ID NO: 49208 - DNA, 101 bp, rice(Oryza sativa)
  misc_feature (71): n=t or c
acctggacccaaattaattaagaaccggtcatacatagggatacaggtaactaacccacgaatctacttanaaatcaacataaatggattattttgatcaa

SEQ ID NO: 49209 - DNA, 101 bp, rice(Oryza sativa)
  misc_feature (71): n=a or g
tctcgcattggaaatccatttttctgaaaattcccgcgaaacctttgagatctgaagctcaactttgactnaaatgcattttcaacggagctcccttcaca

SEQ ID NO: 49210 - DNA, 101 bp, rice(Oryza sativa)
  misc_feature (71): n=a or g
aatttttttgcaacgccaatatcgttggcgcagtgatccaacataacgacactaatttcatcgcataaatngatcagaggcataaatagtgtgccttgccc

SEQ ID NO: 49211 - DNA, 101 bp, rice(Oryza sativa)
  misc_feature (71): n=t or c
tacaatgataaccattggggacggagcaacatcacatttttgggacttagcctggatgcacggtcgccacncgaaggatgtcatgccacaagtgtacacaa

SEQ ID NO: 49212 - DNA, 101 bp, rice(Oryza sativa)
  misc_feature (71): n=t or g
tctttatggtcataaacctcgttattttgggttgacggcctctgctgcatgttctgcaccggaattatcanattggcttcatgagagagacaagatgcaga

SEQ ID NO: 49213 - DNA, 101 bp, rice(Oryza sativa)
  misc_feature (71): n=a or c
tgaccctgaccccttcctctgtggccttgagcatgaagcagatgggcgcaatcctgggcatcatggacagnatcctcggcgggtaggtcatcaccctcgcc

SEQ ID NO: 49214 - DNA, 101 bp, rice(Oryza sativa)
  misc_feature (71): n=t or c
tctcggatgtagggggcataggtacgtatgttggccttggtattctactagtatatacgaagcgatgcccngcgtaagggatgattggtcagaccaggtta

SEQ ID NO: 49215 - DNA, 101 bp, rice(Oryza sativa)
  misc_feature (71): n=t or c
agcatcctctaataagtcatcatctccatcactaagatcatagtcactgtcaaacaattcctgctgttcanctccatcaggttcttgttgttcatctccat

SEQ ID NO: 49216 - DNA, 101 bp, rice(Oryza sativa)
  misc_feature (71): n=a or g
aagtcacctagctcctccaactcctccatgagcttcactcgcctcctcccaaggccaccttggtctactcnacaatctgagtgcagtctacctctcctcca

SEQ ID NO: 49217 - DNA, 101 bp, rice(Oryza sativa)
  misc_feature (71): n=a or g
tccagtactgtagcatcttccccagaaggtatgagcttgaacgtgacaatcttgttcgtatgtggatagcncaagaatttgtgaaggacaatgatggaaac

SEQ ID NO: 49218 - DNA, 101 bp, rice(Oryza sativa)
  misc_feature (71): n=a or g
ctattctctggccatccaatgcgactggaaaaaagataccatgaaaaacaggcaagccagttgtactttcnaaccttcaaccatgcccacgtccatggaga

SEQ ID NO: 49219 - DNA, 101 bp, rice(Oryza sativa)
  misc_feature (71): n=a or c
aaccttaagcattgcaatgagccagtaatttttgatggatataaaatccttgggagggacaatgacagagnaaatgtaaagaatttgctcttccaaaatga

SEQ ID NO: 49220 - DNA, 101 bp, rice(Oryza sativa)
  misc_feature (71): n=a or g
tgaactcgcagtgctttctaagaaggccatggagattggtgggtcatcgtataaaaaactagaggagatgntccatgagatcagtgagctaactcgtgata

SEQ ID NO: 49221 - DNA, 101 bp, rice(Oryza sativa)
  misc_feature (71): n=a or g
gtctctgtgtttgtgctatgtttcaaaaagaaatatatggttgtattcgtagcgaaacatttttcccttcnaaatatttcctatccattggaataactttg

SEQ ID NO: 49222 - DNA, 101 bp, rice(Oryza sativa)
  misc_feature (71): n=t or g
cgtggtgcgtgtgcagtgttatcggcgccgtgatcattgtcgtggggctgtacaccgtgctctggggcaangggagggacttggacggcgccgccgtcgcc

SEQ ID NO: 49223 - DNA, 101 bp, rice(Oryza sativa)
  misc_feature (71): n=t or c
tgatacggactaaggaggcattatcttcccgactataactctaacgcctcctattttaggaagataatttncttctctattcatcgtattttcttaataaa

SEQ ID NO: 49224 - DNA, 101 bp, rice(Oryza sativa)
  misc_feature (71): n=a or c
tagtgatgcgtttgtgcgtgcttttgcagtttatttgaaacaagtcagtttcattgagaattggaacttgnagcggatgcaccgccgcggctatatcacag

SEQ ID NO: 49225 - DNA, 101 bp, rice(Oryza sativa)
  misc_feature (71): n=a or c
tactgaaggaaaaaaaatatttctttattttttccaatctactcagcatgactaaattgcaagctactctngactaccactttttctactattgctcattt

SEQ ID NO: 49226 - DNA, 101 bp, rice(Oryza sativa)
  misc_feature (71): n=a or c
gataatcagtgcactcaccagattgggccccacccacagattaaaaataaatgtcaacaaaaaactctgcncctccccagctctcctatggacaccttcag

SEQ ID NO: 49227 - DNA, 101 bp, rice(Oryza sativa)
  misc_feature (71): n=a or g
aaagcgtcggttttgactaagagcaggtaccgtacaatagcattctataagcatacttcctacgtcccacnatacttggctttctagtatttaaaaattat

SEQ ID NO: 49228 - DNA, 101 bp, rice(Oryza sativa)
  misc_feature (71): n=t or c
ccatcaatgtaagtgtactcgacaggcattctgcgttttccttccgagatcacattgtgacttgattaagngtaggctcttcttctgactaacatcatcgg

SEQ ID NO: 49229 - DNA, 101 bp, rice(Oryza sativa)
  misc_feature (71): n=t or c
taagtattatcagcttggagggagtaacagaattctctcccctattgcatgttcagaggagcaagtccaantggtggctgatctattgcaatgtgctgtga

SEQ ID NO: 49230 - DNA, 101 bp, rice(Oryza sativa)
  misc_feature (71): n=a or g
cctggctgacttcatcgcggaatggaccccagtggatgaacctgttccatccgatgtccctttcccccctngagaggaagaggatccaaacgccgacattc

SEQ ID NO: 49231 - DNA, 101 bp, rice(Oryza sativa)
  misc_feature (71): n=a or g
tgaaacaagaaggatgtagaaagctgatggaaagagattgatggacatacctcaggaatttccgtcgtatncgccattgctgctttagggatgttgagtca

SEQ ID NO: 49232 - DNA, 101 bp, rice(Oryza sativa)
  misc_feature (71): n=a or g
gcattaacgaaaacagcgagagagcagcagacttggattgacaagacagaagcaaaatctcaactccgcantcttaataagaattttgatggcctcctcct

SEQ ID NO: 49233 - DNA, 101 bp, rice(Oryza sativa)
  misc_feature (71): n=t or c
cttgacgaagactcgacttgcttgttggtctcgtctcgtccttttttgaaggaagttgctatgatgttctnttctaatcttcttttttttttttggaccca

SEQ ID NO: 49234 - DNA, 101 bp, rice(Oryza sativa)
  misc_feature (71): n=t or c
aggcgggtgaggtttcctggaaagcagagctgcagcgtttttagggaatcaacatgtttaatctcaagttntccaagtgatagcggtaggagccatcttcc

SEQ ID NO: 49235 - DNA, 101 bp, rice(Oryza sativa)
  misc_feature (71): n=a or g
aagaatctaataaagacaagcaagcacattccctaaaggttgaatggaacatatttggcctcatcttttcncttatgtatatttatcaactaaaatttaaa

SEQ ID NO: 49236 - DNA, 101 bp, rice(Oryza sativa)
  misc_feature (71): n=t or c
taaagggggttaccaaccaggagtaaaaaagatttcttcaccagtatgctaaagatgggcatctttagtcncggattcctactcccggttggaaccctgga

SEQ ID NO: 49237 - DNA, 101 bp, rice(Oryza sativa)
  misc_feature (71): n=t or c
gcaattgcgcgggccacccagctagttcagatcaaaaggagagaaattgcaggcaaaatctgaactgaagntgttctatgcttgttcaaatagctaaaatg

SEQ ID NO: 49238 - DNA, 101 bp, rice(Oryza sativa)
  misc_feature (71): n=t or c
tctctatctcctatagaatttcctcctccatctgatcattgatttatggattttatttatccaattattcnaactatgtcactatagtttaataaagcaac

SEQ ID NO: 49239 - DNA, 101 bp, rice(Oryza sativa)
  misc_feature (71): n=a or g
tggagaggcgagctgtccttcttcagttctacggcaaattaaataaaactcgatcagctggctctgctccnatccttaattaatttgaagacaagatttgt

SEQ ID NO: 49240 - DNA, 101 bp, rice(Oryza sativa)
  misc_feature (71): n=t or c
ctctcccaggctagcggaaggagaagtctaacactcctcctcccgagcccggctccatctcccttttcccnggggggcaaagcggcaacgccgctaccagg

SEQ ID NO: 49241 - DNA, 101 bp, rice(Oryza sativa)
  misc_feature (71): n=t or c
tctgtacagtatagctgtctttgttcgtttctccatcaaggaggagatgaaattttggattctcgtggcangcttttcaaactactaaacagtgtgttttg

SEQ ID NO: 49242 - DNA, 101 bp, rice(Oryza sativa)
  misc_feature (71): n=a or g
aggtgaaagggatcccttaagaagctggttttgtgcatccttcacctgaacaggcatcacaggtgaccggntttcctttatttgttggtgttgcacatcct

SEQ ID NO: 49243 - DNA, 101 bp, rice(Oryza sativa)
  misc_feature (71): n=a or g
agcaaacgggaacccggctcttctacacatgcaaatttatcccatcctacagcacgccaaatagtatgaanctcagcatccatacctatccttttcagaag

SEQ ID NO: 49244 - DNA, 101 bp, rice(Oryza sativa)
  misc_feature (71): n=t or c
ccattttctccctatatattcacatacacatatgcgtacatgccaattgccaagtagtagtagtatgcacnggatgtgtcacatcctccacataaaatcct

SEQ ID NO: 49245 - DNA, 101 bp, rice(Oryza sativa)
  misc_feature (71): n=a or g
cttggaaattgctaaaatagaaagtgctgataaaacacctcccaagtagccaagcagggatagatccaacntgggcgttgtggggactcaagtcccctctg

SEQ ID NO: 49246 - DNA, 101 bp, rice(Oryza sativa)
  misc_feature (71): n=a or g
ctttccaatgaacatcttctggatttgtttatatctaaaaagaaccattggtcatgcgcttccctgcaccnagaaccaattggttctagtaggttattgta

SEQ ID NO: 49247 - DNA, 101 bp, rice(Oryza sativa)
  misc_feature (71): n=a or g
atagaccctagaaaaaaaattattcaagggctagaccctttttcttggcaccagtggccatcagcccatcnctactaaacaaaatcatttttcatagcacc

SEQ ID NO: 49248 - DNA, 101 bp, rice(Oryza sativa)
  misc_feature (71): n=t or c
gggtagtcatctagtttgtatagtagttagttgccgttcttctttatcgcttgatagcatatgggttcatngggtcttggatattatatgttacacacaat

SEQ ID NO: 49249 - DNA, 101 bp, rice(Oryza sativa)
  misc_feature (71): n=t or c
gccgcggcgcccggaagccggcgaggaaggcctccattgagaggtagcgtggcgatgagaagaggagcagnagcagctggggatagaattgattgagcaca

SEQ ID NO: 49250 - DNA, 101 bp, rice(Oryza sativa)
  misc_feature (71): n=t or g
atcggttcgatgaacagaagcccatcattctgatccaagcacgatatgactgggagcacttgcgattccangacttcgactctgtggccgagtacgattca

SEQ ID NO: 49251 - DNA, 101 bp, rice(Oryza sativa)
  misc_feature (71): n=a or c
ttactgccggagaacagacatgcaattgttagctggccacagatttatccagtcacatgagtgctactccntccattttaaaatataatacataattattt

SEQ ID NO: 49252 - DNA, 101 bp, rice(Oryza sativa)
  misc_feature (71): n=t or c
taccaaaacaaagagaggagaaatagcaaagaggcatgcaatcgatctagactgtttggtgaagacaaganggatattttccgcgtcgttgagtctatcct

SEQ ID NO: 49253 - DNA, 101 bp, rice(Oryza sativa)
  misc_feature (71): n=t or c
ggggaaagtcggttgcttggtcagcaagaacgattatgacattaattaattgggccgatcaatggcggccncagatcctggccacctgggccatggcatgg

SEQ ID NO: 49254 - DNA, 101 bp, rice(Oryza sativa)
  misc_feature (71): n=a or g
gcttgcatgatcagatgatcagatcactgacctcaacatagaaatttcttcagtgctcctcaagctggganacctcgatgagagtgaggtgagtgtcgaag

SEQ ID NO: 49255 - DNA, 101 bp, rice(Oryza sativa)
  misc_feature (71): n=t or c
ttcaacgccttgcatgacgctaggagcacgcacgtaaacctgctaaactcagcaaacgtgatcctcattcnaaaaaaggatggggctgagggaatctagga

SEQ ID NO: 49256 - DNA, 101 bp, rice(Oryza sativa)
  misc_feature (71): n=t or g
taccttgacagtatgctggggaaacatgcaacaataccaatggctctacatgcagcagaccttacagcagnagctgtatcactcaatgcagcatgaatcta

SEQ ID NO: 49257 - DNA, 101 bp, rice(Oryza sativa)
  misc_feature (71): n=a or g
acgaaacaatgcatcaactaataatttatgaaatcctttaattccatggtcaaaactcagtctcacaattncctaatttatgaaatcctttaattccatgg

SEQ ID NO: 49258 - DNA, 101 bp, rice(Oryza sativa)
  misc_feature (71): n=t or g
ggatagacactctttggaagactgcctcgttttgaagaagtcgctcaagaaacatatggcgttggaaaaangcaagcgagtacgcgtggtcgaaaaggatg

SEQ ID NO: 49259 - DNA, 101 bp, rice(Oryza sativa)
  misc_feature (71): n=t or c
ggttgcatcttgcgtgtataccatggttcagtgctgaaagcaatcgtttcctaattcctactgagctacancacttagctacaacatcgatggttgggtgc

SEQ ID NO: 49260 - DNA, 101 bp, rice(Oryza sativa)
  misc_feature (71): n=a or g
cttctgtattcaaatcgaaataagtttgtgggtagcttaatttggtgctattatattctcatccgtcaagntggttcctggatatgttgagctggtttgct

SEQ ID NO: 49261 - DNA, 101 bp, rice(Oryza sativa)
  misc_feature (71): n=t or c
ctcccccagcgccgccatcggagaagaggtgcctcactttcgacctcctgctgcatctcctcgaggtggtngatccgatgcaggcgacggagggagaatct

SEQ ID NO: 49262 - DNA, 101 bp, rice(Oryza sativa)
  misc_feature (71): n=t or g
ttctactcttccggtctccgttgaacgagatttttgttcttttcacgtccgcttcggatttagtgttgttnatgccattgccgccggggcgtgtacgagtg

SEQ ID NO: 49263 - DNA, 101 bp, rice(Oryza sativa)
  misc_feature (71): n=t or c
aggagatggcggtggcggacgcgagccatcggagtaggtaccaccggacgagatcgccgcctgttctgcancgactcggggtcggggaggttgcgagtttg

SEQ ID NO: 49264 - DNA, 101 bp, rice(Oryza sativa)
  misc_feature (71): n=t or c
tcagtgaagaatctcagtcttcatctgggattcaacaaacggtgttctgtggacttggagacaatgacttngggtgtgtttggttaggcttttcaacctgc

SEQ ID NO: 49265 - DNA, 101 bp, rice(Oryza sativa)
  misc_feature (71): n=t or g
ttactatatataagtccattaaactttttagaaacgctattaagctaccacgtgacactcatataaaagcnggtaggttaccacatgtcatatctctaaat

SEQ ID NO: 49266 - DNA, 101 bp, rice(Oryza sativa)
  misc_feature (71): n=t or c
tggaaacaacaagaaccaacctaaaggagccgtcgccacgtccatctcctcgggcatatcttggtctacgncgtcctgcggcacataccgctcgagctcaa

SEQ ID NO: 49267 - DNA, 101 bp, rice(Oryza sativa)
  misc_feature (71): n=t or c
ggtagttcctctgggaagacatcggggtactcacacaccactggtacagcagttatatcaatggctttggngcccgaaagagcatggagttgtggggaatg

SEQ ID NO: 49268 - DNA, 101 bp, rice(Oryza sativa)
  misc_feature (71): n=a or g
cagtgagaaaagataatactccctctgtcccataatatatgtgatgttgaaggaaatagtactagaaaatntcacatccctctaaaatcttttagattatg

SEQ ID NO: 49269 - DNA, 101 bp, rice(Oryza sativa)
  misc_feature (71): n=a or g
cccgtaaatccgaccgagcggcgccctccatccacacacgagcgacacgcaagccggctaaagcaaaaagnaaaaaaaagacagatcagagatcgaatcaa

SEQ ID NO: 49270 - DNA, 101 bp, rice(Oryza sativa)
  misc_feature (71): n=a or g
caacacttagctcattttcaccggatatgtccccttctttcataggccaacggatctaggatccctttacnacttgcgaccgacgctttggcatcatcgag

SEQ ID NO: 49271 - DNA, 101 bp, rice(Oryza sativa)
  misc_feature (71): n=t or c
tcgtcatggttttttgtttgttgacgatgtcaaactgttctattaaccactagattggctttgagatcggnggtatggtctaaaggtttgctttgagattc

SEQ ID NO: 49272 - DNA, 101 bp, rice(Oryza sativa)
  misc_feature (71): n=a or c
ccctcgttgcttacattacactcaaagagttaacaaaaaaataattctttttgagaagatgtattagcatntgatatatcactccacaaatatgcatctta

SEQ ID NO: 49273 - DNA, 101 bp, rice(Oryza sativa)
  misc_feature (71): n=a or c
actgttactaattactgcaatggtaacaccatctgcaacaatgtgctactaccagctatacatattactcntatgtaatatgtagctacgacatggaggga

SEQ ID NO: 49274 - DNA, 101 bp, rice(Oryza sativa)
  misc_feature (71): n=t or g
agtatttctgagactaatctgttctttttttttcgtctgcagcaaggatcagcagttaacacctctagtancattgatgcttgtttggaaccttcgatggt

SEQ ID NO: 49275 - DNA, 101 bp, rice(Oryza sativa)
  misc_feature (71): n=a or g
aattgtagtgcatccttggttgaatccttgcaccaactcaagcacttgaggtatctgttcctagaatgcancgacatagctagactactacagaacatcag

SEQ ID NO: 49276 - DNA, 101 bp, rice(Oryza sativa)
  misc_feature (71): n=a or g
tagtcccggttgatgagaataaccgggagtaaagatagaaaatatctttagcgggaaaatatctttagccngctgcctcgttgccgacgccgtcgccgacg

SEQ ID NO: 49277 - DNA, 101 bp, rice(Oryza sativa)
  misc_feature (71): n=t or c
cgaagcggttttggttttacgtggcataagtcaacataagaaaataagtagtgtggcccacttatcaattntgcctcttctctcggtcaccacatttgggc

SEQ ID NO: 49278 - DNA, 101 bp, rice(Oryza sativa)
  misc_feature (71): n=t or c
gaaggaaaggattagcaaggaacgtgtttacttgattgtttttcagatgttaatgcgcatgtatcccaaantagatgaatactccgtcgcgttgctgcgga

SEQ ID NO: 49279 - DNA, 101 bp, rice(Oryza sativa)
  misc_feature (71): n=a or g
attataattgatagttaacatgaccatcaggggagatgggtttagtttaggctagttgacatcatgtgatngaaggcaatgtggtgtactattcaagtgta

SEQ ID NO: 49280 - DNA, 101 bp, rice(Oryza sativa)
  misc_feature (71): n=a or g
gctgcaggcgttggcggagcaacatgttgacgtgctcgagagcctggcaccctcggtcaggaagcgcgtcnatgtgctcatggagattcaggtaaagacaa

SEQ ID NO: 49281 - DNA, 101 bp, rice(Oryza sativa)
  misc_feature (71): n=t or c
cattggccaaagcgtacaggaatgttgttttggaacgtaattattacgtacaaattgaacaggatggttcnggagcctgaacatattccgggatacctgct

SEQ ID NO: 49282 - DNA, 101 bp, rice(Oryza sativa)
  misc_feature (71): n=t or c
taagtctatgtattttaagctccttaggttagcaaagtgttcttcggtgatgtcacctgccaggttattgnaactcaggtccaggtgatttaaacctgtga

SEQ ID NO: 49283 - DNA, 101 bp, rice(Oryza sativa)
  misc_feature (71): n=a or c
caatcatgttttatctgtcatgaccaacagagagtgtctgacaagtgatggaggaatggaccaatggtgtnggaggcccatatatatggccatatgtatat

SEQ ID NO: 49284 - DNA, 101 bp, rice(Oryza sativa)
  misc_feature (71): n=t or c
taaagccagaatcctatttttgaggttagacaccaggaggcgctcatcatctgacaaagtcctagtttccngagctatgtccagctgaaagaccactttag

SEQ ID NO: 49285 - DNA, 101 bp, rice(Oryza sativa)
  misc_feature (71): n=a or c
cccccctgcaggagggggcacaaatgcagtgcgtcaaagcatcgcctttacaacattaagcaagttacaanggctataatgtccctaaagttggcgctgcg

SEQ ID NO: 49286 - DNA, 101 bp, rice(Oryza sativa)
  misc_feature (71): n=t or c
ggagtagtctattcaaatatactactccccgtttccatcgcctcctcactcccttccattccattcccttngcgcgcagcctcgtcgcctcgcctcgccga

SEQ ID NO: 49287 - DNA, 101 bp, rice(Oryza sativa)
  misc_feature (71): n=t or c
atacatacctcgaccaaacaatagcttatcaagttctttgctctttacatttcccattgtcttcagcctcnagttcaacacaatggaagctccattccgcg

SEQ ID NO: 49288 - DNA, 101 bp, rice(Oryza sativa)
  misc_feature (71): n=t or c
aagattgcatttttttttctaacaggtgaactttttttgttagatttcacccctacaattggtaacgtggnagaacaaaacagtagtactagtaaaacagt

SEQ ID NO: 49289 - DNA, 101 bp, rice(Oryza sativa)
  misc_feature (71): n=t or c
ttagtttttttttttttttttactttgctcggatgaaatttgctcgttttgtttcctgttcttgcgattgnaagtcattagttgatgggatagtgaaatcc

SEQ ID NO: 49290 - DNA, 101 bp, rice(Oryza sativa)
  misc_feature (71): n=t or c
gataacactagcatcccacatactttggtgtggcagctcgagcaactatatattgacgcagctgattccancaccgggttatagtaaaaaagttggtaact

SEQ ID NO: 49291 - DNA, 101 bp, rice(Oryza sativa)
  misc_feature (71): n=t or c
agacacaataatctagacaaatgctaccggacagatttggcactattggagctgatctaatctctatgatngaaaaaaaaatgtaatttctacacacaaaa

SEQ ID NO: 49292 - DNA, 101 bp, rice(Oryza sativa)
  misc_feature (71): n=t or c
agctcttgtgatctttgtttaaaaatgtgaaacaataatgcagcaaacaaaactagctactagctagtaantgatggtggcattagccagaagtgcttgcg

SEQ ID NO: 49293 - DNA, 101 bp, rice(Oryza sativa)
  misc_feature (71): n=a or c
tagttcattattaagcttaattatttgtgtgttcaggccatgtcagttggatgcagcatgaagacggcagnagcagcaggagtgacgtgccccttccttcc

SEQ ID NO: 49294 - DNA, 101 bp, rice(Oryza sativa)
  misc_feature (71): n=a or g
aatccaccgtcagaagaccactatggagaagacaattgttttaacagtattaaaaaaacacgaatattagnaaatgaactaatatcaaataattagaaggg

SEQ ID NO: 49295 - DNA, 101 bp, rice(Oryza sativa)
  misc_feature (71): n=t or g
gttcggatttgatgggctttatttttagttttgagatcatgtacatgggccgtgttgggcctaaacagaanaggcagttggtgggctgaattagttgtcgg

SEQ ID NO: 49296 - DNA, 101 bp, rice(Oryza sativa)
  misc_feature (71): n=a or g
aggaagttgtcatgaattgcccttttgcgaacaaaagcgctttgattttgggaaatcatttcgttgagccnaggggctagtctgtttgccatgatcttggc

SEQ ID NO: 49297 - DNA, 101 bp, rice(Oryza sativa)
  misc_feature (71): n=t or c
tccatcaggatatcatgtggcaggtctgaaaatttgcgagtcgaagtttttgtcagcgtcgaatgaagttnatcctttggtgaaggtggaggaaggcatag

SEQ ID NO: 49298 - DNA, 101 bp, rice(Oryza sativa)
  misc_feature (71): n=t or c
ctgctgtgctcgttgtagctctgaacagtcagaattccgatgctgccagtgttgccattgtagtcatcgtngtcgtcgatgtcgatgttgagagctcccat

SEQ ID NO: 49299 - DNA, 101 bp, rice(Oryza sativa)
  misc_feature (71): n=t or c
cgtttcgcttatacttaaaatcagccaaacaatggctctgatggagtaggggggaaaagttatggactcancaattacccaaaagtatttataagtcgtaa

SEQ ID NO: 49300 - DNA, 101 bp, rice(Oryza sativa)
  misc_feature (71): n=t or c
atcatttgatatattatttgctaataaataaagcgtccgaaatcgtctttttggcccgctgcacaatgcangtctgcacctttgccttttgcacgtgtgta

SEQ ID NO: 49301 - DNA, 101 bp, rice(Oryza sativa)
  misc_feature (71): n=a or g
catgttcaccaatgctgtactctgggcaggcgcacactaactctcagatgaacaaatttcttgagaccatngctgattggtacagatatgcagacaaccgg

SEQ ID NO: 49302 - DNA, 101 bp, rice(Oryza sativa)
  misc_feature (71): n=t or c
tttggttatgtttgatctggttcgttttggtggattttggtgtgtgcgtgccaggtgtttgacggaattcngcaatgccgagtggagggaggcggctgccg

SEQ ID NO: 49303 - DNA, 101 bp, rice(Oryza sativa)
  misc_feature (71): n=t or c
ctgaactttttatggtgtgtggttctgtgcaataggttctgttgtcacgagatgagactaatctggaatangagcaactcctactcatcacgagcaagtgc

SEQ ID NO: 49304 - DNA, 101 bp, rice(Oryza sativa)
  misc_feature (71): n=a or g
gatttcttcaagcgaagttattctcagttctaatcctcttcttgctggcgatcaaatcaggtgcatgatangcgccgccattaaatatattaattaatgac

SEQ ID NO: 49305 - DNA, 101 bp, rice(Oryza sativa)
  misc_feature (71): n=t or c
agatctgagtagcagggggggcaatcaatcagtggctacttaattaagcttgctggcttatcaagctttgntaaataatgagtgattgtgtgtgctatcag

SEQ ID NO: 49306 - DNA, 101 bp, rice(Oryza sativa)
  misc_feature (71): n=a or g
cctgctaaataaacatcaaacaaaatgattgtccatataattcgcgttgtatgcggccattgctttgcctnctttgcctctctccaatatttcatatctcc

SEQ ID NO: 49307 - DNA, 101 bp, rice(Oryza sativa)
  misc_feature (71): n=t or c
gcacataaagcaaagtttacaatgggcaaacatttgaaatagaggctcccgtggggtaataaagtagagcngcagctatgcagacatgataacagtcaata

SEQ ID NO: 49308 - DNA, 101 bp, rice(Oryza sativa)
  misc_feature (71): n=a or g
taggtttaggggttgtggtttttttttgtaccgacactaccgtgatattttctcttcgtttggagcagccnatcgaaggtgagagaggctttgacttgtgg

SEQ ID NO: 49309 - DNA, 101 bp, rice(Oryza sativa)
  misc_feature (71): n=a or c
caaaagaatcgtcgtcactggtagcaatagtgcacatcgatcgatccctcatcatttccatggccgtccangccattgtatttgatcatcattcgttcaca

SEQ ID NO: 49310 - DNA, 101 bp, rice(Oryza sativa)
  misc_feature (71): n=t or c
gtttgccgcaaagggtcaggcctgaatcctgaagaccggagccaaagaaaagggggcttttaactatttgncactcttacgaatggtgcttaatgatttgt

SEQ ID NO: 49311 - DNA, 101 bp, rice(Oryza sativa)
  misc_feature (71): n=t or c
aaaaaaaaaaacaagtcccaatctataacttcttcctccacctcttcccctctttactcacttccatttcnctgtgcccatgtgacgtcactacacgtccg

SEQ ID NO: 49312 - DNA, 101 bp, rice(Oryza sativa)
  misc_feature (71): n=t or c
ttaacgaaagaaaaaaaaaagatcagtcacaatgccattggttgataatatcttattataaactgtattcncttcgtttcacaatgtaatactttctacca

SEQ ID NO: 49313 - DNA, 101 bp, rice(Oryza sativa)
  misc_feature (71): n=a or g
agtacgtatagacttttccatgtttagttgtcgatcagttgtcatttgcgatgtcgataacgcgtgggtanacacagactggccaggtacagtccaacacc

SEQ ID NO: 49314 - DNA, 101 bp, rice(Oryza sativa)
  misc_feature (71): n=a or g
tggtgaaggaaaacggtttaaaaaattcagacgcgtgcagtagggatcgaacccaacaacctccaacttcnagttttgttcacctaaccactttccctatc

SEQ ID NO: 49315 - DNA, 101 bp, rice(Oryza sativa)
  misc_feature (71): n=t or c
tcagacctcataacagagaatggaacgtgggatatgggcaaaatatatcaatacttctttcccatagatgntgatgtaatatgcagaatctatatttcctc

SEQ ID NO: 49316 - DNA, 101 bp, rice(Oryza sativa)
  misc_feature (71): n=a or g
attggtttttttttttttggaatctaaccgtatttcatgaaccctagtcctgtcccgtgaggcggacaagnaggcgtgggggcctgatctggcccctgagc

SEQ ID NO: 49317 - DNA, 101 bp, rice(Oryza sativa)
  misc_feature (71): n=t or c
aaactattcgacctatgagcttaccgcttatacaatgtacgtacttcacaataaatagatactatacagcnttatgcatactatctgccaacataacataa

SEQ ID NO: 49318 - DNA, 101 bp, rice(Oryza sativa)
  misc_feature (71): n=t or c
taaaaaataaaagaaaagttaaagcgagttataacatgagatggatggagtactctgcaaagaattccagntatgccagcgaagtgagcaaaatattcagt

SEQ ID NO: 49319 - DNA, 101 bp, rice(Oryza sativa)
  misc_feature (71): n=t or g
accgacaccggtgagggtgaatccatcccatccggcctccagtttcgtctcctcgatcgccccgccgcttncttgcgccgatccccatcctgcgcccggcg

SEQ ID NO: 49320 - DNA, 101 bp, rice(Oryza sativa)
  misc_feature (71): n=t or c
tagcctcgtcgtcgtcgtcttcgatgccgatgatgacgacgacgtgtgagtagtagtgcaggtgcagccgngcttgttccgacgtcctaaccctagctcta

SEQ ID NO: 49321 - DNA, 101 bp, rice(Oryza sativa)
  misc_feature (71): n=a or g
ttgggcgatgatgatgccaaagcagcaaggaccgaggaaagaacgggcgtttctcctctttgacaagctcntgcacctccctaacagcctccctcatcgca

SEQ ID NO: 49322 - DNA, 101 bp, rice(Oryza sativa)
  misc_feature (71): n=a or g
gaagttgcttccatctttaggccaaatacaatctctcaggacacttcgtattgctagactgaatgcagtgntttgtataggccccgagttttatgggactg

SEQ ID NO: 49323 - DNA, 101 bp, rice(Oryza sativa)
  misc_feature (71): n=a or c
gtgtagagctggacagaatcacttgtctttggggttgaaaagagaactttagtacttttgtcattaggagnaaaaggatctggaccataaatctgcaatat

SEQ ID NO: 49324 - DNA, 101 bp, rice(Oryza sativa)
  misc_feature (71): n=t or c
ttgatatgactaaccttgttgatgcgggccgtatctgcaatgtcggccttgtcgtcgtcgtcgacatcaangtcggccggcgtcaccttcgccttggtgga

SEQ ID NO: 49325 - DNA, 101 bp, rice(Oryza sativa)
  misc_feature (71): n=a or g
caagaccccgcagctccatcctctggttctgatgtccaagtttcgagtggtttgaaaacaaccactcgtcngtttaacccagagcatatgtgccaaaacaa

SEQ ID NO: 49326 - DNA, 101 bp, rice(Oryza sativa)
  misc_feature (71): n=t or c
tgaagaaactcccgaggatgctttccacaagccatccaattgcagcttctaccgtagctccagctaacccnatcgtctcatggactaccgaagaccgcagc

SEQ ID NO: 49327 - DNA, 101 bp, rice(Oryza sativa)
  misc_feature (71): n=a or c
ttattgttattcctggtctcatgtgttcttgatgtcaacctaggagaacaatacggaaggtgatcctgaanttgttgacgattctgaattttaccaacaac

SEQ ID NO: 49328 - DNA, 101 bp, rice(Oryza sativa)
  misc_feature (71): n=a or g
gctataataggtattccattgatatgataggagcatcttgacattgaggtctcaggcaagtgggaaaaagnttgagctatgtgaactcaacaacattttga

SEQ ID NO: 49329 - DNA, 101 bp, rice(Oryza sativa)
  misc_feature (71): n=t or c
agtaaaagcataaaataaaaaggaaagcttgcaagcaattcataaagaagaatgtgactaccctttgaggnctttgtagctttctggatcttctacttaat

SEQ ID NO: 49330 - DNA, 101 bp, rice(Oryza sativa)
  misc_feature (71): n=a or g
ttttgtataactttgcttatttttcatgtctcgttagcggtagctcaatcaatcagagtcattactgtgtnattttataaaattaatccggtgaataacaa

SEQ ID NO: 49331 - DNA, 101 bp, rice(Oryza sativa)
  misc_feature (71): n=t or g
aaaattgtgtgttactattatagaagctcacaggtttgtaaaatcgacataagaagcaccatgcatcccantaatgttcatggaagactttgtgagttttg

SEQ ID NO: 49332 - DNA, 101 bp, rice(Oryza sativa)
  misc_feature (71): n=a or g
gtggcaatagaatgcttacccaccacatccacaaattcaccctccccaccgctcattgtcctattagcacngtgtattctactagcactaattgtactaag

SEQ ID NO: 49333 - DNA, 101 bp, rice(Oryza sativa)
  misc_feature (71): n=a or g
gtcgccaagtgtggcatcatgcaattattatggcaaagctgtattagtcatgatcgaagccacttggtgancttattcccttctactttgaaccaatactc

SEQ ID NO: 49334 - DNA, 101 bp, rice(Oryza sativa)
  misc_feature (71): n=a or g
acactatattttaatacacatgaaacattatgtaccacgaagaaagtataagtgctactccctccgagctnataatacttgtcgttttagataaagatgag

SEQ ID NO: 49335 - DNA, 101 bp, rice(Oryza sativa)
  misc_feature (71): n=t or c
gtgtattgaaaaaaagctttttttttcatttgcattcctatcgaaatcatgtttttcccgcgaaagggcangtagtctagtggttacaagagcctcaatag

SEQ ID NO: 49336 - DNA, 101 bp, rice(Oryza sativa)
  misc_feature (71): n=t or g
accacatgcagctgcagaagaaaaggccaagaagcatacccagattggccaagaaattgagtctcggatanggcctccaaagtgtgaaggttggagcttca

SEQ ID NO: 49337 - DNA, 101 bp, rice(Oryza sativa)
  misc_feature (71): n=a or g
tcactgcttaaaaggtgaatcttcagaagaggaaaaaggcctgcatgagaaactgcagaaagcattatctnatttggatgaagcatactctgcagtttctg

SEQ ID NO: 49338 - DNA, 101 bp, rice(Oryza sativa)
  misc_feature (71): n=t or g
tgctgacaagataaaaaaaaccctccatttcaagccagtagttttcaaatctaaaaattggggacttcggnatttctgtatgtatcgattttaactacaca

SEQ ID NO: 49339 - DNA, 101 bp, rice(Oryza sativa)
  misc_feature (71): n=t or c
tcctcgtcagctcggcgaatccttccgtggacatcctggtttcgtcggagcaccaaacggaaataaccttnagagaaggcgacctgtacttgcaaagttgc

SEQ ID NO: 49340 - DNA, 101 bp, rice(Oryza sativa)
  misc_feature (71): n=a or g
aaatccatcacattttttgtctgctctagtttcctagcagcctcaaagaaagcatcactacccatatttcnaaggctgcgataacgaaccatgtgttcaga

SEQ ID NO: 49341 - DNA, 101 bp, rice(Oryza sativa)
  misc_feature (71): n=t or g
tcagaataactgaagaaattactatagctacgtgtgccgtgtgatagaaatttttcatgtatactgcgtcntgtgtttggtacggcttcgtgtgattcatt

SEQ ID NO: 49342 - DNA, 101 bp, rice(Oryza sativa)
  misc_feature (71): n=a or g
gtcaaaaatcatgaaataaaaagggcatgtccctataaagcataaaatttcacttagcaatcaactatttntttgttatgtaattattaagcatgaacata

SEQ ID NO: 49343 - DNA, 101 bp, rice(Oryza sativa)
  misc_feature (71): n=a or g
acgcttttcgcaagcacgctgccacgtacaagacatcatggaagcgtcctgttggcggctgttaaatgccnattctataccgccaacatctgcataaagtt

SEQ ID NO: 49344 - DNA, 101 bp, rice(Oryza sativa)
  misc_feature (71): n=t or c
tcgtccacggatcaagtagagtagggatcagtatctaacgatgtgatgcgagatgccaaataatctagttnttggatcatgcacttggcgcagatacgggt

SEQ ID NO: 49345 - DNA, 101 bp, rice(Oryza sativa)
  misc_feature (71): n=a or g
tgatcgggcattcaccgttataaattactcctcgcctcaaaccaccgaggtggtactaaactttgccacantatacttctgctgctggctgttgccgatct

SEQ ID NO: 49346 - DNA, 101 bp, rice(Oryza sativa)
  misc_feature (71): n=a or g
aggattggtgtttgaccagcacttctcgcacctagcgctgaatgcagagttgaaggaggatttgaaggccncggagatgatggtgaaacagctggccacag

SEQ ID NO: 49347 - DNA, 101 bp, rice(Oryza sativa)
  misc_feature (71): n=t or g
atatattaactcgcaagtagcacagcgtgtaatatcacagcttgtcacacttgctgctgttgatgaagagnctgatattctggttagtgtttatttttgtg

SEQ ID NO: 49348 - DNA, 101 bp, rice(Oryza sativa)
  misc_feature (71): n=t or c
aaatcaggagcaagaaaccacaggacaatccggtcgatcttagcaagaaagaagagagctcgatcaatggngggtgcagcgaaggcgtcgtggatggtggc

SEQ ID NO: 49349 - DNA, 101 bp, rice(Oryza sativa)
  misc_feature (71): n=t or c
ggatttcttaagactcgaacagatgtaattagtggacatgcatgcttgaatgtgcttatccagtcaaaccnatgtgagctgtaagagtggatccttttctt

SEQ ID NO: 49350 - DNA, 101 bp, rice(Oryza sativa)
  misc_feature (71): n=a or g
tgttccattgaagtcgtttgaagccatatcagcaattctcagttctgtaaattcacaggtgtttccaccanccatatatgaaggatccattagttgtccag

SEQ ID NO: 49351 - DNA, 101 bp, rice(Oryza sativa)
  misc_feature (71): n=a or g
gttcagataattgacacgagaatcaaagtagcatatgctcttgcaaggcaatggtttggcatatacacaantgcagaggaggcaaccgatggtaagtcagc

SEQ ID NO: 49352 - DNA, 101 bp, rice(Oryza sativa)
  misc_feature (71): n=t or c
cgttgcctttgtttcatagtctgccactactcaaggatttttaaaccgagtaaagtggagatcatcctgcntgtactgttttcattcttctaccaactaga

SEQ ID NO: 49353 - DNA, 101 bp, rice(Oryza sativa)
  misc_feature (71): n=a or c
cgagaaggagcttcctcctcctcctcttcttcttctctgccatggagagatcgccgtcgtcgtcaaggtanctgagcgcggcgacgagccacggcggaagg

SEQ ID NO: 49354 - DNA, 101 bp, rice(Oryza sativa)
  misc_feature (71): n=a or g
tttctccgtcttaaaatatggtaaaaaacactatattaagacgggtagtattactttcgtactccccttcnttccaaaatataagaatttctagctttcaa

SEQ ID NO: 49355 - DNA, 101 bp, rice(Oryza sativa)
  misc_feature (71): n=a or g
ttaaatcctataaacctatagaagtgatcccatttaatatatgcaatcacaacacaaggacatatatgtgnacttttgcgtcttttcgtggattttgatct

SEQ ID NO: 49356 - DNA, 101 bp, rice(Oryza sativa)
  misc_feature (71): n=t or c
tttggtcaattgtttcctgttatcttcaataccaacaagatcatcttgaacaagttccagtagacaatctngagattgttttctttgaacatcagccagtg

SEQ ID NO: 49357 - DNA, 101 bp, rice(Oryza sativa)
  misc_feature (71): n=a or c
caagagaccttgggagtactgccacatataaaagccccatatccggcagacccaccacatatcagtaaccnactttagatgacaaatattgtagaggagac

SEQ ID NO: 49358 - DNA, 101 bp, rice(Oryza sativa)
  misc_feature (71): n=t or c
caatttgtgtgtattaattaccttaatttcttgttgacagaacgagtacggtgtctttactgtgatgacanggggattaagatcgtgcatcctattggggt

SEQ ID NO: 49359 - DNA, 101 bp, rice(Oryza sativa)
  misc_feature (71): n=t or c
tcaggtatactaccactgaggtggttgtctgaaagattcaacaatgtcaaattcttcagttctccgatgcngcgcgggatctctccagaaagggaattgtt

SEQ ID NO: 49360 - DNA, 101 bp, rice(Oryza sativa)
  misc_feature (71): n=a or g
aagtacgaaatatggacacatcatggcgaacatcaagtggatcggcccgaaaaaagaagttccgccagaanttgaagacatggagtacgccgatggttgtg

SEQ ID NO: 49361 - DNA, 101 bp, rice(Oryza sativa)
  misc_feature (71): n=t or g
tttttgcactgtgtttaattaccttggagcgccacatgaggcagtaggaggagtggaagaggtggacggancggtcggggaagagcctggtgtagaaagag

SEQ ID NO: 49362 - DNA, 101 bp, rice(Oryza sativa)
  misc_feature (71): n=t or g
tggttatggttcatactacattctcccccaacaaccacatgttcttaaacccgtacttctaattacacacngctgaacaaaccctctctaacccccggttt

SEQ ID NO: 49363 - DNA, 101 bp, rice(Oryza sativa)
  misc_feature (71): n=a or g
cactcactttggtaaaggtgtgtagaccaaaagacaagggggggggattgggtgtcattgatctcagagtncaaaacaaggctcttctccctaagcatcta

SEQ ID NO: 49364 - DNA, 101 bp, rice(Oryza sativa)
  misc_feature (71): n=t or c
gtcagggcataagttattgcatacttcgtagaattcatttagaatgcataactagatactccctccatccnaaaatatctgacgtcattgacttttcttaa

SEQ ID NO: 49365 - DNA, 101 bp, rice(Oryza sativa)
  misc_feature (71): n=a or g
atcgttgaaggtttacctcctctattcttaaaaaaaaaccatcatgggatataacacatactactattttntcttatatcacatacatacatgtttgcttt

SEQ ID NO: 49366 - DNA, 101 bp, rice(Oryza sativa)
  misc_feature (71): n=a or g
taccaaatgggatttggtttctgtacgtcgaatgccacattgaggcgtttcgtcatatgaaatgttatgangcttgtgattatcatatttgtatgtcatgt

SEQ ID NO: 49367 - DNA, 101 bp, rice(Oryza sativa)
  misc_feature (71): n=a or g
tggttactctacagtttcctttttgtcacgtacggtaccaacttgattgcaaatttctctgacccgagttnagccagcgataattatggtcatctttgtac

SEQ ID NO: 49368 - DNA, 101 bp, rice(Oryza sativa)
  misc_feature (71): n=t or c
acggaggttggcgcaccggcctggactgaccagacgatcgccgttcgccacgacgacatagagatcatggngcactggagacagatggaggcacaggtgac

SEQ ID NO: 49369 - DNA, 101 bp, rice(Oryza sativa)
  misc_feature (71): n=a or g
aattttcatacgcaggaaggagacaacgagcacacctgctctcgagtctcgactcgctggccaatgggccntggcgtctcctctcggcgtgcaggccgttg

SEQ ID NO: 49370 - DNA, 101 bp, rice(Oryza sativa)
  misc_feature (71): n=a or g
ttgatttcaaaatattcatattttgttgcatgcgatgaaatcaactctcaagagtttggttgtaaaatgtnaagattttgcagcaaaagaaattaaagtct

SEQ ID NO: 49371 - DNA, 101 bp, rice(Oryza sativa)
  misc_feature (71): n=a or g
tctttttagcttatttctttcttgcctttttttttcccaatttaatgacagaatttgttatatgttcttgncttaatatccccttggatttaattcattgt

SEQ ID NO: 49372 - DNA, 101 bp, rice(Oryza sativa)
  misc_feature (71): n=t or g
acaaacattttttgttccatcgacagtggacagttcacttcaaggagtatattttggaggtaatagttctnctgctgctgctgctgctgccagccagatgt

SEQ ID NO: 49373 - DNA, 101 bp, rice(Oryza sativa)
  misc_feature (71): n=t or c
aaaggaaagcttaactgctcagctttactttgaatgttccacaggagaatttcagaccatgcaagccagcnaggaagtttcaaccatcgaaaatgaggttc

SEQ ID NO: 49374 - DNA, 101 bp, rice(Oryza sativa)
  misc_feature (71): n=a or g
tcgccacgtcgctcctcgccggccaggtgagctagctagctacctacctacatagcttagcctacattccnatgatatatgcatggctgcttaattaactt

SEQ ID NO: 49375 - DNA, 101 bp, rice(Oryza sativa)
  misc_feature (71): n=t or c
aaactgaataactctaattcagttaaacactaaatcctaaaaaatttcccaaatcagaatcaaaacatcangaatcaaggcagtgtgggttttcatcagga

SEQ ID NO: 49376 - DNA, 101 bp, rice(Oryza sativa)
  misc_feature (71): n=t or g
caatttcccaatctccactccaccagagtactccactttgggatgcgtgcaatttaatttattttggtggngtgaggctcaggcagccctagccccaaagg

SEQ ID NO: 49377 - DNA, 101 bp, rice(Oryza sativa)
  misc_feature (71): n=a or c
gaaacaagcaagaagctagcaaaaccgcacacgtacggttttcagggacacatttacgtatacacacatangcaccactatataggagcacacagcacagt

SEQ ID NO: 49378 - DNA, 101 bp, rice(Oryza sativa)
  misc_feature (71): n=a or g
tctcctttctttcctctctcatcttttggttcttctgtttgccacagaagaggggggagcggcagcgagcnaggacgagcgaccagagcaggcgggcgagc

SEQ ID NO: 49379 - DNA, 101 bp, rice(Oryza sativa)
  misc_feature (71): n=t or c
ggtccaacacctaatactagtagtctagtaactgcctatggcctacctagaagaagaaacgcgcgaaagangagaggagttgcaacgtcgtcggcaactcg

SEQ ID NO: 49380 - DNA, 101 bp, rice(Oryza sativa)
  misc_feature (71): n=a or g
cacaccaagacggtgtagatcaggctatcagagcaggcagcagaaagcaaacaagggagattggaaagaanattcagaagaagcaaattgaatagcaagag

SEQ ID NO: 49381 - DNA, 101 bp, rice(Oryza sativa)
  misc_feature (71): n=t or c
acttttaaaggaagctagcgaggctaaccaatagaggaaaacatatagaaaatctagtctatttgtgtcanacgggtgggctgaaaaacttagtactgtat

SEQ ID NO: 49382 - DNA, 101 bp, rice(Oryza sativa)
  misc_feature (71): n=t or g
ttacatttgcttaccgatatgcatgttttctctcttgtcaatttccttttggtctcctcaccaattagagnggtgctgtatctgcttcatctacctcattg

SEQ ID NO: 49383 - DNA, 101 bp, rice(Oryza sativa)
  misc_feature (71): n=t or c
tgctatacatatgtaacttttaacatataagggccctctttagatcccgacaaaattttatatcctatcanatcgaatatttggacacatgcatcgagtat

SEQ ID NO: 49384 - DNA, 101 bp, rice(Oryza sativa)
  misc_feature (71): n=a or g
tttgctgatacaaaagagagaaaatgagtggatagataaatattgttgctacatgatggttggaaaaagancagaacagtaatagttttatattatattaa

SEQ ID NO: 49385 - DNA, 101 bp, rice(Oryza sativa)
  misc_feature (71): n=a or g
gggaagatagcttgcatttgtgcatagtgatgcaactgcaataaaggatccttctcgaaggcccaacacanacattggcatatcatttgaggtttgatctt

SEQ ID NO: 49386 - DNA, 101 bp, rice(Oryza sativa)
  misc_feature (71): n=t or c
gcaatgctcacccacaaaataaagggtccatcctaatttcataatagtgtccacctgcaaagtccaagtantccacttatatcattgtgtcctaatgatct

SEQ ID NO: 49387 - DNA, 101 bp, rice(Oryza sativa)
  misc_feature (71): n=t or c
ggaaatgacatcgtcagggatcattcactgcgaaagactgaaattctatacgaagatgtgcaagatttctngtggcatttagggcctgttcactttgatac

SEQ ID NO: 49388 - DNA, 101 bp, rice(Oryza sativa)
  misc_feature (71): n=a or g
ttcacatgtcaacttatctaccccactttccaaaaactgaagcgccttttctgacatcgaatatcttagancaactgagtgcatcttttgagatatacgcg

SEQ ID NO: 49389 - DNA, 101 bp, rice(Oryza sativa)
  misc_feature (71): n=a or c
ttgtaagtaaagagcatgggtcatctggtgctaaatggattggctagcaaaagcttttatggtgcccaggntctcaaaacaaacccgatgtatcaataacg

SEQ ID NO: 49390 - DNA, 101 bp, rice(Oryza sativa)
  misc_feature (71): n=a or g
cagtagcttctgccgatcagcctggccaactgcacaatcatgccagaagatattggacgccttcggcacanttgatgacatttgcaaaactttgttctcgc

SEQ ID NO: 49391 - DNA, 101 bp, rice(Oryza sativa)
  misc_feature (71): n=t or c
ccccccccccaacacacacacacaccgtagagttcagccaactcaacgtgacaaacaaaatggtagatccnggcaccactagaaaaacagttttctacagc

SEQ ID NO: 49392 - DNA, 101 bp, rice(Oryza sativa)
  misc_feature (71): n=t or c
gtaaattgacttagtaatccagatttggtacaaacaaactaagcttaagggcaggggaatatactatctangcagcatgcgttactgctcccaccacaaaa

SEQ ID NO: 49393 - DNA, 101 bp, rice(Oryza sativa)
  misc_feature (71): n=a or c
tcagttatatacttatgttagcagtgaatttttcagaagattcctttgcattttagaactaatacagtgcntggtggtggctaagagcgaggggcaaagaa

SEQ ID NO: 49394 - DNA, 101 bp, rice(Oryza sativa)
  misc_feature (71): n=t or c
tttatcagcttgtttgagtaccatgtgaggaagaacttccccttctcagtgacatatgttccattatccgngaagaaccgggtcttctcgggagtgtcatt

SEQ ID NO: 49395 - DNA, 101 bp, rice(Oryza sativa)
  misc_feature (71): n=t or c
gtcaataagattacaaaatagagtacacatcagacacacagctatagggctccctgattccacaacaatcngtagaaggctagcagccaacacagaagaaa

SEQ ID NO: 49396 - DNA, 101 bp, rice(Oryza sativa)
  misc_feature (71): n=t or g
tggtaataaaatcacattttgcagatttgccgtgttgaagacataactgtcagtggcatagtcagggggantataattcacattcatcgagcaagaactgt

SEQ ID NO: 49397 - DNA, 101 bp, rice(Oryza sativa)
  misc_feature (71): n=a or g
gggagtttccatggtcatgacgtctgcaggtcacttttttaagtcaagctagtcagtgatcaatgcgattncgaggtttgtggacgatttgtggaatatag

SEQ ID NO: 49398 - DNA, 101 bp, rice(Oryza sativa)
  misc_feature (71): n=a or g
cctgaacctctcctggaggagggcgatggaggagttgacctcgcagttgcctccttgccttctcatggccnggtcgggatcggagtatcggatccacgtag

SEQ ID NO: 49399 - DNA, 101 bp, rice(Oryza sativa)
  misc_feature (71): n=t or c
cagactctgaagctcaaagtcgggaagaacttaaactcagatatagaagttttgaaggctatacggcttgnccatccagattgttcatttatcttggatgc

SEQ ID NO: 49400 - DNA, 101 bp, rice(Oryza sativa)
  misc_feature (71): n=a or g
atgtcagtaacaacaatccatcaaactgttgagaagaaatccatgctcaagtagtttccttggcgcgagcntgtgtataatgaagattgatgcaaagctcc

SEQ ID NO: 49401 - DNA, 101 bp, rice(Oryza sativa)
  misc_feature (71): n=t or c
tacggtccgtcgtcgatctataccgcaagccacctgatccaacggtagttatccatcgggtaatttggaanatgccattataatttttcaaagtttaagat

SEQ ID NO: 49402 - DNA, 101 bp, rice(Oryza sativa)
  misc_feature (71): n=t or g
caagctaacattacgatagggaagaagaaatgagcagatagtcatcgtaattatcggtcccttcatttaanctgaatattataacaaattagttaccaact

SEQ ID NO: 49403 - DNA, 101 bp, rice(Oryza sativa)
  misc_feature (71): n=a or g
atggcgcggttgagtaagatcttgtctaagtggggtcagaagaaaatgagtaatttcaggctacaacttcngattgcgaatgaaatcattctccgttttga

SEQ ID NO: 49404 - DNA, 101 bp, rice(Oryza sativa)
  misc_feature (71): n=a or g
taagaatgagtttttttatcaacctccacgagctatttttaaaaaatatgatatactatgtggaatggatnaaccagaagaaaattgcaatgctctccaaa

SEQ ID NO: 49405 - DNA, 101 bp, rice(Oryza sativa)
  misc_feature (71): n=t or c
gggtatactgaatctggggacatggcatctgcactggagctgtttcttgagatggaaagagaaggtttggntccagatgaagcaacatttgcgtcgctgct

SEQ ID NO: 49406 - DNA, 101 bp, rice(Oryza sativa)
  misc_feature (71): n=a or g
tgaacaagcagtccaagcagtgcctcactctattgatctttgggtcagttattgtggatttgctatgtgcncatatgaagagcctgctcatattagaaggt

SEQ ID NO: 49407 - DNA, 101 bp, rice(Oryza sativa)
  misc_feature (71): n=t or c
aactattttttttctattacttagcccgttgttctggccccctcatgttataataatggcttcagtactantctaatactccatccattttaaaatataag

SEQ ID NO: 49408 - DNA, 101 bp, rice(Oryza sativa)
  misc_feature (71): n=t or c
gccgaaattttccattttctcaaacttttgtgtattttcccaaaatttattgaaattcagtcaagttgtgntaaaattttcaataatttcagtccaaaaat

SEQ ID NO: 49409 - DNA, 101 bp, rice(Oryza sativa)
  misc_feature (71): n=a or g
ggctgagtttgggcacaacttatttcaaataactaatctgtatcggcaagcaaacatcaaaattgtacatntattccatgttccatcctaatagaattgtc

SEQ ID NO: 49410 - DNA, 101 bp, rice(Oryza sativa)
  misc_feature (71): n=a or g
aaacccagccacaaccatgtactctctccaccctttctacccctcaccaataacttatgtcgtgagattcntgccaaccttgggctctagcagccacctct

SEQ ID NO: 49411 - DNA, 101 bp, rice(Oryza sativa)
  misc_feature (71): n=a or g
atctggcatggaacacaggtagtagccacatcacagagtagtggtagcagtctagcagattagcactagtncagcatactgaaaaatagatttatttgatt

SEQ ID NO: 49412 - DNA, 101 bp, rice(Oryza sativa)
  misc_feature (71): n=t or g
gacaacaactcctgatcatacatccccctccactgttgttggtctttcttatacttgatgaactctactangaggcttttattattcgcgtaaatggactt

SEQ ID NO: 49413 - DNA, 101 bp, rice(Oryza sativa)
  misc_feature (71): n=a or g
acatggctgaggaagaagaagaagagagaactcttcacacttcactcttcgctcttcaaagaaggaggagnaggagaagaagcgagagggaggcgtgggct

SEQ ID NO: 49414 - DNA, 101 bp, rice(Oryza sativa)
  misc_feature (71): n=a or g
acacagatagagaagcgcattatgtaagtagagagcatcaacaaaagaatatagatgaactgcagagaacnccagcagagacttgttcttgcaacgagttg

SEQ ID NO: 49415 - DNA, 101 bp, rice(Oryza sativa)
  misc_feature (71): n=t or c
acgacgtttctgctgtaccggacactctccctctgttctctcatcaccggagcagaagcaggagcggagtngtcctctgcttgtgcctccgctgctccatc

SEQ ID NO: 49416 - DNA, 101 bp, rice(Oryza sativa)
  misc_feature (71): n=t or g
gtcagggagataaaaaaaagaaagagaaaaggaactgtgcacgctgcacacgggcaatcagggagggaggnaggtttgggatgtttttctgaatgattaat

SEQ ID NO: 49417 - DNA, 101 bp, rice(Oryza sativa)
  misc_feature (71): n=t or c
attggtccaagtaggcaaatgtttggagacgatgtgattggtacggtgaacataaagatggtggaggctgngaggagcgtgggcgcggccgccaagttcac

SEQ ID NO: 49418 - DNA, 101 bp, rice(Oryza sativa)
  misc_feature (71): n=a or g
cacgtgggccccatatgtaatcctcaatcccctaaggttgctggcttggtgctactcctcttcctcctccngcattgctcctatccagcggtggcggcgga

SEQ ID NO: 49419 - DNA, 101 bp, rice(Oryza sativa)
  misc_feature (71): n=t or c
aaaacaaaataatgagcccatacactcaagggttcacctttctgattgagcgtaggatctttgatccaagngatatgataattttcgtcaaacttcaagaa

SEQ ID NO: 49420 - DNA, 101 bp, rice(Oryza sativa)
  misc_feature (71): n=t or g
cttacagcccaatgctcatgacagacggtatatcccaatttgtgatcttccaatgatattgagcaacattnacactttatcgtgtttatatcatatcatgt

SEQ ID NO: 49421 - DNA, 101 bp, rice(Oryza sativa)
  misc_feature (71): n=a or g
gattcagacagatgtatcagctctgggtatcatactacttcagctagttacagggcattcagatgcaaagngtctgagagattttgtggcacagaaactgg

SEQ ID NO: 49422 - DNA, 101 bp, rice(Oryza sativa)
  misc_feature (71): n=a or g
ttaaacgtggtgaaacactgttatttgcactatttgaatgtcagacatacatatctctttatggccatctnttacttaaaatatatgttttagcttctgct

SEQ ID NO: 49423 - DNA, 101 bp, rice(Oryza sativa)
  misc_feature (71): n=t or c
ttcatgattatattttgatgaaaaatatatatatgtgttgcatatggtaggggctcgttgttgcaatcaanttttttttaatgttacatctccttaaaaca

SEQ ID NO: 49424 - DNA, 101 bp, rice(Oryza sativa)
  misc_feature (71): n=t or g
cgccatctcggacggatcacgcatttgactttgccttttttttcgacttcttgctgccgagtcaattccgngaaggcctccataaaaactccatctcgatc

SEQ ID NO: 49425 - DNA, 101 bp, rice(Oryza sativa)
  misc_feature (71): n=a or c
ttcaggttcgccaccggcaacaccacgccggccgatcaggcaaatgacatgacctactcgctggtaatctntgcgcttcgcttctcctccaccttggaggt

SEQ ID NO: 49426 - DNA, 101 bp, rice(Oryza sativa)
  misc_feature (71): n=t or c
tagcatattttgaattttttattcggtggaagcagtgatttattccacaaactagcaatcatctcacctantggcttaggctagttcctttcagattattt

SEQ ID NO: 49427 - DNA, 101 bp, rice(Oryza sativa)
  misc_feature (71): n=t or c
tacattgaccatcaccatttataaccggccctccagaaaacccgttggcacagtcaaattcatgaaactcngtaagtttcatagtgtaacctttggtattg

SEQ ID NO: 49428 - DNA, 101 bp, rice(Oryza sativa)
  misc_feature (71): n=a or g
ccatgtaggccacaatctcttgctcacaacaccaccatgcccctgaccatcaacttgctcgtgcatgcgcnttagatccgctacgcccaccgctcgctaga

SEQ ID NO: 49429 - DNA, 101 bp, rice(Oryza sativa)
  misc_feature (71): n=a or g
catacgaatttcttcatcaccaccttcacaaatccctcatttgtgtagtttataagagttgttcgcacatntttagtgccacgttactagtttaattagca

SEQ ID NO: 49430 - DNA, 101 bp, rice(Oryza sativa)
  misc_feature (71): n=t or c
tgagaggataggggtgaagtagtggcgcatgcgaactgggaaattattttaattcctcgagaggatatttnatcattatttacatgtcacttaaatggtta

SEQ ID NO: 49431 - DNA, 101 bp, rice(Oryza sativa)
  misc_feature (71): n=a or g
gatccctgacaagttgacgcacaacaatttccttctacggaaagcacaaattcttgcagtgatccggggcnctcgtatggaaggctatctcaccagcgcaa

SEQ ID NO: 49432 - DNA, 101 bp, rice(Oryza sativa)
  misc_feature (71): n=t or c
aaaatcactcgcgcgagggcgtagcgtgcggcaagggacacgtgaaaagtgcgggcccaattaatttacgngcatcttagatatgagggacactttggcat

SEQ ID NO: 49433 - DNA, 101 bp, rice(Oryza sativa)
  misc_feature (71): n=t or c
gtgttaccttctaatgttactaacatcatagacctaactatcatacaaatagaatttggctagagcgaaantggacaacttgttgatagtcaccgcggtaa

SEQ ID NO: 49434 - DNA, 101 bp, rice(Oryza sativa)
  misc_feature (71): n=a or g
aagattagaaggtggttgaagaccttcaagaacatcagatcttgtggtccgttgcaccataccccaagctngctccaactttttcatattccgtttggaca

SEQ ID NO: 49435 - DNA, 101 bp, rice(Oryza sativa)
  misc_feature (71): n=a or g
aaggtacctatgttgctgaccattaatgactagttcgaagacctagagtaggagcacatgtcccgaagganaaggggaaaaagttaattttgactccctca

SEQ ID NO: 49436 - DNA, 101 bp, rice(Oryza sativa)
  misc_feature (71): n=a or g
tttgtttgcacacaaaatgacgttagaagatagggaactcttggattgtatcatggagaacacctccttcntttgttgtgaaactgtcctggaaatcgagg

SEQ ID NO: 49437 - DNA, 101 bp, rice(Oryza sativa)
  misc_feature (71): n=a or g
ccccgccaccaccttggctgtgcccacatgacaatacaatcgcaacagggctaaacaaaactacctcggcnatcatacccgtagggtaagacgtcagtgca

SEQ ID NO: 49438 - DNA, 101 bp, rice(Oryza sativa)
  misc_feature (71): n=t or c
aacgtggccaaataacgctgccatgtcagcgagattggcgtgacaatattgttttgccacatcagttcagntagcatggtcaaaatgttcggattttgaaa

SEQ ID NO: 49439 - DNA, 101 bp, rice(Oryza sativa)
  misc_feature (71): n=a or g
ttttctatagtaaaataaccttattgtatttaggcactgcgcctgatggcagtggttttgctttgttgacnctttacatacgcacaaagtgctagacttga

SEQ ID NO: 49440 - DNA, 101 bp, rice(Oryza sativa)
  misc_feature (71): n=a or g
gtcggactcggagctgctgctggtgttggacaagtcgaagcagttttgcagcacggaagtgtagacgcgcntctcccccttcggcagcgagatgtccttca

SEQ ID NO: 49441 - DNA, 101 bp, rice(Oryza sativa)
  misc_feature (71): n=a or c
tctttattttcagaagaaaaaaacaccatcatcggagccgtggagggggtactcgtcgtgatctgcaggtngctgttggcagcaggtgcgtgattgatgga

SEQ ID NO: 49442 - DNA, 101 bp, rice(Oryza sativa)
  misc_feature (71): n=a or c
tagttccatctttgtgacctgatcgagaggcgcatcgcctcatctttgtgatctatcagcatgtatactgngatgtgcgtactcgtacagagcttggccag

SEQ ID NO: 49443 - DNA, 101 bp, rice(Oryza sativa)
  misc_feature (71): n=a or g
aatccctgcatcactgccatcagtcgcaatagtgaatgtcttagaataatctagcaatgctagcacagganctgtcaccagagctaacttgagagcctgaa

SEQ ID NO: 49444 - DNA, 101 bp, rice(Oryza sativa)
  misc_feature (71): n=a or g
cctcaatccccttttcctcaaacacacccttacacgccatgtcatgtgaaatgtacgcaattctcagcganagagccagagaggtttgggttgttattagt

SEQ ID NO: 49445 - DNA, 101 bp, rice(Oryza sativa)
  misc_feature (71): n=a or c
gggagacagacagaagagtatttccttattcagatagaatagaacttctgggcttagttggagtcggacancgcatcctgggccatagagaacggcccaaa

SEQ ID NO: 49446 - DNA, 101 bp, rice(Oryza sativa)
  misc_feature (71): n=t or c
atgatgggccggtgtgctgttactttcgtcgtttcattgttcggccagccttaacgggaaattaccgttcngtacaccctggcgacacgtggcagtccctt

SEQ ID NO: 49447 - DNA, 101 bp, rice(Oryza sativa)
  misc_feature (71): n=t or g
atcaagcgagatcgtcttcttcttaatcatcaatggaacaatcagcagggaccttgctcttgagtctacgngctctcgctctttggagcagcgacttcctt

SEQ ID NO: 49448 - DNA, 101 bp, rice(Oryza sativa)
  misc_feature (71): n=t or g
tggaataaaacaatgtaagaatatcatgtatgcatgagcaaagggaccaggaacattaggcgtccaagtangaatacattttaaaaataactaaaattcag

SEQ ID NO: 49449 - DNA, 101 bp, rice(Oryza sativa)
  misc_feature (71): n=a or g
gccgtctcctgatcatcggagcaccagcgccctcctcttgtttcatggaagaagaaaaaagaatgagtagngaaggagagagaataggaaaaaaatattcc

SEQ ID NO: 49450 - DNA, 101 bp, rice(Oryza sativa)
  misc_feature (71): n=a or c
tgctaatgacaacaatctgttcaccgaaacgcttcaaaaagagcagcaaacaacaattggatggaaatcangaaccctaaatagaggggaaataaaaaata

SEQ ID NO: 49451 - DNA, 101 bp, rice(Oryza sativa)
  misc_feature (71): n=t or g
aatgccgtttcattttaaggtacgtgcagtcaatacaagttaactcgatctcgtgtaatttgcaatacaanatttgacaaaacggtgcaaccaaagccatt

SEQ ID NO: 49452 - DNA, 101 bp, rice(Oryza sativa)
  misc_feature (71): n=t or c
tccatgattccattacaacagacagaaaaaaaaaacctgcattgattttttatagggcatctttaaatttnaaaatgtcaaattatgtatattttgaccag

SEQ ID NO: 49453 - DNA, 101 bp, rice(Oryza sativa)
  misc_feature (71): n=a or g
tatcaatctccaacaaccttaacaagatgctagatagtaaaagaacttgttaccagaataatcttacctcnagtactctgactctaagtttcagatcaccg

SEQ ID NO: 49454 - DNA, 101 bp, rice(Oryza sativa)
  misc_feature (71): n=t or c
gcgagagaagatgatgagggaatctaagtcggatgaggaagtcaagtctctagttatctctaaatatcctnggcgccctgacatcgtcagaaacaaataga

SEQ ID NO: 49455 - DNA, 101 bp, rice(Oryza sativa)
  misc_feature (71): n=a or g
ttttcctgtgttgaaactatgaggactgatagtgatataaataataatgattccattttcagatgaataanaaattaagtttcgtgacaattaatgagaga

SEQ ID NO: 49456 - DNA, 101 bp, rice(Oryza sativa)
  misc_feature (71): n=a or c
tttgaattcctttaaaaaaatacacattagaaacgtggctatttctgtgtctcaagtcgattgatcccaanatgagagagaagctcatcgtattttagact

SEQ ID NO: 49457 - DNA, 101 bp, rice(Oryza sativa)
  misc_feature (71): n=t or c
acgtgttataagtgctattattttctatttacccattaaaaatagggctaatcatatactacatccgttcnaaaatataattatttttagctatgaatctg

SEQ ID NO: 49458 - DNA, 101 bp, rice(Oryza sativa)
  misc_feature (71): n=t or c
ggtctccccctccaaatctcgtttttgttatacacgatgatttgctacggatgtttgctcatggacgcatnggtgagggcgagggcgatggagcagagctt

SEQ ID NO: 49459 - DNA, 101 bp, rice(Oryza sativa)
  misc_feature (71): n=t or c
gatttatggccatcccaagagagagaaaaacaatagaagagtaatatccagcagcaaatgatttctccaangctttagatcaaactaatagctaggcctac

SEQ ID NO: 49460 - DNA, 101 bp, rice(Oryza sativa)
  misc_feature (71): n=a or g
tctgatctctgtttggttggacacattggtacctactcctacatgtgtttcaagtcactgcacctccattncacaaactagaaagtagtttctactcactg

SEQ ID NO: 49461 - DNA, 101 bp, rice(Oryza sativa)
  misc_feature (71): n=a or g
gttagtgcatgtgtggtagtcactgtgcagcattggtgtcaacctcgatctctccttcaacttgccatcantcttactttgaaaaagagagctgtctccat

SEQ ID NO: 49462 - DNA, 101 bp, rice(Oryza sativa)
  misc_feature (71): n=a or c
tgtcgcttaatggtttgaaaagcgtgtaatagaaatcgaggtggaatgaaacaagatgacttttacggtanaatgtactagtagtatatactgctaatata

SEQ ID NO: 49463 - DNA, 101 bp, rice(Oryza sativa)
  misc_feature (71): n=a or c
gtaatagtatttgggataaagttgttaggtgatctcctgcaagtgtagcttccattaagtcctagtgacanctgaaagagaaaatgacaaactagaaagtc

SEQ ID NO: 49464 - DNA, 101 bp, rice(Oryza sativa)
  misc_feature (71): n=t or c
acctgtaggagactggtctgcaatttacgactctattggttttaggactagagatcaaaatgaggcagttnagaacacaaggaagatattgtcttttagct

SEQ ID NO: 49465 - DNA, 101 bp, rice(Oryza sativa)
  misc_feature (71): n=a or g
agatggcacatgtgtgacatttctagttcccgtctcaatggaagggttcatccgaggcaacgtagaagaanttgagaagcataggttgatgccgtgaggct

SEQ ID NO: 49466 - DNA, 101 bp, rice(Oryza sativa)
  misc_feature (71): n=a or c
tagtgaatgggaagtatgtgtcaacccatcgcatttccacagcacctgcacacatgtttctttatatttanaccaatgcatatatatttgataaatttctt

SEQ ID NO: 49467 - DNA, 101 bp, rice(Oryza sativa)
  misc_feature (71): n=t or c
catggctcctcttgatagaagactcggtcgtcttctcagctcctatctttcacccccttatcctctccacntcaatcgagagagtggagaccacacaaagg

SEQ ID NO: 49468 - DNA, 101 bp, rice(Oryza sativa)
  misc_feature (71): n=t or g
cacttggatcaaaaataactcctggtgatgtcataagcccagtatccgatgttgatggagcgcgacaaaanattacaattaaagtgtctagggtaattaac

SEQ ID NO: 49469 - DNA, 101 bp, rice(Oryza sativa)
  misc_feature (71): n=a or g
gagagattcattttctgtggcacaacttgtggccctacagccaattttcttcatctggctcaagctattcntgaggagaagtcaatccctctaggtaaatt

SEQ ID NO: 49470 - DNA, 101 bp, rice(Oryza sativa)
  misc_feature (71): n=t or c
gagatgtaatttagtgaaggattagccttgtgtaaaatgcaagattggccaaatattgaggttggcaccanggaagctactagctagcttattcatgccct

SEQ ID NO: 49471 - DNA, 101 bp, rice(Oryza sativa)
  misc_feature (71): n=t or c
atttttccacgcactctctgtgggtcaattaatcctattgactcctacacaaaacccttttgctactggtnagactcatgaccaaattgatactagcacat

SEQ ID NO: 49472 - DNA, 101 bp, rice(Oryza sativa)
  misc_feature (71): n=a or g
agcaacggcaagttttgtccttactgtgggcattattggtcttgtactcatacgaaggcatatgaggtatncagaactgcgcgaagattgggaggttgagt

SEQ ID NO: 49473 - DNA, 101 bp, rice(Oryza sativa)
  misc_feature (71): n=a or c
tacaaactaattaataaagaagaggtttggcagggcattcttaggaataaatacttcacatcgtacaagtnaaaaacgtcctagatattcacatttttggg

SEQ ID NO: 49474 - DNA, 101 bp, rice(Oryza sativa)
  misc_feature (71): n=t or c
aataacatgtcctgataatgtggatcttggatacaattggaatcaagagaggcgacattatcattagaacnatcatctttaatttcctcaacttgatcaag

SEQ ID NO: 49475 - DNA, 101 bp, rice(Oryza sativa)
  misc_feature (71): n=t or c
taggcgaaaagccgcgctggtgggctatatatacccccctccccccagttttcacttttacttttaccctngattattttcgccatcttcccagccgcccg

SEQ ID NO: 49476 - DNA, 101 bp, rice(Oryza sativa)
  misc_feature (71): n=a or c
tcggcatacttgctaaaaccatacccgatccccttcctgctgaacacgaatggctctgtggtatgcacaancgccggcggcgtgggctcgccgttgaagaa

SEQ ID NO: 49477 - DNA, 101 bp, rice(Oryza sativa)
  misc_feature (71): n=t or g
aaggtagggaggcaggaattggcgccatcagaatacagtggttttggtgtgatataagtgcaacactagtntttatccagatgcattccgtagacacacaa

SEQ ID NO: 49478 - DNA, 101 bp, rice(Oryza sativa)
  misc_feature (71): n=t or c
catctccatgtagggataacatattgaaaaccctaagaaattactctcaaaactagcacagtggcctgcanagattgcgcggctagtatcattatattttc

SEQ ID NO: 49479 - DNA, 101 bp, rice(Oryza sativa)
  misc_feature (71): n=a or g
atcccgggcacctccggatctaccgacaattttttttgcctcgccacgtagaacatttgaacgcatgtacnaagtattaaatgtggacgaaaaaaaacaat

SEQ ID NO: 49480 - DNA, 101 bp, rice(Oryza sativa)
  misc_feature (71): n=a or g
cagcgtgtagcattctcactttgtgtgcgcgcacctacccaacgaaagccaacaggtggcacatcctgtgnaatgtctgtctctgggcacaggggagaccg

SEQ ID NO: 49481 - DNA, 101 bp, rice(Oryza sativa)
  misc_feature (71): n=a or g
agcaatggcaaaaaagatgtcgaggatcatgcaaagggtaaccatggtgagaagaatgttgagtacatcantagcaaagcaaaagtgggtgaggggaataa

SEQ ID NO: 49482 - DNA, 101 bp, rice(Oryza sativa)
  misc_feature (71): n=t or c
cgcggcgggagctccgggggggagtaggagtagccggaattgcggaggcgggagaggatgagggacatggnggagcgggaggaggagcggctggtgccgaa

SEQ ID NO: 49483 - DNA, 101 bp, rice(Oryza sativa)
  misc_feature (71): n=t or c
tctgtagttggtgaggcaagagcagtagtcctgtaaccaccgatgctattccattgtctcctcttggttgntgctgatcattcccaatctgtgcatcctca

SEQ ID NO: 49484 - DNA, 101 bp, rice(Oryza sativa)
  misc_feature (71): n=a or g
cttaaatcaaagagttgcagtaaacaatatcctaacatgaacacgttcttcaataaatttccattccacantaagcttcgtgctggaacccaagtgataca

SEQ ID NO: 49485 - DNA, 101 bp, rice(Oryza sativa)
  misc_feature (71): n=t or c
tgagccactctactttcttactctcaatatttaattacatgttcagagattcagaaatccagaagtgaacnttttcaattctccaagtacatgttcagaga

SEQ ID NO: 49486 - DNA, 101 bp, rice(Oryza sativa)
  misc_feature (71): n=t or c
ggccgcagtttcattgatagaaacagacagagttgtccgaagtccagtgcaaaaaagaacaagtaccttanggcatctgacttgaatcccatcaggtttta

SEQ ID NO: 49487 - DNA, 101 bp, rice(Oryza sativa)
  misc_feature (71): n=t or c
cacaactttactaatttccttgttaatcaaacagggtacgtaataatgcagtgggcggagctctggcactngcccgtggtggctgggtcttgactccgccc

SEQ ID NO: 49488 - DNA, 101 bp, rice(Oryza sativa)
  misc_feature (71): n=t or c
aacccgaagttcaccgtcgcgttttgatatccagcgaggccctgcagcacctcccattgtcgccaagtttngtcaccgcctcctttgggttcgcagctgcg

SEQ ID NO: 49489 - DNA, 101 bp, rice(Oryza sativa)
  misc_feature (71): n=a or g
agtgccactaaccttgattttttggaggattctaccacccctgtgcaggctcctatcggcgccaaccgacnacctgcagctcccttgccagccgccccaac

SEQ ID NO: 49490 - DNA, 101 bp, rice(Oryza sativa)
  misc_feature (71): n=t or c
gtctcgacttagtccttattctttcaagctacttcactgaattattgtcgtgcattattttatccacttcntagaaaacattttttttccaaaaaaaacgt

SEQ ID NO: 49491 - DNA, 101 bp, rice(Oryza sativa)
  misc_feature (71): n=a or g
gcttgtatccattgttttggaggttttggcaagagactgcctagacgatacctcctgggaaagaagcgacnaaagcggcggcgccgccgtccgtcgaggtc

SEQ ID NO: 49492 - DNA, 101 bp, rice(Oryza sativa)
  misc_feature (71): n=t or c
taacttcgaactgagtggctcgtcaaaaggtaaatacaaagtctgtccaactaactggtgcagtcatctcngtaatcttcaattaaccggagtcaatatag

SEQ ID NO: 49493 - DNA, 101 bp, rice(Oryza sativa)
  misc_feature (71): n=a or g
ttgttgcgttcaatggaagatggcctggtagctgatggagttatagcacaagatattagccaagcctctantttttggagaattcgtgaggtgatcatatg

SEQ ID NO: 49494 - DNA, 101 bp, rice(Oryza sativa)
  misc_feature (71): n=t or c
ccggagcatgaatcataaagcaagtatcaaggttagtaatttgtaagattttggctccccaaatctatcgncagctatttagctattttttattgattatt

SEQ ID NO: 49495 - DNA, 101 bp, rice(Oryza sativa)
  misc_feature (71): n=a or c
agcaacagctcccaggaatctgctgcctgtatagagtttaaccgctcagaataacagagagaagatcagantcaagaagcatacatacatacatgatgcgc

SEQ ID NO: 49496 - DNA, 101 bp, rice(Oryza sativa)
  misc_feature (71): n=a or g
aaacttctgttctgaaaatgatgtctcagtcgaaaagcagccaaatctttcaggtgaaccatcaaaacatntccatcctaccaaggaaagctccgtgcatg

SEQ ID NO: 49497 - DNA, 101 bp, rice(Oryza sativa)
  misc_feature (71): n=t or c
ataaaagccaactgtgctcgaccgtaaggacaaatagaaaatctaaaaacatgatagatagtctccccctntggcatcaagacaccaaaaagagaggacga

SEQ ID NO: 49498 - DNA, 101 bp, rice(Oryza sativa)
  misc_feature (71): n=t or g
tccgaaccaccgctgtcatcagcccacatgtgaaccgtactgagctcattgtcagtcagaacgacgacacnatcaggcccaacaaggacaaggaaaagcac

SEQ ID NO: 49499 - DNA, 101 bp, rice(Oryza sativa)
  misc_feature (71): n=t or c
ttcgctatgcgcttctttgtttcgctatttttcccggttcgacgcttaatatggctacatcttttattttngcagtattgattcttgattaggccgacgct

SEQ ID NO: 49500 - DNA, 101 bp, rice(Oryza sativa)
  misc_feature (71): n=a or g
ggctggataatgaaataaaaacaacaacggactagcgagcctacgatctcaacttcacaggcatttaactngggtgtggggtataaactaagactccacct

SEQ ID NO: 49501 - DNA, 101 bp, rice(Oryza sativa)
  misc_feature (71): n=a or c
ttctttcttcattttttttctttacccgatgtgtttgcagttgccacctcttgggaaaaggtttggtcaancatgtcaaggctatattataggaaggactt

SEQ ID NO: 49502 - DNA, 101 bp, rice(Oryza sativa)
  misc_feature (71): n=a or g
taccaaccataggtccactacacccagctgaaacatacatatgcagcctcgcagaaatgtcgtcatagcangactaattagtaagttctgaaaaaagaaga

SEQ ID NO: 49503 - DNA, 101 bp, rice(Oryza sativa)
  misc_feature (71): n=t or c
ccctctagtatgtcttgtccaaacagattctaatttggcaaagatgcattcccccgtctaaaaaaaaaccncctcaaatcaagtctttttttatggagggt

SEQ ID NO: 49504 - DNA, 101 bp, rice(Oryza sativa)
  misc_feature (71): n=a or g
aaaatgcaaccttgaaaggagaaaacaaaccttatttcatatggctctcctccaggaggtgcatgaaaacnaaggtcatccattattgaaaaatatgaatg

SEQ ID NO: 49505 - DNA, 101 bp, rice(Oryza sativa)
  misc_feature (71): n=t or g
gtttgggagaatttataaaccgatgaggagggtgtctcgggaaggacgtgattttggacttccatagaggnctctgggttgtagagggacacaatacagac

SEQ ID NO: 49506 - DNA, 101 bp, rice(Oryza sativa)
  misc_feature (71): n=a or g
tctcaaggttaccctgcctagcttaccttgacttgcaagtgttcatggttcctggcatggagatcattatngatagtgtatcattttcagttctcaaagaa

SEQ ID NO: 49507 - DNA, 101 bp, rice(Oryza sativa)
  misc_feature (71): n=t or c
atcccacctgttccgcttctgcagattgacgtcaaacatcacttgagcgctcctaagggctttcacagtgnagtgatgtggcattcagcctcaagcttaca

SEQ ID NO: 49508 - DNA, 101 bp, rice(Oryza sativa)
  misc_feature (71): n=a or c
gagcagcaagagagagaagctagagaagaagagcgggttgaaagtgaaatatgttgcaaagatatctggcncaaattgaaaatggttagttaattctagtc

SEQ ID NO: 49509 - DNA, 101 bp, rice(Oryza sativa)
  misc_feature (71): n=a or c
tgtctccacagtgaactgtttggaaaaatctggtaacccaagtacaggagcagaggttaaagcttgcttangttgttggaaggcagcttcagcttcagatc

SEQ ID NO: 49510 - DNA, 101 bp, rice(Oryza sativa)
  misc_feature (71): n=t or c
gtccagaccttctcgatatcaccagaaaacagcttctcaactttaacctcttgttttgtcggtaagttgtntttgttcaatggaggctgtactcttccagg

SEQ ID NO: 49511 - DNA, 101 bp, rice(Oryza sativa)
  misc_feature (71): n=t or c
tcgcagcttcaaagttggctctattctgcagtccgaaatccgcccgtgtgaatctgtttcttttttagtcntgtccatcattcctaaccaaaacaagagtg

SEQ ID NO: 49512 - DNA, 101 bp, rice(Oryza sativa)
  misc_feature (71): n=t or g
gagccaacctcgcaaccaaccatatgtgatcagcgacgtacagtacagatcgttcgcaataaagttagacntctcgtctctctttgtgcttgtgcttagtt

SEQ ID NO: 49513 - DNA, 101 bp, rice(Oryza sativa)
  misc_feature (71): n=a or g
tttctaattttatgataattcagtgacacccacctagtttcggctttagtagtggtatttttccaatacancgtttccataatggcacgatcaaatttacc

SEQ ID NO: 49514 - DNA, 101 bp, rice(Oryza sativa)
  misc_feature (71): n=a or g
ccgatttttctctctcctcatcgggcgcccgatcctgagttgcctcaaaaataaactcatgaagttatctnaagggctgtttgggaaacagggacttattc

SEQ ID NO: 49515 - DNA, 101 bp, rice(Oryza sativa)
  misc_feature (71): n=a or g
gctagaagttgaagctaatctgtcaaaaatagaatgtaatgtgtacgtagacgattcgcctgcgctttccnggtagaacaaaacaaggctatcataggagt

SEQ ID NO: 49516 - DNA, 101 bp, rice(Oryza sativa)
  misc_feature (71): n=t or c
ctctgatctctgcatgaaattatagcatagatccatcgaattagctagctattagctagttagcatggcantaattaaaattagaagggcagatgtacaca

SEQ ID NO: 49517 - DNA, 101 bp, rice(Oryza sativa)
  misc_feature (71): n=t or c
acggtttctcacactattcgtgagttaatgttactgagcaaacatctgagatacgatgtatattcttcgtnttaaaataaacaaatctaatacattctata

SEQ ID NO: 49518 - DNA, 101 bp, rice(Oryza sativa)
  misc_feature (71): n=t or c
gtcattctccatcgatcttgtcgtgcccagaaaaagaagtccatggattgcaagagccatccattgaatcncatggctccaacctccaccttcttgttgga

SEQ ID NO: 49519 - DNA, 101 bp, rice(Oryza sativa)
  misc_feature (71): n=a or g
ctctcgtcggtgcttgggtcgctgagtactaaggtcgaacacttggagggcacagttcagaaacaggatgngggcgccaaaaagccggtggaggcgaagga

SEQ ID NO: 49520 - DNA, 101 bp, rice(Oryza sativa)
  misc_feature (71): n=t or c
ggactaaactacactattactgcagtctatataggtttcaaatggagtgcggtgttacacttccaatcctntatggccacgtagccttgcggccagggtta

SEQ ID NO: 49521 - DNA, 101 bp, rice(Oryza sativa)
  misc_feature (71): n=a or g
cgccgttcgccttcgccttgagcttccttatgctctccgcggagaaagcgaagaagcactcttgcaatggnggtggtgggtggtcgcgtcgcgggatgatg

SEQ ID NO: 49522 - DNA, 101 bp, rice(Oryza sativa)
  misc_feature (71): n=a or g
ctgtacttctgggggcagctgattttcatcagtggaaaggatagataagctaccacaaggaggtggtgtcntgggaggtaggacagatggagtgttcacca

SEQ ID NO: 49523 - DNA, 101 bp, rice(Oryza sativa)
  misc_feature (71): n=t or g
accagccttgattagagaaatagagctacctgtaaagagcactctaaggagattagcacaagattagaganagatagagagcttggcttgaaagatagccg

SEQ ID NO: 49524 - DNA, 101 bp, rice(Oryza sativa)
  misc_feature (71): n=t or c
gcagagtgccaacaaattgatgagggtatatgcatcatagcaggcatcatattatgttctctttttttacnacagttttcaccttgggagaagctgaaact

SEQ ID NO: 49525 - DNA, 101 bp, rice(Oryza sativa)
  misc_feature (71): n=a or c
taatttaattgccaaatatctgtagatgtaagtaactgcctagcaaattaagcaagccttttgatttatanaaagggaacattttaaattgccagaacaaa

SEQ ID NO: 49526 - DNA, 101 bp, rice(Oryza sativa)
  misc_feature (71): n=a or c
actttgaaaggcgttggaagtctttgtgctcttttagttttatgtaaggtgtgcttgagcctttgtgctcnttttgtttgtgaacatgtgtgtatgaactg

SEQ ID NO: 49527 - DNA, 101 bp, rice(Oryza sativa)
  misc_feature (71): n=a or c
acaacttcatcttcttcgtgtgaactagaccccaacacctcacggttgctggattgccctgcagcgctctncgtagggactcttccttgacatgctagcac

SEQ ID NO: 49528 - DNA, 101 bp, rice(Oryza sativa)
  misc_feature (71): n=t or c
ctccaagtttcagaaagtattgcatttgtgtacacaagtactgttacccttatcgtttaactaataaacgntgtgttttatgtagaaatgaagttgcatta

SEQ ID NO: 49529 - DNA, 101 bp, rice(Oryza sativa)
  misc_feature (71): n=a or g
ccatactgcttaatcacattatgtccgaccggtttaaatagtccggcatggagcaagtacatcgccaagcnatgacgaaatgcgccaacgctggcgggtcc

SEQ ID NO: 49530 - DNA, 101 bp, rice(Oryza sativa)
  misc_feature (71): n=t or c
tctcaactgagggtgatgtatacagttttggaataattgtcctagagatgatcacaggaaagcgcccaacngatgagatctttaaggatggcatgaacctt

SEQ ID NO: 49531 - DNA, 101 bp, rice(Oryza sativa)
  misc_feature (71): n=a or g
ctggatcctttttctcttgcagagtggtgacaagagaactcaaagcctgcacaactctaagaattgcagtnccattggctgatgatgtgctaagaagagcc

SEQ ID NO: 49532 - DNA, 101 bp, rice(Oryza sativa)
  misc_feature (71): n=a or g
ctgcctcaatcaagatgatgatgacctactgggattgctgggcaatcaaactcctctaagagattgtcgcngcttctttgatattgatggtaggtagtttc

SEQ ID NO: 49533 - DNA, 101 bp, rice(Oryza sativa)
  misc_feature (71): n=t or c
atctggaagaagtaggagaaaagtacttcaatgagttggtcaatagaaatatggtgcaaccagtggacatngactatactggtagagcaaaggcttgccga

SEQ ID NO: 49534 - DNA, 101 bp, rice(Oryza sativa)
  misc_feature (71): n=a or g
gagtaacaagaagaagaaaaaaattggcggcaatagtaattcaccatcaacctgtctctgtaactgtaacnaatggagaacgaatggatggcaaaatgtac

SEQ ID NO: 49535 - DNA, 101 bp, rice(Oryza sativa)
  misc_feature (71): n=a or g
tttagatggcatgcatgtaatgagagttcatccccacggggaatgaaaatccaaatctgttagagcagacntgtagtcaaaaggacagatgatcgagcccg

SEQ ID NO: 49536 - DNA, 101 bp, rice(Oryza sativa)
  misc_feature (71): n=a or c
ggagaacataatcaggcgattatacaggagatcaccaccagaaatcattagctccagctcaagtaacaaantcggcaatgcccggattttcagggaagggg

SEQ ID NO: 49537 - DNA, 101 bp, rice(Oryza sativa)
  misc_feature (71): n=t or g
actgcagataattttggtctgagtgtctcttaaaaaaaaggagataattttggtctgaatgaacagtgaantgttttatttcactgatttttgtccgtatc

SEQ ID NO: 49538 - DNA, 101 bp, rice(Oryza sativa)
  misc_feature (71): n=t or c
tgatacaatatgcgagtatggaataagctcaatcaaatagaaaatgggataacaaatactccctccgtccnaactcccaaaatataacaacttttagccct

SEQ ID NO: 49539 - DNA, 101 bp, rice(Oryza sativa)
  misc_feature (71): n=a or c
acaatttcgggatattgtggcaccttcttaagaagtctcctaatttggagaagctcactatgcggtgctgnaaggtaaatttgccttcatttatttttatt

SEQ ID NO: 49540 - DNA, 101 bp, rice(Oryza sativa)
  misc_feature (71): n=t or g
gaacagtatatattcgacgcgttcagttactccccatccacagcactttttgaggttcaacttctcagtcncctatgctcttataacattctagatgtcat

SEQ ID NO: 49541 - DNA, 101 bp, rice(Oryza sativa)
  misc_feature (71): n=t or g
ttggccttgtgggataccagcgcgatccttcacccttcgctgccttttgcttaacagacttcgcagtgggngctttgcccagatgaacttgatgccttgag

SEQ ID NO: 49542 - DNA, 101 bp, rice(Oryza sativa)
  misc_feature (71): n=t or g
tcaaagtgtatccatacaaatattggtcgtccatggtgacatgcttggttggagtatttcaaaccgcattngtcggaatcatattaaggagagacaagagt

SEQ ID NO: 49543 - DNA, 101 bp, rice(Oryza sativa)
  misc_feature (71): n=t or c
gtcgtattctctatttcaacgacgtaggtgtattcaatcgagtcgtacgtagctggctagctagtttcaantttcatatccttcgcttctgctgccaatta

SEQ ID NO: 49544 - DNA, 101 bp, rice(Oryza sativa)
  misc_feature (71): n=a or g
atgacaaggagctcgccaccctagctgcctgctttcgtacctggtttttttgaggatgaacagcatcgaangatttttgaggatgaacagcatctcgaaag

SEQ ID NO: 49545 - DNA, 101 bp, rice(Oryza sativa)
  misc_feature (71): n=a or c
ctgaccactgatgttcctgaatttcctgaattgcctgtggttgagacaagggaagaagatggagttattcntgtccagcaattaggccaagatcatcatca

SEQ ID NO: 49546 - DNA, 101 bp, rice(Oryza sativa)
  misc_feature (71): n=t or c
tgtcttctaaattttcgtacgcctcttgaagctgcacctttatctcctcaacggcaacgatgaactcctgnagaggcttcccactccgcttgactaagtgt

SEQ ID NO: 49547 - DNA, 101 bp, rice(Oryza sativa)
  misc_feature (71): n=t or c
gcatacccaaagtgctttcatcaagaagagatgcatacaagataatttcctctatgtgtgcaacatggtcngatccttgcacatgcaacggaaaccatccc

SEQ ID NO: 49548 - DNA, 101 bp, rice(Oryza sativa)
  misc_feature (71): n=a or g
aacgccgatgccacatgactcaagtcctacgatgcgatggcaagctccgtgagctcgagaggtcacttagngcacccgcaatggttatctataggctctct

SEQ ID NO: 49549 - DNA, 101 bp, rice(Oryza sativa)
  misc_feature (71): n=a or g
atccagttcccttcctatgatgctctctttatctaccaaatagctagtgggacgcacgctatggatatcanggacaatccgccgttccccatcattatcag

SEQ ID NO: 49550 - DNA, 101 bp, rice(Oryza sativa)
  misc_feature (71): n=a or g
ataaggctaaatttcaaactgtggaaccttttcctcttggacatctagtaagaaagaagaaatagcatacngataaattgagtactattgtattcttggac

SEQ ID NO: 49551 - DNA, 101 bp, rice(Oryza sativa)
  misc_feature (71): n=a or c
agcagagtaaaaagcataaattgaactccatggcttagtggaaatcgacttcactttaccttaactaattntaccttttttgccaaaaccgaatgaaaaag

SEQ ID NO: 49552 - DNA, 101 bp, rice(Oryza sativa)
  misc_feature (71): n=t or c
tccaaattgcaattattttatgaactcatattttcttgatcatgagcagttcggcaggatgccaatagaanttgctgtgcgatgtggtacattgaaagatg

SEQ ID NO: 49553 - DNA, 101 bp, rice(Oryza sativa)
  misc_feature (71): n=a or c
aaggggggccattgttcttacgattgatcattgatgagtgaaaaattgtatcttaggggctgtttggtttncagggacttattccaagtcgtcacatcgga

SEQ ID NO: 49554 - DNA, 101 bp, rice(Oryza sativa)
  misc_feature (71): n=a or g
agacaactttgtattgagtcatccagcaacggcaattggcgctcaatttggactctggaattcatagatgnattacagcttgtcgaaattaaagggaaaat

SEQ ID NO: 49555 - DNA, 101 bp, rice(Oryza sativa)
  misc_feature (71): n=t or c
attatttctggtctgctgcagtttactttcaagaagcagcaatccttgcaaccattcggtttgaagatcangaactgaagtatctgcaagaatatcatttc

SEQ ID NO: 49556 - DNA, 101 bp, rice(Oryza sativa)
  misc_feature (71): n=t or g
gtcatctttagaatggaaactccacggttttgggaagggcaaccgaggttgctgtagatgaatcaaaagangccgctcacaaaatgttaccgtgcaaagaa

SEQ ID NO: 49557 - DNA, 101 bp, rice(Oryza sativa)
  misc_feature (71): n=a or g
gtgagtcagtgagctcatactcataaggagtgttctcaattataggaaccaccaattcgtcacggtaaccntggcctttaattcctttaatcatttccata

SEQ ID NO: 49558 - DNA, 101 bp, rice(Oryza sativa)
  misc_feature (71): n=a or g
tccctcgttttctgcatacatgttttttaaactagtaaatggtacgcgttttgcaaaaaaagttatatagnaaagttactttaaaaatcatattaatctat

SEQ ID NO: 49559 - DNA, 101 bp, rice(Oryza sativa)
  misc_feature (71): n=a or g
tgcggcagcgctgcggctgcgaaaaatggcagccgaacaggctctttatttttaaataatcattgcattgnaatctatgaaactaaaagataaatgaatca

SEQ ID NO: 49560 - DNA, 101 bp, rice(Oryza sativa)
  misc_feature (71): n=t or g
tgacttttcggttcataataaaccgatttataagtctaagtctatacaaagagtattcagggttggtttgntttatggcttaaataggcattaccaaattt

SEQ ID NO: 49561 - DNA, 101 bp, rice(Oryza sativa)
  misc_feature (71): n=t or c
tagctgctgctgctgcaagcaggaatgtatcctttggagcagcacaatggatctggccggaaccattgagncaaggtggtctgaacattgtcccagtgttc

SEQ ID NO: 49562 - DNA, 101 bp, rice(Oryza sativa)
  misc_feature (71): n=t or c
aacctgaaggtaaaaaacacattcagctcagctgttgtaaattcaacaggtcacgctgtagtgttgtgcgngataactcaatgctaaaaaaggagacgtgg

SEQ ID NO: 49563 - DNA, 101 bp, rice(Oryza sativa)
  misc_feature (71): n=t or c
tggaggttggtgatgacgtcgttcgctgacatcacgtcgtacatggcggcgttgatggcttcctgaagctngatgcacttcagccgggtcacatgccgcct

SEQ ID NO: 49564 - DNA, 101 bp, rice(Oryza sativa)
  misc_feature (71): n=t or c
ttttggagggctttttataatgtcaggctcttttgtgggagtctaccaatcatgaagcctttgtagtcganatttgggcaagtaaacaaccatatccaaat

SEQ ID NO: 49565 - DNA, 101 bp, rice(Oryza sativa)
  misc_feature (71): n=t or c
agggggagatggaagatgagagagattgggaaaggataagaagcggaggaaacaatggacgggggacttantaggatgtgtttagttcgcgaaaagaaaat

SEQ ID NO: 49566 - DNA, 101 bp, rice(Oryza sativa)
  misc_feature (71): n=t or c
ctcactcctttgctgctgttgcatttgaggggagagaggagagtgctaggatgcctaagggcaattaagtnatttggctgcgccgttacccaccgttacaa

SEQ ID NO: 49567 - DNA, 101 bp, rice(Oryza sativa)
  misc_feature (71): n=t or c
ttctctggcagctatgtgtgtgttaagtttgagattaggattagagagtccagaggtaatcttttgagttngtcatccagtcggagacttcaagggcccaa

SEQ ID NO: 49568 - DNA, 101 bp, rice(Oryza sativa)
  misc_feature (71): n=t or c
cgttgccgtcattaggagtgatttttttcttctaggagagcttctttgatgagactgatcgattgaactgntgctgcatggtttgtttccgtttctttttc

SEQ ID NO: 49569 - DNA, 101 bp, rice(Oryza sativa)
  misc_feature (71): n=a or c
acatatcctattaccatgaatctggatagctaagaatctatccatatttattatattagtcacgtctaatnataagtttgtttatttggatggagggagta

SEQ ID NO: 49570 - DNA, 101 bp, rice(Oryza sativa)
  misc_feature (71): n=t or c
atacctgtttttttcaacgattcagcccagctagttggccggccgacttaattacgtaattcatgaccccnggcccgggccacaataatgatgcaagacaa

SEQ ID NO: 49571 - DNA, 101 bp, rice(Oryza sativa)
  misc_feature (71): n=t or c
gagagggggcggaggcaggtggcccttcgccggactggatctctagcaacagggctagcattgtcagtganctccatgttgtgggagccgaagtacaccac

SEQ ID NO: 49572 - DNA, 101 bp, rice(Oryza sativa)
  misc_feature (71): n=a or g
attaaatgaatgtcaagtcacacgcatgttgaggttggcacgtgagacaccagaagaaagggagaatagtnttttagaggtgaattttgcctatctttcac

SEQ ID NO: 49573 - DNA, 101 bp, rice(Oryza sativa)
  misc_feature (71): n=t or g
gcatgtgcaggttaggaaggggtacaagcactttgtgatggagttcgatcgcctgcaacccgacgatgtcntctgggagccgtacagtgcgcgggccatta

SEQ ID NO: 49574 - DNA, 101 bp, rice(Oryza sativa)
  misc_feature (71): n=t or c
ctgcctagcttgatttttgtttaaccgctctagcagggcaggcacagatgattattaatgatcctatatgngaatattaggaaatgatctaatattaaata

SEQ ID NO: 49575 - DNA, 101 bp, rice(Oryza sativa)
  misc_feature (71): n=a or g
ttaaggctgaagaagattctcttgctggtggaggtaattaactaatatctgtttgctgcatttcccttacnattccatcttacagttttcagcatactgtg

SEQ ID NO: 49576 - DNA, 101 bp, rice(Oryza sativa)
  misc_feature (71): n=t or c
acatgcctaatgggaatttgaatatgtggttgcataaacaatttgcaagtgttgcttcaaaatgtttgagnttagctcaaagagtgaatatagctgtggac

SEQ ID NO: 49577 - DNA, 101 bp, rice(Oryza sativa)
  misc_feature (71): n=a or g
aagtcttacctgctactagactcctagaggactgtaagaatatggtcgatccatcacccccatattttctnaactttatagtactagttcagatcttcagc

SEQ ID NO: 49578 - DNA, 101 bp, rice(Oryza sativa)
  misc_feature (71): n=t or c
tcactgacttgaacatagagcaaagtagagtaaaaaaatgagagtttttattatgaggtgccaggtaccangaggtaccactcacatccatccatttgcaa

SEQ ID NO: 49579 - DNA, 101 bp, rice(Oryza sativa)
  misc_feature (71): n=t or g
atttttttttcaaacacaaaaagtagtaaaatccacaatagatttttgttttgcataaaaacttgtaatgnaaaaaaatgtcccctttaaactaggtgttt

SEQ ID NO: 49580 - DNA, 101 bp, rice(Oryza sativa)
  misc_feature (71): n=a or c
accattgcaaaagcgcagactcttttactactcccagagtttttgaggtttgaaacacggaacataaaaanaaaaaggttgaagagaaatttgattaatta

SEQ ID NO: 49581 - DNA, 101 bp, rice(Oryza sativa)
  misc_feature (71): n=t or c
atatactactacttgaagaactgaaagtaccttaatttttacctgtcagctatgtacttgaggagctgatngctaacaaacttcctccccatgaacgcctc

SEQ ID NO: 49582 - DNA, 101 bp, rice(Oryza sativa)
  misc_feature (71): n=a or g
taagcaataatgggcttctttagaccattttcaggtacgtctattttttaatttatgtgatgattggaatnctacgtggacgccacgacagcgaaaaccac

SEQ ID NO: 49583 - DNA, 101 bp, rice(Oryza sativa)
  misc_feature (71): n=a or g
tatcaagaaagttaacaagacagtaatgaagtacctctggcgatgatatgccagcaaaacttagtgcatcngcttccttctggctgaggttgttagtgtaa

SEQ ID NO: 49584 - DNA, 101 bp, rice(Oryza sativa)
  misc_feature (71): n=a or g
aagaggcaaaccggaatagcctccgattcctccgaagtggaacaatcttggtcagctcatctctactattntaaaaattgaagatgtttttgtcggtattt

SEQ ID NO: 49585 - DNA, 101 bp, rice(Oryza sativa)
  misc_feature (71): n=a or c
agactacaatggacaaggtgtgtgcaactatgagctgggataatggagatgctttcatggatatgttggtnagtactactttgtcagctcaattaatgtgt

SEQ ID NO: 49586 - DNA, 101 bp, rice(Oryza sativa)
  misc_feature (71): n=a or g
tgatagcagctatgattctgatttgtccgaatcttccgactctgattgttctgaccctaagtttgatcctnatcaagaaattattgatgagggtgatgatg

SEQ ID NO: 49587 - DNA, 101 bp, rice(Oryza sativa)
  misc_feature (71): n=a or g
gtcgtaaacgcacgctttcgtcaccaagctgatcaaaatgcagggttgccgcgaacgtagtgttcctgatnagttgtaccaaatcggtacgttgaggctac

SEQ ID NO: 49588 - DNA, 101 bp, rice(Oryza sativa)
  misc_feature (71): n=t or c
gttttcctactaccgattagatcgagccggcaatcctcttaaaaaaaatactcccattcgttcctaaatanttgacaccattgacttatttaaacatgttt

SEQ ID NO: 49589 - DNA, 101 bp, rice(Oryza sativa)
  misc_feature (71): n=t or c
ttaataattctactaatcaacatgcatttgtaatctagttaaacatgatacacacgcgcgcgtaccttgtngatcttgccatattcgatgatggcaccatc

SEQ ID NO: 49590 - DNA, 101 bp, rice(Oryza sativa)
  misc_feature (71): n=t or c
gtcaggttgtgatacatgtgcccagaaacaattgttttgtataattaggaagaaagtccgcatagatgcgngggtaatttatttattgtttataaaaaaac

SEQ ID NO: 49591 - DNA, 101 bp, rice(Oryza sativa)
  misc_feature (71): n=a or g
gcatataaaataaacctgtatccttatttgcttctattgctcttgtttctatttctatggttgctcgatcncaggggatgtcctggtggtgagcgatggcc

SEQ ID NO: 49592 - DNA, 101 bp, rice(Oryza sativa)
  misc_feature (71): n=a or g
cattgaactagagtaaactcaggggtatagaatggattttctcttacattatattattcgtaagtaaactncgacacgaatttatcaagcctaattaatcc

SEQ ID NO: 49593 - DNA, 101 bp, rice(Oryza sativa)
  misc_feature (71): n=t or c
gaggtgggccgttggaatggtcgacatgtttatgctatgcttgccaaagtcgtgtatcggtttcatgtttnagtatgagctttagttagaagtgggtggaa

SEQ ID NO: 49594 - DNA, 101 bp, rice(Oryza sativa)
  misc_feature (71): n=a or g
tcacactcacacgagactctgactaatttgtatgagattctaatggaggacgggacgccgacaaatgattntggtgaaggtgcatctgcacaagataatag

SEQ ID NO: 49595 - DNA, 101 bp, rice(Oryza sativa)
  misc_feature (71): n=t or c
gcatacataacgatcagcaatagtttcccacgccattcaacaatgtggaactcattcactgcacaaccctngactgggggaagcgtctgtgtaacacaccg

SEQ ID NO: 49596 - DNA, 101 bp, rice(Oryza sativa)
  misc_feature (71): n=t or g
ctacttgttctacctagtgagtataactctgttccactggtgcagacttctacaccaccatatgtctatanatgctgacttggtttttgctcccaagtgtt

SEQ ID NO: 49597 - DNA, 101 bp, rice(Oryza sativa)
  misc_feature (71): n=a or g
attttgggacgacgtaagtatttaacaagcctctgaccttctgaaagggcctgcggtctacgtggtgaagngtcggggtggacgtgggggcagcagtaggc

SEQ ID NO: 49598 - DNA, 101 bp, rice(Oryza sativa)
  misc_feature (71): n=a or g
tgggacacaattatttctttcagccagaatatttccgtaggtgaggcttgttcttgattgtgagtctgatnaatatgcttgcaaaggagaccaactctcca

SEQ ID NO: 49599 - DNA, 101 bp, rice(Oryza sativa)
  misc_feature (71): n=t or g
agttaaaaaactaaacatgtagtcaagaactaaaaatgatttcataaccaagcatcatatggcaaaaacanatgcggcgtccaataagacattctgccgac

SEQ ID NO: 49600 - DNA, 101 bp, rice(Oryza sativa)
  misc_feature (71): n=t or c
agtatgaaactaagatgaaaagagcagaaattatggggcattaccttctctagaggatacgctgttttacngcaagtggcacacttctcctgtgtccctga

SEQ ID NO: 49601 - DNA, 101 bp, rice(Oryza sativa)
  misc_feature (71): n=t or c
acgaatacggcgatggaggccgaatagcagatcgatctgatggatggccatggacccaacaatgaagtganaatagatcgaatccaatgctctgataccac

SEQ ID NO: 49602 - DNA, 101 bp, rice(Oryza sativa)
  misc_feature (71): n=t or c
cttcatttgggtttggacccattttgttttagatccgaacggatggagtgggcaagtaggcgatgctttcnggatccgtttttcacatcgtccattcctag

SEQ ID NO: 49603 - DNA, 101 bp, rice(Oryza sativa)
  misc_feature (71): n=t or c
tcgttcaggcagcgacgaggtgaagaggaggagtgaggagaagtggtggaggcggctagtagggttttgcngcccgagctatccctcctggagtgatgcaa

SEQ ID NO: 49604 - DNA, 101 bp, rice(Oryza sativa)
  misc_feature (71): n=a or g
ttgtttgtgccactgaagattaatggttcttgctgagggtgttcttggtttgtagtagttcttaccctccngcttcgtggccgaagatccgagggaacacc

SEQ ID NO: 49605 - DNA, 101 bp, rice(Oryza sativa)
  misc_feature (71): n=a or g
tgaccccacgttgctgaccgttgcttcgcgccaagttcccttgaaccatagggattttgaaaaaaaacatnctacttcctccgtcctaaaatgaagccatt

SEQ ID NO: 49606 - DNA, 101 bp, rice(Oryza sativa)
  misc_feature (71): n=t or c
cctgacacgccgtgcagggtgcatgcgcgtgtgtgacagctagtaggctactactacctatgtcccattanaagtgcagccattagtttccgtgcccgacc

SEQ ID NO: 49607 - DNA, 101 bp, rice(Oryza sativa)
  misc_feature (71): n=a or g
aataagaatgacatagtttcgcccatccacacgatcgatttgtcaaacctagccgtatattgctccaattnattgaacttctacaggcctttcggtgtact

SEQ ID NO: 49608 - DNA, 101 bp, rice(Oryza sativa)
  misc_feature (71): n=t or c
ctcttgcgatgcgtggtgagtggtgactgtaatgtaatggaaggttcaggtctaacgctactggcattgcnattcagcaggagcaggcaagatccctgacc

SEQ ID NO: 49609 - DNA, 101 bp, rice(Oryza sativa)
  misc_feature (71): n=a or g
gtcgcagtaatttgctcattgcatatttgcacttgatttgctgcttgcaggtatatggccaaaatggttantcagtgtatctctccgcggcagtcctttcg

SEQ ID NO: 49610 - DNA, 101 bp, rice(Oryza sativa)
  misc_feature (71): n=a or c
agatcttcatcttcttattattaccataaactcgtcgagctccgggtctgacgactgcccttgaaggtacntgtcttctgcacgcgagtcgagctcgccgg

SEQ ID NO: 49611 - DNA, 101 bp, rice(Oryza sativa)
  misc_feature (71): n=t or c
gcccttgggcaccatcatcattaactgatcgggagcgaggagaaaatttgggaactgacatctacatctanagggaagtaagtgtaggcaaaactttagag

SEQ ID NO: 49612 - DNA, 101 bp, rice(Oryza sativa)
  misc_feature (71): n=t or c
aacgttccaaattgatgaagcaattaaaattggcttagcagcttggaagtgggtgacttacacccataganaagattgaccatcggcacccttcctcaacc

SEQ ID NO: 49613 - DNA, 101 bp, rice(Oryza sativa)
  misc_feature (71): n=t or c
atacctataaatatcagatccaatacgtgagtatcacgtatcagacccgatatctaaatattagatccganacatataaatattaggcctggtacctatat

SEQ ID NO: 49614 - DNA, 101 bp, rice(Oryza sativa)
  misc_feature (71): n=t or c
tttctagaaaacttttagaaatctacacctaaaaaacgacgtctaggagagagttttattttttttatgangtggcacacgggtgttggcataccgcgtaa

SEQ ID NO: 49615 - DNA, 101 bp, rice(Oryza sativa)
  misc_feature (71): n=a or g
cctgtaatgattaacttctccacacgcgcaactatatgcttcccgaaagtgtagttcttcagttcgttcanatgcatcttgatgcttgagaggatcacaac

SEQ ID NO: 49616 - DNA, 101 bp, rice(Oryza sativa)
  misc_feature (71): n=a or g
cagtcagctggtgaggtgatagtctggtggttgaaacataatttaagtacaatctggaggtaagcgtctgngggaatactagccttgatctctttggccca

SEQ ID NO: 49617 - DNA, 101 bp, rice(Oryza sativa)
  misc_feature (71): n=a or g
gggccgggccaaacagtagagggccaaaataaagaaaacagaccagcccaccaagcctattactgttcacnagaatcccaatacactcaacagtttcgcca
